United States Patent 11,078,247 (RNA ENCODING A THERAPEUTIC PROTEIN) - sequence listing, part 33

SEQ ID NO: 56216 - RNA, 2469 nt, Artificial Sequence
  derived and/or modified sequence opt3 from FER__Homo_sapiens__NP_005237
augggcuucgggagcgaccugaagaacucccacgaggccgugcucaaacuucaggauugggaacugagauuguuagagaccgucaagaaauuuauggcucugaggaucaagucugacaaagaauacgcaucaacacuacaaaaucucugcaaccagguugauaaggagaguacugugcagaugaauuauguaagcaacguguccaagucuuggcugcuuaugauucagcaaacggaacagcugucgcggauaaugaaaacccaugccgaggaccuaaauucaggaccccuccaccgccugacaaugaugaucaaggauaaacagcaggucaagaaaagcuacauuggugugcaucaacagaucgaggcggaaaugauuaagguuacuaagaccgagcuggaaaaacucaaguguaguuaucgacaguuaaucaaagagaugaacuccgcuaaggagaaauacaaggaagcccuggcaaaaggcaaggagacagaaaaggccaaagagcguuaugacaaggcuaccaugaaacuucacauguugcauaaucaguacgugcuggcacuaaagggggcccaacuccaccagaaccaguauuacgauauaacucugccucuucuguuggacucucuccaaaagaugcaggaagagaugaucaaggcucugaagggaauuuucgaugaguacagccagaucacauccuuagucaccgaagagauugugaauguacacaaagaaauccagaugucaguugagcaaauagacccaaguacggaauauaacaauuuuauugaugugcauagaacuaccgccgcgaaggagcaggagaucgaauuugacacaagccugcucgaggaaaacgagaaucuucaggcaaacgaaauuauguggaauaaccugacugccgagucuuugcaggucaugcuaaaaacccuggcugaggaacucaugcaaacacagcagaugcugcuuaacaaggaggaagccgugcuggaguuggagaaaaggaucgaagaguccucagaaaccugcgagaaaaagagcgauaucgugcuccuguuaagucagaaacaagcacuggaagaguugaagcagucuguccagcagcuccgguguacggaggcuaaauuuuccgcccaaaaggaacugcuugagcagaaaguucaggaaaaugacggcaaggagccgcccccugugguaaacuacgaagaggacgcgcgcagcgugacuucgauggagagaaaggaaagguugucuaaauucgaguccauucggcacucaauagccgguaucauucgcaguccaaagagcgcacugggguccucugcucucagcgauaugaucucaauaagugaaaaaccccuggccgagcaagacugguaucauggagcuauuccucgaaucgaagcccaggagcuucugaagaaacagggcgauuucuuggucagagagucccacggcaagccaggggaauacgugcucagcguuuauucugacggacagaggcggcacuucaucauucaauacguggauaauauguaucguuuugaggguacaggcuucucaaacaucccccagcugauugaccaucacuacaccacuaaacaggucauaacaaagaagaguggggugguauuacugaauccuaucccaaaagauaagaaauggauucuaagccaugaagacguuauccucggagagcugcuuggcaaggguaacuuuggggagguguacaaaggaaccuugaaggauaagacguccgucgcagugaaaaccugcaaggaagaccugccgcaggagcucaaaaucaaguuccugcaagaagccaaaauuuuaaagcaguaugaucaccccaauauagucaagcugaucggcguguguacacagcgccagccuguuuacauuaucauggagcuugugucuggcggggacuuuuugacuuuccucagaaggaaaaaggacgaacugaaacuaaagcaacugguaaaauucucgcucgaugcugcggcaggaaugcuguaucuugagagcaagaacugcauucaucgggacuuggccgcucgaaauugucuggucggugagaacaauguguuaaagaucuccgauuuuggcaugucacgccaggaagacgggggaguuuacaguucuagcggccucaaacagauaccaaucaaguggaccgcccccgaggcacugaacuaugguagauacuccucagaaagcgauguguggucuuucgggauucuucugugggagacauuuuccuugggcgucugcccuuauccaggaaugacuaaucaacaggccagggaacagguggagcggggcuaccgcaugagugcuccccagcacuguccggaggacaucagcaaaauuaugaugaagugcugggauuacaaaccugaaaacagacccaaguucucugagcuccaaaaagaacugaccaucauaaagaggaagcuaacauga

SEQ ID NO: 56217 - RNA, 2034 nt, Artificial Sequence
  derived and/or modified sequence opt3 from FERMT1__Homo_sapiens__NP_060141
augcugagcuccaccgacuucacauuugccucuugggagcucguggucagaguugaucaccccaacgaagaacagcaaaaggacgugacucuuaggguaucaggcgaucugcaugucgggggagugauguugaaauuaguggaacagaucaauauuagucaggacuggagcgauuucgcucuguggugggagcagaagcacugcuggcuacucaaaacgcauuggacccuggacaaguacgguguucaagcagaugccaaacuucuguuuacaccucagcacaagauguugcggcuccgccugccaaaccugaagauggugcgacuccgugucuccuucucugcggugguauuuaaagcuguuucggacauauguaagaucuuaaauauuagaaggucagaggagcugagccuuuugaaaccgaguggcgauuauuucaagaaaaagaagaaaaaggacaaaaacaauaaggagcccaucauugaagauauccugaaccuagaguccucuccuacugccagcggguccucagugaguccaggacucuacagcaaaaccaugacacccauauaugacccuaucaauggcaccccagcaucuuccacuaugacaugguuuucagauagcccccugaccgaacagaacugcaguauucuugccuucucucagccuccacaauccccggaggcucuggcagacauguaccagccccggagcuuggucgacaaggccaaacucaaugcugguuggcuggauucgucucgcuccuuaauggagcaggggauccaggaagacgagcaacugcuccuuagauuuaaguauuacucauucuuugaucugaacccuaaguaugacgccgugaggauuaaucaguuguacgaacaggcgcggugggcaauccuacuggaggaaauagauuguacggaggaggaaaugcucauuuucgccgcucugcaauaccauaucaguaaacuuagccuguccgccgagacucaggacuuugcaggagaaucugagguggaugaaauugaggcugccuugagcaaccucgaggucacccuggaaggcggcaaggcggacucauuacuggaggauaucacagacaucccaaaacuagccgauaaucucaagcuguuccgccccaaaaaguugcuuccuaaggcauucaaacaguauugguuuauuuucaaggacaccaguauagcuuacuuuaaaaacaaggaacuggagcagggggaaccacucgagaaacugaaucuucgaggaugcgagguugugcccgacguaaacguggccgguagaaaguucggcaucaagcuguugauuccggucgcugaugggaugaacgaaauguaucucaggugugaccacgagaaucaauacgcccaguggauggcagccugcaugcuggcuuccaaaggaaagacuauggcggauagcucuuaucagccugaaguguuaaacauccugucauuucuacggaugaaaaaucguaacagugcaagccagguugccuccucucucgagaauauggacaugaaccccgaguguuucgugucgccacgcugcgcuaagagacacaaaagcaagcaacuggccgcaaggauacuugaagcccaucagaaugucgcucagaugccuuugguggaggccaagcugcgguuuauucaggcauggcaaucccuccccgaguucggccugacauacuauuuaguacgauuuaaagguucaaagaaagaugacauccuggggguuaguuacaaccgccuuaucaagauugaugcggcuaccggaaucccagugacgacuuggagauucacaaauauuaaacaguggaacgucaauugggaaaccaggcaaguggucauagaauuugaccagaacguguucacugccuuuacauguuugucugcagauugcaagaucguucacgaguacauuggcggcuauaucuuccucagcacccgguccaaagaccagaaugagacgcuggaugaagaccuauuccauaagcugaccgggggacaggauuga

SEQ ID NO: 56218 - RNA, 2064 nt, Artificial Sequence
  derived and/or modified sequence opt3 from FERMT2__Homo_sapiens__NP_001128471
auggcccuggacggcaucagaaugcccgaugggugcuacgcugacggaaccugggagcucagcgugcacgucacagaucuuaacagggacguuacucugcgggugacgggugaaguacauauuggcggggugauguugaaguuagucgagaaacuggaugugaagaaagacugguccgaucacgcacuauggugggaaaagaaacgcaccuggcuccugaagacacauuggacucuugacaaguauggaauacaggccgaugcgaaacugcaauucaccccucagcacaaguugcuccgacugcagcugccaaauaugaaauacguuaaggugaaagucaacuuuucugaccguguguucaaggcuguaucagauaucuguaagacauuuaauauuagacauccggaggaacucaguuuacugaaaaagcccagggacccuaccaaaaagaaaaagaaaaaguuggaugaccagagcgaggacgaggcccuugaacuggagggcccacuaaucacucccgguuccgggucuauuuauucgucaccuggacucuacagcaagacaaugaccccaacguaugaugcacacgacggcaguccccuguccccuacuucugccugguucggcgauagcgcucuuuccgaagggaacccaggaauccuggcaguuucacaaccgauaaccagucccgagaucuuggccaaaauguuuaagccucaggcucuccuggacaaagccaagauuaaucaggguugguuagauagcucucggucccugauggagcaggacgugaaagaaaacgaggcgcuccuucugcgcuucaaguacuauucauuuuucgauuugaauccaaaguacgacgcaaucagaauuaaccaacuauacgaacaggccaaaugggcuauccugcucgaggaaauagagugcacagaggaagagaugaugauguuugccgcacugcaguaucacauuaauaaacuuagcaucaugacuuccgaaaaccaucugaauaacucugauaaggaggucgacgaaguggaugcugccuuguccgaccucgagauuacccuggagggcgggaagacaagcaccaucuuaggagacaucacgucgauucccgaacuggcggauuacauaaaaguguucaagccuaagaaacuaacucucaagggcuauaaacaguacugguguacauuuaaggacaccucuaucuccugcuauaaaucaaaggaggaaaguagcgguacuccagcccaccaaaugaaucugagggggugugaggucacacccgauguuaacauuuccggacagaaguucaauaucaaacuuuugauaccgguggcagaaggcaugaacgagauuuggcugcggugcgacaacgagaagcaguacgcucauuggauggccgcuugucgccucgccucuaaaggcaagaccauggcagauagcucauauaaucuggaaguacaaaacauccuuaguuuucugaaaaugcagcacuugaauccugacccccagcucaucccagagcagauuacgaccgauaucacaccugaaugccuggugaguccccgauacuuaaagaaauacaagaacaagcaaccaggguauauuagagaccugauaacugccaggauccuagaggcucaccagaaugucgcgcagaugagccucauugaggcaaaaaugcgguucauccaggccuggcaaucucugcccgaguucggaaucacccauuuuauugcucguuuccaggguggcaagaaagaagaacuuauagggaucgccuacaaccgcuugauuagaauggaugcaucaacaggagacgccaucaagacuuggagguuuaguaauaugaaacaguggaacgugaauugggagauuaagaugguuaccguggaguucgcugaugaaguccggcugagcuuuaucuguacagagguggacugcaagguaguucacgaguucauaggcgguuauaucuuucucuccacccgagccaaagaucagaacgaaucucuggacgaagagauguucuacaaguuaacuucgggguggguguga

SEQ ID NO: 56219 - RNA, 1992 nt, Artificial Sequence
  derived and/or modified sequence opt3 from FERMT3__Homo_sapiens__NP_113659
auggccggcaugaagaccgcuagcggggacuacaucgauuccucuugggagcugagaguguucgucggagaagaggaccccgaagcagagucaguuacacucagggugacuggugaaagucacauuggcgggguacuucugaaaauaguggagcagaucaaccggaagcaagauuggagcgaccaugccauuuggugggagcagaaacgccagugguuguuacagacgcacuggacccuggauaaguauggaauccuagcggacgcucgacucuuuuucggcccucaacaucguccagucauucugagacuuccgaauaggcgggcccugcgcuugagagcauccuuuucucagccccucuuccaggccguggcugcaaucugcaggcugcugucgauacggcacccugaagaacucucauuacugcgcgccccagagaaaaaggagaagaaaaagaaagagaaggaacccgaggaagaacuuuacgauuugagcaaaguugugcuggcugguggggucgccccugcgcuauuucgaggaaugccagcacauuucagugacuccgcccagacagaggcuuguuaucacaugcucucuagaccccaaccuccaccggauccccugcuucugcagagguugccucggccaagcucccucucagacaagacucagcugcacagucguugguuagauagcucucgcugccugaugcagcaaggcaucaaggccggcgacgcacucuggcuuagauuuaaauacuauuccuucuuugaucuggaccccaagaccgacccugugagguugacacagcuauacgagcaggcucggugggaucugcuccuggaggaaauugacuguaccgaggaagagaugaugguauucgccgcgcuucaauaucauaucaacaaacugucacagagcggggaaguuggagagccagccgguacugaucccggcuuggacgaucucgacguggcacugaguaauuuagaggucaagcuggaagggucugcuccgacagaugugcuagacucccucaccacgauuccugagcugaaagaucaccuucgaaucuuucgccccagaaaguugacucugaaaggauacaggcagcauuggguggucuucaaggaaaccacacucagcuacuauaagucgcaggacgaggccccaggcgauccuauacaacagcugaaccuuaaagguugcgaaguugugcccgacguaaaugugucugggcagaaguuuuguauuaaacuguuggucccaucccccgagggaaugucagagaucuaccuccggugccaggacgaacaacaguaugcucgcuggauggccggcuguagacuggcaaguaagggcaggacuauggccgauagcuccuacaccucugaggugcaggcuauuuuagcguuccugagccuacagcguacagggucaggagguccuggcaaccacccacacgggccggacgcaagugccgaaggacucaaucccuauggccugguugcuccucgguuccaacgaaaauuuaaggccaagcagcuuaccccaagaaucuuggaggcacaucagaacguggcccagcugucccucgcugaggcccaacugagguucauccaggcauggcagagcuuacccgauuuugguauuucuuacgucauggugcgcuucaaagggucacggaaggacgaaauacugggcaucgcgaauaacagacuuauuaggaucgauuuggcuguaggagacguugugaaaacguggcgcuuuaguaauaugcgacaauggaacgucaauugggauauacgucagguggccauugaguucgacgaacacaucaacgucgcauuuagcugcguguccgccucuugucggaucguucaugaguauauuggcggguacaucuuccucucgacuagagaaagggcucgcggagaggagcuggaugaagaccuauuucugcagcucacagguggccacgaggccuucuga

SEQ ID NO: 56220 - RNA, 2085 nt, Artificial Sequence
  derived and/or modified sequence opt3 from FES__Homo_sapiens__NP_001137257
augggcuucagcuccgagcugugcucuccccaggggcacggagugcuccaacagaugcaggaagccgagcuuagacuguuggaagguaugaggaaguggauggcucagcgggucaaaucagaccgcgaguacgcaggcuuacugcaucacaugagucuacaagauagcgggggacagucccgagccaucucuccugacucgccaauuucacagacccauagccaggauauagaaaagcucaaaagucaauaucgugcgcuggcuagagacuccgcccaggcaaagaggaaauaccaggaggccucuaaggauaaggaccgggauaaagcuaaggacaaauauguucgcagccuuuggaagcuguuugcacaccauaacagauacguguugggcguaagggccgcucagcuccaccaccaacaucaccaucagcugcugcucccggguuuacugcggucccuucaggauuugcacgaggaaauggccuguauccugaaagagauucuacaagaauaucucgagaucucaagucuggugcaggacgaggucguggcgauucaccgcgaaauggcagccgcugccgcacgaauccagcccgaggcugaauaccagggguuccuuagacaauauggaagcgccccugauguuccacccugcgugacauuugacgagucucuguuggaagagggcgagccucucgaaccaggcgagcugcaguuaaaugaacugacugucgaguccgugcagcauacgcucaccucaguaacagaugaacuugcgguugccacugagaugguguucaggcggcaggagauggucacccaacugcagcaggaauugcguaacgaggaagagaauacacacccccgcgaaagagugcagcuacuggggaagaggcaagugcuccaggaggcacugcagggacuucaggucgcucuguguagccaagccaaguugcaggcucagcaagagcuccugcagaccaaauuagaacaucuggguccuggcgagccaccgcccguucuacuccugcaggacgaccggcacaguacuucuuccagcgaacaggagcgagaagggggacgcacaccuacccuugagauauugaagucgcauaucucuggcauuuuuagaccaaaauucuccaaccuguacaggcucgagggugaaggguuucccucaaucccucugcuuauugaucaccuguugaguacgcaacagccacucacuaagaaaagcggagugguacugcaccgggccgugcccaaggacaaaugggucuuaaaucaugaggaucuggugcuaggcgaacagaucggccgcgggaacuucggagagguguuuuccgguagacucagggcagacaauacccugguugccgucaagucuugccgugagacacuuccgccugauuugaaggcuaaauuccugcaggaagcgcggauacucaagcaauacagccaccccaacauugugcgacugaucggcguauguacucagaaacagccaauuuauaucguuauggaguuagugcaagggggagacuuucugaccuuccuuagaacagaaggcgcaagguugcgcgucaagacccuccugcagauggugggugaugccgcugccgggauggaguaccuagaaucaaaaugcuguauccaucgggaccuggcagccagaaauugccucgucacggagaagaacgugcugaagauuagugauuuuggcauguccagggaggaagcugacggaguuuaugccgcaagcggcgggcuucgccaggugccuguaaaauggacugcgcccgaggcuuugaauuacggacgauauucuucagaaagugaugucuggagcuucgguauacuguuaugggagacauucucccucggcgccucuccauaccccaaccugucgaaucagcaaacccgggaauuuguggagaaagggggacgucuuccuuguccagagcugugcccggacgcaguuuucagauugauggaacaguguugggccuaugagcccggccagaggccuagcuuuuccacuaucuaccaggaacuccaaucaauucgcaagcggcacagauga

SEQ ID NO: 56221 - RNA, 717 nt, Artificial Sequence
  derived and/or modified sequence opt3 from FEV__Homo_sapiens__NP_059991
augagacagagcggcgccucccaaccccugcucaucaacauguaccuuccugacccagugggggauggacuguucaaggacgguaagaauccgucuuggggccccuugaguccugcuguccagaaggggucaggacagauucaguuauggcaauuucugcuagagcuccuggcagauagggccaacgcgggcugcauagcuugggaaggugggcacggagaguucaaacuuaccgacccagaugaaguugcccggcgcuggggcgagcgaaagagcaaacccaauaugaacuaugacaagcugucccgugcauugagauacuauuacgauaagaauaucaugucuaaagugcauggcaagagguaugccuaccgguuugacuuccaggggcucgcucaggcaugucagccuccacccgcccacgcucaugccgcggcagccgcugccgcagcugccgcggccgcacaagauggagcucuguauaaacugccugccggucucgcuccauuaccguuucccggccugucgaaacuuaacuugauggccgcaucagccgggguagcuccugcgggauucagcuacuggccaggccccgguccugcagccacagcugccgcagccacugcugcccuguacccaagucccucccuacagccgccucccgggccauuuggagcaguggcggcugccucucaccucggcggccauuaucacuga

SEQ ID NO: 56222 - RNA, 1179 nt, Artificial Sequence
  derived and/or modified sequence opt3 from FEZ1__Homo_sapiens__NP_005094
auggaggcuccccuggugagccucgacgaagaguucgaagaucuuagaccuuccugcucugaggacccagaagagaagccgcaguguuuuuacggcucaaguccccaccaucuggaggauccuagcuuguccgaauuagagaacuucucuucggaaaucauuucauuuaaaagcauggaggaccuggucaaugaguucgaugaaaagcuaaacguuugcuuuaggaauuauaacgccaaaaccgagaaucucgcaccagugaagaaccaacugcagauacaggaagaggaagagacacuucaggacgaggaaguaugggaugcccugacugacaauuacauccccaguuuguccgaggauuggcgggacccuaacauugaagcgcucaaugggaacuguucugauacggagauccacgaaaaagaggaggaagaguucaaugaaaagagcgagaacgacuccggaauuaaugaggaaccacugcugaccgcugaucaagugaucgaggaaauagaggaaaugaugcagaacucacccgacccugaggaggaagaggaaguccucgaggaagaggacgguggcgagacaaguagccaggccgauucuguguuacugcaggaaaugcaagcacuuacucagaccuuuaauaacaacugguccuaugagggguugcgccauaugucaggaagcgaacugacagagcuacucgaccagguugaaggcgccauccgagauuucagugaggagcuggugcagcaacuugcucguagagacgaacuggaguuugaaaaggaggucaaaaauucuuucauuaccguguugaucgaaguacagaacaagcagaaagagcaaagggagcucaugaagaaacggcgcaaggaaaagggucuguccuuacagagcucgagaauugagaaagggaaucagaugccacugaagagguuuucuauggaaggaaucuccaacauacuccagucaggcauucggcaaacuuucggcaguagcgggacagauaaacaguaccuuaauaccguuaucccguaugagaagaaagcaucucccccuuccguggaggaccugcagauguugacgaacauucuauuugccaugaaggaagauaaugagaaagucccaacucugcucaccgacuacauccugaaggugcuuugccccacauga

SEQ ID NO: 56223 - RNA, 1143 nt, Artificial Sequence
  derived and/or modified sequence opt3 from FEZ2__Homo_sapiens__NP_001036013
auggccgcugacggcgauuggcaggacuucuacgaguuucaagaacccgcaagaagccugcucgaucaggagaacugcaaugccuccccugaaccaggggcggaggcuggagccgaagccgguggcggggcagacggauucccggcucccgcauguucucuugaggagaagcugucauugugcuuuaggccuagugauccaggcgccgaacccccucggaccgcugugcgcccaaucacagagcgaaguuuacugcagggugacgaaauuuggaacgcccuaacugauaauuaugggaacgucaugcccguugacuggaaauccucucacacgcguacccuccaucugcuuacacugaauuugucggagaagggagugucagauagccuccuguucgacacuagcgaugacgaggaacugagagagcagcucgauaugcacuccauaaucguaucuugugugaacgacgaaccuuuauuuaccgcggaccaagucauugaggaaaucgaggagaugaugcaggaaagcccagauccggaggacgaugaaacacccacccaguccgacaggcugucaaugcuuagucaggagauucaaacuuugaaacggagcucuacaggcuccuacgaggaacgcgugaagagacugucaguuagcgagcuaaaugaaauccucgaggaaauagagaccgcaaucaaagaauauagugaggagcuggugcagcagcuugcccugagggaugaauuggaguucgaaaaggaggucaagaacucuuuuauuuccgugcucaucgagguacagaauaaacaaaaggaacauaaagagacggcuaagaaaaagaagaaacugaagaacggcagcucgcagaaugggaaaaacgaacggucucacaugccuggaacucgcuucuccauggaggguauuucaaauguuauccagaacggcuuacgacauaccuuugggaauaguggaggcgaaaagcaauaccugacaacugugauaccauaugagaaaaagaacggucccccuagcgucgaggaccuccagauucuuaccaaaauccugagagccaugaaggaagauuccgagaaggugccaucuuugcuaacagacuacauucugaaagugcucugccccaccuga

SEQ ID NO: 56224 - RNA, 1428 nt, Artificial Sequence
  derived and/or modified sequence opt3 from FEZF1__Homo_sapiens__NP_001019784
auggacagcuccugccacaacgccaccacaaagaugcuggcuacugcacccgccagaggcaauaugaugucuacgucaaaaccucucgcguucaguaucgagaggauuauggcucggaccccagaaccgaaggcccuucccgugccucauuuucugcagggggcauugccaaaaggagagcccaagcacagcuuacaucugaacuccucuauaccuuguaugaucccauucguccccguugccuacgauacaucgccuaaagcuggugugacuggcucagaaccacgcaaggcaagccuagaggccccggcugcccccgcggcaguaccuagugccccagcuuuuuccugcucugaccuccugaauugugcccuuagccugaagggggauuuggcacgagacgcucucccccugcaacaguauaaacuggugcguccuagagucgugaaccacuccucauuccaugccaugggagcgcucugcuacuuaaauaggggcgaugguccaugucaccccgccgcagggguuaacauucacccgguggcuaguuauuuucugagcucuccucuucauccccagccaaagaccuacuuggccgaacggaauaaacuggucgugccugcuguagagaaguaucccuccggaguugccuucaaagaccuaucacaggcacaacuccagcacuacaugaaggagagcgcccagcugcuuagugaaaagaucgcuuuuaaaacaucugauuucucccgcggcagcccaaacgcgaagcccaaaguguuuaccugcgaggucuguggcaagguguucaaugcacauuauaaccugacuagacacaugccugugcacacaggggccaggccauuugucugcaaaguuuguggaaaggguuuccggcaggcuucgaccuugugccgccauaaaauuauccacacgcaagaaaagccgcauaaguguaaucagugcggcaaagccuuuaaccgaucuuccacucucaauacccacacaagaauacaugcaggguacaagcccuucgugugcgaguucuguggaaaaggcuuucaccagaaggguaacuacaaaaaucacaagcugacucauucaggggagaagcaguucaaaugcaacaucuguaacaaggccuuucaccaaguauauaauuuaaccuuccauaugcacacacacaacgacaaaaagccuuuuaccugcccaacguguggaaaaggcuucugcaggaauuuugaucugaagaagcaugugcggaaacuccacgacaguagccuuggccuggcucguacucccgccggggaaccuggaacagagccacccccgccuuugccacagcagcccccuaugacccuacccccacugcaaccuccccucccaacuccggguccucugcagcccggccuucaucaggggcaccaguga

SEQ ID NO: 56225 - RNA, 1380 nt, Artificial Sequence
  derived and/or modified sequence opt3 from FEZF2__Homo_sapiens__NP_060478
auggccagcuccgcuucucuggagaccauggugcccccugcaugcccaagagccggcgcgucaccggcuacaaguaagacucucgccuucagcaucgaaaggauuauggcaaaaacguccgagccccgggccccuuuugaaccacgccccggggcucuugaggcagacggaucucaggguaagaaacuguugaacuuauguucgccucugccaugcaugauaccccuacaaccucucggcuacgaagucccaucaaagacccugcuuagcuauagugagcuguggaaauccucuuugcgagccgggggaggcggugggggaggcggcgggggagguggcgggggaggcggugcuccgguuuguggggccagcggacucugcaagacaaauuguggcgugugcuguaaggcggagcugggccuggcacccuccgcccucccugcugggcguguaaucaaaccacaggugauuaaccaggccgucggauuacccgcaucagguagucuguacuauuucaauuaccuugauagcacugcuuauccuccaucugaauugcuguccggccaccuauuucccucagggcuccugaacgcccaggcgccggccgcacuugcugcccauccuaagcuguucuugcucgagaaugcuaaacuggccggauuagcagccgacaaguuuccccacccagcuccuuacccccauaaagaaagacugccagcgccccucgagcaagugcuuaaggagaacagcgcacugaccgccgaaaggggcgguguuaaggggcacaguaaauugccuggcggaucugcugauggcaagccgaaaaauuucacaugcgaggugugugggaaggucuuuaacgcccauuauaaucuaacccggcacaugccagugcacacuggagcacgccccuucguaugcaaaguuugugguaagggcuuuagacaggccuccacacugugcaggcauaaaaucauucacacccaggaaaagccucauaagugcaaccagugugggaaggcuuucaaucggagcucgacgcucaacacucacauccgcauacacgccggauacaaaccauuugugugcgaguucuguggcaaagguuuucaucaaaaggggaauuacaaaaaccacaagcugacccauucuggcgaaaagcaguauaaaugcacaaucuguaauaaggcauuccaccaggucuacaaccuuacuuuccauaugcacacccacaacgacaaaaagcccuuuacaugcgcgaccuguggaaaaggcuucugccgaaauuuugaucugaagaagcaugugagaaaauugcacgacuccguggggccugcugccccaucagcaaaggaucucacgaggacuguccagaguuga

SEQ ID NO: 56226 - RNA, 903 nt, Artificial Sequence
  derived and/or modified sequence opt3 from FFAR1__Homo_sapiens__NP_005294
auggaccugcccccucagcucagcuucggccuuuacguggccgcuuuugcacugggguucccauugaacgucuuagccaucagaggagcgaccgcucacgccaggcugcggcuaacaccgucccucguuuaugcacugaaucuugguugcucugaucuguugcucacugugucacugccccugaaggccguagaggcucucgcaaguggcgccuggccuuuaccagcuagccugugucccguguuugccgucgcgcauuucuuuccucuuuacgcagggggaggcuucuuggccgcucuguccgccggucgcuaucuaggggcagcuuuuccacucggauaccaagccuuccgacgucccugcuauucuuggggcgugugugcggccauuugggcacugguucuuugccaccugggcuugguguuugggcucgaagcuccuggagguuggcuggaccauucgaacacgucauuaggcauaaauaccccagucaacgggagcccggugugucuggaggccugggaucccgcuagugccggaccugcaagauucucccucucucuucuguuguuuuuccuaccacuggccaucacagcuuuuugcuacguaggcugucucagggcgcuggcacggagcggucuuacucaccgcagaaaacugagggccgcuuggguugccgggggagcauugcucacccuguuacugugcgugggccccuauaaugccuccaacgucgcuucauuccuauacccuaaucucggcgggaguuggcggaagcugggacuuauuacaggugccuggagcgugguguugaacccacuggucaccggcuaccucgggcgcggacccggccugaaaacuguuugugcagcgcgaacacagggugggaagucucagaaauga

SEQ ID NO: 56227 - RNA, 993 nt, Artificial Sequence
  derived and/or modified sequence opt3 from FFAR2__Homo_sapiens__NP_005297
augcugcccgacuggaagaguucccucauccuuauggccuacauuauaaucuuccugaccggcuugccugcuaacuuacuggcacuaagagccuuuguggggaggauucggcagccacaaccggcgcccguccacauccuccugcuuucucugacauuggcugaucuccugcugcucuuacugcuuccuuucaaaauuaucgaggccgcaucaaauuuucgcugguauuugccaaagguugugugcgcccugacuagcuucggauuuuacagcuccauauauuguucuacguggcuacucgcugguaucucgauugaacgauaccugggcguagcauuccccgugcaguauaaacuuucacguagaccucuguacggggucaucgccgcuuugguggccuggguuaugagcuuuggacauugcaccauugugaucauaguccaguaucucaacacaacugaacaggugaggaguggcaaugagauuaccuguuacgagaacuucacagacaaucaacuggauguaguuuuaccagugcggcuggaacucugccuuguccuguuuuucauccccauggcggugaccaucuuuuguuacuggcgcuucguguggauuauguugucccagccucuagucggugcacagagaaggcggcgcgccguugggcuggcugugguaacucuccugaacuuucuugugugcuucggaccauauaaugucucucaccuggugggcuaccaucagcgaaagagcccgugguggagauccaucgccguuguguucucaaguuugaacgcaagccucgacccccuguuauuuuauuucucuuccucagucgugaggcgggcuuuuggccgugggcugcaaguacuacgcaaucagggaagcagucuccuggguagaaggggcaaagauacagccgaggggaccaacgaggaccggggaguuggccagggugaagggaugccuucuuccgauuucacgacugaguga

SEQ ID NO: 56228 - RNA, 1041 nt, Artificial Sequence
  derived and/or modified sequence opt3 from FFAR3__Homo_sapiens__NP_005295
auggacaccggccccgaucagagcuacuucuccgggaaccacugguuuguguucucugucuaucugcucacauuucuuguuggacugccuuugaauuuacuggcccuagugguauucguggguaagcuccaaagaaggccagucgcuguggacguucugcuucugaacuugacugcaucagaucuccugcugcucuuauuucugccguuccggaugguggaggccgcgaauggcaugcauuggccccuuccuuuuaucuugugcccacugaguggguucauuuucuucacgaccauauaccuaacagcucucuuucuggccgcagucagcaucgaacgcuuccuuuccguggcccacccccugugguauaaaacucgaccucguuugggacaggcuggccucguaucuguugcauguuggcuguuagccucggcucauugcucaguggucuacgugauugaguuuagcggugacaucagucacucccaggggaccaacggaacauguuaucuggaauuuagaaaggaucagcucgccauucuucugccagugagguuggagauggcggucguucuauucgugguaccccugaucauaaccucuuacugcuauagccggcucguguggauccugggccgcggcgggucccauagaaggcaacggcgcgucgcaggacuucuggccgcuacuuugcucaauuuucugguguguuucgguccuuacaacguuucacacguggucggcuacauuugcggggaaaguccagccuggcgaaucuaugugacauuacugagcacccuaaauucuuguguagacccguuuguuuacuauuucuccucaagcggauuucaggcagauuuccacgagcuccugagaaggcuuugcggcuuguggggucaguggcagcaagagaguucuauggaacugaaagagcagaaagggggagaggaacagcgggcugaccgucccgccgagcgcaagacguccgaacauagccagggcuguggcacugggggacaaguggcgugcgccgagucguga

SEQ ID NO: 56229 - RNA, 1086 nt, Artificial Sequence
  derived and/or modified sequence opt3 from FFAR4__Homo_sapiens__NP_001182684
augagccccgagugcgccagagcugcaggcgacgccccucugaggucccucgaacaggcgaaccggacccgcuucccauuuuucucugaugugaagggggaccaccgacuuguccuggcugccguugagacaacuguguugguauuaaucuuugcagugucacugcuaggaaaugucugugcccucgugcugguugcucguagaaggcggcgcggugcaacggccugccuugugcugaacuuguucugugcugaucuccuguuuauuagugccauaccgcugguccucgcggugagauggaccgaagcaugguuacugggccccguagccugccaucuuuuguucuacguuaugacacugagcggguccgugacuauccuaacccucgcugccgucucucuggagaggaugguguguauugugcaccuucaacggggaguccgcggcccugguagacgagcaagggcuguucuguuggcccucaucuggggguauucggcgguggccgcacugccauuaugcguauuuuuccggguggucccccagcgucugccuggagcugaccaggaaauuucaaucuguacacucauauggccaaccauccccggcgagauuagcugggaugugaguuuuguuacucuuaauuuccuggugccuggcuuggucaucgugauuuccuacucuaaaauccuacagauaacaaaggccagccgcaaaagacugaccguaucccucgcuuauucagagagucaucaaauuaggguuagccagcaggacuuucggcuguuccgaacgcuuuuucuguugauggugucuuucuucaucaugugguccccaauuaucaucacuauucuccugauauuaauccagaacuuuaagcaagaucuggucauuuggccgucacuauucuuuuggguggucgccuucaccuuugcaaauagcgcccucaaccccauccuguacaauaugacacuuugccgcaacgaauggaaaaagauauucuguugcuuuugguucccugagaagggggcuauuuugacugacaccagugugaaaagaaaugaucugucuaucaucuccggauga

SEQ ID NO: 56230 - RNA, 2601 nt, Artificial Sequence
  derived and/or modified sequence opt3 from FGA__Homo_sapiens__NP_000499
auguucagcaugagaaucgugugccugguccucuccguugugggcaccgccuggacagcugacucuggggagggagauuuucuugcagaagguggcgggguaaggggaccccggguggucgagcgccaccagucagccuguaaggacagugauuggccuuucugcagcgacgaagauuggaacuacaaauguccauccggcugccgaaugaagggucugauugacgaggugaaucaagauuuuacuaaccguauaaauaaauugaagaacucuuuauucgaauaucagaaaaauaacaaggacucgcauucacugacgaccaauaucauggagauucuaagaggggauuuuagcagugcgaacaauagggacaacacauacaaucggguuuccgaggaucuccgcucuagaaucgaagugcugaagaggaaagucauugagaaggugcagcacauccagcuucugcaaaagaacguacgggcucaguugguugacaugaagcgccucgaaguggauauagacaucaaaauucgaagcuguagaggauccugcucaagggcccuggcacgggaggucgaccugaaggauuaugaggaccagcagaagcaacucgaacaggugaucgccaaagauuuacugccgagucgugaccgccagcaucuucccuugauuaagaugaaaccugugccagaucugguccccggcaauuucaagagccagcuacaaaaaguuccuccagaguggaaggcucucacugacaugccccagaugagaauggaacuggagaggccuggcgggaacgaaaucacccggggagguucuacauccuacggcaccgggucagagacugagagcccacgaaauccgaguucugcaggauccuggaacagcggcucgucuggucccggguccacaggaaaccgcaauccuggcucaaguggcaccgggggaacggccacuuggaaaccagguagcuccggccccgggucuaccggaagcuggaacucaggcaguuccgguacagggagcacuggcaaucagaacccuggaucuccaagacccggcucaaccgggacauggaauccgggaaguagcgaaagggguuccgcuggccacuggaccucugagucgagcguguccgggucaacgggacaauggcauagugaaucuggcagcuuucggccugauucccccgguucagggaacgcccgcccaaauaacccugacuggggcacuuucgaggaaguaagcggaaaugugucucccggcacaagaagggaguaucacaccgagaaacuugucacuuccaagggggauaaagaacugcguacaggaaaggagaaagugaccagugguagcacgaccacaacucggcgaucuuguuccaagaccguuacaaaaacugugauaggcccagacgggcacaaggaagucaccaaggaggugguaacaucagaagauggaagugacugccccgaggcgauggacuugggcacccucagcgguauugggacucuggauggcuuuagacauaggcacccugacgaggcagccuucuuugauacggcuucgacaggaaaaaccuucccaggcuuuuucuccccgauguuaggggaguucguuucugaaacugaaagccgcggaucagagaguggcaucuuuaccaacacaaaggaguccucuagccaucaccccgguauugccgaguucccuucccgggggaaaucaagcaguuacucuaagcaguuuaccuccagcacuucguauaauagaggagacucaacauucgaaucuaaaaguuacaagauggcagaugaagcuggcuccgaggccgaccacgaagguacgcauagcaccaagaggggccacgcgaaaucucgcccagugcgagauugugacgauguccugcagacucaucccagcgggacacaguccggaaucuuuaacaucaagcucccuggcucaaguaaaauuuucagcguguacugcgaccaagagaccucucuugggggauggcuguugauacagcagcggauggauggcucccuaaauuuuaaccguacauggcaggacuauaagagagguuucgggucacugaaugaugagggagaaggcgaguuuuggcucgguaacgacuaccugcaccuucugacucaaaggggcagugucuugcgcguggaacucgaggacugggccgggaacgaagcauaugcugaguaccauuuccggguuggaagcgaggccgaaggcuaugcuuuacagguguccucuuacgaggggaccgccggagaugcacugaucgaaggcucgguagaggaaggugccgaguauacgagccacaauaacaugcaguuuucaaccuucgacagagaugcugaccagugggaggaaaauugugcggaggucuacgggggaggcuggugguacaacaauugccaagcagccaaccugaaugguauuuauuacccaggcggguccuaugaucccaggaacaauaguccguacgaaaucgagaacggagugguuugggugucuuuucgaggcgcugacuauagccuacgcgccguccggaugaaaauaagaccucucgugacacaguga

SEQ ID NO: 56231 - RNA, 1476 nt, Artificial Sequence
  derived and/or modified sequence opt3 from FGB__Homo_sapiens__NP_005132
augaagagaauggugagcugguccuuccacaaacugaagaccaugaaacaucuccuucuguuguuacugugcgucuuucuaguuaagucucagggcgugaacgacaaugaggaaggguucuuuucagccaggggacaccggccccucgauaaaaagcgcgaggaagcuccuagucugcgaccagcaccgcccccuaucagcgguggcggguaccgugccagaccagcgaaggcugccgcaacacaaaagaagguagagaggaaagcccccgacgcuggaggcugucuucaugcagauccugaccuggguguguugugcccaacugggugucagcuccaggaagcccugcugcagcaagagcggcccauucgcaacuccgucgaugagcucaauaacaauguggaagcuguuucucagacgucgucaagcaguuuccaguauauguacuuacugaaggaccuuuggcagaaaagacaaaaacaggugaaggauaacgagaaugucgugaacgaauauuccucugaguuggagaaacaccagcuguacauagacgaaaccguaaauagcaacaucccuacaaaucuaaggguucuccgguccauucuggagaaccuucgcucaaagauccagaaacuggaaagugaugugagcgcccaaauggaguauugccgaacuccauguaccgucucuugcaauauuccggugguguccggaaaggaaugugaggagaucauaagaaaaggcggcgaaacaucagagauguacuugauccagcccgacagcagugucaagccuuauaggguuuacugcgauaugaacaccgaaaaugggggauggacugugauucagaaccggcaagacgguucuguagauuuuggccguaaaugggacccauacaagcagggguucggaaacguggcgacaaauaccgacggcaagaacuauuguggucuccccggggaguacuggcugggaaaugauaaaaucucccaguuaacgcgcaugggcccuacugaacugcucauugagauggaggacuggaagggcgauaaagucaaggcacauuaugggggauuuaccgugcagaacgaagccaauaaauaccaaaucagcguuaacaaguauagagguacagcuggcaaugcccuuauggacggggcaucgcagcugaugggagagaacaggacuaugaccauacacaauggcauguucuuuucuacauacgaucgggacaacgaugguugguugaccuccgacccacgaaagcagugcucaaaagaagaugggggcggauggugguauaaucgcugucacgcugccaaccccaauggcagauacuacuggggagggcaguauacgugggacauggcgaagcaugguacugaugacggcguggucuggaugaacuggaaagggaguugguacagcaugaggaagauguccaugaaaauucggccguucuuuccucaacaguga

SEQ ID NO: 56232 - RNA, 2886 nt, Artificial Sequence
  derived and/or modified sequence opt3 from FGD1__Homo_sapiens__NP_004454
augcacggccauagagcccccgggggagcugguccuagcgagccagaacacccggcaaccaacccaccuggcgccgcgccacccgcuugcgccgacuccgauccuggggcaucugagccaggacugcucgccaggcggggcucagguagugcucuugggggaccccuggacccucaguucgugggcccaagcgauacauccuugggcgcagccccggggcaucgcgucuuacccuguggaccuucuccacaacaccaucgagcucugcguuuuucguaccaccuagaagguucacagcccagaccuggccuccaccaggggaauaggauccugguuaagagccuuagucuggacccaggacaguccuuggagccccauccggaaggcccucaacggcuccgcucugaucccgguccaccuacugagacgcccagccagagaccauccccgcugaaaagggccccugggccaaagccccaggugcccccuaaaccaucauaucugcagaugccccggaugccuccaccccucgagccgauuccuccacccccuagucgccccuuaccagcggacccucgaguagcaaagggacuggcccccagagcugaagccagcccaucuuccgcagcugugucaagccuuauagagaaauucgaaagggagccggucaucguggccagugaucggccuguucccggcccaucucccggcccuccagagcccgugauguugccucaaccgaccucccagccacccgucccucagcugccagaaggggaggcgagccguugccuauuucuccuggcccccggaccucgcgacggugaaaaggugccgaacagagauucgggcauugacucuaucuccucacccaguaauagcgaggaaacauguuucguauccgaugacgggccaccuucucacagccuuugccccggacccccugcacuggcuucaguucccguggccuuggcugauccacauaggccgggcagucaggaggucgacuccgaccucgaggaagaggaugacgaagaggaagaggaggaaaaggaucgggagauuccugugccccugauggaacgacaagagagcguggaauuaacuguccagcagaaaguuuuucacaucgccaacgagcugcuccaaaccgagaaggcauacgugucucgccuucaccuguuggaccagguauucugugccagacuacuggaagaggcuaggaaucggucaaguuuuccagcggaugugguccaugguauauucagcaacaucugcuccauuuauuguuuucaccagcaguuccuccugcccgaacuugagaaacgcauggaggaaugggacagauacccuaggaucggggauauucugcaaaaguuggcaccauuucucaaaauguauggcgaguacgugaagaauuucgaccgugccguugaacuggugaacacauggaccgagcggucuacucaguuuaaggucaucauacaugaagugcagaaagaggaggcuugcggaaauuuaacacugcagcaccauaugcuagaacccguacaacgaaucccuagauaugagcuccugcuuaaggauuacuugcugaaacucccgcacggcucgccagacagcaaggaugcccagaaaucccuggaacuuauugcaaccgccgcugagcacucaaacgccgcaauuaggaagauggaacgcaugcauaaacuguugaagguuuacgagcucuuagggggagaggaagacaucgugagucccacgaaggagcugaucaaagaaggucacauucugaagcuaucugcgaaaaauggcacuacccaggaccgguaucucauacuguucaacgauagacuuuuguacugugucccuaggcugcgccuccuggggcagaaguucagcgugcgagcucggaucgacgucgauggaauggaguuaaaagaauccucaaaucugaaccuuccccguacauuuuuggugagcggcaagcaaagaucucucgagcugcaggccaggacugaggaagagaagaaagacuggguucaggcaauuaauuccacccuacugaagcaugaacagacacucgagaccuucaaacugcuuaacaguacgaaccgcgaggaugaagacacuccaccuaauagccccaacguggauuuggguaagcgggccccaacaccuaucagagagaaagaaguaaccaugugcaugaggugucaagagccguuuaauucuauaacuaagcgacgccaccacugcaaggcuugcgggcaugucguguguggcaaaugcuccgaguuccgggccagacugguuuaugacaacaauaggucaaaccguguguguacagauugcuacgucgcauuacacggagugcccggcaguagcccagcuuguucgcagcauaccccucagcgccggagauccauucucgagaagcaagccucuguagcggccgagaauagcgugaucugcucauuucugcacuauauggaaaaagggggaaaggguuggcauaaggcuugguucguuguccccgagaacgaaccacuugugcuguacaucuauggcgcaccucaggacgugaaagcccagaggaguuugccccucauuggguuugaggucggaccgccagaagcuggcgagcgaccugaucggcgccacguuuucaagaucacgcagucccaccugucuugguacuuuagccccgagaccgaagaacuacaaagaagguggauggccgugcugggucgggcagggcgaggcgacacauucuguccaggacccacucucuccgaagauagagagauggaagaggcgccuguggccgcucugggcgccaccgcagagccgcccgaaucaccacagacacgcgacaaaacuuga

SEQ ID NO: 56233 - RNA, 1968 nt, Artificial Sequence
  derived and/or modified sequence opt3 from FGD2__Homo_sapiens__NP_775829
augaagggcgccagcgaggaaaaacuggcuuccgugucuaaccucgucaccguuuucgaaaauucaagaacacccgaagcagccccuagggggcagcggcuugaggacgugcaccaucgcccagaaugccgaccgcccgagaguccuggaccacgugagaagacuaacguaggugaagcggugggcagcgagcccagaacggucuccaggcgguaccugaacucuuugaaaaauaaguuaucgucagaggcuuggcgcaaaagcugucaaccugugacccugaguggguccggaacacaggagccagagaagaagaucguucaggaacuacucgagacugaacaggccuauguggcaagacugcaccuucuggaucaagucuuuuuccaggaguugcucaaaaccgccaggucuagcaaggcuuuucccgaagacgugguacggguuauuuucuccaauauaucaaguaucuaccaguuucauagccaguucuuucugccugagcugcaacgccgacucgaugacuggacagcaaacccaagaauuggcgaugugauccagaaauuagccccguuccugaagauguauucugaguacgucaaaaauuuugaaagggcugccgagcuuuuggcgaccuggacugacaagucaccccuguuccaggaagugcuaacacggauucaguccagcgaggcaagugguucucucacccugcaacaccauaugcuugaaccugugcagcguaucccacgcuaugagcuguugcucaaggaguacauacagaaacugcccgcccaagcuccugaucaggccgacgcacagaaggcuuuagauaugaucuuuuccgccgcgcagcacagcaacgccgcaauuacggaaauggagagacugcaagaccucugggaagucuaucagaggcuugggcuggaggaugacaucguugauccaucgaauacuuugcuacgggaaggacccgugcugaaaauuucuuuccgacgcaacgacccgauggagagauaccucuuucuguucaauaacaugcuucuguacugcguaccuagggugauccaggucggcgcucaguuccaagugcggacccgcauagacguugccggcaugaaggugagagaguugauggaugcugaauuuccccacuccuuccucgucucagggaaacagaggacacuggaguuacaggcccguagucaggaagagaugauuagcuggaugcaagcauuucaggccgcuaucgaccagauugagaagcggaaugaaacuuucaaagcggcagcccagggaccagagggugauauccaagaacaggagcugcaguccgaggaacuaggccuccgagcuccucaaugggugagagacaagaugguaaccauguguaugaggugccaggagcccuuuaacgcccugacacgccggagacaucacuguagggcaugcggguauguugugugugcccgcugcucugauuaccgagcugaacuuaaguaugacgauaaucggccaaaccgugucuguuugcauugcuacgccuuccugaccggaaacgugcuccccgaggcaaaagaagacaagagaaggggcauccuggagaaagguagcucagcgacgccugaucagagucuuauguguuccuuucugcaguugauuggggacaaguggggaaaaagcggcccacgcggcuggugcgucauaccgcgggaugacccccucgugcuguauguuuacgcugccccucaagacaugagagcacacacuucuaucccauuacugggguaucaggugacaguaggaccccagggugauccuagggucuuccagcuacaacagucaggccagcucuacaccuuuaaggccgaaacugaggagcugaaggggcgaugggugaaagcuauggaacgcgccgcaaguggauggagcccauccuggcccaaugacggcgaucuuucugacuga

SEQ ID NO: 56234 - RNA, 2178 nt, Artificial Sequence
  derived and/or modified sequence opt3 from FGD3__Homo_sapiens__NP_001077005
auggagagcggcagaggguccucuacacccccuggaccaaucgccgcucuggguaugccggacaccggccccgggucaaguagccucggaaagcugcaggcacugccugugggcccaagggcccacugcggugaucccgucuccuuggcggcugccggggacggaucuccugauauuggcccaacuggcgaauuaucggggucacugaaaauacccaaccgggacagcggaaucgauaguccuuccucuagcguugccggugagaauuucccaugugaagagggccuagaagcagggccgucccccacggugcucggagcucaugcagagauggcccuggacucacaaguaccuaaggugaccccacaggaggaagcugauagugacgucggcgaggaacccgauagcgagaacacaccucagaaagccgacaaggaugcgggucuugcacagcacucugggccacaaaaacuguugcauauugcccaggagcuccugcacacugaagagaccuacgugaagcgccugcaucucuuagaccagguguuuugcacacgacugaccgaugcuggaaucccgcccgaaguuauuaugggcaucuucuccaauauaucaagcauccaccguuuucacggccaguuccuuuugccugagcugaagacuagaauuacagaagagugggacaccaaccccaggcuaggggacauccuccaaaaacuggccccauuucuuaagauguauggagaguacgucaaaaauuucgaucgggcagugggucugguaaguacguggacucagcgcucuccuuuguuuaaggacguugugcauuccauucagaaacaggaagucuguggcaaccucacccugcaacaccauauguuagagcccgugcagagagugccaagguaugaacugcuccuuaaggauuaccugaagcgguugccccaggacgcuccugaucgcaaagacgccgagcgaagccuagaacugaucucgacagcggccaaucacucuaacgcagcuauaagaaaggucgagaaaaugcacaagcuccuggagguuuaugaacaacuugggggagaggaagauauugugaauccagccaacgagcugaucaaagaaggccagauucagaaguuguccgcuaaaaaugguacuccgcaggacaggcaucucuuccuguuuaacucaaugaucuuauacugcguacccaagcugcggcuaauggggcaaaaguucagugugcgugagaaaauggauaucagcggccuccagguccaggacauugugaagccuaauaccgcccacacauuuauaaucaccggacgcaaaagaucccuggagcuucagacgaggacugaagaggaaaagaaagaguggauucaaaucauacaggcaacaauugagaagcauaagcagaacucugaaaccuucaaagccuuuggcggggcuuucagccaggaugaggacccaucauugagucccgacaugccuaucacuuccacaagcccaguugaacccguggucaccacggagggaucuucaggugcggcaggccuggaaccgcggaagcucaguagcaaaacccgacgcgauaaggagaaacaauccuguaagucuugcggggagacauucaauucgaucacuaagagaaggcaccauuguaaacugugcggagccgugauuuguggcaagugcagcgaauuuaaagcugagaacucccggcagucacgcguauguagagacugcuuccuuacccagccuguugccccagaaaguacagagaagacucccaccgcagauccucagcccucucuguugugcgguccacucaggcugagcgaauccggggagacauggucagaggugugggccgcuaucccuaugagcgacccccaagucuuacaccuucagggcggaucucaggauggccgucuaccacggaccauuccgcucccuuccuguaaacugagugugcccgacccagaggaacgacuugauagcgggcacgucuggaaguugcaaugggccaagcagucuugguaucuguccgcaucaagugcggaacuccagcagcaauggcuggagacuuuaagcacggcugcccauggagacacagcacaggauucgcccggugcccugcagcuucaggugccuaugggcgcugccgcaccauga

SEQ ID NO: 56235 - RNA, 2637 nt, Artificial Sequence
  derived and/or modified sequence opt3 from FGD4__Homo_sapiens__NP_001291409
augaacuucaagagagugaaaccaaauaucuuucugcucaaccagagcaggcuuauuauauccaucugcgagauuaugucuaccgaccaaggcucaaguacauguccuaagaucgcccuggucccaccgugcagcacuuccucuacgaccacauugguuggggaaaaugugucggaggaagaggcucagggaauuaacgguaaucggcccgcaaaacacucagccgcgagcccuaagccacagguacccccuaaaccauuacaucugcagaacagucccuccucuaauauccaccaaacuccucgccauaaggcucuaccaagcgccaagccgcgaauggaagagauaaaacccgcauccgccucaugugugaguaaggagaaaccuagcaaggucucugaucucaucucccguuucgaaggcgggucaagccugaguaacuacucugaccuuaaaaaggaguccgcugugaaucugaacgcaccaagaacccccggaaggcacggcuugacaaccacuccucagcagaagcuccugagccagcaucugccacaacggcaggguaaugauacagacaaaacccagggggcccagacgugcguugcuaacggagugauggccgcgcaaaaucagauggaaugugaggaggaaaaggcagccacucucucgucugauaccuccauucaggcuucagagcccuuacuggacacacacaucgucaacggcgaacgcgaugagacugccaccgcaccggcuaguccuacaaccgacagcugcgauggcaaugccuccgacucuagcuauagaacgcccgggauuggaccagugcuuccuuuggaagagaggggugcggagacugaaacaaaaguacaagagcgggaaaacggcgagucaccccuggaacuagagcagcucgaucagcaccaugagaugaaggaaaccaacgagcagaaacugcacaagaucgccaaugaacuucuguugacugagcgcgcauacguuaaccgacucgaccuguuagaucaaguguuuuauuguaaacugcucgaagaggcuaauagagggaguuucccagccgagauggucaacaagauauuuuccaauauuagcucuaucaacgcuuuccauucaaaguuucuucugcccgaauuggagaaaaggaugcaggaaugggagacaaccccucggauuggagacauccuacagaagcuggccccauuccucaaaauguacggcgaguaugugaaggguuuugacaaugcaauggaacuggugaaaaacaugacggagcguaucccgcaguucaagagugucguugaagagauucaaaagcagaaaauaugcgggagccuuacccugcagcaccacauguuggaacccgugcagcgcaucccuagauacgagaugcuccugaaggauuauuuaaggaaacugccacccgacucccuagauuggaaugacgccaagaaaucucucgagauuaucucgacagcugcgagccauuccaacucagcaauacggaagauggaaaaucugaagaaacuuuuggagauuuacgaaaugcugggagaggaagaggauaucguaaacccuaguaaugagcucaucaaggaaggccaaauucugaaacuugccgcucgaaacacuucugcccaggagcgcuaccuguuuuuguucaauaacaugcuccuguauugugugccaaaguuuagcuuagucggcuccaaauucaccgugagaacaaggguugggaucgacggaaugaagauuguggaaacucagaacgaggaauacccccacaccuuccaggucucagguaaggagcggacacuggagcuacaagcaagcucugcccaggauaaagaagaguggauaaaggcucuccaggaaaccaucgacgccuuucaucaacgccacgagacuuucagaaaugcaauugcgaaagauaacgacauccauuccgaggugaguacggcugaacugggcaagagggccccgcguuggauccgggauaaugagguaacaaugugcaugaaauguaaggaaccuuuuaacgcacuuacccgaagaaggcaccacugccgcgccugcggguauguuguguguuggaaaugcagcgacuacaaggcucaguuggaguaugacggaggcaagcugucuaaagucuguaaggauugcuaccagauuauauccgguuucacugacucagaagagaaaaagcggaaagggauccucgagauugaaagugccgaggugagcggcaauucggucguguguuccuuucugcaguauauggaaaagucuaagccauggcaaaaagcauggugcguuauccccaagcaggauccuuuagugcuguacauguacggagcuccccaggacguaagagcccaggcgaccauuccacuuuugggcuaugucguggaugagaugccuaggagcgccgaccucccccauucauucaaacugacacaaaguaaguccguucacucuuuugcugcagauagcgaggaacuaaaacagaaguggcugaaggugauccuccuggccgucaccggggagacuccaggagguccgaacgaacauccugcuacacuugacgaucaccccgagcccaaaaagaaauccgaauguuga

SEQ ID NO: 56236 - RNA, 4389 nt, Artificial Sequence
  derived and/or modified sequence opt3 from FGD5__Homo_sapiens__NP_689749
auguucagaggccccaagccuccaaucgccccgaaacccaggcugaccgcuccuaacgaguggcgggcaagcguguaccucaaugacucccuuaacaagugcucuaaugggcgccugccaugugucgaucgaggauuggacgaagguccccguucaauuccuaaaugcagugagagcgaaacagaugaggacuauauaguugugccaagaguacccuuaagggaagaugagccuaaggacgagggcuccguggggaacaaagcccuggucucuccagaaucgucagcggaggaagaggaggaacgggaggaaggaggcgaggcuuguggucuagaagggacuggagccggcgaggauagcguggcaccggccgcucccggcgcaggggcccucagucgcgagggagaagaggguacggaccuggcucuugaagaugagggcgaagggugcgccgacgagccuggaacccuggagcagguuuccagaucugaagaggaagagaaguuggugcaaccacacagggaauguagccucgaggauuccggccccugggcgggugagggggucuuucagucagaccugcugcucccucauauccacggagaagaucaggagccacccgacacaccgggcgaagcagaggaggacgaugaagagggcugcgccaguacugacccugcuggggccgaugaaggaagcggucccgaccggccaaccgaggauaugggccaggacgcagaagauacaucugaggagccucccgaaaaggaggaauuagcuggggugcaagaggccgaaaccgcgacugacuguccagagguacuggaggaaggaugcgaggaagccacaggcguuaccgguggggaacagguggaucuuuccgaacccccugaccaugagaaaaagacgaaucaggaggucgcagcugccacuuuggaagaucacgcucaggacgagucagccgaagagagcugucaaauugugccauucgagaacgacugcauggaagauuuugugaccagucugacaggcucuccguacgaguucuuucccacugaauccaccagcuucuguucggagucuugcuccccucuaucagaaagugcaaaaggacucgagagcgagcaggccccaaagcugggccuucgcgcugaagagaaucccauggucggggcgcugugcggacagugugguuccuugcagggcggggcagccgaaggaccugcugccccagacguugugguagugcucgaggaagaggcacuggaugacgccuuagcuaaccccuaugucaugggcgugggucugccggggcaagccgcaccuggcgagggaggccaggcggcuucugaugcccucgggggauacgguagcaaagaagaacuuaauugcgaagcagagggcgggcugguuccagccgaccgaaagaacacaucaaccagagugaggccccauaguggaaaggucgcuggcuaugugccugaaacgguacccgaggagacugguccagaagccggguccagcgcaccuggcaucggaggcgcugccgaggaaguugggaaaacauugcuaucucuggagggaaagccccucgaggcgucacgggcccugccagcuaaaccgcgugcauuuacccuuuacccucgcaguuucagcguggaaggcagagagauucccgucuccguguaucaggaaccagaggguucugggcuggaugaccacaggaucaagcggaaagaagauaauuugucgcucagcugugucauaggauccucaggcaguuuuucucaacgaaaccaccuucccagcuccgguacuucaacaccuagcucuaugguggacaucccacccccuuucgauuuagccugcauuaccaagaaaccgaucacgaaguccaguccaagccugcuaauugagucugacucccccgauaaguacaaaaagaaaaagucaaguuuuaaacgcuuccucgcucugaccuuuaagaagaaaacagagaauaagcugcauguugacgugaacguaagcucguccagaucuagcucagaaaguuccuaccacggcccuucuaggaucuuggaggucgaccggcgcagccuguccaauucaccacagcucaaaagcagaacugggaagcugagggccagugaaucucccuccagccuuauauucuaucgugauggaaaacggaagggcgugccuuucucgcgaaccguuucaagaguggagucuuuugaagacaggagucgcccgcccuuccugccauugccucucacaaagccccgguccauuagcuuuccaucugcagauacuagcgacuacgagaacaucccugcgaugaacuccgauuaugagaauauucagauucccccaagaaggccggcccgcgcuggggccuucaccaaacuguuugaagaccagucacgagcauuaaguacagcuaacgagaaugauggauacgucgacaugagcucuuucaacgccuuugaauccaagcaacagucagcagaucaggacgccgagagugcuuauaccgaaccuuacaaagugugucccaucagcuccgcggccccaaaggaggaucugacuucugacgaggaacagcggucgagcgaggaagaggauucagcaucccgugaccccaguguaacgcauaaaguggagggccaaucuagagcucuaguuaucgcccaggaacuccugagcuccgagaaggccuaugucgaaaugcuucagcacuugaaucuggacuuccacggugcugugaugagggcacucgaugacauggaucaugaggggcgcgacacacuggcccgggaagaguuaagacagggacugucagagcuuccugcgauacacgauuugcaucaaggcauccucgaggagcuggaagagaggcuaucuaacugggaaagccagcagaagguggcugacgucuuucuggcccgagagcaggguuucgaucaccaugcaacccacauucuccaauuugaccgcuaccugggccuuuugagugagaauugccugcacuccccacgguuagccgcugcaguuagagaguucgagcagagcgugcaagggggaucucagacugccaaacauaggcuccugcgugugguacagcgccuuuuucaguaccagguccuguugaccgauuaucucaacaaucugugucccgacucagcggaauacgauaacacacaaggcgcucuaucccugaucaguaaggugaccgaccgggccaaugacagcauggagcagggggaaaaccuccagaaacugguucacauagagcauucggugagaggacagggcgaucuuuugcaaccugguagggaguuccugaaggaagggacuuuaaugaaagucacaggaaagaaucgacggccgcgccaccucuuccugaugaacgacgugcuucuguauacguacccacagaaagauggcaaguauagacuaaagaauacccucgcaguugccaacaugaaagugucuaggcccguaauggagaaggucccuuacgcucugaaaauugaaacuuccgagagcugcuugaugcugucagccaguucuugugcagagcgggacgaaugguaugguugcuuaucccgagcucuccccgaggauuacaaggcccaggcgcuggccgcauuucaccauagcguggaaaucagagagcgccuuggcgugucacugggggaaaggccaccuacauugguccccguuacccacgugaugauguguaugaacugcggaugcgacuucagucucacacugcgucggcaucacugucaugcuugcggcaaaaucguauguagaaauugcagcaggaacaaguacccacuaaaguaucugaaagaucgcauggccaaggugugugacgggugcuuuggagagcuuaaaaagcgaggcagagcugucccuggucucaugcgggagaggccgguguccaugucuuucccccugagcuccccacgcuuuucagggucugcauucaguucgguuuuucagagcauuaauccuuccacuuucaaaaagcaaaagaaagugcccucugccuugaccgaagucgccgcuucaggagagggcagcgcgaucuccggcuaccugagucguuguaagagagggaaacggcacuggaagaaauuaugguuugugauuaagggaaagguucucuauacguacauggcaucugaagauaaaguggcccuggagagcaugccacuucuggguuucaccauagcuccugaaaaggaggagggcucauccgaagucgggcccaucuuucacuuguaucauaaaaagacacucuucuacaguuuuaaagccgaggacacuaacagcgcacagagguggauugaagccauggaggaugcuucuguacuguga

SEQ ID NO: 56237 - RNA, 4293 nt, Artificial Sequence
  derived and/or modified sequence opt3 from FGD6__Homo_sapiens__NP_060821
augaccagcgccgcugagaucaagaaacccccuguggcaccaaagccgaaauucgucguugccaacaauaagcccgcgccuccacccauugcuccuaaaccagacauagugaucuccucuguaccccagucaacaaagaagaugaaaccugccauugcaccaaagccgaaagugcugaagacuucacccgucagagaaaucggccaaagcccuuccaggaaaauuaugcucaaccuugaggggcacaagcaggaacuggccgagucuacggauaauuuuaacugcaaguacgaaggaaaucagucgaacgacuauaucucaccaauguguagcugcaguuccgaguguauacauaaauugggucaccgggagaauuuaugcgugaagcagcugguucuagaaccccucgagaugaacgaaaaucuggagaacucuaaaaucgaugagacccuuacaauuaagacucgcagcaaaugugaccuguacggcgaaaaggcuaaaaaucaagggggaguggucuugaaggcauccgugcucgaggaggagcugaaggaugcccugauccaucagaugccuccauucauuucagcucagaaacaccgacccaccgacaguccggaaaugaacggcgguugcaauagcaacgggcaguuucguaucgaguucgccgaucucucuccuucccccaguagcuuugagaagguaccagaccaucacaguugucacuuacaacugccuucugaugaaugcgagcauuucgaaacaugucaggacgauuccgagaaaagcaauaacugcuuucagucgucugaacuugaggcguuggagaacggaaagagauccacccugauaucaagugacggcguuagcaaaaaguccgaagugaaggaucuaggcccccucgagauucaccuggucccauauacucccaaauucccuacaccaaagccgaggaaaacccggacggcacgccuucugagacagaaguguguggacacucccucugaaagcaccgaggaaccugggaauagugacaguuccagcucuugcuugacagagaacucacucaaaaucaauaagauuagugugcugcaucaaaacgucuuaugcaagcaggagcagguugauaaaaugaagcugggaaauaaaagcgaacucaacauggaguccaauucugacgcccaagaucuugugaacucgcagaaggcuauguguaaugaaacuaccagcuuugagaaaauggccccauccuucgacaaggauucaaaccugaguucugacagcacaaccguagaugguuccucaaugagcuuggcaguggacgagggcacgggguuuaucaggugcacugucucuaugucccuacccaagcagcugaaacucacauguaaugaacaucugcagaguggacggaaccuuggcgugagcgcuccucaaaugcagaaggagucuguuaucaaagaagaaaauucccugcgcauugugccaaagaaaccccagcgacacucauugccggccaccgguguccucaagaaagcggccagugaggagcuguuagaaaagagcucguacccuuccucugaagaaaagagcucagaaaaaucacuggagagaaaccaccuacagcaccucugcgcacaaaauaggggaguguccucuagcuucgauaugccaaagcgggcuuccgaaaaacccguauggaagcugccucaucccauacuuccauuuucagggaacccugaguucuugaaaagcguuacugugaguucuaacuccgagcccagcacagcccugaccaagccacgugcuaagucgcucucagccauggacgucgaaaaauguacgaagccgugcaaagauucuaccaagaaaaauaguuucaagaagcugcuuuccaugaaacugagcaucuguuuuaugaagucugacuuccagaaauuuuggagcaaguccucacaguugggcgacacaacuaccggccaccucaguagcggggagcagaaaggaauugaaucugauuggcaaggucuguuagugggcgaggaaaagcgcuccaagccuaucaaagcauauucaacagagaacuacagucuggagagccagaagaaaagaaagaaauccagggggcagacuucugccgcuaauggacuacgggcggaaucgcucgacgaucagaugcugagccgagagucauccagucaagcacccuauaagucugucaccagccuuugcgccccagaauacgagaacauacgccauuacgaggaaauucccgaguaugaaaauuugccuuucaucauggcuaucagaaaaacacaggagcuggaauggcagaacuccucaucuauggaggacgccgaugcaaauguguacgagguugaggagccauaugaagcccccgacggccaacuccagcuggguccuaggcaccagcacagcaguuccggggcuagccaggaggaacaaaacgauuuaggccugggagaccuuccgucugaugaggaggaaauuaucaauucauccgacgaggaugacgugaguagcgaaucgucuaagggcgagccagaucccuuggaagacaagcaggacgaggauaacgggaugaaauccaagguacaucacauugccaaagagauaaugagcucagaaaaggucuuuguggacguucucaaacugcuacauaucgauuuccgggacgcaguggcgcacgcuagucgccagcugggaaagccugucauugaggauagaauccucaaucagauccuguacuaucuuccacaauuguacgaacugaacagggacuuacucaaggagcuggaggaacguaugcuucacuggaccgagcagcagcggauugccgauauauuugugaaaaagggucccuaucugaaaauguacucuacuuacaucaaggaguucgacaaaaauauugcauugcucgaugaacaguguaagaagaacccuggcuuugccgcuguagugcgagaguucgaaauguccccgagaugcgccaaucuggcacuaaaacauuaucugcucaagcccguucaaaggaucccacaguaccgccugcuuuugacggacuaucugaaaaacuuaauugaggaugcuggggacuaccgggauacacaggacgcccucgcggucgugaucgaaguggccaaccacgcuaaugacaccaugaagcaaggagauaacuuucagaaacugaugcagauacaguauagccuuaauggccaucacgagaucguccaaccugguagaguuuuccugaaggaagggauucuaaugaagcucucaaggaaagugaugcagccccgcauguuuuuccuguucaacgacgcauugcuguacacuaccccagugcagaguggcauguauaaguuaaauaacaugcucagccuggccggaaugaaaguacgaaagccuacacaggaggcuuaccaaaaugaacuuaaaaucgaguccgucgagcggucuuuuauucugagcgccuccucagcaaccgaacgugaugagugguuggaagcgaucucuagagccauagaggaauacgcuaagaagaggauuacuuucugucccagucgcucgcucgacgaggccgauagcgagaacaaagaagagguguccccacugggcucuaaggcaccgaucuggauuccugacacacgggcuacgaugugcaugaucugcaccucagaauuuacucuaacauggagaaggcaucacugucgagccugcgggaaaauaguuugucaggcaugcagcuccaauaaguauggacuggauuaccuuaaaaaccagcccgcccgcgugugugagcacugcuuccaggagcuccaaaagcuggaccaucagcacaguccacggaucgguucucccggcaaucauaaaagcccuucauccgcuuugaguagcguccugcacucuauuccauccgggagaaagcagaagaaaauccccgcggccuuaaaggaagugucagcaaacaccgaggauagcucgaugucuggauaucucuacaggaguaaaggcaauaagaaaccuuggaagcauuuuugguucguuauuaagaacaaagugcuguauacauacgcugccuccgaagacguagccgcucuugagagccagccgcuguuggguuuuacugucauccaagugaaggaugaaaauucagaguccaaaguguuccagcuccugcacaagaacaugcuauuuuaugucuucaaagcagaggacgcccacucugcgcagaaguggauagaggcuuuucaagaagggaccauucuguga

SEQ ID NO: 56238 - RNA, 627 nt, Artificial Sequence
  derived and/or modified sequence opt3 from FGF10__Homo_sapiens__XP_005248321
auguggaaguggauccugacccacugcgccagcgcuuucccccaucucccuggcuguugcuguugcuguuuucuucuguuguucuuaguguccucugucccaguuacaugccaggcacuggggcaagacauggugucaccggaggccacuaacaguagcuccucuucguuuucaagccccaguuccgcgggaagacacguaaggucuuacaaucaucuacagggugaugugcgguggcgcaaacucuucagcuuuacgaaguauuuccugaaaauugaaaagaacggcaaagucuccgggaccaagaaggagaauuguccuuacucaauacuugaaaucacaaguguggagauuggaguuguggcugucaaagccaucaacagcaauuauuaccuggcaaugaacaagaaaggcaaguuguaugguucuaaagaauuuaauaacgacugcaagcucaaggagcgaauugaggaaaauggguacaacacuuaugccuccuucaauuggcagcacaacggacgucagauguacguggcucugaauggcaaaggcgcaccaagaagggggcaaaagacccggcgcaaaaacacaucagcccauuuucugcccaugguaguucacagcuga

SEQ ID NO: 56239 - RNA, 678 nt, Artificial Sequence
  derived and/or modified sequence opt3 from FGF11__Homo_sapiens__NP_004103
auggccgcucuggcaagcucccucaucagacagaagagggaggugcgggaacccggcgggucucgcccugucucagcccaacgacguguuugcccaagaggaaccaaaagucuuugucagaagcagcuguugauuuuacugagcaaagugaggcuaugcgguggccggccggcgcgccccgacagagggccugagccacagcucaagggaauaguaacaaaacuguucuguaggcaaggcuuuuaccuucaggcuaaccccgaugguuccauccaggggacuccugaagacacgucuucguucacccacuuuaaucugauuccagugggauugcgggucgugacaauccagucagccaagcucggccauuauauggcaaugaacgccgagggccugcuguacagcaguccccacuucacugcugaaugccgcuuuaaggaguguguuuucgagaauuauuacgugcucuaugcauccgccuuauaccgacaaagaaggucugggcgggcuugguaucugggacuugauaaagaaggucaggucaugaagggcaaccgugugaaaaagaccaaagccgcggcacacuuuuugccuaagcugcuagagguagccauguaccaggaaccaagccuccauuccguuccggaggcuucacccaguagcccuccagcccccuga

SEQ ID NO: 56240 - RNA, 546 nt, Artificial Sequence
  derived and/or modified sequence opt3 from FGF12__Homo_sapiens__NP_004104
auggagagcaaggaaccccagcugaaaggcaucgugaccagacucuucucccaacagggguacuuucuucagaugcacccugacggaacaauugaugguacuaaggacgagaacucugauuauacgcuguucaauuugauaccagucggcuuaaggguuguggccauccaggggguaaaggcuucacuguacguggcaaugaacggagaaggcuaucuauacaguagcgacgucuuuaccccggagugcaaguucaaagaauccguguuugagaauuauuacguuauuuauucuucgacacucuaccggcaacaggagucaggucgcgccugguuccuggggcuuaacaaggaaggacagaucaugaagggcaaucgagugaaaaagacuaaacccagcagucauuuugucccuaagccaauugagguguguauguaccgugaacccucccugcacgagaucggcgagaaacaggggagaucuaggaaaagcuccggaaccccuacaaugaacgguggcaagguaguuaaucaagauucaaccuga

SEQ ID NO: 56241 - RNA, 600 nt, Artificial Sequence
  derived and/or modified sequence opt3 from FGF13__Homo_sapiens__NP_001132970
augagcggcaaggugaccaaacccaaggaggaaaaagacgccuccaaggagccucagcugaaagggaucgucacaaagcucuacucuagacaaggauaucaccuucagcugcaggcugaugguacuauugacggcacgaaggaugaagacucaaccuacacauuguucaacuuaauaccaguugggcugagggugguagcaauccagggagugcaaacuaaacuauaucucgccaugaauagugagggcuaccuguauaccagcgaacuuuuuacaccggagugcaaguucaaagaguccgucuuugaaaacuacuaugugaccuacucuucgaugauuuaccggcagcagcagucaggucgcgggugguaucugggauugaauaaggagggcgaaaucaugaaaggcaaccauguuaagaagaauaaacccgcggcucacuuccucccuaagccacugaaaguggccauguacaaggagcccagccugcaugaucucacugaguuuagucgauccgggucuggaacaccuaccaaaagccguuccgucucagguguguuaaacggcgggaagaguaugagccacaaugaaucuacguga

SEQ ID NO: 56242 - RNA, 744 nt, Artificial Sequence
  derived and/or modified sequence opt3 from FGF14__Homo_sapiens__NP_004106
auggccgcugcaaucgccagcggccugauuagacagaagaggcaagcgcgggagcagcacugggaccgccccuccgcuucucgacguagaucaaguccuagcaaaaacagggggcucugcaauggaaaccuuguggauauauucuccaagguccggaucuuuggucugaaaaagcgcagauugaggcggcaggacccacaguuaaaaggcauuguuacccgccuguacugucgacaaggguauuaccuacagaugcauccggauggagcccucgacggcacaaaggaugacucuacuaauucgacgcuguucaaccuuauccccgugggucugagaguaguggcaauucagggggucaagaccggauuguauaucgccaugaauggcgaaggcuaccucuauccuucagagcuguuuacaccagaaugcaaauucaaggagagcguguuugaaaacuacuauguuauauacaguuccaugcuguacaggcagcaagagucugggcgggcuugguuccucggauuaaauaaagagggucaggcaaugaagggcaaccgugugaaaaagacuaagcccgccgcucacuuucugccuaaaccacuugaagucgccauguaucgcgagcccagcuugcaugaugugggggaaaccguaccuaagccaggaguuacaccguccaaaucaaccagugcgagcgcaaucaugaauggcgguaagcccgugaacaaaucuaagacuacauga

SEQ ID NO: 56243 - RNA, 624 nt, Artificial Sequence
  derived and/or modified sequence opt3 from FGF16__Homo_sapiens__NP_003859
auggccgaggugggcggggucuucgcuagccuggacugggaucuccacggauuuuccucuucacuugguaacguuccccuggcagacaguccuggcuucuugaaugaaagauuagggcagaucgagggaaagcugcaaaggggcagcccaaccgauuuugcccaucuaaaagguauucuccggcgccgacagcuguacugccguacaggguuccaccuugaaauauuuccgaacggaacugugcauggcacgagacacgaccauuccagguucggcauccuggaguuuauuucuuuggcgguagggcucaucucgauucggggaguggauucaggucuguaucugggcaugaaugaacgcggggagcucuacggaagcaagaaauuaaccagagagugugucuucagggaacaguuugaggaaaacugguauaauacauacgcuaguacucuguauaagcacuccgacucugagcggcaguacuauguggcccuuaacaaagauggcagcccccgcgaggguuaccgaaccaagagacaccaaaaguucacacacuuuuugccuaggccaguugaccccuccaaacugccuucaaugagucgggaucuauuccauuaccguuga

SEQ ID NO: 56244 - RNA, 618 nt, Artificial Sequence
  derived and/or modified sequence opt3 from FGF17__Homo_sapiens__NP_001291407
augggcgccgcuagacugcuccccaaccuuacccugugcuugcaguuacugauccuauguugccaaacacaguacgugagggaccagggggcaaugacugaucagcucagccggcgccaaauucgagaguaucagcuguacucccguacgucuggaaagcacguccagguuaccgguagaaggauaucagccacagcggaagacggcaauaaauucgcuaaacuuaucguggagacugauaccuuugggagucggguacgcauuaagggagccgaaagcgagaaguauaucuguaugaacaaaagaggcaagcugauugguaagccuuccgggaaaucuaaggacugcguguucacagaaaucgucuuggagaauaacuacaccgcauuucagaaugccaggcaugagggaugguucauggcuuuuacucggcaaggccgcccacgacaggcaucgagaucaaggcagaaccagcgggaagcccacuucauaaaacgucucuaucaaggccagcugccguuucccaaucaugcugagaagcagaaacaauucgaauuuguggggagcgccccuacacgcagaaccaagaggacgcggcgaccacagccccugacuuga

SEQ ID NO: 56245 - RNA, 624 nt, Artificial Sequence
  derived and/or modified sequence opt3 from FGF18__Homo_sapiens__NP_003853
auguacagcgcccccuccgcuugcaccugucugugccuccacuuccuucuguuguguuuucaggugcaagucuuaguugcagaggaaaacguggacuucagaauccauguagagaaucagacaagggcccgggaugacgugucucgcaagcagcugcgacuauaucagcucuacucacguacgaguggcaaacacauucaaguccuggggagaaggauaagcgcgcggggagaagauggugacaaguaugcucagcuucugguggagacugauaccuuuggcucccagguucgcaucaaagggaaggaaacagaguucuacuugugcaugaacagaaaaggaaagcucgugggcaagccugacgguacuucuaaagagugugucuuuauugaaaaggugcuggagaauaacuauaccgcccugaugucggcaaaauacucagggugguauguaggauucacaaagaaaggcaggccacggaagggcccgaagacccgcgaaaaucagcaagauguucauuuuaugaaacgauaccccaaggggcagccugagcuccagaaaccauucaaguacacuacagugaccaaaagaagcaggcggauccgucccacgcacccugccuga

SEQ ID NO: 56246 - RNA, 651 nt, Artificial Sequence
  derived and/or modified sequence opt3 from FGF19__Homo_sapiens__NP_005108
augagaagcggcugcguggucguucacguguggauccuggccgggcucuggcuugcuguagcaggaaggccccuggccuucuccgacgcggguccucaugugcacuacggcuggggugauccaauucgguugcgccauuuauauaccucuggaccgcacggccugucaaguuguuuucuacgaauacgugcugacggugucguggauugcgccagagggcagagcgcacauucccuccuggagaucaaggccguugcucuuaggacaguggcaauuaaaggaguccacucugugcgguaccuguguaugggcgccgacggcaagaugcaaggguugcuccaguauucggaagaggauugcgcuuucgaagaggaaauccgccccgacggauacaacguauauagaucagagaaacacaggcugccuguuagccugaguuccgccaagcagcggcagcucuacaaaaaucgcggguuuuuaccacugucucauuuccuucccauguugccuauggugccagaggaacccgaggaucugcgaggccaccuagaaagcgacauguuuuccucaccucucgagacugauaguauggacccauucgggcuggucacgggacuugaggcggugagaagcccgucuuuugaaaaguga

SEQ ID NO: 56247 - RNA, 468 nt, Artificial Sequence
  derived and/or modified sequence opt3 from FGF1__Homo_sapiens__NP_001244139
auggccgagggcgaaaucaccacauucacugcucugacggagaaguuuaaccuucccccugggaauuacaaaaagccaaaacuccuguauugcagcaacggaggucacuucuugagaauuuuaccggacggcaccguggaugggacaagggaccgguccgaucagcauauacaacugcagcuaucugcagaaucagucggagagguuuacaucaagaguacugaaaccggccaguaucucgccauggacacagauggucugcuuuacgggagccagacccccaaugaggagugucuguuuuuggaacgccucgaggaaaaccacuauaauacuuacauuuccaaaaagcaugcggagaagaacugguucgugggacugaaaaagaauggcucuugcaaacgaggcccucguacacacuaugggcaaaaggcuauccuguuucucccauuacccguaucgucagacuga

SEQ ID NO: 56248 - RNA, 636 nt, Artificial Sequence
  derived and/or modified sequence opt3 from FGF20__Homo_sapiens__NP_062825
auggcuccccuggccgaggugggcggguuccucggaggucuugaaggccuggggcagcaagucggaagccacuuuuuguuaccuccagcaggcgagagaccgccccugcuaggugaaaggcgguccgccgcggagcgcucugcucgagggggaccuggcgccgcacagcucgcccaucugcacggcauccuucguagaaggcagcuguacugccggaccggguuccauuugcagauucucccagacggaucaguucaagguacacgccaggaucacagucuguuuggcauacuggaguucaucagcguggcuguagggcucguguccauuagaggagucgacucuggcuuauaucuggguaugaacgauaagggggaacuuuacggaucggagaaauugacuucagaauguaucuuuagggagcaguucgaagagaauugguauaacacguacagcaguaauauuuauaagcauggcgacaccggccggcgcuacuuuguggcacugaacaaagaugggacaccccgagacggagccagauccaagaggcaccagaaauucacucacuuucuaccucggccaguugaucccgagcgugugccugaacucuauaaggaccugcuuauguacaccuga

SEQ ID NO: 56249 - RNA, 630 nt, Artificial Sequence
  derived and/or modified sequence opt3 from FGF21__Homo_sapiens__XP_005258788
auggacagcgaugagaccggcuucgaacacuccgggcugugggugucuguccucgccggacuucuguugggugcuugccaggcacaucccaucccugacucaaguccauuacugcaauuuggcgggcagguuagacagagguaccuauauacagaugacgcccagcaaacugaggcgcaccucgaaauucgggaggauggaacggugggcggugcugccgaccagagcccggaaucccugcuucagcugaaggcauugaaacccgggguaauacagauccucggagugaagaccucucgcuuccugugucaacgaccugauggcgcccuguacggcucgcuccauuuugacccagaggcuugcucauuccgugaguuacugcuugaagauggguauaacgucuaccagagcgaggcacacggauugccccugcaucuaccugguaauaaaaguccacacagagaccccgccccuaggggcccagcucgguuucucccgcugcccgggcuuccuccagcccugcccgaaccuccaggaauuuuggcgccccagccgccugaugugggcuccucugacccccucagcaugguugguccaucccaggggcgcucaccuaguuaugcaagcuga

SEQ ID NO: 56250 - RNA, 756 nt, Artificial Sequence
  derived and/or modified sequence opt3 from FGF23__Homo_sapiens__NP_065689
augcugggcgccagacucaggcuuugggugugcgcucuguguagcgucugcuccaugucuguuuugcgggcauaccccaacgccucaccuuuacuggggaguagcuggggaggucuaauccaccucuauaccgcgacagcucgcaauuccuaccaucugcagauucacaagaacggccauguggacggggccccacaccaaacuauauauucugcacuuaugauccgaucggaggaugccggauucguagugauuacgggcgucaugucacguagauaccuguguauggacuuuagggguaauaucuucgggagccauuauuuugauccggaaaacugccgguuccagcaccagaccuuggagaauggauacgacguguaucacaguccccaguaccauuuucucguuucccugggccgcgcuaaaagagcauuccugccuggcaugaacccacccccuuacucucaauuucucagcaggcggaaugaaauuccauuaauccacuucaacacacccauaccucgccgacauacuagauccgccgaggaugacucagaaagggauccacugaaugugcuuaagccgcgggcucguaugacccccgccccugcgaguuguagccaggaguugccaucugcagaggacaacucccccauggccucagauccucugggggucgugcgcggagguagaguaaauacacacgcuggcgggaccggaccagaaggcugcaggcccuuugccaaauucaucuga

SEQ ID NO: 56251 - RNA, 867 nt, Artificial Sequence
  derived and/or modified sequence opt3 from FGF2__Homo_sapiens__NP_001997
auggugggcgucgggggaggugacguugaggaugugacccccagaccuggcgggugccagaucagcggaaggggcgcccgggguuguaacgggauuccaggagcugcagccugggaagcggcucugccgcgccgacgucccagaaggcacccuuccguaaauccacggucucgcgccgcaggcucacccagaacaaggggccggcgcacugaggaacgaccuagugggagcagacucggagacaggggucggggccgugcccuuccagggggacgccugggcgguagagggaggggacgggcucccgagcgagugggcggccgcgggagaggaagggguacggcagccccucgggcugccccagcggcacgcggcuccagaccggggcccgccggaaccauggcugccggcucuauaacaacuuugccugcauuaccagaagauggugggucgggcgcuuuucccccuggacauuucaaggacccaaaaaggcuguacugcaagaacggcggguucuuucuacguauccaccccgauggacgggucgacggugugcgagagaaaucagauccgcauauuaagcuccaacugcaggccgaggaaagaggcguugugagcaucaaaggggucugugcgaauagguaucuugccaugaaggaggacggacgccuguuggcaaguaagugcgugaccgaugaauguuucuuuuucgagcggcucgaguccaacaauuacaacacauauagaucuaggaaauacaccagcugguauguagcucugaagcgcacuggccaguacaaacuggguuccaagacagggccuggccagaaagccauucucuuuuuacccaugucagcuaagaguuga

SEQ ID NO: 56252 - RNA, 720 nt, Artificial Sequence
  derived and/or modified sequence opt3 from FGF3__Homo_sapiens__NP_005238
augggccugaucuggcuccuucuguugagcuuacuggagcccggguggccugccgcuggaccaggugcaagacuaaggcgggacgccggcgggcgcggaggcguguacgaacaccucgguggggcgccgcgacguagaaagcuguauugcgcuaccaaauaccaucuucagcugcaccccuccggaagggucaacggcucuuuggaaaauucagccuauaguauucucgagauaacagcaguugaggugggcaucguagccauucgggggcuguucagcggacgcuaccuggcuaugaacaagagagguaggcucuaugcauccgaacauuacucugccgagugugaguuuguggaacggauccacgaguuaggcuauaauacuuacgcuucgcgccuguaccgaacggucucaagcaccccuggggccagaaggcaaccaagugcggaacggcuuugguauguguccguuaacggaaaaggccguccccgcagagguuucaagacaaggcggacucagaaaucuagcuuguuucugccucgagugcuagaucaucgcgaccacgagauggucagacagcuccaguccgggcugccaaggcccccuggaaagggcgugcaaccacggcgcagaaggcagaagcagucaccggauaaucuugagcccagucacguacaggcaagccgucugggcucucaauuggaagccuccgcucauuga

SEQ ID NO: 56253 - RNA, 621 nt, Artificial Sequence
  derived and/or modified sequence opt3 from FGF4__Homo_sapiens__XP_006718538
augagcggccccgggaccgccgcuguggcacugcucccugccguccuucuggcguuguuagcuccaugggccggaagagguggcgcagccgcuccgacagcacccaacgggacucuggaggccgaacuagagaggcggugggaaucccucguugcucugucucuugcccgccugccuguggcggcacagccaaaggaggccgcuguacaaucaggagccggcgacuacuugcucgguaucaaacgacugcguagacuguauugcaauguggggauuggauuccaccuccaggcauuacccgauggcaggauaggcggggcucaugccgacacgcgggauagucugcuugaauugagcccugucgagcgcggagugguuuccaucuuugguguggcgucuagauucuuugucgccaugucgucaaagggcaaacuguacgggagcccauucuuuaccgacgaguguacauucaaggaaauucuacuccccaacaauuauaacgcauacgagaguuauaaauacccuggaauguuuaucgcucuguccaagaauggcaagacuaaaaaggguaacagggugucuccaaccaugaaaguaacacacuuccuuccgcggcuguga

SEQ ID NO: 56254 - RNA, 807 nt, Artificial Sequence
  derived and/or modified sequence opt3 from FGF5__Homo_sapiens__NP_004455
augagccuguccuuccuccuucuguuguuuuucucucacuuaauccugucagccugggcucauggcgaaaagagacuagcacccaaagggcagccuggaccagccgcgaccgacaggaacccgcgggguaguagcucccgccaaucuucgucaagcgcuaugaguuccucuagcgccuccucaagucccgcagccagccucggcucucagggguccggacuggaacagagcucauuucaguggaguccuucuggccgacguacagguucccuuuacugcagaguggggauuggauuccaucugcaaauauauccagauggcaaggucaauggcagccacgaggcuaacauguugucgguucucgaaaucuuugcagugucucaggggauuguaggaaucagggguguguucuccaauaaauuucuggccaugucaaagaaaggcaagcugcacgcuagugccaaguucacugacgauuguaaauuucgggagcgcuuccaggaaaacagcuacaauacguaugcguccgcaauucauagaaccgagaagacagggagggagugguacgucgcccucaacaaacggggaaaggcuaaacgcggcugcucuccccgagugaagccucagcacaucagcacucacuuuuuaccaagauucaagcaaucagaacagcccgagcugaguuuuaccguuacagugccugagaaaaagaaaccaccgucccccauaaagccuaaaaucccacuuagcgcccccaggaagaauaccaacucugucaaauaucgguugaaguuccguuucgguuga

SEQ ID NO: 56255 - RNA, 627 nt, Artificial Sequence
  derived and/or modified sequence opt3 from FGF6__Homo_sapiens__NP_066276
auggcccugggccagaagcuguucaucaccaugagcagaggggcuggaaggcuucaagguacacugugggcauugguguuuuuaggcauucuggucgggaugguugugcccuccccugccggaacucgggcgaacaauacgcuacucgacucucgcggcugggguacccugcuuucacgaagucgugcugggcuggccggagagauagcaggcguaaacugggaaagcggcuacuugguggggaucaaaagacagaggcggcucuauugcaaugucggaauugguuuccaccuccaggugcugccagauggccgcaucuccgggacacaugaggaaaacccguacucucucuuagagauuucgacuguugaaagaggaguggucucacuguuuggcgugaggagcgcccuuuucguagcuaugaauaguaagggucgguuguaugcaacccccuccuuucaggaggaguguaaauuccgcgaaacacugcuaccuaacaauuacaacgccuaugagucugaccucuaccaagggaccuauaucgcucugagcaaguacggacgaguuaaaagaggcuccaaggugucaccaauaaugacugucacacacuuucuucccaggaucuga

SEQ ID NO: 56256 - RNA, 585 nt, Artificial Sequence
  derived and/or modified sequence opt3 from FGF7__Homo_sapiens__NP_002000
augcacaaguggauccugaccuggauucuccccacacuucuguacagaagcugcuuccauauaaucuguuuggugggcacuauuuccuuagccugcaacgacaugacgccugagcagauggcuaccaaugucaacuguucuucaccagaaaggcacacacggaguuaugauuacauggagggaggagacauccgcguucgacgucuguuuugcagaacucaaugguaucuaaggauugauaaacgggguaaggugaaaggcacccaggaaaugaagaauaacuacaauaucauggagauacgcacaguagcaguggggaucgucgccauuaaaggaguggaaagcgaguucuaucucgcgaugaacaaggagggcaagcuguacgcuaaaaaggaauguaaugaggacugcaacuuuaaagaacuuauccuggagaaucauuauaacaccuacgccuccgcaaaguggacucacaaugguggggagauguucguugccuugaaccagaaagggauuccggugagaggcaagaagaccaaaaaggaacagaaaacagcucauuuucuccccauggcaaucacguga

SEQ ID NO: 56257 - RNA, 648 nt, Artificial Sequence
  derived and/or modified sequence opt3 from FGF8__Homo_sapiens__NP_006110
augggcagccccagauccgcccugucuugccuccuucugcacuuguuagugcugugucuacaggcucaagucaccguucagucaaguccuaacuucacacagcaugugagggagcagagccucguaacugaccaacugucccggcgccuuauccgaacguaccagcuguauucucguaccucggggaagcacgugcaggucuuggcaaauaaaagaauuaacgccauggcggaagauggagacccauuugcuaagcucauaguggagacagauacuuucgguucaaggguucgggugcgcggcgccgaaaccgggcuguacaucugcaugaauaaaaagggaaaacugauugcaaagagcaacggcaaggguaaagacugugucuuuacagagaucgugcucgaaaauaacuauaccgccuuacagaaugcuaaguacgaggggugguauauggcauucacuagaaaaggaaggccgcggaagggcaguaaaacacgccaacaucagcgagagguacacuuuaugaagagacugcccaggggccaucacaccacggaacagucccuucgguucgaguuuuugaacuacccuccauucacucguucucugcgcgggagccagagaaccugggcccccgaaccuagguga

SEQ ID NO: 56258 - RNA, 627 nt, Artificial Sequence
  derived and/or modified sequence opt3 from FGF9__Homo_sapiens__NP_002001
auggcuccccugggcgagguggggaacuacuucggaguccaggacgccguuccuuuugguaaugugccaguacucccgguggauagccccguccuucuguccgaccacuugggccaaucugaagcagggggauuaccuagaggcccagccgugaccgaucuggaccaucuaaaggguauccucaggcggcgccagcuguauugccgaacaggguuccaccuugagauuuuucccaacggaacuauacagggcacgcguaaagaucauucaagauucggcauccuggaauuuauuaguaucgcgguuggguuggugagcauuaggggagucgacuccggucucuaccugggcaugaaugagaagggggaacuguauggaucugagaaacucacccaggaguguguguuccgggaacaauuugaggaaaacugguacaauacauauucgucaaacuuauacaagcacguagauacuggccgcagauauuacguugcucugaauaaagacgguaccccuagggaggggacacggaccaagcgccaucagaaguucacucacuuucuuccacgacccguggauccugacaaagucccagaguuguacaaggauauccugagccagaguuga

SEQ ID NO: 56259 - RNA, 705 nt, Artificial Sequence
  derived and/or modified sequence opt3 from FGFBP1__Homo_sapiens__NP_005121
augaagaucugcagccugacccuccuuuccuuccuguuguuagccgcucaggugcugcuagucgagggcaaaaagaaaguuaagaacgggcuccacucuaaagugguaucagaacaaaaggacacacugggaaauacucagauuaagcagaaaaguagacccgguaacaagggcaaauuugugacgaaggaucaggcaaauuguaggugggccgcgaccgagcaagaagaggggauaagccuuaaagucgaaugcacacagcuggaccaugaguucuccuguguguuugcuggaaacccuacuucuugcuugaagcucaaggaugagcggguuuacuggaaacagguggcccgcaaucugcgaucgcagaaggacaucugucguuauucaaaaaccgcagucaagacaagagugugcaggaaagauuucccagaaagcagucugaagcucguauccucuaccuuauuuggcaacacuaaaccgcggaaggagaagacagaaaugagcccccgcgagcacauuaaagguaaggagaccacgccuuccucacuggccguuacucaaaccauggcuacaaaagcaccagaauguguggaggaccccgauauggccaaucagagaaagacugcucuugaguucugcggggaaaccuggaguagcuuguguacauuuuuccugucuaucguccaggacaccuccugcuga

SEQ ID NO: 56260 - RNA, 672 nt, Artificial Sequence
  derived and/or modified sequence opt3 from FGFBP2__Homo_sapiens__NP_114156
augaaguucgugcccugccugcuccuugucacccugagcuguuugggcacauuagggcaggccccuagacaaaaacagggauccacuggugaggaauuucacuuccagacgggcgggagggacucuugcaccaugcggccaucaagucugggacagggcgcuggugagguuuggcuacgcguggauugucgaaacacagaccaaacuuacuggugcgaauaucgugggcagccgagcaugugucaggcauuugccgcggaucccaagccuuacuggaaucaggcucuccaagagcugagaaggcuucaucacgccugccagggagcaccaguacugcggcccuccgugugucgcgaagccggcccucaggcucauaugcagcaagucaccucuucguugaaaggcucaccagagcccaaccagcagccugaggcagggacaccaagccucagaccgaaggccaccgugaaacugacugaagcuacacaacugggaaaggacaguauggaggaacucgguaaggccaaacccaccacgaggccuacugcgaagccaacccagcccggcccucggccagggggaaaugaggaggccaaaaagaaagcaugggaacacugcuggaagcccuuccaggcuuuaugugccuuucugaucuccuucuuucgcggcuga

SEQ ID NO: 56261 - RNA, 777 nt, Artificial Sequence
  derived and/or modified sequence opt3 from FGFBP3__Homo_sapiens__NP_689642
augacacccccuaagcugagagccagccucuccccaucucuucuguuguuacugucaggcugccuacucgcugcagccaggcgggagaaaggggcggcuaguaacguggccgaaccgguccccggaccuaccgguggcagcuccgggcgcuuccugucuccagagcagcacgcauguucguggcaacuucuguugcccgccccugaagcugcagccggaucagagcucgcucugcgaugccagagcccagacggcgcccgucaucagugugcguacagaggucaccccgaaaggugcgcagccuaugcugcccggcgcgcacauuuuuggaagcagguucucgggggacugaggaaaaagagacggccuugucacgauccagcuccguuacaagcccgccugugcgcgggcaaaaagggccauggggccgagcuucgauuggugcccagagcaaguccuccagcuaggcccacuguagccggauucgcuggugaguccaagccucgggcccguaaucgcggcagaacgagggaacgggcaucugggccagccgcuggaacacccccgccucagagcgcgcccccaaaagagaacccuuccgaacgaaagaccaaugagggcaaacgcaaggcagcccuggugcccaacgaggaaagaccaauggguacugggcccgacccugauggacuagacggcaaugcugagcucaccgaaacauacugugccgagaaauggcacucacugugcaacuuuuucgucaauuuuuggaacggcuga

SEQ ID NO: 56262 - RNA, 2439 nt, Artificial Sequence
  derived and/or modified sequence opt3 from FGFR1__Homo_sapiens__NP_001167535
auggccgcugugaccagagacuucggcgagaugcugcuccacagcgggaggguccuucccgcagaagcccagccuuggggagcgccaguugagguggaauccuuucugguacauccgggugauuuguuacaacugcggugccgccuacgagacgaugugcagucuaucaacuggcuccgugacggcguccagcuggcugagucaaauagaacaaggauuacuggggaagagguggagguucaggauagugugcccgccgacagcggacuuuacgcaugugucacguccucuccuucgggcucagauaccacauauuucagcgugaacguaagugacgcccugccauccucugaagaugacgaugacgaugacgacagcuccucagaggaaaaggagacugauaauaccaaacccaaccggaugccuguugcuccauacuggacaagucccgagaagauggagaaaaaguugcacgcagugccugccgcuaaaaccgucaaguuuaagugcccaagcucugguacuccgaaucccacacuccgcuggcugaaaaacgggaaggaguucaaaccugaccauagaauaggaggcuauaaggugagguacgccaccugguccaucauuauggauucaguggucccaagcgacaaaggcaauuauacguguaucguugaaaacgaguacgggaguauuaaucacacuuaucaacuggaugugguagaacggucuccccaucgcccuauccuccaggcgggauuaccagcaaacaagaccguggcccuggguuccaaugucgaguuuaugugcaagguguacagcgacccccagccgcacauacaguggcuuaaacacaucgagguuaacggcucgaagauugggccugauaauuugcccuacgugcaaauccugaaaacagcuggagucaacacuaccgacaaggaaauggaggugcuacaucuccgaaauguaucuuucgaagaugccggcgaguauacaugucuggcagguaacuccauugggcuuucacaccauagugcuuggcugaccguuuuggaagcccucgaggagagaccagcggugaugacgagcccucuguacuuagaaaucauaauuuauugcacuggagccuuucugaucuccuguauggucggcucugugauugucuacaaaaugaaaagcggcacaaagaagucagacuuccacagucagauggcagugcacaagcucgcuaaauccaucccccuuaggcggcagguuagcgccgauucuucagcuaguaugaacagcggggugcuguugguacguccaucccgccuaucuucgagcggaacccccaugcuggccggugucuccgaguaugaacucccugaggacccaagaugggaacugccgagggaccggcuugugcugggcaagcccuugggggagggaugcuuuggccagguugugcucgcagaggccaucggucuggauaaagacaagccuaaucgagucacuaaaguggcuguaaagauguuaaagucagaugcgacagaaaaagaccugagugaucuaauuucugagauggaaaugaugaagaugauagggaaacauaagaacaucauuaaucuccugggcgcauguacccaagacggaccacuuuacgugaucguugaguaugccagcaaaggcaacuugcgcgaguaccugcaggcuagaaggcccccugggcucgaauacugcuauaauccaucccacaaccccgaggaacagcugucaagcaaggaucuugucucuugugccuaccaaguggcacggggaauggaguaucuggccuccaagaaaugcauacaucgcgacuuggcugccagaaaugugcucgucacggaagauaacguuaugaagauugcagacuucggucuggcgagggauauccaccauaucgacuacuauaaaaagaccacaaauggccguuuaccggugaaauggauggcuccugaggcccuguuugaucggauuuacacucaccagagugacguguggagcuucgggguacuacucugggagaucuuuacccugggaggcucuccauaucccggugucccuguggaagaacuuuucaaguugcugaaggaagggcaccgaauggacaaacccuccaacugcacaaaugagcucuacaugaugaugagagauuguuggcaugcaguuccaucacagaggccuacuuucaagcagcugguggaagacuuagaucgcauugucgcccugaccaguaaccaagaguaccuugacuugagcaugccccucgaucaguauucgccauccuuuccggacacacggucuucaaccugcagcaguggcgaggauuccguguucucucacgaaccucugcccgaggaaccaugucuacccagacauccugcucagcuggccaauggaggccucaaaaggcgcuga

SEQ ID NO: 56263 - RNA, 648 nt, Artificial Sequence
  derived and/or modified sequence opt3 from FGFR1OP2__Homo_sapiens__NP_001165358
augagcugcaccaucgagaaggcccuggcugacgcaaaagcccucguggaaagacuuagggaucacgacgaugcggcugagucccugauugaacagacaacugccuugaacaagcgggucgaggcaaugaaacaauaccaggaagagauacaggaguuaaaugaaguugcccgccaucgaccccguucuacgcuggugaugggcauccagcaagagaacagacagauuagggaacuacagcaggagaauaaggagcuccggaccucacuggaggaacaccaaagugcucuugaacugaucaugagcaaauaucgcgagcagauguucagauugcucauggcauccaagaaggacgauccugggauuaucaugaaacugaaggaacagcauucuaaagagcugcaggcccacguagaccaaauaacagagauggcugccgugaugaggaaggcgaucgaaauugaugagcagcagggauguaaagaacaagagcggaucuuucagcucgaacaggagaacaaggguuuacgcgagauucugcagaucacucgagaaucguuccuuaauuugagaaaggacgaugcaucagagagcaccagucuguccgcccuagucacaaacucugaccucagccugaggaaauccuga

SEQ ID NO: 56264 - RNA, 1056 nt, Artificial Sequence
  derived and/or modified sequence opt3 from FGFR1OP__Homo_sapiens__NP_001265619
auggccgcuaccgcagccgcgguggucgcugaggaagacacagagcugagagaucuccuuguucagacucuggaaaacagcggcguguugaauaggaucaaggccgaguuacgggcagccguauuccuggcucuagaagaacaagagaaaguggaaaacaagacgccccucgucaaugagucccugaaaaaguuucuuaacaccaaagacgggcgccugguggcaucuuugguugccgaguuccuccaguuuuucaaucuggauuuuacacuggcuguguuccagccugagacuucaacccuccagggauuagagggucgagaaaaccuggcccgugaccuuggcauuauagaggcggaagggacagucggaggcccauugcugcuagaggugaucagaaggugccaacagaaggaaaaggguccgaccacuggggagaaagcaaaugaugaggccaaccagagugacacaagcguaucccucucugaacccaagucgaaaucaagccugcaccuucugagucaugagaccaagauuggauccuuuuugucuaaucggacgcucgauggcaaagacaaggcuggccuguguccugaugaagacgauauggagggggacagcuucuuugaugacccaauccccaagccugagaaaacuuacggauuacgcaaggaaccaagaaaacaggccgguucccuggcaucacucagugacgcucccccucuuaagagcggccugucuuccuuggccggggcgccaucacuaaaagauagcgagaguaagaggggaaacaccguucugaaagaccucaagcugauuucugauaagaucggcucccuuggucuggggacaggagaagacgaugacuauguggaugacuucaauagcacuucgcaccggucugagaaauccgaaauaucaaucggcgaggaaauugaggaggauuugagugucgaaaucgacgauauuaacaccagcgacaagacaaucacccaacucgagugccuguuauccauaggcgcccugcauuuuaaaaauacggcagacauuuucuga

SEQ ID NO: 56265 - RNA, 2466 nt, Artificial Sequence
  derived and/or modified sequence opt3 from FGFR2__Homo_sapiens__NP_000132
auggugagcuggggcagauucaucugccuggucguugugaccauggccacacucucccuugcuaggcccucuuuuucacugguagaggacacuacguuggaaccugaggaaccaccgaccaaguaccagauuagucaacccgagguguaugucgcagccccuggggaauccuuagaggugcggugucugcuaaaagaugcggcuguuauauccuggacaaaggacggagugcaccucgguccaaacaaucgcacuguccugaucggcgaguaccuucagauuaaaggggccacaccccgagauucuggacuguaugcaugcaccgccucgcguaccguggacucagaaacuugguacuucaugguaaacguuacagaugcuaucagcaguggcgacgaugaggacgauaccgacggugcagaagauuuuguguccgaaaauucuaacaauaagagagccccuuauuggacgaacacugagaaaauggaaaagagguugcaugcugucccagccgcgaauaccgugaaguuccggugucccgcagggggaaacccuaugccaacaaugcgcuggcucaaaaauggcaaggaguuuaaacaggaacacagaauuggcggguacaaggugaggaaccagcauuggagccugaucauggaguccgucguuccgucagacaaaggaaauuauacuugcgugguagaaaacgaguacgguaguauaaaucacaccuaccaucuggauguggucgagcggagcccccaccgcccuauccuccaagccggcuuaccagcuaacgccucuacagugguugggggagacguggaguucgucuguaagguguauuccgacgcacagccccacauucaguggaucaagcauguagagaaaaauggcucaaaguacgguccugaugggcugccauaucuuaaaguuuugaaggcugccggagugaacaccacggacaaagaaauugagguccuguacauccgaaacgugacuuuugaagaugcgggcgaguauacaugccuagccggcaauagcauagggauuaguuuccacucugcauggcucaccguccugcccgcuccgggaagagagaaggaaaucacugccuccccugacuaccuugagauugcuaucuauuguaucgguguguuucugauugccugcaugguugugacaguaauauuguguaggaugaaaaacaccacgaagaagcccgauuucagcucgcagccagcaguccauaaacucaccaagcggaucccucugcgucgccaagugacaguuucugccgaauccucaaguagcaugaauagcaacacucccuuagugagaauuaccacaaggcugucuagcacugcugacaccccaaugcucgcgggcgucucagaguacgaacuucccgaggauccuaaaugggaguuuccacgggacaagcugacauuggggaaaccgcuaggagaaggcugcuucggucaggugguaauggcagaggccguggggaucgauaaggacaagcccaaagaagcuguuaccgucgccgugaagaugcugaaagaugacgcaacugagaaggaccucagugaucugguguccgagauggaaaugaugaaaaugauaggcaagcacaagaauauuaucaaccuucugggagccuguacgcaggacggcccuuuguacgucaucguugaguaugcuagcaaagggaaucuccgagaauaccugcgcgccagaaggccacccggaauggaguauucuuacgauauuaaccgggugccugaggaacagaugacauuuaaggacuuagugucaugcaccuaucaacuggcacgcgguauggaguaccuagcgagucagaaaugcauccacagagaucucgcugccaggaauguacuggucacugaaaacaaugugaugaagauugcagacuucggccuugcccgugauauaaacaauaucgacuauuacaaaaagaccacaaacgggcgguugccaguuaaguggauggcucccgaggcccuguucgaucgaguguacacccaucagagcgacgucugguccuuuggagugcucaugugggaaauuuucacucugggcgguucuccguauccugggaucccaguugaggaacuuuuuaaacuguugaaggagggccacagaauggauaaacccgcaaauuguacaaacgagcucuacaugaugaugagggacugcuggcaugcugugccuucgcaacgccccacguucaagcagcugguagaagauuuagaccggauccugacccuaacuacaaacgaggaauaucucgaccugagccagccacuugagcaguacuccccuucauaucccgauaccagaaguucuuguagcuccggagacgauucagucuuuagcccagacccgaugccuuacgaacccugcuugccacaauauccccacauuaauggcucugugaaaacauga

SEQ ID NO: 56266 - RNA, 2421 nt, Artificial Sequence
  derived and/or modified sequence opt3 from FGFR3__Homo_sapiens__NP_000133
augggcgcccccgcuugcgcacuggcccucuguguggcggucgcuaucguugccggggcaagcuccgagucucuuggaaccgaacagagagugguagguagggccgcugaggugccuggcccagaaccggggcaacaggagcagcuggucuucggaucaggcgacgcaguggaauugaguugucccccuccaggugggggacccaugggcccuacaguuugggugaaggauggcacuggguuagucccaagcgagcgggugcugguaggaccccagcgccuacaaguucucaacgccucccacgaggacucuggugcuuacucgugccgacagcgucugacgcagagagugcuuugccauuuuucagucagggugaccgaugccccuagcaguggcgacgaugaagacggggaggaugaagcggaggacacaggaguggauacuggcgcaccauauuggacccggccggagcgcauggacaaaaagcuguuggccguccccgcugccaauacaguuagauucagguguccugcagcugguaacccaacccccuccauuucuuggcucaaaaaugggcgggaauuucgcggagagcaccgaauaggcggcaucaagcugagacaucagcaauggagccuggugauggaauccguagugccuucagauagggggaacuacacuugcgucguggagaauaaauucggaaguauucggcagacauauacccucgacguuuuagaacguagcccacaccgccccauccugcaggccggucuuccggcgaaccagacggccguguugggcucugaugucgaguuucauuguaagguguacuccgacgcacaaccucacauucaguggcugaagcacguagagguuaaugggucaaaagugggacccgacggcacuccauaugucaccgugcuaaagacagcuggugccaacacuaccgauaaagaacucgagguccugagccuucauaaugugacauucgaagacgcuggggaguauaccugccuggccggcaacaguaucggauuuucucaccauuccgcaugguugguugugcucccugccgaagaggagcugguagaagcugaugaggcgggcagcgucuacgcagggauauuaucguacggaguggguuucuuucuguucauccucguuguggccgcugucacgcuuuguagacugaggucucccccaaagaaaggcuuggggucccccacugugcacaagauuucacgguuuccucuaaagcgacagguaagucuggaaagcaaugccuccaugucuagcaacacaccacucgugcgcaucgcaagacugucaaguggagagggcccgacccuugccaauguuuccgaacuggaguugcccgcugacccuaaaugggagcucagcagggcccggcugacuuuagguaagccacugggggaaggcugcuucggacaagucgugauggcagaggcgauuggcaucgauaaagaccgcgcugccaagcccgugacagucgcaguuaaaaugcuaaaggaugacgccaccgauaaagaccucucugaucuggugucagaaauggagaugaugaagaugauagggaagcacaaaaacauuaucaaucuuuugggagcuuguacgcaggguggcccucuguacgugcucguagaguaugccgcaaaggggaaccugagagaauuucuuagggcucgucggccacccggacuggacuacaguuucgauaccugcaaaccgccugaggaacaguugacauucaaggaccucgucagcugcgccuaucagguggcgcgaggcauggaguaccuggccucccaaaaauguauucauagagacuuagcugcaaggaacguucuggugacugaagauaaugucaugaagaucgccgacuuuggucuagcucgcgaugugcacaaccucgacuauuacaagaaaaccacaaaugggcggcugccaguuaaguggauggcccccgaggcacuuuucgauagaguguauacucaucagucugacguauggucguuuggcgucuugcugugggagaucuucacccucggaggcagcccuuaccccgggauuccaguggaggaacuguuuaaauuacugaaggaaggacacaggauggauaaaccugcgaacugcacacaugaccuuuacaugauaaugcgcgaguguuggcacgccgcucccucccagcgaccaaccuucaagcaguugguggaagaucucgaccggguccugacuguuacgucaacagaugaguaucuagaccugagugccccguuugagcaauacucuccuggcggucaggacacccccagcuccucaagcucuggggaugacuccguguucgcacacgaucuccugccacccgcuccuccaaguagcggaggcucucguacuuga

SEQ ID NO: 56267 - RNA, 2205 nt, Artificial Sequence
  derived and/or modified sequence opt3 from FGFR4__Homo_sapiens__NP_001278909
augagacugcuccuugcccuguugggcguguuacugagcguccccgggccuccaguucuaucccucgaggcuucugaagagguggaacuggagccgugccuugcacccucacuggaacagcaagagcaggaguugaccguagcccucggacagccugugaggcuguguugcggucgggcggaacgcggcgggcacugguacaaggagggaagucgacuggcuccagccggccgugucagagguuggagggggcggcucgaaaucgcaucuuucuuacccgaggacgccggacgcuaucugugucuugcuagaggcuccaugauuguguugcagaaccugacacuaauaacuggcgauucucucacgucgucaaaugacgaugaggacccuaaaagccauagggauccaaguaaccggcacuccuacccccaacaggcaccuuauuggacccauccacagcgcauggaaaagaaacugcacgccguuccggcugggaauacagugaaguuucgaugccccgccgcgggaaacccuacuccaaccaucagauggcuuaaagacggucaggcauuccauggcgagaauaggauugggggaauccggcugcgucaccaacacuggucuuuggucauggaaagcgugguacccuccgaucgcggcacauacaccugucucguugagaacgccguggguucaauuagauauaauuaccuguuagacguccuggaaaggaguccucaucggccaauccuccaggcugggcuucccgccaacacuacagcaguggugggaagcgaugucgagcuguugugcaagguuuauucugacgcucagccgcacauacaguggcuaaagcauaucgugauuaauggcuccucauuuggcgccgauggguucccuuacguacaagugcugaaaaccgcggacaucaacagcagugaggucgaagugcucuaccugcgaaauguuucugccgaggaugcaggagaauauacgugucuugcugguaacuccauuggccugagcuaccagucggccugguugacugugcuccccgaggaagacccaaccuggacagcugccgcaccugaggccucuucccccuggucacaggcucugccagcgagucaagcacaccccugguaugaggccugcgucagcccuccagcugccccgcccuguuccccugcaucuuuagugcuggggaagccacuaggagaaggcugcuuuggucagguaguucgcgccgaggcuuucgggauggaccccgccagaccugaucaggcaagcacuguggcggucaaaaugcucaaggacaaugcuucagauaaagaccuggccgaucuugugagugaaauggaggucaugaaguugaucggcaggcacaagaacauaauuaaucugcucggaguguguacccaggaaggcccacuguacguuaucguggagugcgcagccaaagggaaccuucgggaguuucugcgcgcuagaaggcccccgggaccugacuuguccccagaugguccccguagcucugaaggcccucucucauuccccguacuggucaguugcgccuaucaaguggcacgggggaugcaguacuuagagagccgaaaguguauucauagagaccuggcugccaggaacguucuagugacagaagauaaugucaugaaaaucgcggacuuuggacucgcccgcggcgugcaccauaucgauuauuacaagaaaaccuccaacggucggcugccaguaaaguggauggcuccugaggcacuuuucgacagaguguacacgcaccagucugacguuuggucguuugggauuuugcugugggagauauucacucucggcggaagccccuauccaggcaucccggucgaggaacuguuuuccuuacugagggaagggcaucgcauggaucgaccuccccacugcccacccgagcuuuacggauugaugcgggaauguuggcacgccgcuccuucacagcguccaacauucaaacaacucguggaggcccuggacaaggugcuacuggcagucagugaggaauaucucgaucugagacuuaccuucggucccuacucuccuagcggcggggacgcguccucaacuugcagcagcuccgauaguguuuuuagccaugacccguugccacugggaucuuccucauuccccuuuggcaguggugugcagacauga

SEQ ID NO: 56268 - RNA, 1515 nt, Artificial Sequence
  derived and/or modified sequence opt3 from FGFRL1__Homo_sapiens__NP_001004358
augacccccagcccucugcuccuucuguuguuaccaccgcugcuacucggcgccuuucccccugcugcagccgcgagagggccacccaagauggcugacaaaguggucccuaggcagguugcccggcugggacgcacagugcgacuucaaugcccaguagagggugaucccccuccacugacuauguggacgaaggacggccguaccauccacuccggguggucuagauucaggguguugccgcagggacucaaagucaaacagguggaacgggaggaugcaggcguuuacguguguaaggccacaaacgguuucgggucacugagugucaauuauacucuggugguacucgacgauauuagccccggaaaggaauccuuaggcccugacucuucgucaggcgggcaggaggauccagcuagccaacagugggcacgccccagauuuacccagccuaguaagaugaggcggcgcguuauagcccgaccagugggauccucugucagacugaaaugcguggcuagcggucaucccaggccggacaucacauggaugaaggaugaccaggcccuuacccggccugaagcggcagagccccguaaaaagaaauggacuuugucccugaagaaccuacgcccagaggauucaggcaaguacacauguagagugaguaauagggccggggcuauuaacgccaccuauaaagucgacguuauccaacggacgcgaagcaagccugugcucacuggaacccaccccguaaauacaacuguggauuucggcgguaccacaucuuuucagugcaaaguccgcuccgacgugaagccaguuauucaguggcugaaaagaguggaauacggggcagagggaaggcauaacucaaccaucgacgucggcggccagaaguucgugguacuucccacgggggauguuuggagccggccugacggaaguuaucugaauaaauugcucauaacucgcgcuagacaagaugacgccgguauguacaucugucugggcgcgaacacaaugggguauucuuuuagguccgccuucuuaaccgugcugccagauccgaagcccccuggaccacccgucgcaagcucgucuuccgcuacuucacucccuuggccaguggucauuggcauccccgccggugcuguguuuauucuugggacacuguugcuauggcugugccaggcccagaagaaaccguguaccccugcaccagcucccccucuccccggccaccguccaccuggaacggcccgggaccgaaguggcgauaaggaccugcccagccuugcggcacuguccgccgggccaggaguugguuugugcgaggaacauggcucuccggcugccccucaacaccuccuggggcccggaccaguggcaggccccaaauuauacccuaagcuguacaccgauauccacacacauacucacacccauagccacacacacucacauguagaggguaaaguccaccagcauauacacuaucaguguuga

SEQ ID NO: 56269 - RNA, 1314 nt, Artificial Sequence
  derived and/or modified sequence opt3 from FGG__Homo_sapiens__NP_000500
augagcuggucccugcaccccagaaaccucauccuuuacuucuaugcccuguuguuuuuaucuucaaccugcguggcuuacgucgcaacaagggacaauuguugcauucuggaugagcgguucggcaguuauuguccuacuacgugcgggauagccgacuuucuaagcaccuaccagacaaagguugauaaagaccuccaaucccuggaagauauccuucaucagguggagaacaagacuucugaaguaaaacagcugauuaaggcgauccaguugaccuauaauccagacgagucgucaaaaccgaacaugauugaugcugccacacucaagagccgcaagaugcuggaagagaucaugaaauacgaggcaaguauacugacccacgacuccucuauccgauaucuccaagaaauuuacaauagcaacaaucagaagaucgugaacuuaaaagagaaggucgcccagcuggaagcucagugucaagagcccugcaaagauacugugcagauucaugacaucacaggaaaggauugucaggacauagcaaauaagggugccaaacaguccggccuuuacuucauuaagccuuugaaagcuaaccaacaguuucugguuuauugcgagaucgaugggucaggaaauggcuggaccguguuccagaagcgucuagacgguagugucgacuuuaaaaagaacuggauucaauacaaagaaggguucggacaccucagcccaacgggcacuaccgaguuuuggcugggcaaugaaaagauccaucuuaucucuacacaguccgccauucccuaugcgcugagaguggaguuggaagauuggaacgggaggacuucaaccgcagacuacgccauguucaagguaggaccugaggcugauaaauaucggcucacauacgccuauuuugcugguggcgacgcaggggaugccuucgacggauuugauuucggcgacgauccaagcgacaaguucuuuaccagucacaaugguaugcaguucucuacgugggauaacgacaacgacaaauuugaggggaauugugcggaacaggauggauccggcugguggaugaacaagugccacgccggccaucugaaugggguuuacuaccaaggagguacuuauagcaaagcaucgacacccaacggcuacgacaaugggauaaucugggcuaccuggaagacucgcugguauucuaugaagaaaacaaccaugaagauuaucccuuucaacagauuaacgauaggagagggccagcagcaccaucuggguggggccaaacaggcuggcgauguguga

SEQ ID NO: 56270 - RNA, 1086 nt, Artificial Sequence
  derived and/or modified sequence opt3 from FGGY__Homo_sapiens__XP_011540039
augagcggcggggagcagaagcccgaaagauacuaugugggagucgacguugguaccggcuccgugagggccgcucugguagaucaaucuggggugcuccuugcauucgccgaccagccuaucaaaaacugggagccacaguuuaaucaccaugaacagucaagugaggauauuugggcggcuugcugugucgugacaaagaaaguugugcaaggaauagaccugaaccagauccggggcuuggguuucgaugccacuugcagcuuagucgugcuggacaagcaguuucacccgcuacccguaaaucaggaaggggauucccaucgcaacguuauuauguggcucgaccaccgagcagugucucaagucaaucguaucaacgagacgaaacauucggugcugcaguacgugggaggcgucaugucaguugagaugcaggccccuaaacuucugugguugaaggaaaaucucagagagauuuguugggauaaggcuggccacuucuuugaccugccagauuuccugagcuggaaggcaaccggggugacagccaggagucucugcuccuuaguauguaaauggacuuauucugcugaaaagggaugggacgauagcuuuuggaaaaugaucggucuggaggacuucguggccgacaacuacuccaagauaggcaaucagguccuucccccuggggcgucauugggaaacggccugaccccagaggcagcccgggaucuaggucuccugcccgggaucgcuguggccgcaagucuuauugacgcucacgccggaggccugggcguuaucggggcggaugugcgcggacaugguuugauuugcgaaggccaaccugucacaagcagacucgccgugaucugugggaccucuuccugccacaugggaauaucaaaggacccaauuuuuguaccgggcguuuggggucccuauuucagcgcaauggugccuggguuuuggcugaaugagggcggacagagugucacuggcaaauuaaucgaucauauggugcaggggcacgcugccuucccagaacugcaagucaaggcuacagccaggucucccgacuga

SEQ ID NO: 56271 - RNA, 939 nt, Artificial Sequence
  derived and/or modified sequence opt3 from FGL1__Homo_sapiens__NP_004458
auggccaagguguucagcuuuauccuggucaccacagcucucacuaugggcagagagauuuccgcacuugaagacugcgcccaggagcaaaugaggcugcgggcgcagguucgcuuguuagaaacgcgagugaaacagcagcaaguaaagauaaaacagcugcuacaggagaacgaagugcaguuccucgauaagggggacgagaauaccgucaucgaucugggaucuaaacgucaauacgcugacuguucagagauuuuuaacgaugguuauaaacuuaguggcuucuacaagaucaagccccugcagagcccugccgaauuuuccguguauugcgacaugucugaugggggaggcuggacaguuauucagagaaggucggacgguucagagaauuucaaccggggguggaaggauuacgaaaauggauuuggcaacuucgugcagaaacacggcgaguauugguuggggaauaagaaccuccauuuucugacuacccaagaggacuacacacugaaaaucgaucucgcagacuucgaaaagaauagccgcuaugcccaguacaagaacuuuaaagucggagaugagaagaauuucuacgaauuaaacauaggugaguauaguggcaccgcuggggacucccuggcaggaaauuuucacccagaagugcaguggugggccucucaucaaagaaugaaauucagcacuugggacagggaucacgacaacuacgagggcaauugugcugaggaagaucaguccgguuggugguucaaccggugccauucagccaaccuuaaugggguauauuacaguggaccguauacagcgaagaccgacaacggcaucguuugguacacguggcacggcuggugguauagcuugaaaucuguggucaugaagauucgccccaaugauuuuaucccuaacgugauuuga

SEQ ID NO: 56272 - RNA, 1320 nt, Artificial Sequence
  derived and/or modified sequence opt3 from FGL2__Homo_sapiens__NP_006673
augaagcuggccaacugguacuggcucagcuccgcugugcuugcaaccuauggcuuccuggucguugccaauaacgagacagaagagaucaaagacgaaagagcgaaggaugugugccccguaagguuggagucucgggggaaaugugaagaggcuggagagugcccuuaccaggugucauuaccaccgcugacuauucaacuacccaagcaguuuagucgcauagaagaggucuucaaagaagugcagaaucucaaggagaucguuaacagccugaagaaauccugucaggacugcaaacuucaagccgaugacaauggugauccuggccgaaacgggcuguugcucccaucuacgggagcacccggcgaggugggugacaaucgugucagagaacuggagucggaagugaacaagcugucaagcgagcucaagaaugccaaagaagagauuaacguauuacacgggaggcuggagaaacuuaauuugguuaacaugaauaacaucgaaaauuauguggauaguaaggucgcuaaccugaccuuuguggugaacucccuagacggaaaguguucuaagugcccuagccaggagcagauucagucccggccaguccaacaucucaucuacaaagauuguucagacuauuacgcaauaggcaagcgcaguagcgaaacauauagaguuacucccgauccuaaaaauucuuccuucgagguguacugcgacauggaaaccaugggcgggggauggacaguacugcaggccaggcuugaugguucaaccaacuuuacucggacauggcaggacuacaaggcuggcuucgggaaucugcgccgagaguuuugguugggaaacgacaaaauccaccuccugaccaagagcaaggagaugauuuuaagaaucgaucuggaagacuucaauggcguggagcucuaugcccuuuacgaucaguuuuaugucgcgaacgaguuccugaaauacagguugcauguggguaauuauaacgggacggcaggagacgcccuacgguuuaauaagcacuacaaccaugaucugaaauucuuuacuaccccagacaaggauaaugaccguuauccgaguggcaacuguggccucuacuacucuuccggguggugguucgaugcuugccugagcgccaaucuuaacggaaaauauuaccaccaaaaguaucgcgguguuagaaauggcauuuucugggggacauggcccggagugucggaagcacacccuggcgguuacaagucuuccuuuaaagaagcuaagaugaugaucaggccaaaacauuucaagcccuga

SEQ ID NO: 56273 - RNA, 1383 nt, Artificial Sequence
  derived and/or modified sequence opt3 from FGR__Homo_sapiens__XP_011539313
augggcugcguguucuguaagaaacuggagcccgucgccaccgcuaaggaagacgcagggcucgagggagauuuuagaagcuacggugccgcggaccacuauggcccugauccaacaaaagcuaggccggccuccucuuucgcacauauccccaacuacucaaauuuuaguagccaggccauuaacccuggguuccuugacuccggaacuauacggggcguuucugugaagguaacgggugggcgccugggauugucggcuccagaaaaauuagcagccuuucccgcuaccacauggccucugcuaacucaaucaaagcucaagagcgccuauagucuguccauccgagauugggaccagacccguggcgaucacgugaaacauuacaagauuagaaaacuugacaugggcggguauuacaucacaaccaggguccaguucaauucugugcaggagcugguucaacacuauauggaagugaacgauggauugugcaaucuccugauugcgccauguacuaucaugaagccccagacacugggucucgcaaaagacgccugggagauaagccgguccucaaucaccuuagagcgcagacugggcacggggugcuuuggagaugucuggcuuggcacuuggaacgguaguaccaagguggcuguaaagacauugaaaccugggacuaugagcccaaaggccuuccuggaagaggcacagguuaugaaacuacucaggcaugacaagcuggugcagcuuuacgcugucgugucugaggaaccgauuuacaucgugaccgaguuuaugugucacggaucccuguuggauuuccucaaaaaucccgaaggccaagaccugcgguuaccucagcuggucgacauggccgcgcagguugccgagggcauggcauauauggaacgcaugaacuacauucaccgagaucucagagcugccaauauccuugugggggagaggcuggcuugcaagauagccgacuuuggauuggcacggcuaauuaaagaugacgaauauaacccaugucaggguucaaaguuccccaucaaguggacagccccugaggcugcgcuguuuggccguuucaccauuaaaagcgauguauggaguuucgggauccuccugacggagcuuaucacuaagggacgcauuccauaccccggcaugaauaaaagagaagugcuggagcaagucgaacaggguuaucauaugccgugcccucccggguguccagcaucuuuguacgaggccauggaacagacauggaggcucgacccugaggagcggcccaccuuugaauaucugcaauccuucuuagaggauuacuuuacuagcgcugaaccacaguaccagcccggcgaccagacauga

SEQ ID NO: 56274 - RNA, 3432 nt, Artificial Sequence
  derived and/or modified sequence opt3 from FHDC1__Homo_sapiens__NP_203751
augcacgugaugaacugcgucagccugguuuccgacaaggagaauggcaacaucgccaccgcucccggguucaugauuggacagacaccuccaccggcacccccuccacccccuccacccccuccaccgucucccccuuguucaugcaguagagaagaguguccaagcuccccgccuccacccccgccucccccacucccuggugaacccccaauacccccuccaccgcccggccuuccuccaacuacgcauaugaauggguacucucaccugggcaaaaagaaaaggaugcggucguuuuucuggaagaccauccccgaggaacaagugcgcggcaaaacaaacauuuggacuuuggccgcgcgacaggagcaucacuaucagaucgauaccaagacaauugaggaauuauuuggucagcaagaggacaccacuaagucaagccugccucguagagggaggacacuaaauaguuccuuccgggaagcucgcgaggagaucaccauacucgaugccaaaagaucuaugaacaucggaauuuuucugaagcaguucaaaaagagcccaagguccaucguagaagacauucaucagggcaaaucagagcacuacggcagugaaacgcuucgggaguuucugaaguucuugcccgaaagcgaggaggugaagaaacucaaggcauuuucuggggaugucuccaaacugucacuggccgacagcuuccucuauggauuaauccaggugccgaauuacagucugcgcauagaagcuaugguucuuaagaaagaguuuuugccuucuugcuccagccuguauacugauauuaccgugcuacgaacagcaaucaaggaacucaugucgugugaggaacugcacucuauucuucaucuggucuugcaagccgguaacaucaugaaugcuggcggguacgccggaaacgcggugggcuucaaacucuccucacuguuaaagcuggcagacacuaaggccaauaaaccagguaugaaccuccuucacuuuguagcucaggaggcccagaagaaagauaccauccuguugaauuucagugagaagcuacaucacguucagaaaacagcaagacugagccucgaaaacaccgaggcugaacugcaccuucuguucgugaggacgaaguccuugaaggagaauauucaacgggacggggaacucugccagcagauggaggauuuucugcaauucgccauagagaaauuacgugaacuggaguguuggaagcaggaacuacaggacgaggcguauacucucaucgacuuuuucugcgaggauaaaaagacaaugaaacuggacgaauguuuucagauuuuccgcgauuuuugcaccaaguucaacaaggccgucaaagacaaccaugauagagaggcacaagaacuuaggcaguugcagcggcugaaggagcaggaacaaaaacagcgaucuugggcuacuggagagcucggcgccuuuggccgcagcucaagugagaaugacguggaacugcuuacaaagaaaggggcugagggacuguugcccuuccuccacccuagacccaucuccccaagcucuccuucauacaggcccccaaacacccggcgcaguagacugagcuuagguccguccgccgauagggaacugcuaacguuucucgagucuucgaccggcagcccugaggaacccaauaaguuccauucccugccacguucaaguccccggcaggcacgaccuacaauagccugucuugagccagcugaagugagacaccaggacucuagcuuugcgcauaagccccaagcauccgggggacaggaggaagccccuaacccgccaucagcucaggcccaccaguuggcagccgcucaacccgagaaucacgccagcgcauucccuagggcgcgccggcagggcgucucuguucugagaaaaagguacuccgaaccagugagucucgguagcgcucagucucccccucuguccccguuagcccuggggauuaaggagcaugagcuuguaacuggcuuggcacaauucaaccuccagggaucacagggcauggaagagaccagucagcugacacuaagcgauuuuucgcccauggaacuggaguccguggggcaccgcggaccacaaucucucagcgccucaaguuccucucugacuccuaugggucgagacgcucuuggcagcuugucccccgcccuggaggaugggaaagcagcuccagacgaaccuggaucagccgcguuaggcagcgucgguaguucugaucccgagaauaaggacccacggccccucuucugcaucuccgacaccacagauugcagccugacccuugacuguucggaagggacugauucacguccuagaggcggagaccccgaggaaggcggggagggagaugguucuaugaguuccggcgugggggagaugggagacagccagguuucuagcaacccaacguccucacccccuggcgaagccccagcucccgugagugucgauagcgagccuucuugcaaaggugggcugccgagggacaagccaacaaaacgcaaggaugugguagcacccaagcggggcuccuugaaagaagccucaccuggagcuaguaagcccggcagcgccagaaggucccagggggcaguugcgaaaucugugcgaacccucacugccucggagaaugaaagcaugcgcaaggucaugccaaucaccaaaucaucccggggagcuggcuggagaaggccugagcugaguucucguggucccagccagaacccaccuuccucaacagacaccguguggucucgccaaaauagcguccggagagccaguacuggggcagaggaacagaggcuaccgcgaggauccagcggaucuucauccacacggcccggucgcgaugugccacugcagccuagaggcaguuuuaagaagcccagcgcuaaaccacucaggaaccugccucggcagaagcccgaggaaaauaaaacgugucgagcccauucggaggggccggaaucuccaaaggaggagccuaaaacccccuccguuccaagcgugccccacgaacuuccuagaguaccgucauucgcacgcaacacugucgccaguucuuccaggagcaugcguacagacuugcccccaguggcuaaggcgccuggaauuacccggacaguuucacaaagacagcugagggugaagggcgaucccgaggacgccgcaccuaaagacaguagcacuuuacgccgagcuuccucugccagagccccaaagaaacggcccgaaagcgcugaggggccuuccgcaaauaccgaggccccacucaaggcgaggggagcuggcgaacgcgccucacugcguagaaaagauucuagucggacgacccuugguaggauccugaacccccuacgcaaguga

SEQ ID NO: 56275 - RNA, 1533 nt, Artificial Sequence
  derived and/or modified sequence opt3 from FH__Homo_sapiens__NP_000134
auguacagagcccugaggcuccuugcucggagccgcccccuggugcgagccccugcagcggcuuuggccuccgcaccaggcuuagggggagccgcugucccgucuuucuggcccccuaacgcagcccguauggcuucacagaauaguuuuagaaucgaguaugacaccuucggugaacugaagguuccaaacgauaaauacuauggcgcccaaacagugaggagcacuaugaauuuuaagauugggggaguaacggagcggaugcccaccccugugauaaaagcguucggcauccuaaagcgcgcagccgcugaagucaaccaggacuacggucucgauccaaaaauugccaaugcaaucaugaaggcugccgacgagguggcggaagggaagcugaacgaucacuuuccccuuguuguguggcagacaggauccggcacucagaccaauaugaacgucaaugaggugauuucuaacagagccaucgagaugcugggcggggaauugggaucgaaaauaccuguacauccaaaugaccacguuaacaagucacaaagcaguaaugauacauucccgaccgcaaugcauaucgcugccgcuauugaggugcacgaaguccuccugcccggucugcagaaacuccaugacgccuuagaugcaaaguccaaagaguuugcccagaucauuaagaucggcaggacucacacacaggacgcugugccucugacccuugggcaagaguucucuggauaugugcagcaggucaaguacgcgaugacgcggauaaaagcagccaugccacgcauuuaugaauuggcugccggcgguacugcaguugggaccggacugaacacacgaaucggcuuugccgagaagguggcugccaaaguagcagcgcuaacuggccuccccuucgugaccgcuccuaauaaguuugaagcccuggcagcccacgaugcucuugucgagcugagcggggccaugaacacaaccgcaugcuccuugaugaaaauugcuaacgacaucagauuccucggaucagguccaaggaguggccugggggaauuaauccugcccgagaaugagccgggaagcucuauuaugccuggcaaggugaaccccacgcagugugaagccaugacuaugguugcggcccaagugauggguaaucaugucgcugugacaguagggggcuccaacggacacuuugagcucaauguuuucaaaccaaugaugauaaagaacgugcuucauucagcacggcuguugggcgaugccagcgucaguuucaccgaaaauugcguggucgggauccaggcuaacacugagcguauuaauaagcuaaugaacgaaucucugaugcucgugacagcccugaauccucacaucggauacgacaaagcagcgaagauagccaaaaccgcucacaagaacgguuccacgcuuaaagagaccgccauugagcugggcuacuugacagcagaacaguuugacgaguggguuaagcccaaggauaugcucgggccaaaauga

SEQ ID NO: 56276 - RNA, 444 nt, Artificial Sequence
  derived and/or modified sequence opt3 from FHIT__Homo_sapiens__NP_002003
augagcuucagauuuggccagcaccugaucaagcccuccguggucuuccucaaaaccgagcuuucuuuugcccugguuaacaggaagccugugguaccagggcauguguuggucugcccguuacggcccguggaacgcuuccacgaccugcgaccugaugagguugcugaccuauuucaaacaacucagcgugugggaacggucguggaaaaacauuuccacgguaccucacucacauuuaguaugcaggauggcccagaggcagggcagacuguaaagcauguucacgugcacguccugcccagaaaagccggagacuuccauaggaaugauagcauuuacgaggaacuucaaaagcacgacaaggaggauuuuccugcguccuggcggucugaagaggaaauggcugccgaggcagccgcucugcgcguguauuuccaguga

SEQ ID NO: 56277 - RNA, 891 nt, Artificial Sequence
  derived and/or modified sequence opt3 from FHL1__Homo_sapiens__NP_001153171
auggccagccacagacauuccggccccucuucauacaagguggggaccauggcugagaaauucgacugccacuauuguagggauccucugcagggaaagaaauacguccaaaaggacggucaucacugcugucucaaaugcuuugauaaguucugugcaaacacaugcguugaaugucggaagccaaucggcgccgacaguaaagaggugcauuauaagaaucgcuuuuggcacgauacuugcuuccgaugugcgaaaugccuucacccgcuggcuaacgaaacguuuguagccaaggacaauaaaauuuuguguaacaagugcaccacacgugaggauagccccaagugcaaaggguguuucaaggcaauaguggccggagaccagaaugucgaauacaaaggcacuguguggcauaaggauugcuuuaccuguuccaacugcaaacagguuaucgguacagggucuuucuuuccuaagggagaggacuucuauugugugaccugccacgagacuaaauuugcuaagcauugugucaagugcaauaaagcaauuacaucgggcggcaucaccuaccaggaucaaccauggcacgccgacuguuucgugugcguaacguguucaaagaaauuagcugggcagagauuuacugccguugaagaucaguauuacugcguggacugcuacaagaacuucgucgcgaaaaagugugcaggaugcaagaaucccauuaccgguuucggcaaagggagcagugugguggccuaugagggacaguccuggcacgacuacuguuuucauugcaagaaauguucugucaaccuggcuaauaagagguucguuuuucaccaagaacagguguauugcccugauugugccaaaaagcuauga

SEQ ID NO: 56278 - RNA, 1170 nt, Artificial Sequence
  derived and/or modified sequence opt3 from FHL2__Homo_sapiens__XP_005263959
augaccagaaggggcuucagccgggccggggcugcacagcgcuccacacgacccgccgcggagccucaaccaccggcugcccgugcacugcagcccagaccuggagugccagguccccucaggugccgggaauaccuucagccuccagcuccccgcagagaggccgaaggccugucucaccaggggucagaggucggagcagaaaguggcgccaggccuaaggagcggggugcugagccagaauuggggcgcuuauggcugcgaacuguuagcuccuggagacuaggauggcauuuugacuucggcguggccgagaaaccgggcguaaagaugacggaaagguuugauugucaccauugcaacgagucucucuucgggaaaaaguauauccugcgggaggaaucgcccuacuguguggucugcuuugagacccuuuucgcgaauacaugugaagagugcggaaaaccuauugguugugacugcaaggaucugucauauaaggaccgucacuggcaugaagcauguuuucacugcagccaaugucgcaacaguuugguggauaaaccauucgccgcuaaggaggaccagcuccugugcacugauugcuacuccaaugaguauucuagcaaaugucaggaaugcaagaaaaccauaaugcccggcacaagaaagauggaguacaagggguccucauggcacgaaaccuguuuuaucugccauaggugucagcaaccuauuggaacuaaaaguuucaucccaaaggacaaccagaauuuuugcguucccuguuaugagaaacagcacgccaugcagugcgugcaauguaagaaaccgauuacaaccggcggugucacguaccgggaacagccuuggcauaaggagugcuucguguguacugcaugccgaaaacagcugagcgggcaacgcuuuaccgcuagagaugacuucgccuacugccucaacuguuucugcgauuuauaugcgaagaagugugccggaugcacaaaucccaucucuggccugggcgggacuaaauacauauccuuugaggaaaggcaguggcacaacgacuguuucaauugcaagaaauguucacuuagcuugguaggacgggguuuucugaccgagcgcgaugacauccuaugcccagacuguggcaaggauauuuga

SEQ ID NO: 56279 - RNA, 855 nt, Artificial Sequence
  derived and/or modified sequence opt3 from FHL5__Homo_sapiens__XP_006715676
augaccacagcccacuucuacugccaguauuguacugcuagccugcucggcaagaaauacgugcuuaaggacgauucccccuauugcgucacguguuacgacagaguuuucucuaacuauugcgaggaauguaaaaagccuaucgagucagauaguaaagaccugugcuacaaggauaggcauuggcacgaaggguguuucaagugcaccaaauguaaucauagcuugguggagaagccauuugcagccaaagacgaacgguuacugugcacagaguguuauuccaacgaguguucuucgaagugcuuccacugcaaacgcacuauuaugccgggaucacgaaagauggaauuuaaggguaauuacuggcaugagaccugcuucguaugugaaaacugccgucaacccauaggcacaaaaccucuaaucagcaaggagagugggaauuacugugugccaugcuuugagaaagaauuugcgcacuauuguaacuuuugcaagaaagucauuaccuccggaggcaucacuuucugugaucagcucuggcacaaggagugcuuucuguguucugguugcagaaaagaccuuugcgaggaacaguucaugagcagggaugacuaccccuuuuguguggauugcuauaaucaucuguacgcuaacaaguguguugccugcuccaagccuauuucaggguugacaggagcaaaauucaucuguuuccaggacagucaauggcacagcgaaugcuuuaauuguggcaagugcucugugucccucgucggcaaaggguuccugacccagaacaaggagauauuuugucagaaaugcggaucagguauggauacggacaucuga

SEQ ID NO: 56280 - RNA, 3495 nt, Artificial Sequence
  derived and/or modified sequence opt3 from FHOD1__Homo_sapiens__NP_037373
auggccggcggggaggacagaggagauggugaacccgugagcgucguuaccgugaggguacaguaccuggaggacacagauccuuucgcuugcgcaaacuuuccagaaccgcggcgcgcccccacuuguucccucgacggcgcgcuuccucugggggcucaaaucccagccgugcaccgauuguuaggagcaccccugaagcuagaggauugcgcccuccaggucucuccuucaggcuauuaccuggacacggaacuuagucuggaggagcagcgugaaauguuggaggguuucuaugaagagauuagcaaagggagaaagccaacccucauacugaggacacagcuguccgugcggguuaaugcuauccucgagaaauuauacucuucgucaggacccgaacugcgcagaagccuuuuuaguuugaagcaaauuuuccaggaggauaaagaccuggugccugaauuuguccauuccgagggccuaucuugucucaucagggugggcgcagccgcugaucacaacuaucagagcuacauucugcgggcccuugggcagcugauguuguucguagacggaaugcucgguguuguggcgcauuccgauacuauccaauggcuguauaccuuaugcgcaucacugagucgccucgucgugaagacagcccuuaagcuguugcuaguguuugucgaauacagcgagaauaacgcuccacuguucauacgagccguuaauucuguggcauccaccacuggcgcuccgcccugggccaaccucguaucaauccuggaggaaaagaauggggcggacccugagcuucugguguacacagucaccuugauuaacaagacgcucgccgcacugccagaucaggacagcuuuuaugacgugacugaugcuuuagaacagcagggaauggaggcccugguucaaagacaccuaggcaccgcugguacagacguggaucucaggacucagcugguccuuuacgaaaaugccuugaaacuggaggacggggauaucgaggaagcacccggagccggcggccggcgugagcgcagaaagccuaguucugaagaggggaaaaggucccggcgaagccucgaaggagguggcuguccagcucgcgcgcccgagccggggccuaccggacccgcaucgccagugggcccuacaucuuccaccggucccgcccugcuuacggggccagcuucaagucccguaggcccuccaagcggacugcaggccuccguuaacuuguucccgacuauuucuguggcacccagcgccgacacaucaagugagagauccaucuauaaggcuagguuucucgaaaaugucgccgcagcggagaccgaaaagcaaguggcucuggcccagggccgggcagagacuuuagccggggcuaugccuaacgaggccggaggucauccagaugcacgccagcugugggacagccccgaaacagcuccugccgcgagaaccccacagucucccgccccgugcguccuacucagggcucaacguucacuggcaccugagccaaaagaaccccuuauaccugccagucccaaggcugagccaauuugggaauugccuacgcgggcaccccgacugagcaucggcgaucucgacuucuccgaucugggggaggacgaggaccaggauauguuaaauguggaaucuguugaggccggaaaagacauuccagcgccgucgccuccccugccacuuuugagcggcgugcccccuccacccccucucccgccacccccuccaaucaagggucccuuuccuccgcccccaccucugccccuagccgcuccacugccucacuccguacccgauucaagugcccucccaaccaaaagaaagacagucaaacuguucuggagggaacuuaaguuggcagggggccacggagugucugcuagccgcuucggcccgugugccacucugugggcauccuuagacccuguuucaguggauaccgcccggcucgagcaucuguuugaaagcagagcuaaggagguccuucccucuaaaaaggcgggggagggaaggcgcacaaugacuaccgugcuggacccaaaacgauccaacgccaucaauauugguuugacaacccugcccccuguacacgugauaaaggcagcucuccuaaacuucgaugaauuugccguuaguaaagacggcaucgagaagcugcucacuaugaugccaacggaagaggaacggcagaagauugaggaggcccagcuggcuaaccccgauaucccucuugggccggcagaaaauuucuugaugacacuggccagcauaggaggcuuagcggcucgucuccaacugugggccuuuaaacuugacuacgauucuauggagagagaaauugcagagccacuguucgaccuaaaggucgguauggagcagcucgugcagaacgccaccuuuaggugcauccuggcuacuuugcuggcaguggggaauuucuuaaacggcucccagucaaguggauuugaacucagcuaucuggagaaagucucggaaguuaaggauaccgugcgccggcaaucccuucugcaucacuuguguucucucgugcugcagacaagacccgagagcucagaccuauacagugaaaucccugcccugaccaggugcgcgaaaguagacuucgagcagcuuacugagaaucucggccagcuggaacgacgcucccgggcugccgaggaaucuuugagaagccuggcaaagcacgaguuagcccccgcucucagggcccgucugacacauuuucuugaucaaugugcacgccgggucgcuaugcugagaauugugcacaggcgaguuugcaaccgguuccaugccuuuuugcucuaucugggguacacgccacaggcggcccgcgaagugagaaucaugcaguucugccacacccuaagggaguucgcacuggaguaccggacuugucgagaaagaguccuucaacagcagcagaagcaagcuacauaucgcgagaggaauaaaacccguggacggaugauuacagaaacugagaaguuuuccggcguggccggugaagcuccuucaaaccccagcguuccaguggcaguaaguucugggccuggaagaggcgacgccgauucccaugccagcaugaaaucgcuccugaccucaaggccggaggacacgacccacaaucgccgaucuagagguaugguccagaguuccagccccauaaugccaacagugggcccuucuacugcuagccccgaggaaccaccuggguccucauugcccagugauaccagcgacgagaucauggauuuacuggugcagucugucacaaaguccucaccgcgggcgcucgcagccagggaacgcaaacguaguagaggaaaccggaaaagccugaggcgcacucuuaaguccggccugggggacgauuugguucaggcucuaggacugucuaaaggcccaggucucgagguguga

SEQ ID NO: 56281 - RNA, 4269 nt, Artificial Sequence
  derived and/or modified sequence opt3 from FHOD3__Homo_sapiens__NP_001268668
auggccacccuggcuugcagagugcaguuccucgacgauacagaccccuuuaacagcacuaauuucccugagccauccaggccgccccuuuuuacguuccgggaagaucuggcauugggcacccaauuagccgggguccaccgccugcuacaggcgccucauaagcucgacgauuguacacugcagcuuucucacaacggagcuuaccuggacuuggaggccacucucgcagaacagcgagaugagcuggaagguuuucaagacgaugccggccgugggaaaaagcauucaaucauucugagaacccagcucaguguuagggugcacgcuugcauagagaaauuauauaauagcuccggacgggaccugcgcagagcacuuuucucuuugaagcagaucuuucaggaugacaaagaucugguacaugaguucguggucgccgaaggccuaacaugucucauuaaggugggugcugaggccgaccaaaacuaccagaauuauauccugagggcgcuugggcagauuaugcuguacguugacggaaugaacggcgugaucaaucggaacgaaaccauacagugguuguauacucucaucggcucgaaguuucgccuggucgugaaaacagcauuaaagcugcuccuuguauucguugaguacucagagagcaaugccccacuguugauucaagcugugaccgccgucgauacgaaacgaggggugaagcccuggaguaacaucauggaaauucuagaggaaaaagacggaguggauacugagcugcucgucuaugcaaugacccugguuaauaagacacuuuccggucugccugaccaggauacuuuuuacgacgugguagauugcuuggaggaacucggcaucgcugccgugucucagagacaccugaacaagaaagggaccgacuuagaucuggucgagcaacuaaauauauacgaaguggcgcucaggcacgaggacggagaugaaacaaccgagccacccccuagcggcugucgggaccgucgcagagccuccguuugcucaaguggugggggagaacauaggggccuggaccggcgacgcagcagaaggcacucugugcaguccauuaagucaacgcuuagcgcaccaacaaguccguguucucaguccgcucccagcuucaaaccuaaccagguccgggauuugcgcgagaaguauucgaauuuuggcaacaacucuuaccauuccucaagaccaaguagcggguccucugugcccacuaccccuacuagcucaguaaguccaccccaagaggccaggcuggaacguuccagcccgucuggacuccugacaucaaguuuccggcagcaccaggagagccuugcugccgaacgagagagaaggcgccaggaacgggaggagagacugcaaaggaucgaacgcgaggaacgaaauaaauuccgguauaaguacuuggagcagcucgcagccgaggaacacgagaaagaacugcguuccagaucuguuucgaggggucgcgcugacuuaagccuggaucuaaccuccccugcggcacccgccugccucgcuccacugucacauaguccuucuagcuccgacucacaggaggcccuuacggugagcgcaucuucccccggcaccccacaccauccccaggccagugcuggggauccugaaccagagagcgaggccgaaccggaggcagaagcgggagcuggccaagucgccgacgaggcaggucaggauauugccucugcucacgaaggggccgagacagagguggaacaggcauuggagcaggaacccgaggaacgggcuucccugucagagaaggagagacaaaacgaaggcgucaaugagagggacaacuguagugccagcucgguguccucuagcucaaguacucucgaacgagaggagaaggaagauaaacugucccgcgaccggaccacaggauuauggccugcgggcguucaggaugccggggugaauggacagugcggugacauccugacuaacaagagauuuaugcuugauauguuguaugcucauaauaggaaaucuccagacgacgaggaaaagggcgauggggaggcaggacguacccaacaggaagccgaggcuguagccagccucgcaacacgcaucuccacccugcaggcgaacucacagacucaagacgagagcguccggagaguggauguuggcugucuagacaauagggguagugugaaagccuucgcugaaaaguuuaacucuggggaucugggccgaggauccauuagccccgacgccgagccuaaugauaaggucccagaaacggcacccgugcagccgaaaacagagucggacuacauaugggaucagcucauggcuaacccucgggaacugcgcauccaggacauggauuucaccgaccuuggcgaggaggaugacauugacguauuggauguggaccuggggcacagagaagccccaggacccccucccccaccucccccaacuuucuuaggucucccgccucccccacccccuccacugcuugauucaauacccccuccgccaguucccggcaaucuguuggucccuccacccccuguguucaacgcaccgcaagggcucggauggucucaggugcccaggggccagccaaccuuuacaaagaaaaagaaaaccauccggcuguucuggaaugagguccgaccuuuugacuggcccugcaagaacaacagacgcugcagggaauuucuauggaguaagcuggagccaauuaaaguugauacuucccgucucgaacaccuguuugagagcaagucuaaagagcuuagcguguccaagaaaacagccgcugacgguaagcggcaggaaaucaucguguuggauucaaagagaaguaaugcgauuaacaucgggcugacgguauuaccucccccaaggaccauuaaaauagccauccucaauuucgacgaguaugcacugaacaaggaaggcauugagaaaauccuuacuaugaucccgacagaugaggaaaagcagaaaauucaagaggcucagcuggccaauccugaaauaccccuaggaagcgccgagcaauuucuccugaccuugucuuccaucucagaacugagugcucgcuuacaucucugggcauucaagauggacuacgagacaacugagaaagaagucgccgagccacugcuugaucugaaggaaggcauugaccaguuggagaacaauaagacccucggguucauccugagcacgcuacuggcgauuggaaacuuucuuaauggcaccaacgcuaaagccuucgaacucuccuaccuggagaaggugcccgagguuaaagacacagugcacaagcagucuuugcugcaucacgucuguacuauggugguugaaaauuuuccugauucgagcgacuuauauucagagaucggugcaauaacccgauccgccaaaguggauuucgaccagcuccaagauaaccugugccagauggaaagacgguguaaggcuaguugggaccaccuuaaggcaaucgccaaacaugagaugaagccaguacugaaacagaggaugucugaauuuuugaaggauugcgcggagcgcauuaucauucucaaaaucguccaccguagaauaauuaaucgguuccauagcuuucugcuauucauggggcaucccccuuacgcuaucagggaggugaacauuaauaaguuuugucgcaucauauccgaguucgcccuggaauaucgaacaacuagagaacgggugcuucagcaaaagcagaaaagggcaaaccaccgcgagagaaacaagaccaggggaaaaaugaucacggacucaggcaaguuuucugguagcaguccggccccacccucccagccucagggccucagcuacgcugaggaugccgcagaacacgagaauaugaaagcuguccugaagacaucuucacccuccguugaagacgccaccccagcguugggggugcggacucguagucgcgccagccgaggaucgacaucuuccuggaccaugggcacugaugacagcccuaacguaaccgaugacgcagcugacgagauuauggauagaaucgugaagucagccacacaaguccccagucagagggugguuccacgggaacgcaaaagaucuagggcuaaucggaaguccuuacgaagaacgcugaaaagcgggcucaccccugaggaggcacgcgcccugggacuugugggcacuucagaacugcaguuguga

SEQ ID NO: 56282 - RNA, 1074 nt, Artificial Sequence
  derived and/or modified sequence opt3 from FIBP__Homo_sapiens__NP_004205
augaccagcgagcuggacaucuucgugggcaacacaacucucauugaugaagacgucuacagacuuuggcuggauggguauuccguuacggacgccguggcuuugaggguacggucuggaauauuagagcagaccggugcaacagccgcggugcugcaaucagauacuauggaccacuaccgcaccuuucauaugcuagaacgacuccugcacgcucccccuaaacuucugcaucaguugaucuuccagauuccaccgagucgucaggcccuccugaucgagagauauuacgcauuugaugaagccuucgucagggaggugcugggcaagaagcucagcaaagggacaaagaaagacuuagaugacauuuccaccaagacuggaaucacacugaagucuugccggcgccaauuugauaauuucaaaagaguuuuuaagguggucgaggaaaugaggggcucgcuuguggacaacauacagcagcacuucuugcugucagaucggcuagcucgcgacuaugcagccaucguauuuuucgcuaauaaccgauuugagaccgguaaaaagaaacuccaguaccugagcuucggggacuuugccuucugugcggaacuuaugauucaaaauuggacgcugggagcaguugauagucagauggacgauauggacauggauuuggacaaggaguuccuccaggaucugaaggaguuaaaagugcuggucgccgacaaggaucuccuugaccugcauaaauccuuggugugcacugcucuaagaggcaagcugggcguguuuucugaaauggaggccaacuucaaaaaucucagcagggggcuggucaacguugcagcuaaacuuacccacaauaaggaugugcgggaccuguuuguagacuugguggaaaaguucgucgagcccugucguuccgaucacuggccucucucagacgugcgcuuuuuccugaaccaguauagugccagcguucauucuuuagauggauuuagacaccaagcgcugugggacagguacauggguacacuacggggcugccuccugcgacuuuaccaugauuga

SEQ ID NO: 56283 - RNA, 2724 nt, Artificial Sequence
  derived and/or modified sequence opt3 from FIG4__Homo_sapiens__NP_055660
augcccaccgccgcugcaccuaucauuagcuccgugcagaagcugguccucuacgagacaagagccagguauuuccuuguuggcucuaacaaugcggaaacuaaauaccgggugcugaagauagaccgcacggagccaaaagauuugguaaucauugacgaucgacacguguauacccaacaggaaguccgugaguuacuggggagacuagaccucggaaacaggacaaagaugggucagaaaggcucaagugggcuguuucgggcugugagcgccuucggaguugugggcuuuguccgcuuccuugaagguuacuauaucgugcugauuacuaagagaaggaagauggcagauaucgggggacaugccauauacaaaguagaggacaccaauaugaucuauauuccgaacgauuccguucgggugacacaccccgacgaggcucgcuacuugcgaaucuuucagaaugucgaucucucuucgaacuucuacuuuucauauagcuacgaccugagucauucccugcaauauaaucucaccguguuaagaaugccucuggaaaugcuuaagucugagaugacucagaacaggcaggagagcuucgauauuuuugaagacgagggcuugaucacacagggcggguccggaguguucgguauaugcucagaaccauacaugaaauaugucuggaauggcgagcugcuagauauuaucaagaguaccguucaccgggacuggcuccuguacauuauccauggguuuuguggacaaagcaaacuucugaucuauggccgucccguguacguaacguugauugcacgcagaucuuccaaguucgccgguacuagguuucucaagcgaggggcuaacugcgaaggagacguggccaaugaggucgaaaccgagcagauacugugugaugcgucagugaugagcuucacagcaggcaguuacucuuccuauguucaggugcggggcagcgucccuuuauacuggucgcaggacaucucuacuaugaugccaaaacccccuauuacccuggaucaagccgacccauucgcucacguggccgcacuccacuuugaucagauguuccagcgcuuuggguccccgaucauaauucuuaaccugguaaaggagagagagaaaaggaagcaugaacggaucuugucagaggagcuaguugcugccgugacauaucugaaucaauuccugcccccugaacacaccaucgucuacauuccaugggacauggcgaaauauacgaagaguaaacucugcaacgugcuugaucgccugaaugucaucgccgaaagcgugguuaagaagacuggauuuuucgugaacagacccgacuccuacuguucuauuuugaggccugaugagaaauggaacgaacucgguggcugcguaauaccaacagggcgucugcagaccggaaucuuacggacuaauugugucgacugccuggaucgaacaaacaccgcacaguuuauggugggcaagugugcucuagccuaucagcucuacagccugggucuuauugacaaacccaauuugcaauucgacacggaugcuguuagacuguuugaggaacucuacgaggaccauggggauacccugucacuucaguauggcggaagucagcuggugcacagggucaagacauaccgcaaaaucgccccguggacucagcacuccaaggacaucaugcaaaccuugagccgguauuacucuaacgcauucucagaugccgacagacaggauaguauuaaucucuuucugggcguguuccauccuacagaagggaagccccacuuaugggagcugccaacugacuuuuaucuacaucacaaaaacaccaugaggcuccugccuacacgccgaagcuacaccuauugguggacucccgagguaauaaagcaucuuccauugcccuacgaugaagugaucugcgcuguuaaucugaaaaagcucauugucaaaaaguuccacaaguacgaggaagagaucgacauucacaacgaguucuuucggccuuaugaacuguccucuuucgaugacacguuuuguuuagcgaugacaucgagcgcacgugauuucaugccaaaaaccgugggaaucgacccgucccccuuuacugugagaaagccugacgagaccgguaaaucaguccugggcaauaagaguaacagggaagaggccguucuucagcgcaaaacagcugccucugcaccacccccuccaagcgaagaggccguguccucaagcucugaggaugacuccgggaccgaucgggaagaggaaggaagugugagccagagaucuacucccguaaagaugacagacgcuggcgauuccgccaaggucacggagaaugugguucaaccgaugaaagaauuguacgguauaaaccucucagacgggcugagugaggaggauuucagcaucuauucgagguuugugcagcuaggccagucccagcauaagcaagacaaaaauucucagcagccuugcagccgaugcucagauggagucauuaagcugaccccaaucagugcauucucccaagacaacauuuacgaagugcagcccccucgcguugaucggaaaucuacugagaucuuucaggcgcacauacaggcuagccaaggcauuaugcagccccucgggaaggaagacuccucaauguauagagaguacaucaggaaucguuaucuguga

SEQ ID NO: 56284 - RNA, 1065 nt, Artificial Sequence
  derived and/or modified sequence opt3 from FIGF__Homo_sapiens__NP_004460
auguacagagaguggguggucguuaacguguucaugaugcuguauguacagcucgugcaaggcagcuccaaugaacacgggcccgucaagaggucuucacagaguacccuugagcggagcgaacagcagauccgcgccgcuuccucucuggaggaauuguuacgaauuacacauucggaggacuggaaacuguggcguugcagacuaaggcucaagucauuuacuagcauggauagucgguccgcaucucaccgcagcacgagauucgccgcgaccuuuuacgacauagagacacugaaagugaucgaugaagaguggcaaaggacucaguguuccccucgggaaaccugcguugagguggcuucagagcuuggaaagaguacaaacaccuucuuuaaaccaccgugugucaauguguuccgcugcgguggcuguugcaacgaagagagccugauuuguaugaauacuucuacauccuauaucucaaagcaguuguuugaaauuagcguaccccucaccaguguuccugagcuggugccagucaagguggccaaccauacggggugcaaaugucugcccacugcaccucgacacccauacucuaucauaagaagguccauccagauucccgaagaggaccggugcagccauucgaagaaacucuguccuaucgauauguuaugggacucuaauaagugcaaaugcgugcugcaagaggaaaacccacuugccggaaccgaggaucacucccacuugcaggaaccggcucuguguggcccccauaugauguucgacgaggaucguugcgaaugugucugcaagacaccuuguccaaaggaccuaauucagcaccccaaaaauugcucauguuuugagugcaaggagagucucgaaacuuguugccagaaacauaagcuguuccacccugauaccuguagcugcgaggaccgcugcccauuucacacaagacccugugcauccgguaaaaccgccugcgcuaagcauuguagguucccgaaagaaaagcgggccgcgcaagggccucacucucgaaagaaccccuga

SEQ ID NO: 56285 - RNA, 660 nt, Artificial Sequence
  derived and/or modified sequence opt3 from FIGLA__Homo_sapiens__NP_001004311
auggaccccgccccuggcgugcuggauccaagagcugcaccgcccgcccuccuugggaccccucaggcggagguccuggaagacguuuugagggagcaauucggaccauuaccccagcuggcugccgugugccggcuaaagcgccucccuagcgguggcuacuccucuacagaaaaccugcagcuuguacuggagcgacguagaguggcaaaugccaaagaaagggagcggaucaagaacuugaaucgcggguuugcuagacucaaagcacuggucccauuccugccccagucaaggaagccuaguaaaguggauauucucaagggagccacugaguauauacaaguuuuaagcgaccugcuugaaggcgcuaaggauuccaaaaagcaggacccagaugagcagucuuacucgaacaauucaagcgaaagucacacguccucugcccggcaguugagccgcaacaucacccaacauauuuccugugcguuuggucugaaaaaugaggaggaagggccgugggcagacggaggcucaggcgagcccgcccacgcuugccgacauagugugaugagcacaacugaaaucauuucuccuaccagaucccuagauagguucccagaggucgaacuccugucacaccggcuuccccagguguga

SEQ ID NO: 56286 - RNA, 2280 nt, Artificial Sequence
  derived and/or modified sequence opt3 from FIGN__Homo_sapiens__NP_060556
augaucagcuccaccucuguguacggccugaagaugcaguggacacccgagcacgcccaauggccugaacagcauuucgacauuacuucaacgaccagaaguccagcucacaaagucgaggcauauagggggcaucuccagcggacauaccaguaugccugggcgaacgaugacauaagcgcucuuacugccuccaaucuguugaagaaauacgcagaaaaguauucuggaaucuuagaggguccgguugaucgccccgugcugucgaacuacucagacaccccuagcggccuaguaaaugggcguaaaaacgaaagugagccauggcaacccucccucaauucugaggccguguauccuaugaacugcgucccagaugugauuacagcuagcaaggcaggaguuuccucagcccugcccccugcugacgugagugccagcaucgguucuuccccaggcgucgcgucaaaucuuaccgaaccgagcuacaguucuuccacuugugggagccacacagugcccucgcugcaugcaggauugccuucucaggaguacgccccaggcuauaacggcuccuaccuccacucaaccuauaguagccagcccgcuccugcccugccaagcccccacccgucuccucugcauagcucagggcucuuacagcccccaccucccccacccccuccaccggcacugguacccggauacaaugguacgaguaaccuuuccagcuauucuuacccuucagcuaguuauccaccccaaacugccguuggcagcggguacuccccuggaggcgcgccacccccgccuucugccuacuugccaucggguauucccgcaccuacaccccugccaccuaccacugugcccggguauaccuaccagggacacggccuaacaccaaucgcuccgagcgcccucaccaauuccucagcuaguucucugaagcgaaaagccuuuuauauggcaggccagggggauauggacagcuccuacggaaacuauucauacggucagcaaagaagcacgcagucuccuauguauaggaugcccgauaauuccauaaguaacacuaaucggggcaacggguucgaccgcagcgccgaaacaucuucccuugcuuuuaagccaaccaaacagcugaugucaagugagcaacagagaaaguucagcucgcaguccucuagggcguugacucccccuagcuacucaacagcuaaaaacagucucggaucccggucuagcgaguccuuuggcaaguacaccucaccagucaugagcgaacauggugaugagcaccgccagcuguuaagucaccccaugcaagggccuggccugcgagccgcuacgucuuccaaucauagcguggacgaacagcucaagaacaccgauacacaccuuaucgaccuggugacuaaugagauuaucacccagggaccgccagucgacuggaacgauauugccggcuuggaccuaguuaaagcagugaucaaggaagagguacuguggcccgugcucagaucggaugccuucucagggcugacagcacuuccuaggucuauacuguuguuuggaccacgggguacuggcaaaacccuccuggggcguugcauugccagucaguuaggagcaacauucuuuaagaucgcgggcuccggucuggucgcuaaauggcuaggggaggccgaaaagauuauccaugcauccuuccucguggcccgcuguagacaacccucuguuaucuuugugagcgacauugauaugcugcuuuccucacaggucaaugaggaacacaguccugugagcaggaugcggaccgaguucuugaugcagcuggacacuguacucacgucugcugaagaucagauaguugugaucugcgccacauccaaaccggaggagauugacgaaucacugcgacgcuauuuuaugaagagacuucugauccccuugccagauaguaccgcaaggcaucaaauaauuguccagcuccugagccagcacaacuacuguuuaaaugacaaggaguucgcucugcuagugcagcggacugaaggcuucuccggacucgaugucgcccaccugugccaagaggcggugguuggcccucuucaugccaugcccgcuaccgacuugucugcaaucaugccaucgcagcugcgcccugugacauaucaggacuuugaaaacgccuucuguaaaauccaacccagcauuucacagaaggagcucgauauguacguagaguggaauaaaauguuugggugcucccaguga

SEQ ID NO: 56287 - RNA, 3651 nt, Artificial Sequence
  derived and/or modified sequence opt3 from FILIP1__Homo_sapiens__NP_001276916
auggugggcaugagaagcaggaaccaagggggagaguccgccucugacggucacaucucaugccccaagccuaguauuauaggcaaugcuggggagaaaagccuguccgaggaugcaaagaaaaagaaaaagucuaaccggaaggaagacgaugucauggccucgggaaccguuaaacgccaucucaagacaucaggcgagugugaacgaaaaacuaagaaaagccuugagcugaguaaggaggacuugauccaguuacuguccauuauggaaggugagcuacaggcgcgugaagaugugauccacaugcucaagacggagaaaaccaagccagagguacuggaagcucauuacgggucugccgagccggaaaaagugcuuagaguccugcacagggacgcaauuuuggcccaggaaaagagcaucggagaagauguguaugagaaacccauauccgagcucgaccggcuggaagagaagcagaaagaaacauaccgcagaaugcuggagcaacucuuacuggcugaaaagugccauaggcggacuguuuaugagcuugagaaugaaaagcacaaacacaccgauuacaugaacaagucagacgauuucacaaauuugcuggagcaggaacgcgagcgacugaaaaagcuccuggaacaggagaaagcauaucaggccagaaaggagaaggaaaacgcuaaaaggcuuaauaagcugcgggacgaguuggugaaacucaagaguuuugcccugauguuagucgaugaacgucaaaugcauaucgagcagcugggccuccagagccagaaagugcaagaccuuacccagaagcugcgcgaggaagaggaaaaguugaaagcgauuacuucuaaguccaaagaggacagacagaagcuacugaaacucgaaguagauuucgagcacaaggcaucaagguuuagccaagagcaugaagagaugaacgccaagcuggcuaaucaggaaagucacaaccggcagcuucgacugaaauugguuggccucacacagcgcaucgaggaacuggaggagaccaauaagaacuuacaaaaagccgaagaggaacugcaggagcuaagagacaagauugcaaaaggggaauguggaaauucuucccucauggcugagguggagaaccugaggaagcggguccuugaaauggaggguaaagaugaagagaucacgaagacugagagccagugccgcgaauugagaaagaaacugcaggaggaggaacaccauucgaaggaacucaggcuggagguggagaaacuucaaaagcguaugucugaacuggagaaauuggaagaggccuucuccaagucaaagagugaauguacccagcuccaccugaauuuagagaaagagaagaaccugacaaaagaccuacucaacgaacuggagguggucaagagccggguuaaagaacuugagugcuccgaaucucgauuggagaaggcggagcugagccucaaggaugaccugacuaaauuaaagucauuuaccgugaugcugguagaugaacggaaaaauaugauggagaagauaaaacaggaagagaggaagguggacggccuuaacaagaauuucaaagucgagcaggggaaggugauggauguuacagaaaaauugauugaggaaaguaagaaacuccugaagcuaaaauccgagauggaagagaagguguacaaccugacccgcgagcgggacgaacucaucggaaagcugaaaagcgaggaagagaagucuucagaacuuaguuguagcgucgauuugcugaaaaagagauuagacggcauugaggagguggaaagggagaucacgcgcggucgaucccggaaagggucugaacucacuugcccugaggacaauaagaucaaggaacugacacuugagauugagcgucugaaaaagagauugcaacagcucgaaguaguugagggagaucugaugaaaaccgaagacgaguaugaucagcuagagcagaaguuuaggacugaacaagacaaagccaacuuccugucgcagcagcucgaggaaauaaagcaucaaaucgcaaagaauaaagcuauugagaagggcgaaguggucagccaggaggccgagcugcgccaccgguuuagacuugaagaggcuaaauccagggauuugaaggccgaagugcaggcacugaaagagaagauccaugaauuaaugaacaaggaggaccagcucucacaacugcaggucgauuacagugugcuucagcagcgauucauggaggaagagaauaaaaacaagaauaugggccaagaaguucugaaccuaacaaaagagcucgaacugucuaagcgcuacagccgggccuugagaccauccgugaaugggaggcguaugguagacguccccgugaccucaacgggaguucagaccgaugcugugagcggugaggcggcagaggaagagacuccugccgucuuuauacgcaaaucuuuccaggaagagaaccacauuauguccaaucugagacaggugggcuuaaagaagccaguagagagaaguagcgugcucgacagguaucccccugcugccaacgaacugacaaugcgaaaaucuuggaucccauggaugcggaagcgcgagaacgggccguccaucacccaagaaaaaggacccagaacaaauucaaguccuggccacccaggugagguuguccuuagccccaagcaggggcagccucugcauauuagggugacuccagaucacgaaaacucgaccgcaacauuggagaucaccucccccacuucugaggaauuuuucagcucaacgacagugauuccgacccucggcaaucaaaaaccucggauaacuaucauucccaguccaaacgucaugccucagaagcagaaauccggagacaccacacugggccccgagcgagccaugucuccaguuaccaucacuacauucagcagagaaaagacgcccgaguccgggcgcggagcuuuugccgauaggccuaccucaccaauccagauuaugacugugagcacaagugcagcgccggcugaaauagccgugucucccgagucccaagagaugccuaugggucguaccauccuaaagguaacaccagaaaaacagacuguccccaccccugugcggaaguacaauagcaacgcaaauauuaucacgaccgaggacaacaaaauucauauccaccugggcucgcaguucaagagaucaccagggacaucuggagaaggcguuagucccgugauaacugucaggccggugaauguuaccgccgagaaagaaguguccacagguacuguacuucgcagcccucgaaaccaccucucuagcagaccaggggcuuccaaggucaccucaacgaucacaauuacccccgugacuacaaguagcgcccggggcacccagucuguguccggacaagacggcucaagucagaggccuacucccacccgcaucccaaugagcaaggggaugaaagcaggaaagccugucguugcugcccccggugcgggcaaucugacaaaauuugagccacgugccgagacgcaguccaugaagauugaauugaaaaagucugcugcaucgagcaccacuucacuagggggaggcaaggguuga

SEQ ID NO: 56288 - RNA, 3402 nt, Artificial Sequence
  derived and/or modified sequence opt3 from FILIP1L__Homo_sapiens__NP_001035924
augagaagcaggggcuccgacaccgaggggucugcccagaagaaauucccccggcacacaaagggacauucauuucaagguccuaaaaacaugaagcaccgccagcaggauaaagacaguccaagcgaauccgaugugauccugccgugccccaaggcugagaagccucauucuggcaaugggcaccaggcagaagaccucucgcgagaugaccuucuguucuuguuaucaauucuggagggagaacuacaagcccgugaugaggucauaggcauccucaaagcggagaagauggaccuggcucuacuggaagcccaguacgguuuuguuacuccaaagaagguguuggaggcacuccagagagaugccuuccaggcuaaaagcacgcccuggcaagaagacauuuaugagaagccuaugaacgagcuggauaagguaguggaaaaacauaaggagaguuacaggcggauccuggggcagcucuuagucgcagaaaaaucccgcagacagaccauucuggagcuugaagaggagaagaggaaacacaaggaauauauggagaaaucugacgaauuuaucuguuugcuggagcaggaaugcgagcggcuaaagaagcucauagaucaagagaucaaaagccaggaagagaaggaacaggagaaagaaaagcgcgugacaacucugaaagaggagcuuaccaagcugaaguccuucgccuugaugguuguggacgaacaacagcgacucacagcucagcugaccuuacagagacagaaaauucaagagcugacuacaaaugccaaggaaacccacacgaaacucgcgcuugcagaggccaggguccaggaggaagaacagaaggcuacucggcuggaaaaagaguugcaaacccagacaacuaaguuucaucaggaccaggauaccaucauggccaagcuaacaaacgaagacucacaaaaucgucagcugcagcagaaacucgcagcucugagucgccaaauugaugagcuugaggaaaccaacagaagccugaggaaggccgaggaagaguugcaggacaucaaagaaaagauaucuaaaggagaguacggcaaugcgggcauuauggccgagguggaggagcuccggaagcgaguacuggauauggaagggaaggacgaggaauuaaucaaaauggaggagcagugucgcgaucugaacaagagacuagaaagggagacgcuccaauccaaagacuucaagcuggaaguugagaaacuuucaaagcggauuauggcauuggagaaacuggaagaugcuuuuaauaagagcaagcaggagugcuauagucucaaauguaaccuggaaaaggagcgcaugacuacaaaacagcuuucucaggaacuggaguccuugaaggugagaaucaaagagcucgaagccaucgagagcaggcuggaaaagaccgaguucacuuuaaaggaagaccugacaaaacuaaagacccucacggucauguuuguggaugagcguaaaaccaugucggagaagcugaaaaagacagaagacaaacuucaagcugccucuucccagcuccagguggagcagaauaaagucacuaccguuacagaaaagcugauugaggaaacuaaacgggcacucaagucaaaaaccgacguggaggagaagauguacaguguaacaaaggaacgagaugaccugaaaaacaaguuaaaagccgaggaagagaagggaaaugaucugcuuagcagagugaacauguugaaaaauaggcuccaaucccuggaggcuauagaaaaggacuuccuuaaaaacaagcugaaccaggauucugguaagagcaccacugcgcuccaccaggagaauaacaaaaucaaggaacugucacaggaggucgaacgccuuaaauugaagcugaaagacaugaaggcaauugaggaugacuuaaugaagacggaggaugaauaugagacacucgaacggagauacgccaaugagagggacaaagcucaauuucugaguaaggaacuugagcaugugaaaauggagcuggccaaguacaaauuggcagaaaagaccgagacuucccacgaacagugguuguucaagcgccugcaggaggaagaggccaaaagcggccaccuaucucgagagguugaugcucugaaggagaaaauccaugaauauauggccaccgaagaccucauaugccaucugcaaggggaucacucagugcuucagaagaaauugaaccagcaggagaaucggaaccgugaccugggaagagagauugaaaauuuaacaaaggagcucgaaagguaccgccacuucaguaagagccugcggccaucccuuaacggcagaaggaucucugacccccaagucuuuucgaaagaggugcagaccgaagcaguagauaaugagccuccagacuauaagagccugaucccgcuagagcgagcgguuauuaacggucagcucuacgaagaguccgaaaaucaggaugaggaccccaacgaugaagggucagugcugaguuucaaauguucucaaagcacuccuugcccagucaaucgcaaguuguggauccccuggaugaaauccaaggagggacaucugcagaacggcaagaugcagacaaaaccuaaugcuaacuuugugcagccaggcgacuuaguccucucacacacgcccgggcaaccgcugcacauuaaggugaccccugaucauguucagaacacugccacacuugagauaaccagccccacaacugaaucuccacacuccuauaccaguacggcagugaucccuaauuguggaacccccaaacagcggauuacaauccugcagaacgccagcaucacuccaguaaagucuaaaaccuccacagaggacuugaugaaucucgaacaagguaugucacccauuacuauggcuaccuucgccagagcacagacgccugagaguugcggcagccugacaccagaaaggaccaugucgccgauacagguccuagcugugacuggguccgccucuagccccgagcaaggacguucaccugagccaacagaaaucagugcgaagcaugccauuuuucgcguuucccccgaucggcagucuagcuggcaguuccagagauccaacucaaauagcaguucugugaucaccacugaggacaacaaaauucacauccaccugggcuccccuuacaugcaagcugucgcaagcccagugaggcccgccucgccgucagcuccucuucaggauaaucgaacccagggucucauaaacggggcccugaauaagacaacgaacaagguaaccucuaguaucacuauuacaccaaccgcaacacccuugccucggcagucccaaaucacugugagcaauauuuauaacuga

SEQ ID NO: 56289 - RNA, 1767 nt, Artificial Sequence
  derived and/or modified sequence opt3 from FIP1L1__Homo_sapiens__NP_001128409
augagcgccggcgagguggaaagacuggucuccgagcucucugggggaaccgguggcgacgaagaggaagaguggcuuuacggggaugagaacgaaguugagaggcccgaagaggagaaugcuucagcaaacccuccaaguggaaucgaagacgagacagccgaaaauggcgugccgaagcccaaaguaacugagacggaagaugacagcgauuccgacucugaugacgaugaggacgaugugcacgucaccauuggugacauaaagacaggggcgccucaguauggaucguacggcacugcuccagugaaccugaauaucaaaaccggcgggcggguuuauggaacaaccgguacuaaggugaaaggcgucgauuuggacgcccccgggucaauuaacggagugccuuuacuggagguagaccuagauagcuucgaagacaagccauggcgcaagcccggcgcagaucucagugacuacuuuaauuaugguuucaacgaggauacauggaaagccuacugcgaaaagcaaaaacgaauccguauggggcuggagguuauuccugugaccuccacgacuaauaagaucaccgcugaagacuguacaauggaggucacuccaggagcagagauacaggauggcagauuuaaccuuuucaaagugcagcagggcaggaccgggaauagugaaaaggagacagcccugccgagcaccaaggcugaauuuacgucacccccuucauuguucaaaacuggacucccacccagucggaacagcacaucuucccaaucacagaccagcacugccagucgcaaggcaaauucuuccguggguaaauggcaggacagauauggcagggcggagagcccugaucugcggcgccugccaggggccaucgacgucauuggacagacaaucaccauuucgcgaguugaaggcagaaggcgggcuaacgaaaauucuaacauccaagugcucuccgagcguucagccacggagguagauaacaauuuuaguaagcccccgccuuucuuucccccaggugcaccucccacccauuuaccacccccuccauuccugccgcccccuccaacagugagcacugcucccccucuuauaccacccccggggauuccuaucaccgucccacccccuggcuuucccccaccucccggagccccaccgccuuccuugauucccacaaucgagucuggccacagcucaggguacgacagucgcuccgcgagagccuucccauacggaaacguggcauuuccccaucugccugguagcgcuccaucuuggcccucccuaguugacacuucuaaacagugggauuauuacgccaggcgggaaaaggaccgagaucgcgagagagacagggaucgggagcgcgacagagauagggaccgugaacgggagcgaaccagagaaagggagcgcgaacgggaucacagcccuacaccguccguguucaauucugacgaggagagauauagguaccgcgaauaugcugagcgaggcuacgaacggcaucgugccucgagagagaaagaagagaggcaccgcgagcggagacacagggaaaaggaggaaacccgacauaagagcucccgcucaaacagucggagaaggcacgagucugaagagggggauagccaucgucgccacaaacacaagaaauccaagcggucaaaagagggaaaggaagcaggcagcgagccagcccccgaacaggagucuacugaggcuacgccugcggaauga

SEQ ID NO: 56290 - RNA, 459 nt, Artificial Sequence
  derived and/or modified sequence opt3 from FIS1__Homo_sapiens__NP_057152
auggaggccgugcugaacgaacucgucagcguugaggaccuucugaaguucgagaaaaaguuucaguccgagaaagcugcaggcucugugucaaagaguacccaauucgaauacgccuggugcuugguaagaagcaaauauaaugaugacaucaggaaggggauuguguuacuggaggagcuacuccccaagggauccaaagaagaacagcgggauuacgucuuuuaucuggcgguggguaacuaccgccuuaaggaauaugagaaagcucugaaguacguucgaggcuugcuccagacagagccucagaauaaccaagccaaagaacuggagcgucugauagacaaggcaaugaagaaagaugggcucgugggaauggccaucgucggcgguauggcuuuagggguggcaggacuggccggccuuauuggcuuggcuguaucuaagucgaaaucauga

SEQ ID NO: 56291 - RNA, 879 nt, Artificial Sequence
  derived and/or modified sequence opt3 from FITM1__Homo_sapiens__NP_981947
auggagagaggccccguggucggggccggacugggugcuggcgcaaggauccaggcccuccuugggugccuguugaagguuuuacuguggguggcgagcgcucuacucuacuucggauccgaacaagccgcacggcugcuuggcucuccuugucugcgccgauuguaucacgccuggcucgcugcaguagugauuuuugguccacugcugcaguuccaugucaacccgcguaccauauuugccucacacgggaauuucuuuaacaucaaauucgugaauagugcuuggggauggacaugcacuuuucucggcggcuucguuuuacugguggucuuucuugccacgagaaggguggcgguaaccgcacggcauuugagccgccugguugugggggccgcugucuggagaggagccgguagggcauuccuacucauugaggaccugacaggcuccuguuuugaaccccuuccucaggggcuguugcuccacgagcugccagaucggcgcucuugcuuagcugccggacaucaguggcgaggcuacacugugucgucacacaccuuccugcucacauuuuguugccuucugauggcggaagaggccgcaguguucgcuaaguauuuggcccacggucuacccgcuggggccccucugagacucgucuuccugcuuaacguucuguugcucggacuguggaacuuuuuacugcuauguaccgugaucuacuuccaucaauauacucacaaaguagugggcgcagccgucggcacauuugcuugguaccucaccuaugggagcugguaccaucagccauggagucccggauccccuggucacggccuguucccaaggccgcacucuagccggaagcauaauuga

SEQ ID NO: 56292 - RNA, 789 nt, Artificial Sequence
  derived and/or modified sequence opt3 from FITM2__Homo_sapiens__NP_001073941
auggagcaccuggaaagaugcgaguggcuccuuaggggcacccuggugcgggccgcuguccgccgauacuugcccugggcauuaguugccagcaugcuggcggggucccuacucaaggaacugucuccucuuccagagucauaucugaguaacaaacguaauguguugaacguauacuucgugaaggucgcuugggccuggacauuuugucuccugcugccguucaucgcacucacuaauuaucauuuaacgggaaaagccggucuggugcuuagaagguugagcacccugcuaguuggcacagcuauuugguacauaugcacuuccaucuuuucuaacauugaacacuauaccgggucguguuaccagucacccgcacucgagggagugcggaaggagcaucaaagcaaacagcagugccaccaggaaggcgguuucuggcauggguuugacaucaguggacacuccuuccugcuuacauuuugugcccugaugauugucgaggaaaugucuguguugcacgagguaaagaccgaucgcagccauugccuccacacugcuaucacaacccugguuguggccuuaggcauacugacguucaucuggguccucauguuucuuuguacugcgguguauuuccauaaucugucccaaaagguguuuggcaccuuguucgggcuacugucaugguacggaacauacgguuuuugguauccuaaagcauucaguccaggccugcccccucagagcugcucucucaaccuuaagcaggacuccuacaaaaaguga

SEQ ID NO: 56293 - RNA, 1314 nt, Artificial Sequence
  derived and/or modified sequence opt3 from FJX1__Homo_sapiens__NP_055159
augggcagaaggaugcggggcgccgcugcaaccgccggacuguggcuccuugcgcuggguagcuuguuagcucuguggggcgggcuauuacccccucgcacagagcugccagccucccgaccgcccgaagaccgucuuccuagaaggccagcacggucuggaggccccgccccugcuccacgcuucccccugccuccaccguuggcaugggaugccagaggugggucacucaagacuuuuagggcucugcugacgcucgccgcgggagcagacgggcccccucggcagagucgcagcgagccacgauggcacguguccgccagacaacccaggccugaagagucugcugccguccauggcgggguuuucuggucgcggggauuagaagaacaggugccacccgguuuuucagaggcacaggcugccgcguggcuggaagccgcacguggcgcucgcaugguagcccuugagagagggggaugcggcaggagcaguaaccgguuggcucgauucgccgaugguacccgcgcaugugugagauacgggaucaauccggaacagauucaaggagaggcccuguccuauuaccuagcuaggcuccugggccuucagcggcacgucccuccccuggcguuggcacgcguggaggccagaggcgcucagugggcccagguucaagaggagcucagggcagcccauuggacagaagggucuguggucagccugacucguugguuaccaaaccugaccgacgugguaguuccugcucccuggcgguccgaggauggacgacucagaccacuuagggacgccgguggcgaacuggcaaauuugucacaggcggagcuaguggaucugguccaguggacagaccucauacuguuugauuaucuuaccgcuaacuucgaccgccuggugaguaauuuguuuagccuccagugggauccccgggugaugcaaagagccacuucuaaccugcacagggggccuggaggcgcauuagucuuccuggacaaugaggccggucuaguucauggguaccgcguggcuggcaugugggauaaauauaacgaaccacuccugcaguccguaugcguguuucgagagcggacagcccguagaguccuugaauugcacaggggacaggacgcagcugcccgccugcuccggcuguacagaaggcacgagccgcgauuccccgaacuugcggcccuggcugacccucaugcacaauugcuccagcgccggcuggauuuucucgccaagcacauccugcauuguaaagcuaaguauggcagaaggucagggaccuga

SEQ ID NO: 56294 - RNA, 1749 nt, Artificial Sequence
  derived and/or modified sequence opt3 from FKBP10__Homo_sapiens__NP_068758
auguuccccgccggcccuccaagccacucccugcucagacuuccgcuguugcaguuacugcuacucgugguccaagcuguugggaggggacugggucgggcaucucccgccggcgggccucuugaggacgugguaaucgaacgcuaccauauuccacgagcgugcccccgugaggugcagaugggagauuuugucagauaucacuacaacggcaccuucgaagacgguaagaaauuugauucaaguuaugacaggaauacacugguggcuauaguugugggggucggacgguugaucacuggcauggaucgcggccucauggggaugugugugaacgagagaaggcggcugauuguaccuccacaucugggauacgguagcaucggccucgccggguuaauucccccugacgcaacgcuguauuucgauguugugcuuuuggacgucuggaauaaggaagauaccguccagguguccacacugcuacgcccaccgcacugcccccgaauggugcaggacggagauuuuguuagauaccauuauaacggcacucuccuggacgguaccucuuucgauacaucguacucaaaagggggaaccuacgacacuuaugugggcagcggcuggcuuaucaaggggauggaccaaggacuguuggguauguguccuggcgagaggcggaaaauaaucauuccacccuuucucgccuacggggagaagggauauggcacaguaaucccuccacaggcuagucugguguuccacgucuuacugauugaugugcacaaucccaaggacgcaguucagcucgaaacccuugagcugccgccugguugcgugcgucgcgccggggcuggcgauuuuaugagauaccauuauaacggauccuugauggacggcacgcuauucgauucuagcuacuccaggaaucacacuuauaacaccuacaucgggcagggauacauaauucccgguauggaccaaggccugcagggggccuguaugggagaacggcgacgcaucacaauuccaccucaucucgcguauggcgagaaugguacuggggauaaaauccccggcucagcaguccugaucuuuaacgugcacguaauugacuuccacaauccagccgauguuguggagauaagaacccuuaguaggcccagcgaaacaugcaacgagaccacgaagcugggagacuuuguccgguaccauuauaauuguucuuugcucgauggcacucagcuguucacaucccacgacuacggggcuccucaggaagccaccuuaggagcaaacaaagugaucgagggucuggacacuggccuacaagggaugugcgucggagaacgcagacagcucauugugccaccgcaucuggcucacggcgagucaggugcccgugggguucccggcagcgcggugcuuuuguucgagguagaacuggucaguagggaggauggacucccuacaggcuaucuguuuguguggcauaaggacccacccgccaaucuuuucgaagauauggaccugaacaaagauggggagguuccuccagaagaguuuucuaccuucaucaaggcacagguguccgagggaaagggccgguugaugcccggucaagacccggaaaagacgauaggggauauguuucagaaccaggaccgaaaucaggauggaaagauuaccgucgacgagcucaaacugaaaagcgaugaagacgaggaaagagugcacgaggaguuauga

SEQ ID NO: 56295 - RNA, 300 nt, Artificial Sequence
  derived and/or modified sequence opt3 from FKBP11__Homo_sapiens__NP_001137253
augugcgugggcgaaaagagaagggccaucauucccucacaccuggcuuacgggaaacggggauucccuccauccgucccggcagacgccguugugcaguaugauguagaacucauagcgcuuauccgcgcuaacuacuggcugaaguuggugaaagguauuuuaccccuggucggcauggccauggugccugcacuacucgggcugaucggauaucaucuuuaccgaaaggccaaucguccaaaaguuucuaagaagaaacugaaggaggagaaaagaaacaagagcaaaaagaaguga

SEQ ID NO: 56296 - RNA, 636 nt, Artificial Sequence
  derived and/or modified sequence opt3 from FKBP14__Homo_sapiens__NP_060416
augagacuguuccucuggaacgccgugcuuacccuguuugucacuagcuugaucggcgcuuuaauucccgagccugaaguuaagauagaggugcugcagaaaccauucaucugccacaggaagacaaaagggggagaccuaaugcucguacauuacgaagguuaucuggagaaggauggcucccuuuuucacucuacgcauaaacacaauaacgggcaaccgauuugguucacccugggaaucuuggaagcacucaagggcugggaccagggucugaaggggaugugugugggagagaaacggaagcugauuauacccccugcccucggcuacggcaaagaggggaagggaaaaaucccacccgaaucaacauuaaucuuuaauauugaucugcuugagauccgcaacgguccucgaagucaugagagcuuccaggaaauggacuugaaugaugacuggaagcuguccaaggaugaggucaaagcguaucuaaagaaagaauuugagaagcacggcgcugugguuaacgaaucucaccaugacgcccucguggaggauauuuucgacaaagaagaugaggacaaggauggguuuaucucggcacgugaguucacuuacaaacacgacgaacuguga

SEQ ID NO: 56297 - RNA, 3660 nt, Artificial Sequence
  derived and/or modified sequence opt3 from FKBP15__Homo_sapiens__NP_056073
auguucggcgccggggacgaggaugacaccgauuuucugagccccuccggaggugcuagacucgcaucucuuuucggccuggaccaggccgcggcugggcacggaaacgaauuuuuccaauacacagccccuaagcagccaaagaagggccaggguacugcagccacggggaaucaggcuaccccgaaaacagcacccgccacuaugucaaccccuacaaucuugguggcuaccgccguccaugcguauagguacacuaacggacaauauguuaagcagggcaaauuuggcgcagccguguuagggaaucacacagcucgggaguaccgcauucugcuauauauaagucagcagcaaccaguaaccguggcccgaauccaugucaacuucgaacucauggugcgucccaauaacuacagcacguuuuaugaugaccagagacagaauugguccauuauguucgagucugaaaaggcagcuguugaguuuaacaaacaggugugcaucgccaaauguaauucgacuucaagccuggaugcgguccuuagucaagaccugauuguggccgauggaccugcaguagagguuggugacuccuuggaaguggcuuacaccggcuggcuguuccagaaccacguccugggacagguguuugauucuacagccaauaaggacaaacugcucagguuaaagcuggggagcggcaaagugaucaaggguugggaggaugggaugcuuggaaugaagaaaggcggcaagcgguugcugauagucccacccgcuugcgccguuggguccgaaggagugaucgguuggacucaagcaaccgacucaauucuaguauucgagguggagguccgcagagugaaauuugccagggacaguggcagcgaugggcauucuguuuccucacgggacagcgcugcgccuaguccaaucccgggagcagauaaccucucugccgaccccguggucuccccuccaacaagcauucccuucaagucgggcgaaccugcucugcgcaccaaaucuaauucccuuucagagcagcuggccaucaacacgaguccagaugcagugaaggccaaauugauaagccgaauggcuaagaugggucagcccaugcucccgauucugccuccccaguuagacuccaaugauucugaaaucgaggacguaaacacucugcaagggggcggacagccaguugugacaccuagcguccagcccucacuccacccagcccaccccgcacuuccucagaugaccagucaagcgccacagccguccgugacuggccugcaggcucccagcgccgcauugaugcaggucucuucacuagauagucauagcgccguguccgggaacgcucaaucuuuccagccuuacgccggaaugcaggcauaugcuuacccacaggccucggcgguuacaagccaacugcagcccgugagaccucucuauccagcuccccugucccagccgccucacuuucaagguucaggcgacauggccaguuuccuuaugaccgaagcaaggcagcauaauacggagauucggauggccguaucuaaggucgcugauaaaauggaccaccugaugaccaagguggaggaauugcagaaacacagcgccgggaacuccaugcucaucccaucaaugagcguuacaauggagacuucuaugaucauguccaauauucagcguauaauccaagaaaacgagcgccugaagcaggaaauuuuagagaaaaguaauagaaucgaggaacagaacgacaagauaagcgagcugauugaaaggaaucagcgguacguggagcaaucuaaccuaaugauggaaaagcgaaauaacucccuccagaccgcaacagagaauacucaggcgcgcguccugcaugccgagcaggaaaaagcuaaggugaccgaggaacuugccgcagcuacagcccaaguaucacacuugcagcugaaaaugaccgcacaucagaagaaagagacugagcuccaaaugcagcugacggaaagucuuaaggagacagaucuguugagaggacagcucaccaaggugcaggccaaacugagcgaauuacaagagacuucggaacaggcucaguccaaguuuaaaucugagaagcagaacaggaaacaacuggagcuaaagguuaccagccucgaagaggaacugacagaccuucgggucgagaaggaaucauuggagaaaaaucugagugagcgcaagaaaaaguccgcgcaggaaagaucucaggccgaggaagagaucgaugaaaucaggaaaagcuaucaggaggagcucgacaagcugcgucaauuacugaaaaagacccggguguccacugaucaggcagcugccgaacagcuuucauuggugcaggccgagcuccaaacacagugggaagcuaagugugagcaccuccuagcaagcgccaaagacgagcaucugcagcaauaccaggaagucugcgcgcagcgagaugcuuaucagcaaaagcucguucagcugcaggagaaaugucuugccuugcaggcacaaauuacggcccugaccaagcagaacgaacagcacaucaaagaguuagaaaagaauaagagucagaugucuggcguggaggcugcagccuccgaccccagcgagaaagugaagaaaauuaugaaccaaguauuccagucgcucagaagggaauuugagcuggaagagucauacaacggucgcacuauacuugggacaaucaugaauaccauuaagauggucacacugcaguugcucaaccaacaggaacaggagaaagaggaaucuaguuccgaggaagaggaagagaaggcggaggaacggccuagaaggcccagccaggagcaaucugcuagcgccuccucaggccagccacaggcaccucugaaucgcgaacgacccgagaguccaauggugccgagcgagcagguuguggaagaggccgucccucuacccccacaagcucugacuaccucucaggauggacaccggcguaagggcgacuccgaagccgaggcacucucagaaaucaaagaugggagucugcccccugagcuuagcugcaucccaucccauagaguguugggacccccuacgucuauuccgccagagccccuggguccuguuucgauggacagcgaaugugaggaaucauuagcugccuccccaauggcggccaagcccgauaacccuaguggcaaagugugcguaagggaggucgcaccggacgggccccuccaggaaucuagcacccgccugucccuuacaucagacccagaggagggagauccucuggcucuaggccccgaaucuccaggugagccucagcccccacaacucaagaaagacgaugugacuagcaguaccgggccgcacaaggaacuguccagcacagaggccggcucuacuguggcuggagcagccuugcggccuucacaucacucccagagaaguagccugucgggcgacgaagaggaugaguuauucaagggggccacccucaaagcucugaggcccaaggcgcagccagaagaggaagacgaggaugaggucucuaugaaaggacgacccccuccaacgccccuuuuuggcgacgaugacgaugacgaugacauagacuggcuggguuga

SEQ ID NO: 56298 - RNA, 327 nt, Artificial Sequence
  derived and/or modified sequence opt3 from FKBP1A__Homo_sapiens__NP_000792
augggcgugcaggucgagaccaucagccccggggacggaagaacauucccuaagaggggucaaacuugcguugugcacuacacgggcaugcuggaagaugggaagaaguuugacuccucucgggaucgcaacaaaccauucaaguuuaugcucggaaaacaggagguaauucgaggcugggaagaggguguggcccagaugucagucgggcagcgugcuaaacuuaccauaaguccggacuaugcauacggagccacaggccaucccggcaucauuccuccacacgcgacucugguguucgauguugaauuguuaaagcuggaguga

SEQ ID NO: 56299 - RNA, 327 nt, Artificial Sequence
  derived and/or modified sequence opt3 from FKBP1B__Homo_sapiens__NP_004107
augggcguggagaucgaaaccauuagccccggggacggaagaacauucccuaagaaaggucagacuugcgucguucacuacacgggcaugcugcaaaacgggaagaaauuugauuccucuagggaccggaauaagccauucaaauuucgcauaggaaagcaggaggugaucaagggcuucgaagagggugccgcucagaugucacucgggcagcgagcaaaacuuaccuguacaccggauguagccuauggagcgacuggccaucccggcgugauuccuccaaacgcuacccugaucuuugacgucgaauuguuaaaucuggaguga

SEQ ID NO: 56300 - RNA, 429 nt, Artificial Sequence
  derived and/or modified sequence opt3 from FKBP2__Homo_sapiens__NP_004461
augagacugagcugguucagggugcucaccguccuuuccaucugccugucugccguugcuacagcaacuggcgccgaggggaagcggaaauugcagauuggagugaagaaacgcguagaccacugucccauaaagucacgaaaaggugauguguuacauaugcacuacacgggcaagcuggaagacgggaccgaguuugauaguagccuaccucaaaaccagccauucgucuuuucccucggaacaggccaggugaucaaggguugggaccaggggcugcuuggaaugugcgaaggcgagaaacguaagcugguuauuccgucugaauugggcuauggggagagaggagcgcccccuaaaaucccagguggcgcuacucucguguucgaggucgaacugcugaagauugagaggcggaccgaacucuga

SEQ ID NO: 56301 - RNA, 675 nt, Artificial Sequence
  derived and/or modified sequence opt3 from FKBP3__Homo_sapiens__NP_002004
auggccgcugcagugccccagagagccuggaccgucgagcaacugaggagcgaacagcucccuaagaaagacaucauuaaguuccuucaggagcacggcuccgauucuuuucuggcggaacauaaauuguuagggaacauaaagaauguugcuaaaacagccaacaaggaccaccuggugacugcauacaaucaucuauucgagacgaagcgguuuaaaggaaccgaaucaaucaguaagguaagcgaacaggugaaaaacgucaagcucaaugaggauaaaccaaaggagacaaaguccgaggaaacucuggacgaggguccgcccaaauauaccaagucugugcuuaaaaagggcgauaaaacaaacuucccuaagaaaggggacguugugcacugcugguacaccggaacucugcaagauggcacagucuuugacaccaauauucagacgucggccaagaagaaaaagaacgcuaaaccauugucauucaagguggguguagggaaaguuauccgcggaugggaugaggcacuccugacuaugagcaagggcgaaaaggcccgacuggagauugaacccgagugggcuuauggcaaaaaggggcagccugacgccaaaaucccacccaaugcgaagcucaccuuugaaguggaguuagucgauauagacuga

SEQ ID NO: 56302 - RNA, 1380 nt, Artificial Sequence
  derived and/or modified sequence opt3 from FKBP4__Homo_sapiens__NP_002005
augaccgccgaggaaaugaaggcuacagagagcggcgcacaguccgcgccccugccuauggaagggguggacaucucuccaaaacaagaugagggaguccucaagguuauuaaaagagaagguacuggcacggagaugccgaugauaggggacaggguguucguacacuacaccggauggcuucuggauggcacaaaguuugacucaaguuuggaucggaaagacaaguucagcuuugauuuagguaagggggaggugaucaaagccugggacauugcuaucgccacuaugaaggucggagaagugugccauauuaccuguaaacccgaguaugcauacggcuccgccggcucuccuccaaagauucccccuaacgcuacacugguuuucgaaguggagcuauuugaguucaaaggggaagaucucaccgaggaagaggacggagguauaauccgccgaauccagacucguggcgaaggguaugcaaagccaaaugagggagccaucgucgagguggcucuggaaggcuacuauaaggauaaacuuuuugaccagagagagcugagguucgaaauuggugagggggaaaacuuggaucuccccuacggacuggagcgggccauccagcgcauggagaagggcgaacacucgauaguauaucugaaaccuucauacgcguuuggcagcguugggaaggagaaauuccaaauuccaccgaaugcagaacucaaguacgaguuacaucugaaaaguuuugaaaaggccaaggaguccugggagaugaacucugaagagaaacuugaacagagcacaaucgugaaggagagaggaaccgucuauuucaaagaggguaaguacaaacaggcuuugcugcaguauaagaagauuguguccuggcuagaauacgagucaaguuuuagcaaugaagaggcccaaaaagcacaggcucucaggcuggccucucaccuuaaccuggcgaugugccauuugaagcuccaggccuucuccgcagcuaucgaaucauguaauaaagcccuggaguuagacagcaacaaugagaagggccuguuccggcgcggggaagcucaccucgccgugaacgacuuugagcuugcacgagccgauuuccagaaaguccugcaauuguaucccaauaacaaggcugcgaagacgcagcuagcaguuugccagcaaagaaucaggcggcagcuggcccgugagaaaaagcucuacgcuaauauguuugagcgccuggccgaagaggagaacaaagcaaaggccgaagcuaguucuggagaccacccuacugauaccgagaugaaagaagaacagaaguccaauacagccggcagccagucgcaaguggaaacugaggcauga

SEQ ID NO: 56303 - RNA, 1374 nt, Artificial Sequence
  derived and/or modified sequence opt3 from FKBP5__Homo_sapiens__NP_001139247
augaccacagacgagggcgccaagaacaaugaagagagccccacugcuacgguggcagaacagggggaggauaucaccuccaaaaaggacagaggaguccugaaaauuguuaagaggguggguaacggcgaagagacaccuaugauaggggauaaaguauacgugcacuauaagggaaagcucucuaauggcaaaaaguucgacucaagucaugaucggaacgagccauuugucuucagccuugguaaagggcaagugaucaaggccugggacauuggaguugcgacuaugaaaaagggcgaaaucugccaccuguuguguaagccggaguacgcuuauggcuccgccgggucuuuacccaaaauuccuucgaaugcaacccuguuuuucgaaaucgagcuacucgauuuuaagggagaggaccuguucgaagaugguggcauaauccgccgaacaaaacguaagggggagggauacucaaacccaaaugaaggcgccaccguggagauucaucuugaagguagaugcgggggaaggauguuugacugucgggaugucgcuuucacugugggcgagggcgaggaccacgauauccccauugggaucgacaaagcacuggaaaagaugcagcgcgaggaacagugcauauuguaucucggaccuagauacgguuuuggcgaggccgggaaaccaaaguucggaauugaacccaacgcugagcugaucuaugagguaacacucaagagcuuugaaaaagccaaggagaguugggaaauggacaccaaagagaagcuggaacaggcggcaauuguuaaagagaagggcacgguguacuucaagggugggaaauacaugcaagccgucauccaguauggcaagaucguguccugguuagagauggaauacggacugucugagaaagaaagcaaggcuuccgagucauuucuuuuggccgcauuccugaaucuagcuauguguuaucucaaacugagggaguacacuaaggccguggaaugcugugauaaggcgcuuggccuggacagugccaacgagaaaggguuguaucggcgcggagaagcacagcuccugaugaaugaguucgaaagcgcuaagggugauuuugagaaagucuuagagguuaacccucagaauaaggccgcucgacugcaaauuucuaugugccagaaaaaggccaaggaacauaacgagagagacaggcggauauacgcaaauauguucaaaaaguuugccgaacaggaugcuaaagaggaagcgaacaaggcaaugggcaaaaagaccuccgagggggugacaaacgagaaaggaacugacucacaggccauggaagaggaaaagccagagggccacguauga

SEQ ID NO: 56304 - RNA, 969 nt, Artificial Sequence
  derived and/or modified sequence opt3 from FKBP6__Homo_sapiens__NP_001128683
augagcgccuccucuuggccccagaacggcaugccuccaucaagucuguacgagagacucagccaaaggaugcuugacaucuccggggaucggggagugcugaaggacgucauucgcgaaggugcuggcgauuugguugcaccggacgccucuguguuaguaaaauauucgggguaccuggagcacauggaucgacccuucgacucaaauuauuuucguaagaccccuagacuaaugaaacucggagaagauauaacacuguggggcauggagcuuggucuguugagcaugaggcgcggggaacucgcgcgguuccuguuuaagccaaacuacgcuuauggaacucugggcugucccccucucaucccacccaauacgaccguguuauucgagauugagcugcuugacuuuuuggauugcgccgaaagugacaaauucugcgcacuguccgccgagcagcaggaucaguuuccucuacaaaagguccucaagguggcugcaacagaaagagaguucggcaacuaccuguuuaggcagaaucgguucuaugacgccaaaguucgcuacaagcgagcccuucuguugcucagaaggcggucugcuccaccggaggaacagcaucugguggaggcggcaaaauuacccguccugcucaaccuuagcuuuacuuaccugaaguuggaucguccuaccaucgcccuauguuauggggaacaggcucugauuaucgaccaaaagaaugccaaagcacucuuccgcugcggacaggcuugucugcuucugacagaguaccagaaggccagagacuuuuuggugagggcgcagaaagaacaaccauucaaccacgauauaaauaacgagcucaagaaacuggccuccugcuaucgggacuacguagauaaggagaaagaaauguggcaucgaauguucgcacccuguggugacggcucaaccgcuggggagaguuga

SEQ ID NO: 56305 - RNA, 666 nt, Artificial Sequence
  derived and/or modified sequence opt3 from FKBP7__Homo_sapiens__NP_001128684
augcccaagaccaugcacuuccuguuuagauucaucguguuuuucuaccucuggggccuuuuuacagcccagaggcagaaaaaggaggaaagcacugaggaagucaaaauugagguucugcaucggccugaaaacugcuccaagacgucuaaaaagggggacuuguuaaaugcucacuaugauggauaccuggcaaaggacgguucaaaauucuauuguagucgcacccaaaacgagggccauccaaagugguuugugcuagggguaggacaggugauaaaaggccucgauaucgccaugacagacaugugcccgggugagaagcgaaaagucgugauucccccuagcuucgcguacgggaaggaaggauaugagggcaagaucccacccgaugcuacucugauuuuugaaaucgagcuuuacgccguuaccaaaggcccucguuccauagagacauucaagcagaucgacauggauaaugacagacaacugucuaaagcagaaauuaacuuguaucuccagagggaguuugaaaaggaugagaaaccacgggacaagucguaccaggaugccgugcuggaagacaucuucaaaaagaaugaucacgacggggacggauuuauuucacccaaggaguacaacgucuaucagcaugaugagcuguga

SEQ ID NO: 56306 - RNA, 1242 nt, Artificial Sequence
  derived and/or modified sequence opt3 from FKBP8__Homo_sapiens__NP_036313
auggccagcugcgcugagcccuccgaaccuucugcaccacugccggccggcgugcccccucucgaggacuucgaaguccuugaugggguugaggacgcggaaggagaggaggaagaggaagaggaggaagaggaagaggaugaccugucagaauugccacccuuagaggauaugggucagccuccagcugaggaagccgagcaacccggcgcacuggccagagaauuucuagcugcaauggagccugaaccagccccggcucccgccccugaggaguggcucgacauccuggggaacggacuucugaggaagaaaaccuuggugccagggcccccugguaguagccggccaguaaagggccagguggucacagugcaccuccagacuucccuggaaaauggaacgcgcguucaggaggaacccgagcugguguucacccucggcgauugugacgucauucaagcguuagaucugucugugccgcuuauggacguaggcgaaacagcaaugguuacugccgauucgaaauacugcuaugggccucagggaucacgaagccccuacauaccaccucaugcugccuugugucuggaggugacccuaaagacagcagucgacggucccgaucucgagaugcugaccggccaggaacguguggcucuugccaacagaaaaagggagugcgggaaugcgcacuaucagcgggccgacuuugugcuggcagcuaacaguuacgacuuggccaucaaggcuauuacuuccucugccaaggucgauaugacauucgaagaggaggcacaacuccugcaguuaaaaguuaagugucugaauaaccucgccgcuagccagcuuaaacuggaccauuaucgcgcggcauugagauccugcucacucgugcuggaacaccagccagauaauaucaaggcccucuuuaggaaaggaaagguacuggcucaacagggcgaguacagugaagccauucccauccuucgggcagcccugaaguuggagccuagcaacaaaaccauacaugcugaacucucuaagcuggugaaaaagcacgccgcacagcgcuccacggagacugcguuauaucgaaaaaugcuggguaauccaucaagacuaccggcuaagugucccgggaaaggagccuggagcaucccuuggaaguggcuauucggcgcaaccgccgucgcucugggcgggguggcccuuaguguugugauugcagcuaggaacuga

SEQ ID NO: 56307 - RNA, 1872 nt, Artificial Sequence
  derived and/or modified sequence opt3 from FKBP9__Homo_sapiens__NP_001271270
auggccuucagaggcuggaggcccccuccaccgccccugcuccuucuguuguuaugggugaccgggcaggcugcaccugucgccggacuggguagcgacgcggagcuacaaaucgaacggcgcuuuguuccagaugagugcccccgaacagugcguuccggcgacuucguaagauaccacuauguggggacuuuuccugauggacagaaguucgacucuagguacugggauacggcugaagacaaagccgauaagucaccauguccccagguccgggugggcguuaacaccaguccuagcugccgccucaaacagaaggguguggggauuuauuggaaagaccugcaauuucuugucagagugcagaaucauggacuguccuacgauagggacucuacauucaacguauuuguuggcaagggccaguugauaacugggauggaucaggcacucgugggaaugugugucaaugagcggcgcuucgugaagaucccaccgaaacuggccuaugguaacgaaggcgugucgggggucauucccccuaauucaguucugcacuuugacgugcucuuaauggauaucuggaacagcgaggaccaaguacagauucauaccuacuucaagccacccaguugcccucgaacaauccagguguccgacuuugucagauaucacuacaauggaaccuuccuggauggcacucuuuuugacucuagccauaacaggaugaaaacauacgauaccuauguggguauagggugguugaucccaggaauggacaagggccugcuaggcauguguguuggggagaaacggauuaucacgauucccccguuccucgcuuacggagaagauggugacggcaaggauaucccugggcaggcaucccugguguucgacgucgcccuucuggauuugcacaaucccaaggacucaauaaguauugagaacaaagugguaccagaaaauugcgagcguaucagccaaucuggagauuuucuccgcuaucacuacaacggcacucuguuagacgguacccuguucgacuccucauauagcagaaauaggacauuugauacuuacauugggcagggcuauguuaucccuggaauggacgagggccuccuugggguguguaucggagaaaagcggcgaauugucgugcccccacaucuggguuacggcgaggaagggcgcggaaacauacccggcagugcugucuugguguucgauauccacguuauugacuuucauaauccuucugauuccaucagcauaaccucgcacuacaaaccaccggacugcucugugcuauccaagaaaggugauuaucugaaguaccacuauaacgccucacuccuggacgggacacuucuggauaguaccuggaacuugggcaaaacguacaauauuguacucggaagcggccaggucgugcuggggauggacaugggauuaagagagauguguguuggugaaaagaggacugugaucauucccccucaucugggcuauggggaggcgggagucgauggcgaggugccagguuccgcaguacuuguguucgacaucgaacuccuggagcuuguugccggguugcccgaaggcuacauguuuaucuggaacggagaggucucuccuaaucuguucgaagagauugauaaggacggcaacggggaggugcuccuggaagaguuuagcgaauauauacacgcucaaguggccucaggaaaaggcaagcuagcaccagguuucgacgcugagcugaucgucaaaaauauguuuacaaaccaggaucggaauggggacggaaagguuaccgccgaagaguucaaauugaaggaucaggaggcgaagcaugacgaacucuga

SEQ ID NO: 56308 - RNA, 1050 nt, Artificial Sequence
  derived and/or modified sequence opt3 from FKBPL__Homo_sapiens__NP_071393
auggagacacccccugugaacaccaucggcgaaaaggacacuagccagccacaacaggagugggaaaagaaucugagagagaaccucgauuccgucauucagauaaggcagcaaccgcgggaucccccuacggaaacccuugagcuggagguuucuccagaccccgccucacagaucuuggaacacacacagggggcugagaaguuaguggcagaacuggagggagacagucauaaaagccacgguuccacuucucagaugccugaggcccuacaagcgucggaucucugguacugcccagacggcucauucguaaagaaaauugugauccgcgggcauggacuggauaagcccaaacuuggcagcuguugccgaguccuggcuuuggguuuuccuuucgggaguggaccaccggaaggcuggaccgagcucacaaugggcguggggcccuggcgugaagagaccuggggagaacugauugagaaaugucuggaguccaugugccagggugaagaggccgaacuccaguuaccuggccacucugggccacccguuagacugacucuugccagcuuuacacagggaagggacuccugggaguuggaaaccucagagaaggaggcacuggcucgggaggaacgcgcaagaggcacggaacuauucagggccgguaauccugagggggcugcccgguguuauggacgcgcgcuccgacugcuucugacuuugccacccccgggcccucccgaaagaaccgugcuccaugcaaaccuggccgcuugccaauuacugcucggccagccacagcuugccgcacaaaguugugauaggguccuggagcgggagccugggcacuugaaagcucuauaccgucgcggaguggcccaggcggcccuggguaaucucgaaaaggcaacagcugaccugaaaaagguacuugccaucgaucccaagaacagagcugcccaggaggaacugggcaaaguugugauacaggggaagaaucaagacgcaggauuggcccagggccucaggaaaauguuugguuga

SEQ ID NO: 56309 - RNA, 1488 nt, Artificial Sequence
  derived and/or modified sequence opt3 from FKRP__Homo_sapiens__XP_011525609
augagacugaccaggugccaggccgcucucgcagccgcgaucacacuuaaccuguugguguuauucuacgucagcuggcugcaacaccagccccgcaauucccgggcucgaggcccucguagagccucugcagccgggccaaggguuacugugcuaguacgggaguuugaggcuuucgacaacgcagugccggaacucgucgauucauuucugcagcaggaccccgcccaaccugugguuguggcugccgauacgcuuccauaucccccucuggcguugccacgcauucccaaugucagacucgcacugcugcagccugcccucgacaggccagcugccgcaagucggccggaaaccuacguggcuacagaguucguagccuuaguucccgauggagcgcgcgccgaagcaccuggucugcuugagcgaaugguggaggcuuugagagccggcagcgcuaggcuggucgccgcaccaguggccacugcuaaccccgcgcggugucuagcacucaaugugucccugcgugaauggaccgcccgcuauggggcugccccugcagccccaagaugcgacgcucuugauggagacgccgucguucuguugagggcacgggaucucuuuaaccugucugcgcccuuagcucgaccggugggcacaucgcuguuccuccagaccgcccuucgcgguugggcaguacagcuguuggaccuaacuuuugccgcugccagacaaccuccccuggcaacagcucaugccagguggaaggcggagcgggaagggcgcgccagaagggcugcacuccugcgugcccuuggaauacggcuggugucaugggagggcggccgauuggagugguucggguguaauaaagaaaccacgagaugcuuuggaacugucgugggugauaccccagcuuaccucuaugaggaaagguggacaccucccuguugccugcgcgccuuacgggagacugcaagauacguugugggcguccuggaagcggccggggugagguauuggcuagagggaggcagccuccugggugcugcccgccacggggacaucauuccaugggauuacgacguagaccuuggaaucuacuuggaggauguuggcaacugugaacagcugcgaggcgcagaggcugggaguguggucgacgaacggggauucgugugggagaaggccgucgaaggugacuuuuuccgugugcaguauuccgagucuaaucaucuccacguugaucuguggcccuuuuacccuagaaacggcgugaugaccaaagauacauggcuugaccauaggcaggauguagaguucccagaacacuuccugcaaccguuggucccccucccuuuugcaggguucguggcccaggcuccaaauaacuaucgccgguuucuggaguuaaaguucggacccggcguuauugaaaauccucaguacccaaaccccgcgcugcuaagccucaccgguuccggguga

SEQ ID NO: 56310 - RNA, 1386 nt, Artificial Sequence
  derived and/or modified sequence opt3 from FKTN__Homo_sapiens__NP_001073270
augagcagaaucaacaagaaugugguccuggcccuccuuacccugacauccucugcuuucuuguuauuucagcuguacuauuacaaacacuaucuaucaacuaagaacggcgcagggcucaguaaaagcaagggauccaggauugguuucgacucuacgcaauggcgggccguuaaaaaguuuauaaugcugaccucgaaucagaacgugcccguauuccuuaucgauccucugauuuuggagcucaucaauaagaacuuugaacaggugaaaaauacaucacauggcagcaccagucagugcaaguucuuuugugucccacgcgacuucacugcguuugcucugcaauaccaccuguggaaaaacgaggaagggugguuccgaauugccgagaauaugggauuucagugccucaagaucgaauccaaagauccgcguuuagacggcauagauucucugagcgguacagagaucccccuucauuauauuuguaaguuggcaacccacgccauccaucuggugguuuuccacgagagauccgggaacuaccuauggcacggacaucucaggcugaaggaacacauugaccggaaauuugugccuuuccgcaaacuucaguucggcagauauccaggcgcuuuugauaggcccgagcugcagcaagucacuguggacggguuggaaguacucaucccuaaggauccaaugcauuucguugaggaggugccccacucacgguuuauagaaugccgcuacaaggaggcacgagccuucuuucagcaguaccuggacgauaauacagucgaagcuguggccuucagaaaaagugcgaaggaguuacugcagcucgcagccaaaacccuuaacaagcugggagugccuuuuugguugagcucugguacgugucuaggcugguauaggcaaugcaauauuaucccauacuccaaggacgucgaucuggggauuuucauccaggacuauaaaucagacaucauucucgcuuuucaggaugccggacugccgcuuaagcacaaauucggcaagguugaagacagccuggaguugaguuuucaagguaaagaugacgugaagcucgauguauucuuuuucuacgaggaaacugaccauauguggaacgggggaacccaggcaaagacaggcaaaaaguucaaauaucuguuucccaaguucacuuuauguuggaccgaguuuguggauaugaaaguccacgugccuugcgaaacacuggaguacauagaagcuaauuauggcaagaccuggaagaucccaguuaaaacgugggacuggaagcggucucccccuaacgugcagccaaacgggauuuggcccaucuccgagugggaugaggucauacagcuauacuga

SEQ ID NO: 56311 - RNA, 1341 nt, Artificial Sequence
  derived and/or modified sequence opt3 from FLAD1__Homo_sapiens__NP_001171820
augaccagcagagccuccgagcugucucccggcaggucagugacagcugggaucauuauagucggagacgaaauccucaagggucacacucaggauacgaacaccuucuuucuuugccggacacugcgcaguuugggcguucaggugugucgaguaagcguggucccugacgagguggcaacuauugccgcggaaguuaccuccuucucuaaucguuuuacacauguguuaaccgcugggggaaucggcccaacucacgaugacgucacauucgaggccguggcacaggccuuuggugaugaacugaaaccgcaucccaagcuagaggcugcaaccaaagcccucgggggagagggcugggaaaagcugucgcuuguaccuucaagcgcuagacugcacuacggcacggacccaugcacugggcagcccuucagguuuccuuugguuagugugcggaacgucuaucucuucccagguauucccgagcugcugcgcagagugcucgaaggaaugaaaggcuuauuucagaauccugccgugcaauuccauuccaaggagcuguacgucgcggcagaugaggccucuaucgcuccaauacuugccgaagcacaggcucacuuugggaggcgguugggacugggcagcuauccggacugggguuccaacuacuaucagguuaagcuaacccucgauucagaggaagaggggccccuggaagagugucuugccuaccugacagcgcgcuugccucagggaagucucgugccauauaugcccaaugccguagagcaagcaagcgaagcuguguacaaacuggccgagucuggcuccucauuaggcaagaaagucgcuggggcccugcagacuaucgaaaccagccucgcacaguacagucuuacacagcugugcgugggauucaacgguggcaaggacuguaccgccuugcuacaccuguuucaugcugcgguucaacgaaaacucccugaugugccaaauccccugcagauucuuuauaucagaucuauuuccccguucccugagcuggaacaguucuugcaagacacgaucaagagguacaaccuccagaugcuggaggcagaggggagcaugaagcaggccuuaggagaacugcaggcucggcacccccaacuagaggccguccucaugggcacucgucgcacagauccauauucgugcucucuguguccuuuuucccccaccgacccagguuggcccgcauucaugagaauaaauccucuuuuggacuggacuuacagggauauuugggacuuucugcggcaacucuucgugccauauugcauccuguacgaucgaggguga

SEQ ID NO: 56312 - RNA, 1029 nt, Artificial Sequence
  derived and/or modified sequence opt3 from FLCN__Homo_sapiens__NP_653207
augaacgccaucguggcucugugccacuucugugagcuccauggccccagaacccuguuuugcacagaaguccuucacgcaccuuugccacagggggacggaaaugaggauagcccgggucaaggcgaacaggccgaggaagaggagggagggauucagaugaacuccaggaugcgggcgcauucucccgcugaaggcgccucaguugagaguagcuccccugguccaaagaaaucugacaugugugaagggugccgcucguuagcagccggacaccccggcuacauaucacaugauaaggagacuagcaucaaauaugugagucaccagcacccuucccauccacaacuguucucuauuguacgacaggcuugugugcguagccuauccugcgaggucugucccggcagagaagggccuaucuuuuucggagacgagcagcacgguuuuguguucucacauacguuuuucauuaaggauagucucgcaaggggcuuucagcggugguacagcaucauaaccaucaugauggaccgcauuuaucugaucaauucuuggccauuccuucuggggaaaguuagaggaauuaucgaugaauugcaaggcaaggcccucaagguguuugaggcugaacaguucgguugcccgcagagggcccagcggaugaacacagcguuuacucccuuccugcaccaacgcaaugggaacgcagcccgaucccugaccucacucacaagcgacgauaauuuaugggcuugucugcacaccaguuucgccuggcuuuugaaagcaugcggaucuagacugacugagaagcuacucgagggcgcuccuacagaagacacccugguccagauggagaaacuugccggcgaagcgggggugcuguugccaggacccuggccugguuggccauggggcgggacguccugucuccugagcuggcaggagucguuaagggaaggaaacgccgcacugaaucaaccccggacuucucuccgugaggcucauccgccuauauccguauga

SEQ ID NO: 56313 - RNA, 7176 nt, Artificial Sequence
  derived and/or modified sequence opt3 from FLG2__Homo_sapiens__NP_001014364
augaccgaccugcucagaagcguggucacaguuaucgauguguucuacaaguauacuaaacaggacggcgagugcgggacgcuuuccaagggagaacugaaagaguuguuagaaaaggagcugcaccccguacuaaaaaacccugaugacccagauaccguggacgucauuaugcauaugcucgauagggaccacgaucggcgccuggacuuuacagaauuccuucugaugauauuuaaguugacuauggccuguaauaaggugcucucuaaagaguacugcaaggcuucagguaguaaaaagcaucgacguggccacagacaucaagaggaagagagcgaaaccgaggaggaugaagaggacacaccggggcacaaauccggauauaggcacucuucguggucagaaggcgaggaacaugguuacagcagugggcacucccggggaaccguuaagugucgccauggcucuaacagcagaaggcugggccggcaggggaaucuguccucaaguggaaaccaggaggguagccagaagcgcuaucaccgaucuuccugcggccacucauggagcgggggaaaagauagacauggcaguucuuccguggagcucagggaacggaucaauaagagccacauuucgcccucucgugaguccggugaagaguacgaaucagggaguggaagcaacuccugggagcgcaaaggccauggcggguuaucuuguggacuggagacuagcggucacgaaucaaauaguacacaauccagaaucagggagcagaagcuuggcagcucuugcucagggaguggagacagcggccggcgaucccaugcaugugguuauucuaacucgagcgggugcggccgcccucagaaugccuccucaaguugucagucucacagauucggaggccaagggaaccaguuuagcuacauucaguccggaugccagucagguaucaaaggcgggcaaggacacggcugugucagcggugggcagccaucuggcugcggacagcccgaauccaauccuugcagucaaagcuacucucagaggggcuauggggcgcgggagaacggacagccacagaauugugguggccaauggcgcaccggguccucacagaguagcugcuguggacaguacggcucgggugggucccagucuugcagcaacggccaacaugaauauggaucauguggcagauucaguaauuccucuagcuccaacgaguuuucaaagugcgaccaguacgggagcggaaguucucaguccacgagcuucgagcagcacggcacugguuugucgcaaucaucuggguuugaacagcauguguguggaaguggccagaccugcggucagcacgaguccacaagcucucaaagccugggcuaugaucagcacggguccucaaguggaaaaacuagcggcuucgggcagcauggaucuggcuccggucaaucaaguggguuuggacaguguggcagcgguuccggccagucuucgggguucggacagcacggcagcguaucagggcaauccaguggauuuggccagcaugguucuguuagcgggcaguccucaggauucggccagcacgaaucuaggagccgucaaaguuccuacggucagcauggcagcgggucuucacaguccaguggauauggccaguacgggagccgggagaccucgggauucggccaacacggucuagggucuggacaguccacaggcuuuggccaguacgggagcggaucaggucaaaguucuggcuucgggcagcacggauccggcagcggucagucaaguggguuuggacagcaugagagccgauccggccaaucuagcuauggccagcacuccucagggucuagucagucgagcggauacggucagcauggcuccagacaaaccucuggguucggacagcacggcucagguagcucccagaguacgggguuuggacaguauggcucuggcagcgggcaaucauccggauucggucagcaugugaguggcagcgggcagucuuccggauuuggccagcacgaaucaaggagcggucacucgucuuacgggcaacauggauucggcaguucccagagcucaggcuaugggcagcacggauccucuagcggucaaacuaguggcuuugggcagcaugagcucuccagcggacagucuucaaguuucggccagcacgguuccgggagcggacaaucuucgggcuuuggccagcacgggucaggaagcggucaguccaguggcuucgggcagcaugaaucucgcagcggacaauccucauacggccagcacaguucugguagcucccagucaagcggguauggccagcauggaucucggcaaacauccggcuuugggcagcacggaagugguagcucgcaguccaccggcuucgggcaauacggaucuggcucaggucagagcgcuggguucggccagcauggaaguggcuccgggcagucuagcggauuuggucaacacgagucaagaucccaccagaguagcuacggccagcaugggucuggaucaucccagagcucuggcuauggucaacacgggaguucguccggccagacuagcggauucggccagcauaggucaucuagcgggcaguacuccggauuuggccaacacgguagugggucaggacagucuagcggcuucggucagcacggcacaggguccggacaguauaguggcuuugggcaacaugaaagccgcucccaccagucuucauacggacagcauggcagcgguucgucccaaaguucuggguauggacagcacggcagcucauccggucagaccuucggcuuugggcagcaucgaucuggaaguggccaaagcuccggguucggacagcacggcucagguagcgggcagucuaguggauuuggccagcacgaguccggcagcgggaagucaucuggauucggucaacaugagucccggucgagccagaguaacuacggccagcacgggucuggauccagccagucaaguggcuauggucaacauggguccagcucuggacagacgaccggcuuuggccagcaccguucaagcuccgggcaauacucuggauucggucagcacggcagugggucggaccagagcuccggauuuggccagcaugguacagggucaggacaaucuagcggcuucggccaguacgaaaguagauccaggcagucaucuuaugggcagcacggaagcgguuccagucaaagcucuggcuacgggcagcauggaucaaauuccggccagacuagcgguuucgggcagcaccgccccggaaguggccaaucuuccggcuuugggcaguauggaucggguagcggccagucauccggguucggacaacauggcucugguaccgggaagaguagcggauuugcccagcacgaguaccggucaggccaguccagcuauggccagcacgggacaggaucuagucaauccagcgguugcggccagcaugaaucagggucuggaccuacuaccucguucggccagcacgucagcgguuccgauaacuuuaguucuucagggcagcauauaagcgacuccggacaaaguacaggcuucggccaguacgggucuggaagcggucaguccaccggccuggggcagggagagucacaacagguggaaagcggcucuacugugcacgguagacaggagacgacacaugggcagaccaucaauacuaccaggcacucccaaaguggccagggacagucaacacaaaccggcagccgagucacucgccggagaaggucgucccagucugagaacagugauagcgaaguucacucaaaagugucccaucgucacucugagcauauucacacacaggcagggagccacuauccaaagaguggauccacgguacgccggagacaggguaccacucauggccaaaggggggacacaacccgacacggacauagcggccacggucagucuacacagacugggucacggaccuccggccgccagagauuuagccauagugaugccacggacucugaagugcacucaggagucucccacaggccgcauagccaagagcagacccacucgcaggcuggcucucagcauggggaaagugaguccacagugcacgagcggcacgaaacuaccuacggacaaacaggugaggcaacuggccaugggcacagcggacauggccagucaacccagcgagguucuagaacgacaggccgcagggggagcggacacuccgaaaguucagauagcgagguucauuccggcgggucucaccguccccaaagucaggagcagacccacggacaggccggcagccaacauggugaauccgggucaacugugcacggacggcauggcacaacccacggucagacuggcgacaccacaagacaugcucacuaccaccaugggaaaucuacgcagaggggaucgagcaccacuggccgccgaggguccggacacagugagucuagcgauucagaaguccauuccggcgguagccacacacacucugggcauacccacggacagaguggcucccaacauggugagucagaaagcaucauucacgacagacaucggaucacacacggccagacuggggacaccacgaggcacucuuauucgggacaugagcagacaacccagacuggcucccgcaccacagggcgucaaagaacuagucacagcgagucaaccgauucugaagugcauuccggaggcagccaccggccucacaguagggagcauacauacggucaggccgggucacagcacgaagagccagaauucacgguacaugagcgccacggaaccacucauggccagauaggcgacacaaccgggcacucccacagcggacauggucaaucuacucagcgaggcaguagaacaaccgggcggcagaggagcucccacucugagucaagcgauuccgaaguucauucgggagugucucacacgcacacuggccauacccacggucaagcggggagucagcauggacagagcgagucaauuguccccgaacgccacggcacaacccauggccagacuggggacacaaccagacacgcacacuaucaucacggacuuacaacucaaaccgguuccaggacgacaggccggcgugggucuggacauagcgaguacuccgauagugaaggcuauucaggugugagccacacccauucugggcacacucacggacaggcccgcucccagcauggcgagagugagagcaucguccacgaacgacauggcaccauucacgggcagacaggagacacuaccagacacgcucauucaggucacggccaaucuacgcagacaggguccaggaccacuggacggcgcucgagcggccauagugaguacuccgauucugaaggucacucaggguuuagccagagaccucauuccaggggacacacacacggccaggccggcucucaacauggggagagcgagaguaucguggacgaacggcacggaaccacucauggucagacaggcgauaccucagggcacucccagagcggacacggccaaucuacgcagagugguuccagcacuaccgggcgaagacgcucaggacauucggagucuagcgacuccgaaguucacaguggcggcucacauacacacucugggcauacccacagccaggcaaggucccagcacggagagagugaaagcacagugcauaagcggcaccaaacuacccauggucagacgggcgauacaacugagcacgggcauccaucucacggacagaccauccagacaggcucccguaccacugguagaagggggucaggccacagcgaguauucggacuccgaaggacccucuggcguaagucauacccacucagggcauacacacggacaagcugguagccacuacccggaguccggcucuagcguccaugaacgccacgggacgacucauggacagaccgccgauacaacccggcacggccauaguggucacgggcagucaacucagcgaggcuccagaacaaccggaaggcgcgcgagcggccacucugaguacuccgacagugaagggcauagcggagugucacacacgcauucuggucacgcccacggccaagcagggucccagcauggagagagcggcucgaguguucacgagcggcaugguacuacacacgggcagaccggcgacaccacuagacaugcucacucuggacacggccaaucaacacagcguggguccaggaccgccggacggcgcgguagcggccauucugaaagcuccgauagugaggugcacucaggggucagccauacacacuccggacauacuuauggccaggcucgaucucagcacggugaaaguggcucagccauucacgggagacaaggaacgauacauggccagaccggggacacaacuaggcacggacagagcggccauggucaguccacccaaacagggucucggaccacuggacgccagagaucgagccacuccgagaguucagauucugaagugcacagcgaggcauccccuacgcauaguggccacacccauucucaggccgguagcaggcacggccagucaggguccagcggacauggccgacaagggacaacucacggacagaccggcgacacaacccggcacgcucauuacgguuaugggcagucuacucagcguggaucaagaacaacgggccgcagggguaguggccacuccgagagcucggauucugaaguacauuccugggggagccacacccacucaggacauauccaaggccaggcggggagucagcaacggcagcccggaucuacugugcacggcagacuggagacaacccauggucagaccggggacacaacucgccacggacauuccggcuacggccagagcacgcaaaccgggucaaggaguucccgagcaagccacuuccagucucacucgagcgaacggcagagacauggauccucacagguuuggaaacacgguucuuauggcccagccgaguacgauuaugggcauacaggauacggcccuaguggugggagcaggaaguccauuucuaauucacacuugagcuggaguacugacuccaccgcuaacaagcaacucucucgccacuga

SEQ ID NO: 56314 - RNA, 12186 nt, Artificial Sequence
  derived and/or modified sequence opt3 from FLG__Homo_sapiens__NP_002007
augagcacccugcuagagaacaucuucgccauuauaaaucuuuuuaagcaguacuccaaaaaggacaaaaacacugauacucugucuaagaaagaauugaaggaguuacuggaaaaggaguuccgacaaauccucaaaaaucccgacgauccugacaugguggaugucuuuauggaccaccucgauauugaccauaacaagaaaaucgauuucacggaauuucugcuuaugguuuucaagcuggcucaggcauauuacgagucaaccaggaaagagaauuugccaauuaguggccacaagcaucggaagcacagccaucacgacaaacacgaagauaacaagcaggaggaaaauaaagagaaccgcaagcgaccguccucucucgagcguagaaauaacaggaaagggaauaagggacggucgaaaucaccccgcgaaacugguggcaagaggcaugagagcaguuccgaaaagaaagagaggaagggguauucuccuacucaccgggaagaggaguacggcaaaaaccaucacaauagcuccaagaaagaaaagaacaagaccgagaauacacgccugggcgacaaccgaaaaagacugucagaaaggcucgaggaaaaggaggauaacgaggaagguguguaugacuacgagaauaccgggcggaugacucagaaauggauccaaaguggacacauagccacauauuacaccauccaggacgaagcguacgauacgacugacagcuuacuggaggaaaacaagauuuaugagcguucucgcuccucagauggcaaaagcaguucucagguaaauagauccaggcaugagaacaccagccaggugccacuucaagaaucgcggacacgaaagcgcagaggcucuagggucucccaggaccgggauucagaggggcacagugaagacagcgagcgccauuccggaucugcuagcagaaaucaccaugguucagccugggagcagaguagggauggcucccgucacccccggagccacgacgaagaucgagcaucucaugggcacucagccgacaguagcagacaguccggaacuaggcaugcugagaccucuucgcgcggccaaacagcaagcucccacgaacaggcccggucaaguccuggugagagacacgggucuggacaucagcaaagcgcugauuccucaaggcacagcgccaccggccgcggccaggcgucuuccgcagugagugaccgagggcaucggggaagcucugguucccaggccucagacagugaaggccacagcgagaacucggauacgcaguccguuucugggcauggaaaggcuggcuugcgucaacagagccaccaggagucaacuagagguaggaguggggaacgcuccggccggucuggaagcucccuguaccaggugucaacacacgagcaaccagacagcgcccauggcagaaccgggacaaguacaggagguaggcagggcucucaccaugaacaggcacgagauuccagccgccacucggcuucacaggaggggcaagacaccauccggggacaucccggcucuaguagaggugggaggcagggcucccaccacgaacagagcgucaaucguucuggacauagcggcucccaccauucacacacgaccagucaggggcgcagcgaugccucucacggacaauccgguucacggagugcgagcagacagacaaggaacgaggagcaguccggcgacgggacucgacauucuggaucgcggcaccaugaagccagcucacaagcagauuccagucgccacucucaggugggccagggucagagcuccgggccuagaaccucaaggaaucaaggcucuagcguaagucaggacuccgauagccagggacauucugaggacucagaacggugguccggcagugcuagccgaaaccaccacgggucggcccaggagcaaucuagagauggaucccgccauccaaggagccaccaugaagaccgugcuggccacggucacucagccgauaguucucggaaauccgggacaagacauacucagaauagcucaaguggacaggcagccagcucccacgagcaggcuaggucuagcgcgggcgagcgccaugguucccgacaccaacuacagucagcagacucuaguagacauucgggcaccgggcacggacaggccagcuccgcuguucgggacucuggccacagggggucaagcggaucccaagccacagauagugaaggccauucugaggacagcgauacccagucaguguccggucacgggcaggcaggacaucaccagcaaagucaccaggaaagcgcccgcgaccguucuggcgagagaucccggaggucagguagcuuucucuaucaggucucgacucauaagcagucugagaguucccacggcuggacggggccgagcacaggagugcgccaaggcucacaucacgaacaggcucgagauaacuccagacauucugccagccaggacgggcaggauaccauucggggacaccccggcaguuccaggcgcgguagacaagggagccaccaugagcagucuguggacaggucaggacacaguggcucccaucacagccauacuaccucucagggucggucggaugcaucacguggccagagcgggucccgcagugcgucucgaacaaccagaaaugaggaacaaagcagggacggaucccggcacucaggcagucgccaccaugaggcuucuagccacgccgauaucuccagacauucacaggcagggcagggacaaagcgagggcucuaggacuucccggcgacaggguaguagcgucucgcaggacuccgauucugaggggcacucagaagacagcgagagauggaguggauccgccucucgcaaccacaggggcagcgcucaggaacaaucacggcauggcucccgucacccuagaagucaucacgaggacagggccgggcauggacacagcgcagauucuucacgccaguccgguacaccacacgcugaaacgagcucuggcgggcaggccgcgaguucgcaugagcaggcccgguccagccccggagagcgacacggcucaagacaucaacagucugcugacagcuccaggcacagugguauaccucgccggcaggcaucaucugccguuagagauagcgggcacuggggauccaguggcagccaggcuuccgacucugaaggccauucagaggaaagcgauacccaaucgguguccgggcacggacaggacgguccacaucagcaaagucaccaggagucugcccgugauuggagcggcgggaggucaggacgguccggcucuuucauuuaccagguaaguacucaugaacagagcgaguccgcacacggucgcacacgaaccucaacagggagaaggcaaggaagccaccaugagcaggcgcgggacucuagucgccacuccgccagccaggaaggccaggauacuaucagagcucaucccggcucaaggcgagggggacggcaagguucucaccaugagcaguccguggaccguucgggccacagcgggagucaccauucucacaccacgucccagggaagaagcgaugccucacauggccagagugguucccgcagcgcaucuaggcaaacccggaaagacaagcagucaggggacggaagcagacacuccggcucucgccaccaugaagcugccaguugggcagauucgagcaggcacucccaggucggccaggagcaaucaucugggagccgaacaagucggcaucagggauccucagugucucaggacagcgauuccgagagacacagugacgauagcgaaaggcugucugguucagccucccgcaaucaucacggcagcagucgugagcaaucucgggacggguccagacacccgggauuucaucaggaagauagggcuucgcacggccauagcgcggacucaucccgccagucugguacucaccacaccgagaguagcucacaugggcaggccguuuccagccacgaacaagcacgaucuaguccuggagagcggcauggcuccagacaccagcagagcgcugauucaucuaggcauucgggcauugggcaccgccaggccagcuccgccgugagagacaguggacaccgggguucuucaggcagccaagucacaaacuccgaggggcauagugaagauucugacacucagagcguguccgcucacggacaggcaggcccccaucagcaaucacacaaagagagcgccaggggucagucuggggaauccaguggccguucacgcagcuuccuuuaucagguaucgucccacgagcaaucugaaaguacccauggacagacggcgccaagcacaggcgggagacagggaucaagacacgagcaggcucggaacuccucuaggcauagcgccagucaagauggucaggacaccauccgcggccacccuggguccagcagaggaggccggcaggguucuuaccaugagcagucaguugacagguccgggcacagcggcuaucaccauagucacacuacaccccaaggacgaucugaugcaucacauggccaguccgggccacguagcgccucgagacagacccgcaaugaggaacaaucuggagacgguagucggcacuccggcagcaggcaucacgaacccucaacuagagcugggucuagccgccacucccaagugggacagggcgagagugcagguucaaagaccagccggaggcagggguccucugucagucaagaucgagacagcgaaggccauuccgaggauucagagagacggucugaaucggccagcaggaaccacuacggauccgcgcgcgagcagagucgucauggcucuagaaauccucgaagccaccaggaagacagggcuucacacgggcauuccgccgagagcucucggcagaguggaacacgccacgcagagacguccucaggcggucaagccgcuagcucucaggaacaggccagaucguccccaggggagaggcauggaagucggcaccagcaaagcgcagauucaucuaccgacuccggcacuggucgcagacaggauagcaguguggucggcgacucagggaaccgaggauccagcggcucucaggcuagugauagcgaagggcauuccgaggaaucugacacacagucagugagcgcccacggacaagcgggcccgcaccagcagucccaucaggagucgaccaggggucaaucuggggagcggaguggacguagcggcucauuucuguaccagguuuccacacacgaacagucugagagcgcccauggucgcacuggccccuccaccgggggaagacaaaggagucggcacgaacaggcaagagauucaagccgccacucugcuucccaggagggccaggacacgauccgagggcauccuggaaguagcaggggcggucggcaagggucacacuaugaacagucuguggacuccucgggacauagcggcagucaccauucccacacaaccucucaggagagaucagauguaagccguggccaguccgggucucgcagcgucaguaggcaaacucggaaugagaagcagucaggagacgguuccagacacagcggcucucgacaucacgaagccaguuccagggcugauagcucacgccauucgcaaguggggcagggacaaucuagcggcccacggaccuccagaaaccaggguaguucaguuucucaggacagcgauucccaagggcacagugaggacagcgaaagguggucuggauccgcaucacgcaaucauuugggcagcgccugggagcagucgcgugauggcucccggcaccccgggucucaccaugaagacagagccggacacggucauagugcugauucaagccgacaguccggcacaaggcacacugagucuagcagucgcgggcaggcggcaucaucccacgagcaagcccggagcucugcuggagaaagacauggcucccaccaucagcuccagagugccgacagcucaaggcacucugguauugggcauggacaggcauccagcgccgugcgcgauucgggccacagaggcuacagugggucucaggcuucagacuccgagggacacagcgaagacucugauacccagagcgucuccgcgcaggguaaagccggcccucaucagcaaagucacaaggagucagcacgggggcagagcggagaguccucuggccgaagugguucauuccuguaucaggugagcacacaugaacaguccgagucuacgcacgggcaaucggcuccaagcaccggaggcaggcagggcucccacuacgaccaggcccaagauaguucacgucauucugcaagccaggaagggcaggacacuauaagaggacaccccgguccgucccggggcgggcgccagggaagucaucaagagcagucuguagauaggagcggccacucagguucccaucacagccacacaaccucucaggggcgaucagacgccaguagaggacaguccggcagccggucggcuucucgcaaaacuuaugauaaggaacaauccggcgacgggagcaggcauucaggaagucaccaucacgaggccucuuccugggcggauagcucaagacauaguuuagugggucagggccaguccagcgggccucggacaucucguccacgcggaucgagcguuucccaggacucagauucugagggccacagugaagacagcgagaggcgauccgguucugcaucaagaaaccaccaugggagcgcccaagaacagagucgggauggauccaggcacccccgcucucaucacgaggacagagcuggccacggccauagcgccgaauccucacggcagagugggacccaccaugcugagaauagcucuggaggucaagcagccuccucgcacgagcaggcuaggagcucagccggcgaacgccaugggagucaccaccagcaguccgcagacucuagccgacauucaggaaucggccacggucaagcguccucugccgucagagauagcgggcaucguggcaguuccggaagccaggcuucugacucagagggccacagugaagauuccgacacgcagagcgugucugcccacgggcaggcaggaccucaucaacagucgcaccaggagucaacucgggguaggagcgcuggccgcuccgggagaaguggaucuuuucuguaccaggugagcacccaugaacaauccgagucagcccacggccggacagguaccaguacugggggcaggcagggaagccaucacaaacaggcacgagauucuuccagacacagcacaucacaagagggccaggacaccauucaugggcaccccggaucuuccagugguggccgccaggggagccauuaugaacagcucgucgaucggucgggacacuccggcucucaccauucacacacaacuagccaagguaggagugacgccucccauggccacucugggagccguucagcuaguagacagacccgcaacgaugagcaguccggagacggcagcaggcauucugggucccggcaccacgaagcgucaagccgagccgauaguucuggacauucgcagguuggccaaggucaguccgaggggccaagaacgagccgcaauuggggaucaucuuucagucaggacagcgacucccagggccacucagaggauagcgaaaggugguccgguucugcaagucggaaccaucacggcagcgcucaagagcagcuuagagacgggucccgucauccucgcucucaccaggaagauagggccggacacggccauucagccgacucgagccggcagagugggacacgacacacccaaacuuccucuggaggccaggcagcuagcucacaugagcaggccagauccagugcgggugaaaggcacgggucucaccaucaacagagcgcugauuccucacgccacagcggaaucggccauggucaggccucuagugcagugcgggacuccggccacagaggguacagcggaucgcaggccucugauaaugagggccauucagaggacuccgauacccaaagcgugagugcucacgggcaggcaggaucucaccagcagucccaucaagaaagcgcccgaggcaggucaggugagacaagugggcacuccggcagcuuccuguaccagguaucuacucaugaacagucagagagcucccacggauggaccggccccaguacgcgggggcgccagggaucuagacacgaacaagcgcaggacucgagccgucauuccgcuucacaggauggucaagacacaauaaggggccacccagggucuagucggggaggcagacaggguuaucaucacgagcauagcgucgauuccucagggcacucuggaagccaccauucccacaccacaagucagggccgcagcgacgccucuaggggccaguccgggucacgaagcgcaagucggacaaccagaaacgaggaacaaucgggagacgguucucgccauuccggcagcaggcaccaugaggccucaacucacgcugauauuagucgucacucccaggccgugcaggggcagucugaaggaagcagacggucacgcaggcaaggcuccagcguuucucaggacagugauuccgagggucauagcgaagacucagagcgauggucugggucggcaaguagaaaucaccauggaagcgcucaggagcaguugcgggauggcucccgccacccgaggucucaccaagaagacagagccggccaugggcacucagcggauagcucccggcagaguggaacacgucauacccagacgucuagcgguggccaggccgcauccucacacgagcaagcucgaagcagugccggggaaaggcauggaucucaccaccagcaguccgcagacucgagccgccauucaggcaucggucacgggcaggcuuccucugccgugagagauaguggacaucggggcuacagcggcucccaggccucagacaacgaggggcacucugaggauagcgacacucagagugucuccgcgcacggacaggcugguagccaucaacagucucaccaggaaucagcaaggggccgcuccggggagaccaguggacauagcggcucuuuucuauaucaggugucgacacacgaacaauccgagucaagccaugguuggaccgggccuaguacaagaggacggcagggcucucgacacgaacaggcccaggauuccagcaggcacucagcuucucaauacggccaggacacuaucagagggcaucccggaagcucccgcgguggccgucagggguaucaccaugagcacaguguugacucaagcggacacuccggcucucaucacagucauaccacgagccaaggucgguccgaugccucgagggggcagucuggcucaagaagcgcaucccgcacaacucggaacgaggaacagaguggagacucuagccgacacucaguguccaggcaucacgaggccagcacccacgcugauauuaguagacauucucaggcgguacaaggccaguccgaagggucacgccggagcaggcgucagggaucuucggucucccaggacagugauagcgagggucacucagaagacucugagagaugguccggcagcgccagucgaaaucaucgcggguccgugcaagagcagagccggcacggaucuaggcauccaagaucacaccacgaagaucgggcaggccauggucacagugcugaccgcuccaggcagagcgggacaagacaugccgagaccucuucaggcggacaggcagccucgagccacgaacaagcucgauccagucccggcgagcgucacgggucucggcaucagcagagcgccgauuccucaaggcacucuggaaucccucgcggucaggcgagcagugcagugagagacuccaggcauuggggcucaagcgggucucaagccuccgauagugaaggacacagcgaggagucggacacucagucagucucuggccauggucaggcugggccacaccaacagucccaccaggaaagcgcccgggacagaaguggcggacgcuccggccgaucugggagcuuccuguaccagguuucaacccaugagcaauccgaaagugcacacggaaggacacggacgagcacugguagacgccagggcucucaucacgagcaggcucgugauucauccaggcacagcgccucucaggaggggcaagacaccauucggggacaucccggcaguucgagacgaggucgccagggcucccacuaugaacagagcguggauaggucagggcauucuggaagccaccauucccacacaaccagucagggccggucagacgcuucuagagggcaaagcggaucccgcagugccagcaggcagacucguaacgaugagcagucuggcgacgguuccagacacucauggagccaucaccaugaagcaucgacacaagcggauuccucucggcacagucagagcgggcagggacagucagccggcccucgaaccucccgcaaucaagguucuagcguaagucaggacuccgauucacagggccauagcgaggacucugaaagguggaguggguccgcuagcagaaaccaccggggaucagcccaggagcaaucuagggauggcucccgccacccgacgagccaucacgaggacagagcagggcauggacacucggcugaaaguucucggcagucaggcacucaccaugccgaaaauuccagcggugggcaggcagccaguucucacgaacaggcgcgaagcuccgcuggagagcgucauggcucacaccaucaacagagcgccgauuccucuaggcacagugguauaggccacgggcaggcaucaagcgccgugcgcgacuccggacauagaggaucuucggggagccaagcuagugacuccgaaggacacucagaggauucugacacacagagcgucuccgcccauggccaggcagguccacaccagcaaagucaccaggagagcacccgggggaggucugcuggaagaucaggccgauccggcagcuuucucuaccaggugucuacccaugaacagagugaguccgcccacgggcgcgcgggacccucaacugguggccggcaagggagcaggcaugaacaggcuagagauucgucucgccacuccgccagccaggagggacaggacacaauccggggccauccugguagucguagagggggaagacaaggcucauaccacgaacaguccguugaucgaucuggccacagcgggagucaucacucacauaccacaucccagggacggagcgacgcaucucacggucagucgggcagccgcuccgccaguagggagacuagaaacgaggaacaaucuggggauggaucacggcauagcggcucccgccaccacgaggcuucuacgcaggcagacaguagcaggcauucacaguccggucaaggggaaagcgccggaucucgaagaucccgucggcagggcaguucagugagccaggauucugacuccgaggcguauccagaggauucggaacgcaggagcgagagugccucaagaaaucaccauggcuccucucgggaacagagccgagacgggaguaggcaccccggauccucacaccgcgauaccgcuagccauguccaaucuuccccugugcagagcgacucuaguacagcaaaggagcacggucauuucucaucccugagccaggacucggccuaccacucuggcauucagaguagagggagcccgcauuccucaucuagcuaucacuaccaauccgaaggaacugagcggcagaaaggccagaguggucuuguuuggcgucacgggucauauggaagcgcugauuacgacuauggcgagucuggcuuuaggcauucccagcacgggagcgugaguuacaacucaaaucccgucguauucaaggaaagauccgauaucugcaaggccucugcauuuggaaaagaccauccacgcuacuaugcuaccuacaucaacaaggauccuggucuguguggccacucgagcgacauuuccaaacaauugggguucucucagagucagcgguauuacuauuacgaguga

SEQ ID NO: 56315 - RNA, 1161 nt, Artificial Sequence
  derived and/or modified sequence opt3 from FLI1__Homo_sapiens__NP_001257939
auggagggcgggcuggccggagaaagagcuagggagagccccguggacugcuccgucucuaaguguucaaaacucguugguggcggggaaaguaacccuaugaauuacaacagcuauauggaugagaagaauggaccaccgcccccuaacaugaccacaaaugaacggcgcgugaucguaccagcagaccccacucuuuggacgcaggagcacgugcgacaauggcuggagugggccauuaaagaauacuccuugauggagauagauaccucuuucuuucagaacauggacggcaaggaauuaugcaaaaugaauaaggaggauuuccugcgugcgacaacucuauauaacaccgagguccuccugucgcaucuuucauaccugagagaaagcaguuugcucgcuuauaauacaaccucccacacugaccagucuagcaggcuguccgugaaggaggauccuucauacgacaguguucggcgcggugccugggggaacaauaugaacagcggacugaauaaaucuccaccccucggcggcgcacagacaaucuccaagaacaccgaacaaagaccucagccagauccguaucagauuuuagggcccacgucaagcaggcuggccaauccuggaaguggucagauccaacuuuggcaguuuuugcuggagcuacucucugacuccgcuaacgcaagcuguauuacuugggaaggcaccaacggggaguucaaaaugacagauccagacgagguggcccggcgcuggggagaacgaaagucgaaacccaauaugaacuacgauaagcugucuagagcucuuagguacuauuacgacaagaauaucaugacuaaaguccauggcaagcgguaugccuacaaauuugacuuccacgguauagcgcaggcacugcagccucauccaaccgaguccucaauguauaaguaccccagugauaucagcuauaugccguccuaccacgcccaccaacagaaagugaacuuuguaccuccccauccaucuagcaugccuguuacaucaaguuccuucuuuggggcugccagccaguacuggaccucucccacgggaggcauuuauccaaaucccaacgugccucgucacccaaauacucaugucccgucacacuugggcaguuacuauuga

SEQ ID NO: 56316 - RNA, 3645 nt, Artificial Sequence
  derived and/or modified sequence opt3 from FLII__Homo_sapiens__NP_001243194
auggaggccaccggcgugcugcccuucgucagagggguugaccucagcggaaacgauuuuaaggguggcuacuucccugaaaaugugaaagcuaugacaucccuuagguggcugaaguugaaccggacuggguuaugcuaucugccagaggaacuagcagcccuccagaaacuggagcaccuuucuguaucacauaauaaccugacgaccuugcacggagaacucaguagccugccgucccugcgcgcgaucguggcucgagccaauucucucaagaacucgggcguccccgacgauauuuuuaaauuagacgaucugucagugcuugacuugagccauaaucaacugacagaguguccucgugagcuagaaaacgcaaagaauaugcucguucugaaccuuagucacaauagacagcugccagccaugacugcuuugcagacccuccaucugagguccacacagcggacccaaucuaacuuacccacuagccuggagggucucuccaaucuugcagauguggaccugucaugcaacgauuugacacgcgucccugaaugucuauacacccugccaagucucagaaggcugaaucuuagcucuaaccagauaacggagcuguccuugugcaucgaccagugggugcacguagagacucucaaccugucacggaaucaguuaaccagccugcccagugccauuuguaagcuaucuaaacucaagaaacuguaucuuaacuccaauaaguuggauuucgacgggcugccuagcggaaucggcaaacucacaaaccuggaagaguuuauggcugccaauaacaaucuugaacugguuccagagucguugugccgcuguccgaagcuccgaaagcugguguuaaacaaaaaucaccuggucacucuacccgaagcgauucauuuccucaccgagaucgaggugcuggaugugagagaaaacccuaaucuugucaugccacccaagccugcagacagggccgcugagugguacaacauagacuuuucuuugcaaaaucagcugcggcucgccggcgcauccccagcuacaguugccgcggccgcagcugggucaggacccaaagauccgauggcccguaagaugcgccugagaaggcggaaagacagugcucaggaugaccaggccaagcaaguguuaaaagguaugagcgauguagcacaggaaaagaacaagaaacaggaggaauccgccgacgcucgagcgccuucuggcaaggugcgcagaugggaucaagggcuggagaaacccaggcuugacuauagcgaguucuuuaccgaagaugucggacaguugccaggccucacgaucuggcagauugagaauuucgugccuguucugguggaagaggcauuucacgguaaguucuacgaagccgacugcuauaucguccuaaaaacuuuucuggaugacucagggagucucaacugggagauuuacuacuggaucggaggcgaggcuacacuggacaagaaggccuguuccgcaauacaugccgugaaccuucggaauuauuugggcgcugaaugccgcaccguaagagaggaaaugggggaugagagcgaggaguuccugcagguuuucgacaacgauauuucuuacaucgaaggagguacugccucaggcuuuuauacaguggaagacacccacuacgucacgaggauguaucguguguacgggaaaaagaauauuaaauuagagcccgucccacucaagggaaccagucuggauccccgguucguguuucuucuggaccgaggcuuggauaucuauguuuggagaggugcacaagcgacacucagcuccacuaccaaagcuaggcuguucgccgaaaagaucaacaagaaugagcgcaaagggaaggcagagauuacacuacuggugcagggccaggaacucccugaguuuugggaagcccugggaggcgagccaucugaaaucaaaaagcacguaccggaggacuucuggcccccucagccaaaacuuuacaaggucggguugggacuggguuacuuagagcucccccaaauaaacuauaagcugucgguggaacauaaacagcggccuaagguugagcuuaugccaagaaugaggcugcuacagagccuccuggauacucgcuguguguacauuuuggacugcugguccgaugucuuuaucuggcugggccgaaaaucaccccgguuagugcgugcugccgcacucaagcuggggcaggaacuuugcggaaugcugcacagaccgaggcaugcuaccguaagucgcucuuuggagggcacagaagcccaaguguucaaagcgaaguuuaaaaauugggacgauguucucaccgucgacuauacucggaacgccgaggcugugcugcagagcccuggucuauccgggaaggugaagagagacgcagagaaaaaggaucagaugaaagccgaccugacggcucuuuuccucccaaggcagcccccuaugucacuggccgaagcagagcaauugauggaagaguggaaugaggaucuggacggcauggaaggauuugucuuagagggcaagaaauucgcgcgacuccccgaagaggaauuugggcacuucuacacacaggauuguuauguuuuccugugccgcuacugggugccaguggaguaugaggaagaggaaaagaaggaggacaaagaagagaaggccgagggaaaagaaggugaggaagcuaccgccgaggcagaagagaagcagccugaggaagauuuucaauguauaguauacuucuggcagggccgggaggcuagcaacaugggguggcuuacuuuuaccuucucucugcagaaaaaguuugaauccuuguuccccggaaagcucgaggucgugagaaugacacagcaacaggagaauccaaaauuucugagucauuucaagaggaaauuuauuauccaccguggcaagcgcaaagccguucagggugcacagcaaccgagccuauaccagauccggaccaacgggucugcccugugcacuagauguauucagaucaauacagacuccucacuucucaacagugaguucugcuuuauucugaaggugccuuucgaaagcgaagauaaucagggcauagucuaugcuugggugggaagggcgucggaccccgaugaggccaaguuggcagaagacaucuuaaacacgauguuugauaccuccuacucuaaacaaguuauuaacgagggcgaggaaccagagaauuucuucuggguggggaucggagcucagaagcccuaugacgacgaugccgaauacaugaaacacacucgacuguuucgguguagcaacgagaagggcuauuucgccguaacagaaaaaugcucagacuuuugucaggaugaccucgcugaugacgauaucaugcugcuugacaauggucaagaggucuacauguggguggggacccagacaagucagguggagauuaagcuguccuugaaagcaugccaggucuauauacaacauaugcgcucuaaggaacacgagagaccuaggcggcuacgacugguuagaaagggaaacgaacagcaugccuucacucgcuguuuucacgcguggagcgcuuucugcaaagcccucgcauga

SEQ ID NO: 56317 - RNA, 7944 nt, Artificial Sequence
  derived and/or modified sequence opt3 from FLNA__Homo_sapiens__NP_001104026
augagcuccucucacucaagagccggccagagugcugccggggccgcgcccggagguggcguggacaccagggaugcugaaaugccugccacugaaaaagaccuggcagaggaugccccauggaaaaagauacaacagaacacuuucacgcgguggugcaaugaacaucucaaaugugucagcaagcgcauugcuaaccuucagaccgaccuguccgauggguugcgauuaauagcacugcuggagguucucucucagaaaaagaugcaccguaagcauaaucaaagaccgacauuuaggcagaugcagcuggaaaacgugucggucgcccuugaguuccuggaccgggagucaaucaaauuggugagcauugauaguaaggcuaucgucgacggaaaucucaaacugauucugggccucaucuggacuuuaauacugcacuacuccaucucuaugcccaugugggaugaagaggaagacgaggaggccaagaaacagaccccuaagcaacgccuuuuggguuggauucagaacaagcugccacagcuacccaucacaaauuuuagcagagauuggcaguccgggagggcgcucggagcacugguggacucaugcgccccuggccuuuguccagauugggacaguugggacgcuagcaaacccguuaccaacgcccgggaagcaaugcaacaggcugaugacuggcugggcauuccucaggugaucacuccagaggaaauagucgauccgaauguggacgagcauucuguaaugacauauuugucccaauuccccaaggccaaacucaagccuggggcgccacugcgccccaaauuaaacccuaagaaagcccgagcauacggaccagguauugaacccaccggcaauaugguuaagaagagagcugaguuuacgguggagacuaggucagccgggcagggagaaguccugguguauguggaggauccggcuggccaccaggaagaggccaaagucaccgcaaacaaugacaagaaccggacauucagcguuugguacgugccugaaguaacugguacccacaaagugacaguccucuuugccgggcagcauaucgcuaagagucccuucgagguguauguugauaaaucucaaggagacgcguccaaggugaccgcacagggcccaggccuugagccuagcgggaauauugccaacaagacgacuuacuuugaaaucuucacagcuggagccgguaccggcgaggucgaagugguaauccaggaucccauggggcagaaaggaacuguugagccacaacuggaagcacguggcgacucgacauaucgcugcucuuaccagcccaccauggagggugugcacacgguccaugugaccuuugccggggucccuauuccaagauccccguacacagugacuguuggccaggcuuguaaccccucagccugcagggcagugggacggggcuugcagccuaaggggguacgagucaaagagaccgcggauuucaagguguauacaaaaggagcugguaguggcgaacuaaagguuacugugaaggggccaaaaggagaggaacgcgucaagcaaaaagaccugggcgacgguguguacggguuugaguauuaccccaugguaccuggcaccuauauagugacaaucaccuggggaggccagaauauugggagaagcccauucgagguuaaggucggaacugaaugugguaaccagaaagugagggccuggggccccgggcucgagggaggcguggucgguaaguccgcagauuucguuguggaagccaucggggacgaugugggcacgcugggauuuucuguagagggcccgagccaggcuaagauagaaugcgacgauaaaggggacggaucaugugauguccgguacuggccucaagaggccggcgaguaugcagugcacguucuuugcaauagugaagacauucgccuguccccauucauggcugauaucagagacgcaccccaggauuuucacccugacagggugaaggcgcguggucccggguuggagaaaacaggagucgccgugaacaagccagcugaguucaccguugaugcaaaacauggcgguaaggccccucuccgggugcagguacaagacaaugagggcugucccgucgaagcucuggugaaagacaacgggaauggaacuuacagcugcucuuacgugccacgaaagccggucaagcacaccgccaugguuucauggggcggggugaguaucccuaacagccccuuuagaguaaaugugggagcaggcucccauccaaacaaagucaagguguauggucccgggguugcgaaaacaggauuaaaggcccacgagccuaccuacuucacuguggauugcgcugaggccggccagggugacgucucuauuggcaucaaaugugcaccaggggugguuggacccgcugaagccgauauugacuuugauauaaucaggaaugacaacgauacauucacggugaaguauaccccucgcggcgcagggucguacacuauuaugguccuguuugccgaccaggcuacaccgaccagcccaauccggguaaagguggagcccucccaugaugcgucaaaaguuaaggccgaaggaccuggccuaaguagaacagguguggagcucgggaaaccaacucacuucaccgucaaugcaaaggcugccggaaaaggcaagcuggacgugcaguuuucuggucuuacgaagggcgaugccguaagggacguggauaucauugaccaccaugacaacaccuauacagucaaauacacucccguucaacaggggccugugggagugaaugucaccuauggcggggauccgauacccaagagcccauucuccguggcuguuucaccuagcuuggaccugucuaaaaucaagguauccggacucggcgaaaaaguggaugucgguaaggaccaggaguuuacagugaagaguaaaggggcaggaggccagggcaagguugccagcaaaauuguggggcccucuggagcggcugucccaugcaagguggagccuggucugggcgccgauaacuccguaguccgcuuccuuccccgagaagaggggccauacgaaguggagguuacuuacgacggagugccggucccuggcucacccuucccacuggaggcaguggcccccaccaaaccuaguaagguuaaggcuuuugguccaggguugcaaggaggcagcgcaggcucgcccgcccgguucacgaucgauacaaagggggcgggaaccgguggccucgggcugacuguggaaggaccuugugaggcucaguuagaaugccuggacaacggcgaugguacauguuccgucucuuaugugccgaccgagccaggggacuacaauauuaacauccuauuugccgauacucacauacccggaagcccuuucaaggcacauguagugcccugcuuugacgccucaaaaguuaaguguaguggcccaggccucgaacgugcuaccgccggggaggucggacaguuccagguggacugcuccucugcagguagcgcugagcugacaaucgaaauuuguuccgaggccggccuuccugcggaaguguauauccaagaucacggggacggaacgcacaccauuacuuacauccccuugugcccaggcgccuauacagucaccauaaaauacggugggcagccuguaccgaauuuucccucaaagcuacagguggagccagcaguugauacaagcggagugcaauguuauggcccuggcauugaagggcagggagucuucagagaggcuacuaccgaguuuaguguggacgccagggcucucacgcagacagguggcccccauguuaaagcacgcguggccaacccaucugggaaucugaccgaaacuuacguccaggaucggggagacggcauguacaagguggaguauaccccuuacgaagaggguuuacacuccguagaugugacauaugacgggagccccguuccgucgucaccauuccaagucccugugacugaaggaugcgaucccucuagagugaggguccauggcccaggcauccagagugggaccacaaacaagcccaauaaauuuacgguugagacccgaggagccgguacuggcgggcugggacuugcuguggagggcccuuccgaagcgaagaugagcugcauggacaacaaagaugguucuuguagcguagaguacauuccguaugaagcagggacauacuccuugaaugugaccuauggcggacaccagguccccggcucaccauucaaggugccuguucaugacgugacugaugccaguaaagucaagugcagcgggcccggacucucuccugguaugguacgcgcuaaccugccacaguccuuucaaguggacacaucaaaggccggcguugcaccccuacaggugaaaguccaggggccuaagggacugguggagccagucgacgugguugauaaugccgacggcacccagacggugaacuacguacccagucgggaggguccguacagcaucuccgugcucuauggggaugaagaggucccuagaucuccauucaaaguuaaggugcugcccacucacgacgcuucgaaagucaaggcgagcggcccuggacuuaauaccacaggcgugccagccucauugcccguagaguucaccauagaugcaaaggacgcuggggagggacuguuagccgugcaaaucacugauccggaagguaaaccuaagaaaacacacauucaggacaaccaugauggcaccuacacaguugcauaugugcccgacgucacugggagguacaccauccucauuaaguauggaggcgaugagaucccauuuuccccuuaccgugugcgcgccguccccacgggugacgcuaguaaauguacagugaccguuucuauagggggccacggacugggcgccgggauuggaccaacuauccagaucggcgaggaaaccguaauuacaguggauacuaaggcggcagguaaggggaaaguaaccugcacgguguguacacccgacggaagcgagguugacguggaugucguggaaaaugaggacggcaccuucgauaucuuuuauacugccccucagccagguaaguacguaauuugcgugcgguucggcggggaacauguuccgaacucccccuuucaagucacagcucuugccggagaccagccuucagugcagccaccccugagaucucaacaguuggcuccucaguacaccuaugcacagggcgggcaacagacuugggccccagagaggccccucgugggagucaacggccuggauguuacaagccuacgaccuuucgaccuggugauaccguuuaccaucaaaaagggugagauuacgggggaaguacggaugccaaguggaaaaguggcucagcccacuaucaccgauaauaaggacggcacagucaccgugcgcuacgccccuuccgaggcaggucuccacgaaauggauauuagauaugacaacaugcauauccccggcagcccacugcaguucuacguugauuaugugaauugugggcacgucacagcguacggaccuggccuuacucacggggugguaaacaaacccgccaccuuuacgguuaauacaaaggacgcuggagagggcgguuugucucuggccauagaagggccaucaaaggcagagaucuccugcacugacaaccaagauggaaccuguagugugagcuauuuaccgguccucccuggcgacuacucgauucuggugaaauacaaugagcagcaugugcccggcucuccauucacagcuagggucaccggggaugacuccaugcggaugagccaccuuaagguuggaucagccgcagauauccccauuaacaucagugaaacugaccugucucuacucaccgccacagugguaccuccauccggucgagaggaacccugccuguugaaaagacugcgcaauggccauguggggaucagcuuugucccuaaggagacgggagagcacuuagugcacguuaaaaagaacggccagcauguggcuucaaguccgauuccagucgugaucagccaguccgaaaucggugaugcgucuaggguacguguuagcgggcaaggacuccacgagggccauacuuucgaacccgccgaguucauuauagacacccgggaugcaggcuaugggggacugucccuuucaaucgaagguccuucuaagguggacauuaauacagaggaucuggaggacggcaccuguagagucacuuacugcccaacagaacccgggaacuauaucauuaauaucaaauuugcugaucagcacgugccuggaagucccuucucgguuaaggugaccggcgaggguagggucaaagaaagcauaacgcgccgaagacgggccccauccguggccaacguagggucucauugcgacuugucacucaagaucccggagauuagcauccaggacaugacugcacaagugacauccccuaguggaaaaacccacgaagcugagauugucgagggcgaaaaucacaccuacuguaucagguuuguucccgccgagaugggcacucauacagugucugucaaguauaaggggcagcacgugccaggaagcccuuuccaguuuaccguagguccccugggcgaagggggagcgcauaaagugcgcgcuggcgguccagggcuagagcgugccgaagcaggaguuccugccgaguucucaauauggacaagagaggcuggcgcaggcgggcuggccauugcgguggaaggacccuccaaggcugagaucaguuuugaagaucggaaagacgguagcugcggcgucgccuacgugguucaggagccgggggauuaugaggucucugugaaguucaacgaagaacacaucccagacuccccuuuugugguacccgucgcaucaccaagcggagaugccaggcgccuuacugugucgucucuccaagaaaguggccugaaaguuaaccagcccgcuuccuucgccgugagcuugaauggugcaaagggggcuauugacgccaagguccacucaccuuccggagcgcuggaggaauguuacgugacggagaucgaucaggacaaauacgccguucgauuuauaccgagagagaacggcguguauuuaauugauguaaaguucaauggcacccauaucccagggucucccuuuaaaauucgggucggagaaccuggucacggcggggaccccggacucgugagcgcauacggcgcuggucuggaaggcggggugacagggaacccagccgaguucguugucaauacaaguaacgcaggcgcuggggcccuuuccgugaccaucgauggaccuagcaagguaaaaauggacugccaggagugucccgaagguuauagggugacauacaccccaauggccccuggcucuuaucugauaucaauuaaguacgggggaccguaucauaucggcgguagucccuucaaagcgaaggucacugggccacgcuugguguccaaucacagccuccaugagacgucuucgguuuuuguggacucacugaccaaggcuacaugcgcaccucaacacggcgcccccggaccaggcccugcugaugccagcaaagucguggcaaaggggcuaggacuguccaaagccuacguuggucagaagaguucuuucacuguggacuguagcaaagcuggcaacaauaugcuucucguagggguccacggacccagaaccccgugcgaggaaauccuggugaagcauguuggcuccagguuguacucagugaguuauuuacugaaggauaaaggugaguacacacucgucgugaaguggggagacgaacacauuccaggcucuccuuaucggguagugguccccuga

SEQ ID NO: 56318 - RNA, 7902 nt, Artificial Sequence
  derived and/or modified sequence opt3 from FLNB__Homo_sapiens__NP_001157789
augcccgugaccgagaaggaccuggccgaagaugcuccuuggaagaagauccagcaaaacacguucacucgauggugcaaugagcaccucaaaugugucaacaagaggauuggcaaucuucagacggaccugagcgauggguugcgguuaauugcccugcuagaaguucucucccagaaacgcauguaccgaaaguaucaucagcguccaaccuuuagacaaaugcagcuggagaacgugucuguagcccuugaguuccuggacagggagucaaucaaguuggugaguauugauagcaaagcgaucgucgacggaaaucucaagcugauucugggucucguguggacauuaauccugcacuacuccauaucuaugccgguuugggaggaugaaggcgacgaugacgcuaaaaagcagacucccaaacagcggcuuuugggguggauccaaaacaagauuccuuaucugccaaucaccaauuuuaaccagaauuggcaggauggaaaggcccuaggcgcacucguggacucgugcgcccccggucuguguccugauugggagucaugggacccacagaaacccgucgacaacgcucgcgaagcaaugcaacaggccgaugacuggcuuggggugccucagguaauuacaccagaggagaucauacauccggauguugacgaacacagcgugaugaccuaccugagucaauuccccaaggcuaaauugaagccuggagccccacucaaacccaagcugaauccuaaaaaggcgagagcauauggcaggggcauugagccaacugggaacauggucaagcagcccgccaaauuuacaguggauaccaucuccgcuggacagggugacgugauggucuucguugaagauccggagggcaauaaggaagaggcccaggugacgccugacucugauaaaaacaagacuuacagcguagaguauuuacccaaagugaccgggcugcauaaggucacagugcucuuugcaggacaacacauuuccaagucaccauucgaaguuaguguggacaaagcucagggcgaugccagcaaggucacugcgaaagguccugggcuugaggccgugggaaauaucgcaaacaagcccaccuacuuugacaucuacacagcuggcgccggcguaggggacauuggaguugaaguggaggauccacaggguaaaaacaccgucgaacuguugguggaggacaagggcaaucaggucuaucggugcguguacaagcccaugcaaccugggccacacguugugaaaauauucuuugcuggagauacgaucccgaagucucccuucguaguccaggugggcgaggccuguaacccuaaugcaugccgcgccuccggucgagggcuacagccaaaaggcguuagaauuagggaaacuacagacuuuaagguggauaccaaagcugcgggaucaggcgagcugggggucacuaugaagggacccaagggucucgaagaacuggugaaacagaaggacuuccuugauggcguauaugcauucgaauacuauccuagcacaccagggcgguacaguaucgccauaaccuggggaggccaucacauucccaaaucuccguuugaggugcaaguugguccugaggcugggaugcagaagguccgugccuggggcccaggacugcauggcgggaucgugggacgcuccgcagacuucguggucgaaagcaucgguucggagguuggcucuuugggguuugccauugaaggacccucccaggcuaaaaucgaguauaacgaucagaaugacggcucaugugaugugaaguacuggccuaaagagcccggugaauacgccgugcacauuaugugcgacgaugaggacauaaaggacaguccauauauggcauucauccacccugcgacagggggcuacaaccccgaucucguaagagcuuauggaccaggccuggaaaagagcggguguauugucaauaacuuagccgaguuuaccguggacccgaaagaugcaggaaaggccccucugaaaaucuucgcucaagacggcgaaggucagaggaucgauauucagaugaagaaucggauggacgggacauacgccugcuccuauacucccguuaaagcaauaaagcauaccaucgcuguggucuggggaggcgugaacauuccacacucucccuaccgaguuaauaucggucaaggcagccauccucagaaggugaaaguauuugggccaggagucgagcgcucaggccuaaaggccaacgagcccacacacuucacuguggauuguaccgaagcgggggagggagacgugagugucggcauuaaaugcgaugccagaguucucuccgaagacgaggaagauguggacuuugauaucauacauaaugcuaacgacacauucaccguaaaguaugugccuccggcagccgguagguacacuaucaaaguccuguuugcuagccaggagauuccagccucucccuuccgggugaagguugacccuucacacgaugcaaguaaggugaaagcggaggggccaggacuuagcaaggccggcgucgaaaaugguaaacccacgcacuuuacaguguacaccaagggcgcugggaaagccccuuugaacguucaguucaacuccccgcugcccggagacgcagugaaggaucucgacaucauugauaauuaugacuacucucauacugucaaguauaccccaacacaacagggcaacaugcagguacuggugaccuacgggggagauccuauccccaaaucgccauucacuguuggcguggcugccccucuugaccugagcaagauaaaauugaauggucucgagaaccgcgucgaaguggggaaggaucaggaguuuacaguagacacgagaggagcaggcggucaaggcaaacuggaugugaccauuuuaucccccucaaggaaggucguuccaugccuggugacuccggugacagggcgugaaaauaguaccgccaaauucaucccucgggaggagggacuauaugcugucgacgugacauacgacggccaccccguuccagggucucccuauacuguagaagcgagccucccuccagaucccuccaaggugaaggcccauggaccuggccuggagggugggcuugucggaaaaccggcagaauuuaccauugacacgaagggcgcuggcaccgggggauugggucugacaguggagggcccaugugaggccaaaaucgaaugcucagauaacggggacggaacuuguagcguuucuuaccuccccaccaagccuggcgaguacuucgugaauauacuguuugaagagguccacauccccgguuccccauucaaagccgauauugaaaugccuuuugaccccaguaaggugguagcuagcgggccaggauuagagcacggcaaggucggcgaggcagggcugcuuucuguggauugcuccgaagccggaccuggugcguugggccucgaggcuguuucagacagugggacaaaagccgaagugagcauccagaacaauaaggauggaacuuaugcagucaccuacgugccgcugacggccggcauguauacacuaaccaugaaauacgguggggagcugguuccccauuucccagcucgagugaaggucgaaccugcaguggacacuucgagaauuaaaguauuuggacccggcaucgagggcaaggauguguucagggaggccacaaccgacuuuacuguugauucccgcccacucacccaggucgggggagaccacauaaaggcgcauauugcuaacccuucuggugccagcacagaauguuucgugacggacaaugcagauggcaccuaucagguggaguacacucccuuugaaaaagggcugcacgucguagaggugacauaugacgauguuccgaucccaaacucaccuuucaagguggccgucaccgaaggaugccaacccagucgggugcaggcucagggcccaggucuuaaagaggccuucacaaauaagcccaacguuuuuacuguggucaccagaggggcaggaaucggcggcuuggggauuacgguggagggaccuuccgaaucuaaaaucaauuguagggacaacaaggaugguagcugcuccgcugaguacauuccguucgcccccggcgacuacgauguaaacauaacauaugggggagcgcauaucccaggcucaccuuuucgcgugcccguuaaggacgucguggauccuagcaaagugaagauugccgguccagggcugggaaguggcguccgagcacggguuuuacaaucuuucaccguggacuccagcaaagcuggccucgcaccccuggaaguacgugugcuugggccuagagcugaugacacugauucgcagucauggaggucuccacugaaggcauugagugaguuuuucaaaggagaccccaagggugacuuuaauaagaccggccucgucgagccggugaacguuguggauaauggggacggaacacacacugucaccuacacaccuucccaggaaggcccauauaugguaagcgugaaauacgccgaugaggaaaucccccgcucuccuuucaagguuaaagugcugccaacguaugacgccagcaaggucaccgcuuccggucccgggcuaucaaguuacggcgugccggcgagccugccugucgauuuugcaauugacgcccgggaugcuggagagggccuccuggccgugcagaucacugaccaagaagggaaacccaagagagcaauaguucacgauaacaaagacggaacauaugccgugaccuacaucccagauaagacugguagguacaugauuggcguaacauaugggggagacgacaucccucuuucucccuaccgcauuagagcuacccagacgggcgaugcguccaaguguuuggccacugguccagggaucgcaucaaccgugaaaacaggcgaggaggucggauucguuguggacgcuaagaccgccggcaaagggaaggucacuugcacagugcugacccccgauggaacagaagcagaggccgacguaauagaaaaugaggaugguacuuaugacauauuuuacaccgcugccaaaccuggcacguaugugaucuacguucgguucgggggaguggauaucccaaacaguccguucacagucauggcgaccgacggcgaagugacugcagucgaggaggcccccgugaaugcuuguccuccagguuuuagacccuggguuaccgaagaggccuauguaccugugagcgauaugaacggguuaggcuucaagccauuugaccucgucauucccuucgcugugaggaagggagaaauaacaggcgagguucauaugccuuccgggaaaacugcaaccccggaaaucguggauaauaaggacggaacggucacagugcguuacgccccaaccgagguaggccugcacgagaugcauauuaaauacauggguucucacauccccgaaucgccucuucaguuuuaugugaacuaccccaauagcgggucaguuuccgcuuauggaccaggccuggucuacgguguggccaacaagacugcaacauucaccauugugacugaggaugcgggcgaagggggacuagaccucgccaucgagggcccuaguaaagcugagauaucuugcaucgacaauaaggaugggacaugcaccgucacguaucugcccacuuugccaggagacuacagcauucugguuaaguauaacgauaaacauaucccgggcuccccuuuuaccgccaagauuacagacgauucacgccgguguucucaggugaaauuagguagcgcagcugacuuccuccuggauaucagugaaaccgaccuuuccagccugacagccucuauaaaggcacccucagggagagaugagccaugcuugcucaaaaggcugcccaauaaccacauuggaaucuccuuuaucccucgagaaguaggcgagcaccuagugaguauuaagaagaacgguaaucaugucgccaacagcccagugucgaucaugguugugcaaucugaaauaggcgacgcucggcgcgcgaaagucuacgggagaggacuguccgagggcaggacuuucgagaugagcgauuuuauuguggacacccgggacgccggguacggaggcaucucacuugcaguagaaggucccaguaagguugauauucagacggaggaccucgaagaugggacauguaaagugucuuauuucccuacugucccgggaguguacaucguguccaccaaguuugcugacgagcacgucccaggcagccccuucacaguuaaaauaucaggcgaagggcgagugaaggagaguauuaccagaacuagccgcgccccuuccguagccaccgugggaucuaucugcgaucugaauuugaaaaucccagagauuaacagcuccgacaugucagcacaugucacaucucccagugguagggugacggaagcugagaucguuccuaugggcaaaaauucgcacugugugcguuucgucccccaggaaaugggggugcacacuguaagcguuaaguaucggggacagcaugugaccggcuccccauuucaauucacagucgguccgcugggggagggaggcgcccacaaagugagagcgggcgggccuggauuagaaaggggugaggcuggcguucccgccgaguuuucuauuuggacccgcgaagcaggggccggaggccucucaauagcuguggaggguccaagcaaggcagaaaucacuuucgaugaccauaaaaacggguccugcggagucaguuacauugcccaggagccuggcaauuaugaggugucuaucaaguuuaacgaugaacacauccccgagagcccauaccugguaccugugauugcgcccucagacgaugcucgaagacuuacagucaugucccugcaggaaaguggcuugaaaguuaaucagccggccagcuucgcaauacggcucaacggggccaagggaaagaucgacgcuaaagugcauucuccauccggugccgucgaggaaugucacgugucagagcuggagccugauaaguaugcaguaagguuuauuccccacgaaaauggcgugcauaccaucgacguuaaauucaacgggagccacguggucggaucgccauuuaaggugcgcguuggcgagcccggucaagcugggaauccugcccuagucucugcguacggaacgggccuggaaggcgggacuacagggauucagagugaguucuuuaucaacaccacccgugccgguccgggcacucuuuccgugacaauagaagggccaagcaaagugaagauggacugccaggagacccccgagggauacaagguaauguauacaccuauggcacccggcaauuaccucaucucagucaaauauggugggccaaaccauauugugggauccccuuucaaggcuaaaguuacuggccaaagacuggugucucccggcagcgccaaugaaacgaguuccaucuuggucgagagcgugacccggucuucaacagaaacuuguuacagugcaauuccaaaggcuuccagcgaugccucuaaaguuaccucgaagggggccggauuaucaaaggcguuugugggucagaaaagcuccuuccugguagacugcaguaaggcuggcucuaacaugcuccugaucgggguccacggaccuacaaccccgugugaggaagugagcaugaaacacgugggcaaccagcaguauaauguuacuuacgucgugaaggagaggggugauuauguacuugcagugaaauggggagaggaacauauacccggauccccauuccacgucacggugccuuga

SEQ ID NO: 56319 - RNA, 8079 nt, Artificial Sequence
  derived and/or modified sequence opt3 from FLNC__Homo_sapiens__NP_001120959
augaugaacaauucaggcuacuccgacgccgggcugggacucggugaugagaccgacgaaaugcccucuacugagaaggaucuugcugaagacgcaccuuggaaaaagauccagcaaaacacuuucacgcgguggugcaaugagcaccugaaaugugugggcaagagguugaccgauuuacagcgggaccugucagaugggcuacgccucauugcccugcuugaaguccugagucagaaacgaauguaucguaaguuucauccaagaccgaacuucaggcagaugaaguuggagaauguuagcguggcgcucgaguuucuggaacgggagcacauaaaacugguauccaucgacucuaaggcuauuguggaugggaaccucaaauuaauccugggccuuauuuggacauugauccugcauuacucgauaucaaugcccaugugggaagacgaggaugacgaggaugcccgcaagcaaacuccuaaacagagacuacucgguuggauccagaauaaggucccacagcugcccauuaccaacuucaauagggacuggcaagacgggaaggcacuuggagcccugguggauaacugcgcuccuggcuuguguccagacugggaagcaugggaucccaaucagccuguugagaacgcccgggaagcuaugcagcaggccgacgauuggcucggcgugccacaagucaucgcgccggaggaaauuguggaccccaauguagaugagcacagcguuaugacauaucugagucaguuuccuaaagcaaaguuaaaaccaggggcccccgugcgcuccaagcagcugaacccuaaaaaggcuaucgccuacggaccagguauagagccccaaggcaauaccguccuccagccggcacauuucacugugcagacaguggacgcuggggucggagaaguucuuguguauauugaggauccugaaggccacaccgaggaagccaaaguagugcccaacaacgacaaggaucgaacguacgcggucucuuaugugccaaagguugccggucugcacaaagugacugucuuguuugcagggcagaauaucgagagaagcccuuucgaggugaacguaggaauggcucuaggcgacgccaauaagguuuccgcuaggggccccgggcuggaaccagugggaaacgucgccaauaaacccaccuacuuugacauuuacacagccggugcaggcacuggggauguggcugucgugaucguugacccucaaggacggcgugauaccguggagguagcgcucgaagacaagggcgauucaacauuccgcugcaccuauagaccagcaauggaggguccgcauacgguccacguggccuuugcuggggcccccaucacuaggaguccuuucccaguucaugugagcgaagcauguaaccccaaugccugccgggcuucuggccgaggacugcagccuaaaggcguccgcgugaaggagguagccgacuuuaagguguucacaaaaggggcaggauccggugagcuuaagguuaccgucaaaggcccaaaggggacugaagaacccgugaaagugagagaagcgggagauggcgucuucgagugugaguacuauccgguugugccugguaaguacgugguaacaauuaccuggggaggcuaugcuauaccaaggucacccuuugaaguccaggugagcccugaggccggaguucagaaggugcgggcauggggccccgggcuggaaacgggacaagucgguaaaagugccgacuucgugguugaggcuaucggcaccgaaguggggacauugggauuuucuauugagggcccaucccaggccaagaucgagugcgaugacaaaggugaugggagcugugacguacgcuacuggccuacugaacccggcgaguaugcaguccacgugauaugcgaugacgaagacauuagagauucgccauucaucgcucacauccucccggccccucccgacuguuuuccagauaaggugaaagcguucggacccggccuggagccuaccgggugcauugucgacaagccagccgaauuuacaaucgaugcuagggcagccggaaagggcgacuuaaaacuguacgcucaggaugccgacgguugccccauugauauaaagguuaucccuaacggggacggaacuuuccguuguucuuacgugccgaccaaaccaauuaagcauacaaucaucauuuccuggggcgguguaaaugugcccaaaucaccuuuucgggucaacgugggcgaggggagucacccagagcgaguuaagguguauggacccggcgucgagaagaccgggcuaaaggcaaaugagccuacuuacuucacgguggauugcagcgaagcgggacagggcgacguuuccauagguaucaagugugccccggggguggucggacccgcugaggccgauauugacuuugacaucauuaaaaacgauaaugacacauucaccguaaaguauacuccaccuggcgcagguagauacaccaucauggugcucuuugcuaaccaagaaauacccgccucuccauuccauaucaaaguugauccuagccacgacgcaucaaaggugaaagccgagggccccgggcugaauaggacaggagucgaggugggcaagccaacccauuucacuguacuuacaaagggggcuggaaaagcgaaguuggaugugcaguuugccggcacggcaaaaggugaagucguucgcgacuucgagauuaucgauaaccacgacuauaguuacaccgugaaguauacugcugugcagcaggggaacauggccgucacagugaccuacggaggcgauccgguuccuaaaucccccuuuguagugaaugucgccccaccccuggaccucagcaagauuaaggugcaaggucugaacucuaaaguugcugugggccaggaacaggcauucucagucaauacaagaggggccggaggccaagggcagcuugaugugagaaugacaagcccuagcaggcgcccaauccccugcaagcuggagccuggaggcggugcggaggcucaggccguacgauacaugccgccagaagaggggcccuauaaagucgacauaaccuacgacggacacccugugcccggcuccccauuugcaguugaaggcguguugccucccgauccaucuaaggucugugccuaugggccuggacucaaagguggccugguggggacgccggcucccuucucgauugacaccaagggagcaggcacagguggguuaggacugacuguugagggcccaugcgaagccaagaucgagugucaggauaacggcgacgggagcugcgcgguguccuaccuaccuaccgagcccggagaauauacaauuaauauccucuuugcugaggcccauauaccagguucaccuuucaaagcaacuauccggcccgucuuugauccgaguaaggugcgugccucuggcccagggcuggaaagaggaaaaguaggcgaggcugccaccuucacgguggacuguagcgaagcuggugaagcagagcuuacaauugaaaucuuguccgaugccgggguuaaggcggagguccugauucacaacaaugccgacggaaccuaccauaucacuuauagcccugcauuucccggcacauacaccauaacuauuaaauacggcgggcacccagugcccaaguucccuaccagggugcacguccaaccggcuguagauacaagcggagugaaaguuucuggucccggcguggaaccacaugggguccuccgcgaggugacgaccgaauuuacuguugacgcccggucccugacagcuaccggaggcaaccacgugacagcaagagucuuaaauccuaguggugccaagacugauaccuaugugacggacaacggggauggaacauacaggguacaguauaccgccuacgaggagggcgugcaucugguugaaguccuuuaugacgagguggcugugcccaagagcccuuuccgagucggcguuacugaagggugcgacccaacccgcgugcgggcguucggacccgguuuggagggcgggcucguaaauaaagcaaacagauuuacaguggagacuaggggagccggcaccggugggcugggacuagcuaucgaaggcccuucugaggccaagauguccuguaaagauaauaaggacggcucaugcacagucgaauacaucccauucacgcccggggauuaugacgugaacauuaccuuuggaggucguccgaucccuggcaguccauuccgcguucccgugaaagaugucguagacccugggaaggugaagugcagcggaccaggccugggugcagggguucgggccagagugccccagacuuuuacagucgauuguucgcaggcuggcagggcgccgcuccaaguggccguccugggaccuaccggcguggcagagcccguugaagugcgagacaauggggauggaacucacacaguacauuacaccccagcuacggacgguccuuacacuguggccgucaaauaugcagaucaggagguuccccgguccccauucaagauuaaagugcuucccgcccacgacgcuucuaagguccgcgccagcggcccuggguugaacgcgucaggaauaccagcaagucugccgguggaguuuaccaucgaugccagagacgcuggcgaagguuuacucacaguacagauucuggaccccgaggggaaaccuaagaaggccaacaucagggauaauggcgacggaaccuacacuguguccuaucuuccagauaugucuggccgguacacaauuaccaucaaauaugggggagacgaaauacccuacagcccuuuccgaauccacgcucugccaacaggugaugcauccaagugcuugguuacugugucaauuggcgggcauggacucggcgccugucugggucccagaauccagauugggcaagagaccgucaucacgguggacgcuaaagccgcaggcgaaggaaaggucacaugcaccgugagcacuccugauggcgcggagcuagacguugauguaguggagaaccacgacgggaccuuugauauauauuacacagccccggaaccaggaaaauacgucauuacuauccgcuucggcggugagcauauccccaauaguccuuuucacgugcuggcuaccgaggaacccguugugccagucgaaccuauggagucuaugcucaggcccuucaaccuggugauuccauucgccguacagaagggggagcuuacgggagaagugcguaugccguccggcaagacagcacggccuaauauaaccgacaacaaagacgguacuaucacaguuagauaugcucccaccgagaagggcuugcaucagauggggauuaaauacgauggaaaucacaucccaggcagcccccugcaauuuuaugucgacgccauuaacucgaggcacgugucagcauacgggccuggauuaucucauggcauggugaauaagccagccacuuucacaaucgucaccaaagaugcuggugaagggggacucagucuggcgguugagggccccuccaaggccgagauaacguguaaggacaacaaagaugguacuugcaccgugagcuaucuuccuacagcaccgggcgacuacucuaucauuguacgcuuugaugacaagcacaucccagggagccccuucaccgcuaaaauuacaggagaugacuccaugcgaacuucacagcugaaugugggcaccaguacggaugucagccuaaagaucacagaaucugaccucucccagcugacugccucaauaagagccccuagugggaacgaggaaccauguuugcugaaacgguuacccaauaggcauauuggaaucagcuuuaccccuaaggaggugggcgaacacguuguguccguccgcaaaucugguaagcacgugacaaacucgcccuucaagauccucguagggccaagcgagauuggagaugcaucaaaaguucguguguggggcaagggccuguccgaggggcauaccuuucaggucgcugaguucaucguggacacuagaaaugccggauaugguggccuugggcugaguauagagggaccgucuaaaguggacauuaacugcgaagauauggaggacggcaccuguaaggucacauacugcccuacggaacccgguacuuacaucauuaacaucaaauuugcggauaagcacguuccagggagcccuuucaccgugaagguaacaggagagggccggaugaaagaguccauaaccaggcgccgacaagcucccucaauugccacuaucggcucuacaugugacuugaaucucaagaucccagggaacugguuucagauggugagcgcacaggaaagacugacccggacguucacuaggaguucccauacauauacccgcaccgagagaacugaaauuagcaaaacaaggggaggugagaccaagcgggaaguccguguggaggagucuacacagguuggcggggauccuuuucccgccguguucggagacuuccuaggccgcgaacgacuggguucauuuggguccaucacuagacaacaggagggagaagcuaguagccaggauaugacggcacaggucaccucgccgucuggcaaaguggaggccgcggagauuguagaaggcgaggacuccgcuuacagcguuagguucgugccacaagaaauggggccucacacagucgccgugaaguaucggggacagcauguucccgguucaccauuucaguucacugugggcccccuuggggagggaggcgcacacaagguccgcgccggugggaccggacucgaaagaggcguggcuggcguaccugccgaguuuaguauauggacaagggaggcaggggcuggaggucugucuaucgccguggaaggcccguccaaagcggagauugccuucgaagaucggaaggacgggagcugcggagucucauacguugugcaggagccaggcgauuaugaagucaguaucaaauuuaaugacgagcacauccccgacagcccuuucgugguacccguggcauccuugucugaugacgcucgaagacugaccguuacuagcuuacaagagacgggucucaaggugaaccagccagccuccuuugcaguccagcugaauggggcucgcggagugauugaugccaggguucauaccccuucaggcgccgucgaagagugcuacgugucugaacuugacagugauaaacacacaauacgguucaucccccaugagaacggcgugcacucgauugacguaaaguuuaauggggcgcacaucccaggaagcccuuucaagauucgugucggugaacaaucccaggcuggcgauccggggcuggugucugcauauggacccggcuuggagggugggacuaccggaguuucaagcgaguuuaucgugaacacacucaaugccggcuccggcgcucugagugucaccauagacgggccaucuaaagugcagcuagauuguagagaaugcccugagggacauguugugacuuacacacccauggccccagguaacuaccugaucgcaauuaaguauggcgggccucagcacaucguaggaagccccuucaaagccaaggucacgggcccgaggcuuucaggugggcauucccuccacgaaaccaguacugugcugguggagacaguuaccaaaaguucuuccucacgcggcagcucguacucuaguauuccaaaguucuccagcgacgcuucaaaagucgugacccggggaccuggcuugucccaagcguuuguagggcagaaaaauucuuucacaguggauuguagcaaggccggaacuaacaugaugauggucggugugcauggccccaaaacgccaugcgaggaaguuuaugugaagcacauggggaaucgagucuacaacgugaccuauacaguuaaagagaagggagacuacaucuuaauagugaaauggggcgaugaaaguguacccgguuccccuuuuaaggucaaggugcccuga

SEQ ID NO: 56320 - RNA, 1284 nt, Artificial Sequence
  derived and/or modified sequence opt3 from FLOT1__Homo_sapiens__NP_005794
auguucuuuaccugcggccccaacgaggccaugguggucagcggguucuguagauccccuccaguuaugguggcuggagguaggguauuugugcugccgugcauccagcaaauucagcggauaucucucaauacacuuacucugaacgucaagucagaaaaaguguacacgcgccacggcguucccaucagugugaccgggauugcacaggucaagauccagggacaaaauaaagagauguuggccgcggcuugucagauguucuuaggcaagacagaagccgagauugcacauaucgcccuggaaacucuagagggucaccagcgagcuauaauggcacauaugaccguggaggaaaucuauaaagaccgucagaaguuuagcgagcaaguauucaagguugccuccucugaucucgugaacauggggauuucggucgugucauacacacugaaagacauccacgaugaccaggauuaucuucauagccugggaaaggcuagaaccgcccaggugcagaaagacgcgaggauuggcgaagcagaggccaagcgggaugcuggcauccgcgaggccaaagcaaagcaagaaaaggucagugcucaguacuuguccgagauagaaauggccaaagcgcagagagacuaugagcucaagaaagccgcauacgauauugaaguuaauacuaggcgggcucaagccgaccuggcuuaucagcuccagguggccaagacaaaacagcaaaucgaggagcagcgcguacaggugcaggucguggaacgagcacaacagguugccgugcaggagcaggaaauugcuagaagggagaaggaacuggaggcgcggguccguaaaccugcagaggccgaacgcuacaaguuagagagacuggcugaagccgagaagucucaacuuaucaugcaggcagaagccgaggcugccagcgugaggaugcgaggggaggcagaagcguuugcuaucggagcccgggcacgcgccgaggcugaacagauggccaaaaaggcagaggcuuuccaguuguaccaagaggccgcgcagcuggauaugcuacucgaaaaacugccacagguagccgaggaaauuuccgguccccuuaccucagcuaacaagauaacgcugguuaguagcggcucugggacuaugggagcagccaaagugaccggcgaggucuuggacauccucacaagacugccugaauccguggagagguuaacuggugucucaauuagccaagugaaucacaagccacugcggaccgcuuga

SEQ ID NO: 56321 - RNA, 1287 nt, Artificial Sequence
  derived and/or modified sequence opt3 from FLOT2__Homo_sapiens__NP_004466
augggcaacugccacaccguggggcccaaugaggcccuggucguuagcggagguuguugcggcuccgacuacaagcaguauguguucgggggaugggcuugggcauggugguguaucucugauacacaaagaauuucacucgaaauaaugacucuucagccuaggugcgaggacguagaaacggccgagggcguggcgcugaccgucacagguguggcucagguuaaaaucaugacugaaaaggaguuguuagccguggcaugugagcaguuucuggggaaaaacguccaagauauuaagaaugugguacuacagacccucgaaggacaucugcggaguauccuuggcacacugaccguugagcagauuuaccaggaccgcgaucaauucgccaaauuggugcgagaagucgcugcaccagacgugggccguauggggaucgagauacucagcuuuacuaucaaggauguguaugacaaggucgauuaccuguccucucugggaaaaacacagaccgccguugugcagagagacgcugauauugguguagccgaggcggaaagggacgcaggcauccgggaggccgaaugcaagaaagagaugcucgaugugaaguucauggcugacacgaaaauugccgacucgaagcgcgcauuugaauuacagaagucagcuuucagcgaggaggucaacaucaaaacugccgaagcgcaacuggccuaugagcuucagggggcaagagaacagcaaaagauaaggcaggaggaaauugagaucgaggugguucagcggaaaaagcagauugcuguggaagcccaagagaucuugcgcaccgauaaagaacugaucgcuacaguccgaagaccggccgaggcagaagcccacaggauucagcagauagcugagggagagaaggugaaacagguacuacucgcgcaagcagaagccgagaagauccggaagauuggcgaagcugaggccgcaguuaucgaggccauggguaaagcugaagccgagcguaugaagcugaaagcagaagcguaccagaaguauggggacgcugccaaaauggcacuugugcuggaggccuugccccagauagcugccaagauugcagcuccucucacuaaggucgaugaaaucgugguccugaguggagacaauuccaaagugaccucugagguuaaccgcuuacuggccgagcucccagcgagcgugcaugcccuuacaggcguagaucuguccaagauccccuugauuaaaaaggcuaccggcguccagguguga

SEQ ID NO: 56322 - RNA, 1983 nt, Artificial Sequence
  derived and/or modified sequence opt3 from FLRT2__Homo_sapiens__NP_037363
augggccugcagaccacaaaguggcccagccacggggccuucuuucucaaauccuggcuuaucauuucucugggauuguacucacaagugaguaaguuacuggcuugcccuagcgucuguagaugcgacaggaacuucguuuauuguaaugagcggucccuaacuucugugccacucgguauaccggaaggcguaacggugcuguaccuucauaacaaucagaucaacaaugcaggguuucccgccgagcugcacaacguccagucggugcauaccguuuauuuguacggaaaucagcucgaugaguucccuaugaaccugcccaaaaaugugcgcguccugcaccuccaagagaacaauauucagacaaucucacgagcggcuuuagcccagcugcuuaaguuggaagaacugcaucuagacgauaacagcauuaguacugugggcguagaggacggugcauuucgugaagccaucucccucaaacugcuuuuccugucuaagaaucacuugagcuccguucccguggggcucccugucgaucugcaggaguuaagaguggacgaaaacaggauagcugugaucucagauauggcauuucaaaaucugaccagucucgagcggcuuauugucgacggaaaccuguugacaaacaagggcaucgccgagggcaccuucagccaccuaacuaaacugaaggaauuuucuauuguucgcaauucccucucacauccacccccugaucugccagggacacaccuuaucagacuguauuugcaggacaaccagauaaaucauauuccgcucaccgcuuucagcaaccugaggaaauuagagcggcuggauaucaguaauaaccagcuacgcaugcucacgcaaggaguguuugacaaucugucuaaccuuaagcaguugacugcccgaaauaaccccugguucugcgauuguuccauuaaauggguaaccgaauggcugaaguacaucccuagcucgcucaaugugagagguuuuaugugccagggcccagagcaagucagggggauggcggugcgggaacugaacaugaaucuucugucuugucccacaacuaccccuggauugccacucuucacacccgcaccguccaccgccucaccuacgacucagcccccaacacugaguaucccuaaccccagccguuccuauaccccacccacuccuacaaccucuaaguuaccaacgauuccggacugggacggccgcgagagaguuaccccaccuauaagcgagaggauccagcugucaauucacuucgugaaugauacaaguauccaggucuccuggcuaagccucuuuacugugauggcuuacaaacugaccuggguaaagaugggucacucucuuguugggggaauagugcaagaacggauugucucaggcgagaaacagcauuugagucuggugaaccucgaaccacgaagcacauaccgcaucugccugguccccuuagacgccuucaacuauagagcaguggaggauacuaucuguuccgaagcuaccacacacgccucuuaccugaauaacggcucgaauaccgcgagcucccaugagcagacuacgucacacaguauggggucuccuuuucuuuuggccggacucauugguggcgcaguuaucuucgugcugguaguccuacugagcguguuuugcuggcauaugcacaagaaagggagguauacaucccagaaguggaaauacaaccggggacgcagaaaggacgauuauugugaggcuggcaccaagaaagacaauucaauucucgaaaugacugagaccagcuuccaaauaguuucucugaacaaugaucagcuuuugaagggugacuuuaggcugcagccaaucuacacacccaacgggggcauuaauuauaccgauugccacaucccgaacaauaugcguuacugcaacuccagugugccugacuuagaacauugucacacuuga

SEQ ID NO: 56323 - RNA, 1950 nt, Artificial Sequence
  derived and/or modified sequence opt3 from FLRT3__Homo_sapiens__NP_938205
augaucagcgccgcuugguccauuuuccugauaggcaccaagaucgggcucuuucuucagguggcaccccugucugucauggccaaaucaugcccuaguguuuguagaugcgacgcgggauucauuuacuguaacgauagguuuuugacaagcaucccaacugguauuccggaggacgcuacgaccuuauaucugcaaaauaaccagaucaauaacgccggcauacccuccgaucuaaagaaucuccugaaaguggaacggaucuaccuuuaucacaacucucuggacgaguucccuacaaauuugccaaaguacguaaaagaacuccaucugcaggagaacaauauucgcacuaucaccuaugauucgcugucaaagauucccuaccucgaagaguuacaccuggacgauaacagcgugagugcagucuccaucgaggaaggggccuuucgagacucuaauuaucuucguuugcuguuccuaagcagaaaccaucucuccacaauaccuuggggacugccaaggaccauugaggaacuucggcuggaugacaaucgcaucucaacuauuaguagccccucuuugcagggccucacaucccugaagagauuagugcuggaugguaaccuccuuaauaaccacgggcugggagacaaaguguuuuucaacuugguuaaucuaaccgagcugucacucgucaggaacagccugacggcugcaccugugaaucuuccaggcacuaaccugcggaaguuguaccuccaagauaaucauaucaaccgcguaccgcccaaugccuuuaguuaccugcgacaguuauauagacuggacaugucuaacaauaaccuauccaaucucccucagggcaucuucgacgaucuggacaacauuacccagcuuauauugaggaauaacccaugguacugcggguguaaaaugaaguggguucgggauuggcugcaaagccuccccgugaaagucaaugugcguggacugaugugccaggcuccugagaaggugcgcgguauggccaucaaggaccuuaacgcggaacuguuugauuguaaagacucgggcauugucucuacaauccagauaacuaccgcaauuccaaacacaguuuaucccgcccaggggcaauggccggcuccugugaccaagcagcccgauaucaaaaauccaaaguugacgaaagaccaccagacuacaggauccccuucaagaaagaccaucacuauuacaguaaaaagugugaccagcgauacgauccacauuuccuggaagcucgcccugcccaugaccgcauuaaggcugucuuggcuaaagcucggccauagcccagcuuucgguucaauaacagagacuaucgucaccggggaacggagugaguaccuggugacagcccuugaacccgacuccccuuauaaaguuugcauggugccaauggagacuagcaacuuguaccuguuugaugagaccccggucuguauugaaacagagaccgcgccccuccgaauguauaauccuacuacgacacugaaccgcgaacaagagaaggaaccauacaaaaaucccaacuuaccucuggccgcaaucaucggaggcgcuguggcccuuguaaccauugcuuugcucgcccugguuugcugguacgugcacagaaauggcucucuauucucaaggaacugugcauauaguaaggggcggcgcagaaaagacgacuacgccgaggcuggaacuaagaaggauaauagcauacuggagaucagggaaaccuccuuccagaugcucccaauuucuaacgagcccaucucgaaagaagaguuugucauucauacaaucuucccgccuaaugguaugaaccuguauaagaauaaccacagcgaauccucaaguaaucguucuuaccgggacagcggcauaccagauuccgaccacucacauagcuga

SEQ ID NO: 56324 - RNA, 2064 nt, Artificial Sequence
  derived and/or modified sequence opt3 from FLT1__Homo_sapiens__NP_001153392
auggugagcuacugggacaccggcguccugcucugcgcccuucuguccuguuuguuacugacagggucuucaaguggaagcaagcuaaaagaucccgagcucucccugaaggguacucagcacaucaugcaagcuggccagacgcuucaucugcagugcagaggggaagcagcccacaaauggucuuugccugagaugguuucgaaggaaucagagaggcucagcauuaccaaaagugcguguggacggaacggcaagcaguucugcuccacacugacucugaauaccgcucaagccaaccauacagguuuuuauucuuguaaguaccucgcagugccaaccagcaaaaagaaagaaacugaguccgccauauauaucuucauuucagacacagggcgcccguuuguagagauguacagugaaauccccgagauuauccacaugaccgaaggacgagaguuagugauaccuugccgugucacgagcccaaauaucacugugacccugaagaaauucccccuugauacauugauuccugacggcaagagaaucauuugggauucuaggaagggcuuuaucauauccaacgcuacuuauaaagagauugggcugcuaaccugugaagcaacaguuaauggacaucucuacaagaccaacuaucugacgcaccggcagacuaauacaaucauugacgugcagaucucaaccccacgccccgucaaacuucugagaggucacacuuuggugcucaacugcacagccaccacgccucugaauaccaggguacagaugacauggagcuacccagaugagaagaacaaacgggcuaguguucgccgaagaaucgaccaaucuaauucccaugccaacauuuucuacagcguguuaacuauagauaagaugcagaauaaagacaagggccuguauaccuguaggguccggucggggccgucuuuuaaguccgugaacacaucagugcacaucuacgauaaagcguucauuacugucaagcaucguaaacagcagguucucgaaaccguggcaggaaagcgcaguuauagacuuagcaugaaaguaaaggccuuucccuccccugagguggucuggcugaaggacggcuugccagcuacagaaaaaucugccagguaccuaacccgggguuauagccugaucauaaaggaugugacugaggaggacgcagggaauuacacgauucuccugucaaucaaacaaaguaacguuuucaagaaccuuacagcuacccugaucgugaaugucaaaccccagauuuaugaaaaggccguguccagcuuuccugacccagcguuguacccccucggaucucgacagauccugacuugcaccgccuacggcauuccgcaaccuacaauaaagugguucuggcaccccuguaaccacaaucauucagaggcacgcugcgauuuuugcaguaacaaugaagagagcuucaucuuagacgcugauuccaacaugggcaauagaauugaaucuaucacccagaggauggccaucauugaggggaaaaacaagauggcuucgacucugguaguugccgacagccggauauccggaaucuauauuuguaucgcaucaaauaaaguggguacagucggccgcaacauuaguuucuacaucacggaugugccaaauggguuucacgucaaccuagagaagaugccuaccgaaggagaggaccucaaacugucuugcacugugaauaaguuccuuuauagagauguuacauggauauugcugaggaccgugaacaaucguacaaugcauuacagcaucuccaagcagaaaauggccauuacuaaggaacacucaaucacccucaaccugacgauuaugaacguaagccuucaggacucuggcaccuaugcuugucgggcgcgaaaugucuacacaggugaggaaauccugcagaaaaaggagauaacuauuagaggggagcauugcaacaaaaaggcaguguuuuccaggaucaguaaauucaagagcacccgcaaugauuguacaacucaaucuaacguuaagcacuga

SEQ ID NO: 56325 - RNA, 2982 nt, Artificial Sequence
  derived and/or modified sequence opt3 from FLT3__Homo_sapiens__NP_004110
augcccgcccuggcuagagacggcgggcagcucccucuucugguggucuucagcgcaaugaucuuuggaaccauuacaaaccaagauuugccaguuauaaagugcguguuaaucaaucacaaaaacaaugacuccucuguagguaagucaaguagcuacccgaugguguccgagucucccgaagaucugggcugugcccuaaggccucagucgucagggacugucuaugaggcggcugccguggaaguugacgugagcgcaaguauuacgcuccagguccugguggaugccccaggaaacaucuccugccuuuggguauucaaacauucuagccugaauugucagccccacuuugacuugcaaaaccggggcguuguguccauggucauucucaagaugaccgagacacaggcuggugaauaccugcuguucauccagucagaggcaacuaauuauaccauacucuuuacagugaguauccgcaacaccuuacuguacacucuucgacguccuuauuucagaaaaauggagaaucaggaugccuuggugugcauuagcgaaucugucccagagcccaucguugaaugggugcugugugacucccaaggggagucaugcaaggaggaaagcccugcuguagugaagaaagaggaaaagguccuacaugagcucuuuggaacagauauuagguguugcgcccggaacgaacugggccgcgaguguaccagacuuuucacgaucgaccugaaucagacuccacagaccacauugccgcagcucuuucugaaagugggcgagcccuuauggauaaggugcaaggcgguucacgugaaccauggguucggacugacuugggaacucgagaauaaagcacuugaagaggguaacuacuuugaaaugaguaccuauucuacaaaucggaccaugauucgcauccuguucgccuuugucuccagcguggcucgaaacgauacgggcuacuacacuuguucgucuuccaagcacccuucacaaagugccuugguaacaauuguugagaagggguucaucaacgcaaccaauagcuccgaggacuaugaaaucgaucaguacgaggaauuuugcuuuucugugagauucaaggcuuauccacagauuaggugcacuuggacauuuagccggaagucauuccccugugagcaaaaaggacuagacaacggcuacaguauauccaaguuuugcaaucacaaacaucagccuggugaauauaucuuccacgccgagaacgacgaugcgcaguuuaccaagauguucacgcugaauauucgucgcaaaccacagguccucgccgaggcaagcgcuucucaagccucauguuuuagugacggguacccccugccgagcuggaccuggaagaagugcuccgauaaaucuccuaacuguacagaagagaucacugaaggaguguggaauagaaaggcuaacaggaaagucuucggccagugggugucgagcuccacccuuaauaugucagaggccauaaagggcuuucugguuaaaugcugugcauauaacaguuuggggacaucuugcgagacuauucuccugaauagccccggaccauucccuuuuauccaggacaacaucuccuucuacgccaccauugguguguguuuacuguucaucguaguccuaacacuccugauuugccauaaguacaagaaacaguuucgguaugaaucacaacuucagauggugcagguuaccggcagcucugauaaugaguacuucuauguggacuuucgagaauacgaguaugauuugaagugggaguucccccgcgaaaaccuggaguuugggaaaguccucggauccggcgcuuucgguaaggugaugaaugcgacugcauacgggauaaguaaaacgggcguaagcauccagguggccguuaagaugcugaaggaaaaagcugacucuuccgagagagaagcccuuaugucagagcugaagaugaugacacaauugggaagucacgaaaacauugucaaccuccugggcgcauguaccuuaagcgggccaaucuaucugaucuuugaguacugcugcuacggagaucuacucaauuaucugaggucgaaacgggagaaguuccaccgcacuuggaccgaaauuuuuaaagagcauaacuucuccuuuuaccccacauuccagucucacccuaauagcucaaugccagguaguagagaagugcagauacauccggacuccgaucagaucucuggccuucacgggaacagcuuucauuccgaggacgaaauugaguaugagaaucaaaagagguuggaagaggaagaggaccugaacgugcucaccuucgaggaucuguuauguuucgccuaccaggucgcuaagggaauggaauuucuggaguucaaaucaugcguucaccgugaccuugccgcacggaauguguuggugacucacggcaagguagucaaaaucugugauuuuggucucgcgcgagacauuaugagcgauaguaacuaugugguuagagggaaugcuaggcugcccgugaaguggauggccccugaaucucuauucgagggcaucuacacaauaaaauccgacgucuggagcuauggaauccugcucugggaaauuuucucgcugggcgugaacccauaccccgggaucccuguugaugcaaauuucuacaaacuuauucagaacggauuuaaaauggaccaaccauucuaugccacggaggagaucuacauaauuaugcagucaugcugggcuuuugauucucgcaagcggcccaguuucccgaauuugaccuccuuucuggguugucaguuagccgacgcagaagaggcuauguaucagaacguggauggcagaguaagcgaaugcccucauacuuaccaaaauaggcgcccauucucucgagagauggaccucgggcugcuuagcccccaggcccaggucgaagauuccuga

SEQ ID NO: 56326 - RNA, 708 nt, Artificial Sequence
  derived and/or modified sequence opt3 from FLT3LG__Homo_sapiens__NP_001450
augaccgugcuggcccccgcuuggagcccuacaacuuaccuccuucuguuguuacugcuauccucuggccucucagggacgcaggacugcaguuuccaacacagcccaaucuccucugauuuugcagucaagauuagagagcugucggacuaucuucugcaggauuacccgguuaccguggccucaaacuugcaggacgaggaacucuguggaggucuguggaggcugguacucgcgcagcgguggauggaacgcuuaaaaacaguggcuggcagcaagaugcaagggcugcuugagcgagucaauacugaaauacauuucgugaccaaaugcgccuuucagcccccuccaaguuguuugcguuucguucagacaaacaucuccagacugcuacaggagaccucugagcaacucguggcacugaagcccuggauuacuaggcagaauuuuagccggugccuugaacugcagugucagccugauuccucaacauugccacccccuuggaguccacgcccgcucgaggccaccgcucccacggcaccucaaccaccccuguuacugcuccuucuguugccugucggacuacugcuccuggccgcugccuggugccuucacuggcagagaacuaggcggcgcaccccacgacccggcgaacaggugccgccuguacccagcccacaagaccuguugcucguugagcauuga

SEQ ID NO: 56327 - RNA, 3897 nt, Artificial Sequence
  derived and/or modified sequence opt3 from FLT4__Homo_sapiens__NP_002011
augcagagaggcgccgcucugugccucaggcuuuggcuguguuugggguuacuggacggacuugugagcgguuacuccaugacacccccuacccucaacaucacugaggaaucucacgucauugauacgggcgacucacugaguauaagcugccgggggcaacauccacuugagugggcauggccgggagcccaggaagcgcccgcuaccggcgauaaggacuccgaggauacagguguugugcgcgacugugaagggacugaugcccgaccuuauugcaaaguacuguugcuccacgaggugcaugcaaaugacaccggaucuuacgucuguuauuacaaguauaucaaagcccguauugagggcacaaccgcugcaucgucauacguguucguuagagauuuugaacagccauucaucaacaagcccgacacucugcuggugaauaggaaagaugccaugugggucccuugccucgugagcauuccaggcuuaaacguaacacugcggagucaguccucuguucuuuggcccgacgggcaagagguggucugggaugaccgcagaggaauguuggugagcaccccucugcuacacgacgcucucuaucugcagugugaaacgacuuggggugaucaggacuuucuuuccaauccauuccuggugcauaucaccggcaacgaguuguacgauauacagcuccugccgaggaagucauuagagcugcucgucggggaaaagcuaguucugaauugcacagugugggccgaguuuaacaguggaguaacuuucgacugggauuaccccggcaaacaagcggaacgggguaagugggugccugagcgccgaagccagcagacccacacagaauugucuuccauccuaaccauucacaaugucucacagcaugaccuggggagcuauguguguaaagcaaacaauggaauccaaagauuuagggagaguacggagguuauugugcacgaaaacccauucaucucugucgaguggcucaagggccccauacuggaagccacugcuggcgaugagcuugugaaacugccuguaaaguuggccgcauacccacccccggaauuucagugguauaaggacgggaaagcucucuccggacggcauagcccucacgcccugguuuuaaaggaggugacagaggcgucgaccgguacuuacacacuggcccuauggaacucugcagcuggccuccgucgcaauauuucccuggaacuugucgugaaugugcccccacagauccacgagaaagaagccucaaguccuagcauuuauuccagacauucuaggcaggcuuugaccugcacggccuacggggucccccugccacucagcauccaauggcacuggcggcccuggaccccuuguaagauguucgcacagcgaucacugcgcagaaggcagcaacaggaucuuaugccacagugccgggacuggcgcgccguuacaacucaggaugcugugaacccgaucgagagucuggacaccuggacagaauuuguagagggaaagaacaagacugucuccaaauuggugauucaaaaugcgaacguuagcgcaauguauaagugcguggucucuaauaaggugggccaggacgagagacucauauacuucuacguaaccacaauccccgaugguuuuaccauugaaucaaaaccuagugaggaacuguuagaggggcagccagugcugcuaagcugucaggccgacuccuauaaguacgagcaucucaggugguaucgucugaaccuuucuacuuugcacgaugcucauggcaauccccugcuccuggacugcaaaaacguucacuuauucgccacgccucuggcagccucgcuugaagaggucgcuccaggagcccggcacgcaacauugagccucuccaucccccgaguggcgccggaacaugagggccacuacgugugugaaguccaagauagaaggucacaugacaagcacugccacaaaaaguaucugaguguucaggcucuagaggccccucgccugacccagaaucucacugaucugcuugugaacgugucugacagcuuggagaugcagugucugguagcaggggcccaugcuccauccauagucugguacaaggaugaacgguuacucgaggaaaaaucaggaguggaccuggccgauagcaaucaaaaacuuucuauucagagaguuagggaggaagacgcaggucgcuaucugugcuccguguguaacgcuaaaggcugcgucaauaguagcgccucuguggcgguugagggguccgaggauaagggaucaauggaaaucgugaucuugguaggcaccggugucauugccguguucuuuugggugcuccugcuacugaucuucuguaacaugcgacggcccgcucacgcagacauuaaaacaggguaccucaguauaaucauggacccuggcgaggucccccuggaggaacagugcgaauaccuuagcuaugaugccucgcaaugggaguuuccacgugagagauugcaucugggaaggguuuuaggcuacggggcuuucggaaaggugguagaagccuccgcauuugguauucacaagggcucuagcugugacaccguggcggucaaaaugcucaaggagggggccacugcuucagaacaucgcgcccugaugagugagcuuaaaauccugauccacauuggaaaucaccuaaacgugguuaaucuccugggcgcaugcacaaagccucagggucccuugauggugauagucgaguucugcaaauaugggaaccuguccaacuuuuuacgggcuaagagagaugccuucucuccaugugcagaaaagagcccggagcagaggggccgauuucgcgccaugguggaacucgcucggcuggacagaaggcguccuggauccucagaucgcguucuuuucgcgcgguuuagcaaaacggagggcggggccagaagggcaagucccgaccaggaagcugaggaucugugguugucuccacucaccauggaggaccuggugugcuacuccuuccaagucgcccgaggaauggaauuucuagccagccggaaguguauccaucgcgaucuggcugcaagaaauauucuucucucggagucagacguagugaaaaucugcgauuucggccuggccagggacauuuauaaggaucccgacuacguucggaaagguucugcgcgauugccucugaaguggauggcuccagaaaguaucuucgacaaaguguauacuacacaguccgaugucuggagcuuugggguguuacucugggagauauucucucugggagccagccccuacccuggcguacagaucaacgaagaguuuugucagagacuucgcgacgguaccaggaugcgugcaccggagcuggccacaccagcuauucggagaaucauguugaauugcugguccggcgaucccaaggcaaggccugccuucucagaacucguggagauucugggggaccuacugcaaggacgcggccuucaggaagaggaagaggucuguauggcgccacgaaguagccagucuuccgaggaagggucauuuagucagguuagcacuauggcucuccacaucgcccaagcagaugccgaggacucucccccuucccugcagagacauucguuggcugcccgguacuauaacugggugagcuucccgggaugcuuagcaaggggcgcugaaacccgcgguucaucccguaugaagacguuugaggaguuccccaugaccccaacaacuuacaaagggaguguggauaaucagaccgacucuggaaugguccuggccagcgaagaguuugaacaaauagaguccagacaccggcaggaaucaggcuucagguga

SEQ ID NO: 56328 - RNA, 1668 nt, Artificial Sequence
  derived and/or modified sequence opt3 from FLVCR1__Homo_sapiens__NP_054772
auggccagacccgacgaugaggaaggcgcugcaguggccccugggcacccacuggcgaagggauaccucccgcuucccaggggugcuccugucggcaaagagagcguugaacugcagaacgggccaaaggccggaaccuuccccgugaauggcgcaccucgggacuccuuggccgcugcaucugguguauuagggggaccacaaacaccccuggccccugaggaagagacucaggcucgccuacucccagccggcgcgggcgcagagacgccgggggccgaaucaaguccccugccucuuaccgcucugagcccacgacguuuuguggucuugcucaucuucucccuguauucucuggugaacgccuuucaguggauucaguacucgauaaucucaaauguuuucgagggauuuuauggugugacacucuuacauauugauuggcugagcauggucuacaugcuugcauaugugcccuugaucuucccugcuacuuggcugcuagacaccagaggccucaggcugacagcccuucuggggaguggauugaacugccucggcgcguggauuaaaugugguuccguacaacagcaccuguuuuggguuaccauguuagggcagugccuguguucuguggcccaggucuucauccucggacuuccaagccggauagcauccgugugguuuggccccaaggaagugucaacugcuugcgccacagcuguccugggcaaucaauuggggaccgccguuggauuccuacugccgccugugcucguacccaacacgcagaaugauacuaaccugcuugcauguaauaucaguaccauguuuuacgguacaagcgccguggcuacucuguuguucauucucaccgcgaucgcauuuaaagagaagccacgcuauccucccucucaggcccaggcugcccugcaagacuccccacccgaggaauacucauacaagaaaagcauuagaaacuuauucaagaauaucccuuucguccugcuacucauaacauauggcauuaugaccggggcauuuuacagugugucuacgcugcuuaaccagaugaucuugacuuauuacgagggagaagagguuaaugccggcaggauuggucugacacucguggucgcugggauggugggcuccauccugugcggacuuuggcuggauuauaccaaaacuuacaagcagacaaccuugaucguauauauucucagcuucauaggcaugguuaucuuuacguucacccuggacuuacgguacauuaucauaguguuugucacagggggagugcuggguuucuuuaugacuggcuaccuaccacucggguucgaauuugccgucgagauuaccuauccggagucggaaggaacaucuuccggccugcuuaacgcaucagcgcaaaucuucgguaucuuguuuacucuggcucaggggaaacucaccagugauuacggccccaaggccggaaauauuuuccuguguguguggauguuuaucggcauuauauuaacagcacugaucaagagcgaccuucgccgacauaacauuaacaucgggaucaccaauguugaugugaaagccauuccugcugacuccccaacugaucaggagcccaagacgguaauguugucuaaacagagcgaaucagccauauga

SEQ ID NO: 56329 - RNA, 966 nt, Artificial Sequence
  derived and/or modified sequence opt3 from FLVCR2__Homo_sapiens__NP_001182212
augagcgccgacaacuccucuaccaucugcguguguagaucagucaggcaggagcugggcauugcuauaggguuccucguucccccugugcuuguaccaaauaucgaagaucgggacgagcuggcauaccacauuaguaucauguuuuauauuaucggagguguggccacauuguuacugauccuagucauaauuguguucaaggaaaaaccgaaguaucccccuagccgcgcgcaaucccucucuuacgcucugacuucgccagaugccucauaccuuggcagcaucgcacgacuguuuaaaaacuugaauuucguucuccuggugauuacguaugggcugaacgccggagcuuuuuacgcacucaguaccuuacugaaucguauggucaucuggcauuaucccggcgaggaagugaacgccgguagaauagggcuuacaauuguaaucgcuggaauguugggcgccguuauuuccggcaucuggcuggacaggucuaagacuuacaaagagaccacccuaguggucuacaucaugacacucguggggaugguggucuauacuuucacacugaaucuuggacaccuguggguuguguuuauuaccgcggguacgaugggcuucuuuaugacuggguacuugccucucggauucgaguuugcaguagaacugaccuauccagagagcgaaggcauauccucagguuuacugaacaucagugcccagguguucgggauuaucuuuacaauaagccagggacagauuaucgauaauuacggcacuaagcccggcaacaucuuccucugcgucuuccuuacccugggggcugccuugacagcauuuauuaaggcugaccuacggcgccaaaaagccaauaaggagacccuggagaacaaacuccaggaagaggaagaggaaucuaauacguccaaggugccuacugcgguuucagaggaucaucuguga

SEQ ID NO: 56330 - RNA, 3591 nt, Artificial Sequence
  derived and/or modified sequence opt3 from FMN1__Homo_sapiens__NP_001096654
auggagaacguggacaauagccuggauggcuccgacgucucugaacccgccaagccugaggcugggcucgaaguugcacagucaauccuuaguaaauucagcaugaagucccuguuuggauucaccucuaaauuggagucggugaacccagaagaggaggaugccguauuaaaggcguuucacucacuggacgugaauccgacaagccaacaggaugacaguuccaacggucuagauccccaggaagcuggcucuagagucagcccugaccucgggaaugaugagaaaauugccuccguggaaacugagucagagggaagucagaggaaggaagcaggcacgagccugcuugcccaagagcuguugccacucucuacccugaaggguacaaaagacgauguuauaugcgugcgggggacucugguccauaccacauccgacucagauagcgacgacggaggccaggaacccgaggaaggcaguucuaccaacgggccuaaguccccaagcggagugcucucggagcccucucaggaguccaaagaaaauccugguggcuuccgcgagaacacuguaacaggggaaaugaauggagcugaguuaugugcagaagauccacagcgaaucccgcccgagaugucaaguaagcuggaggccggcaacggugggcuucaaaccgaacguagaccuagccaggaccagguuggagaggaaggcucccaggauuugccagcugugacgaaucaaaacucuagcgucggcauuacugagucagccaguuccaaaaaggaagugagcggggagaagucuuuucagcugcccgcguucuuuucaggacuaagggugcucaaaaagggugcaaccgccgagggcggggaaacaaucacugagauuaaaccuaaggacggagaucuggcccuucugaaauugacccagccaguccaaaagagucucguucaggcuggccugcagacagugaaaagcgaaaagaaggcaaccgaccccaaagcuacgccgacuuuacuggagcagcucucccuucuguugaauaucgauaugccuaagacagagcccaaaggugccgacccagaaucuccucggcgcgaggaaauggggugcaacgcggaucaagagucgcagagcggccccggaguaccacagacccagggcggggaagugaagcccaaauccccugagacugcccuagaggcauucaaggcucuguuuauaagaccaccgaggaagggaacaaccgccgacacgucagaacucgaggcucugaaacggaagaugcgccacgaaaaagagagucuucgagccgucuucgaaagaucuaauagcaagcccgcagaugguccuuccgacucaaaaagcccagaccauucucugaccgagcaagaugacaggacacccggccgguugcaggccguguggccuccacccaagacuaaggauaccgaggaaaaaguugggcucaaguacacagaggcugaauaucaggcggcaauccugcacuuaaaacgugagcauaaggaagagauugagaaccugcaggcccaauuugaacuacgcgcuuuccacaucagaggagagcacgccaugauuacugcaaggcucgaagagaccaucgagaaccugaaacaugaacuugagcaccgguggcgaggcgguugugaggagcgcaaggacgugugcauauccacagaugacgauuguccgccuaagaccuuuagaaaugucugcgugcagacugacagggaaacguucuugaaaccaugugagagugagagcaagacaacccggucuaaccagcugguacccaaaaagcucaauauuuccucacugagucagcuuagcccucccaacgaucauaaagacauccacgccgcucugcaaccaauggaagggauggccucgaaucagcagaaggcauugccucccccaccggcguccauuccucccccacccccucucccaucuggccugggauccuuaucacccgcuccuccgaugccacccguuagugccggcccuccacugcccccuccgcccccaccucccccaccucuacccccaccguccucugcagggccucccccacccccuccacccccuccgcucccaaacagccccgccccucccaauccaggagguccucccccagcuccuccgcccccaggccuggccccucccccaccucccgggcuuuucuuuggauugggcuccucaagcagucaaugcccgcgcaaaccagcaaucgagccuucuugucccaugaagccacuguacuggacuagaauccagauuuccgauaggagccagaacgcuacccccacacucugggacucgcuggaggaaccugauauacgugacccgucagaguucgaauauuuauuuucuaaggacaccacucagcaaaagaagaaaccccugagugagacauacgaaaagaaaaauaaggugaagaaaaucauuaaacuuuuggaugguaaacggucccagacggucgggauccucauaagcucucugcaccuagagaugaaggacauucagcaggccaucuucaacguggaugacagcgucguggaucuggaaacccucgcggcccuguaugagaaucgagcucaagaagacgagcuuguuaaaaucagaaaguacuaugagacuuccaaggaagaggaauugaaacuguuagauaagccagagcaguuucuccaugagcuggcacagauuccuaacuucgccgaaagggcucagugcaucauuuuucgcucaguguucagugagggcauaacaagccuucaccggaaaguagaaaucauuaccagagccucuaaggaccuguugcaugucaaauccgugaaggauauccucgcacugauccuagcguuuggaaauuacaugaacggcgggaauaggacacgcggacaagccgacggcuacucacuggagauucuccccaagcugaaagauguuaagagucgagacaacgguauaaaccuuguggauuaugucgugaaauacuauuugcgguacuaugaccaggaagcugggacugaaaagagcguauucccucugccagagccccaggacuuuuucuuagccucccaagugaaauuugaagaucucaucaaggaccugcguaaacuuaagagacagcuggaggcaucugaaaagcagaugguugucguguguaaagagucgccuaaggaauaccuacagccauucaaagauaagcucgaggaguucuuucaaaaagcuaagaaggaacacaaaauggaggaaagccaucuggagaaugcccagaagucauucgaaaccacggugagguauuuuggaaugaaacccaaguccggcgagaaagagauuaccccgaguuacgucuucaugguuugguacgaauuuugcucugacuucaagacaaucuggaagcgcgagagcaaaaacauuuccaaggaacgguugaaaauggcacaggagucagugucuaagcugacuagcgagaaaaagguggaaaccaagaaaaucaauccuacagccaguuuaaaggagagacucaggcagaaagaagcuagcguaacuaccaacuga

SEQ ID NO: 56331 - RNA, 5169 nt, Artificial Sequence
  derived and/or modified sequence opt3 from FMN2__Homo_sapiens__NP_064450
augggaaaccaggacgggaagcugaaacgaagcgccggagaugcucuccacgaggguggagggggagcagaagacgcccuuggacccagggauguggaggcgaccaagaaagguuccgggggaaagaaagcucugggaaagcauggcaaagggggagguggcgggggaggcgguggggaaucuggcaagaagaaaucaaagagcgacagccgggccuccgucuucucuaauuugcgcauccguaaaaacuuaucgaagggcaagggcgccgggggaucaagagaggauguucuggacagccaagcccuacagacaggugaacucgauagugcucacucccugcuuacuaaaacgccugaccugucuuugagcgcagaugaggccggccucuccgacaccgagugcgcugauccauuugaagugacagggccgggaggccccgguccugccgaggcgagaguagggggcaggccaauugcagaagacguggagacugccgcuggagcccaggauggccagcggaccucaagugggagcgacacagacauauacucuuuccauuccgcaaccgagcaagaagaucugcugucagacauccagcaggcuauucgccuccagcaacagcagcagcaacaguuacagcugcaacuucagcagcagcaacagcagcagcaauugcagggagccgaggaacccgcggccccuccaacugcagucagcccccagccuggugcuuuucugggccuagauagauuccuccuggggccaaguggaggcgccggugaggcuccggggucucccgacacagaacaggcccuuuccgcacugagcgauuugccugagucgcucgccgcugagccaagggaaccccaacagccuccaucucccggcggacugccgguguccgaggcgccuucauuacccgcagcccagccagcugccaaggacaguccuagcuccaccgcauuucccuucccagaagccggccccggggaggaagcugccggagcaccuguucggggugcgggcgauacggacgaggagggggaagaggaugcuuuugaagacgccccacgcggaucuccgggcgaggaaugggcacccgaggugggugaggaugccccucagcgacugggggaagaaccagaagaggaggcucaaggccccgacgccccugcagcugccagccucccaggaucacccgcgccgagucagagauguuucaaaccuuauccacuuaucacucccugcuauauuaagaccacaacuaggcagcuguccagcccuaaucacucucccucacaaaguccaaaccagagcccucggaucaaacgucgccccgaaccauccuugucuagaggcucgaggaccgcccuagcuagcgucgcagccccggcuaagaaacaucgggccgacgggggacuggcagcgggccucucccgaucagccgauuggacagaggaacugggugcucgcaccccuagaguagggggaagugcccaccuucuggagaggggcguggcaucugacagcgguggcgggguuucccccgcuuuggccgcaaaggccucaggagcuccagcggccgcagauggcuuucagaauguguucacggggcggacucuccuggaaaaguuauuuagccagcaagagaacggacccccugaggaagcugagaaauucuguucucgcaucaucgccaugggccugcuacucccauuuuccgacugcuucagagaacccuguaaucagaacgcccagacaaaugcugcaaguuucgaucaggaccaacuguauaccugggccgcggucagccagccuacucacucucuugauuacuccgagggucaguuuccgaggcgugugccaucaauggggcccccuaguaagccacccgacgaggaacaucgguuggaggaugcugaaacagagagccagucggccguguccgaaaccccucaaaaacgaucugacgcaguccagaaggagguuguggauaugaaaagcgaaggacaggccacgguaauucaacagcuggagcagaccaucgaggaccucagaacaaagauugcugaacuggagaggcaguauccggcacuugauacugaaguggccucaggccaccaaggucuggagaacggcgucaccgcgaguggggacgugugcuuggaggcucuccgccuggaagagaaggaaguucggcaucacagaaucuuagaggccaaauccauccagacaucucccacugaagagggaggcgugcugacccuaccaccugucgacgggcuccccggaaggccaccuugucccccaggcgcagagagcgguccgcagacaaaguucugcuccgaaauuucacugaucgugagcccucgccgaauuaguguacagcuugauucucaccaacccacccaguccaucagccagccacccccuccacccucguugcuguggucagccgggcagggacaaccuggcucucagccgccacauaguaucuccacugaguuucagacgagccacgaacauucuguuagcuccgcuuucaaaaauucauguaacauucccaguccucccccacucccuugcacagagaguucuuccucaaugcccggucugggcauggugccaccuccgcccccaccuuuacccgggaugaccgucccaacucugccuaguaccgccaucccccagccgccaccucuucaaggaacagaaauguugcccccacccccuccgccccucccaggcgcagggaucccucccccuccaccccugccuggagcuggcauucuaccacugcccccgcucccuggugccgggaucccacccccuccaccccugccgggagcggccaucccucccccaccuccccuuccaggcgcaggcauucccuugccuccaccgcugcccggggcuggaaucccuccacccccuccauuacccggugccggcaucccuccgccacccccucuccccggggcuggcauuccaccucccccaccgcugccuggcgcagguauacccccacccccuccacuucccggggccggcauuccuccgccacccccucugccaggcgccggcauacccccucccccaccguugccuggggcuggaaucccacccccucccccacucccuggugcgggcauucccccgccaccuccccugccaggggcaggaauacccccuccgccaccccuaccuggcgccgguauacccccaccucccccacugccuggggcuggcauuccgcccccaccuccccucccaggcgccggcauaccucccccgccaccucugcccggggugggaaucccacccccucccccacuuccuggugcaggcauuccgcccccaccucccuugccaggggccggaaucccucccccgccuccacugcccggcgcugguauuccuccacccccuccauuaccccgggucgggaucccgccucccccaccccucccuggagcgggcauaccacccccuccaccgcugcccggcgccgggaucccuccacccccuccacuucccggaguggguauuccgccuccacccccucugcccggcguugggaucccaccgccucccccacuacccggagcaggcauuccuccacccccuccacucccggguauggggauacccccugcuccagcacccccucugccacccccuggaaccggcauaccgcccccaccuuugcugcccgugagcggcccaccuuuacucccccagguaggguccucuacucugccaacaccgcaggucuguggauuucuuccucccccacugcccucggguuuguucggccucgggaugaaucaagacaagggaagccguaaacagccuauugagccaugcagacccaugaagccucuguacuggacgaggauccagcuacacucaaagcgcgauuccaguaccucucugauuugggagaaaaucgaggaaccgagcauagacugccaugaauuugaggaacuuuucuccaagacugcagugaaagagcggaagaaacccaucucagauacaauuucuaagaccaaggccaaacagguugugaagcuccugagcaacaaaagaagucaagcugucggcaucuugauguccagccugcacuuagacaugaaggauauucagcacgccgugguaaaucucgacaacucugugguugaucuggagacacuucaggcgcuguaugaaaacagggcacagucagacgaguuggagaaaaucgagaagcauggucgauccaguaaagauaaggagaaugccaagagccucgacaaaccagaacaauuucuguacgagcuaucgcugauaccuaacuucucugaacgcgucuuuuguauucuuuuccaguccacuuuuagcgagucaaucugcaguauccggagaaagcucgaacuguugcagaaauuaugugagacccugaagaaugggcccggcgugaugcaagugcucggacugguccuugcuuucggcaacuacaugaaugggggaaacaaaacgaggggucaggccgauggcuucgggcuggacauuuugccaaagcuaaaggacguuaaaucuuccgauaauagccguucacugcucaguuauaucgugagcuacuaucugcgcaacuuugacgaggaugcuggaaaggaacagugccuuuucccuuuacccgagccacaggaccuguuucaagcaucccagaugaaauucgaagauuuucagaaggaccuccggaaauugaagaaggaucugaaagccugugagguggaagcuggcaagguauaccaggucucuagcaaagagcacaugcaaccguucaaggagaauauggaacaguuuauuauacaggccaaaaucgaccaggaggcagaagagaacucccucaccgaaacacauaagugcuuccuggagacuaccgcguacuuuuucaugaagccuaaacuuggugagaaggaagugucacccaaugccuuuuucucuauuuggcacgaguuuaguucggauuucaaagacuucuggaagaaagaaaacaagcuguugcuacaagagagaguuaaagaggcugaagagguguguaggcagaagaaggggaaaagccuguacaagaucaaaccacgacacgauuccggcauuaaggccaaaaucucuaugaagacauga

SEQ ID NO: 56332 - RNA, 3303 nt, Artificial Sequence
  derived and/or modified sequence opt3 from FMNL1__Homo_sapiens__NP_005883
augggcaacgccgcugggagcgcagagcagcccgccggaccugcggcuccaccgcccaagcaaccugccccacccaaacagccuaugccagcagccggugaacuggaggaaagauucaauagggcucucaacugcaugaaucuucccccugacaaggugcagcuguugucccaguacgauaacgagaaaaagugggaauuaaucugugaccaagagcgguuucaggucaaaaauccaccggcagccuauauucagaagcugaagucuuacguugauaccggcggggugucacgcaaaguagcugccgacuggaugaguaaccuaggauucaagcgacgugugcaggagagcacacaaguccucagagaacuggagacuucccuuaggacgaaucacauaggcugggugcaggaauuucugaacgaggagaaucgggguuuggauguucuccuggaauaucuggcguucgcacagugcucugugaccuacgacauggagucgacagauaacggggccucaaauagcgaaaagaacaagccccucgagcagagugucgaagacuuauccaaaggaccuccaucuagcgugcccaagucccgccaucugacuaucaagcugaccccugcucacucaagaaaagccuugaggaauagucggauuguaagccaaaaggaugacguucauguguguaucaugugccugcgcgcaauuaugaacuaucagucuggcuuuucccuagucaugaaucacccagcuugugugaacgagaucgcccucucacugaacaauaaaaacccccgaacaaaggcgcuugugcuggaguugcucgccgcagucugccugguuagaggcgggcaugauauaaucuuagcugccuucgacaauuuuaaagaaguguguggagagcagcacagguucgaaaagcugauggaguacuuucggaacgaagauagcaauauugacuucaugguagcuugcaugcaauuuaucaacauugugguccacaguguggagaauaugaacuuccguguuuuucuccaguaugaguucacccaucuuggucuggacuuguaccuagaacgccugagacucacugagucugauaaacuucaggugcagauccaagccuaccuugacaauauauucgaugucggcgcacuguuggaagacacagagaccaagaacgccgugcucgaacacauggaggagcugcaggaacagguagcuuuacugacggagaggcuacgggaugcggaaaaugaguccauggcaaagauugccgagcucgaaaaacagcugagccaagcucgaaaggagcuugaaacuuugcgcgagagauuuucggaaucuaccgccaugggggcauccaggcggccgccugagcccgagaaagccccuccagcugcccccacacgcccaucagcacuggaacucaagguugaggaacuggaggaaaaaggacuuaucaggauucugagaggccccggugacgcggugaguaucgagaucuugccugucgcuguggccacuccaagcgggggagaugcaccgacccccggcgucccuacaggcuccccaucucccgaccucgccccugcugccgagccagcacccggggcugccccgccuccacccccuccccugccaggauuaccuagcccccaggaagcgccaccgucagccccuccccaggcuccaccccugccugguaguccagagcccccuccggcaccaccccuaccuggcgaucucccacccccuccgcccccaccucccccaccucccgggaccgacggaccagugccgccucccccacccccuccacccccuccgccaggcggucccccugaugcccuggggcgucgggacuccgaacuuggccccggaguuaaggcuaagaaaccaauucagacgaaguuccgaaugccuuugcugaacuggguggcccucaaacccagccaaauaacuggcacaguauuuaccgagcugaaugacgaaaaggucuuacaggagcuggauaugucugacuucgaggaacaguuuaaaacuaagucacaggggccaagucuugauuugagcgcacucaaguccaaagcggcccaaaaggcuccuucuaaagccacacugaucgaggcaaacagagcuaagaaucuagccauuacccugaggaaaggaaaccucggugcagaacgcaucugucaggccauagaggcuuaugaccugcaggcgcuuggcuuggauuuccuggaguuacucaugcgguuucugccgacggaauacgagagaucgcuuauuaccagguucgaacgcgagcaacgacccauggaggaacugagcgaggaagaccgguuuauguugugcuucucccguaucccaagacucccugagaggaugacaacucugaccuuucuagggaacuuccccgauacagcccagcugcucaugccacagcugaaugcaaucauugcugccucaaugaguaucaagucuagcgacaaacuucgccagauuuuggaaauagugcuggccuuuggaaacuauaugaacuccucaaaacggggcgcugcauacgguuucagauuacaaagccucgaugcccugcuugagaugaagucuacugacaggaaacagacccugcuacauuaucucguuaaggugaucgcggaaaaauacccucagcugacaggguuccacuccgauuugcacuuucuggacaaggcuggcagugucagcuuagauucugugcucgccgacguacgaucccugcagcgcggacuugagcugacccaacgggaguucgugagacaggacgauuguaugguuuugaaagaauuucucagggcaaauucacccacuauggacaagcugcuagccgauaguaagacggcucaggaggcauucgaaagcgucguggaguauuuuggcgaaaauccgaaaacaaccucgccagggcuguucuuuucccuuuucucucguuuuauuaaggccuacaaaaaggcggagcaggagguggaacaauggaaaaaggaggcugccgcacaggaagccggagcugacacuccugguaagggcgagcccccagcccccaaaagcccuccgaaggcacgccggccccagauggaucucaucucagagcugaaaagaaggcaacagaaggaaccauugaucuacgagagugaccgagauggggcuauugaagacauaaucaccgucauuaaaacaguuccuuucaccgcccggacuggaaagcgcacauccagacuguuaugcgaggcgucucucggcgaagagaugccccuguga

SEQ ID NO: 56333 - RNA, 3279 nt, Artificial Sequence
  derived and/or modified sequence opt3 from FMNL2__Homo_sapiens__NP_443137
augggcaacgccgggagcauggacucccagcaaaccgauuucagagcucacaaugugccccugaagcucccuaugccagagccgggagaacuugaggaaagguuugcaaucguccugaacgccaugaauuugcccccugacaaagcgcgguuacugcgccaguacgauaacgagaagaaaugggaacuaauuugcgaccaggagcgauuccagguuaagaauccaccccauacauauauacaaaaacucaaggguuaccuggauccugcugugacucguaagaaauuuagaaggcggguacaggagucuacccaggugcuucgcgaacuggagaucucauugagaacgaaccacauuggcugggucagggaguuccucaaugaagagaacaaggggcuggacgugcugguugaauaucucaguuuugcccaguacgcagugacauucgauuuugagagcgucgaauccacuguggagucuucgguagacaaaucaaagccauggagccggaguaucgaagauuuacaucgcggauccaaucugcccucuccuguuggcaacagcgugucccgaucagguagacacagugcccuuagguauaauaccuugccaagccggcguacacugaaaaacucucgccuagucuccaagaaggacgaugugcauguguguauuaugugccucagagcuaucaugaauuaccaauauggguucaacauggucaugucacacccgcacgcaguuaaugagauagcccugagccuuaacaacaaaaaucccaggaccaaggcucugguguuggagcuccuggccgcgguauguuuagugcggggaggccaugaaaucauucugagugcauuugacaacuucaaagaggucugcggcgaaaagcagcgauuugagaaacucauggaacacuuccgcaaugaggauaacaauaucgacuuuaugguggccucuaugcaguucauuaacaucguugugcauuccgucgaggacaugaauuucagagugcaccuucaguacgaauuuacuaagcugggguuggaugaguaccuagacaaacugaagcacacagaaagcgauaagcuccaaguacagauacaggcuuaucuggacaacguuuucgaugugggagcccuucuggaggacgcagaaaccaaaaaugcugccuuggagagggucgaggaacucgaggaaaacauuucgcaucugucugagaaguuacaagauacggagaaugaagcgauguccaaaaucguggagcuggaaaagcagcuaaugcagcggaacaaagagcucgacgucgugcgcgaaauuuacaaggaugccaauacucagguucacacccugagaaagauggugaaagagaaggaggaagcaauccaaaggcagucaacacuugagaaaaagauccaugaauuggagaaacaggguacuauuaagauacagaagaaaggcgacggggauaucgcuauucugccuguagucgccaguggaacccucagcaugggcuccgaagugguugcugguaacucuguggggccaacaaugggagccgcaagcucaggcccccugccuccacccccgccuccccuuccaccuaguuccgacacccccgagacgguccaaaauggcccagugacucccccuaugccaccgcccccuccacccccuccacccccgccuccacccccucccccaccucccccaccgccucugcccgggccagccgcugagacaguacccgcgccuccauuggcacccccucucccgagcgccccaccccugccuggaaccucuucaccaacugugguuuuuaacagugguuuagcugccgucaagaucaaaaagcccauaaaaacaaaguuccguaugccuguguuuaacuggguggcacugaagccgaaucagauuaacggcaccgucuucaaugaaaucgacgaugagcggauccuagaagaccucaacguugaugaguuugaagagauuuucaaaacgaaggcccaggggcccgcuaucgaccugagcuccucuaaacagaagauuccacaaaaaggaucgaauaaggugacccuuuuggaggccaaccgagcaaagaaucuggcgauaacacucagaaaggcuggcaagacugccgaugaaaucuguaaagcaauucacguguuugaccugaagaccuuaccuguagauuucgucgagugccugaugagguuucuucccacagaaaacgaggugaaaguuuugcgccucuaugagcgggaaagaaagccacuggagaaucuaagcgacgaagauagguucaugaugcaguuuuccaaaaucgagcgccugaugcagaagaugacuaucauggccuucauugguaacuucgcugaaucaauacagaugcucaccccucaacugcaugccaucauugcagcuagugugucuaucaagagcucccagaaacuuaagaaaauuuuggagaucauacuggccuuagggaauuacaugaacucaagcaagcgaggcgcggucuauggauuuaaacuccagucucuggaccuucuguuggauacaaaguccaccgaccggaagcaaacucuccugcacuacaucaguaaugugguuaaagagaaguaucaccaggugagccuauucuacaacgaacugcauuacguagagaaagccgcugcagucucucucgaaaaugugcugcuugaugugaaggaguugcagcguggcauggaccugacgaaaagagaauauacaaugcacgaccauaacaccuuacucaaggaguuuauucugaacaaugaggggaaacuuaaaaagcugcaggaugacgccaaaaucgcucaagaugccuucgacgaugucguuaaguacuuuggagaaaaccccaaaacuaccccaccguccguguucuuuccuguauucgugagguuugucaaggcauauaaacaggcggaggaagagaaugaacuacgcaagaagcaggagcaggcccucauggagaaacuguuggaacaagaggcucugauggaacagcaggaccccaagucaccaagucacaaaagcaagcggcagcaacaggaguuaauugccgagcucagaaggcgacaggugaaagauaaccgccacguuuacgaagguaaggacggcgcaaucgaggauauaauuacagaccugcggaaucaacccuauagaagggcugaugccgugcgucgcucgguccggagaagguucgacgaucagaaccuucgauccgugaauggggcagaaaucaccauguga

SEQ ID NO: 56334 - RNA, 3084 nt, Artificial Sequence
  derived and/or modified sequence opt3 from FMNL3__Homo_sapiens__NP_783863
augggcaaccuggagagcgccgaaggggugcccggagagccuccauccgucccgcuccuucugcccccugguaagaugccaaugcccgaaccuugcgaguuggaagagagauucgcuuuaguucugucuucaaugaaucuaccacccgacaaagcaaggcuccugcggcaguacgauaacgagaagaaaugggaccuuaucugugaucaagaacgcuuucaggugaagaauccuccacacaccuauauucagaaacugcagaguuucuuggacccgagcguaacacgaaagaaguuucguagaagggugcaagaguccacuaaaguccuccgggaacuggagauaucucugcgcacgaaccauaucggcugggugagagaguuccucaaugaugaaaacaagggguuagacguucugguggauuaccuuucguuugcccagugcucagucauguucgacuuugagggauuggaaagcggcgaugacggugcguucgauaaacugaggaguuggucccggucuauugaggaccuacagcccccuagcgcucucuccgccccauuuaccaauucacuggcacgcagugcccgacagagcgugcuuagauauucuacacugcccgggaggcgggcuuugaagaacucccgucucguaucacaaaaagaugacguucacguguguauccugugcuuacgcgcaauuaugaauuaccaguauggauucaaccuggucaugagccauccucacgccgugaaugaaaucgcucucagucuuaacaauaagaacccaagaacuaaggcccugguguuggagcuacuggcggcagucugucucguuaggggcggccaugagauaauccuggccgcuuuugacaauuucaaagaagugugcaaggagcuucaccgguuugaaaaacugauggaguacuuccgaaacgaagauucuaacauugacuucaugguagccuguaugcaguuuaucaauauugugguccacuccguggaggauaugaacuuccgcguucauuugcaguaugaguuuaccaagcucgggcuggaagaguucuuacaaaagagcagacacacagaaucggagaagcuacaggugcagauccaagcauaccuggacaaugucuuugaugugggaggucuccuggaagacgcugagaccaaaaacguagcccuugagaagguugaagaguuggaggaacaugugucucaccugacugagaagcuccuggaucuugaaaaugagaacaugaugagggucgcggaacuggagaaacaguugcuccagcgggaaaaggagcuggaguccauaaaagaaacauacgagaauaccucacaccaggugcauacguuacgcagacugauuaaggaaaaagaggaagccuuccaaaggcguugccaccuagagcccaacguccggggccucgagaguguggacagcgaagcacuggcucgaguugggccggccgagcuuuccgaaggaaugccucccucugauuuggaccugcucgcuccagccccucccccagaggaagugcugcccuuaccuccaccgcccgcaccuccacugcccccuccacccccgccucuuccagauaagugucccccugcucccccauugccuggcgccgcgcccagcguaguccucacugugggucugucagcaaucagaauuaagaaaccaaucaagaccaaauuuaggcuaccgguuuucaauuggacagcccugaagccuaaccagaucagugggacuguguuuuccgagcucgacgacgagaaaauucuggaagaucuugacuuggauaaguucgaggaacuguuuaagaccaaagcucagggacccgccuuagaccucauaugcagcaagaauaaaacagcacagaaggccgcuucuaaagucacccugcuugaggccaaccgcgcaaagaaucuggcgaucacguugcggaaggcuggcagaucagccgaggaaauuuguagggcaauccauacuuucgaucuccaaacacugccaguggacuuuguagagugccuaaugcgcuuccugcccaccgaagccgaggugaaacuccugcgacaguaugaacgggagcgucagccucuugaggaauuggcugccgaggauagauucaugcuguuauuuaguaagguugaaaggcucacucagcgcauggcaggcauggcuuuccuggggaacuuucaagacaaucuucagaugcugacaccacagcuaaacgccauaauugcggccagcgcuuccgucaaaucuucgcagaagcucaaacaaaugcuggagaucaucuuggcacugggaaacuacaugaauagcuccaagcggggugccguguauggcuucaaauuacagucacucgaucugcuucuggacaccaagaguacggauagaaagaugaccuugcuccacuuuauugcucugacagugaaagaaaaguaccccgaccuagccaacuucuggcaugagcugcacuuugucgagaaagcagcggccguuucucuugaaaaugugcuccuggaugugaaggaguuggggaggggaauggaacugauccgacgcgagugcagcauucacgacaacuccguauuacggaauuuccucucaacuaacgaaggcaaacuggacaaacuucagagagaugcuaagaccgccgaggaggcauauaaugcugucgugagguacuuuggugaaagcccuaaaacaacuccgccaucuguuuucuuucccguguucguccguuuuauacgcuccuauaaggaggccgaacaagagaacgaggcacggaaaaagcaggaagaggugaugagagaaaaacagcuggcccaggaggcuaagaaguuggacgcgaaaaccccuagucaaaggaauaaguggcagcagcaggaacucaucgccgagcugcgacggcgccaagcaaaagagcauagaccaguuuacgaagggaaggauggcacaauugaggacaucaucaccggacuacacugucagcccauggugguaaggcaucaggcucggagcgccgccccuccgucugggcccccacgagcuccuggcccccacuga

SEQ ID NO: 56335 - RNA, 1611 nt, Artificial Sequence
  derived and/or modified sequence opt3 from FMO1__Homo_sapiens__NP_001269621
augcaggagaacauggccaagagaguggcuaucgucggcgcagggguuagcggacuggccuccauuaaaugcugucucgaagagggucuugaaccuaccugcuucgagaggucugacgaucugggcggguuguggcgguuuacagaacacguggaggagggacgcgcgucauuauacaagaguguagugagcaauuccuguaaagaaaugucuugcuauucggacuuccccuuuccagaggauuacccgaacuauguccccaauucacaauuccuggaauaccuaaagauguaugcuaaccauuuugaccuccugaaacacauacaguucaagacuaagguguguagcguuacgaaaugcagugauuccgccgugucuggccagugggaggucgugaccaugcaugaggaaaagcaggagagcgcaaucuuugacgccguaaugguuuguacagguuuccuuacuaauccuuaccugccauuggauuccuuucccgggauuaacgcuuucaaaggacaauauuuucacucacgacaguacaagcauccugacaucuucaaagauaagcgugugcucgucauuggcaugggcaauagugggaccgacaucgcaguggaagccagccaccuggcugagaagguguuucugucuacaaccggagguggcugggucauauccagaaucuucgauucaggguacccaugggacaugguuuucaugacuagguuucagaacaugcuccggaauagcuuacccacaccuauugugaccuggcugauggaacgcaaaaucaacaauuggcuuaaccacgccaauuauggauugauuccagaggauagaacgcagcugaaggaguucguacuaaacgacgaacucccgggcaggaucauaacugguaaaguguuuauucggcccaguaucaaggaggucaaagaaaauucugugauuuucaacaacaccuccaaggaggaaccuaucgacaucauuguuuuugcgacaggguacacuuucgcauuuccauuccuggaugagagcguggucaaaguggaggacggacaagccucgcuuuauaaguacauauuucccgcucaucugcagaagccuaccuuggccaucauuggccucaucaaaccacugggcucuaugauacccacaggggaaacccaggcacgcugggcuguacgaguuuuaaagggagugaauaaacugccgccucccuccgucaugauugaggaaaucaacgccagaaaggagaauaaaccaucaugguucggucucugcuauuguaaggcgcuucagagugauuacaucacguauauugacgaacuguugacuuacaucaacgccaagccuaaucuauuuagcaugcugcucacagauccccaccuggcacuuaccguguucuuuggcccaugcucccccuaccaauucaggcugacugggccuggaaaaugggagggcgcucggaacgccauuaugacacagugggaccguaccuucaaggucauaaaagcucgcgugguucaggagucuccaagcccguuugaaucauucuugaagguguuuaguuuccucgcccuguuaguagcaaucuuucugauuuuccuauga

SEQ ID NO: 56336 - RNA, 1608 nt, Artificial Sequence
  derived and/or modified sequence opt3 from FMO2__Homo_sapiens__NP_001451
auggcuaagaaaguggcugucaucggcgcagggguuagcggacugauuucccucaagugcuguguggacgagggucuugaaccuaccugcuucgagagaacagaagauauaggcgggguauggagguuuaaagagaacguggaagacggacgggccucuaucuaccagucagucgugacuaauacgaguaaggagaugagcuguuucuccgauuuucccaugccagaggacuucccgaacuuucugcacaauucuaaauuguuagaauauuuccgcauuuuugcgaagaaguucgaucugcuaaaauacauccaauuucagaccacaguucucucggugcgaaagugccccgacuucucaagcaguggccaguggaaagucgugacucaguccaacgguaaggagcaaucugcuguauuugaugccguuaugguguguagcgggcaucacauucugccucauaucccacuuaaauccuuccccggaauggaacguuuuaagggccaguauuuccacucaagacaguacaagcauccugacggcuucgaggggaaaaggauacuggucaucggaauggguaauaguggcagcgauauugcaguggaguugucuaagaacgccgcucagguguuuaucuccacccggcacgggacaugggucaugucacgcauuagcgaagacggauauccaugggauaguguuuuccacaccagauuuaggucuaugcuccggaaugugcugccccgcacugcaguaaaauggaugaucgagcaacagaugaaccgaugguucaaucaugaaaacuacggccuggagccucagaauaaguauauaaugaaagaaccagugcucaacgacgaugucccguccagauuacugugcggugccauuaaggugaaaagcacaguuaaggagcuuaccgagacgucggcuaucuuugaagacgggacuguggaggaaaauauugacgucaucaucuucgccaccggauacucuuuuuccuuccccuuuuuggaggauucacuggugaagguagaaaacaauaugguuagucuauacaaauauauuuucccugcgcaccucgacaagagcacacuggcauguauaggccuuauccagccacugggcuccauuuuucccacugccgaguugcaagcuaggugggugacccgggucuucaaagggcucugcucucugccuagcgagcguacaaugaugauggauaucauaaagcgcaacgagaaaagaauugacuuauuuggagaaucacagagucagacccugcaaacgaacuacguggauuaucucgacgaacuugcccuggagaucggugcaaagccagauuucuguuccuugcuauucaaggaccccaaacuggcugucaggcucuacuuuggcccgugcaauagcuaucaguaccggcugguggggccuggacagugggaaggcgcccgaaacgcgaucuucacucagaagcaacgcauucuuaaaccccugaagacaagagccuugaaagauucuucaaauuuuaguguuagcuuccuccugaagaucuuaggucugcuagcagugguagucgccuuuuucugucagcuccagugguccuga

SEQ ID NO: 56337 - RNA, 1599 nt, Artificial Sequence
  derived and/or modified sequence opt3 from FMO3__Homo_sapiens__NP_008825
augggcaagaaaguggccaucauuggggcuggagucagcggucuggcauccauaagaucuugccucgaggaaggccuugagcccaccuguuucgaaaagucaaacgacaucgggggacuguggaaauuuagugaucacgccgaggaaggcagggcgagcauuuacaaguccguuuucucuaauucgucaaaagagaugaugugcuuuccugacuucccauuuccggaugacuuccccaacuuuaugcauaauagcaagauccaggaguauauuaucgcuuucgccaaggagaaaaacuuguuaaaguacauacaauuuaaaacauucgugaguuccguaaauaagcacccugauuuugcaacuacgggucagugggacgugaccacagagcgggaugggaaaaaggaaucugccgucuucgacgcugugaugguuuguagcggacaucacguguauccaaaccugcccaaggaguccuuuccuggccuaaaucauuucaaaggcaagugcuuccacucacgcgauuacaaagagccaggggucuuuaacggaaagcgagugcucguaguuggucugggcaauagugggugugacaucgcaacugaacuuagccguaccgccgaacaggugaugauuucuuccagaucaggaagcugggucaugaguagggugugggauaacggcuaucccugggacaugcuguuggugacacgguucgguaccuuucucaaaaauaaccugccuacugcuaucucugauuggcuguacgucaagcagaugaaugcccgcuucaaacacgaaaacuaugggcucaugccauuaaauggaguucugagaaaggagccgguguuuaacgacgaacuucccgcguccauuuugugcggcaucguaagcgugaagccuaacgucaaagaguucacagagaccucggcaauauuugaagacggcacgauuuucgaggggaucgauugugugauuuuugccacuggauacucuuucgcuuacccauuucuggacgaauccaucaucaagucaaggaauaacgagauuauacuauucaaagguguuuuucccccucuccuggaaaagaguaccaucgccgugauuggcuucguccaaagccuuggggcagcuaucccaacaguggaucugcagucccggugggccgcgcagguaauaaaaggaacuugcaccuugcccucuauggaggacaugaugaaugauauuaacgagaagauggaaaagaaacgcaagugguucggcaaaagcgagacaauccagaccgacuauaucguuuacauggaugaacucucaaguuuuauuggugccaagccgaauaucccuuggcuguucuuaacggaccccaaacuggcaauggagguguauuuugggccauguuccccuuaccaauuccgacucgucggccccggacaguggccaggcgcuagaaacgccauucuuacucagugggauaggagccugaagcccaugcagacacggguggucgggcguuugcaaaagccuugcuuuuucuuucauuggcuaaaacuguucgcuauaccaauccuccugauugccguguuucuuguucugaccuga

SEQ ID NO: 56338 - RNA, 1677 nt, Artificial Sequence
  derived and/or modified sequence opt3 from FMO4__Homo_sapiens__NP_002013
auggccaagaaaguggcugucaucggcgcagggguuagcggacuguccucuauuaagugcuguguggacgaggaucucgaacccacaugcuucgagagaucagacgauauagguggccuuuggaaauuuacagaaaguagcaaggacgggaugacuaggguauacaaaucccuggugacgaacgucuguaaggagaugucuugcuauucggauuucccuuuucacgaagacuacccaaauuucaugaaccaugagaaguuuugggauuauuugcaggaguucgccgaacacuuugacuuacugaaauacauccaauucaagaccacaguguguucaauuacuaaacggccggauuuuagcgagaccggacagugggacguugugacagaaaccgagggcaagcagaaucgcgcggucuucgaugcugugaugguaugcacuggucauuuucuaaacccccaccucccucuggaggccuucccagggauccauaaauuuaagggacagauucuucacagucaagaauauaagauccccgagggcuuccagggcaaacgaguucuggugauaggguugggaaauacagguggcgacaucgcagucgaacucucccguaccgccgcucaggugcugcugucuacgagaacugggaccugggugcucggaaggagcuccgauuggggcuacccuuauaacaugauggucacacggcgcuguugcucauucauugcacagguuuuaccaaguagauuucugaauuggauccaagagaggaaacuuaacaaacgguucaaucacgaagacuacgguuugagcauuacuaaggggaaaaaggccaaauuuaucgugaacgacgagcugcccaauuguauacuaugcggagcuauuaccaugaagacaucuguaaucgaguucaccgaaacguccgccguguuugaggauggcacugucgaagagaacauugacgugguuaucuucacaaccggcuacacuuuuucauuccccuuuuucgaggaaccacucaagagccuguguaccaaaaagaucuuucuuuauaaacagguguucccgcugaauuuggagcgcgcgacccucgcaauuauagggcugaucggauuaaaggguaguauucugucuggcacggaacuccaggcccgaugggucaccagaguguuuaaagggcuuugcaagaucccuccuucccagaagcugaugauggaggcuacagaaaaagagcaauugauaaagaggggaguauucaaagauacuagcaaggacaaauucgauuacauugccuauauggacgauaucgcagcuugcaucggcaccaagccaucgauuccccuacuguuucucaaggacccucggcuggccugggaaguuuucuuugguccauguacacccuaccaguaucgucuuauggggccgggcaaaugggauggagcgcgcaacgccauccugacucagugggacagaaccuugaagccucucaaaacaaggauugugcccgauucuuccaagccagcaucaaugagucauuaccugaaggcuuggggcgccccugucuuacuggcuagccuacuccugauaugcaaguccucucuuuucuugaagcuggugcgggacaaacuccaagaccgaaugagccccuaucuggucucacuuuggcgcggguga

SEQ ID NO: 56339 - RNA, 1131 nt, Artificial Sequence
  derived and/or modified sequence opt3 from FMOD__Homo_sapiens__NP_002014
augcaguggaccagccugcuccuucuggccggcuuguucuccuuaucucaagcucaguacgaggacgauccccacuggugguuucauuaucugagaucacagcagaguacauacuaugacccuuacgauccauauccguacgaaacuuaugagcccuacccuuacgggguggacgaaggaccagcauauacguacgguagccccuccccuccagaucccagggacugcccucaagagugugauugcccaccgaacuuccccaccgccauguauugugacaaucggaaccuaaaguaccucccuuuugucccaucucgcaugaaauauguuuacuuccagaauaaccagaucacaucgauucaggaaggcguguuugauaaugcgacugggcugcuuuggauagcucugcacggaaaccaaaucaccucagacaagguaggccgaaaaguguucagcaaguugcgucaucucgagagacuguaucuggaucacaauaaccucacaaggaugcccgguccuuuaccacggagucugcgcgagcuucauuuggaccacaaucagauuuccagaguccccaacaaugcccuggaagggcuagagaaccucaccgcacuguaccuucagcacaaugaaauccaggaggugggaucuagcaugaggggccugcgguccuugauucuccuggauuuaucauacaaccaucugcgcaaaguuccggacggccucccuagugcccuugagcaacuguauauggaacacaauaacguguacacuguccccgacagcuauuuucgaggggcuccaaaguugcuauacgugagacugucucauaacucccucacaaauaacggacuggcaucaaauaccuucaacagcaguucucuucuggaguuggaucucuccuauaaucagcugcagaagaucccucccguaaacacgaauuuagaaaaccuguaccuacaagguaauaggauaaacgaguuuagcaucucgucuuucugcacuguuguggacgucgugaauuuuuccaaacuccaggugcugcggcuugauggcaacgaaauuaagcguucagccaugccagcugacgcccccuugugucugcgccucgcgagucugaucgagauuuga

SEQ ID NO: 56340 - RNA, 1614 nt, Artificial Sequence
  derived and/or modified sequence opt3 from FMR1__Homo_sapiens__NP_001172004
auggaggaacugguggucgagguuagaggcagcaacggggccuucuacaaggcuuuugugaaagacguacacgaagauuccaucaccguggcauucgagaauaacuggcagcccgacaggcaaauuccuuuucaugauguccgguucccaccgcccgugggauauaauaaggacauaaacgaaucugaugagguugagguguacucacgcgccaaugaaaaagagccuugcuguugguggcucgcgaagguccgaaugaucaaaggugaauuuuaugugauugaguacgcugccugcgacgcaacauauaacgagaucguaacuauugaacgucuuagaaguguuaauccaaacaagcccgccacgaaggauaccuuccacaaaaucaagcuggacgugccugaggauuugaggcagaugugugcuaaagaagcagcccauaaggacuuuaaaaaggcugucggcgccuucagcgugacauacgauccagagaauuaucaguuagugauacuguccaucaacgaagucacuucuaagcgggcgcacaugcuaauugacaugcauuuucgcucgcucagaaccaaacugucacuuaucaugaggaaugaggaggcaagcaagcagcuggaaaguucccggcaauuggccucucgcuuccacgagcaguuuauuguucgagaagaucucauggggcuggcuaucggaacacacggcgccaacauacagcaggcaagaaaagugcccgguguaaccgcuauugaccuggacgaggauacuugcacauuccauaucuacggggaagaccaagaugccgugaagaaagcgaggagcuuucucgaguucgccgaggacgucauucaggugccucggaauuuaguuggaaaggugaucggcaaaaacggcaagcugauccaggaaauugucgauaaguccggggugguacguguucgcauagaggcagaaaaugagaaaaacgugccacaggaagaggagaucaugccgcccaacucacuuccuaguaauaacagcagagucggaccaaaugcucccgaagagaagaaacacuuggacauuaaggaaaacucuacccauuucucccaaccuaauucaacgaaagugcagaggguccugguggccagcaguguuguggcuggugagucucagaagccagagcuaaaggccuggcaaggcaugguacccuuugucuucguggggacuaaagauuccaucgcaaacgccaccguucuccuggacuaccaccuuaauuaucugaaguugcagcagcggaaacgaggacgcgcuagcugugcggaagagacagauggcgguguggaaggggaggaagaggacaaggaggaagaggaugucgaagaggcaucgaaagaaacuaccauaacaccggagcagauuaucgugcacguaauccaagagagacucaaggaggaacagcagauggacccuuuuaggucugaacugaccgccauuaugaagggaguguccacguuaaaacauuaccggauucccccaguuaaggucgugggcugcgcucgcgugaaaaucgucacuagaaggaagcguucacagacagccuggaugguuaguaaccacagcuga

SEQ ID NO: 56341 - RNA, 7068 nt, Artificial Sequence
  derived and/or modified sequence opt3 from FN1__Homo_sapiens__NP_002017
augcugagaggccccgggccuggacuccuucuguuggccgugcagugcuuagguaccgcugucccaagcacaggcgcauccaagucuaaaaggcaagcccagcagaugguucagccgcaaucacccguggcgguaagucagagcaagccuggguguuacgacaacggaaaacacuaucagaucaaucagcaaugggagcggacuuaccugggcaacgcucuagugugcacguguuauggugggucccgcggauucaauugcgaaucuaagccagaggccgaagagaccuguuuugauaaauacacaggcaacacuuaucgagucggcgacaccuacgaacgucccaaggauucgaugauuugggacugcacauguauaggggcaggaagagguaggaucucaugcaccauugccaaucggugucaugagggcgggcagagcuauaagaucggagauacuuggcgcagaccucacgagacaggcgguuacaugcucgaaugcgugugucuggggaacggaaaaggcgaguggaccugcaagccaauugcugaaaaaugcuucgaccaugcagccggcacgaguuacguugugggggagacuugggagaagcccuaucagggauggaugauggucgauuguaccugccuuggugaaggcuccgggaggaucacauguacuucucggaaucgcugcaacgaccaggauacccgaacaagcuacagaauaggagacaccugguccaaaaaggauaauaggggcaaccuguugcaauguaucugcacggguaaugggcggggcgaguggaagugugaacgucacacuucagugcagacaaccaguagcggaucuggcccuuuuacugacguacgcgcugccguuuaucagccacaaccgcauccccagccuccacccuacgggcacugcgugacagauuccggagucguguauucaguggguaugcaguggcucaaaacccagggcaacaagcaaaugcuguguacgugccuggggaauggagucagcugucaggagaccgcgguuacacagacuuacggcgguaacaguaauggggaaccuugcgugcucccauucaccuauaacggcagaacauuuuacucuugcacuaccgagggaaggcaggacggccacuuaugguguuccacaaccagcaacuacgagcaagaccagaaauauucguucugcacugaucauacgguacuggugcagacacgggggggaaauucuaacggugcacuuugucacuuucccuucuuguacaauaaccauaauuauaccgacugcacuuccgaaggccgacgcgauaacaugaaguggugugggaccacacagaauuacgacgccgaucaaaaauuuggauucugcccgauggcugcccacgaggaaauuuguaccacuaacgagggcgucauguauagaaucggugaccagugggauaagcagcacgacauggggcauaugaugaggugcacaugugugggcaauggacggggcgaauggacgugcauugcauacucacagcugcgcgaucaauguaucguugacgauauaaccuauaacgugaaugacacuuuucacaaaagacaugaggaggggcacaugcuaaacugcacaugcuucggacagggcaggggucguuggaagugugacccugucgaucagugccaagacagugaaaccgggacauuuuaccagauuggagauagcugggagaaguacgugcauggcguacgguaucaguguuacugcuauggucgaggcaucggggaauggcacugucagccccuccaaacuuacccauccucuagcggaccuguugagguguucauuaccgaaacgcccucacagccaaauagucaccccauccaguggaacgcuccucagccaucccauaucagcaaauauauucugagauggaggccgaagaauucugucggccgcuggaaagaggccaccauacccgggcaccuuaacucauacacaaucaagggacugaaaccuggcguggucuaugagggucaauugauuaguauccagcaguacgggcaucaggaagugacucgguucgacuuuaccacaacuagcaccuccacgccaguuacaucuaacaccgugacuggagagacaacccccuucucgccucucguagcgacuagcgaauccgucaccgagauaacagccucaaguuuugugguuucuugggugagcgcauccgauacggucucaggcuucagaguggaguacgaacugagcgaggaaggugacgagccacaauauuuagaucugcccucuaccgcuacuuccguaaauauuccggaccuccuuccuggcaggaaguacaucgugaacguuuaucagaucagugaagauggggagcagagccugauuuugucuacaucccaaaccacagccccagacgcucccccugaucccacugucgaccagguggaugacaccucaaucgugguccgcuggagucgaccacaggccccuauuacgggauaccggauaguuuauagccccucgguggagggcuccucuacagaacuaaaucugccagagaccgcaaacagcgugacucucucagaccugcagccggggguacaauacaauaucaccauuuaugccgucgaagagaaccaggaaaguacaccugugguuauccagcaggagacuaccggaacaccccguuccgauacggugccaucucccagagaccuucaauuugucgaggugaccgauguuaaggugacuaucauguggacaccuccagaaagcgcuguaaccggcuacagggucgacgugauucccgugaaucugccuggugagcacgggcagcgcuugccgauaucccggaacacuuucgcggaagucacaggacucucaccaggcguuaccuacuauuuuaaaguguucgcaguaagccacgguagagagaguaagccccugacggcccagcagacuaccaaauuagaugcuccuacaaaucugcaauuugugaacgaaaccgacucuacuguccuagugagguggacaccaccccgagcccagaucaccggcuaccgccucacaguugggcugacucggagaggacagccuaggcaguauaaugugggcccguccgucagcaaguacccccuucguaacuugcaaccagcaucggaguauaccgugucacugguugccauuaaagggaaucaggagucuccuaaggcuacgggaguguucacaacccuccagcccggcaguuccaucccaccuuacaacacugaagucaccgagacaacuauuguaaucaccuggacgcccgccccacgcauagguuuuaagcugggggugcggccgagccaaggaggcgaagcaccuagagagguuacaucugauagcggcuccaucguggucucagggcuuacccccggaguggaguauguauacacuauucaggugcugagggacggucaggaacgagaugcgccaaucgucaauaaaguugugacacccuugaguccuccaaccaaccuccaucuggaggcuaaccccgacacuggcguguuaacagucagcugggaacggucuaccacgccugauauuacuggguaccgcaucaccacaaccccgacaaauggacagcaaggcaacucccuggaggaagugguucacgccgaccagucaaguugcacuuucgauaaucuaagcccaggucucgaguauaacguauccguguacaccgucaaggacgacaaagagucugugcccauaucggauacgauuaucccugcaguucccccaccuacagaccugagauuuacuaauauugggcccgauaccaugagggugacaugggccccaccuccgagcaucgaccuuaccaacuucuugguccgguauucacccgugaagaaugaagaggauguagcugaacuguccauaaguccaucugacaacgccgucgugcucacuaaucuguuaccuggaaccgaguacguugugagcgucuccucaguguaugaacagcaugagucuacaccccugcgaggcagacagaaaacgggccuugauagcccaacugggaucgacuucagugauauuaccgcaaacuccuuuacaguucacuggaucgcuccucgcgccaccauuacuggauacaggauccgucaucaccccgagcacuucagcggucggccgagagaagacagggugccacauucucgcaauucaauaacauugaccaaccucacgccuggcacugaguaugucguguccauuguagcgcugaaugggcgagaagagaguccccuacugaucggacaacagagcacagugucggauguuccaagagaccucgaagucguggccgcuacccccaccucucugcuuaucuccugggacgcaccugccgugacuguccgguacuacaggauuacauauggcgagaccggugggaacagcccgguacaggaguuuacagugcccggaucaaagaguacugcuacgaucucuggcuugaagccaggcguugauuacaccauuacaguguaugccgucacugggcgcggagacuccccugcaagcucaaaacccauaaguaucaauuaccguaccgaaauugauaagccuagccagaugcaagugacagacguucaggauaacuccaucucugugaaauggcugccaagcuccucacccgucaccgguuauagagugacuacgaccccuaagaacggcccagggcccacaaaaacuaagaccgcgggaccggaccagacagagaugaccauugaaggcuuacaaccuacuguagaguacgugguuucugucuaugcccagaauccaaguggugagucgcagccccucgugcagacagcugugacgaacaucgaucggccuaaagggcuggccuucaccgacgucgauguugacagcauaaagaucgcaugggaauccccacaaggacaggugucuagguaccgcguaacuuacucaagccccgaggauggcauucacgaacuuuuuccggcuccugacggcgaggaagauacagccgagcugcagggguugcgacccggauccgaguauaccgugagugucguggcacuccaugacgacauggaaucucagccacugaucgguacccaaagcacagccauuccugcucccacugaucuaaaguucacgcagguuaccccaacaucacuguccgcgcaguggacucccccuaaugugcagcucaccggcuacagaguccggguaacaccaaaagagaagaccgggccgaugaaagaaaucaaccuggcccccgacaguagcucugugguuguguccggacuuauggucgcaacuaaguaugaggugucagucuacgcuuugaaagauacgcugacaagcaggccugcccaaggcgugguuaccacuuuagaaaaugugucgccaccccgcagagccaggguaaccgacgcuacagagacuaccauaacaauuucuuggcggacgaagaccgagacuaucacagguuuucagguggaugcagucccugccaacgggcagaccccaauccagcguacuauuaagcccgacguucgcaguuauacaauaaccggacuccaaccuggcacggauuacaaaaucuaucuguacacccuuaaugacaacgcgcgauccagcccgguggucauugaugcuucaacagccaucgacgcaccauccaaucugagauuccuagccacuacccccaacucucuccuggugagcuggcagccucccagggcucggauuacaggcuacaucauaaaguaugaaaaaccagggaguccuccccgcgagguagugccaagaccgaggccuggaguuacugaagcaaccaucacagguuuggagcccggcaccgaauacacuauuuaugugaucgcccugaagaauaaccagaaauccgagccauuaauugggcggaagaagacggaugagcucccccaacuggucacacuuccucacccaaaucugcauggacccgaaaucuuggacgugccuagcaccguccagaaaacuccguuugugacccacccaggcuacgauacagguaacgggauacagcuccccggcacgucuggacagcaaccuucaguuggccagcagaugauuuucgaggaacacggguuucgaagaaccacuccacccacaaccgcgacuccuauccgccauaggccccggccauauccgccuaauguaggacaggaggcucugagucaaacaaccaucuccugggcccccuuccaggacacaagcgaguacauuaucucuugucacccaguggguacugacgaagagccucuacaguuucguguccccggcaccucgacgucagcaacccugacagggcuuacuagaggagccaccuauaacauaauuguggaagcucucaaggaucagcaaaggcauaaaguucgcgaggaaguggucacagugggcaauagcguaaacgagggucugaaccagccaacugacgauuccugcuucgacccuuacaccgugagucacuacgccguuggggaugagugggaacggaugucugagagcggcuucaaguugcugugucagugcuuaggauuuggcuccgggcacuuccgaugugacucaaguagauggugccaugauaauggagucaacuauaaaaucggugaaaagugggacaggcaaggcgagaaugggcagaugaugucuugcacgugucucggaaacggcaagggugaauuuaaaugcgauccccacgaggcaacauguuacgacgaugggaagaccuaucaugugggcgagcaguggcagaaagaauaccugggagcuauuugcagcuguacuugcuucggcgggcaacgcggauggcggugugacaauugcagacguccgggcggugagccauccccugaagggacaaccggacagucauauaaccaguacagccagagguaucaccaacggacuaauaccaacgugaauugucccaucgagugcuuuaugccacuugacguccaggccgaucgcgaagacucucgagaguga

SEQ ID NO: 56342 - RNA, 930 nt, Artificial Sequence
  derived and/or modified sequence opt3 from FN3K__Homo_sapiens__NP_071441
auggagcagcugcucagagccgaacuuaggaccgcuacacugcgggcauucggcgggcccggagccgguugcaucagcgagggccgcgcguacgacacugaugcugggccuguguuugucaagguuaaccgacguacgcaagccagacagauguucgaaggagagguggcauccuuggaagccuuaaggucuaccggccugguacgggugccacgcccgaugaaagucauugaccuacccggugggggagcugcauuugugauggagcaccucaagaugaaaucacugaguagccaggccuccaaacuuggcgagcagauggcugaucugcauuuguauaaucaaaagcucagagaaaagcugaaggaggaagagaacacaguuggcaggcgcggggagggagccgaaccucaguacguggacaaauucgguuuucacacugucaccuguugcggcuucauaccacaggugaaugaguggcaggaugacuggcccacauuuuucgcgcggcaucgacugcaagcacagcucgauuuaaucgaaaaggacuaugccgauagagaggcuagggaacuguggucucggcuucagguaaaaauuccugacuuguuuugugggcuggagaucguuccagcccuacuccacggagaucuguggucgggcaacguggcagaggacgaugucggucccauuaucuacgacccugcuucauucuaugggcauagcgaauuugagcuugccauagcgcugauguucggaggcuuuccacguaguuucuucaccgccuaccaccgcaagaucccgaaagcacccggcuuugaccagagauugcuccuguaucaauuauucaauuaccugaaccacuggaaucauuuugggagggaauaccgguccccuucucucggaacuaugcgacgccuucugaaguga

SEQ ID NO: 56343 - RNA, 930 nt, Artificial Sequence
  derived and/or modified sequence opt3 from FN3KRP__Homo_sapiens__NP_078895
auggaggaacugcucagaagggagcuuggcugcagcuccgugcgggccaccgggcacucuggagguggcuguaucucacaggggcgcaguuacgacacagaucaaggacgagucuucguuaaggugaaccccaaagcugaagcacguagaauguuugagggcgaaauggccagccugacugcgauuuugaagacgaauaccguaaaagugccuaagccaauaaaagucuuagacgcuccgggugggggauccgugcugguuauggagcauauggauaugaggcaccuaucuucgcaugccgcaaagcucggcgcccagcuggcugaccuucaccuggauaacaagaaauugggcgagaugcggcucaaggaagcagggacagugggacgcgguggcgggcaggaggaaagacccuucgucgccagguuuggauucgacgugguaacuugcuguggcuaucugccucagguuaaugauuggcaagaggacuggguggucuuuuacgcucggcagcgcauccagccacagauggauaugguggagaaagaaucaggugaccgagaggcccugcaacucuggagcgcguuacagcugaagauucccgaucuuuucagagacuuggaaaucauuccugcacugcuacauggggaucucuggggaggcaacguggccgaggacaguuccggcccagucaucuuugaccccgcuucuuucuaugggcacagcgaauacgagcuggccauagcaggaauguuugguggcuucuccucaaguuuuuauagcgcuuaccacgggaaaaucccuaaggccccaggauucgagaagaggcuucagcuguaucaguuguuucauuaccucaaucacuggaaccauuucggcucugguuaccggggguccucacugaauauuaugcguaacuuaguuaaauga

SEQ ID NO: 56344 - RNA, 1854 nt, Artificial Sequence
  derived and/or modified sequence opt3 from FNBP1__Homo_sapiens__NP_055848
augagcuggggcaccgagcugugggaccaguucgauaaccucgaaaagcacacacaaugggggaucgacauucuugagaaauacauaaaguuugugaaagaaagaacugagaucgaacuguccuaugccaagcaguugaggaauuuaucuaaaaaguaccagcccaagaaaaacucaaaggaggaggaagaguauaaauacacgaguugcaaggcuuucauuagcaaucugaacgaaaugaaugauuaugcaggacagcaugaggucaucuccgagaacauggccucucaaauuaucguugaccuagcgcgguacgugcaggaacucaaacaggagcgcaagucgaauuuucacgauggucgaaaggcucagcaacauauagaaaccuguuggaaacagcuggagucaagcaagcguagauucgaaagggacugcaaagaggccgaucgggcacagcaguauuuugagaagauggacgccgauaucaacguaacaaaagcugacguggaaaaggcacgccaacaggcccagauuagacaccaaauggcugaggauaguaaagccgacuacuccucuauccuucagaaguucaaucaugaacagcacgaguacuaucacacucauauuccuaacaucuuucagaagauacaagaaauggaggagaggcggauuguccgcaugggcgaaagcaugaaaaccuacgcggagguggaucgacagguuaucccaauuaucgggaagugucuggacggaaucgugaaagcagccgaauccauugaccagaagaaugauucacaguuggucauagaggcuuauaaaaguggcuucgaaccgcccggugacaucgaguuugaggauuacacacaaccuaugaagagaaccgugagcgacaacucucucuccaauucaaggggagaagggaagccagaucugaaauucggcggcaagagcaaagggaagcuguggcccuuuauuaaaaagaacaagcucaugaguuuacugacuucuccucaccagccacccccuccaccgcccgccuccgcaagcccuucggcuguaccaaauggaccccagucuccuaaacagcaaaaggagccacuuucccaucgguucaacgaauuuaugacaucaaaacccaagauccacugcuuccguaguuugaaacgcggucugagccuaaagcucggcgccaccccggaggacuucuccaaccugccucccgagcagagaaggaagaaacuucagcagaagguugaugaacugaauaaagagauacaaaaggaaauggaccagcgggaugcgauuacgaaaaugaaggacguguauuugaaaaacccacagaugggggauccugccucucucgaccacaagcuggcagaggucagccaaaauaucgaaaaguuacgaguggagacucagaaauuugaggcuuggcuggccgaaguggagggacgccuccccgcuagaucagaacaggccaggcggcagaguggccuuuacgacucccaaaacccacccaccgucaauaacugugcacaggaucgcgagagcccugacgguucuuauacagaagaacagucacaggagagugaaaugaagguucuggccacugauuucgacgaugaguuugacgaugaggagccauugccggcuaucgggaccugcaaagcgcuauacacauucgaaggacaaaaugagggcaccauuagcgugguagagggcgaaacgcuguacgugaucgaggaagacaagggggauggauggacuagaauuaggcguaacgaggacgaggaagguuauguccccacauccuacguggagguuugucucgauaaaaaugcaaaggacucuuga

SEQ ID NO: 56345 - RNA, 5685 nt, Artificial Sequence
  derived and/or modified sequence opt3 from FNDC1__Homo_sapiens__NP_115921
auggcccccgaggcuggcgcaacccugagagccccuaggcggcucagcugggcggcucuucuguuguuagccgcacugcuaccaguggccuccucugcugcagccucagucgaccacccgcucaagccccgccauguuaaacugcuuaguacaaagauggggcugaaagugacuugggauccuccaaaggacgcuacgagccgacccguagaacacuacaacaucgccuauggaaaauccuugaagucucucaaguacauuaaagugaaugcggagaccuauucguuccugauagaagaugucgagccuggugugguuuacuuugugcugcucacagcagaaaaccauucaggcgucagccguccaguguauagagccgagagucccccugggggagaguggaucgaaauugacggcuucccaaucaaggguccggggcccuuuaaugagacuguaaccgaaaaagagguuccuaacaagccauuaagggugcggguccgcuccucugaugacagacugagcguggcuuggaaagcccccaggcuuuccggagcaaagucaccucggcgcagucgaggcuucuugcugggcuacggggagagcggaagaaagaugaauuaugugccacuaacaagggaugaacggacccacgagauuaaaaagcucgcuucugaauccgucuacguugugucacugcagagcaugaacagucaaggucguucucagcccguauaccgcgccgcgcuuacuaaaagaaagaucuccgaggaagacgagcuggaugugccggacgauauaagcgucagggugaugucgucucaguccguuuuggugucaugggucgacccugugcucgagaaacagaagaaaguaguugccagucggcaauauacagugcgauaccgcgaaaagggcgagcuggcaagaugggauuauaagcagaucgcuaauaggcgggucuuaauugaaaaccugauccccgacaccguguacgaguuugccguccgcauuagccagggggaaagagacggaaaaugguccacgucuguguuccagaggacuccagagagcgcuccuaccacagcccccgagaaucucaacguuuggccagugaauggcaagcccacuguagucgcagccucaugggaugcucuuccugaaaccgaggguaaagugaaggaauauauccugaguuacgcgccagcauugaaaccguuuggggccaagucccuaacauaucccggagacaccacgagcgcucugguugauggccuccaaccuggcgagcguuaccuguucaagauacgggccacuaaccgaagagggcuuggaccacauucuaaagcauuuauuguggccaugcccacaaccucaaaggcugacgucgaacagaauacugaggauaacgguaaaccugagaagccagaacccaguagcccguccccuagggccccagcaucuucgcagcaccccagcgugccugcguccccccagggccgcaaugcuaaagaccuguugcucgaucugaagaacaagaucuuagccaacgggggagcaccacggaaaccucaacugagagccaagaaagcugaggaacuagaccuccagucaacagagauuaccggcgaggaagagcuggguaguagggaagauucucccaugagcccauccgacacgcaggaucaaaagcgcacccuucgaccgccuucacggcacgggcauagcguaguggcccccggccguacagcaguuagagcuaggaugccagccuugccccgccgggagggagucgacaaaccuggcuucucucuggcgacucagccaagacccggggccccuccguccgcuagugcaagcccagcccaccaugcuucuacccagggaacaucccacaggcccucacucccugccagucugaaugacaacgaucuuguggacagcgaugaagacgagcgagcaguggguucgcugcacccaaagggcgcguuugcccagccccgcccugcuuuguccccgucucggcaaagccccucaaguguccucagagauagguccucuguucauccaggggccaagccugcaagccccgcucgucgcacuccacacuccggagccgcagaggaagacucaagcgccagugcuccucccucucggcuguccccaccgcauggcgguagcucgagauuacugccuacccagccccaccuaucaucuccacucaguaaagggggcaaggauggagaggacgcgcccgccacaaauuccaacgcaccuagcaggucuaccaugagcuccucagugaguagccaucugucuucccgaacucaggugucagaaggcgcugaggccagugauggggaaagccacggagacggugaucgggaggacggcgggcgccaggccgaggcuacggcacaaacacuuagagccaggccagcguccggacacuuccauuugcugcggcacaaacccuuugcugccaauggccgaucuccuucgagauucagcaucggucgcgggccgaggcuccagccaucauccaguccccagucuaccguaccuagccgugcacauccccgggucccaucccacucagauucucacccuaagcugagcaguggcauccauggagacgaagaggacgaaaaacccuuaccagccacugugguuaacgaucacgugccuuccagcucuagacagccgauuucaaggggcugggaggaccugcgccgauccccccaaagaggggcuagucuucaucggaaggaaccaauaccugagaaucccaaaagcaccggagcagauacacacccacagggcaaguacucgucuuuggccuccaaggcgcaggacguccagcaaagcaccgaugcugacacugagggucauucaccuaaagcccagcccgggaguacagauaggcacgcaucuccggcccgcccaccugcugcccguucccagcaacaccccagcgugccaagacggaugacgcccggaagggcaccucagcagcagccgcccccaccuguugcuaccucacaacaucaccccggcccucagagucgcgacgccggucgaagcccaucccagcccagacucucucugacucaggcgggccggccuaggccaacaagccaagggcgcucccauucaucuagugaucccuauaccgccucgagcagaggaaugcuaccgacagcacugcagaaccaggacgaagaugcucagggcuccuacgacgaugacucuacugagguggaagcccaagacguaagggcuccugcacacgccgcccgggcuaaggaggcggcagccucacucccaaaacaucagcaggucgagagccccaccggggcuggagccggcggugaucaccguucccaacgcgggcacgcagccaguccugcucgaccaucuagacccggaggcccgcagagcagggcgcgggugccuucacgcgccgcacccgguaaguccgaaccaccuaguaaaagaccccugagcucuaagucccagcagucagugagcgcugaggacgaugaagaggaagacgccggcuucuuuaaggggggaaaagaggaucuuuugucgucuagugucccaaaguggcccuccagcucaacgccuaggggcgggaaagacgcagauggaucccuggccaaggaggaacgggagccagcuaucgccuuagcgccgcgaggcgguucucucgcacccguuaaaagaccucugccacccccuccagggagcaguccccgcgccucccaugugccuagcaggcuuccgccacggucugcugccaccguaucacccguggcuggaacacacccuuggccccaauauacuacccgugcaccaccuggccauuucaguacaacucccaugcuguccuugagacagaggaugaugcacgcccgcuuucggaauccacucagccgacagccggcuagaccuucuuacaggcaggguuauaacggccgccccaaugucgaagggaaggugcugccaggaucgaacggcaagcccaaugggcaacggauuaucaacggaccucagggcaccaaauggguuguggaccuagauagaggucugguccucaaugccgaggggcguuaccugcaggacucacacggaaacccacuuaggauaaaguugggcggcgaugggcggacgauuguggaccuggaaggaacacccguugugagcccugacgguuuaccgcucuucggccaggggcgccauggaaccccacuggcaaacgcgcaagauaaacccauccuuucccugggcgguaagccucuagucgggcucgagguaaucaaaaagacuacacacccacccaccacuaccaugcagccuacaacgaccacuacaccccugccaaccacaacuaccccgcgaccuacgacagccaccacuagaaggaccacaacuacccggcgcacaacgaccagaaggcccacuacaaccgugcgaacuacaacccggacgacuaccacaaccacuccaacaccuaccacacccauuccaacuugcccucccggaaccuuggagcgucaugacgaugacggcaaucugaucaugaguucuaacggcauuccggaauguuaugcugaggaagaugaguuuagcggguuagaaacggacacagccguuccaaccgaggaggcauacgugauauacgaugaagacuaugaguucgaaacuuccagaccucccaccacaacugagccaucaaccacggcuacaaccccccgcgucaucccugaggaaggagccauuaguucuuuuccggaggaagaguucgaucucgcagguaggaagcgguuuguggccccauacguaacuuaucugaauaaagaccccagcgcuccuugcucccuuacagaugcgcuggaccacuuccagguggauucauuggacgaaaucauccccaacgaccucaagaaaagcgaucugccaccucagcaugcccccagaaauauuaccgucguugcaguggagggcugucacucuuuugugauagucgacugggauaaggcuacuccaggggacgugguuacaggauaccuaguauauuccgccaguuacgaggauuucauccgcaacaaauggagcacccaagccucguccgugacgcaccugccuauugaaaaucuuaagccgaacacuagguauuacuuuaaaguccaggcacagaauccccauggcuacgguccaaucucuccuucagugagcuucguuaccgagagugacaacccccuccuggugguccgaccaccugggggagaacccauuuggaucccguucgcuuuuaagcacgauccauccuauacagacugccauggccggcaauacgugaagagaaccugguauaggaaauucguaggcgucguguuguguaauucucugcgcuacaagauauauuuaagcgauaaccucaaagacacauuuuacucaaucggggauuccuggggacguggugaggaccacugccaguucguugauagucaccuggacggccggacugggccucagagcuauguggaagcccuucccaccauucagggauacuacagacaauauaggcaggagccaguccgcuuuggcaauaucgguuucgggacgcccuacuauuacgugggaugguaugaguguggcguuucuauuccuggcaagugguga

SEQ ID NO: 56346 - RNA, 3597 nt, Artificial Sequence
  derived and/or modified sequence opt3 from FNDC3A__Homo_sapiens__NP_001073141
auggccgagcaucccccucugcucgacaccacacagauccuuagcuccgauauuucucuguugucagcuccaauagugagugcagacggcacucaacaggucaucuuaguucaggugaacccgggggaagccuucacgauuagaagggaggauggacaguuucaaugcaucaccggucccgcgcagguaccuaugaugagcccaaauggcuccgugcccccuauuuacgucccacccggguaugcuccucaggugaucgaagacaacggaguucggcgcguggucgugguaccacaggccccggaguuccaccccggcucucacacaguucugcaucgaucgccucacccaccccuaccugguuuuauaccagugcccacuaugaugccgccucccccacgucauauguacucaccugucaccggggcaggagauaugacaacccaauauaugccccaguaccagagcagucagguguauggcgacguggaugcccacuccacucacggcagaucuaauuucagggacgaacggagcuccaagacauacgagcgccuccaaaagaagcugaaagauagacaggggacccagaaggacaaaaugucaaguccacccagcucuccucaaaaguguccauccccgaucaacgagcauaauggacuuauuaagggucagaucgcuggcgggauuaacacgggaucagcaaaaaucaagagcggcaaagguaaagggggaacucaggucgauaccgaaauagaggaaaaagacgaggagacaaaggccuuugaagcucuguugaguaauauuguuaagcccguggccucugauauccaggcgaggacuguagugcucaccugguccccuccaagcucgcugauuaacggcgagacagacgaaucuuccguccccgagcuguauggcuacgaagugcucaucucaaguaccgggaaagacggaaaguacaaaagcguuuaugugggugaggagacgaauaucacuuuaaacgaucugaagccugcaauggacuaccacgccaaaguccaagcugaauauaauuccauuaagggcacaccaucugaggccgaaauauucaccacucuuagcugcgagcccgauaucccgaacccuccacggauugcaaaucgcaccaaaaacucauugacccugcaguggaaggcucccagugacaauggguccaagauccagaacuuugugcuagaaugggaugagggaaaaggcaacggugaguucugucagugcuacauggggagccaaaagcaguuuaaaauaacgaagcucucuccugccaugggcuguaaauuccgacugucagcgagaaaugacuauggaaccaguggcuuuagcgaagagguacuuuacuauacauccgggugcgcccccucuaugccagcaucgccuguucugacuaaggcuggaauuaccugguugagccuccagugguccaagcccucagguacaccaagugaugaaggcaucucuuacauccuggagauggaagaggagacuagcggguacggauucaaaccgaaguaugacggcgaagauuuagccuacaccgugaaaaaccugaggcgguccacaaaguauaaauuuaaggucauugcuuacaauucagaggguaagagcaacccuucugaaguggucgaguucaccacuugucccgacaaaccagggauccccgugaagccuuccguuaaaggcaagauucauagucacagcuucaaaauaacgugggauccacccaaggacaauggaggcgccacaaucaacaaguaugugguagagauggcagaagggucuaauggaaacaaaugggagaugauuuacuccggugccacccgugaacaccucugcgaccgccuuaauccuggcuguuuuuauagacugagggucuacugcaucucagaugggggacagagugcugugagcgagucguugcuaguucaaacuccggcggugccacccggcccuugucugccaccccggcuccagggucgaccuaaggcaaaagaaauccagcugcgcugggggccgccccuugucgacggcggauccccaauuucuugcuacagcguggagaugucaccuauagagaaggaugaacccagagagguauaucagggcagugaaguggagugcaccguuuccucucuguugccagggaaaacauacagcuucaggcuccgggccgcuaacaagaugggauuuggcccuuucuccgaaaaaugugacaucaccacugcccccgguccaccggaucaaugcaagccuccccaggucacaugucgcucagcaacgugcgcccaggugaauugggaggugccacugagcaacgggaccgacgucacugaguauagauuagaauggggaggcguugaggguaguaugcaaauuuguuacugcggccccgggcugucuuaugaaaucaagggacuauccccugcuacaaccuacuauuguagggugcaggcccucagcgugguaggcgcagggccauuuucggaggucguggcgugcguuacacccccuucagugccgggaauugucacuugucugcaggaaaucucugaugacgagauagagaauccacauuacagucccuccacaugccuugcuaucagcugggaaaaaccuugugaucacggcucugagauuuuggccuacagcaucgacuucggugauaagcagucccugacgguggggaaaguuaccucauauauuaucaacaaucuccaacccgacacaacuuaccguauacggauucaggcacugaacagucuuggagccggcccauuuagccauaugaucaagcugaaaaccaagccuuugcccccagauccuccgcgacucgaaugcguggcuuucucucaccagaaccugaaguuaaaauggggugagggcacacccaagacucuguccaccgacucaauucaguaucaucuacaaauggaggacaaaaaugggagauuuguaagucucuacaggggaccaugccacacguauaagguccagcgccugaacgaaagcacauccuacaaauucuguauccaggccugcaaugaggcaggcgaagggccucuuucucaggaguauauauuuaccacucccaagucggugccagcugccuugaaggcgccuaaaaucgaaaaggugaacgaucacauuugugagaucacaugggagugccugcaacccaugaaaggagacccggucauuuacagccuccagguuaugcugggcaaggauucagaguucaaacagaucuacaaggguccagacuccaguuuucgguauucuagcuuacaacugaauugugaauacagauucagggugugcgccauacgccagugucaggauucccuugggcaucaggacuugguaggaccuuauucaaccacuguccucuucauuucucaacgaaccgaacccccagcuagcacaaaccgggauacgguggagaguacccguacuagaagggcacuguccgacgaacagugcgccgcugugauccuaguucuguuugccuucuuuagcauccucauugcauucaucauucaguacuuugugauaaaguga

SEQ ID NO: 56347 - RNA, 3615 nt, Artificial Sequence
  derived and/or modified sequence opt3 from FNDC3B__Homo_sapiens__NP_001128567
auguacgugaccaugaugaugacagaccagaucccccuggagcucccuccacuucugaacggcgaagucgccaugaugccgcacuugguuaauggggaugcugcacaacaggugauuuuaguacaggugaaccccggagagacuuucacgauaagagccgaagacgguacccugcagugcauccaaggcccugcggaggucccaaugaugagccccaauggguccauuccuccaauccaugugcccccuggauauauuucucagguuaucgaagauucaacaggcgugaggcgggucgugguaacuccacagaguccggaguguuaucccccuagcuacccauccgcuaugucucccacccaccaucuaccuccauaccucacacaccauccccacuuuauacacaacucgcauaccgccuauuacccgccuguuacuggucccggggacaugccaccucaguucuuuccccaacaccaucugccacacacaaucuauggagagcaggaaauuauccccuucuacggcaugucaaccuacauuacgcgcgaggaucaguauagcaagccuccacacaaaaagcugaaagaccgacagaucgaucgucaaaauagacuuaacaguccgcccuccucuauauacaagagcuccugcacuaccguguauaauggcuacgggaaaggacauucagguggcagugggggaggcgguagcgggucuggaccuggcauuaagaagacagaaaggcgggcacgcuccucaccaaaaagcaacgacagugauuugcaggaguaugagcucgaagucaagagagugcaggacauccugucuggcauugagaaaccccaaguguccaauauccaggccagggcugucguucugagcugggcaccuccaguggggcucucguguggaccccacucugguuuauccuuuccguacucauaugaaguagcccugagugauaagggccgggacgggaaauacaagaucauuuacagcggagaggaacuugagugcaacuugaaggaucugcgcccugcuacugacuaucaugugcgagucuacgccauguauaauuccgugaaaggcucuuguagcgagccaguuucauucaccacacacaguugcgcgcccgaauguccuuuucccccaaagcuagcacauagauccaaaagcucucucacccugcaguggaaggccccuauagacaacgguucaaaaaucacgaauuaccuucuggagugggaugaagggaagaggaacaguggcuuccggcagugcuuuuucggaagccaaaaacacuguaaguugacuaagcucugccccgcuaugggcuauacauuucgucuggccgcacgcaaugacauugggaccuccggauacucucaggagguggucuguuauacuuuagguaacaucccacagaugccgucggcuccuagacuggugagggccggcauaacauggguaacccuccaguggagcaaacccgaagggugcuccccagaggagguuauuacguacacccuugaaauccaagaggaugaaaacgacaaucuguuccaccccaaguacacaggagaggauuugacuugcaccgugaaaaaccuaaagcggucaacacaguauaaauuucgacugacugcgaguaauaccgaaggcaagucuuguccuagcgagguccucgugugcacaaccuccccagaccgccccgguccuccgacuagaccacuggucaaggggcccgugacgucacauggcuucagcguuaaaugggauccuccaaaggacaacggaggcucugagauccuuaaauaccuguuggaaauuacagaugggaauagcgaggccaaccagugggaaguggcauauaguggaagcgcuaccgaguacacuuucacccaccucaagcccgguacacuguauaaauuaagggccuguugcaucucuaccggcgggcauucccaguguucagagagucugccuguacggacucuaagcauugcuccgggacaaugcagacccccacgcguccucggcaggccuaagcacaaggaagugcaccuggagugggacguucccgccucggaauccgguugugaggugucugaauacagcgucgagaugacagagccagaagauguggcaucagagguauaucaugggccugaacuugagugcacggugggcaauuugcugcccggaaccguuuaccguuuucggguccgagcccucaacgacggcggguacggaccauauagugacguguccgaaauaacuacagcugcgggcccgccuggucaguguaaagcacccugcaucucuuguaccccagaugggugcgugcuggucggaugggagagccccgacuccucaggcgccgauauuagcgaguacagacuugaauggggugaggacgaagagagucuggaauugaucuaucacggcacagauacuagguucgagauccgcgaccuccugccugcugcccaguacugcugucgguuacaggcauuuaaucaagccggggcuggaccauauucugagcugguucuaugccagacccccgccuccgcaccugauccggugagcacgcucugugugcuggaagaggaaccacuugacgcguaccccgauucgccuucagcuugcuugguacugaacugggaggagcccuguaauaacggcucugaaauucucgccuauaccauagaccugggggauacaaguaucacugucggaaauaccacaaugcaugugaugaaggacuuacugccagagacuaccuacagaauuaggauccaggcaauuaacgaaaucggcgccgguccuuucucccaauuuauaaaagcuaagacgcgcccccuuccaccuuugccgccccgacucgagugcgccgcagcugggccacagagccugaaacuaaaguggggagauucuaauagcaagacacacgccgcggaagacaucguuuacacccugcagcucgaggaccggaacaaacguuucauuuccaucuauagaggcccuucacauacuuacaaggugcagaggcugacagaguuuaccuguuauaguuuccgcauucaagccgcuagcgaagccggugagggccccuuuucugaaacuuacaccuucuccacaacgaaaucagucccaccuaccaucaaggcaccccgggugacucagcuugaggggaacaguugcgaaauauugugggagacaguuccgagcaugaaaggagauccagugaauuauauucugcagguauuagucggcagagaguccgaauacaaacagguguauaagggggaggaagcuaccuuucaaaucucuggacuccagacaaacacugacuacagguuccgagugugugccugccgccggugucuggauaccucgcaggagcuuagcggcgcauuuucaccuuccgcggccuucguccugcagagaagugaaguuauguugacgggugacauggggucucucgaugaccccaagaugaaguccaugaugccaacagaugagcaauucgcugccauuaucgugcugggauuugcaacccuauccauacuguucgcuuuuauccuccaguacuuccugaugaaauga

SEQ ID NO: 56348 - RNA, 705 nt, Artificial Sequence
  derived and/or modified sequence opt3 from FNDC4__Homo_sapiens__NP_073734
augcccagcggcugccacuccucuccuccaucagggcugagaggagacauggccagucucgugccgcuuagccccuaccuguccccuaccgucuuguuacugguuucuugugaucuagguuucgugagggcugaccggccacccucgccuguaaacgugacagucacucaucuccgcgcaaauucagccacggugagcugggauguuccagagggcaacaucgugauuggguauaguauaucccaacaacgacagaauggacccggccagcgugucaucagagaagugaacaccacaacuagggcgugcgcucuguggggucuugccgaggacucugauuacaccguacagguucggagcauugggcugcgcggagaauccccuccaggcccgagagugcacuuuaggacauugaagggcucagaccggcuccccaguaauucuagcuccccuggggauaucaccgucgagggacuggacggugaacgcccacugcaaacuggcgagguggugauuaucgucguugugcucuuaaugugggcagccguaauagggcuguucugucgacaguaugauaucauuaaagacaacgauucaaauaacaaucccaaggagaaaggaaagggcccugaacagagcccacaggguagacccguggggacaaggcagaaaaagaguccgucuaucaacaccauugacgucuga

SEQ ID NO: 56349 - RNA, 1140 nt, Artificial Sequence
  derived and/or modified sequence opt3 from FNTA__Homo_sapiens__NP_002018
auggccgcuaccgagggcgugggggaagcagcccagggaggugagcccggccaaccugcgcagccaccgccccagccucacccacccccuccacagcaacagcauaaggaagagauggcugccgaagcaggggaggccgucgcuagccccauggacgauggauucguuucccuggacucuccuucauacgugcucuauagagauagggcagagugggccgacaucgauccaguaccgcagaacgacggccccaauccugugguccagauuauauacagugauaaauuucgggacguguaugauuacuuccgcgcuguucuucaacgagacgaacguagcgagagagccuuuaagcugacaagggaugcgaucgaauugaacgcagccaauuauacuguguggcacuuccggcgcgucuuacugaaaucccuacagaaggaccuccaugaggagaugaacuacauuacggcuaucauugaggaacagccaaagaauuaucagguguggcaccauagaaggguacugguugaauggcuucgggaucccucucaagagcuggaauuuaucgccgacauauugaaccaggacgcaaagaauuaccacgcuuggcagcaccgccaaugggugauccaggaguucaagcucugggauaacgagcugcaguacgucgaccagcugcucaaagaagaugugcgaaauaacucgguguggaaucaaagauauuuugucauuucaaacaccacagguuacaaugacagggccguuuuagagcgggaagugcaguauacucuggagaugaucaaacuuguaccucauaacgaaagcgcguggaauuacuugaaagggauucugcaggaucguggacuaaguaaguauccaaaccuccugaaccagcuucuggacuugcaacccucccacucuagcccguaccucaucgccuuccugguggauauauaugaggacauguuagagaaucagugcgauaacaaagaagacauucugaauaaggcacucgagcuuugugaaauccuggcuaaggagaaagauaccauucgcaaggaauacuggagauacaucggcagguccuugcagucaaaacauaguacagagaacgacagcccuaccaauguccagcaauga

SEQ ID NO: 56350 - RNA, 1314 nt, Artificial Sequence
  derived and/or modified sequence opt3 from FNTB__Homo_sapiens__NP_002019
auggccagccccuccucuuucaccuacuauugcccuccaucaaguagcccggugugguccgagccccuguacucucucagaccugaacacgcuagggagcggcuucaggacgauucggucgaaacaguuacuucaaucgagcaagcaaagguggaagagaaaauucaggagguauuuagcaguuauaaguucaaccaucuggugccacgcuuggucuuacagcgagaaaaacacuuucauuaccugaagcguggccuaagacagcucacggacgccuaugagugucuggaugcguccaggcccuggcuuugcuacuggauacugcacucuuuggaacuccuggacgagccuaucccacaaauuguggcuaccgauguuugucaguuccuggagcucugccagagccccgaagggggauuugguggcgggccuggacaguauccacauuuagccccgacauacgcagccgugaaugcucuguguaucauuggcacugaggaagcauacgacaucauaaaccgggagaaacuuuugcaauaucuguacucccuaaagcagcccgaugguucauuccucaugcacgucgggggagaaguggacguacgcagugccuauugcgcugccagcguugcgucucugaccaauaucauuacaccugaucuuuuugagggcaccgcagaguggaucgccagaugucagaacugggaaggcgggauuggaggugugccaggcauggaggcucacgggggauacacuuucugcggccuggccgcauuggucauccucaagagggaacggucccugaauuuaaaaucacugcuccagugggugacaagccgccaaaugcgauuugaggguggguuccagggaagauguaacaaacuuguggacggcugcuauaguuuuuggcaggcuggccuguugccccuacugcauagggcccuccacgcgcaaggggauccugcccugucuaugucccauuggauguuccaccagcaggcacuucaggaauacauacugauguguugccaaugcccagcuggagguuugcucgacaagcccggcaagagccgggauuuuuaucacaccuguuacugccugucgggguuaucuauugcccagcauuucggauccggcgcuaugcugcacgacgucguucuaggugugccggagaaugcccuccagccuacgcaucccguauacaacaucgggccagacaaagugauucaggcaacuaccuauuuccugcaaaagccuguccccggcuuugaggaacuuaaggaugagacaucagccgaaccagcuacugacuga

SEQ ID NO: 56351 - RNA, 5406 nt, Artificial Sequence
  derived and/or modified sequence opt3 from FOCAD__Homo_sapiens__NP_060264
augagcgacgauaucagaaagagguucgaguuucccaacucccugauucagucucaagccgugggacaccucauagcugcaguccuuaaagaaaauggguucucagagaagauccaucagaguaccaaccagacuccugcccugaauuuguuaugggaaaaaugcuguagcgacaacguugugguacggacugcgugcugugagggucugguggcucucgucgcccaggaucacgcagaauuuuccuacgugcucaaugguauucugaaccuuaucccuucuacgcgcaauacccauggccugauuaaggccaucaugcacuugcuccaaaugcaggcucugaaagaggggcagggaggcgagaagaacauacagucgaucuauacaauucgaaaucauccgcacccccugaucacuguucucgaacaccguccugacugcuggccaguguucuuacaacagcugaccgcauuuuuccagcagugucccgagagacuugaagucucaugcauucaaaucauggccccauuuuugugguaccuguauugugagccaagccagcuacaggaguacgcuaagcucaggcuggcccuucugaaaguguugcuccaaccccagguacugugcgauaaggaccagccuaguauauuagaacagcaaauucugcagcucuguugcgauaucguuccaugucuucaggugaaagaccugauucagacaaccgaggcgaugauguucaucgaagaggucugcuugucccuacugcggcauccgguguuuuggaagauccaacucacucagaugucucugcagcuucugugcgugagcgaagucuccuugaaaauuacaggugaguguucaaguagcauacaccuccuggagcauucuguugaauuacugaaggaggauuuccccguggagcuuguaaucauugggaucgcacuccugcuuuugcagaccccugccucccaacagaagccaauacugaaccucgcucugaaacuucugucagugacggaggaccagaagauucccaaaagcaguuugcuccuggucaugccuaucuuacagauccugucuuccacugcccuagaagauugcauuagcguggacgaggagggaccaucgcgccaacagcucgcacugaaucuuuuggaaaugauccagcaagaguguuauagagaugaccaccagaagcugucuuacaaacucguuugccccgugaccuccauguauggcacaauuuuuacugcuuggaggauacuggaagucaugaccgacucaagugccgcgagcgauugguuagccuccguggagucucugcuuccgaucacagcaguaauuccugcucccgccuucuugcuccuggcucaccuacugguugaagacaagggccagaaccuccaucagauccugaaagugaccacggagcuugcccaagcagauagcucacaggucccaaauuugaucccugugcugauguuuaaguuagggcggccccucgagccaauucuguacaacgacauacuuuacacucugcccaaguugggaguccacaaaguguguaucggucagauucuccgcaucauucagcugcuaggcacaaccccucgacugagagccguuacucucaggcugcuuacaaguuugugggaaaagcaagaucggguguauccagagcugcagcguuucauggcuguauccgacgucccgagcuuaucuguggggaaagaaguucagugggagaagcucaucgcgaaagcagccucaauacgcgauaucugcaagcagagacccuaccaacauggagcugacaugcuggccgcaauuagucaggugcuuaaugaguguaccaagccugaucaggccacgccagcugcccugguccuacaaggccuccacgcacugugccaggcggaagugguauguaucaggagcaccuggaacgcuuugucccccaaacugucuugcgacacacggccuuuaauucucaagacucugucggagcuuuucagccuggugccauccuugaccguuaacacaacugaauaugagaauuuuaaaguccaggugcucucauuccuguggacccauacacagaacaaggaucccaucguggccaaugcagccuaccgaagucuagcuaacuuuucugccggugaacacaccauacugcaccuuccggagaaaauucgcccugagaucccaauucccgaagaacucgacgacgaugaagacgucgaggauguugaccugagcgugccuggguccuguuauuugaagcuguuaucacucacucccccacuggugcuuccugcacuggaagaguucuuuacgagcuugguaaagcaagagauggucaauaugcccagaggaaucuaccauucugcucucaaaggcggcgccagguccgaucaggggaagacaguggcgggaauaccaaacuucauccugaaaauguaugaaaccaauaagcagccgggucuaaaaccuggccuggccgggggaaugcuauuuugcuacgacguuaguauguaccagagcaaggauggcaagccccucaaccggcugauggcuucucgcgguagauccuucaaacaaacuucauuggcauuagugcacgagguccauauucagcugagugaauggcacagggccaucuuucucccacaggcuuggcuggccuauaugaaucgugcauaccacgcgauucuucaggggcggcugggcgaguuggaacuacaacugaagcauggaaaagaggagcccgaagaggugcaguauaagaaaagcaccgccuggcucuggguucgagacaugcugacagaugaaaucaccaaggcugccgcaaaagagucgccugugguaaagggcaacgcucuuuuagcccuguccucucucgcagucguggugagcagacacgaggccucauugaguuccgacucugaugggcugcucgaaguccagccaaauuuccugagcaugaaggaguggguuuccauggugcuugacacucuguugguaauaguggauucacauuaccagcccaggggacaacuacugagcugguuuuauuacaaaaguuauucuggugaaaacacagcuuccgcgauugcccgcagcgcagcugccacggcccucucguuacuggucccuguguucaucaucucaugcaaggagaaaguugaagagauucuuaauaugcugaccgcucggcucccgggcaagccaucugcagacgagagucaggccgugcagauccacaugggguuggcgcugggaauguuucucuccagacugugugaagagaaacuuagcgacauuucuggccaagaaaugaaccuacuguugaugaaauccuuagaugcucuggagaauugcuguuucgacacuagccucgaauacaacacagguugcauacugggggucggccuugugcugucacucaugagucauagcucucagaugcaguccaggguucacguggccgcauugcugcgcaagcuaucagcccacgucgaugacaguggaagccagucccgaaccuuccaagagguacuggcuuacacacucucuugugugugcacuucggcauuuagcgccggcaucauugaggcgaccgaagcugaggauguuaugaacaaacuucggcuguuaguggaaaauucacagcagacguccggguucgccuuggcacugggaaacaucguccauggucucaguguguguggccacgggaaggccgaggaccugggaucuaaacuucugcccgcuuggauucguaucguacucaccgaaggcacaccuacuauguugugccuggccgcauuacaugguaugguggcucuagucgggagcgagggcgauguuaugcagcugaaguccgaggccauacaaaccucacacuuucagggaagacucaaugaagugaucaggacacuuacucaggugauuucugucagcggcgugaucgggcugcagaguaacgcgguuugguugcugggacaucuccaccuguccacccuuaguucuucacaaucccgcgccaguguaccaacggacuauagcuaccuccccgagucgucuuucauuggcgcagcuaucggauuuuucauaacagggggcaagaagggcccugaauccgugccgcccagccuguugaaggucgugaugaaaccaauugccaccguuggugagucauaucaguacccucccgugaauugggcugcacuguuaaguccacuaaugcggcugaacuuuggcgaggaaauccagcaacucugucuugagaucauggucacucaggcccagucuucccagaaugccgcugcgcuguuggggcugugggugacaccuccccucauucacagccugucacuuaacaccaagagauauuuacugauaagugcaccacucuggaucaaacauauuagcgaugaacaaaucuugggauucguagagaaucugauggucgccguguuuaaggcugccuccccgcuaggcucuccugaacugugccccagcgcacuccacgggcuuucccaggccaugaaacugccaucacccgcucaucacuuguggucucugcucagugaggcgacuggaaagauuuucgaccuguuaccuaacaagaucaggcgaaaagaucuugagcuguacauaucgaucgccaagugucuccuagaaaugaccgacgaugacgcaaaucgcauugcucagguuacaaaaagcaacaucgagaaggccgcauuugugaaacuguauuuggucucccagggccgguucccacuggugaaucucacggacaugcuuucuguugccgugcaacacagagaaaaggagguccuggcuuggaugauuuugcauucacuguaccaggccaggaucgugagccacgcgaacaccgguguacucaaacguauggaaugguuacuggagcuuaugggguacauacgcaauguggcauaucaguccaccagcuuucauaacacagcccuggauaaggcucuagacuucuuccuccugauuuuugccacagcuguugucgcaugggccgaucacacagcucccuugcugcucggacuuucugccagcuggcugccuuggcaucaggagaacggcccggcagguccagugcccucauucuuaggccgguccccuaugcacagagugacucugcaagaagucuugacccuccugcccaauaguauggcgcuacuucugcagaaggagccauggaaagaacagacgcagaaguuuaucgacuggcuauucagcaucauggagucuccuaaagaagcccuguccgcucaaucaagggauuugcugaaggccacacuccuuagccugcgaguauuacccgaguuuaaaaagaaggcaguguggacccgggcuuacgggugguga

SEQ ID NO: 56352 - RNA, 2160 nt, Artificial Sequence
  derived and/or modified sequence opt3 from FOLH1__Homo_sapiens__NP_001014986
auguggaaccugcuccacgagaccgacagcgccguggcuacagcaagaaggccccgguggcuuugcgccggcgcgcuggucuuggcugggggauucuuuuuacuggguuuccuauuuggcugguucaucaaguccucuaaugaagccacuaacauuacgccuaaacauaauaugaaggcauuucucgaugagcugaaagccgaaaacauaaagaaauuccuuuacaauuuuacccagaucccacaccuggcugggacagagcaaaacuuccaguuggcaaagcagauucagucacaauggaaggaauuuggacucgacaguguugagcuggcccauuaugaugugcugcucagcuacccgaauaaaacucaccccaacuauaucuccauuaucaaugaggacggcaacgaaauauucaauaccucuuuauuugagccuccacccccugguuacgaaaacguaucggauaucgugccacccuucucagcuuuuagcccucaggggaugccagagggagaccuggucuaugugaauuacgcccgcacagaggauuucuucaagcuagaacgagacaugaaaauuaacuguaguggcaagaucguuauugcgcguuauggcaaaguguuuagagggaauaaggucaagaacgcacaguuggccggagcuaaaggugugauccuguacuccgauccggccgacuacuucgcacccggcguaaagucuuauccugauggguggaaccuaccaggaggcgguguucagagggggaauauacucaaccugaauggagcuggcgacccccuuaccccuggcuacccagccaacgaguaugcguaccggcgcgggauugccgaagcagugggacugcccagcaucccgguccauccuauugguuauuacgaugcucaaaaauugcucgagaagaugggcggguccgcucccccagacucaaguuggagaggaagccugaaagugccuuauaaugugggccccgguuuuacugggaacuucucuacacagaaggucaaaaugcacauccacuccaccaaugaaguuacgaggaucuacaacgugauuggcacuuuacggggagccguagagccagaccgcuacgugauacugggcgggcaucgagauucaugggucuuuggagguaucgacccccagagcggcgccgcagugguucacgagauugugagaaguuucgggacccucaagaaggaaggauggaggccucggcguacaauccuuuuugccucuugggaugcugaggaguucggccuguuggguuccacugaaugggcggaagagaauagccgccuacugcaggagagaggggucgcauauauaaacgccgacucgucuauugaaggcaauuacacccucaggguggauugcacaccacugauguauucccuuguacauaaccugaccaaagaguugaagucaccggacgaaggauuugagggcaaaagucucuacgaaagcuggacgaagaaaucccccucuccugaguucagcgggaugccacggaucucaaagcugggaagugguaaugauuuugagguuuucuuucaacgauuaggcaucgcuuccgggcgcgccagauauacuaagaacugggaaacaaauaaauucagcggauacccccuguaucacucuguguacgagaccuacgaacuugucgagaaguucuaugacccuauguuuaaauaccaccucacuguggcacaggucaggggcgguaugguguucgagcuggccaacucaauuguucuuccauuugauugucgggacuaugcugugguauugcgcaaguacgccgauaaaaucuauaguauuagcaugaagcauccccaggaaaugaagacauacuccgucucuuucgacucgcuguuuagcgcagugaaaaacuucaccgagauagcguccaaguuuucagaaagacuccaagacuucgauaaaaguaagcacguuaucuaugcuccgucuagccauaauaaauacgccggggaguccuuuccuggcauuuacgacgcacuguucgauaucgaaucaaagguggacccaagcaaggccuggggagaggucaaaaggcagaucuauguggcugccuuuacgguacaggcagcugccgagacccuuucugaaguggcguga

SEQ ID NO: 56353 - RNA, 774 nt, Artificial Sequence
  derived and/or modified sequence opt3 from FOLR1__Homo_sapiens__NP_000793
auggcccagagaaugaccacacaacugcuccuucuguuggugugggucgcuguugugggcgaggcacagacuaggaucgccugggcgcggacggaauuacugaacguaugcaugaaugcuaagcaccauaaagagaagcccgggccugaagacaaacuacacgagcagugucgcccauggcgaaagaacgccugcuguagcaccaauacaucccaggaagcacauaaagaugugucuuaccucuaucguuucaacuggaaucacugcggagagauggccccggcuuguaagagacauuuuauucaagacacuugccuguacgaguguucacccaaccuugguccuuggauacagcaggucgaucagaguuggaggaaggaacgggugcugaauguuccauugugcaaagaggacugugaacaauggugggaggauugccgcaccagcuauacauguaaguccaacuggcacaaaggcuggaauuggaccucuggguucaacaagugcgcagugggagccgcuugccagcccuuucacuucuacuuuccuacuccaacaguccucuguaaugagaucuggacccauucguauaaagugucaaacuacagcagaggcagugguaggugcauucagaugugguucgaccccgcccaggggaauccuaacgaagagguagcgcgguuuuaugcagccgcuauguccggagccggcccaugggcagcuuggccguuccugcugucucucgccuuaaugcugcuuugguugcugagcuga

SEQ ID NO: 56354 - RNA, 768 nt, Artificial Sequence
  derived and/or modified sequence opt3 from FOLR2__Homo_sapiens__NP_001107008
augguguggaaguggaugccccugcuccuucuguuggucugcguugccaccauguguagcgcucaggacagaacagauuuacugaacgugugcauggacgcaaaacaccauaagacuaaaccuggcccagaggauaagcuacacgaccaauguuccccguggaaaaagaaugccugcuguacggcgucuaccucacaggaacuccauaaggauacaaguaggcuguacaacuucaauugggaccacugcgggaaaauggagcccgcuuguaagcggcauuuuauccaggauacuugccuuuaugaauguagcccuaaccugggaccauggauucagcaaguaaaucaguccuggcgcaaagagcgauucuuggacgugccccucugcaaggaagauugucagcguuggugggaggacugccacaccucucacacaugcaaaucgaacuggcauagagguugggauuggaccucaggcgucaauaaguguccugccggggcacugugcaggacuuuugagagcuacuucccaacacccgccgcucugugugaaggacucuggagucacuccuauaaggugucuaacuacagccggggcuccggucgcugcauacagaugugguuugacucagcacaagggaauccuaacgaggaaguugccagauucuaugcugccgcgaugcaugugaaugcaggagagauguuacacggcaccggcgggcugcuuuugagucuggcccuaaugcuccagcuguggcuucugggauga

SEQ ID NO: 56355 - RNA, 738 nt, Artificial Sequence
  derived and/or modified sequence opt3 from FOLR3__Homo_sapiens__NP_000795
auggacauggccuggcagaugaugcaacugcuccuucuggcuuuggugaccgcagccggcagcgcgcagcccagauccgcuagggcccggacagauuuacugaacgucugcaugaaugcaaagcaccauaaaacucagccuucuccagaggacgaacuauacgggcaguguucaccguggaagaaaaacgccugcuguacggcuaguaccagccaagagcuccacaaggauacaucccgccuguauaauuucaacugggaccauugcggaaaaauggaacccacuuguaagcgacacuuuauccaggauucuugccuuuacgaguguucgccuaaucuggguccauggauucgucagguuaaccagucauggagaaaggaaaggauauugaaugugccccucugcaaagaggacugugagcgguggugggaagauugccgcaccagcuauacauguaagaguaacuggcauaaaggcuggaauuggaccuccgggaucaacgagugcccugcaggagcccugugcucuacuuucgaaagcuacuuuccaacacccgcugcccugugugagggccucuggucccacucauucaagguaaguaauuauagcagagguucugggaggugcauucaaaugugguuugacuccgcgcagggaaacccuaaugaggaaguggcaaaauucuacgccgcugccaugaacgcaggcgcuccaucacggggcaucauugauagcuga

SEQ ID NO: 56356 - RNA, 525 nt, Artificial Sequence
  derived and/or modified sequence opt3 from FOPNL__Homo_sapiens__NP_653201
auggccaccguggcugagcugaaggcaguccucaaagacacacuugaaaagaaaggcguucuggggcacuugaaggccagaaucagggcggagguguucaacgcuuuagaugacgaucgggaaccccgcccuagccugucccaugagaaucuacucauuaacgaacugauacgagaguaccuugaguuuaauaaauauaaguacacugccucuguacugaucgcagaaucaggacagccaguggucccguuggaccgucaauuccucauucacgagcugaacgccuuugaagagaguaaggauaauacgaucccccugcucuaugguauuuuagcucauuuccugagaggcaccaaagacgggauccagaacgcauuucuuaagggaccuagcuugcagccauccgaucccucucugggcaggcagccuucgcggcgcaaaccaauggacgaucaccuaagaaaggaggaacaaaaaucaacaaauauagaggaccuccaugugagccaggccguuaacagguga

SEQ ID NO: 56357 - RNA, 909 nt, Artificial Sequence
  derived and/or modified sequence opt3 from FOSB__Homo_sapiens__NP_001107643
auguuccaggccuuucccggcgacuacgauagcggguccagauguucuucaaguccuagcgcugagucccaauaucugucuucgguggacucauucggaagcccaccgaccgcagccgcgagucaggaaugcgcuggucucggcgagaugcccggguccuuugucccuacaguuacugccaucacgaccucucaggaucuucaguggcuggugcaaccaacauugauuagcuccauggcacagucacagggacagcccuuagccagucaaccuccaguaguggaccccuacgauaugccuggcacuagcuauucuaccccagguauguccggguacucaagcggaggcgcuaguggcucugggggaccguccacaagcgguaccacuucgggccccgggccugcaaggccagcccgggcucgcccccgacguccuagagaagagacagaaaccgaccagcuggaggaggaaaaggccgagcuagaaucugagauagcggagcuccagaaagaaaaggagaggcuggaguucguccuuguggcacacaaaccaggaugcaagauccccuaugaagaaggcccggguccugggccccuggccgagguucgggauuugccaggauccgcuccugccaaagaggacggcuuuucauggcuccugcccccacccccuccaccgccccugccuuuccagacgagucaagaugcaccacccaaccucacugcuagcuuauuuacccauuccgaagugcagguccugggcgacccuuucccagugguaaaucccucuuacacaagcucauuuguucuuacuuguccggaggugagugccuucgcgggggcccagcgcaccuccggaagcgaucaaccuucugacccauugaacucacccagucugcuagcacucuga

SEQ ID NO: 56358 - RNA, 1143 nt, Artificial Sequence
  derived and/or modified sequence opt3 from FOS__Homo_sapiens__NP_005243
augauguucagcggcuuuaacgccgacuacgaggcuuccucuucaagaugcaguagcgcaucccccgccggggauucucugucguauuaccacagcccugcggacagcuucaguuccaugggaucuccagugaaugcucaggauuuuuguaccgaccucgccgucagcuccgcaaacuucaucccgacaguuacugccauuucaacgagucccgaucuucaauggcuggugcagccugcuuugguaagcucuguggcaccaucccagaccagggcuccccauccuuuuggugucccagcccccucagccggcgcguauagccgggcaggggugguuaagacaaugacuggaggccgcgcccagaguauaggucgacgugggaaaguggaacaauuaucuccugaggaagaggaaaagagaaggauccggcgcgagagaaauaaaauggcugccgcaaagugcaggaaccggcgccgagagcugaccgacacacuacaggcugaaaccgaucagcucgaggacgaaaaauccgcccugcagacugagauugcgaaucuucugaaggagaaggaaaaauuggaguucauccucgccgcacacagaccagcuuguaagauuccggaugaccugggauuucccgaagagaugagcgucgccucgcuggaucucacaggcggcuuaccugaaguggcuaccccagagucugaggaagccuucacgcugccccuuuugaacgacccugagccaaaacccuccguagaaccgguuaagucaaucaguagcauggagcugaaaacugaaccuuuugaugacuuccuauuucccgcauccucuaggccaagcgggucagagaccgcccggagugugccugacauggaucucuccggaucauucuacgcugcggacugggagccccugcauucugguucacuuggcauggggccaauggcaacagaacuggagcccuugugcacuccugucgugaccuguacaccaaguugcaccgccuauacgagcuccuuuguguucacuuacccggaagcugauucuuuccccucgugugccgcagcccaccguaagggaagcuccucaaaugagccuaguucugacagccucuccucaccaacacuguuagcucuguga

SEQ ID NO: 56359 - RNA, 408 nt, Artificial Sequence
  derived and/or modified sequence opt3 from FOSL1__Homo_sapiens__NP_001287784
auguucagagacuuuggcgagcccgggccuagcuccggaaacgguggcggguacggaggcccagcccagccgcccgcugcagcccaagcggcucagcagaaguuccaccuggugccuucuaucaauaccaugucagguagucaggaacuccaauggaugguccagccacauuuucuugggcccagcuccuauccuaggccacugacauacccccaguauucuccuccacagccgcggcccggaguuauucgcgccuugggcccuccacccggcgugcgacguagaccuugcgagcaaccagggggaaggggugcacccccgucgaaagcccgggcugaacaggcaggcugugggcagguacaggagccugaagagggaacugaucgcuuacccgccggcggugacuga

SEQ ID NO: 56360 - RNA, 981 nt, Artificial Sequence
  derived and/or modified sequence opt3 from FOSL2__Homo_sapiens__NP_005244
auguaccaggacuaucccggcaacuucgauaccagcuccagagggucuucaggaaguccugcccacgcugagagcuacuccucugguggcgggggacaacagaaguuuaggguggacaugccaggcucggguucagcauucaucccgacaauuaaugccauaacuacgagccaggaucugcaguggaugguccaacccaccguuaucacaaguauguccaacccuuauccacggucucaucccuacagcccucucccagggcuugcguccgugcccggacacauggcucugccucgcccaggcguaauuaaaacuaucggcaccacaguggggcgacguagaagggacgaacaguugucaccggaggaagaggaaaagcggcgcauuagaagggagcggaauaaauuagccgcagccaagugccgcaaccgaagaagggagcugaccgaaaaacuacaggcugagacugaagaacucgaggaagagaagaguggacugcagaaggaaaucgcagagcuucaaaaagaaaaggagaaacuggaguuuauguuggucgcccauggucccguguguaagauaagcccugaggagcggcguucuccacccgcuccuggccuccagccaaugcgcuccgggggaggcucaguuggugccguggucgugaaacaggaaccccuggaggaagauagcccgaguucuuccagcgcggggcuggacaaggcacagagaucgguaaucaagccuauuucuaucgccggaggcuucuauggcgaggagccccuccacacaccaauuguugugaccuccacgccugcugucacucccgggaccucaaauuuaguguuuacauacccaagugugcuggaacaagagagccccgccuccccuucugaaagcugcucaaaagcacauaggcggaguuccagcucuggagaucagucaagugacagccuuaacuccccaacuuugcuggcucuauga

SEQ ID NO: 56361 - RNA, 1419 nt, Artificial Sequence
  derived and/or modified sequence opt3 from FOXA1__Homo_sapiens__NP_004487
augcugggcaccgugaagauggaggggcacgaaacaagcgacuggaacuccuacuaugccgauacucaggaggcuuacucuucaguccccguuaguaauaugaacagcggacucgguuccaugaacucuaugaauacguauaugaccaugaauacaaugacuaccucgggcaacaugaccccugcaucauucaauaugagcuacgccaacccagggcuuggagcgggccugaguccgggugcuguggccgggaugcccggaggcuccgcaggcgccaugaacucuaugacagcugcagggguaacugccaugggaacagcuuugagcccuuccgguaugggcgccaugggggcgcaacaggcagccucaaugaauggauuaggcccauaugcugccgcaaugaaucccugcaugaguccuauggcuuacgccccaagcaaccuggguagaucuagggccgggggaggcggcgacgccaaaaccuuuaagcgguccuauccccaugcaaaaccuccauacucauacaucagccuaauuacgauggcuauacagcaggccccgaguaagaugcucacucugucugaaaucuaucaauggauuauggaucuuuuccccuacuaucgccagaaucagcagcgauggcaaaacuccauccgucacagccugucguuuaaugacuguuucgugaaagucgcuagaucuccugauaagccagggaagggauccuacuggaccuugcaucccgacucagguaacauguuugagaacggcugcuaucucaggcggcagaaacgcuucaagugugaaaaacagccuggggccggaggcggugggggcaguggaagcggcggguccggagcaaaggguggcccagagucuagaaaagaucccagcggggccucaaauccgagugcugacuccccucugcacaggggagugcauggcaagacaggucagcuggagggggcgcccgcaccaggcccugccgcuagcccccaaacucucgaucacucuggagccaccgcaacaggcggggccucagaauuaaagaccccagcuaguagcacggcgcccccuauuuccucuggaccaggugcacuggcgucgguuccggcuagccaccccgcccauggccuugcaccucacgagucccaguugcaucugaaaggggacccacacuacucauuuaaccaccccuucaguaucaauaaccuaaugucuagcuccgaacagcaacauaagcucgauuuuaaagccuaugagcaggcucugcaguacucaccuuacggaagcacucuuccagccucucugcccuugggcuccgcaagugugacaacccggagcccgauagagccuucugcucucgaaccagccuauuaccagggugucuauucccgccccgugcugaauacuucauga

SEQ ID NO: 56362 - RNA, 1392 nt, Artificial Sequence
  derived and/or modified sequence opt3 from FOXA2__Homo_sapiens__NP_068556
augcacagcgccuccucuaugcugggcgcugugaagauggaggggcaugaacccucagacuggaguagcuacuaugcagagccugaaggauacuccucugucucgaauaugaaugccggucucggcaugaacgggaugaauaccuauaugucaaugagcgcggcugccaugggaaguggcuccgguaacaugucugcagggagcaugaauauguccucauacguuggagccggcaugaguccaagccuugcuggcaugucuccgggggcaggagccauggcugguaugggcggguccgccggagcggcaggcguggccgguauggggccccaccugucaccuagcuugaguccauuaggaggccaggcugccggcgcaaugggagggcuggcucccuaugccaacaugaacucuauguccccuauguacggucaagcgggccuaagcagagccagggauccaaaaacauaucggcgcucguacacucaugcaaagcccccuuacucuuauaucucccucauuacgauggcuauacagcagucaccaaauaaaaugcugacccuuagugagaucuaccaguggauuauggaccuguucccguuuuaucgacaaaaucagcagcguuggcagaacagcaucagacacuccuugucuuucaaugauugcuuucucaagguacccaggagcccugacaaaccagggaagggaucauucuggacacugcaucccgauaguggcaacauguuugaaaaugguuguuaccugcggcgccaaaagagauucaaaugcgagaagcagcucgccuuaaaagaggcugccggggcagccggcuccggaaagaaagcugcggcaggcgcccaggcuagccaggcccaacugggggaagcagccggaccugcuucugagacuccagccgguaccgaaucaccccacaguagcgcauccccgugucaggagcacaagaggggcgggcuuggagaguugaagggcaccccugcggcugcccugucucccccagaaccugcacccucgccaggucagcaacagcaggccgcugcccaucuacucgggcccccucaccauccaggccugccgcccgaggcacaccuuaaaccugaacaccauuaugcuuuuaaccacccauucagcauuaauaaccugauguccucagagcagcaacaucaccauagucaccaccaucaccagccccauaagauggacuugaaagccuacgaacaggugaugcacuauccuggauacggcucuccaaugcccgggagccucgcgaugggaccggucacaaacaagacuggucuggaugccuccccuuuagcugcagacacaucauacuaucagggcguguacagccggccaaucaugaacucuuccuga

SEQ ID NO: 56363 - RNA, 1053 nt, Artificial Sequence
  derived and/or modified sequence opt3 from FOXA3__Homo_sapiens__NP_004488
augcugggcagcgugaagauggaggcccacgaccucgcugaaugguccuacuaucccgaggcaggggaagucuacucuccuguuaccccagugccgacaauggcgccccuuaacucauauaugacucugaauccuuugaguagcccauaucccccuggagguuuaccagccucuccccugccuuccggcccacuagcuccgcccgccccugcagccccacucgggcccacguucccuggacugggcguaucgggugggucaagcaguuccggauacggcgcuccaggccccgggcuugugcauggaaaagagaugccgaaggguuacagaaggccucuggcacacgccaaacccccauauucuuacaucagcuugauuaccauggcuauacagcaagccccuggcaagaugcucacacuguccgaaaucuaccaguggauuauggaucuguuucccuauuaccgggagaaccagcagcgcuggcaaaauucaauccgacauagucucagcuucaacgacugcuuugucaaaguggcgcguucuccagauaagcccgggaagggauccuauugggcauuacacccuucaagcggcaauauguucgagaacgguuguuaccugagaaggcagaaacgguuuaaacuugaagagaagguuaagaaagggggaaguggcgccgcuacuaccacacgcaauggcaccgggucugccgcauccacuacaaccccagcugccacggugacuagcccgccccagccuccacccccugcgccagaacccgaggcccagggaggugaggacgucggcgcauuggauugcgggucgccggcuucuuccaccccuuauuucacaggacuggaacuaccaggcgagcucaagcuggacgcccccuacaacuuuaaucauccuuucucaauuaacaaucuuaugagugaacaaacucccgcuccaccuaagcuggauguggguuuugggggcuauggagccgagggcggggaacccggaguauacuaccaggguuuguauagcagaucccuccugaacgcaucuuga

SEQ ID NO: 56364 - RNA, 978 nt, Artificial Sequence
  derived and/or modified sequence opt3 from FOXB1__Homo_sapiens__NP_036314
augcccagaccuggcaggaacaccuacagcgaccagaagccaccguauuccuacaucucucugacagccauggcuauucaaucaagucccgagaaaaugcucccucuuagcgaaauauauaaguucaucauggaucgguuuccauacuaucgcgagaauacucagcgauggcagaacucccugcgucacaauuugucuuucaacgacugcuuuauuaaaauccccagaaggccugaucagccagggaagggaucguucugggcauuacaucccucauguggugacauguuugaaaauggcagcuuccugcggcgcagaaaaagguuuaaggugcuaaagagugaucaccucgccccuuccaaaccagcggacgcugcccaauaccugcagcagcaggcaaaacuucggcugucugccuuggcugcaagcgggacgcaucucccgcaaaugcccgccgcugccuauaaccugggaggcgucgcgcagccuuccgguuucaagcacccauuugcaauugagaauaucauagcccgcgaauacaagaugcccgggggacuggcuuucucagccaugcagccuguuccagcagcuuacccccucccgaaccaguuaaccacaaugggcaguagccugggcacuggguggccucauguguauggaucugccgguaugaucgauuccgcgacccccauuucaauggccagcggcgacuacagugcauaugggguaccacuuaaaccuuugugccacgcugccggacaaacacugcccgcuaucccagugcccauuaagccuaccccagccgcagucccggcccuacccgcucucccugcgccaauccccacucugcuuucuaauuccccuccaagccugucgcccacaucuucccagaccgcaacgucacagaguagcccggccacuccuuccgagaccuugacaucuccagcuagcgcccuccacucaguggcaguucauuga

SEQ ID NO: 56365 - RNA, 1662 nt, Artificial Sequence
  derived and/or modified sequence opt3 from FOXC1__Homo_sapiens__NP_001444
augcaggccagauacagcguguccucucccaacucacugggcgucguuccuuaucucgggggagagcaaaguuacuauagggcugcagccgcggcugccgguggcggguacaccgcaaugccagccccgaugagcguguauucccaccccgcucaugcagaacaguacccuggaggcauggcccgggcuuaugguccauacacaccccagccucagccaaaggacaugguaaaacccccuuacucuuauaucgcccuuauuacuauggcgauacaaaaugcaccagauaagaaaaucacgcugaacgggauuuaccaguucaucauggaccgcuuuccguucuaucgagauaauaagcagggauggcagaacucgauucgucacaauuugucauuaaacgagugcuuugugaaaguccccagagacgauaagaagccuggcaaaggcagcuacuggacccuggacccagauaguuauaauauguucgaaaacggguccuuucuaaggcggcgcagaagguucaagaaaaaggacgccgugaaagauaaggaggaaaaggaccggcuccaucugaaagagcccccuccacccggacgccaaccgccucccgcuccaccugagcaggccgaugguaaugcacccggcccacagcccccuccaguucgaauccaggacauaaagacagaaaacgggacuuguccgucucccccucaaccacuuagccccgcugccgcgcugggauccggcucagccgcagcugugccuaaaaucgagaguccagauagcagcuccagcagcuugaguucugguuccucucccccggggucgcucccuucugccagaccacugucccuggacggagcugacucagcacccccucccccagccccuagugcucccccaccgcaccauagccagggcuuuuccgucgauaauauuaugaccucucucaggggcagcccucagucagccgcggcagaauuaaguuccgggcugcuugccagcgcugccgcaucuucacgggccggaaucgcucccccauuggcccugggugcauacagucccggccaaagcucccuauauucuucgccuugcagccagacauccucagcggggaguucuggaggcggugggggcggagcuggcgccgcagggggagccgguggcgcugggaccuaccacuguaaccuccaggccaugagccuguacgcagcuggagagcguggcggucaccuucagggggccccaggcggagcgggcggguccgccguggacgauccccugccugacuauucauugccgccaguaacuucaucuuccaguagcucucucucccauggagguggcgggggaggcggugggggcggacaagaggcuggccaccaucccgcagcccaccaggggcgccugacaucaugguacuuaaaucaggcuggaggcgaucugggucaccucgccagugcagcggccgcugccgcagcugccggguauccuggacagcaacagaacuuccauagcguuagagaaauguuugagucgcagaggauuggccuuaauaacuccccagugaacgguaauucuagcugccagauggcauuccccucaagucaaucccuguaccggaccucuggcgccuuugucuaugacuguagcaaguucuga

SEQ ID NO: 56366 - RNA, 1506 nt, Artificial Sequence
  derived and/or modified sequence opt3 from FOXC2__Homo_sapiens__NP_005242
augcaggccagauacagcguguccgaccccaacgcucugggcgucguuccuuaucucucugagcaaaauuacuauagggcagccgggucauacggagguauggcgaguccaaugggcguguauagcgggcacccggaacaguacuccgcuggaaugggccggucuuaugcccccuaccaucaccaucagccugcagccccaaaggaucuuguaaaacccccuuacucguauaucgcucugauuaccauggcaauacagaacgccccagagaagaaaaucacauugaaugguauuuaccaauucaucauggaccgcuuucccuucuaucgagaaaacaagcagggguggcaaaauucaauucgucacaacuuaagccugaaugagugcuuugugaaagucccuagagaugacaagaagccaggaaaaggcaguuacuggacucuagauccggacuccuauaacauguucgaaaauggcucuuuucucaggcggcgcagaagguucaagaaaaaggaugugagcaaagagaaggaggaacgggcucaucugaaggagcccccuccagccgcguccaaaggggcacccgccacgccucaccuugcugacgccccaaaggaagcagagaaaaagguugugaucaaaucagaggcugccagucccgcgcugccggucauaaccaagguggaaacauugagcccugagucugcccuccagggaucccccagaucagcagcuagcacuccagccgguaguccugauggcucucugcccgaacaccaugcugccgcaccaaacgggcugcccggauuuuccguagagaauaucaugacccuccgaacaagcccuccaggcggugaauuaucgccgggggccggacgcgcuggccugguugugcccccucuugcguugccauacgcagccgcucccccugccgcauauggccagccaugugcccaggggcuggaggcuggagccgcggguggcuaccagugcucuaugagggcaaugucccuauacaccggggcugagcggcccgcccacaugugugucccgccugcacucgacgaagcccugucagaucauccaaguggacccacuagcccucuuuccgcucugaacuuggccgcaggccaggagggugcucucgccgcgacagggcaccaccaucaacaccauggccaccaucacccccaggccccaccucccccaccggcuccucagccccaaccaacgccccagccuggagcagccgcugcccaggcagcgucuugguaucugaaucacagcggcgacuuaaaccaucugccagggcacaccuucgccgcucagcaacagacuuuucccaaugugcgugaaauguucaacucacaucgccucggaauugagaacaguacccuuggugaaucccaggugagcggcaaugccucuugccagcugccuuacagaucaacaccgccauuguauaggcacgcagcucccuacaguuaugauuguacuaaauacuga

SEQ ID NO: 56367 - RNA, 1398 nt, Artificial Sequence
  derived and/or modified sequence opt3 from FOXD1__Homo_sapiens__NP_004463
augacccugagcacagagauguccgacgccucuggccucgcugaagagacugauaucgacguggucggggaaggagaggaugaagaggacgaggaagaggaagaugacgaugaggguggcgggggaggccccagacuugcaguuccugcccagaggcggcgccgacguagaucauacgcgggugaggacgaacuggaggauuuggaagaggaagaggacgaugacgauauuuuacuggcuccaccggccgggggaagucccgcaccuccaggccccgccccugcugcaggcgccggggcuggagguggcgggggaggcgguggggccggaggcggcgggagcgcgggauccggugcaaagaacccccuagugaaaccaccuuauucuuacauagcccucaucacgauggcuauucugcaaucgccaaagaaaaggcuuacccugucagagaucugcgaguucauuagcggccgguuuccguauuaccgcgaaaaguuccccgccuggcagaauaguaucagacacaacuugucccucaaugacuguuuuguaaaaauaccuagggaaccagggaaccccggaaagggcaauuauuggacacuggacccugagucugcagauauguucgacaacgguagcuuucugcggcgccgaaagagauucaaaaggcagccacucuuacccccgaaugcugccgcggccgaaucccugcuuuugcguggggcaggcgcugccggaggcgcuggggauccugccgcagccgcugcgcuguuucccccagcaccucccccacccccucaugccuacggauaugguccauacggcugcggguacggacuacagcucccgcccuaugcuccuccaucagcccuguucgcagccgcugccgcagcggcugccgcagccgcuuuucacccccauaguccuccacccccgccuccaccccacggcgccgcagcugagcuugcccggacugcguucgguuaccgcccucauccccugggggccgcuuugccaggcccucuccccgcaagcgccgcuaaggccggaggcccaggggcaucugcgcuggccagauccccguuuucaaucgagagcauuaucggagguaguuuaggcccugcugccgcagcugccgcagccgcucaagcggccgcagcugcccaggccucucccuccccaagccccguggcugcaccuccagcccccgggucgucuggaggcgguugugcggcucaggccgcagucgggccugccgcugcacugaccaggucccucguggccgcggcugccgcagccgcuucaaguguuagcuccucugccgcacuuggcacacugcaccagggaaccgcuuugagcucaguggaaaacuucacugcccggauuaguaauugcuga

SEQ ID NO: 56368 - RNA, 1122 nt, Artificial Sequence
  derived and/or modified sequence opt3 from FOXE1__Homo_sapiens__NP_004464
augaccgccgagagcgggcccccuccaccgcagcccgaagugcuggcuacagucaaggaggaaagaggcgagacugcagccggagcggguguuccuggcgaagcuacggggaggggagccggcggucggcgccgaaaacguccacuccaaagagggaagcccccuuacuccuauaucgcacuuauugccauggcuauagcacacgccccagagaggcggcugaccuugggaggcaucuacaaauucauuacagagcgcuuucccuucuauagagacaacccuaagaaauggcaaaauucuaucaggcauaacuuaacucugaaugauugcuuucuaaagauuccacgggaagcuggccgcccggggaagggaaacuacugggcccucgaccccaaugcggaggauauguucgaaucagguaguuuucugcgaagaaggaaacgguucaagcguagcgaccuuuccaccuauccugcauacaugcacgaugccgcugccgcagcugccgcggccgcagcugccgcugccgcagccgcuaucuuuccaggcgcggugcccgcagcccgcccuccauaucccggggcuguauacgccggauacgcaccgccuucucuggccgcucccccaccuguguauuaccccgccgcaucgccaggccccuguagagucuucgguuuggugccugagaggccacucucaccggagcuggggcccgcgccuagcggaccaggcggcaguugcgcuuuugccuccgcaggggcccccgcuacaaccacuggauaucagccugccgguuguacaggcgcacggccagcuaaccccucugccuacgcggccgcuuaugcagggccggacggagccuacccucagggcgcugguagcgccauauucgcagcggccgggcgacuggcuggcccagccucacccccugcaggaggcuccagugggggaguugaaaccacgguggauuuuuauggucgcacuagccccggccaguucggggcucucggagccugcuacaauccaggcggucaguuagggggcgcaucugccggagcuuaccaugcgagacacgccgcagcuuauccuggcgggaucgacagguuugucuccgccauguga

SEQ ID NO: 56369 - RNA, 1140 nt, Artificial Sequence
  derived and/or modified sequence opt3 from FOXF1__Homo_sapiens__NP_001442
augagcuccgcccccgagaagcagcaaccuccacacggcgggggagguggcgggggaggcggugggggagcugcaauggacccggccucuucaggccccaguaaagcgaagaaaaccaacgcuggcaucagaaggccugaaaagccacccuacagcuauauugcccugauagugauggcaauccaguccucuccuacaaaacggcucacucuuucggagauuuaccaguuccugcagucacgcuuuccauucuuucgagggagcuaucaaggauggaagaauaguguccgucauaacuuguccuuaaaugaaugcuucaucaagcugcccaaaggucuaggcagaccugggaagggacacuacuggacgauugauccagccucugaguuuauguucgaagagggcagcuuuaggcggcgcccgagagguuucaggcggaaaugucaggcucucaagcccauguauuccaugaugaacgggcugggauuuaaucaucuuccugacaccuacggcuuccagggcucagcagggggacugaguugcccacccaacagcuuggcccucgaggguggccuggggaugaugaauggacaucugccuggcaacguugaugguauggcucucccaucucacuccgugccccacuuaccgucaaaugggggccacagcuauaugggaggcugugggggagccgcggccggugaauacccucaucacgacaguucuguacccgcauccccacugcuuccuacaggcgcugggggagugauggagccccaugccgucuacagcggcucggcagcugccuggccacccucugcguccgccgcauugaacucaggugcuaguuauaucaaacagcaaccucugagcccaugcaauccggccgcuaacccccuauccgggucucucagcacucacucacuggaacagccuuaccuucaccagaauagucauaacgccccagcagagcugcagggcauaccccgcuaucacucccaaagcccuucuaugugugaucgaaaggaguuuguguucucauuuaaugccauggcuaguagcuccaugcauucugcgggaggcgggucguacuaucaccagcagguuaccuaccaagacaucaagccaugcgugauguga

SEQ ID NO: 56370 - RNA, 1335 nt, Artificial Sequence
  derived and/or modified sequence opt3 from FOXF2__Homo_sapiens__NP_001443
augaccacagagggcgggcccccuccagccccgcugagaagggcuugcagccccgugccuggagcacuccaggccgcgcuuauguccccacccccugcugccgcagccgcugcagccgcugccccagaaacuacgucuucaaguagcuccucuucgucagcgagcugugcaaguuccucuagcuccucaaacagugccagcgcucccucugccgcaugcaaguccgcugguggcgggggagccggcgcggguucagggggagccaaaaaggcaagcaguggccugcggcgcccugagaaaccaccguacucuuauaucgcuuugauugucauggccauacaauccagccccucgaagcgauuaacccugucugaaaucuaccaguuccuacaggcucguuuuccuuucuuuagaggcgccuaucagggguggaaaaauuccguuaggcacaaccucucacugaaugaguguuucauuaaacuuccaaagggacugggucggcccggcaaggggcauuacuggacaaucgacccugcaagugaauuuauguucgaggaggggagcuuucgcagaaggccacggggcuuccgccgaaagugccaagccuugaaacccauguaucacagagugguauccggucucggguuuggagcuucucugcugccgcagggcuucgauuuucaggcgccucccagcgcaccacucggcugucauucacagggaggauacgguggcuuagacaugaugccugccggguaugaugcuggagccggcgcacccagucacgcccauccacaccaccaucaccaucaccacgugccccauauguccccuaacccagguagcacuuacauggcuucuugcccgguccccgccgggccuggcggagugggcgcagcugggggagguggcgggggagacuacggcccagauucaaguagcucccccguuccuucuucgccagcgauggccagcgcaauugaaugucacucccccuauaccucaccggccgcucauuggaguucuccuggugccagcccauaccugaagcaacccccugcacuuacacccuccucaaauccagcugccagcgcgggguugcacucuuccaugaguagcuauucucuggagcaguccuaccuacaucagaacgccagggaagaccucucagugggccugccucgguaucagcaccacaguacccccgucugcgaucguaaagacuucgugcuuaauuuuaacggaaucagcucguuccauccauccgcuucuggcagcuacuaucaccaucaccaccaaucaguaugucaggauauaaagccgugcguuauguga

SEQ ID NO: 56371 - RNA, 1470 nt, Artificial Sequence
  derived and/or modified sequence opt3 from FOXG1__Homo_sapiens__NP_005240
augcuggacaugggcgauagaaaggaggugaaaaugauccccaagagcuccuucucuauuaacucacucgucccugaagccguucagaaugacaaccaccaugcuagucacgggcaucacaauagccaucacccacaacaccaucaccaucaccaccaucaccaucaccauccgcccccuccagcaccccagccuccacccccuccacagcagcaacagccgcccccuccacccccuccagcgccccagccgccucagaccaggggagcccccgcugccgaugacgauaaagguccacaacagcuucuguugccucccccacccccuccaccgcccgcagccgcuuuagacggcgcaaaggccgaugggcugggaggcaaaggugagccugggggaggcccaggcgaacuagcucccguggggccugacgagaaggaaaagggagccggugcgggcggggaggagaaaaagggagcaggcgaaggugggaaagauggagagggcggcaaggaaggggagaaaaagaacggaaaguacgagaaaccacccuuuuccuauaaugcccucauaaugauggcuauccggcagucuccggaaaagcgccugacacuuaacgguauuuacgaguucaucaugaaaaauuuuccuuauuaccgagaaaacaagcagggcuggcaaaauucgauucgucacaaccugucauugaauaaaugcuucguaaaggugccaagacacuaugacgaucccgggaaaggaaacuacuggaugcucgacccuagcagugaugacgucuuuaucggcgguacuacggggaagcugaggcggcgcuccaccacaucuagagccaagcuggcauucaaaaggggcgcucggcucacuagcaccggauuaacauuuauggaccgcgccggcucccuguauuggcccaugucaccauuccuuaguuugcaucacccucgagcgagcucuacccuguccuacaaugggacuacaucagccuaccccagccauccaaugccguauaguucugugcuaacccagaacucccucggaaauaaccacagcuuuucgacggcaaacggucugucuguugauagacuugugaauggcgagauaccuuacgcuacucaccaucugaccgccgcugccuuggcagccuccguccccugugggcucucagugccaugcaguggaacauauagccugaaccccuguuccguaaauuuacuggcuggccagacuucuuacuucuuuccucacguuccacaucccagcaugaccucacaaaguuccacaagcaugucugcgagggcagccucaaguagcaccuccccucaggcuccgucuacgcucccaugcgaaucgcuucggcccagccugccuuccuucacuacagguuugucagggggccuaagugacuauuuuacccaccagaaccagggaucuagcuccaauccacugauccauuga

SEQ ID NO: 56372 - RNA, 1098 nt, Artificial Sequence
  derived and/or modified sequence opt3 from FOXH1__Homo_sapiens__NP_003914
augggccccugcagcggguccagacugggaccuccagaggccgaaucuccgucacagcccccuaagaggcggaaaaagcgcuaccuccgacacgacaaaccacccuauaccuaccuugcuaugaucgcacuggugauucaagccgcgccuagucguagauugaaguuagcucagauaaucaggcagguccaggccguuuucccauuuuuccgggaggauuaugaagguuggaaagacagcauucgccauaaccuguccucuaauagauguuuuaggaaggugcccaaggauccugcaaaaccacaagccaagggcaacuucugggcuguagacgugucgcuaaucccggcagaggcccuccggcugcagaauacagcucuuugccgccgauggcagaacgggggagccagaggcgcguuugcaaaagaucugggucccuacgucuugcacgggaggccuuaucggccacccucaccuccacccccgccuagcgaaggauucaguauuaagucccuccugggcggcucuggggagggagcccccuggccaggucuggcuccucagagcucccccgugccagccggcacuggcaauucaggagaggaagcaguucccacgccuccacucccgaguagcgagcgucccuuauggccucuguguccacuucccggcccuacccgcguggaaggugagacaguccaagggggagcuaucggcccaucuacuuugucccccgagccgagagccuggccucugcaucuacuccagggcaccgcggugccagggggaaggucaagcgguggccaccgggccagucugugggggcagcuucccacaucuuaccugccuauauauacccccaacguaguuaugccauuggcaccucccccaacuuccugcccgcaguguccuagcacaucgcccgcuuacuggggaguggccccagaaacccgagggcccccuggucuccugugcgacuuagaugcucuguuucaaggggucccacccaauaaaucuaucuacgacgugugggugucccauccucgcgaucucgccgcaccgggcccaggauggcuucugucaugguguaguuuguga

SEQ ID NO: 56373 - RNA, 1137 nt, Artificial Sequence
  derived and/or modified sequence opt3 from FOXI1__Homo_sapiens__NP_036320
augagcuccuucgaccugcccgccccuucuccaccgagaugcucaccccaguuuccuaguaucggccaagagccacccgaaaugaaccucuacuaugagaauuucuuucacccucagggggugccaagcccccagaggccuuccuucgaaggagguggcgaguacggggcuaccccaaacccguaucuuugguuuaauggacccacaaugacuccuccacccuaccugccuggcccaaacgcaucucccuucuugccgcaggccuaugguguccaacggccuuuacugcccucgguuucagggcuaggaggcagcgaucucggcuggcugccaauuccuagucaggaggaacuuaugaagcuggugcgacccccauacuccuauucugcguugauagcuauggccauccauggggcacccgacaaacgccucacgcugagccagauuuaccaguacguagccgauaauuuuccuuucuauaacaaguccaaagcuggauggcaaaauucaauccgucacaaccugagucucaaugacuguuuuaagaaagugccaagagaugaggacgauccggguaagggcaacuacuggaccuuagaccccaauugcgaaaagauguucgauaacgggaauuuuaggcggaaacgcaagagaaaaagcgacgucucuuccucaacagcaagccuggcccuugagaagacugaaaguucuuugccuguggauuccccaaaaaccacagagccccaggacauucuggauggagcuagcccuggcgguaccacuucgucuccagagaagaggcccuccccgccuccaucaggggcccccugucuaaacaguuuccucagcuccaugacagcguauguuucuggaggcagcccuaccucacauccccuggugacgccaggccuuaguccugaacccuccgacaagacugggcagaauagccugaccuuuaacucuuucucaccauugacaaaccucaguaaucacagcggagguggcgacugggcaaacccgaugccuacuaauaugcuguccuacgggggaucugucuuaucgcaguucagcccccauuuuuauaacuccgugaauaccucaggcguacuguacccacgggaggguacagaaguuuga

SEQ ID NO: 56374 - RNA, 1266 nt, Artificial Sequence
  derived and/or modified sequence opt3 from FOXJ1__Homo_sapiens__NP_001445
auggccgagagcuggcugagacucuccggcgcugggcccgcagaagaggccggaccugaagguggccuugaggaaccagacgcgcuggaugacucuuugaccucauuacaguggcugcaagaguucaguauccuaaacgcuaaggccccggcacugcccccugggggaacagauccacacggcuaccaucaggugcccgguagcgccgcuccuggguccccacucgcagccgaccccgcuugccuuggacagccucacacuccaggcaaaccgacgucuucguguaccucaaggagcgcgcccccuggccugcaggccccacccccugaugacgucgauuaugcaacaaauccacauguuaagcccccguacaguuaugccacuuugauuugcauggcuaugcaagccuccaaagcaaccaagauaacacucucugcuaucuacaaauggauuaccgacaacuuuuguuauuuccggcacgccgauccuacuuggcagaauagcauccgccauaaccugucccugaauaagugcuuuauuaaggugccccgagagaaagacgaaccagggaagggagguuucuggcguaucgauccucaguacgcggagagacucuuaucaggcgccuuuaaaaagaggcggcugcccccaguacacauacaccccgcauucgcucgccaggccgcucaagaaccuagugccgugccaagagcagggccgcuuacagucaacaccgaggcccagcaguugcugagggaguuugaagaggcuacgggagaagcgggcuggggugcaggggagggacggcuaggccauaaacgcaagcagccccucccuaagcgaguggccaaaguuccaagacccccuagcacucugcuuccaacccccgaggaacaaggcgagcuggaaccguugaaggggaauuucgacugggaggcuaucuuugaugccggaacacucgguggcgaacugggggcauuagaggcccuggaacucucuccuccacuuucccccgcuucacacguggacgucgaccugacuauucauggaaggcacaucgauuguccugccaccuggggccccagcguggagcaggcagcggacaguuuggauuucgacgagacauuucuagcuaccucuuuccugcagcacccaugggaugaauccgguagcgggugccucccucccgagccacuguuugaagccggcgacgcaacgcuugccucggaucugcaagacugggcuucuguaggagccuucuuguga

SEQ ID NO: 56375 - RNA, 1725 nt, Artificial Sequence
  derived and/or modified sequence opt3 from FOXJ2__Homo_sapiens__NP_060886
auggccagcgaccuggaguccucucucaccucaaucgauuggcuuccccagcugacauugagagcuacuauugaaaaguuaggcagugcaagccaagccgggccuccaggauccucuaggaaaugcucgccggguucacccacggacccuaacgcgacccugagcaaggaugaggcugccgugcaccaggacggcaaaccacgguacaguuaugcaacacuaauaacuuacgccaucaauuccucucccgcuaagaaaaugacccucagcgaaauuuaucgcuggaucugugauaacuucccuuacuauaagaaugcagggauuggauggaagaacuccauccgacauaaucugucacuuaacaaaugcuuucguaaggucccaagacccagggacgauccuggcaaagguaguuacuggacaauagacaccuguccagauaucagccggaagcgcagacacccgcccgacgaugaccugucucaggauuccccugagcaggaagccucaaaaagcccaaggggagggguugcuggcaguggcgaggccucuuugcccccugaggggaauccacaaaugucccuccagagccccacuucgauugcgucuuauucccagggaacagguucaguggacggcggggcaguagccgcuggagccaguggccgggaaagcgcagaggguccgccuccccuguacaacaccaaucaugacuucaaguuuuccuacucugaaaucaacuuccaggaucugagcuggucauuucgcaaucucuauaagaguauguuagagaaauccucuagcucaagucaacacggguucagcucccugcuuggagacauuccaccuucuaacaauuacuauauguaccagcagcagcaacccccacccccucagcagcaacagcagcagcaacagccaccgcagcccccuccacagcaaucgcagccccagcagcaacaggcuccugcccagggcccaagcgcggugggcggggcacccccguugcauacgccuuccacugauggaugcaccccacccgguggcaagcaggccggggcugagggauauggcccucccccagucauggccaugcacccucccccacugcaacacgguggguaccauccgcaccagcaucacccucacucacaucccgcucagcaaccacccccuccacagccccaggcccagggccaagcaccuaucaacaauacaggauuugccuucccgagugacugguguucuaacauagauagccuaaaagaauccuuuaagauggugaaccgacucaauuggucaagcauugagcagucucaguucuccgaacugauggagagucuuagacaggcugaacagaaaaacuggacucuggaccagcaccauaucgcgaauuugugcgauagccucaaccacuuucugacccagacaggccauguuccaccccaagggggaacccacaggccuccagcacccgcccggauugcugacucuugugccuuaacguccgguaagcaagagucagcaaugagucaggugaauagcuauggccacccucaggccccgcaucuguaccccgggccaucgccuauguaccccaucccaacucaagauuccgcuggauauaaccguccugcccaccauauggucccccgcccaucugugccgccucccggcgcaaaugaggaaaucccagacgauuucgacugggaccucauuacauga

SEQ ID NO: 56376 - RNA, 2202 nt, Artificial Sequence
  derived and/or modified sequence opt3 from FOXK1__Homo_sapiens__NP_001032242
auggccgaggugggcgaagacagcggggcuagagcacugcucgcccuuagguccgcgcccugcucuccuguccugugugcugccgcagccgcugcagccuucccagcugccgcgccgcccccugcaccagcccagccccaaccuccacccggaccuccaccgcccccuccacccccuuugccacccggugcuaucgccggcgcagggucaaguggaggcagcuccgguguuucuggggauucggcuguggccggagcggccccggcauuaguagcugccgcugccgcaucagugcggcagagcccuggccccgcccuggcucgccuagagggccgagaauuugaguuccucaugcgucagccaagugucaccauugggagaaacuccucucagggaagcguggaccuguccaugggucuuucaaguuuuauaagcaggcggcaucugcaauugucuuuccaggaaccucacuuuuaccuccgcugccugggcaagaaugggguuuucguggauggagcguuucagagaaggggcgcacccgcccugcagcucccaaaacaauguacauuccgguuucccuccacugcuaucaagauucaguucacgucauuauaucacaaagaggaggccccugcaagcccacugcgcccgcuuuacccccagaucaguccuuugaagauucauaucccagaacccgaccugcgaucuauggucuccccugugccaagccccaccgguacaauaucgguaccgaacucuugcccugccuccccaagaggggcuggaucaaguagcuauagguuuguucagaaugugacuuccgaucuacaacucgccgcagaguucgcggcuaaagccgcaucugaacagcaggccgacaccagcggcggcgauucacccaaggacgagaguaagccucccuuuuccuacgcucaacugaucguccaggccauuagcucugcacaggaucggcagcuuacacugucagggaucuaugcucacauuaccaaacauuacccauauuaccguacugccgacaagggauggcaaaacaguauccgccacaauuugagccucaacagauacuucauaaaagugccuaggucccaggaggaacccgguaagggcucuuucuggcggauugauccagcgucggaggccaaacugguggaacaggcuuuucgaaagcgcagacagaggggagucagcuguuuccggacaccguuugggccuuuauccucacgcagugcacccgccucuccaacccaccccggccugaugagcccuagauccggugggcuccaaacgccagagugccuuucaagggaaggcagccccaucccucaugacccggaguucggaucuaagcuggcuuccguuccagaguaucguuacagucagagcgcccccggcucuccuguguccgcacagccaguaauuauggcggugcccccucggccgucaaguuuggucgccaaacccguggcuuauaugccagccagcaucguuacuucgcagcaaccugcagggcacgcuauccaugugguccagcaggcccccaccgugacaaugguacgaguugugacuaccuccgcaaauucugccaacggauacauucuaacaagccagggugcugcgggcgggucacacgaugccgcaggagcugccguccuggaccucggcagugaagccagaggucuggaggaaaagccaaccauagcuuuugcaacgaucccugccgcugggggcgugauucaaacugucgcgucccagauggcccccggagugccaggccacacaguuaccauccuucagccggcaacuccugugacacuggggcaacaucacuugcccguaagggccgucacccagaauggaaaacaugcugugccaacgaacucucucgcagguaaugccuaugcgcugaccagccccuuacagcugcuagcuacacaggccuccucaagcgcaccuguuguggucacucgcgugugugagguaggcccaaaggaacccgccgcugccguggcagcuaccgccacaacuaccccugcgacagccaccacugcaagugcuucugccuccagcacgggggagccggagguuaaacggucgagagucgaggaaccaucaggagcugugacaacccccgcaggcgugauagccgccgcugguccucaagggcccggcacuggagaauga

SEQ ID NO: 56377 - RNA, 1983 nt, Artificial Sequence
  derived and/or modified sequence opt3 from FOXK2__Homo_sapiens__NP_004505
auggccgcugcagccgcggcucugagcggcgccgggaccccgccugcaggagguggcgccgggggaggcggugcugggggaggcggcuccccacccgggggaugggcaguggccagacucgaggguagggaguucgaauaccuuaugaagaaacggucugucacaaucggccgcaacucaagucaggggagcguugacguguccaugggacacucuucguuuauuucacgacgucaucuggaaauauucacucccccuggcggugggggacacggcggcgcugccccagaguugcccccugcgcaaccaagacccgaugcagggggagacuuuuauuuaaggugccuggguaagaauggcguauucguggauggggucuuucagcggcgcggagccccuccacuacagcucccgagaguguguacguucagguuucccagcaccaacaucaaaauuacauucacugcucugaguuccgaaaagcgggagaaacaggaggccucugaaagcccuguuaaggcagugcaaccacauaucucaccccuuaccauuaauaucccugacacaauggcucaccugauauccccauugcccaguccgaccggcacuaucagcgccgcgaacucuugcccuuccucaccccgcggugccgggagcaguggcuacaaggucggacgagugaugccaucugaucucaaucugauggcagacaacucccagccugagaaugaaaaagaggcuagcggcggggauucgcccaaggacgauucuaaaccacccuauuccuacgcccagcugauuguacaggcuaucacaauggccccugacaagcaacucaccuuaaacggaauuuauacgcauaucacuaaaaauuacccauauuacagaaccgcagauaaggguuggcagaacucaauaaggcacaaucugagucuuaaccgguacuuuauuaagguuccgcguagccaggaggaacccggcaaaggguccuucuggcgcaucgacccugccucugagagcaaguugauugaacaggcuuuuagaaaaaggcggccacgaggagugcccuguuuccgcacaccucugggcccacuaucaaguagauccgcgcccgcaagcccgaaucacgccgguguccucucugcucauucaaguggggcccaaacuccugagagccuguccagggaaggcucuccagcaccccuugagccugagcccggagccgcucagccaaagcuggccgugauccaggaagcacgguuugcgcaaucggcuccuggcagccccuuguccucacagccagugcucaucaccguccagcgccagcugccgcaagccauuaaaccuguuacauauaccguggcaacgcccguaacuacaaguaccucucagccacccgugguccagacugugcacguugugcaucagauaccugccgucagcgugacauccguagcuggguuagccccagcaaacaccuacacgguuucaggacaagcuguggucacccccgccgcggugcuggccccuccgaaggcugaggcacaggaaaauggugaucacagagaggucaaagugaagguugaaccaauccccgccauuggccacgcuacacucgggacugccagcaggaucauacagaccgcacagacaacuccugugcaaaccguaacaauuguccagcaggcgccacuuggacagcaucaacugcccaucaagaccgugacucagaacggcacgcacguugccucugugccuacagcuguccauggucaggugaacaaugccgcagcuuccccguugcacaugcuagccacccaugcaagugccagcgcuucucugcccacuaaacgucacaacggggaccaaccagagcagccugagcucaagcggaucaaaaccgaagacggcgagggaauuguaaucgcgcuguccguggauacacccccagccgcaguucgagaaaagggcguccagaauuga

SEQ ID NO: 56378 - RNA, 1038 nt, Artificial Sequence
  derived and/or modified sequence opt3 from FOXL1__Homo_sapiens__NP_005241
augagccaccuguucgaccccagacucccugcccuugcugcauccccaaugcuguacuuguauggcccggagaggcccggguuaccucuggccuuugcgccagcugccgcacuagccgcuucuggacgggcagaaaccccucagaagccuccauacucauauaucgcccucauugcuauggccauacaagaugcgcccgagcagcgcgugacacugaacgguaucuaccaguucauuauggaccgauuuccuuucuaucaugauaaucgucagggcuggcaaaacaguaucagacacaaucuuagccugaacgacugcuuugucaaaguuccaagggaaaaggggcggccgggaaaaggcuccuacuggacuuuggauccccgcugucucgacauguucgagaaugguaacuauagaaggcggaagcgcaaaccuaagccagggcccggagcaccugaagccaagcgaccaagagcugagacgcaucagaggucugccgaggcacagcccgaagcuggcucgggcgccgggggaucagguccggcgauuagccggcugcaggccgcacccgcuggccccaguccacugcucgaugggccuucucccccagcccccuuacacuggccuggaaccgcuuccccaaaugaggacgccggcgaugcagcccaaggugcugcggcaguggccguagggcaggcugcccguacaggagacggcccgggcagcccccugcgcccugcauccagaucaaguccaaaaagcucugauaaguccaaaucauuuagcaucgacaguauacuugccgggaagcagggacagaaacccccuucuggugaugaauugcugggcggggcuaagccaggacccggcgguaggcuaggggccucccuccuggcagcgagcucgucucuucggccgccuuucaacgcuucccugauguuggacccacaugugcaaggcggauuuuaccagcucggcauccccuuccugucauacuuuccuuuacagguccccgacacugugcugcacuuccaauga

SEQ ID NO: 56379 - RNA, 1131 nt, Artificial Sequence
  derived and/or modified sequence opt3 from FOXL2__Homo_sapiens__NP_075555
augauggccagcuaccccgagccugaagacgcugcaggcgcccugcucgcgccagagaccgggagaacagugaaggaaccggagggacccccuccaucccccgguaaaggcgggggaggcggugggggaacugcuccugaaaagccagaucccgcccagaaaccuccauauucuuacgucgcacuuaucgccauggcuauuagggagucagcagagaagcggcugacguugaguggcauauaucaauacaucauugccaaauucccguuuuaugaaaagaacaagaaaggcuggcagaauagcauccgccacaacuuaucccugaaugagugcuucauuaagguuccccgagaagggggaggugagcguaaaggcaacuacuggacccuagacccugcuugugaggauauguuugaaaaggggaauuauagaaggcggcgcagaaugaaaaggccauuccggcccccuccagcccauuuucagcccggaaagggccucuucggugcgggcggagcagccggcggcugcgggguggcuggagccggugcagacggcuacggguaccuggcuccgccuaaguaucuucagucuggauuucugaacaauucguggcccuugccacaaccucccucaccaaugcccuacgccagcugucagauggcggccgcagcugccgcugccgcagccgcugcggcagccgcuggcccugguaguccaggggccgcagccguagugaaaggccucgcuggaccggccgcauccuauggccccuacacacgcguccagucuauggcgcugccuccaggggugguuaacagcuauaauggacugggugggcccccugcugccccacccccgccuccacacccccauccucacccccaugcacaccaccuccaugccgcugccgcaccaccucccgcuccaccgcaccauggggccgcggccccucccccaggacaguuaucccccgcuaguccugcaacugccgcuccacccgccccugcaccgaccucagcgccaggccugcaauucgccugcgcucgacagcccgagcuugccaugaugcacuguagcuacugggaucacgacucuaagacaggugcauugcauuccagacuggaucuauga

SEQ ID NO: 56380 - RNA, 2292 nt, Artificial Sequence
  derived and/or modified sequence opt3 from FOXM1__Homo_sapiens__NP_068772
augaagaccagccccagaaggccucugauccucaaacggcgccgacuuccacugccggugcagaacgcccccuccgagacaucugaagaggaaccuaagcguucaccagcucaacaggagaguaaucaggcagaagccagcaaagaggucgcggaguccaacucuugcaaguuccccgcuggcauuaaaauaaucaaucacccuacuaugccaaacacgcagguuguggccauucccaauaacgcaaauauccauucgauuaucaccgccuugacagcuaaggggaaggaaucaggaagcagugguccuaacaaauuuauauuaaucuccuguggcggggcaccaacucaaccgcccggacugagaccucagacccagacaucuuacgacgccaagaggaccgagguaacucuagaaacacucggcccaaaacccgcugcccgggaugugaaucugccucgcccacccggugcgcuuugcgagcagaagagagagaccugugcagacggggaagccgcuggaugcacgauuaacaauagccuguccaacauccaaugguugaggaaaaugucaagugauggccucggcagccggucuauuaagcaggagauggaagagaaggaaaauugucaccuggagcagcgccaggucaaaguggaggaaccgucccgaccuucagccagcuggcaaaacaguguuucugagagacccccauauuccuacauggcaaugauccaguucgcuauaaauagcacugaaaggaagcggaugacccugaaagacauuuauacauggaucgaggaucauuuuccuuacuucaagcacauugccaaacccggguggaagaacucgauccgucauaaccucucuuuacacgacauguuugugcgcgaaacuuccgcgaauggaaaagucucauucuggaccauccacccaagugccaacagauaucugacacuugaucagguguuuaagcccuuggacccugguagcccacaacugccggagcaucuagagucccagcagaagaggcccaauccugaacuccggcgaaacaugaccauuaaaacggagcugccacuuggcgcacgcagaaagaugaaaccccuguugccuaggguaucuagcuaccucguuccaauacaguuccccgugaaucaaucacuggucuuacagccgagugugaaggugccucugccacucgcugccucccuuaugagcucugaacuggcucggcacucaaaacgcgucagaaucgcccccaagguuuugcuagcagaggaagggauugccccucugaguagcgcuggacccggcaaggaggagaaacuccuguuuggugaaggguucuccccacuucugccugugcagacuaucaaggaggaagagauacagcccggagaggaaaugccacauuuggcgaggccgauuaaaguagagucuccuccccucgaagaguggccaucgcccgcaccuagcuuuaaggaagaguccucacacaguugggaggauucuagccaauccccaacaccccguccuaaaaagucauauagcggccugcggucuccgacccgaugcguguccgaaauguuagucauccagcacagagagaggcgcgaacggaguagaagcaggcgcaagcagcaucugcuaccacccuguguggacgagccugaacuccuguucucugagggcccauccacuucacgaugggccgcugagcuucccuuuccugccgauaguagcgacccggcaucgcaguuguccuacucucaagaaguugggggacccuucaaaacaccaaucaaggagacccugccuauuagcucaacgcccaguaaauccgugcucccacggaccccugaaucuuggcgucugacacccccagccaaggucgguggccuugauuucagcccggugcagacuucccagggggcuucagacccucugcccgacccauugggacucauggaucugagcaccacacccuuacagagugccccuccacuggagucuccccaaagacuacucuccagcgaaccucuggaccuuaucucgguaccguuuggcaacucaucuccaagugauauugacguucccaaaccugguucccccgagccacaggugagcggguuggcagcgaauaggucucugacugagggccucguccuggauaccaugaacgacagcuuauccaagauacugcuugauaucucauucccuggauuggacgaagauccccucggcccagacaauauuaacuggagucaguuuaucccugagcugcaauga

SEQ ID NO: 56381 - RNA, 1947 nt, Artificial Sequence
  derived and/or modified sequence opt3 from FOXN1__Homo_sapiens__XP_005258103
auggugagccugcccccuccacaguccgacgucacccucccgggccccacaagacuugagggggaaaggcaaggagaucugaugcaggccccugguuugccaggcucucccgcuccucagucaaagcacgcaggguucaguugcagcuccuuuguuucugacggaccacccgagcggacuccuucguuaccaccgcauucaccccgcaucgccagcccuggcccagaacaggugcaaggucacugucccgcggggccuggaccaggccccuuccgacugaguccguccgauaaauacccuggcuuuggguucgaggaagcugccgcaucuagccccggacguuuucuaaaggguucccaugccccauuccacccuuauaaaagacccuuucaugaggacguauucccagaggcugaaacgacccucgcacugaagggccacucauuuaaaacacccgggccucuugaggccuucgaagagauuccaguggaugucgcugaggccgaagcguuucugccgggauucagugcagaggccuggugcaacggcuugcccuacccuagccaggaacacgguccacaggugcucgggucugagguuaaggugaagcccccuguccuggaauccggagcuggcauguuuuguuaucagccaccccugcaacauauguacugcucaagccagccgccuuuccaccaguauaguccaggcgggggaucuuaccccauaccuuaucucgguuccagccauuaccaguaccaaaggauggcaccccaggccucgacugacggccaccagccauuauucccuaaacccaucuauucuuacuccauucugaucuuuauggcucuuaagaauagcaaaaccgggaguuugccagugagcgagauuuauaacuucaugacagagcacuuuccguacuucaagaccgccccugauggauggaaaaauuccguacggcauaaccugucucuaaauaaguguuuugaaaagguugagaacaaaagcggcucaaguucccgcaaggguugccucugggcgcugaaucccgccaaaaucgacaagaugcaagaagaacuucagaaauggaagagaaaagauccaauagcagugaggaagucaauggcuaagcccgaggagcuggacucuuugaucggggauaaacgggagaagcucggcucaccucuguuaggauguccacccccuggccugagugggagcggaccgauucgcccacucgcucccccugccggucuuuccccaccccugcacucuuugcauccugccccgggccccaucccagggaaaaacccucuacaggaccugcucaugggacacacucccucgugcuauggccagacauaccugcaucuuagcccaggucuggcaccucccgggccaccgcaaccuuuguucccccagccagauggccaccucgaacugcgagcccagcccggaaccccucaggacuccccauuacccgcucacacgccuccgucacauagugcgaagcugcuagcagagccaucucccgccagaacuaugcacgacacccuccugccugauggcgaccuugggacagauuuggacgcuauuaaucccagccugacugauuuugacuuccaaggaaaccucugggaacagcugaaagaugacucccuugcccuggauccauugguccucgugaccucaagcccuacaucuuccaguaugcccccaccucagccgcccccacauuguuuuccucccgguccaugccugaccgagacgggcagcggggcaggagacuuagccgcuccuggcucugguggguccggcgcccugggagaucuacaccucacuacacuguauucagcauucauggaacuugagcccaccccgccaacugcgccugcuggccccaguguguacuugagcccaucguccaagcccgucgcccuggcauga

SEQ ID NO: 56382 - RNA, 1296 nt, Artificial Sequence
  derived and/or modified sequence opt3 from FOXN2__Homo_sapiens__NP_002149
augggccccgugaucgggaugaccccugacaagagagccgagacaccaggagcugagaaaauugcaggucugagccagauauacaagaugggcucccucccggaggccgucgaugcggcuaggcccaaagccacucuuguugacucugaaucagcagaugacgagcugacgaacuugaauugguuacacgaaaguaccaaccugcuaacaaauuucagccucggguccgagggacugccuaucgugucuccacuuuaugauauugagggcgacgauguacccucguuugguccugccugcuaccaaaacccagaaaagaaaucagcuacuagcaagcccccuuauaguuucucccuguugaucuacauggcaauugagcauucuccaaauaagugucucccggugaaagaaaucuauagcuggauacuggaccacuuucccuacuucgccaccgcuccuacaggguggaagaacuccguccggcauaaucugucacucaacaaaugcuuucagaagguggagcgcagucacggaaaaguuaauggcaagggcagcuuaugguguguggauccagaguauaagcccaaccugauccaggcccuuaaaaagcagccuuucucuuccgcgucaagccaaaaugggaguuugucuccacauuaccuguccagcgucauuaaacagaaccaggugcgaaaucuaaaggaaucggacaucgaugcagccgcugccaugaugcuccugaacaccucuauugagcagggaauccuugaaugcgagaaaccccugccguugaagacugcacuccagaaaaagcguuccuacgguaaugcuuuucaccacccuucagccguaagacugcaagaaagugacagcuuagcgacauccauagaucccaaggaggaccauaacuauucugccagcucaauggcagcucagaggugugccagucgguccagcguuucuucacugaguagcguggacgaggucuacgaguucauuccuaaaaacucccacgugggcucugaugggucggaaggauuucauagcgaagaggacaccgauguggacuaugaagaugacccacucggcgauuccgguuacgcuucacagcccugcgccaagaucagugagaaagggcaaucuggaaagaaaaugcgcaagcagacgugucaggagauugacgaagaacuuaaggaagcagccggcagccuguugcaccuagcuggcaucagaacuugccuggggucccucaucucaaccgcgaaaacacaaaaucagaagcagaggaaaaaguga

SEQ ID NO: 56383 - RNA, 1473 nt, Artificial Sequence
  derived and/or modified sequence opt3 from FOXN3__Homo_sapiens__NP_001078940
augggccccgugaugccuccaagcaagaaaccggaguccucugggaucucagucaguagcggacugucccagugcuacgguggcucuggguucucgaaggcccuccaagaagacgaugaccuugauuuuucacugcccgacauuagauuggaggaaggagcuauggaggaugaagaguuaaccaaccugaauuggcuacacgagagcaaaaaccuccugaagaguuucggcgaauccguucuuaggucugugagcccuguacaggaccuggaugacgauacaccacccuccccugcacauucagacaugccauaugaugcccggcagaaucccaacuguaaaccuccauacaguuuuagcugcuugauauucauggcgaucgaggacucuccgacuaagcgccuccccgugaaggauauuuauaauuggauccuggaacacuuuccuuacuucgcuaacgccccaacggguuggaaaaauuccguccgacauaaccugucacucaauaaguguuuuaaaaagguggacaaagagcguagccagaguauugggaagggaucuuuauggugcaucgaccccgaguauagacaaaaccugauacaggcacuuaagaaaaccccuuaccacccacauccccacguuuucaauacaccgccuacuuguccccaggccuaucaguccaccagcggcccaccuaucuggcccggcucgacauuuuucaagaggaacggggcuuugcugcaagauccagacauugaugcagccucugcuaugaugcuacucaauacucccccugaaauccaggccggauuuccaccgggugugauucagaacggcgcgcggguccugucccgcgggcuuuuccccggagugagaccucugccaaucacccccauaggcguaacagcagccaugaggaaugguauuaccucaugccggaugcgcacggagagugaaccuagcuguggguccccaguugugucuggagaccccaaagaggaucacaacuacagcucagcuaagaguuccaacgcccgaagcacuucuccgaccucagacaguaucagcuccucuucgagcuccgcagaugaccauuacgaauuugcuacaaaaggcucacaggagggcagugaggggucugaagguagcuucagaucccacgagucaccuagcgauacugaagaggacgauaggaagcauucucaaaaagaaccaaaggacuccuugggagacaguggcuaugccagccagcacaagaaacggcagcacuucgcgaaggcccguaaaguccccucugauacccucccucugaagaaacgcagaacagagaagcccccagaguccgacgaugaagagaugaaggaagcagcugggucauuacugcaucucgccggaauuaggaguugccuuaauaacaucaccaaucggacggcuaaaggccaaaaggagcagaaagaaacuacaaagaacuga

SEQ ID NO: 56384 - RNA, 1968 nt, Artificial Sequence
  derived and/or modified sequence opt3 from FOXO1__Homo_sapiens__NP_002006
auggccgaggcuccccagguggucgaaaucgacccugauuucgagccacugccgagacccaggagcugcaccuggccucucccacggcccgaauuuucccaaucuaacucagcaacaaguagcccugccccauccggcucugcggcugccaaucccgacgcagccgcugggcuuccuucggcaucagccgcugccguuagcgcggauuucaugaguaaccuguccuuguuagaggaaucugaggacuuuccacaggcaccgggaagcguggccgcugccguagcagcugccgcggccgcagcugccacugguggccuguguggggauuuccagggacccgaggcuggcugccuacacccugccccaccccagccuccacccccggguccucucucccaacaucccccagugccucccgcagccgcugggccacuggcgggacagccccgcaagucaaguagcucucgacguaaugcauggggcaaccuuuccuacgccgaccugauuacgaaagcuauagaaucaagcgccgagaagagauugacccucagucagaucuaugaauggauggucaaaucugugccuuacuuuaaggauaaaggcgacuccaauagcucggcaggguggaagaacucuauuaggcacaaucugucccugcauucaaaguucauccggguucagaacgagggaacagguaaaaguagcugguggaugcucaauccagagggcgggaaguccggaaaaucuccgcgcagaagggccgcuagcauggauaacaauucaaaguuugccaaaagucggucccgcgcagcgaagaagaaagcuagcuuacaaucuggccaggaaggugccggggacucacccggaagucaguucagcaaguggccugcauccccaggcucucacucgaacgaugacuuugauaauuggagcacuuuccgacccagaaccuccucaaacgccaguacaauuucuggcaggcugagcccuaucaugaccgagcaggacgaccuuggggaaggagaugugcauuccauggucuauccacccucagcugccaaaauggcaagcacuuugccgucucuguccgagauaaguaauccugaaaacauggagaaccuacucgacaaucugaaccuucugagcucuccaacauccuugaccgugucaacgcaaaguagccccgguacuaugaugcagcagaccccuuguuacucguuugcucccccaaauacaucccucaacucuccuagccccaauuaucaaaaguacacuuauggccagucaaguauguccccacugccgcagaugccuauccagaccuuacaagauaacaaaucuagcuacgggggaaugucccaguacaauugcgcccccggccugcucaaggagcuucugacaucagacagcccaccccacaacgauauuaugaccccuguagacccagguguugcgcagcccaauagucggguguuggggcagaacgucaugaugggcccuaauucugugauguccacguauggaagccaagccucgcacaacaaaaugaugaauccgucaucucauacucacccaggccaugcucagcagacaagugcagugaacgggcguccccuaccucacaccgucuccacuaugccacacacaagcggaaugaaucgccugacccagguuaagacgcccgugcaaguaccucucccgcaucccaugcagaugucugcccuggguggcuacagcuccgugucaaguuguaacggguauggaagaaugggccuucugcaccaggaaaaguugccaagcgaucucgacgguauguucaucgagaggcuggauugcgacauggaaucuauuauccggaacgauuuaauggacggggacacccuggauuuuaauuucgacaacguccuaccuaaucaguccuucccccauucagugaaaacaacuacccacaguuggguuagcggcuga

SEQ ID NO: 56385 - RNA, 2022 nt, Artificial Sequence
  derived and/or modified sequence opt3 from FOXO3__Homo_sapiens__NP_963853
auggccgaggcucccgcaagcccugccccacuguccccgcucgaaguggagcuugaccccgaguucgaaccucagucuagaccaaggucaugcaccuggccccugcaacggccugaauugcaggcgaguccagcuaagcccagcggcgagacagccgcagauuccaugaucccugaggaagaggacgaugaagacgaugaggacgggggaggucgcgccggcucugcuauggcaauugggggaggcggugggucgggaacuuuaggcucaggccugcuacucgaggauagcgcccgaguccuggcuccagggggacaggacccggguaguggccccgccacggcggcagggggacuuuccggcgguacccaggcccuguugcaaccucagcagccacugcccccuccacagcccggggcugccggaggcucuggccaaccgcguaaauguagcuccagaaggaacgcaugggggaaucucucauacgcugaucugauaacacgggccaucgaaaguagcccugacaagcgccucacuuuaucucagauuuaugaguggaugguuagaugcgugcccuacuuuaaagauaagggagacuccaacucaagcgcggguuggaaaaauaguaucaggcacaaccugucucuucauucccgguucaugcgcguacagaaugaaggcaccggaaagagcucgugguggauuaucaacccagaugggggcaagucugguaaagccccucgaagaagggcaguguccauggacaauucaaacaaguauacaaaaagucgggggcgugcugccaagaaaaaggcugccuugcagaccgcacccgagagcgccgacgauuccccaucucaacugagcaaguggcccggcucaccuacuucucgcuccagcgacgaacuagaugcuuggacagacuuuagaucuaggaccaauucaaacgcgaguacggucagcggacggcucuccccaauaauggcaucuacugagcuggaugaggugcaggacgaugacgccccgcuuucgcccaugcuguacagcuccucagcuaguuugucuccuagcguuuccaaaccauguaccguggaacucccccgacugacagauauggccggcacuaugaauuuaaacgacgggcugaccgagaaucucauggaugaccuucuggacaacaucacauugccuccaucacagcccagcccgaccggaggucuaaugcaacgcaguuccaguuucccuuauacgacuaagggcagcgggcugggaucuccaacauccucauuuaauaguaccgucuucggccccagcucgcucaacucccugagacagucuccuaugcagacuauucaggaaaacaaacccgcaacauuuagcucaaugagucacuacgguaaucaaacccuucaggaucuguugacguccgacucucucagccauuccgaugugaugaugacccagucagacccacugaugagccaggccaguacagcuguaucugcccaaaacuccaggcggaauguuauguuacgcaacgauccuaugaugagcuucgcagcgcagcccaaucaggggucgcuggugaaccagaaucuacuccaccaucaacaccagacucagggcgcucugggaggcucaagagcccuuucuaacagugucuccaauaugggguugagcgagucuagcucccugggaucagcaaagcaccagcaacagaguccagugagccagucuaugcaaacccucuccgacucacugagugguagcucccuuuauucuacaucggccaaccugccggugaugggccaugaaaaauuuccuagcgauuuggaccucgauauguucaaugggucacuggagugcgacauggaguccaucauuaggagugaauuaauggaugcugacggacuggauuuuaacuucgacucucuaaucagcacucagaaugucguuggccucaacguggguaauuuuaccggggccaagcaggcauccucacagucuuggguacccggcuga

SEQ ID NO: 56386 - RNA, 1353 nt, Artificial Sequence
  derived and/or modified sequence opt3 from FOXO4__Homo_sapiens__NP_001164402
auggaccccggcaacgagaauagcgccaccgaagcugcagccaucauugaucuggacccugauuucgagccacaguccagaccgaggucuugcacauggccccucccucggccagaaauagcgaaccaacccucagagccuccagaaguggagcccgaccuuggggagaaggcuaucgaaagugccccugagaaacgccugacuuuggcacagauuuacgaauggaugguccgaacgguuccauauuuuaaggauaaaggagacagcaauuccucugccgguuggaagaacucgauccgucacaauuuaucacugcauagcaaauucauuaaggugcacaacgaggcuaccggcaagaguuccugguggaugcuaaauccggaagggggaaaaucuggcaaggcacccagaaggcgggccgcuagcauggauuccucaaguaaacuccugcgcgguagaagcaaggccccuaaaaagaagccaucuguacuucccgcgccuccagagggggcaacacccacuuccccggugggacauuuugccaaauggucaggcagcccuuguaguaggaaccgggaggaagcugacauguggaccacauuccgcccccgaucuuccagcaaugccucgucugucuccaccagacugucaccauugaggccugagagugaagugcucgcagaggagauccccgcuagcguuuccucuuacgccggcggggugccacccacucugaacgaaggacuggagcucuuagauggucugaaucuuacaagcucacacaguuugcugucccggagcggccuaucuggguuuucacuccagcauccuggagucaccggcccacugcacacguauaguagcucccuuuucucuccggcggaagguccccugucggccggggagggaugcuuuagcuccucacaggcauuggaagcucuccugaccagugacacuccuccacccccugccgauguguuaaugacacaaguagacccaauacugucucaggcucccacucuccuucuguugggcggccuaccgagcuccucaaagcuggccaccgggguuggacucuguccuaaaccacuggaggcacccgguccuagcucucuugugcccacacuguccaugaucgccccaccucccgucauggcuagugcgccaauuccgaaggcauugggcaccccugugcucacgcccccaacugaggccgcuagccaggaucguaugccccaggaccuggacuuagauauguacauggaaaaccuggagugcgacauggauaauaucauuucugaccuaauggaugaaggggagggacucgacuucaacuuugaaccugauccauga

SEQ ID NO: 56387 - RNA, 1680 nt, Artificial Sequence
  derived and/or modified sequence opt3 from FOXO6__Homo_sapiens__NP_001278210
auggccgcuaagcugagagcacaccagguggacgucgaucccgacuucgccccucaaagcaggccacgguccugcaccuggccgcucccccagccugaucuugcgggcgacgaggauggggcucugggagccgguguugcagaaggcgccgaggacugugggccagaacgccgagcuacagcacccgccauggcuccugccccacccuugggagcggaggugggcccuuuacguaaagcaaagucuucaagaaggaacgccugggguaaucugaguuacgcugaucuaaucacuaaagccauugaaagcgcaccagacaagcggcucacgcugucccagauauaugauuggaugguacgcuacgugccguauuuuaaagacaagggggauucuaacucgucagcuggauggaagaauagcaucagacauaaccuuagucugcacaccagguucauucggguccagaaugagggcacaggcaaauccucuugguggauguugaaccccgagggcggaaagacugguaaaaccccucgcagacgagccgugagcauggacaauggcgcgaaguuucucaggaucaaagggaaggccuccaagaaaaagcaacugcaggcaccagaacggucacccgaugacaguagcccuucugcuccagcccccggaccgguuccugcugccgcaaaaugggccgcuucccccgcgucacaugcaagcgacgauuacgaggccugggcugacuuccguggcggugggcgcccacugcucggagaagccgcagaguuagaggaugacgaagcccuggaggcucuugccccuaguucucccuugauguauccaucccccgcaagcgcgcugucgccugcucuaggcucuagaugcccaggcgaacucccgaggcuggccgagcuugggggaccccuggguuugcacggcgggggaggcgcaggucucccugaagggcuguuagauggcgcccaggacgcuuacggaccacgggcccgagcaggcacacccgcuuauuuugggggauguaaggguggcgccuacgggggaggcgguggguucggcccuccagcgaugggagcccugcgcagacuccccaugcagaccauucaagagaacaaacaggcuuccuuugugccggcagccgcuccuuucaggccaggcgcccuucccgcacuguugccucccccaccucccgcgccacggccggggccuguccuaggagcccccggugagcuggcucucgccggcgcagcugccgcauacccagggaagggagccgcucccuaugcgccuccagcccccucacgcagugcacuggcucauccuaucagccuuaugacucugccgggcgaagccggugccgcuggguuggcaccauccggccacgccgcggcuuuuggagggcccccugggggacuccuguuagaugcccugccaggccccuacgcagccgcugcagccgguccucuaggggcggcuccggacagauuccccgccgaucucgaccuggauauguuuucuggaagccuugagugcgacguggaaucaauaaucuugaaugacuucauggauagugacgagauggauuuuaacuucgacuccgcacugccaccucccccaccuggccucgccggugcucccccaccgaaucagagcuggguaccuggcuga

SEQ ID NO: 56388 - RNA, 345 nt, Artificial Sequence
  derived and/or modified sequence opt3 from FOXP1__Homo_sapiens__NP_001012523
augaugcaggagagcggcaccgaaacaaaguccaacgggucugccauccaaaauggaucagguggcaguaaccaucugcucgagugcgggggacuuagagaaggcaggagcaauggugagacucccgcuguggacauuggggcagccgaucuggcgcacgcucagcagcagcaacagcaguggcacuugauaaaccaucagccuucccggucuccaucgucaugguuaaaacgccugaucagcaguccgugggaacuagagguccuccaaguuccccuguggggagccguggcagagacgaagauguccggcccuguaugucagccaaaucccucuccuuucuga

SEQ ID NO: 56389 - RNA, 2145 nt, Artificial Sequence
  derived and/or modified sequence opt3 from FOXP2__Homo_sapiens__NP_001166237
augaugcaggagagcgccaccgaaacaaucuccaacucuucaaugaaucaaaacggcaugaguacucugagcucccagcucgacgcugggucuagagauggaaggucgucaggugacacgagcagugagguguccaccgucgaacuucugcacuugcagcagcaacaggcauuacaggccgcgcggcagcugcuacuccaacagcagacaucuggccugaagucccccaaauccucagauaagcagcgcccucuucaaguuccagugaguguagcuaugaugacuccccaggugauuaccccgcagcaaaugcagcagauacugcagcaacaggucuugagcccucagcagcuccaagcccugcugcagcagcagcaagcagugaugcuccagcagcagcaauuacaggaguucuacaaaaagcagcaagaacagcugcaucuucaguugcugcagcaacagcagcagcaacagcagcagcaacagcagcaacagcagcagcaacagcagcagcaacagcagcagcaacagcagcagcaacagcagcaacagcagcagcaacagcagcagcaacacccagggaaacaggccaaggagcagcagcaacagcagcaacagcagcagcuagcugcacaacagcucguuuuucagcagcaacugcuucagaugcagcagcugcaacagcagcagcauuugcucucucugcaacgacagggauuaaucuccauucccccuggccaggccgcucugccagugcaaucacucccccaggccggucuuagcccugcggagauccagcagcuguggaaggaagucacaggggugcacaguauggaggacaauggaauuaaacauggcggcuuggaucuaaccacuaacaauucuuccagcacaaccucgucuaacacguccaaggcaucaccaccgaucacucaccacaguauaguaaaugggcaaagcuccguucugucugcccguagagacagcucaagucaugaagagaccggagcuucccacacacucuauggucauggcgugugcaaauggcccgggugugagagcaucugcgaagauuucggacaguuucugaagcaccuuaacaaugagcacgcccuggacgauaggucuacugcacagugucggguccagaugcaaguggugcagcaguuggaaauucagcucucaaaagagcgcgaaagacugcaagcuaugaugacccauuuacacaugaggccuagugagccaaagcccagcccuaagccacugaaccuagucuccucuguuacaaugucgaaaaauaugcucgagaccagcccccagucccugccgcagacgccuacuacacccaccgccccagugacuccuaucacacaaggccccucaguaauuaccccagcgagugugcccaacgucggugccauccggcgccgacauucugacaaguacaauauaccuaugagcuccgaaauugcaccaaacuaugaguucuacaaaaaugcugaugugagaccgcccuuuacguaugccacccuuaucaggcaggcuauuauggaaucaagcgaccggcaguugacacugaacgagaucuacucuugguucacucguaccuuugccuauuuccgcagaaacgcagccacauggaagaaugcuguuaggcacaaccucucccugcauaaaugcuuugugcgggucgaaaaugugaagggggcgguauggacuguugaugagguggaguaccagaaacgacgcagucaaaagaucaccggaagcccuacacuugucaagaacauuccaaccucucugggcuacggcgcagccuugaaugcuucccuccaggccgcacuggccgaaucaaguuuaccccugcuaagcaacccugggcucauaaauaacgcuucguccggacugcuucaggccgugcacgaggacuugaaugguucucuggaccacaucgauagcaacggcaauucaaguccaggguguagcccccagccgcauauucacucuauccaugucaaagaggaaccugugauagcagaagacgaggauugcccaaugagccucguuacuacggcgaaccacucccccgagcuggaagacgauagagagauugaagaggagccuuuaucagaagaccuggaguga

SEQ ID NO: 56390 - RNA, 1191 nt, Artificial Sequence
  derived and/or modified sequence opt3 from FOXP3__Homo_sapiens__NP_001107849
augcccaacccuagaccaggcaagccgagcgcccccucccuggcucucgggccuucuccaggagcaucacccaguuggagggccgcgccuaaagcuagcgaccuucugggugcccggggcccagggggaaccuuccagggccgcgauuugcgagguggggcacacgccuccucuucgucauuaaaucccaugccuccaagccaacugcagcuaaguacaguggacgcucaugcacguacuccgguccuccagguucacccccuggaguccccugccaugaucucucuuacgccacccaccacagcuacuggaguguuuagccugaaggccagaccuggcuugccacccggcauuaacguagcgucccucgaaugggugucaagggagccggcacugcugugcaccuucccuaaucccagugccccacggaaagauagcacacucucugcugucccucaguccucauaccccuuacuggccaacgggguguguaaguggccaggaugcgaaaaaguuuuugaggaacccgaggacuuccuuaagcauugucaagcagaucacuugcuggacgagaagggucgcgcucagugccuacuccagagagaaauggugcagagccuggagcaacagcuuguccuggaaaaagagaaguugagugccaugcaggcgcaucucgccggcaaaauggcacugaccaaggcuucuuccguggccagcucggauaaagggucuuguugcauaguagcugccggaucccagggcccuguugugccagcauggucagguccgagggaggcccccgacaguuuauuugcuguccggcgccaccugugggggagccacggaaauuccacuuucccugaauuucuccauaacauggauuauuucaaguuucacaauaugcgaccacccuucacauacgcgacccuuaucagaugggcaauucuggaggccccugaaaagcaaaggacguugaacgagaucuaucauugguuuacucggauguucgccuuuuuccguaaucacccagcuaccuggaaaaacgcaauucgccacaaucuaucucugcauaaguguuucgugagaguggaaagcgagaaaggcgccgucuggacaguugacgagcucgaauuuaggaagaaacggucacagcgacccagucgcugcuccaacccgacuccuggcccauga

SEQ ID NO: 56391 - RNA, 2043 nt, Artificial Sequence
  derived and/or modified sequence opt3 from FOXP4__Homo_sapiens__NP_001012426
augaugguggagagcgccuccgaaaccaucagaucugcucccucaggccagaacggggucggaagucugagcggucaagcagacggcuccucugggggagccacaggcacuacggcgucggguaccgggagggagguuacaacuggagcugauucaaauggcgaaaugagcccugccgagcuccuucacuuccagcagcagcaagcacugcaaguggcccggcaguuuuuguuacagcaggcuaguggccuguccucuccagggaacaaugacagcaagcaguccgcaucagccguacaggugccggucaguguggcuaugaugagcccccagaugcuaaccccucaacagaugcagcaaauucucucuccaccccagcugcaggcccuucugcagcaacagcaggcguugaugcuccagcaacugcaggaauacuauaaaaagcagcaggagcaacugcaucuccaguuacugacacagcagcaagcaggaaaaccucagccaaaggaggcccuugguaacaaacaguuggcuuuccaacagcagcugcuacagaugcaacagcuccagcagcaacaucugcuuaaucugcagcgccagggcuugguuucccuccagcccaaccaagccucagggccucugcagaccuuaccacaggcagcugugugcccgacugaucugccccaacucuggaagggagaaggcgccccuggucagccagcggaggacagcgucaagcaggaagggcuugaucugacaggaaccgccgcaacggcuacuuccuuugccgcucccccuaaagugucuccacccuugucccaccacacccuaccgaauggccagccuacaguacugacuagccgacgugacucgucuucccaugaggagacccccggcucacacccacucuacgggcacggagaauguaaguggccugguugcgagacacugugugaagaucuuggccaauucauaaaacaucugaacaccgagcacgccuuggacgauagaaguacggcacagugcaggguucagaugcaagugguccagcagcucgaaauccagcuggccaaggagagcgagcgguuacaggcuaugauggcgcaucugcacaugcgccccuccgaaccaaaacccuuuucucaaccucuaaauccagugccggggagcucaaguuucuccaaggugacugucagcgcagccgacucuuuucccgauggacucguucacccuccaacaucagcugccgcacccgugaccccucugagaccacccggccuugguagugccagcuugcaugggggcggaccggcuaggcggcgcuccucugacaaguucuguucgccuauuagcuccgagcuggcccagaaccacgaauuuuauaaaaaugcagauguacgaccacccuucacuuacgcgucacucaucagacaggcuauucuggagacaccugacaggcagcuuacccugaacgaaaucuauaauugguuuacgcggauguucgccuacuuucgucgcaacaccgcaacauggaagaaugccgugagacauaacuugagucuccacaaaugcuucgucaggguggagaacguuaagggcgcuguguggacugucgacgagcgggaauaucaaaaacgaagacccccaaagaugaccgggucuccuacacuggugaaaaauaugauaagcggauuauccuacggugcccugaacgcaucauaccaggcugcccuagcggagagcucuuucccccuccuuaauuccccaggcaugcugaacccggggagugccagcucuuugcugccucucucccaugaugacguaggagcucccguugaaccacugcccucaaauggcaguagcucgccuccacgcuuaagucccccucaguauucucaccaagugcaggucaaggaggaaccggcagaggccgaggaagauaggcagccaggucccccucugggggcuccaaaccccagcgccucaggcccuccggaggaccgggaucuugaagaggaguugcccggagaggaacucaguuga

SEQ ID NO: 56392 - RNA, 1212 nt, Artificial Sequence
  derived and/or modified sequence opt3 from FOXQ1__Homo_sapiens__NP_150285
augaagcuggagguguucguccccagagccgcucacggcgacaaacaggggagcgaucucgaaggagcagggggcuccgacgccccuucuccacuuucagcggcuggggaugacagucugggaagcgauggcgacugcgccgcaaacuccccggccgcuggugggggagcaagggauacccaaggcgacggcgagcagucugccgggggaggucccggcgcugaagaggccaucccugcggcagccgcugccgcaguuguggcugaaggggccgaggcgggagccgcaggcccaggugcugggggagccggcucgggcgagggggcucggucaaagcccuacacacgccgaccuaaaccacccuauagcuacauugccuugauagcaauggccauccgugauagugcuggagguagauuaacucuggcggaaauuaaugaguaucuaaugggcaaguuuccuuucuuuaggggguccuacacgggauggcggaacucuguacgccacaaucucagccugaacgacuguuucgugaaaguccuuagagauccauccaggccguggggcaaggacaauuauuggaugcugaaccccaauucagaauacaccuuugcagaugguguguuccggcgccgaagaaagagguugagucaccgggccccuguuccagcucccgggcuccguccugaggaggccccaggccugcccgcagccccgccucccgcuccagccgcacccgcgagcccccgcaugagaucuccagcuaggcaggaggaacgggccucccccgcaggaaaauuuucaagcaguuucgccaucgacucuauucugcgaaagccuuuucgcuccagaaggcuccgggacacagcuccaggcacuaccuuacaguggggugccgcaccgugcccuccucugccagcuuuccccgcccuuuugccugcggccccaugucgcgcucugcuaccccucugcgcauauggagccggugaaccggcuagacugggcgccagggaggcagaagugccuccaacagcgcccccucuucuguuggcaccccucccagcugccgccccugcuaaaccccugcgugggccagccgcaggaggcgcccauuuauacuguccgcugcggcucccugcugcgcuucaagccgcaagcguccgaagacccgguccacaucugcccuacccuguggagaccuugcuagcuuga

SEQ ID NO: 56393 - RNA, 879 nt, Artificial Sequence
  derived and/or modified sequence opt3 from FOXR1__Homo_sapiens__NP_859072
augggcaacgagcuguuccucgccuuuaccacaagccaccuuccccuggcugaacagaaguuggcaagauacaaguuaaggaucgugaagccuccaaaacugccgcuagagaagaaacccaauccugacaaggaugggccagacuaugaacccaaccucuggaugugggucaauccuaacauuguuuacccacccggaaagcuggagguguccggucggcgcaaacgagaagaucuuacuucuacgcugccuucaagucaaccaccgcagaaggaggaggacgccagcugcuccgaagcggcuggcguagagucuuugucgcagucaagcaguaaacguucucccccuagaaagagguucgccuuuuccccaagcaccugggaacucacagaggaggaagaggcagaagaucaggaggacuccucaaguauggcccugcccagcccucauaaacgggcuccacugcaaucucgcagacucaggcaggcauccucacaggccgggcgguuauggagccgacccccgcugaauuauuuccaccuuauagcuuuggcccugcgcaacaguucuccuuguggacuaaaugugcagcaaaucuacuccuuuacuagaaagcauuuccccuuuuucaggaccgcgccagaaggcuggaagaacacaguccggcacaaucucugcuuucgugauagcuucgagaaagugccuguuucgaugcaggguggggcaucuacccgccccagauccugucuguggaaacuuacugaggaaggacauaggcgguuugccgaggaagcucgagcccuggcaucaacacgcuuggagaguauucagcagugcaugagccaaccagacgugaugcccuuccucuuugaucuguga

SEQ ID NO: 56394 - RNA, 936 nt, Artificial Sequence
  derived and/or modified sequence opt3 from FOXR2__Homo_sapiens__NP_940853
auggaccugaagcucaaagauugcgaguucugguacagccuucacggccaggugcccgggcuguuggacugggauaugagaaacgaauuauuucugccuuguaccacagaccaaugcucccuagccgagcagauccucgcuaaguauagggucggaguuaugaaaccaccggaaaugccccagaagcggcgcccuucuccagauggugacgggcccccuugugagccaaaucuguggauguggguggaucccaacauucuuugcccucugggcucacaggaagcaccaaaaccgaguggaaaggaggacuugacuaauauaagccccuucccucaaccaccccagaaggaugagggcuccaacuguucugaagacaaaguaguggagucgcucccuucaagcaguuccgaacagucuccacugcagaagcaagguauccauagccccuccgauuuugagcugacggaggaagaggccgaggaaccggacgauaauucacuccagaguccugaaaugaaaugcuaccagagccagaaguuauggcaaauuaacaaucaggagaaaucuuggcagcgacccccacugaacuguucccaccuuaucgcguuggcucugcguaauaacccucauugcgggcuaucaguccaagagauuuauaauuucaccagacagcacuuucccuucuuuuggacagccccagacggauggaaaagcacuauccauuacaaccucuguuuccuggacaguuuugaaaaggugcccgauucucuuaaggacgaggauaaugcaaggccucgguccugccuguggaaguugaccaaagaaggccaccgcagauucugggaggaaacaaggguucucgccuuugcucagcgggagcgcauacaggaguguaugagccaaccagaacuguuaaccucgcuguucgaccucuga

SEQ ID NO: 56395 - RNA, 1461 nt, Artificial Sequence
  derived and/or modified sequence opt3 from FOXRED1__Homo_sapiens__NP_060017
augaucagaagggugcugccccacggcauggggcggggacuccuuacccgccgaccugguacacguagaggcggguucagccuggacugggauggaaaggucuccgagauuaaaaagaaaauaaagucuaucuugccaggcaggucaugcgacuuacugcaggauacgagucaucuaccgcccgaacacagcgacguugugauuguaggugggggagugcucggccuguccgucgccuacuggcuuaaaaagcuggagucucggcgcggcgcuaucagaguguugguuguggaaagggaucauacuuauucgcaagcaucaaccgggcucagcgucggagguauuugucagcaguuuagucugccugagaacauccagcugucccucuucucugccagcuuuuuacggaauauaaacgaauaccuggcggugguagacgcuccaccccuugauuugcgcuucaauccuuccggcuaucugcuacucgccucagagaaggacgcagccgcuauggagaguaacguuaaagugcaacgacaggaaggggcaaaggucagccugaugucuccagaucagcuuagaaauaaauuucccuggaucaacacagagggaguggcccuggcuuccuacggcauggaagacgaggguugguucgauccuuggugcuugcuccaggggcugaggcggaaggugcaaucauuaggaguccuguuuugucagggcgagguuacucguuucgugagcaguucucagcgcaugcucaccacagacgauaaagccguagugcuuaagaggauucacgaaguccaugugaagauggacagaucccuggaguaucagccaguugaaugcgcgaucgugauuaaugcagccggcgcuuggagcgcccaaaucgcagcuuuggccggggucggagaggguccgcccggcacccuacaggggacuaaacugccuguggaaccacggaagcgauacguauauguuuggcacuguccccagggaccuggccucgagacaccacugguggcggacaccucgggugccuacuuucgcagagaggggcuuggcucuaacuaccugggaggcaggucccccacggaacaagaggaaccggauccugcaaauuuggaggucgaccacgauuucuuucaggacaaaguguggccccaucucgcucugcgggucccagccuucgaaacuuuaaaggugcagucagcuugggccggguauuacgauuauaacaccuuugaccagaauggaguuguggguccucacccccugguagucaacauguacuucgcaacaggcuucagugggcauggacuacaacaggccccaggcauaggucgcgcuguggcggagaugguucucaaagggagauuucagacuauugaucugagccccuuccuuuuuaccagguucuauuugggcgagaagauccaggaaaauaacauuaucuga

SEQ ID NO: 56396 - RNA, 1686 nt, Artificial Sequence
  derived and/or modified sequence opt3 from FPGS__Homo_sapiens__NP_001275732
augagcagagccaggucccaucugcgggcugcacucuuccuugccgcggcuucugcccgcggcaucaccacacagguggcagcccgacgugggcugucagcuuggcccgucccucaagagccaaguauggaauaccaggacgcaguuagaauguugaacacuuuacagacgaaugccggauaucuggaacaggugaagaggcaacggggugauccgcagacccagcuagaggcuauggagcucuaccuggcccgcagcggccuucagguagaagaccuggauagauugaacauuauacacgugacagggacuaaaggaaagggcaguaccugcgcguuuacagaguguauccucaggucuuauggucugaaaaccggguucuuuucgucaccccaccugguccaagugcgggagcgcauucgaaucaauggacagccuauuagcccagaacucuucacuaaguacuuuuggagauuauaucauaggcuggaggaaacaaaaguugaccuugcaguggucgaggugggcaucggcggggccuacgauugcaccaacauaauccggaagcccguaguuuguggagugaguuccuuggguauugaccacacgucucugcuaggcgauacugucgagaagaucgcuuggcagaaagggggaauuuucaagcagggcgugccugccuuuaccgugcuccaaccagaagguccccuggcaguccuucgugaccgcgcucagcagaucagcugcccucuguauuuguguccaaugcucgaggcccuggaagaagggggaccgcccuuaacacugggccucgagggcgagcaucaaagauccaaugcggcccuugcacugcaguuggcucacugcuggcuacagaggcaggaucggcacggggccggagagccuaaggcuucacgaccaggucugcucuggcaacugccccuugccccuguuuuccagccaacuucccauaugcgccugggcuugagaaacaccgaauggcccgggaggacacaggugcuccggcgcggaccgcugaccugguacuuagacggcgcacacacggccagcucugcucaggcguguguaagaugguuuaggcaagcacugcagggucgugagcggccuuccgggggccccgaagugcgaguccuacucuucaaugccacuggagauagagacccagcugcccugcuuaaguugcugcagccuugccaguuugauuacgcaguguucugucccaaccucacagagguuucaagcaccggcaaugccgaccaacagaacuuuacugugacacuggaccagguccuucugaggugcuuggaacaucagcaacacuggaaucaccucgaugaggagcaggcuaguccagaccuguggucugcccccuccccugaaccagggggaagcgcaucguuacugcuagcgccgcaucccccucacaccuguucugcuuccucacucguguucaguugcauaagccaugcccugcaguggauuucccaaggucgcgauccaaucuuccagcccccuucuccacccaaaggccuuuugacgcacccgguagcacauagcggggccucaauucugcgggaggcugccgcaauccacguucucgugaccggaagucugcacuuagucggcggugugcugaaacuuuuggaaccugcucucucccaguga

SEQ ID NO: 56397 - RNA, 1053 nt, Artificial Sequence
  derived and/or modified sequence opt3 from FPR1__Homo_sapiens__NP_001180235
auggagaccaacagcucccugcccacaaauaucucuggcgggacuccugccgugucagcuggauaccucuuccuugacauuauaacguaucuggucuuugcaguuaccuucguguuggguguauuaggcaacgggcuggugaucugggucgccggauuuagaaugacacacacugugaccacaauuaguuaccuaaaucucgcgguugcugauuucugcuuuaccagcacucugccauucuuuauggugaggaaggccaugggcggucauuggccguucgggugguuucuuuguaaauucgucuuuacaaucguggacauuaaccuguucggauccguauuuuugaucgcacucauagcccuggaucggugcguuugugugcugcaccccgucuggacccagaaucaucgcacggugucucucgcuaagaaagugaucauuggcccuugggucauggcauuacugcuuacuuugccaguuaucauucgagugaccacaguacccggcaagacugggaccguggccugcacauucaacuucucgccuuggaccaaugacccaaaagaacguaucaacgucgcuguggccaugcugacgguuagaggaauaauuagguuuaucauugguuucucagcgcccaugagcaucguggcagucaguuauggccuaaucgccacuaagauucacaagcaagggcucauaaaauccucucggccucugcgcgugcuuagcuuuguagcugccgcauucuuucuguguugguccccauaccagguuguggcuuugaucgccacagucagaauuagggagcuccugcagggaauguauaaggaaaucggcauagcgguggaugucaccucagccuuagcauucuuuaauaguugccugaacccgaugcucuacguguucaugggucaggacuuucgggagcgccuuauucaugcucugcccgccagcuuggaacgagcucuaacugaggauucuacacaaaccuccgacacggccaccaauucaacacugccuagcgcagagguugaacuccaggccaaauga

SEQ ID NO: 56398 - RNA, 1056 nt, Artificial Sequence
  derived and/or modified sequence opt3 from FPR2__Homo_sapiens__XP_006723183
auggagaccaacuucagcacaccccugaaugaauacgaggaaguguccuaugagucugccggcuacacuguccucagaauccuuccucugguuguguuggggguaacguuuguguuaggaguccuggguaacggccuagugauuuggguugcuggguucaggaugacccggacagugacuaccauaugcuaucucaaucuggcacuugccgacuuuucauucacagcgacccugccauuuuugaucgucaguauggcuaugggagaaaaguggccguucggcugguuucucuguaaacugauucacaucgugguagauauuaaccuguucgguagcguuuuucucaucggguucauagccuuagaccgcugcaucugugugcugcaucccgucugggcacagaaucaccgaacugugucccuugccaugaaggugauugucggaccuuggaucuuggcucugguucuaacacucccaguguuucuguuccuuaccacgguaacuauucccaacggcgauaccuacugcacauuuaauuucgcaucuuggggcgggacuccugaggagcgucugaaaguggccaucaccauguugacagcuagaggaauaauuagguucgucaucgguuuuucgcucccaaugucaauuguggccaucuguuauggccugaucgcggcaaagauucauaaaaaggggaugauaaagagcagucggcccuuacgcguucugaccgccguggucgcuuccuucuuuaucugcugguucccuuuucaacucguggcccuucugggaacgguaugguugaaagaaaugcuauucuacggcaaguauaaaauuaucgacauacugguuaacccaacuucuagccucgcauuuuucaauuccugucugaacccgaugcuuuacguguuugucggucaggauuucagagagaggcugauucacucauugcccacaagucucgaacgggcucugagcgaggacucugccccuaccaaugauacugcggccaacuccgcaucaccacccgcugagacagaauuacaggccauguga

SEQ ID NO: 56399 - RNA, 1062 nt, Artificial Sequence
  derived and/or modified sequence opt3 from FPR3__Homo_sapiens__NP_002021
auggagaccaacuucagcaucccccugaaugaaacagaggaagugcucccugagccagccggccacacuguccuuuggauauuuucccuguugguucauggggugacguucguauuuggaguguuagguaacggccuggucauuuggguggcuggguucagaaugaccaggacaguuaauacuaucugcuaccuaaaccucgcacuggccgacuuuucuuucucagcgauucuuccguuucggauggugagugucgcuaugcgcgaaaaguggcccuucgggagcuuucuguguaaauuggugcacguaaugaucgauauuaaucucuucguuuccguguaucugaucaccauaaucgcccuggaccgaugcauuuguguccuccauccugcaugggcccagaaccaccguacaaugucuuuagcuaagagagugaugaccggccuguggaucuuuacuauugugcuuacauugccaaauuucaucuuuuggaccacgauaucgacuaccaacggugauacauacugcauuuucaauuucgcauuuuggggagacacugccgucgagaggcugaacguuuucaucaccauggcuaaaguguuucuaauucuccauuucaucaucggauuuucaguacccaugagcauuauaacaguguguuauggcaucauugccgcgaagauccaccggaaucacaugauaaaaaguucccgcccucugagagucuucgcagccgugguugcuagcuuuuucauuugcugguuuccauacgagcuuaucggcauccugauggccgugugguugaaggaaaugcuccugaacgggaaguauaaaauuaucuuaguccugauuaaucccaccagcucccucgcauucuuuaacucaugucuuaauccuauacuguacguguucaugggaaggaacuuucaagagcgguugauccgcagucuaccaacgagccuggaacgagcucucacugagguaccggauucugcccagacauccaacaccgacacuacaucagcgucucccccugaggaaaccgagcugcaggccauguga

SEQ ID NO: 56400 - RNA, 5931 nt, Artificial Sequence
  derived and/or modified sequence opt3 from FRAS1__Homo_sapiens__NP_001159605
augggcgugcugaaggucuggcucgggcuugcccuggcuuuggcagaguucgccguuuuaccccaccacagcgaaggggcgugcguguaccaggacucccugcuggcugaugccaccaucuggaaaccugacucuugucaaucaugccgcugucacggugauauuguaauaugcaagccagcaguguguaggaacccgcagugcgccuuugagaaaggcgaaguccuccagaucgcugcaaaucaguguugccccgagugugugcugcggacaccugggaguugccaucacgaaaagaaaauucaugagcacggaacugagugggccagcuccccauguucuguuugcucgugcaaccacggcgaagugcgcuguacgccccaaccuugcccaccccuuucauguggucaucaggagcuggcuuucaucccugaagggagcugcuguccagucugcgugggauugggcaagccguguaguuaugagggccacguauuucaggacggggaggauuggcgacucucccguugcgccaagugucugugcagaaauggaguugcgcaguguuucaccgcacaaugccagccccuguuuugcaaccaggacgaaacaguggucagggugccugguaaauguugcccacaguguucugcccggagcugcuccgcugccggccaaguguacgagcauggggaacaguggucagagaaugcauguacuaccugcauuugugaucgcggagaagucagaugccacaagcaggcuugucuccccuuaaggugcggcaaaggucaaagucgggcccgccgacacgggcaguguugcgaggagugcguuagcccugcgggaucuuguuccuaugacggcgugguaagauaccaggaugaaauguggaagggcucagccugcgaguucuguaugugcgaccauggacaggugacaugucaaaccggagaaugcgcaaaagucgagugugcuagggaugaagaacugauccaccuugacgguaagugcuguccagagugcauaagccggaacggcuauuguguguacgaagagacuggggaauuuaugaguucuaaugccuccgagguuaagcguauccccgaaggagagaaaugggaggauggcccgugcaaggugugcgaaugucgcggugcucaggucacaugcuaugagccuagcugucccccaugcccuguggggaccuuggcccuggaaguaaaaggccaguguugccccgacuguacgucgguucauugccacccagacugucuaacuugcucucagucccccgaucauugugaccucugccaagauccuaccaagcugcuucagaacggauggugcgugcacucauguggccugggguucuaccaggcaggaaguuugugccucgccugucagccacaaugcagcacauguacuuccggucuggagugcucuagcugucagccgcccuuacugaugagacacggccagugcgucccuaccuguggggacggauuuuaccaggauaggcauucaugcgcugugugucacgagaguugcgcgggcugcugggguccaacagaaaaacauugucucgcaugccgggacccccuucacguccugcgagaugggggcugugaguccagcugcggaaagggcuucuauaaucgccaagggaccuguucugccugcgaccagucaugugauaguugcggaccuagcuccccaagauguuugacgugcacugagaaaacagugcuacacgacgguaaguguaugucugagugccccggcggguacuaugcugaugccaccggaagguguaagguuugccauaacucgugcgcaagcuguuccggcccgacuccuucacacugcacagccuguaguccacccaaagcucugcggcagggucauugccucccucgcuguggggaaggcuuuuacucugaccacggagugugcaaggccugucauagcuccugccuggcauguaugggccccgcgccaucacacugcaccggguguaaaaagccugaggagggacuucaaguagaacagcugagcgacgucggcauucccucuggugagugcuuggcucagugcagagcccacuucuaucucgaauccacggggaucugugaggcaugccaucagaguuguuuuaggugcgccggaaaaagcccacacaauuguaccgauugcggcccgucucaugugcuguuagacggucaaugucugucccagugcccugauggcuacuuccaccaggaagggucauguacagagugccaucccacuugucgucagugccacggaccacuagagagugacugcauuagcuguuauccccacaucucgcucaccaacggcaauugccggacauccugucgagaagaacaauuccugaaccuuguuggguacugcgcugauugucaucacuugugccagcauugugccgcagaccugcacaauacuggaucuauaugccucagaugucagaacgcucacuaccugcuucugggcgaucauugcgugccugacuguccaagcgguuauuacgccgaaagaggggcgugcaagaagugccacucaaguuguagaacaugccagggacggggccccuuuuccuguucuagcugcgauacaaacuugguccucucccauaccgguacuuguucaacgacaugcuucccuggccacuaucuggacgauaaucaugugugucaaccgugcaacacccacugugggagcugcgacagucaggccucuuguacuuccugcagagauccaaauaaaguauuacuguuuggagagugccaguacgaaagcugugcuccccaauauuaccuagacuucucgaccaacacaugcaaggagugugacuggucaugcucugcauguaguggcccucucaaaaccgauugccugcaguguauggacggguaugugcuucaggauggagccugcguugagcaguguuuguccagcuuuuaccaagacucuggccugugcaagaauugugauagcuacugccuccagugccaggguccacacgaauguacuaggugcaaagggcccuuccuguuacuggaggcucaguguguccaagaaugcggaaagggcuauuuugccgaccaugcaaagcacaaauguacagcgugcccucaggguugucuucagugcucccaucgcgaucgaugucacuugugcgaccacggcuucuuucucaagucagggcuguguguguacaacugcgugccgggauucaguguccauacgagcaaugagaccugcucuggcaaaauucacacucccucccuacauguuaacgggucacugauccucccaauuggaaguaucaagccucuggauuuuagccuuuugaaugugcaggaccaagagggccggguggaagaucuguuauuccacguagucuccacacccaccaacggucagcucgugcugucucguaaugggaaagagguucagcuugacaaggccggaagauuuucguggaaggaugugaacgagaaaaaggucagguucgugcauagcaaagagaagcugcgcaaaggcuauuuguuccucaagaucucagaccagcaauuuuucuccgaaccacagcugauuaauauacaggcuuuuaguacacaagccccuuacguucuacggaacgaggugcugcacaucucuagaggcgagagggcaacuauuaccacgcagaugcucgacauccgagaugacgauaauccccaggacguagucauagaaauuaucgauccaccgcugcacgggcagcuuuugcaaacccugcagagcccugcuacacccaucuaucaguuccaguuagacgagcucucccgcggacugcuucauuacgcccacgaugguucagacucuacuagcgauguggcagugcugcaagccaacgacggccauaguuuucacaacauucuauuccaggucaaaaccguuccacagaaugaucgggggcuccagcugguggcuaacuccaugguaugggugcccgaaggaggcauguugcaaaucacaaauaggauucugcaggcggaggccccuggugcaagcgcugaagagauaaucuauaagauuacucaggacuacccacaauuuggggaggucguguuacucguuaacaugcccgccgacucuccugccgaugaaggacagcaucugccggacggcaggaccgcuacgccaacaucaaccuucacucagcaggauaucaaugagggcaucgugugguaccgucauuccggggcacccgcccaaagugacagcuuucgcuucgaagucucgucugcguccaacgcucagacacggcuugagagccacauguuuaauauugccauacugccucagacccccgaagcaccaaaggugucauuggaggccagucuccauaugacugcuagagaggauggacugaccguuauccagccucacucucuauccuucauuaacagcgaaaaacccucagguaagaucguguauaauauuacacugccacuucauccuaaccaaggcaucauagagcacagggaccacccgcauagucccauccgauacuuuacgcaggaagauauuaaucaggggaaagucauguaucggccaccucccgcagccccacaccuccaggagcugauggcguucagcuucgcuggauugccugaguccguaaaguuucauuucaccgugucugacggcgaacacacuagccccgagaugguucugacaauccauuuacucccguccgaucaacagcugccaguguuucaggucaccgccccucgccuugcagugucacccggugggucuacaaguguaggacuacagguggucguuagagacgccgaaacugcuccaaaagaguuguucuuugaacucaggcggcccccucaacacggcgugcugcuaaagcacaccgccgaguuccgaagaccgauggcaacgggcgauacauuuaccuacgaggacguggaaaagaacgcucugcaguauauucaugaugggucgagcacucgcgaggacuccauggaaaucucugucaccgacggacuuacagugacuaugcucgagguuaggguagaagugucacugagcgaggaucgugguccccgguuggccgcgggcuccaguuuaucuauaaccgucgccagcaaaucaacagcaauuaucacgagaucccaccuggcuuacguggacgauaguagcccagacccugagauuuggauccagcucaauuaucugcccucuuacgggacccuucugaggauauccggaucagaaguugaggaauugagcgaggugucgaacuucacuauggaagauaucaauaacaagaaaauucgcuacucugccgucuuugagacagacggccaucuagugaccgauaguuucuauuuuuccguaagcgacauggaucacaaccaccuggacaaucaaaucuucacuauuaugaucaccccugcugagaacccacccccugucauagcauucgccgaucucauuaccguggacgaaggugggcgagccccacugucauuucaucacuucuuugcuacggaugacgacgauaaucuucagagagacgcgaucaucaaguuauccgcacugcccaaauacggauguauugagaacacuggcaccggcgaucgguucgggccggaaacagccucugaccucgaggcuagcuuuccuauccaggauguuuuggagaauuauauuuacuauuuccagagugugcaugaauccauagagccaacccacgacaucuuuagcuucuacgucucugauggaacuucaaggagugaaauucauuccaucaacauuacaaucgaggugaagacccuggaaguugguaagguggagccccucacaacuauauuucacaccauccgcgagcugagccuuuga

SEQ ID NO: 56401 - RNA, 840 nt, Artificial Sequence
  derived and/or modified sequence opt3 from FRAT1__Homo_sapiens__NP_005470
augcccugcagaagggaggaagaggaagaggccggcgaagaggcugagggggaagaggaagaggaggacagcuuccugcuccuucagcaauccguggcacugggaucuucaggugaagucgaucgguugguugcccagaucggcgagaccuuacagcuggacgcggcucagcacaguccugccagcccaugugggccgcccggagcaccucuacgcgccccaggcccccucgcugcagccgugccugcugauaaggcccgauccccagcgguaccccugcuucugccuccagcauuggccgaaacaguggguccggcucccccugggguccuccguugcgcccugggagacagaggcagggugcggggccgcgcagcuccauacuguguugccgagcuggcgacugggcccucugcccucucgccuuuaccaccccaagcagaucuggacggaccgccuggugcuggcaaacaggggauuccccagccacuuucaggaccuugcagaaggggcugguugcggggugccgcugccagccgccgacugcagcaaagaagggggagucagcccgaaacgcggaccggagaugacgauccacaucgucuacuccagcagcuggugcuuuccggcaaccugauaaaggaggcaguccgcagauugcacucuaggcggcuccaacugcgagccaaauuaccccagcgcccucugcucggcccacuuagcgcuccggugcaugagcccccuuccccaagaucacccagggcggcauguagugacccuggggccagcggacgggcucagcugcgcacaggugauggcguauugguuccagggucuuga

SEQ ID NO: 56402 - RNA, 702 nt, Artificial Sequence
  derived and/or modified sequence opt3 from FRAT2__Homo_sapiens__NP_036215
augcccugcagaagggaggaagaggaagaggccggcgaagaggcugagggggaagaggaagaggacgauagcuuccugcuccuucagcaauccgugacccugggaucuucaggugaggucgaccgguugguugcacagaucggcgaaacauuacagcuggaugccgcgcaggacaguccugcuagcccaugugccccgcccggggugccucuacgcgcaccaggaccccucgccgcugcaguaccugccgauaaggcucgaccacccgccgugccucugcuucugccaccggcguccgcagagacugucggccccgccccuucuggugcuuugcguugcgcccucggggacagaggaagggugcggggccgcgcagcuccauacuguguugccgaaguggcggccggccccucggcacugccugggccaugcagaaggggauggcugcgggaugcugucacgucacgccgacuccaacagagaagguggacccaggccggugcucgggccggcgacgaugacccccaccguuuacugcagcaacuuguguugagcgggaaccugauuaaagaggcaguacgcagacuacagagggccguugcugcgguggcagccacaggaccggcuagugccccuggccccggugggggacgguccggcccagaucgaauagcacuccagccuucuggcagccugcuuuga

SEQ ID NO: 56403 - RNA, 2148 nt, Artificial Sequence
  derived and/or modified sequence opt3 from FREM1__Homo_sapiens__XP_006716792
auggugacccaggagagcaugcugaaggccgcucucccccuuuucacaagauuuaucauuuccaacggccugaggacugaacacggggucuucgagauaacguuggaaaccguugaccgggcauuaccugugguaacacgcaauaaaggacugcgacuagcccaaggugcggugggccuccugucuccagaucuucugcaguugacugacccggauacccccgcugagaaccucacauuucugcugguccagcucccucagcaugggcaauuauaccuguggggaaccggccuuuugcagcacaauuucacucagcaggacguggauucaaagaacguugccuaucgucauagugguggggacagccaaacagauugcuuuaccuucauggcaacggacggaacuaaucagggcuuuaucgugaacggcagagucugggaggaaccagugcuguucaccauucagguagaucagcuagacaaaacagcccccaggaucacucuccugcacuccccuucucaaguugggcuucugaagaauggauguuacgguauuuauaucaccucgcggguguugaaggcuucagauccagacacagaggaugaccagauaaucuuuaagauucuccagggccccaagcaugggcaccuggaaaacaccacgacuggagaguucauccacgaaaaauuuagccaaaaggacuuaaauaguaaaacaauucuguacaucauaaacccuucccucgaggucaauucugauaccguggaguuccagauuauggacccaacuggcaacagcgcaacaccgcagauccuugaacugaaguggucccauauugaguggucacagaccgaauaugaggugugcgaaaaugucgguuugcuaccccuggagaucauccgcagaggguacaguauggauagcgccuuuguuggaauuaaagugaaccaaguaucugcugccgugggcaaggacuucacggucauaccuuccaagcucauccaguucgauccaggcaugucaaccaaaauguggaauauugcgaucacauaugacgggcuggaggaagaugacgagguguuugaaguuauacuuaacagccccgugaacgcaguccugggaacuaagaccaaagccgcugugaagauuuuggauaguaaagguggccagugucacccuucuuacuccagcaaucagucgaagcauucuacaugggagaaagggaucuggcaccuccugccacccggauccucaaguagcacuaccuccggcucuuuccacuuagaaaggcggccgcugccuagcucaaugcaacuagccguaauccgcggugacacacuccgaggguuugauaguaccgaccugucccagagaaaacuuaggacucggggcaacggaaagacgguucgucccagcucuguguaccgcaauggcacagacauuaucuauaacuaccaugggauugucucauugaaacuggaggaugacaguuucccaacccacaagagaaaagcaaaggugagcauaaucucccagccucagaaaacuauuaaggucgcugagcucccccaagccgauaagguggaaucuaccacagacucgcauuuuccaaggcaggaucagcugcccagcuucccuaaaaauugcacccuugagcugaagggauuguuucacuucgaagaggguauccagaaacucuaucaauguaacggcaucgcguggaaggccugguccccacagacuaaagacguugaagauaagucaugcccggcaggguggcaucagcacaguggauacugucacauucugauaacagagcaaaagggcacguggaaugcugccgcucaggccugccgggagcaguauuuagguaaccuggugaccguauuuucucgacagcauaugcgcuggcuaugggacaucgggggcagaaagagcuucuggauuggacucaaugaucaaguccacgcaggccauugggaauggaucgggggagagcccguggccuuuacuaacgguaggcggggcccuucccagcgcucaaaacuggggaaaagcuguguucuugugcagagacagggaaaguggcaaacaaaagacugcaggcgugcuaagccacacaauuacgucuguucucggaaguuguga

SEQ ID NO: 56404 - RNA, 9510 nt, Artificial Sequence
  derived and/or modified sequence opt3 from FREM2__Homo_sapiens__NP_997244
augcacagcgccggaacccccgggcuguccucuagaagaacuggaaacucaacaaguuuccagccugguccaccgcccccuccacggcuccuucuguuguuacugcuacuccugagccuugugucccgcguccccgcucaaccugcagccuuuggccgagcgcuguugucuccagggcucgcuggagccgcgggcguucccgccgaagaagcuaucgugcuggcaaaucguggucugagaguaccuuucgggagggaaguguggcucgacccauuacaugaucugguccuucaggugcagccgggagaccggugcgccguuucgguguuggauaacgacgcucuggcccagcgccccggcagacuaucaccuaagagguuuccaugugauuucggccccggggaaguccgguacagccaccucggagcgcgcaguccuucccgagacagagugaggcugcaacuucgguaugaugcaccagguggcgccguaguucugcccuuggugcucgaagucgaagugguguuuacgcagcuggaggucguuacccguaauuuaccgcuggugguagaggaacuccuugggacuucuaacgcucuggacgcccgcagcuuggaguucgcauuucagccugaaacugaggagugcagagugggcauucuauccggccugggugcucuccccagguacggggaacugcuucauuauccacaggucccuggaggcgcccgggagggcggggcgcccgaaacccuguugauggauuguaaagccuuccaagagcucggagugcgauaccgccacacagcagcuucaagaaguccaaauagggacuggauucccaugguuguggaacugcggagccgcggugccccugucggcucuccagcuuuaaagagagagcauuuucaggugcugguaaggauccgugggggagccgagaacaccgcaccgaaacccuccuucguugccaugaugaugauggaaguggaucaguuuguccuaacugcucucacaccugacaugcuggcggcagaggaugccgaaucaccaagcgaccuuuugauuuucaaucugaccagucccuuucagccuggccaagguuaucucgugucuacggacgaucggucccugccacuuagcucguucacucagcgagaccugagauugcucaagaucgcuuaccagcccccgucugaggauuccgaccaagaaaggcuguucgaguuagagcuggaagucguggaucuagagggggccgcaucagacccuuuugccuucaugguugugguaaaaccaaugaacaccauggcucccgucgugacacgcaauacuggccucauucuguaugaaggacagagucggccucuuaccggccccgccgggagcggaccacagaacuugguuaucuccgaugaggacgaucuggaagcagugagacucgaggucguggcgggucugaggcacggccacuuaguaauacugggggcuucuagcggaucaagugccccuaaguccuuuacaguggcagagcuugccgcuggccagguugucuaccaacaugacgaucgcgacgguagcuugucugacaaucucgugcugcgaaugguggaugggggcggacggcaccagguccaguuccuauuucccaucacccugguuccaguggacgaucagccgccugugcucaacgccaauacgggccugacucuugcagaaggggagacaguacccauuuugccacugucauuaagugcuaccgacauggauagcgacgauucccuccugcuuuucguccuggaaucucccuuuuugacuacaggacaucuccugcuacgucaaacccacccuccacacgagaagcaggagcugcucagaggucuguggaggaaagaaggcgccuucuacgagcgcacggugaccgaauggcagcagcaagacaucacagaggggcgguuguuuuauagacauucgggaccccacagcccuggcccgguuacugaucaguucaccuuuagggugcaggacaaccaugauccacccaaucaguccggucuucaacgauucgucauucgcauccacccuguggaccggcugccacccgaauuagggucaggcugcccucucagaaugguugugcaggagagucagcugacaccgcuuaggaagaaauggcugcguuacacugaucuagacaccgacgaucgcgagcuccgguauacaguaacccaacccccaacugacacggaugaaaaccaucugccugcgcccuugggaacacuggucuuaaccgacaacccaucugugguggucacucacuuuacccaggcccagauaaaucaccauaagauugcuuacagaccucccggccaggagcucgggguugcaacaaggguggcccaauuccaguuccagguagaagaucgagcuggaaacguggccccaggcaccuuuacucuguaucuucacccggucgacaaucagccucccgagauccugaacacagguuucacgauucaagaaaaagggcaucacaucuugagcgagaccgagcuccacgugaaugauguugacacugauguggcacauaucuccuuuacacugacccaggcgccaaagcacggacauaugcgggucucaggccagauucuacacguggguggccuguuccaucuugaagacauaaagcaggggcgcguuagcuacgcccacaacggagauaaaucucucacagacuccuguagucuggaggugagcgauagacaccaugucguacccaucacuuugagggugaauguucggccuguggacgacgaagucccaauucugucucaccccaccggcacguuagaguccuaucucgaugugcuggaaaacggggcuaccgagaucacagccaauguaauaaagggaacuaacgaggaaaccgacgaucuuaugcugacauuuuugcucgaggacccuccgcuguacggcgaaauucuagugaaugguaucccagcagagcaauucacucagcgagauauccuggaggggucagucguuuacacccauacgaguggagaaauuggccuucuccccaaagcugacagcuuuaaccugucguuguccgauaugucucaggaguggagaaucgguggcaauacaauucaaggggugaccauaugggugacuaucuuaccugucgacagccaggcccccgaaauuuucgugggagagcagcugaucguuauggaaggcgauaagucaguaaucacaagugugcacauuuccgcagaggacgucgauucucucaacgacgacauacugugcaccaucgugauucagccaacuagcggguauguugagaauaucuccccugcccccggaucagagaagucgcgcgcuggcauugcgaucagugccuuuaaccuuaaggaucugaggcaaggucauauaaacuacgugcagucuguccacaaagggguggagccaguagaagaccguuucgucuuucgguguuccgauggaaucaauuucagcgagagacaguuuuucccuauugugaucauuccgaccaacgacgaacagcccgagauguucaugagggaguuuaugguuauggaaggcaugucguuggugaucgauacaccaauacuaaaugcagcugacgccgaugucccucuggacgaucucacguucaccauuacucaauuucccacacacggucauaucaugaaccagcugauuaauggcaccgugcuuguugagucauucacauuagaccagaucauagaaucuaguuccaucauuuaugagcacgaugacagcgaaacucaggaggauucuuuugugaucaagcugaccgacgggaagcauagcgucgagaaaacggugcucauuaucguaauaccaguggacgaugaaacaccucgcaugaccauuaacaauggauuggagaucgaaaucggcgacacuaagauuaucaacaauaaaauucugauggccaccgaucucgacuccgaggauaagucacugguuuacauaauccgauaugggcccggacacggccuucugcaaagacggaaaccgacaggugcuuucgagaacauuacuuuggggaugaauuuuacccaggacgaagucgauaggaaccuaauccaguacgugcaccugggacaggagggcauucgcgaccucaucaaguucgaugugacagacggcauaaauccauuaaucgaucguuauuuuuacgucaguauugggagcaucgacauuguauucccugaugugaucucuaagggaguuucccugaaagaagguggcaaggugacgcuuaccacugaccugcucucaacaagugacuugaacagccccgaugagaaucuggucuuuaccauaacuagagcaccaaugcgggggcaucucgaaugcacagaccaacccggaguguccauuaccucuuucacgcagcugcagcuugccggcaacaaaaucuacuauauccacacugcggaugacgagguuaagauggauucguucgaguuucaagugaccgacgguaggaacccugucuuccgcacauuucgaauuagcauaucagauguggacaauaaaaagccgguagugaccauccauaagcuaguugucuccgaaagugagaacaaacugauuacucccuucgaauugacaguggaggauagagacaccccagauaaguuacugaaauuuacaaucacucaggugccuauucacgggcaucuccuguucaauaacacccggcccgucaugguuuuuacgaagcaggaccuuaaugaaaaccugaucucuuacaaacacgacggaacagagagcuccgaggauucauucucuuuuaccgugacugacggcacccacacagauuucuauguauuuccugacacuguguucgaaaccaggcgcccacaggucaugaagauacaagugcucgcuguugauaauagcgugccccagaucgccgucaacaagggcgcaaguacguugagaacacuggccaccgggcaucuaggauuuaugauuacuuccaaaauccugaagguagaggacagggauagccuccacauuucucuucgguucaucgugacagaagcuccucagcaugguuaccuguuaaauuuggacaaaggcaaccacucaauaacccaguucacucaagcagauauugacgauaugaagaucuguuauguucugcgugagggggccaaugcgacauccgacauguuuuacuucgcuguggaagauggaggcgguaacaaacucaccuaucagaauuuucgccugaacugggccuggaucaguuucgagaaggaguacuaccuugucaaugaagacagcaaauuucuggacgugguccucaagcgaagaggguauuugggagagacgucguucauuucuaucggcacuagggaucggaccgcagaaaaggacaaagauuuuaagggcaaagcccagaaacaggugcaauucaacccagggcagacacgcgcuaccuggagaguuaggauacuguccgacggagagcacgagcagagcgaaacauuucaagugguauuaucagagcccgugcuagccgcacuggaguucccgacugucgcuaccguugagauuguggauccuggugacgaaccaacggucuuuaucccccagaguaaauacucuguggaggaggauguaggcgaacucuucauuccuauccggcgauccggggacgugagccaggagcuuaugguugugugcuauacacagcaaggaacugccaccggcacagucccaaccucagugcugaguuacagcgauuauauauccagacccgaagaccauacuucugucgugcgcuuugauaaggacgagagggaaaaguugugucggauuguuaucaucgacgauagccuguacgaggaggaagagaccuuccacguacuccuguccaugccgaugggugggcguauuggaucagaguucccuggcgcacaggugacaaucguccccgacaaagaugacgagccaauauuuuauuucggcgauguggaauacucuguugacgagagugccggguacguggagguccagguguggagaacgggaacugaucuuagcaagagcuccucuguaaccgugaggucacgcaaaacagacccucccagcgcagaugcugguaccgacuauguuggcauaucccggaaccucgauuuugccccaggggucaauaugcagcccgugcgaguggucauccuggacgauuugggacaaccugcucuggaaggcauugagaaguucgaauuaguucuaagaaugccaaugaacgcagcccugggugagccgaguaaagccacugugucuaucaaugacagcguaucagaccuccccaagaugcaguuuaaggagaggaucuacacaggguccgaaagugauggacagauugugaccaugauacaucgcacgggcgacguccaguaucggagcucugugagaugcuacacucgucaaggcuccgcucagguuaugauggauuucgaggaaaggccuaacacagacaccucaaucauuaccuuucuuccaggggagacugaaaaacccugcauccuggaguugauggaugacgugcuguaugaggaagucgaggaacuccggcuggugcuuggaacaccucagagcaauucgccauucggugcggcaguaggcgagcagaacgaaaccuuaauucgcauccgagaugacgccgauaagacaguuauaaaauuuggggagacuaaguucucugugacggagcccaaagaaccuggagagagugucgugaucaggauuccggugaucaggcaaggcgacaccuccaaggucagcauuguucgggugcacacaaaggaugguucagcuacuuccggggaagacuaccauccaguaucugaggaaaucgaguuuaaagagggcgaaacccagcacguggucgagauagaagugacauucgauggaguucgcgagaugagagaggccuuuaccgugcaccugaagcccgacgaaaauaugauugcagagaugcagcucacuaaagccaucgucuauauugaagagaugagcaguauggcugacgugacguucccuuccguaccccaaaucguuagcuugcugauguacgaugacaccucuaaggcgaaagaaucagccgagccaaugaguggcuacccugugauauguaucacagcaugcaaccccaaguauuccgauuacgacaaaacugggagcauuugugcuucugagaauaucaacgauacccuaacaagguaucgauggcugauuucggccccagcaggaccggacggugucaccucaccuaugcgggaaguggauuucgacacauuuuucacaagcuccaagaugguuacgcucgauaguaucuacuuucagcccggcucucgugugcagugcgccgcuagagccgucaauaccaacggggacgagggacuugaacugaugagcccaauagugacuauuucccgcgaggaaggcuugugucagcccaggguaccugguguggucggggcggagccauucucagcaaagcugcgguauacaggccccgaggaugccgacuacaccaaucucaucaaacugaccguuacaaugccucauaucgacggaauguuaccggugauuaguacuagagaacuuucuaacuuugagcugacgcucagcccagauggcacccgcgucgggaaucacaagugcuccaaccuacuggacuauacagaagugaaaacucauuacggauucuugaccgaugcuacaaagaaucccgagaucauaggugaaaccuacccuuaucaauacucacugagcauuaggggcucuacuacgcuccgauuuuaucggaaccuuaaccuggaggccuguuugugggaguucguauccuacuaugacaugagugaacugcucgcugauugcgggggaacaaucggcaccgacggucagguguuaaaucugguucagagcuacgugacucuuagagucccacuguaugugucguacguuuuucacucccccgucggggugggcggauggcagcacuucgaucuaaaaucugagcucaggcugaccuuuguguacgacacagcaauuuuguggaacgauggcaucgggucaccucccgaagccgagcugcaaggaagccucuauccaacaaguaugcgcauaggcgacgagggucgucuugcuguacauuucaagaccgaagcccaguuucacgggcuguucgucuuaucccauccggcaucuuucacaagcucagugaucauguccgcggaucacccuggacugacguuuaguuugcggcucauuagaagcgagcccaccuacaaucagccaguucagcaauggucuuucgugucagacuuugccgucagggauuauuccggcacuuacacagugaagcugguuccuuguaccgcucccagccaucaggaauaucgccuaccagugacuugcaacccucgagagcccguaacauucgaccuugacauccgguuucagcaagucucugauccgguggccgcagaguucagucugaauacccagauguaccuccugucgaaaaaguccuuguggcugagcgacgguucaaugggcuuugggcaggagucugauguggcuuucgccgagggagacauuaucuauggcagaguuauggucgauccagugcagaaccucggggacagcuuuuacuguuccauugaaaaaguauuccuuugcacgggagcagauggcuacgugccuaaguauagucccaugaaugccgaguacgguugccuggcugacucaccaucuuuacuguauagguuuaaaaucgucgauaaggcgcaacccgaaacccaggccacuagcuucgggaacguguuguuuaaugcaaagcucgcuguugacgauccugaggccauacugcuagugaaccagccgggauccgacggcuucaaagucgauaguacuccacuuuuccagguggcccugggucgcgaaugguacauucacaccaucuauacaguuagaagcaaggacaaugcaaaccggggcaucgggaaaagguccguggaguaccacucucucguaucacaaggaaagccccagagcacuaccaaaucgcguaagaagcgagagauucgcuccacaccuagucuggcuugggaaauaggcgccgaaaauucuagagggaccaacauccagcauauugcguuggaccggacuaaaaggcagaucccccacggacgcgcuccaccugauggcauuuuacccugggaacugaauagcccaucauccgccgucucucucgugacgguugugggugggacaaccgucggacuucugacuaucugucuaaccgugauagcaguacugaugugcagaggcaaggagaguuuucggggcaaagacgccccuaaggggagcuccucaagcgaaccgauggugcccccacaaucucaucacaacgauaguuccgaggucuga

SEQ ID NO: 56405 - RNA, 6420 nt, Artificial Sequence
  derived and/or modified sequence opt3 from FREM3__Homo_sapiens__NP_001161707
auggccggcgcuagcagacaccccaccgggacaccuaggcagcugcucguggcacuugccugccuguuguuaucccggccagcgcugcaaggacgcgcuucuucacuagguacugagccggaccccgcccucuaccugccugcacgaggcgcccuugaugggacgcguccagacggacccaguguccugaucgcuaacccuggcuugagaguuccacucgguaggagccuguggcuggauccccuccgggacuuagugauugggguacagccuggagaucgcugugaagugaccguccuggacgcacuuccaagauugaagggcgcccuguccccgaggcgguuccccugcacauuuggcccucgccaggugcaguauacucauuucgggucucacucgccaggacgagcuagaguucuacuccaacugagguacgaugcccccacccauacacuugugcugccuuuuaccuuggcggucgaccucguguucucacagcuggaguuaguaacucggaaucguccacugguuguggaaaaacuccgcagcuggaguagagcaauagauaggcggguccuugacuuugccucccugaagucuggugcuacagccacccgacgcuguagauugacgccccuaccgcacgaggauggcccucugcccaaauaugggaggcucguggacgcagugggagcuccacugccucggggcaagggugucgauugcgaagccuuccuucgcgcggggguuagauaccagcauacugccaccagcucccccaacagggacuaugugccaaugaugguagagcuguugggacccgagggccaggacgcaggcucagcuggggugcucguccgugaacacuuucaacuguuagugcggauccgaggaggugccgagaauacaccuccaagaccgaguuucauggcuacuaugaugauggaaguugauccccuggugcuaaccgcccucacaccugacgcacuggccgcugaggaugucgagagcgacccaggcgaucuuguguuuaacauuuugaaugcgcccacccacccuccagggcaucccggacagcagggcuacguaguuucuacggacgauccgcugggucucccuguguccuucuuuacucagcaagaacugagggagcuuaaaaucgcauaucagccacccgccgaaaacucacacggggagcgccuguuccaguuggaacucgaggucguggacggcgauggagcugccagcgacccuuuugcauucauggucacagugaagaguaugaauacccugguucccguggccucucauaaccggggcuuaguacuguucgaggggcaauccagaccacuaagcucgacucacucuauuccuaucuccgauaaggacaaucucgaagaggucaaaauggcugccgugaggggacugcgccacggucagcuuguuguguuuggcgcacccgcgggguguaaguacuucacaccagcugacuuggccgcaggacgagucguguaccagcaugauggcucaaacaccuauagugacaauauaaucuuucggauggaagauggucaccaucagguagacuuccuguuuccgcucacgauucugccuguggaugacgagcccccaaugguuaacaccaauacaggguuaagccugacugaaggccaagucgugcagaucucccccuucgugcuuucugccaccgauauugacagcgaggauucaacaauccacuuugucuuggagaaccagccucucaaaggaaaugaagaggaaccacagugggagcuggcucccggcaguucccauagcgggcacuaccuaggagaccugcuccugcaacaggccgaacuuccuuugucuacugaggaugaggacuggcacuauauggaaaaggagggucuguacgaaaaaguugugaccgagugguuacagcgugauauaauggagggcagacucuucuauaggcaucuggggccgcacucaccacagagugugaugguacaacuugcauuucauguccaggacgaccacgaucccccuaaccugagcaagcagcacauuuucacaaucaaggugcagccaguugacauuuuguccccccaacucuacccuggaaccacucuggaaaugacggugcaggaguaucagcuaacacauuuucaaaaaaacuuccugcgcuacaucgaucaggacucugaugaccagaaucucugguacacccugcuuacuuugccgaccgauacagacggcaaccaccagguccgggcuggugaaaucgugcugaccgauucgcccgacacuuuaauuaugcauuuuacacaagcccagguuaaucagcacaagguggcguaucagccaccucaaaaacucgggauagcccccagaguaguccaguucacguaccagguggaggaugcugcaggcaacagcgugccaggaaccuucacucuguuucuucagccugucgacaaucaacccccagaaguuacaaacaggggcuucgccauccuggaggggggauccuuuaaucuaucaaguaacgagcuccaugugaccgauccggacacagacauugaucagaucguauucauacuggugcgaggcccucagcacggucacuugcaauauuuuaagcgcugcaugguccccggggaaucuuucaugcaggcugacgugauuaauggaagcguuuccuaccagcauggccgggaucagacuaccacgucagacaccuuucaccuggaggugagcgaugguguccaucacaucccaaucacaauucccaucucugugcauccuaacguugccaauagauccccaaggauuaguuuacguagcucuucccuccuggacgugucaauagauguccuugaaaacaaagcaacugagaucaccaugggcguaauucacgggaagcgcaaagacgugggagaucugauguugaguuucaucguuaaggacagccccaagcucggcacaauccuggugaaugggcuaccuacugaacgguuuacccaagaggaucugauuaacggaagagucgcguaugcccacacggcuggcgagguggguuuccagaaacagcaugacgccuuuucgcuuauacucuccaaggacucuuaccaguggguaguggggaauagcaucauugaaaaaguccaaguucaggugacagugcugccggucgauaacgugggaccaaagguuuucguaggcgagucauuuaucguguaugaaggugagaaaaacaguuugacccugcagcacuuacaugucgaagacguggauacucaccaggacgagcuccuguguacaguuaccucccaacccgcaucuggcuaccuugagaagauugcuagcgccccuggguccaagaugucacagagcggaagucccaucucugcauucucccugagggauauacaggugcgacacaucaauuacguccagagcauucauaaaggcguggaaccacaagaggaccaguucacuuuuuauugcucggaugggaucaacuucucaccuaauguauuuuuccccauuaucauauugccaaccaacgacgaacagccuaagcucuuugcccacgaguucaaaguccuggagggaaugucucuagugauugauacacaacugcuuaauggcgcugacgcggaucucccgcccaacgaacugcauuuucaguugacggccuuaccacggcacggucgcaucauucagcagcuggcaaccgggagucaaccuauccauuccuucacucucaaggagauacaggaagcuagcacaaucguuuacgagcacgacgauucugaaaccaaagaggacagcuuugagguguggcuguccgacggaaagcacacaacucauagaaagguccccauugugguuacccuuguggaugacgaaacgccacaccugacagucaauaacggcuugaaaguggagaagggucauucagaaaucauuaccaauaggauccuaaaagccacugaucuggacagugaugacaagagccucucuuucguacugcacuccggcccucagcaggggcuuuuacaacggcugcgaaaacccagaggagaggugcgcaacaaucucaccuugggcaugaacuuuacacaggaugaaauaaauagggggcugauuuguuauauccacacuggacaggagggcaucguugacauuaucaaguucgaugucaccgacggugugaacacacucacggaucauuacuucuaugugaccauugggaaucuggacucagucuuuccggagguaauaaguaagcguaucacucuuauugaaggagcccgggugacacugaccaacaacuugcuaacuaauagcgauaucaacuccucugacgagcaccauuucucgauuacaagagcuccaagccugggccaccucgaaucauccgacuacgcaggcgagccuaucgccaguuuuacccaguuacaacuggcgucuaauaaaauaagcuauguucauacguccaacgaugaaaagaaaauggacucauucgaguuucaggugaucggggagcuuuaccccgucuucaggacuuuucgcauuuucaucaccgauguggacaauaagaaaccaauucugacaauccaccgacucaccuugcagaaggaagauucucaacugauaacucuccuggagcuuacaguugaagacagcgauacccccgacgaucuaauucuguuuacaaucacucaggugccuaugcacggaaaaaucuuguacaacgguaguagaccggucaccacguucacaaagcaggacuuaaauaagaaccugauuuccuauaaacaugauggcagcgagaccacugaggacucuuuuucacucaccgugacagacgggacucacaccgauuucuacguacugcccgacacggcucuugccacacauaagccacaggugaugcggguucaaauaaggucccuggauaaucgccucccucagaucaccacuaaccguggagcacccgccuugaaaagacugcacacaggccacauggguuuucuaauuaccaguaagagccugaaagcugaagaccaggauucgccucaucggcuccuuaaguauaaggucacuagggggccagagcacggauucaucauuaaaacaggccugggcaaucagucuacccgcguguucacgcaagcagacaucgaugaaaugaagauauccuacguguuaaacgaggggagcaaugccucaaaagacaucuuuuauuucagugucgaagauaacggagguaauaaguugacuaaccagcccuuucaucugaacugggcguggauuugccucgagaaagaguacuauaucguugacgaagauucuaccuuccuggaggugacacuuacccgaagaggcuaccugggggaaacauccuuuauuagcaucggaacuaaggacgagaccgcuaagaaagauaaggacuucaaauggaagacgaauaaacagauacaguuuaacccuggccaaacaacugccaccuggcggguaaggauuaucccagacaaugaauacgagacaucagagaccuuccagaucauucucagugaacccuugauggcagugcuggaguuuccggaaauggccacugucgagaucguggauccuggugacgaaagcaccguuuauauaccagaggcugaguacaagauugaagaggauaucggggaauuacuaauucccgugcgcagauccggagacgccucucaggagcugaucgucauauguagcacaaggcagggcuccgcaacgggcacuauuucaucuaccguacucuucagugauuauaucucgcggccugaggaccacacaagcauccuucauuuugauaagaacgaaacccaaaaaacuugccaggugcugauuaucgacgauuccuuguacgaggaagaggaaucuuucucaguuagccugcgucucccaguggggggacagcugggugcucgcuuucccacaaccaaggucacgauucuugccgaccgauaugaugagccggugcuccacuucggcgacgcggaguaccacgucaaugaauccgccagauauguggagguuugcguguggaggcgggggacugaccugagucaaccuucuagcauagcaguacgcucaagaaaauccgaacaggagagugcugaagccggaacagauuacgugggcaucagcaggaacuuggacuucgcucccgguguccggaugcagaccuuucagguuaccauucuggaugacuuagggcaaccaacucuagagggaccugagaaguucgaacugcuccuucagaugcccaugggcgcagugcugggcgagccaaauaaaacaaccaucuuuaucgaagauacaauuacugacuguaagcagucugccugcuccucauucgauuga

SEQ ID NO: 56406 - RNA, 777 nt, Artificial Sequence
  derived and/or modified sequence opt3 from FRG1__Homo_sapiens__NP_004468
auggccgaguacagcuaugugaaguccaccaaacugguccucaagggcacaaaaacuaagucuaaaaagaagaaaucaaaggacaaaaagagaaaaagggaagaggaugaagagacgcagcuugacaucguugggauuugguggaccgugacaaacuucggagaaauaagugguacuaucgcuauugagauggauaagggcaccuacauccacgcacuggacaauggguuguuuacauuaggagcgccccauaaggagguagaugaaggcccuagcccaccggagcaauucaccgccgugaaacuguccgacucucggauugcucuaaagucggguuaugggaaauaccucggaaucaacucagauggccuggucgugggccgcagcgacgccauagggccccgagaacagugggagccuguuuuucagaauggaaagauggcacuucuggccaguaacuccugcuucauccguuguaaugaggcuggugauauugaagcaaaaucuaagacugccggcgaggaagagaugaucaaaauuagaagcugcgcugaaagggagacaaagaagaaagacgauaucccagaggaagacaaggggaacgugaaacagugugagauaaauuaugucaagaaauuucaauccuuccaggaucacaaguugaagauuucaaaagaagacaguaagauccucaaaaaggcccggaaagacggauuucugcaugagacccugcucgaucgcagagcgaaguuaaaggcagacagguacugcaaauga

SEQ ID NO: 56407 - RNA, 837 nt, Artificial Sequence
  derived and/or modified sequence opt3 from FRG2__Homo_sapiens__NP_001005217
augggcaaggggaacgaggacagcgaucugcacugcuccucuauccaguguucaaccgaccaacccccuuuccagcagauuaguuuuacagaaaaaggaagcgaugagaagaaaccauucaaggaaaaagguaagacugccuuuucccauucuucggagaagcacauacagagacaaggcucagaaccgaaucccaacaaagagaauagcgaggaaacgaagcucaaagcugggaacaguaccgcaggauccgagccugaaucuagcuccuacagggagaauugccggaagcgcaaaaugucaaguaaggacagcugucaggauacagccggcaacugcccagagaaggaauguucucuuucccugaauaaaaagucacgaagcaguacugcggugcauaacucugagauccaggaaaccugcgacgcucaccaucguggucacuccagagccuguacagggcacagcaaaaggcaucggucgcgcgcauugggaguccagacccccucuauuagaaaguccuuaguuacuucagugagggccaugagugaggcuguauaucaagaucuggcacaggugugggcccagcagauccacagcccucuaacaugcgaacaacucacccugcuuacgcggcugcgcggcccauugugugcucagguccagacucucuacuccauggccacccaagcggcauauguguuccccgccgagucuuggcugguuccugcuacacugccaggcccgggggagagcgcccucgaccgagaagcacaucccuuuccuggacaggagauuacugaaaccgugucagguagugaugaggcuaaauuauga

SEQ ID NO: 56408 - RNA, 1518 nt, Artificial Sequence
  derived and/or modified sequence opt3 from FRK__Homo_sapiens__XP_011533957
augagcaacaucugccagagacugugggaguaccucgaacccuaucuuccuugucuguccaccgaggccgacaagucuacagugauugaaaauccaggcgcuuugugcucaccgcaaagucagaggcacgggcauuacuucgucgcauuauuugauuaucaggcccggacugcggaggaccugagcuuccgcgcuggagauaagcuacagguucucgacacgcugcacgaagguuggugguuugcccgacaucuugagaagcguagagauggcuccucucaacagcugcagggguacauacccucgaacuauguggcagaggacaggucauugcaggccgaaccuugguucuuuggagcuaucggccggagcgaugcagagaaacaacuccuguacagugaaaauaagaccgguuccuuccugauucgcgagucugagagccagaaaggggaauuuucccucucaguauuagacggagccguggucaagcacuauagaaucaagaggcuggaugagggcggcuucuuucuuacacggcgccgaauuuucaguacuuugaacgaauuugugagccauuacaccaaaacaucugacgggcuguguguuaagcuaggaaaaccaugccucaagauccaggugcccgcuccuuucgaucuguccuacaaaaccgucgaccagugggagauagauagaaauucaauccaacuucugaagagguuggguagcggccaguuuggggaagugugggagggacucuggaacaauacuacaccaguagccguuaagacccugaaacccggcaguauggacccuaacgacuucuuacgggaggcgcagauuaugaagaaucugcgucacccaaaacucauccaacuuuaugcaguguguacgcuggaagauccgauuuacaucauaacugaguugaugcgccacgguucucuacaggaauaucugcagaacgacaccggguccaagauucaucucacacagcaagucgauauggccgcucagguggccagcggaauggcauaccuggagucgagaaauuauauccacagggaccuugcugcccggaacgugcuggucggcgaacauaauauuuacaaaguugcggauuucggcuuggcccgaguguuuaagguagacaacgaggauaucuaugagucucgccacgaaaucaaacuccccgugaaguggacugcaccugaggcuauuagauccaauaaguucucaauaaaaagugacgucuggagcuuugggauccuguuauacgaaauuaucaccuacggaaagaugccauauuccgguaugacaggcgcccaggugauacagaugcuggcucaaaacuacaggcuaccccagccuucuaacugcccacagcaguucuauaauauuaugcucgaguguuggaacgccgaacccaaagagcggccgaccuuugagacgcugcgcuggaaacuugaagauuacuucgagacugacagcucauauagugaugcaaauaacuuuaucagauga

SEQ ID NO: 56409 - RNA, 1671 nt, Artificial Sequence
  derived and/or modified sequence opt3 from FRMD3__Homo_sapiens__NP_001231888
auguucgccagcugccacugugugcccagaggcaggcggaccaugaagaugauccauuuucgcuccucuucagucaaaagucugagccaggagaugcgaugcacaauucgucuccuugacgauuccgaaauaucuugucacauccaaagagagacuaaggggcaguuccugauugaccauaucugcaacuacuauucguuguuagaaaaagauuacuuuggaauuagguauguugacccugagaagcagcggcacuggcuggaaccaaauaaaucaaucuucaagcagaugaagacgcauccgcccuacaccauguguuuucgcgugaaauucuauccucacgagccacuaaagauaaaagaggaacucacaagauaccugcuuuaucugcaaaucaagagggauauuuuucacggucgguugcucugcagcuucagugacgcugcauaccugggcgccuguaucguacaggcggagcugggggauuacgaccccgaugaacauccugagaacuauauuuccgaguuugaaaucuucccaaaacagucucagaagcucgagcgcaagauaguggaaauucacaaaaaugaguuacgaggacaaagcccuccugucgcugaauuuaaccugcuuuugaaggcccauacucuggagaccuacggcguggacccacacccgugcaaagauuccacagguaccacuacauuccuaggguuuaccgcagccggauucguuguguuccagggcaauaagagaauccaccucauuaaauggcccgacgucuguaagcugaaauuugagggcaagacguucuaugugaucgggacucagaaggagaaaaaggcuaugcuugcauuucauaccucaacacccgccgcuugcaaacaccuguggaaguguggaguagagaaccaggccuucuacaaauaugcgaagaguagccaaaucaagacuguuucuuccucaaaaauauuuuucaaggguagcagguuucgguacaguggcaaaguggcaaaggaagucguggaggccucuuccaaaauucagcgugaaccacccgaggugcaucgcgcuaauaucacccagagcagaucgucucacuccuugaacaagcaacucauuaucaauauggagccucugcagccauuacugcccucaccgagugaacaggaggaagaacucccucuuggggaaggagucccccugccaaaggaggagaacauaagcgccccuuugauuuccucuagccccguuaaagcagcuagggaauaugaggauccacccucagaagaggaggacaagaucaaagaggaaccucuaacaaucagugaacugguguacaauccauccgccagccuccugccgacccccguagacgaugacgagauugauaugcuuuucgacugcccuucucggcuggaauuggagcgagaggauacggacucauuugaagaucucgaggcggacgaaaacgccuuccugaucgcagaggaagaggaguuaaaggaagcucgcagagcccugaguuggagcuacgauauucuaacuggccauauaagggugaauccacucgucaaauccuuuucucggcugcuugugguugguuuggggcugcuccuguucguguuuccccuucuguugcuccuguuagagucggucagcaugcaguga

SEQ ID NO: 56410 - RNA, 3120 nt, Artificial Sequence
  derived and/or modified sequence opt3 from FRMD4A__Homo_sapiens__NP_060497
auggccgugcagcugguccccgacagcgcucucggccuucugaugaugaccgaggggagaaggugccaaguucacuuguuagaugaccggaagcuggaacuacucgugcagccuaaacugcuugcaaaggagcuguuggaucucguagccucccauuucaaccugaaagaaaaggaguacuuuggaaucgcguucacagacgaaacuggucaccugaauuggcuccaguuagaucgccgagugcuggagcaugacuuuccgaaaaagucuggcccagucgugcuuuauuucuguguucguuuuuacauugagucaauaaguuauuugaaggauaacgcuacgaucgaacuguucuuucuaaaugccaaaagcugcauuuacaaggagcucaucgacguggauuccgaagucguguucgagcuggcaucuuauauucuucaggaggccaaaggggacuuuucgucaaacgaaguaguuagaagcgaucugaagaaauugcccgcucucccuacccaagcacugaaggagcacccaaguuuagccuacugugaagacagggugaucgagcauuauaagaaacugaauggacagacacggggccaggcuauagucaacuacauguccaucguggaaucucuccccacuuacggugugcacuauuacgccgucaaggauaaacaggggauuccuugguggcuuggacugagcuauaagggcaucuuccaauacgacuaucacgacaaaguuaagccacgcaaaauuuuucaguggagacaguuggagaaucuauacuucagggagaagaaguuuuccguggaaguacaugauccccggcgcgcgucagugacccgaagaacauucggccacagugggaucgcaguccauaccugguaugccugcccugcucugauaaaaagcauuugggccauggcaaucucucagcaccaauucuaccucgacaggaagcaguccaaaucaaagauucacgcugcccggagccugagugagaucgcgaucgaucuuacugaaacaggaacccugaaaacgucuaaguuggccaacauggguuccaagggcaaaauuauaagcgggucgucuggaucccuccugucaaguggcagccaggaguccgacucuagccaaucagcaaagaaagauauguuagcugcccugaagagucgucaggaagcucuagaggagacucuccgccagagacuggaggagcuuaaaaaguugugucugagggaagccgagcucaccgguaagcugccaguggaauacccgcuugaccccggggaggagccuccaaucguucggcgacgcauuggaacagcauuuaaacuggaugaacagaagaucuugcccaaaggcgaggaagccgagcucgagagacuggaaagggaguucgcuauacaaucccagauuacugaagcggcacggcgcuuagccagcgacccuaaugugucuaagaaacugaagaagcagagaaaaaccucauaucuaaacgcucucaagaaacugcaggagaucgaaaaugccaucaacgagaauaggauuaagaguggcaaaaagccaacacaacgugcaagccuuaucauugaugacgggaacauagccuccgaggauucuucguugagcgacgcucugguccucgaagacgaggauucccaggugaccucaacgaucaguccccugcauucuccgcacaaaggauuaccuccccggccaccuagccauaaucgacccccacccccucagucccuggaaggucuuagacagaugcacuaccauaggaacgacuaugauaagucaccaauuaagccgaaaauguggagcgagucuuccuuggacgaacccuacgagaagguuaaaaagcgcaguagccacucucacuccucaagucauaaacgguuuccuagcacuggcucgugcgccgaggcagggggaggcuccaacucucuccaaaauagcccaaucagaggucugccccacuggaacucacagaguuccaugccuucuacaccagaucuaaggguacgcagcccccauuaugugcacuccacccgaucagucgacaucagcccgacucggcugcacagucucgcgcugcauuuccgucacagaucuuccagccuugaaucgcaggggaaguugcugggcucagagaaugauacaggaucuccugacuuuuacaccccaaggacgcgcaguuccaacggcagcgaucccauggacgauuguucuagcugcaccucccauucaaguagcgaacacuauuacccugcucagaugaaugccaacuacucuacauuagcagaggacucccccucaaaggcccggcaaagacagaggcagcgacaacgcgcugccggggcacucggaagugcuagcuccgguucuaugccaaaucuggccgcgcggggcggggccggaggcgcugguggggcaggcggaggcguguaucuucauucgcagagccagccuucaucccaguacagaauuaaagaauauccccuguacauagaagggggagccacuccagucgugguuaggaguuuggagucugaucaagaaggucacuauagcgugaaggcucaguucaaaaccuccaacucauacacagccggcgggcucuuuaaggagucuuggcguggaggcgguggggacgaaggcgacacuggacgccugaccccgagccggagucagauccuaagaacaccuucccugggcagggagggggcacacgauaaaggagcgggccgagccgcuguaagcgacgagcuccggcagugguaucaacgcucuaccgccucacauaaggaacacuccagacugagucauacuagcucgacgucuuccgauagcgguucacaguacaguacaucuucccagagcaccuucgucgcacacucaagggugacucggaugccccagauguguaaggcuaccagugccgcacuuccacaaagccagcgauccucuacacccagcuccgagauuggggccaccccuccaucaucuccccaucacaucuugacuuggcagacaggagaagcuacggagaauaguccuauucuggacggcucggaaagcccgccacaccaauccaccgaugaguga

SEQ ID NO: 56411 - RNA, 3105 nt, Artificial Sequence
  derived and/or modified sequence opt3 from FRMD4B__Homo_sapiens__NP_055938
auggccagcguguucaugugcggcgucgaggaccugcucuuuuccgggucuagauucguuuggaaccuuaccgugucaacacugaggcggugguacacugaacgcuugcgagcuugucaccagguauuacguacguggugcggacugcaagauguguaucagaugaccgaggguagacauugucagguccaccuacucgacgauaggcggcuggaacuucuggugcagcccaaguugcucgcacgcgagcugcuggaccucguugccagucauuuuaauuuaaaagaaaaggaguacuucggcaucacauuuauugaugacacugggcaacagaacuggcugcagcuugaucacagaguguuggaccaugaucugccuaaaaagccaggaccgaccauacuacacuucgcggucagguuuuauaucgagagcauuuccuuccucaaagacaagacaaccguggaacuguuuuuccuuaaugcuaaggccugcguacacaaaggccagaucgagguugaaucugagacuauuuuuaagcuggcagccuucaucuugcaagaggcuaaaggugauuacacaucggacgaaaacgcacggaaggaucucaaaacccugcccgccuuuccuacgaagacuuuacaggagcauccaucacuggcuuauugugaagaccgcgugauagagcacuaccucaagaucaaagggcuuacccgaggacaggccgucgugcaguauaugaagauuguggaagcgcugcccacauacggcguccauuacuaugcaguuaaagacaagcaaggcuugccuugguggcuagggaucagcuacaaaggaauuggucaguaugauauccaggacaaggugaaaccaagaaagcuguuccaauggaagcagcucgagaaucuguacuucagggagaaaaaguuugccguagaagugcacgauccccggcguauaagugucucccgcagaacuuucggccagucugggcuuuuugugcagaccugguaugcuaacagcucccugauuaaaucaaucuggguuauggccauuagucaacaccaguucuacuuggacaggaagcagagcaaagcaaagaucccuucugcucggucccucgaugagaucgccauggaccugacagaaaccggaacgcagcgagcgucaaaguuagugacucuggaggccaaaagccaauuuauuauggcaaguaauggcucucuaauauccagcgguucgcaggauucugaagucuccgaggagcagaagcgcgagaaaauccucgagcugaagaaaaaggaaaagcuguugcaggagaaacugcucaagaaaguggaagaacugaagaaaauuugccuuagagaggcugaacugacagggaagaugccaaaggaguauccguugaacaucggagaaaaacccccucaaguaaggcggcgcguuggcaccgccuucaagcucgacgauaaucuguuaccaucagaggaggaccccgcucugcaggaacuagagaguaacuuucucauacagcagaaacugguggaagccgcaaagaaacuugccaaugagccugauuuguguaagacugucaaaaagaagagaaaacaagacuacacagacgcuaugaagaaacugcaggaaauugagaacgcgaucaaugaguacaggauccguugcggcaagaaaccaagccagaaggcaaccgugcuccccgaagauauuaucccguccgagucuagcucacugagugacacgaccacauaugaugacccuuccgaugccuucacuuuucccgggcaacgguccucuucagucccacauaguccucgaauuuuacccccaaagagccugggaauagaaagaauccacuucaggaaauccucuauuaacgagcaguuuguggacacccgccagucgcgggaaaugcuuagcacacauuccucacccuacaagacuuuggagagaaggccucaggguggccgcaguaugccaaccacaccgguucucacccgaaaugcuuauucuagcucccaccuggagcccgaaucaagcucucaacauugucggcagcguuccgggagucuagagagccagucucaccuucucuccgaaauggauucagacaaaccuuucuuuagucugagcaagucgcagagauccucuagcacugagauccuugaugacggaucaaguuacacgucccaaucuagcacagaauauuacugcgugaccccaguaacuggccccuauuacaccacacagaccuuggauacuaggacacgcggucggagaagguccaaaaagcagaacgucucaacgagcaacagugggucuaugccuaaucuggcccagaaggacuccuuacgaaacggcguguacagcaaaucgcaagagccacccucaucuaguuauuacaucgcaggauauaccccguacgccgagugugauuucuauuacuccggcggguauguuuacgaaaaugacacugagggacaguacagcgugaacccuucuuaucgcagcuccgcucacuacgguuaugaacggcagagagacuacucaaggaguuuccaugaggaugaggucgaccgugugccacacaaucccuaugccacacuccgccugccucggaaggcagcggcuaaaagcgaacauauuaccaagaacauacacaaagcccuuguagcagagcaccugagaggcugguaccaaagggccucugggcagaaggaucagggacauagcccccagacaucauuugacagugaucgaggcagccaacggugcuuggguuucgcugggcuccaggugccaugcuccccuucuucgcgcgccagcucauauuccaguguuucuagcacuaaugcauccggcaacuggagaacccagcugacgaucggacuaucagacuacgaaacccccgcucacucuagcuacacaaguuguuauggcaaugucuacaacccacugccguccccuagcaggcaguauacugagauuucucaacucgaugggaccgacggaaaucagcuggaagauaaccuugagucauccgagcagcgguuguuuuggcaugaagacaguaagcccgguacacugguguga

SEQ ID NO: 56412 - RNA, 1245 nt, Artificial Sequence
  derived and/or modified sequence opt3 from FRMD5__Homo_sapiens__NP_001273419
augugcuucagagugaaguuuuaccccgccgacccugcugcacugaaagaggaaaucaccagguaucucgucuuccuucagauuaagcgggaucuguaccacggccgcuuguuauguaaaacaagcgacgccgcgcugcuagcugccuauauacuccaagcagagaucggggauuacgacuccggaaagcauccagaagguuauucuucaaaauuucaguucuuuccgaagcacagugagaagcuggaacgaaaaauugccgagauccauaagacugagcuuagcggccagacgcccgcuaccuccgaacugaacuucuugcguaaagcacagacacucgagacuuacgggguugauccucacccaugcaaggacgugucuggaaaugccgcuuuucuggccuucacccccuuuggcuucguagugcugcaagguaacaaaagaguccauuuuauuaaguggaaugaagugacaaagcucaaauucgaggggaagaccuuuuauuuauacgagaaaaagaucauacugacuuacuucgcgccuacaccagaagcauguaaacaccuuuggaagugcggaaucgagaaccaggccuucuauaaauuggaaaagucgucacagguuaggaccgugagcaguuccaaucuguuuuucaagggcucucgguuucgcuacagcggcagagucgcuaaagaggugauggaauccucagccaagauuaaaagggagcccccugagauccaccgggcagggaugguaccaagucgcagcuguccgucuauuacgcauggaccccgacuauccucaguuccuagaacuaggcggcgugcugugcacaucagcauaauggaaggucucgagagucugcgcgauucugcccauuccaccccagucagaagcacaucgcacggcgacacuuuccuuccccacgugaggucuucccggaccgauucaaacgaacgaguggcggucauugccgacgaggcauauaguccugcugauagcguucugccaacacccguggccgaacauuccuuggagcucaugcuguuaucucgccagaucaauggggcuaccugcagcauugaggaagagaaggaaucagaggccaguacgccgacugcaacagaaguagaggcccugggaggcgagcucagagcucuuugucaaggucacuccgggccugaagaggaacaggcgauggugugccugcagaaccccuugagcggagagccagcacauuga

SEQ ID NO: 56413 - RNA, 795 nt, Artificial Sequence
  derived and/or modified sequence opt3 from FRMD6__Homo_sapiens__NP_001253976
auggaccagcuggagaagagaagcagggccuccgggucuucagcuggcaguaugaaacacaagcggcucagccgccauuccaccgcaucucacucgucaagccauacaaguggaaucgaagccgauacuaaaccccgagacacggguccugaggauuccuacucuagcuccgcgauucaccguaaacuuaagaccugcucaaguaugacaagccaugggucuucccacacuucaggcguggaaagcggaggcaaggacagacuggaggaagauuugcaagacgaugagauagagauguuagucgacgauccaagggaccuggaacagaugaacgaggaaagucuagagguuucuccggauauguguaucuauauuaccgaggacaugcucaugucccggaagcugaauggucacagcgggcuuaucgugaaagaaauuggaucgucuacauccucaaguagcgagaccguagugaagcugcgcggccaguccacugauucuuugccccagacaaucugcagaaaaccuaagaccagcacggacaggcauucacucagucuggacgauauacggcuguaccaaaaagacuuccuccgcaucgcuggcuuaugucaggauacugcccaguccuauaccuuugggugcggacacgaacuggacgaggaaggucuuuacuguaacagcugcuuggcacagcaauguauuaauauccaggaugccuucccagucaagcgaacaucuaaguauuuuucacuggaccuaacucaugaugaggugcccgaguucguuguguga

SEQ ID NO: 56414 - RNA, 2145 nt, Artificial Sequence
  derived and/or modified sequence opt3 from FRMD7__Homo_sapiens__NP_919253
augcugcaccucaaggugcaguuccuugacgauagccagaaaaucuuugucguugaccaaaaguccucuggcaaagcccuguucaacuugucaugcagucauuuaaaucuggcugagaaggaauacuuugggcuagaguucuguagccacuccggaaacaauguguggcucgaacugcuuaaacccauuaccaagcagguaaagaacccuaaagagauaguguuuaaguucauggucaaauuuuucccaguggauccgggucaucugagagaagaguugacaagguaucucuuuacucugcagaucaagaaagaccuggcacucggccgguuacccugcucugauaauuguacggcccugaugguuucgcacauucuucaaucagaguugggggacuuccaugaagagaccgaucgcaagcaccuggcgcagacacgauaccuaccuaaccaggacugccucgaaggaaagaucaugcacuuucaucagaaacacauuggccguagcccagcugagagugauauccugcuucuggacauagccagaaaguuggauauguaugguaucaggccccauccugcauccgacggggagggaaugcaaauucaccucgccguggcucacaugggcguccugguguuacggggcaauacuaaaaucaacaccuucaauugggcaaagauucgcaaacugucuuuuaagagaaaacauuuccucaucaagcugcacgccaacauacugguauuguguaaggauacacuagaguucaccauggcuagcagggacgccugcaaagcguuuuggaagacuuguguugaguaccaugcauucuuucggcuguccgaagaaccaaaaucaaagcccaaaacacuccugugcaguaaggggagcucuuuccgcuauuccggacgaacccagagacagcuucuggaauacgguaggaagggccgguugaaaucacucccuuuugagcguaagcacuauccaagccaguaccaugagcgccaauguagaaguucuccggaccuguuauccgaugugagcaaacaggucgaagaccugaggcuagccuacgggggaggcuauuaccagaaugugaacggugugcacgcuucggagcccguccucgaaucucggcgacgcaauuccgcccuggagguuacguucgcaacugaacuugagcacucaaagccugaggcugauccaaccuugcugcaucaaagucagagcuccucuagcuuucccuucauuuauauggacccuguguuuaacacagaaccaaaucccaacccggauccuagagacaucuucucagagaggaguucccucagcucuuuucagacuucaugcaaauucagugggaaccacaugagcauuuacuccggacugaccucuaagguacggcccgccaagcagcuuacauauaccgaugugccauacaucccuuguacgggccaacaggucggcaucaugcccccacagguguuuuucuauguugacaaacccccucaggugccacgcuggucgccgauuagagcggaagagaggacuagcccccauuccuacgucgaaccuacagccaugaagccagcagagcguucaccccggaauauacgaaugaaaaguuuccaacaggaucuucagguguugcaggaggcuaucgccagaaccucugggaggagcaacauuaauguaggacucgaagaggaagacccuaaccuggaggaugcuuuuguuugcaauauccaagagcagacuccaaagcgcucccagucacagagcgacaugaaaacaauacgguuccccuuugguucugaguucagaccguuaggcccuugcccagcccugucccacaaggcagaccuauuuaccgauauguucgccgaacaagaacuccccgcugugcugauggaccagaguacggcggagagguacgucgcaagcgaaucuuccgauucagagagugagauucuuaagccugacuauuacgccuuguaugggaaagaaauccgcagccccauggcucgaauccggcugucguccggaucucuccagcuggaugaggaagacgaggaugccuacuuuaacaccccaacagcagaagaccguacuagcuuaaagccuuguaauuauuuccuggccuga

SEQ ID NO: 56415 - RNA, 4737 nt, Artificial Sequence
  derived and/or modified sequence opt3 from FRMPD1__Homo_sapiens__NP_055722
auggaggaacuggagaccagccucuuccagacaagaaaggcccacaggaucgaacaaaugguggcucgguggcuucgccgaucccgugacucuucagcaagagccaaagucgcggcugccgauggccccgcaaggaacccuacucagacgcugauuccaguucggcauaccgugaagauagacaaagauacauuguuacaggacuacggguuucacaucagugagagccugccgcuaacuguaguggccgucaccgcuggagguuccgcacauggcaaacucuuccccggggaucagauucugcaaaugaauaacgaaccugccgaggaccuuucuugggagcgcgcuguggauauccugagagaagccgaggacucguugucaauuacaguugugaggugcaccagcggagucccaaagaguuccuuucucacugaagagaagcgggcgcgccugaagacaaaucccgugaaaguacacuucgcagaggaaguucugaucucuggccauagccaggguaacucccucuuauguaugccuaaugugcugaaguuguauuuggagaacgggcagaccaaagccuuuaaguucgaagcuaauacgacugucaaagauauaauccugaccgugaaggagaagcuaucaauucgaaguaucgaauacuuugcccucgcacuggaggagcaguauagcauuucuagacuucaccuguugcacgaagaggaacucauccaacagguggucgagagggaagagucccaugacuaccggugccuguuccguguuuguuuugugccaaaagaucccuuagaccugcucaaggaggauccuguagcuuucgaauaucuuuaccugcagucaugcagcgacguguugcaggagcgcuuugccgucgaaaugaaauguaguucugcgcuaagacuggccgcacuccacauacaagagaggauuuaugcuugcgcccagccacagaagaucucccugaaauacauugaaaaggacuggggaaucgagaacuucaucagcccgacacuucugcggaauaugaaaggcaaggauauuaagaaagcuauaucguuucauaugaagcgaaaccaaaauuugcucgagccccgccagaaacagcugaucucugccgcacaguuaagacugaacuaccuacaaauucucggcgaacugaagacuuaugggggaaggaucuucaaugccacccuuauguugcaggaccgggaguccuacauagcucugcucgugggugcgaaauauggcauuucacagguuaucaacaguaagcugaauaucaugagcacacuugcagaguucgccaacauuucccgcguggaacugaccgaggaaucugagaaggucagcgugguaaaaguuuacuugcaggaugugaagguccucacgcuguuacuggaaucaaacagugcuaaagaccuagccugucucaucgcaggguauuacagacugcuuguggauccugucacuuccauuuuucuuuggccaggaaauaagcaacaggcccacagggugagcgcugaggaaggcuaugagucucgugccugcucagacagugaggaaagcuccgagguugauugugugcuggaaccccucucugaccggcgacugguaaaauuagcaccuugcagaucgcugauaaaggaggaacagccacccgguaacagcccgacaccugaggucgcgaggcgcgggcccuccaccuguggagcuucaaguacuacagauucugccgagagcgaagcauccgacucagccaauaccgagagccggggcuacagaacgucuggcuccagugaaagcauggaugcucuugaggaagacgacuuggauaccuguucuuccucaaggaguacauucuuucacuucgggagcccaggacucgccgagucgaucgacuccgauucucaggaggaacgcagcgguauugagacuucaggcuuucugugccuacuggaccucgcacaacgagcuaacccucagugccagaagaccgaguucagugaauccgccgcgcuggagacauuugggugggcccccgaacuuucuacugugcgguuggauccacgucuguacgagggaagccaugcugacuauuacuccuuaugcucaagcguuagucccgcaucuuaucucuccgauagcucggaaucaaccgccucuagacagggcggugcuccuccagccugggggcaacagggcuggacagaggcacagccgaguuccaugcuggaaccccuugcgcugcacccuccauuggccuucgaggacggaagcucugaugaggaauacuaugacgcugccgauaaacucacucccccuggcccacccagcgggccgagggacguguccaccgcagagccuucagcuacgagucugcaaaauaaggccagcacaucuuccccagaaaacucacuacccuguggaccugauggucgccagcccagucggagaggcggggucaaaaaguacgcaaaaacccugaggaagcgacgcagcuuucuccagacugacuauaccucccaggugucuuucccacugguaccuucggccagccuugagucaguggacgauguuugcuacuacgaccgggaacccuauuuggcucugggagcgccauccccgacagucaguucuuuacaagauaugcagggcgagccuggucuccuggagaccaaggcccuugggcugcuagcaccccucagagaaacuaaaagcacaaauccagcuuccagggugauggagauggaacccgagacgauggaaaccaagucagugaucgacucucgugucagcaguaucuccgccauucgcuuucggauagauccuaacaauaaagagaacagcggcguugugccagccgcuucuucauccgcaaguacuccccauuguagcaauccuggaucgucuggcccggacacagcccaggcgagaccaucccagauccugcccuugagccaagaucuggacgggauugcuccuaaggagccaaccaucgaacacggagauucaaguuucucuuuauccagcggugaccccaacccugauagggccugccucgcaucaaauccgggccugaacaaugugagucagggggacacacuugagcugcaguuggaaccccauguacagcucgagaugggacuggagagcuuuuguacuaaccacauucaagaaaccgccccaaaauacacggagccucuacugagcccccgagaugaaccacggucugacgagugcggcaucaacccuggugaaaagauagcuagcauccccaccaaagaggagccacaggggcagcuuucccucgaacgcgacagagaggucacaaauaagaacggcacuaauguguuccaagaagagucaaggaaggauucuggagacaguccgggcgauguuucgaacaaugugagccagacccuggacauuuccucuccugcagggaaaaucgucacaucauugagccuggaugcccccgugacuggaaccgaacagauuccaccccacccuccacgggacccccagggccaaucccgagagccuccgggucaggggugucaggcgcaggagcaaaaguuauucguugaacucgaucuggacccagacuuuuuccuuggaaaacagacggugagucccgcuguaccucccgagggcaucaaggccgaagcaccaaaccaugucacaggucaggauauagccccuagagauucucccgagugggugugcuuuaauccagaaccuagccugccggagcccuugccauguccucaggaggacccccaccucgaaaccucaaaccauugccugcuauccgagggcaaaagugacuccucuuccauuugccugucagcugaaaagagcuuccuuuguuuugccccagagucgcacccugaggugucugcaagucuccgcgucgcuacuucccugggguucgccggaaugaaugaaaugguugcgcccaggaucggcauggaucaaugcagcugucaguuuucauaugccacaugcuuccgugggccgcagccagagaccgaagaggaagaccgggauuuggaggcacacccuauggcucccuuaacuuccccacccucugccggaagcccugugguacugccguggagacccgcuagggcacauaguuguaccacagccccacucucccgcaagagccacauuuggccugaguacugcucucgagcccugagacagcuuaaagcuacgcccgcgucaaccccugaaggcuuuauccaacugauggagaguuugcuagaacugcaggacauacucgagacuuccugggguguggggaacaagcauccacccgaaaaauguacauggcacuucaccgagagccggucuaggcugugcaugggaucgcagaaacuuuuaucaagcugucgccaugucauccguauggaucaauccccugaggaaaugcagggcgcagugagagacacauuucagcaccugguucagcucgccgguuugugcuuccaauuuacugauuguagucggugcucugcuaggcaccgcgaggccgcaggcaaucugcgagacguggucuauaccuaccaucaguucauugaagccgcuaagagcacgugcgagagaggguaucacgaucucuccgugaagcugcuugcgcggcaguguacagcccugaccgcagcuguuuucugcuugacucagaaguuuagggccucaaccgcacuauga

SEQ ID NO: 56416 - RNA, 3930 nt, Artificial Sequence
  derived and/or modified sequence opt3 from FRMPD2__Homo_sapiens__NP_001018081
augcagccccugaccaaggacgccggcaugagccucuccucugugacacuugcuucagcacugcaagucagaggggaggccuugagugaagaggaaaucuggagcuuacuguuccuagcggcugagcagcuccuggaagaucuuaggaacgacuccucugauuacguugugugcccuuggucggcccuguugucagcagccggaagccucaguuuucagggucggguaucccacauugaggcugcaccauucaaagccccggagcugcugcagggccaaucugaagacgagcagcccgaugcuagccagaugcauguguauucccucgggaugacuuuauacuggucagccggauuucacgucccuccacaucagccccugcaacuuugugaaccuuugcacaguauacugcuaacgaugugcgaggaccagccacaucgccgauguacccuccagagcgugcuggaggcgugccguguucacgaaaaggaggugucugucuaucccgccccugcaggccuucacaucagaaggcugguggguuugguacucgggacaauuuccgaaguugagaaacggguggucgaagagucaagcagugugcagcaaaaucgcucuuaccuguuaagaaagaggcugcggggaacuuccagcgagucgccagcugcccaggcaccggaaugucuccaucccugccgcgugucugagcgauccaccgaaacacagucaaguccugagccacacuggagcacccuuacucauucccacuguucucuguuggucaacagagcucuacccggcgccgauccucaagaccagcaggcgggcaggcggcugagcucagggaguguucacuccgccgcagauagcucuuggccaacaacccccucacagcguggauuccuccaacgcagaaguaaauuuagcaggccggaguucauccugcuugcuggugaggccccuaugacgcugcauuugcccggcuccgugguaacuaagaaggggaaaucuuaucucgcucugcgggacuuaugcgugguccugcuaaauggacagcaccucgaggugaagugugauguugaaucgaccgugggcgccgucuuuaacgcagugacuagcuucgccaaucuggaggaacuuacauacuuugguuuggcuuauaugaaauccaaggaguucuuuuuccuggacucagaaacccgacucugcaaaauugcgccagagggguggcgcgagcagccucagaagacaaguaugaacaccuuuacgcuguuccuuagaaucaaguucuuuguaucucauuacggacuguugcaacacagccucacuaggcaucaguucuaccugcaguuacggaaagauauacuggaagaacgccuauauuguaaugaagagauccuccugcagcuuggcguuuuggcacugcaagccgaguuuggcaacuaccccaaggaacagguggaguccaaaccauauuuccacgucgaagacuacauucccgcuucacucaucgagagaaugacagcccugagggugcaggucgaagugagcgagaugcaccguuuaucuuccgcacuguggggcgaggacgccgaacuuaaguuuuugcggguuacccagcaacucccugaguauggagugcugguacaucaggucuucagugaaaaacgaagaccagaggaagagauggcucuagguauuugcgccaagggcgugaucguuuacgaggugaaaaauaacagcaggauagcaaugcugcgcuuucaguggcgggaaacugggaagauuucuacauaucaaaagaaauucaccaucacguccucagucaccggaaagaaacacacauuugugacugauagugcgaagaccagcaaauaccuccuggaccuuugcucggcucagcauggcuucaaugcccagauggguuccgggcagccgucucacguauuguuugaucacgacaaguucgugcaaauggcaaaccugagccccgcccaucaggcuagaucaaagccuuuaauuuggauccagaggcucaguuguuccgagaaugaacuguuuguuucucgccuucagggcgccgcaggaggccuguugagcacauccauggauaacuucaaugucgacgggucaaaagaggcuggagccgaagguaucggccgaagcccaugcacugggcgggagcaacucaagagugcgugugugauucagaaacccaugaccugggauucucuguccggaccuccagugcagagcaugcacgccggcucgaagaacaaccguagaaaaucauucauagcugagcccgguagggaaaucguccgcguuacacuaaagcgggacccgcauagaggguuuggcuucgugauuaaugagggagaauacucuggccaggcagauccugggaucuuuauaaguuccauuaucccaggaggucccgccgagaaggcuaaaaccaucaagccuggcgggcaaauucuggcccucaaccacaucagccuggagggauucacuuuuaauauggcagugaggaugauucagaacucucccgacaauauagaacuuaucauuagccaguccaaaggcguaggugggaacaauccagaugaggaaaagaacucaacggcgaauaguggcgucagcucuacagacaucuuguccuucggauaucaaggcucacuguuaagucauacccaggaccaggaucgaaacacugaggaacucgacauggccggggugcagagccugguuccucgccuucggcaccaacuguccuuucuaccccucaaaggagcugggucuucgugcccaccgagcccucccgagaucucagccggugagauuuacuucguggaacuggucaaggaggaugggaccuugggauuuuccgugacaggcgguauaaauaccaguguuccauauggcgggaucuacgugaagucuauuguacccggaggcccugcagcuaaagaagggcagauccugcagggagacagauuacuccaggucgauggcgugauucuguguggucuuacucacaagcaagccgugcagugccugaaagggccaggacaggucgcaagguugguucucgagcgucgcgugccccggagcacacagcaauguccuuccgccaacgacucaaugggcgaugaaagaacggcuguaucucuggugaccgcgcuaccggguaggccaagcaguugcgucuccgugacugacggccccaaguucgagguuaaacugaagaaaaaugccaacgggcuuggauuuagcuucgugcagauggagaaggaaucuuguucacaucucaaguccgaucugguccgaaucaaacgguuguuuccuggccagccagcagaggaaaauggggcuauagccgccggagacaucauucuggcugugaacggccgcaguacagaggguuuaaucuuccaggaaguucuccaucugcuuagaggggcaccccaagaggugacccuguugcucugcaggccuccgcccggagcccugccagagcuagaacaggaguggcagacaccugaacugagcgcggauaaggaguucacucgggcuaccuguacggacucgugcaccucucccauucuugaucaagaggacuccuggcgagacagcgccucaccagaugcaggcgaaggucucggccugagaccugagaguucucagaaagccauccgcgaagcucagugggggcagaacagggagcgucccugggcauccagcuugacacacucaccagaaagucacccgcauuuaugcaagcugcaccaagagcgggacgagagcacucucgccaccucccuggaaaaagaugucagacagaauuguuauucuguaugcgacauaaugaggcuuggacgcuacagcuuuuccucaccucugacacgauugucuacugauauuuucuga

SEQ ID NO: 56417 - RNA, 3969 nt, Artificial Sequence
  derived and/or modified sequence opt3 from FRMPD4__Homo_sapiens__NP_055543
auggacguguucagcuuugucaagaucgccaaacuguccucucacagaaccaagucaaguggcuggcccccuccaagcgggacauggggacucucccagguuccgcccuacgguugggagaugacugcuaacagggauggccgggacuauuucauuaaucauaugacgcaagcaauaccuuuugaugacccacgccuugaaucuugccagaucauucccccugccccacgaaaaguggagaugcguagagaucccguacugggguucggauuuguggcgggcucggaaaagccugucgugguuaggucagugaccccaggugggccgagcgagggaaaauugauccccggcgaccagauugucaugaucaacgaugaaccugugagugcugccccacgggagcgcguaauagacuuaguuagauccuguaaggagucuauccugcuaacagugauucagcccuacccuagcccaaaguccgcauucaucucagccgcuaaaaaggcaaggcucaaaaguaaucccgucaaggugcgguuuagcgaagaggugauuaucaacggccaagucucugaaacuguuaaagauaauucccugcuuuucaugccgaacgugcugaagguauauuuggagaaugggcagaccaagucauuucgcuucgacugcagcacaaguauaaaagaugugauucucacccugcaggagaagcugucuaucaaaggaauugaacacuuuucccucauguuagagcagcgaacugaaggugccggcacaaagcugcuuuugcugcaugagcaagaaacccuaacgcaggucacucagagaccuagcucgcacaaaaugaggugucucuuccggaucucuuuugugcccaaggacccaaucgaucugcuucgucgcgacccuguugcuuucgaguaccuguaugugcaguccugcaacgacgucgugcaagagagauucgggcccgaauugaaauacgauauugcccucaggcuggcggcauuacagauguauauagccaccguaacaacuaagcagacccaaaagaucucacugaaauacauugagaaggaauggggacucgagacauuucuuccaagugcuguucugcagagcaugaaagaaaagaauaucaaaaaggccuugucccaucuagugaaggcaaaccagaaucuggugcccccuggcaaaaagcucucugcucugcaggccaaaguccacuaccuuaaguuccugagcgacuugcggcucuauggugggcgagucuuuaaagcgacccuggugcaagccgagaagcgcucagagguuacguuacuggugggaccaagauacggcauaagucacguaauuaacacuaagacaaaucuagucgcacuccuggcugauuucucccaugugaacaggaucgaaauguuuagcgaggaagagucucuuguucggguggaauugcacguccuggacgugaaaccgaucacccuccugauggagucaagugaugccaugaaucuugcuugucugacugccggcuauuaccgcuugcucguagacagcagaagguccauuuucaacauggcaaacaagaaaaauacagccacccaggagacggggcccgaaaacaagggaaaacauaaucuguuagguccugauuggaacugcaucccacagaugaccacauuuauuggcgagggggaacaggaggcucaaauaacuuauaucgacucuaagcagaagaccguggagauuacagauucgacuaugugucccaaagaacaccgucaccuguacaucgacaaugcguauagcuccgauggacuaaaccagcagcucucacaaccuggcgaggcaccaugcgaagccgacuaccggagucuggcucagcgaucucuuuugacccugagcggucccgagacacucaagaaagcccaggaauccccgagaggggcaaagguuucauucaucuuuggcgacuucgcccuggaugacggaauuagcccuccaaccuuaggcuacgagacucugcuugaugaggggcccgaaauguuggagaaacagaggaaucucuauauaggaucugcuaacgacaugaagggucuggaucuaacgccugaagccgagggcauccaauuugucgaaaauuccguguacgcaaacauuggggacgugaaaaguuuccaggcggcugagggaaucgaggaaccccugcuccaugauauuuguuaugccgagaauacagacgaugcagaagacgaggaugaagucagcugcgaggaggaccugguugugggcgaaaugaaccagccagccauccuuaauuugucugguuccucagaugacauaaucgaccugaccaguuuaccucccccagagggggaugacaacgaagaugacuuucuccugcgcagccuuaauauggcuauugccgcaccgccucccggcuuccgggauucguccgacgaggaggauucucaaagccaggcugccucauucccagaagacaaggagaagggaaguucccugcagaacgaugaaauccccgugucuuugauugacgcgguaccuacuagcgccgagggcaaaugugaaaaggggcucgauaacgcugucguguccacccugggagcacuagaggcccugucaguuagcgaggaacagcaaacaagugacaauucugguguggcuauccucagagccuacuccccagagagcucgucagauucuggcaacgaaaccaauaguuccgagaugacugaaagcucugagcuggcaacagcgcagaaacagagcgagaaccuuuccaggauguuuuuggccacgcacgaaggguaucauccccuggcugaggaacagaccgaguucccugccucaaagacuccggcaggaggcuuaccacccaaaaguagccacgcucucgccgcacgcccugccacagaccugccacccaaggucgugccuucuaagcaacuucugcauuccgaccacauggaaauggagccggagaccauggaaacaaaaucaguuacugauuacuuuaguaagcuacacauggguagcguggcuuauuccugcaccucuaaacgaaagucgaaacucgcggacggggagggcaaggcacccccaaauggaaacacgaccggcaagaaacagcaggggacaaagacugccgaaauggaggaggaagcuagcggaaaauucggcaccguaucaucccgggauagucagcaucugucuacauuuaauuuggagcguacugccuucagaaaggacagccaaaggugguacgucgccaccgaaggugggauggcugagaaauccggacuggaagcagccacgggcaagacauuuccucgcgcgucagguuuaggcgcucgggaggccgaggggaaggaagagggagcacccgauggcgaaaccucugacgggagcggacucggccagggugauagauuccugacugacgugacaugcgccaguuccgcuaaagaucuugacaacccagaggaugcagacagcucuaccugugaccacccuucaaagcugcccgaagccgaugaguccguggcgagguugugcgacuaccaucucgcuaaacgaaugaguagccugcagucggaggggcacuuuucucuacaauccagccagggaucaagugucgaugccggcugugguacugggucuuccggcagcgcaugcgccaccccaguugaaucaccgcuguguccuagucuuggaaagcaccucauacccgacgcuagcggcaaaggggugaauuauauuccauccgaggaacgcgcccccggacugccuaaccauggcgcaacauucaaggaguugcacccacagacggaagguaugugcccccggaugaccguaccugcucugcauacugccaucaauacagagccguuauuugggacccucagagauggaugucacaggcugccaaaaauuaaggagacaacuguguga

SEQ ID NO: 56418 - RNA, 1035 nt, Artificial Sequence
  derived and/or modified sequence opt3 from FRRS1L__Homo_sapiens__NP_055149
augagaaggccccggcagggcgggggaggugccggcgggagcgcugcagcccgcgcgcgagcuggaggccugggugggggauccgugccugcccgugcaagaggcgccccagcugcagccagggcugccuggcuccgggaccuuugcgcgcgcauggcaagaccgcccaggcaacacccuggcgucugggccucucuguuguuacugcuacucaccgggccagcugccugugcagcuucacccgccgaugacggagcggguccuggcgggcggggaccacgcggccgagccagaggugauacaggggcagacgaggcuguucccaggcaugauaguagcuacggaacuuucgccggcgaauuuuaugaccugcgguaccuuuccgaggaaggcuauccuuucccaacggcuccgcccguggauccuuuugccaagaucaaaguagacgauugcgggaagaccaaaggauguuuccguuacgguaagccaggcugcaacgcagagacaugugacuauuuucugucuuaccgcaugauuggggccgauguggaguucgaauugucggcugacacugauggaugggucgcggugggcuuuucaagcgacaaaaagauggguggggacgauguuauggcaugcgugcacgacgauaauggcagagucaggauacagcauuucuauaacgugggacagugggccaaggagauccagcggaaucccgcucgagacgaagagggcguauuugaaaacaaucgcguuaccuguagauucaaaaggccugugaacgucccacgggaugagacaauuguggaccuccaccugaguugguacuaccuguuugccugggggcccgcaauccaaggauccauuacccgccaugauaucgacucuccgccugccagcgagagaguggucuccauauauaaguacgaagauaucuucaugcccucagcugccuaucagacuuuuaguagcccauucugccucuuacugauuguugcacuuacauucuacuugcugauggguaccccuuga

SEQ ID NO: 56419 - RNA, 1527 nt, Artificial Sequence
  derived and/or modified sequence opt3 from FRS2__Homo_sapiens__NP_001265286
augggcagcugcuguuccugccccgacaaggauaccgugccugacaaccacagaaauaaauucaaggucaucaacguugaugacgaugggaaugagcugggaucugguauuauggaacucacagacacugagcuuauacuguacacgaggaaacgggauucagugaaguggcauuauuuguguuuacgccgauacggcuaugacaguaaccuguuuagcuucgaauccgggcguagaugccagaccggacaaggcaucuuugccuucaaaugugcuagggcagaggaacuauuuaauaugcuccaggagauuaugcagaacaauucuaucaacguaguggaggaaccagucguggagcggaauaaccaccagacagaacuggagguuccgcgcacucccagaaccccuacaaccccagguuucgccgcgcaaaaucuucccaacggguacccuagguauccaucguuuggagaugcuucaagccaucccaguucccggcacccuucugugggcagcgcccgccugccauccgucggcgaggaaucaacucauccguugcucguggcagaggaacagguacacacauacguuaauaccacgggggugcaggaggaacgaaagaacagaaccaguguccacgugccccuggaggccagggugagcaaugcugagucuuccacuccuaaggaggagccaucaagcauugaagaccgggauccccagauccugcucgagccugaaggagucaaauucguuuuagguccaacacccgugcaaaagcagcugauggagaaagagaaacuugaacaguugggccgugaccagguaagugggucuggagcaaacaacacugagugggauaccggcuaugacuccgacgaacgcagagaugccccgagcgugaauaagcuggucuacgagaacauaaauggucuaucgaucccuucugcuuccggggugaggcggggacgacucacaucaaccaguacgagcgacacucaaaacauuaauaacuccgcccagcgcagaacagcgcugcuuaauuacgaaaaccugcccucuuugccaccuguuugggaggcaaggaagcucagccgggaugaggacgauaaucugggccccaagaccccaucauuaaacggcuaucauaauaaccuggaccccaugcacaauuacgugaacacugaaaaugucacagugccugccagugcucauaaaaucgaguauucccgcagaagggauugcaccccaacgguauuuaacuucgacauucgucggccgagccucgaacaccgacagcuuaacuacauccaaguugaucuggaagggggaucugacucagauaauccccagaccccuaagacaccaacuacccccuugccucagacaccaacuagaaggaccgagcuauaugccgugauagacauugaacgcacagcagcuaugaguaaccugcagaaagcccucccccgggacgaugguaccagcagaaagacuaggcacaauuccacggaccugccgauguga

SEQ ID NO: 56420 - RNA, 1479 nt, Artificial Sequence
  derived and/or modified sequence opt3 from FRS3__Homo_sapiens__XP_011512557
augggcagcugcuguuccugccugaacagagacucugugcccgauaaucacccuaccaaguucaaagucacaaacguugacgaugaggggguggaacucggaucagguguaauggagcuuacucagagugaacugguguugcauuuacacaggcgggaggccguccgcuggccauaccugugucuacgacguuauggcuacgacagcaaucucuuuuccuucgaaucugggagaaggugccaaacgggacagggcaucuuugcuuucaaguguucgcgggcagaggagauuuuuaaccugcuucaggaucugaugcagugcaauucaauaaacgugauggaagaaccgguuaucauuacccgcaauagccaucccgccgaauuggaccucccuagagcgccacaacccccuaacgcucuggguuauacagugaguuccuucucuaauggguguccaggagagggccccagguuuagcgccccucggcgccuguccacuucaagucuccgacacccgagcuuaggcgaggaaucuacccaugcacugaucgccccagaugagcagucccacacauacgucaacacccccgcuucagaagacgaucacagaagggggcggcauugccuucagccuuugccagagggacaggcacccuuccugccucaagcccgugguccagaccagcgcgauccccagguguuucuacagccgggccaaguaaaauucguucucgggccuacucccgcuagaaggcacauggugaagugucagggacugugcccaagccuucaugacccuccccaccacaauaacaauaacgaagccccaagugagugucccgcgcagccuaaaugcacauaugagaaugucaccggcggucuguggcgaggggcaggauggcgguugucuccagaggagccgggcuggaacggccucgcccaucgcagagcugcccuguuacacuacgaaaaccugcccccucucccacccgugugggagucccaagcacagcagcuugggggagaagcuggugaugacggcgacagcagggaugggcugacgccuucgucuaauggauuuccagacggcgaggaggaugaaacucccuugcagaagccgaccuccacacgggccgcgauucgcucacaugguaguuucccugugccacuaacuagaaggcgugggagcccccgggucuuuaacuucgacuuccgaagaccuggccccgagccaccuaggcaacugaauuauauccagguugaacucaagggauggggcggggaucgccccaaaggaccacagaacccguccucuccucaggcccccaugccaaccacacaccccgcacggagcucagacaguuacgcugugauagaucugaagaaaaccguagccauguccaaucuucaaagagcucugccuagggacgaugguacggcccgcaagacucgacauaacagcacagacuugccacucuga

SEQ ID NO: 56421 - RNA, 9042 nt, Artificial Sequence
  derived and/or modified sequence opt3 from FRY__Homo_sapiens__NP_075463
auggccagccagcaagacuccggcuucuuugaaaucucuauuaaguaucugcucaaaucauggagcaacaccagccccguggggaauggauauauuaagccuccagucccgcccgcuuccgguacacaccgagaaaaaggcccuccaacuaugcuucccaucaacguugauccugacucuaagccaggggaauacgugcugaaaucguuguucguaaauuuuacgacccaggcagaaaggaagauucggaucauuauggccgagcccuuagaaaagccucugacaaaaucacuacagcgcggagaggauccacaguucgaccaagugaucagcaguauguccucucucagcgaguauugucugccguccauacuucgaacucuguuugauugguacaagcgucagaacggcaucgaagacgagucacaugaauauagacccaggaccaguaauaaaagcaagucugaugagcagcagcgggacuacuugauggagcgcagagaucucgcgauugacuucaucuuuucccugguccugauugaagugcucaaacaaaucccuuuacacccaguuauagauucacugauucaugacgugaucaaccuugcuuucaagcacuuuaaguauaaagaggguuacuuggggcccaauacaggaaacaugcauauugucgccgaucuguacgcagaagugaucggcguucuagcccaggcuaaguucccugcaguuaaaaagaaauuuauggccgagcucaaggaacugaggcacaaagagcagaauccauaugugguccagagcaucauuagucuuauaaugggcaugaaguucuuucggaucaagauguaccccguggaggacuucgaggcuucucugcaauucaugcaggagugugcccacuacuuuuuggaagugaaagacaaggauauuaaacaugcgcucgcagggcuguucgucgagaucuuaguuccgguggccgcugccguaaagaacgaagugaaugucccuugccugcgcaacuuuguggagucccucuacgacaccacucuugagcugagcucgagaaagaagcacucuuuggcacuauauccccugguuacaugucuccugugcgugucccagaagcaacuuuuccugaauagauggcauauauuuuugaacaauugucucucaaaccugaaaaacaaggauccaaaaauggcuagggucgccuuagaaagucuguaccggcuacucuggguguauaugauucguaucaagugcgagagcaauaccgcgacgcagucccgccugaucacuauuaucaccacacuuuucccuaaaggaucuagagguguaguucccagggacaugccauugaacauuuuugugaagauaauccaguucauugcccaggaacggcuggauuuugcaaugaaggagaucaucuucgacuuucucugugucggcaaacccgcuaaggccuucagccugaauccugaacgaaugaacauugggcuucgcgcuuuucuggugauagccgauucauugcaacagaaagacggagagccaccgaugcccgucacuggcgcagugcucccuagugguaauacccugagaguuaagaaaacauacuuauccaagacccugacggaggaagaggccaagaugaucgggaugagccuauacuauucucaggugaggaaagcuguagauaacauucuccggcaccuggacaaggaagucggacgcugcaugaugcuuacuaaugugcagauguugaacaaagagccagaggauaugaucacaggcgaaagaaagcccaaaauugaccuguucaggaccuguguugcggcaaucccucgucuccugccagacggcaugucaaaguuagagcugauagaucuuuuggcccggcucaguauccacauggacgaugaacugcgacauauugcucaaaauagccuacaggggcugcucguggacuucuccgauuggagagaggacguccuguuuggauucacuaacuuucuuuugagggaagugaaugauaugcaccauacacuguuagacucuucgcucaaacugcuucugcaguugcucacccaguggaagcugguaauccaaacgcaggguaagguguacgagcaggccaacaaaauucgcaauagcgagcuaaucgcaaacggcuccucacaccggauacagagugaaagagggccccauugcucuguucugcacgccgucgagggauucgcucucgugcugcuuuguagcuuucaaguggccaccaggaaguuguccguccugauuuuaaaagaaauccgcgcacucuucauugcgcugggccagccggaggaugacgaucgaccuaugaucgacguuauggaucagcuuucaagcucuauacuggaauccuuuauccacguggcugugagugacagcgccacacuaccacucacucauaauguagaccugcaaugguuggucgaguggaacgcagugcugguuaacucucacuaugaugugaagucccccucacaugucuggauuuucgcccagagugugaaagacccuuggguuuuaugccucuuuagcuuccugcggcaggagaaucuucccaagcacugcccaaccgcucugucguacgccuggccuuaugcauuuacacguuugcaguccgugaugccccucguagauccaaacucuccgaucaaugcuaagaaaacuagcaccgccgguucaggggacaacuacgucacacuguggagaaauuaucuaauucuguguuucggcguggcgaagccuaguaucaugucccccggacaccuuagggccucuaccccagaaauaauggcuacuacgcccgauggcacagugagcuacgacaacaaagcaauugggaccccuuccgucggaguucuccugaagcaauuggugccacugaugcgcuuagagucaaucgaaaucacugagagccucguacuggguuuuggccggaccaauagucuuguguucagagaacuggucgaggaguugcauccccucaugaaagaagcccuggagaggcgaccugaaaacaagaagcgccgggagagaagggaucuacugcgucuucagcuccugcgcauuuucgaguuguuagcugacgccggggugaucucugauuccacaaauggagcacuggaacgggacacccucgcgcugggcgcccuuuuucuggaguacguugauuugacuagaaugcuacuggaagcugagaacgacaaagaaguggagauucucaaggauauaagggcccacuucagcgcaauggucgcuaaucugauccagugcgugccgguucaucaccgacgguuucuuuucccacagcaaucguuacgccaucaccuguuuauucucuucucacagugggccggucccuuuucuaucauguucacaccuuuggacagauauagugacaggaaccaccagauuacgcgguaccaguauugugcacugaaagccauguccgcugugcucugcugugggccagucuuugauaauguaggccugagccccgacggauaccuuuauaaguggcuggauaacaucuuggcgugccaagaccuacgagugcaucagcugggcugugagguugugguccucuuacuggaacuuaauccugaucagauaaaccuguucaacugggccaucgacagaugcuacaccgggucuuaucaacucgcaagcggauguuuuaaagcuauugccacugugugcgguucccgcaauuacccguucgauaucguaacauugcugaaccucgugcuguucaaggccucagacaccaauagggagauuuacgaaaucaguaugcagcuuaugcagauacuagaggcuaagcuguuugucuauagcaaaaagguugcagaacagcgucccggcucuauuuuguacgggacacacggaccauuaccuccccuguauuccgugucacucgcccugcuuaguugugagcuggcgcggauguacccagagcucacuuugccucuguucagcgaagugucccaaagauuucccaccacgcauccaaacggcaggcagaucaugcuaaccuaucugcucccguggcuucacaauaucgagcuggucgauucucgcuuauugcugccugguucgagccccucauccccagaagacgaggugaaagaucgagaaggggacguuacagcuagucauggccucagaggaaacggcugggggucucccgaggccacuagccugguacuuaauaaccugauguacaugaccgcaaaguauggagacgaggugccuggcccagaaauggagaaugccuggaacgcucucgcaaauaacgaaaaaugguccaauaacuugcggauuacacugcaguucuuaauaucacuaugcggugucucuagcgauacugugcugcuccccuacaucaagaaaguugccauuuaccuuugcaggaauaacaccauccagacgauggaggagcuguuguuugaacugcaacagacagagccugugaacccgauuguccagcacugugacaauccacccuucuaucgcuuuaccgcgaguuccaaggcuagcgccgcagccucugggacuacaucauccaguaacaccgugguagcuggacaggaaaauuucccugaugccgaggaaaacaagauccucaaagagagcgacgagcguuuuucgaaugucauaagagcacacacucggcuggaaucuagguacuccaacagcucaggcgguaguuaugaugaggacaagaaugaucccaucucuccauacaccggcuggcuucucacaauuacggaaaccaaacaaccucagccccugccaaugccuugcacugggggauguugggcuccguugguggacuaucugcccgagacaaucaccccacgcggcccuuuacaucgaugcaacauugccguuaucuucaugacagaaaugguggucgaucacuccgugagagaggacugggcgcuacaucugccccuccuucugcacgccguauuuuuggggcuggaucacuaccggccagagguguucgaacauagcaagaaacuccugcuucacuuacugauagcacucucauguaauaguaacuuucauagcauugcuuccgucuugcugcagacuagggagaugggagaagccaagacccuaacggugcagccugcuuaucaacccgaguaccuguacacaggcgguuucgacuuccuccgcgaagaucagucuagcccgguaccagacuccgggcuuucaucuaguucgaccagcuccucuaucucacugggaggcagcuccgguaauuugccucagaugacucaagagguggaggacguugauaccgcagccgaaacagacgagaaggccaacaaacugaucgaauuucucacuaccagagcuuucggcccccuguggugccacgaggauauuacaccaaagaaucagaacaguaaaucugcggagcaguuaacgaauuuucuuaggcaugucgugagcguguucaaggacucaaaauccggguuucaccuggaacaccagcucagugaggucgcacuacaaaccgcccuggcuaguucuucccggcauuaugccggacguucauuccagaucuuucgcgcauugaagcagccccugagcgcccacgcucucucggaucuucugucucgauugguagaagugauaggcgagcauggggacgaaauucagggauacguuauggaggcgcugcucacuuuagaggccgcaguggauaaccugagugacugucuuaaaaauuccgaucugcuaacaguccucagcagaucauccucuccugaccugagcaguuccagcaaauugaccgcuucuaggaagucaacuggccaacugaacaugaacccggguacaaccagugggaauacggccacugcagaacggucccgccaccagcgaucuuucagcgugcccaaaaaguuuggaguuaucgauaggucgucagacccaccucggagcgccacccucgaucgcauucaggcuugcacacagcaaggccuuuccaguaaaaccagaucuagcuccucacugaaggacaguuuaacugaccccucucacaucaaccauccuacaaaucuguuggccaccauauucugggugacagucgcgcucauggagagcgauuuugaguucgaguaucugauggcacuaagacuucuguccaggcuccuggcccacaugccauuggacaaggcugaaaaccgggagaaacuggagaagcuccaggcccagcuuaaaugggcugauuuuucaggucugcaacaguuacuguugaagggcuucacuagccucaccacgacagaccugacccuacagcuuuucucucugcucacucccguguccaaaauuaguaugguagaugcaagccaugccaucggguuuccucugaauguguuguguuuacugccacagcucauccaacacuucgaaaaccccaaucaguuuugcaaggacauugcugagcguaucgcccagguuugucuugaagagaagaacccgaaacugucgaaucuagcacaugucaugacccuguacaagacacacuccuauacuagagauugcgcgaccugggugaacguggucugcagguaccuccacgaagccuaugcugacauuacguugaauaugguuacauaccuggccgagcuucuggagaaaggacucccuucugugcagcaaccauuacugcagguaauauacucauugcugagcuauauggaucucagugugguccccgugaagcaguucaacguugaagugcuuaaaaccaucgagaaguacguccaguccguacauuggcgcgaagcacugaauauucuaaaacuggugguuucucggagcgcuucacucguguugccuuccuaucaacacagugaccugagcaagaucgagauccaucgagucuggacuucugccucaaaggagcuuccaggcaaaacacuggauuuucacuucgacauuuccgaaacccccauaaucgggagaagguacgacgaguuacagaacagcucuggacgcgauggcaagccgcgggcaauggccgugacuagaaguacaucguccaccagcucagguucuaauagcaacguccucgugccuguuuccuggaaacguccccaguauagucagaagaggacgaaagaaaagcuggugcacguauugucacugugugggcaagaggugggacucucuaagaacccaagcgucauauuuuccaguugcggcgaccuugaucugcuagaacaucagacuagccugguuuccucugaggacggcgcucgggagcaggaaaauauggaugacaccaacucagagcaacaguuccgcguguuucgagauuucgacuuucucgaugucgaauuggaggacggggaaggagagagcauggauaauuucaacuggggugugagaaggcggucgcuggacuccuuagauaaaugugacaugcagauccuugaggaacgccagcugaguggcucuacaccuagccucaauaagaugcaccaugaggacucagaugaauccucugaggaagaggaccugaccgcgagucaaauuuuggagcacagcgaucugaucaugacacucucccccucagaagagacuaacccaauggaacuucugaccacggccugcgacagcacacccgcagagccucauucuuuuaauacuagaaugaguuccuucgaugcuagccuaccagacaugaacaaucugcagauaucagaggggucuaaagccgaagccguaagggaggaagaggauaccacagugcacgaagacgauuuauccucgagcaucaacgagcucccggcagcuuucgaguguagugacucuuuuucccuggauaugaccgaaggagaggaaaagggcaaucgagccuuggaccaguucacucuugcgagcuuuggugagggggaccggggaguuucacccccuccaagucccuucuuuuccgcuauucuggccgcauuccagccugccgcuugcgaugacgcagaagaggccuggcguagccacaucaaccaacucaugugugauucugacggcucaugcgcgguguacaccuuucaugucuucagcucccuguuuaaaaauauucagaagagauucugcuuuuugacaugcgaugcugccucuuaucugggcgacaaccuacgcgggaucggaaguaaguucgugucgagcucccagaugcucacgucauguucugagugcccaacucuuuuugucgaugcagaaacccuguuaagcugcggucugcucgacaaacugaaguucaguguguuggagcuucaggaauaccuggauacauacaauaacaggaaagaggccacccucuccuggcuggcuaacuguaaggccacuuucgcaggcgggucacgggacggaguuauaacaugccaacccggcgauucugaagagaaacagcuagaguugugucagagacuguauaagcuccacuuucaacuucuguuacuguuccagagcuacugcaagcucauuggucagguacaugaaguguccaguaugccugagcuguugaauaugagccgcgaacuuucugaccugaaaaagcaccucaaagaggcuucagccgucaucgcggccgauccgcuguauuccgacggggcauggagcgagccaaccuuuacgaguacugaagcugccauucagucuaugcuagaguguuuaaagaacaaugaacugggaaaagcauugaggcaaauccgagagugccggucccucuggcccaacgacauauucggcucgagcucagaugacgaagugcagacacugcuuaauaucuacuuuagacaucagacccugggccagaccgggacuuaugcucucguuggauccaaccaaucucugacagagauuuguaccaaguugauggagcuuaauauggaaaucagggauaugauucgccgugcccagaguuaccgggugcugacaacuuuccuaccugacagcucagucuccgguacgagccucuga

SEQ ID NO: 56422 - RNA, 9042 nt, Artificial Sequence
  derived and/or modified sequence opt3 from FRYL__Homo_sapiens__NP_055845
augagcaauaucaccauugaccccgaugugaagccuggagaguacgucauaaagucccuguucgcagaguuugcuguucaggcagagaagaaaaucgaagugguaauggccgagccacucgaaaaacuucugucuagaucauugcaaaggggagaagacuuacaguucgaucagcugauuagcagcauguccucuguggcggagcacugccuaccgucgcuccugcggacucuuuuugacugguaucgccgacagaaugggacugaagaugagucauacgaauaucgucccagaagcaguacgaaauccaagggugacgagcaacagagggagcgggauuaccuguuggaacgcagagaccucgcugucgauuucaucuuuugucuggugcugguugaggugcucaagcagauuccuguccauccagugcccgacccuuuaguacacgaaguucugaaccuugccuucaaacacuuuaagcacaaagagggcuauucugggaccaauaccggaaacgugcauaucauagcagauuuguacgccgaagucaucggcgugcuggcucagagcaaguuccaagcagugaggaaaaaguuugucacugagcuaaaggagcuccggcagaaagaacaguccccacacguugugcagucaguaauuagucugaucauggguaugaaguucuuucgcgugaaaauguaucccgucgaggacuucgaagccagcuuucaauucaugcaggagugcgcucaguacuuccuugaagugaaggauaaagacauuaagcacgcccuggcgggguuguuuguugagauccucauaccuguggcagccgcugucaaaaaugaggugaacguaccaugccugaagaauuucguugaaauguuauaccaaaccacauuugagcugucuucccgaaagaaacauucacucgcccuuuauccgcugauuaccugcuugcuaugugugagccagaagcaguucuuucugaacaauuggcacaucuuccuccagaacugccugagucaucuuaaaaauaaggaccccaaaaugucuagagucgcacuggaauccuuguacaggcuccuguggguguaugucauucggaucaagugugagagcaacacugugacacaaucgcguuuaaugucuaucguuuccgcucuguuuccuaagggaucacgcagugugguaccaagagauacaccccuaaauauuuucgucaaaauaauccaguuuauugcccaggaaaggcucgacuucgcgaugaaggagaucauauuugaucugcuuagcgugggcaaauccacgaagacuuucaccauuaacccugagcggaugaauaucggcuugcgaguuuuucuggugaucgccgacucucuccagcaaaaagauggggaaccacccaugccgacaacuggagucauucugccuagcgguaacacccuucgcgugaagaagaucuuccugaacaaaacauugaccgacgaggaagcaaagguaauuggcaugucaguguacuauccccagguuagaaaagcucucgauaguauacugaggcacuuagacaaggaggucgggcggccaaugugcaugacguccgugcagaugagcaauaaagagccugaagauaugaucacuggagagcgcaagcccaagauugaccuguucagaacauguaucgccgcuaucccaaggcuaauucccgauggcaugucucguaccgaccucauagaacugcuugcccgguugacuauccacauggacgaggaacugcgagcacucgccuuuaacacacugcaggcuuuaaugcuggauuucccugacuggagagaggaugugcuuucagguuuugucuacuucauuguuagggaggugaccgacgugcauccaacguugcucgauaaugcgguaaaaaugcugguccaacuaaucaaccaguggaagcaggcagcccagaugcacaauaaaaaccaagacacccagcaugggguggcuaauggagccagucacccgcccccucuggaacgcagcccauauuccaacguuuuucauguggucgagggcuucgcacucgugauucuguguucuucgcggcccgccacaagaaggcuugcuguuagcguguugcgcgaaauccgagcccuguuugcauuacucgagauaccuaagggcgaugacgaacuggcgaucgauguaauggaccggcuuuccccaucaauucuggagaguuucauccacuugacuggggcugaucagaccacacuccuguacugucccucuagcauugaccuacaaacucuggccgaguggaacuccucaccgaucagccaccaguuugaugucauaucuccuucccauauuuggaucuucgcacacgugacccagggacaggacccauggauuaucagucucagcucuuuucugaaacaagaaaaccuucccaagcauugcuccacagccgugucauacgcuuggauguucgccuauacccguuugcagcuguuaaguccucaggucgacauaaauagccccaucaacgccaagaagguuaauacuacgacaucguccgauucuuacauuggucucuggagaaacuaucugauccuuugcuguagcgcugccaccucaaguuccucuacuagcgcgggcuccgugaggugcucaccaccugagacccuggccagcacacccgacaguggguacucuauugauuccaagaucauaggcauuccaagcccgucgucacuauuuaaacacaucguaccuaugaugcgcucugaaaguauggagaucaccgaaucccucgugcugggcuugggucggacuaaucccggggcuuucagagagcugauugaggaauuacacccaaucauuaaggaggcacucgaaaggcgacccgagaacaugaaacgccggagaaggcgugacauacugcgcguccagcuugugcggaucuucgagcuguuggccgaugcuggcguuauuagccauucugccagcggaggccucgacaacgaaacacacuuucugaauaacacgcuacuggaguauguggaucuuaccagacaacuccuggaagcagagaaugaaaaggacuccgauacuuugaaagacaucaggugucauuucucagcgcuggucgccaacauuauccagaaugugccuguucaccagcgacggaguauauuuccacagcaaucauuacgccauucucucuucaugcuguuuucccacugggcugggcccuucucaaucauguuuacaccucuugauagauacagugacaggaacaugcagauuaaucggcaccaguauugcgcccugaaggcaaugagcgcuguguuguguugcggaccggucgccgauaacguaggucucuccucugacggcuaccuguacaaguggcuagacaauauccuggauucgcuugacaaaaaggugcaucaacucgggugugaggcaguuacccuguuguuagagcugaacccagaucagagcaaucucauguauugggccguggaccgaugcuacacaggaucaggcagagucgcugcggguuguuucaaagccauugcaaacguguuucagaaucgcgauuaucagugcgacacuguaaugcugcuuaaccugaucuuguucaaggcugccgauuccaguaggucuauauacgaaguggccaugcaacuacugcagauucucgagcccaaaauguuucguuaugcucacaagcuggaaguccagcggaccgacgggguucuuagccaguuauccccucugccacaucucuacucagugucuuauuaccaauugagcgaggaacuggcaagagccuaccccgagcucacgcuggcgaucuucagugagaucucccagaggauucagaccgcucacccugccggccgccaggugaugcuucauuaucuguugccguggaugaauaacauagagcuagucgaucugaagccccucccaacagcacgaagacacgacgaggaugaagacgacagcuuaaaagaucgggagcugauggugacuucuaggcgcuggcuucguggagaaggcugggggucaccucaagccaccgcuaugguucugaacaaucucauguacaugacagcaaaguauggagacgaguuggccugguccgagguagaaaacguguggacuacccuggcggaugguuggcccaaaaaucucaagaucauucugcacuuccuuaucaguauuuguggcgucaacagcgagccaucgcuacugccuuacgugaaaaagguuaucguguauuuggggagagacaagacgaugcaguuacuggaggaacucgucucugagcugcagcuuacagaucccguguccagcggaguaacccauauggacaauccaccguacuaucggauaacuucaaguuacaaaaucccuucugucacauccggcaccacuagcucaaguaacaccaugguggcucccacagaugguaauccagacaacaagcccauuaaagaaaauaucgaggaaagcuacguucaccuggauauuuauuccgggcucaacucucauuugaauaggcagcaccaccgccuggagagccgauacuccucaucuaguggcggaucguaugaagaggaaaagagcgacuccaugccucuauacucuaacuggagacugaaagugauggaacauaaucaaggcgagccacuccccuuuccuccggccgggggaugcuggucaccacuugucgauuaugugcccgaaacgagcuccccuggccugcccuuacaccggugcaacaucgcaguuauauugcugaccgaccucauuaucgaucauagugugaaggucgagugggguucuuaccugcaccuucugcuccaugccaucuucauuggguuugaccacugucacccagaaguguaugagcauugcaaaagguugcuguuacaccuacugaucguaaugggaccuaauagcaacauacgcacuguggcuucaguucuccuuagaaacaaggaguucaaugaacccaggguccugacagugaaacagguggcccauuuggacuacaacuuuaccgcaggcauuaaugauuucaucccagacuaccagccuuccccgaugacagauaguggucugaguucuuccucaacuagcucgucuauuagucucggcaacaauuccgcugccaucagccaucugcacaccacgauacuuaacgaggucgacauuucaguagaacaagaugggaaagugaagacacucauggaguuuaucaccucccggaaacguggaccccuguggaaucaugaagacguuucugcgaagaacccaagcaucaaaagugccgagcaguugacuaccuuccugaagcacguggucuccguguuuaagcagaguucuucagagggcauucauuuagaacaccaucuaagugagguugcacugcagacagcucucuccuguagcucucgccacuaugccgggcgaucguuccaaaucuuuagagcucuuaaacagccucugacugcaaccacauugucagaugugcugagcaggcucgucgaaacggugggagaccccggcgaggaugcccaggguuucguaauugagcugcuuuuaacccuggaauccgccauagacacucucgcugagacaaugaagcacuacgauuugcugagugcgcuaucucagaccagcuaucaugacccaaucauggggaauaaauacgcagccaaccggaaguccacuggacaacugaaucucucaacaaguccuauuaacucuagcuccuaucuuggcuacaauucaaacgcucgcagcaauucucugagauugucccugaucggugauaggcggggcgaccgaagacgcaguaacacccucgacaucauggaugggaggauuaaucacagcucgucccuggcccggacgcguucuuuaucaagccuuagagaaaaaggaauguaugacgugcagaguacuaccgagcccacaaaccugauggcaaccauauuuuggaucgccgcuucccuccuagaaucugauuacgaguacgaguaucuguuggcgcugaggcuccuuaacaagcuguugauucaucugccgcucgacaagagcgaaucacgcgagaaaaucgaaaauguucaguccaaguuaaaauggacuaacuucccaggccugcagcaacuuuuccugaagggguuuacaagugccagcacccaggagaugacaguccaccuacucucuaaacugauuucaguguccaagcacacuuugguggauccuagccagcugucuggauucccccucaauauccuuugccuguuaccacaucugauacaacacuuugacagucccacccaguucuguaaggaaacggcaucgcggaucgcuaaagucugcgccgaggagaaguguccuacauugguuaaccucgcacauaugaugucccuguacagcacccacacuuauucacgagauugcucuaauuggauuaacgugguauguagauaccuacaugacagcuuuuccgauaccacauucaaucuugugacuuaucuggccgaacuccuggagaaaggcuugaguucaaugcagcagucucugcuccaaaucauuuacagccuucugucccacaucgacuuaagugcugccccggcgaagcaguuuaaccuggaaauaauuaaaaucauugguaaguauguccagagccccuacuggaaggaggcauugaauauccucaaacuggugguuuccaggucugccagccuaguggucccaagcgauauaccuaagaccuacgggggagacacgggcucgcccgaaaucuccuucacaaaaauuuuuaacaauguaaguaaggagcuuccugguaaaacccuggacuuccacuuugauaucucugagacuccaauuaucggcaacaaguauggggaccagcauagcgcugccggacgcaauggcaaacccaaggugauagcuguuacacggucaaccuccucuacaagcagcggguccaacucaaaugcacucgugccugucagcuggaagagaccacaacugucucagcguaggacacgggaaaaauugaugaacguguuaagucugugcggacccgaguccggccucccgaagaacccuagcgucguguucucaucuaaugaagaucuugagguuggugaccagcagaccucccugauuucgacgacugaggauaucaaccaagaagaggaaguggccguagaggacaauagcagugaacagcaguuugggguguucaaagauuucgacuuucuagaugucgagcuggaggacgcugaaggagagucuauggauaacuucaauuggggcguucgccgaagaucccucgacagcaucgauaagggcgacaccccaucauugcaggaauaccaauguaguuccagcacacccucucugaaccuuaccaaucaggaggacacagaugaaucaagcgaggaggaagccgcacugacugcgucccagauucucucuaggacccaaauguuaaacagugacucggccacggaugagacaaucccugaccacccagaucuguugcugcagagcgaagacuccacugggucaauaaccacagaggaagugcuccagauucgggaugagacccccacucuugaggcuucucuggacaaugccaacagccgccuaccggaagauaccacaaguguccugaaagaggaacaugugacgacuuuugaggacgagggauccuauaucauucaggaacaacaggagucacucguaugccaggguaucuuggaucuggaagagaccgaaaugccugagccccuugcaccagagucuuacccugaaagcgugugcgaggaagacguuacacuggcuuuaaaggagcucgacgaaagaugugaggaggaagaggccgauuucuccggccugaguagccaggacgaagaggaacaagauggguuucccgaggugcagaccucuccauugcccucaccuuuccuguccgcaauaaucgccgcuuuucagccagucgcguaugacgaugaggaagaggccuggaggugccacgugaaucagaugcucagcgacacugauggaaguucugcagucuucacauuucauguguucucccgacuuuuucaaaccauucagcggaaguucggcgaaaucacgaacgaggcuguuucguuucugggugacagccuacagcguauugggacuaaauucaagucaucccuggagguaaugaugcucuguucugaaugcccgacaguguucgucgaugccgagaccuugaugaguuguggacuguuagaaacccuuaaauuuggcgugcuggagcuccaagaacaccuggacacuuacaauguuaagagagaggccgcagagcagugguuggaugacugcaaacgcacauucggcgcuaaggaagauauguauaggaucaacaccgacgcccagcagauggagauucuggcggaacucgagcuuugucggagacuguacaagcuacacuuucaacuguuacuccuguuccaggcuuacugcaaauugaucaaucaggugaacacaauaaagaacgaagccgaggucauuaauaugagcgaggaacuugcacagcuggagucaauccucaaagaagccgaguccgcuagcgaaaacgaggagaucgacauuucuaaggcagcccaaacuacgauagaaaccgcgauccauagucugauugagacauugaaaaauaaggaauuuaucuccgcuguggcccagguaaaggcauuccgcagccuguggcccucagauauuuuugggucuugugaggacgauccugugcagacucuacuccacaucuauuuccaucaccagacccuuggacaaacagguucguuugccguuauaggcagcaaccuggacauguccgaggcuaauuacaaauuaauggaacugaaccucgagaucagggaaagucugcgaaugguccagucuuaucaguugcuugcccaagcaaagccaauggggaauauggugucaaccggauucuga

SEQ ID NO: 56423 - RNA, 978 nt, Artificial Sequence
  derived and/or modified sequence opt3 from FRZB__Homo_sapiens__NP_001454
auggugugcggcagccccgggggaaugcugcuccuuagagccggucuguuggcuuuagcagcccugugccuacucagggucccuggcgcgcgggcugccgcaugcgagccaguucgcaucccgcuguguaagucccuucccuggaacaugaccaaaaugccuaaucaucugcaccacucuacacaggccaacgcuauuuuggcaauagaacaauucgaggggcuccugggaacucauugcucaccagaccugcucuuuuucuuaugugccauguacgcucccaucugcacgauugauuuucagcacgaaccuaucaagccauguaaaagugugugcgagcgagcccgucagggcugugaacccauucugaucaaguauagacauagcuggccugagaaucuugcgugcgaggaauugccaguauacgacagggguguguguauauccccggaggcaaucgucaccgccgauggggcugacuuccccauggauucuucgaacggaaauugccggggcgccucaagcgaacgcugcaaauguaagccuauuagagcaacacagaagacuuauuuuaggaacaauuacaacuaugugauccgggcuaaaguuaaggagauuaaaaccaagugccacgacgugacagccgucguggagguaaaagaaauccugaagaguucccuaguuaauauaccacgcgauaccgugaaccucuacacuucuagcggcugucugugucccccucuuaaugucaacgaggaauauauuaucaugggguacgaggacgaggaacgauccagacuguugcucguggagggaucaauugcggaaaaguggaaagauaggcuggguaagaaagugaagcggugggacaugaaauuacgucaccugggccucaguaagagcgauucuuccaauucagacagcacacaaagucagaaaucugggcgcaacuccaauccaagacaggccaggaacuga

SEQ ID NO: 56424 - RNA, 900 nt, Artificial Sequence
  derived and/or modified sequence opt3 from FSBP__Homo_sapiens__NP_001243070
auggugggcaaggccagaagcuccaacuucacccugucugagaaacucgaccuucugaaguuggucaaacccuacguuaagaucuuagaagaacacacaaauaaacauucagugauuguagaaaagaacaggugcugggauauaaucgcugugaauuauaacgcaauuggggucgaccggccuccacgcacugcccagggacugcgaacgcuauacaagcgucucaaagaguaugcgaagcaagaacugcuucagcagaaagagacccagagugauuuuaagagcaauaucuccgagccgacuaaaaaggugauggaaaugauuccccaaaucucuucguucugucugguuagagacaggaaccacauacagucagcuaauuuggaugaggaagcccaggcagguacaagcagucuccaggugaugcuggaccaucacccugucgccaucaccguggagguaaagcaagaggaagauauuaaaccacccccuccacugguucucaacucccagcagucugacacauuagagcagcgggaggagcaugaacuggugcacgucauggagcgcagccuuucccccucauugaguagcguggauaugagaaugaccucuuccccuucaagcaucccaaggcgggacgacuuuuuccgccacgagaguggcgaacauuuucgaucucugcuaggguacgauccgcaaauucuccagaugcugaaggaggaacaccagaucauacuugagaaucagaaaaacuucggacuguaugugcaagaaaagagagauggcuugaaaaggcggcagcagcucgaggaggaacuguuacgugcuaagauugaggucgaaaaacugaaggcaauccgccucagacaugaccuucccgaguacaauucccuguga

SEQ ID NO: 56425 - RNA, 2478 nt, Artificial Sequence
  derived and/or modified sequence opt3 from FSCB__Homo_sapiens__NP_115511
auggugggcaagagccagcaaaccgacgucaucgagaaaaagaaacacauggccauucccaaguccucuucaccuaaagcuacacauagaauagggaacacuucgggaagcaaggguuccuacucugcaaaggccuaugaaucgaucaggguuucaagcgagcugcagcagacguggaccaaacggaagcacggccaggaaaugacaaguaaaucccuccaaacugauaccauuguggaggaaaagaaagagguaaaacuuguggaggaaacagucgugccagaggaaaagucugcggacguucgcgaggcugccaucgagcugccggaaagcgugcaggaugucgagauucccccuaauaucccauccgugcaguugaaaauggaccgaucacagcaaaccagucguacuggguacuggacaaugaugaacauacccccuguagaaaagguugauaaagagcagcagaccuauuucagcgaaucugagaucguggucauuuccagaccagacucaagcaguacgaagucuaaagaggaugcauuaaagcauaaauccagcggaaagaucuuugccucggaacaccccgaguuccagccugcuacuaauucuaacgaagagauuggccaaaagaauaucuccaggaccucauuuacacaggaaacuaaaaaggguccaccggugcugcuagaggacgagcuccgggaagaggugaccguccccguugugcaggaagggagugcaguaaagaagguggccagcgcugagauagaaccuccauccacagagaaauuccccgccaagauucaaccuccacuggucgaggaagcgaccgcaaaggccgagccccgcccggcugaagagacgcaugugcagguucagccuucuacugaggaaacacccgaugccgaggcagcuaccgccguggcggaaaacagcgucaaagugcagccaccucccgccgaggaagcaccacuuguagaguuucccgcugagauccaaccuccaucagccgaagagaguccguccguugaacuguuggcugagauucugcccccuagcgccgaagagucuccaucagaggaacccccugcagagauccucccacccccggccgaaaagaguccuagcguggagcugcucggagaaaucagauccccaucugcucagaaagcgcccauugagguccagccuuuacccgcagagggcgcccuggaagaggcuccagccaagguggaaccucccacugucgaggagacacuugcagacgugcagccauugcugccggaagaggccccuagggaagaggcucgggaacuacaacucucgaccgccauggagacgcccgcagaggaagcgccaaccgaguuccagagcccccugccuaaagaaacaacugcugaggaagccuccgcagagauacagcuucuggccgcuaccgagccacccgccgaugaaacaccagcagaggcucgcucaccguugagugaagagacuucugccgaagaggcgcacgccgagguucagagcccacucgcugaagagaccacagcagaagaggccuccgcugagauccaacuguuagccgcaauugaagcgcccgccgacgagaccccugcugaagcccagucaccacugagcgaggaaacuucugcagaggaggcucccgccgaagugcaguccccuagugcaaagggcguaagcaucgaggaagccccgcucgagcuucagcccccaucuggggaagagacgacagcugaggaagcguccgccgcaauacaacuguuggcugccaccgaggccucagcugaagaggcaccagccgaaguccagcccccuccugcggaggaggcucccgccgaagugcagccaccgccugcagaggaagcccccgcugagguucaaccacccccugcagaggaagccccagcggaggugcagcccccuccggcugaagaggccccagcagaaguccagcccccucccgccgaggaggcuccagccgaagugcagccucccccagcagaggaagcuccugccgagguacaaagucuaccggcggaagagacucccauugaggaaacccuggccgcagugcacagcccuccugcugaugacguucccgccgaggaagcuagugucgacaagcauuccccuccagcagaucuccugcuuacagaggaauuucccaucggagaggccucugccgaggugagcccgccaccuucagaacagacccccgaggacgaagcucugguggagaaugucaguacugaguuccaguccccacagguugcggguauccccgcagugaaauugggcucugugguacucgaaggggaggccaaguuugaagaggucagcaaaauuaacuccgugcugaaggauuuaucaaauacaaacgacggacaagcuccuacgcuggaaaucgagagcguuuuccacauugagcuaaaacagcgaccgcccgaacucuga

SEQ ID NO: 56426 - RNA, 1482 nt, Artificial Sequence
  derived and/or modified sequence opt3 from FSCN1__Homo_sapiens__NP_003079
augaccgccaacggcacagcugaggcagugcagauccaauucgggcugauuaauugcggaaacaaguaccucacugccgaagcguuugguuucaaagucaaugcuagcgccuccucucuuaagaaaaagcagauauggacgcuggagcagcccccugacgaagcaggcucagccgcuguuuguuugagaagucacuuagggagguaucuggcagccgauaaagacggaaacgugaccugcgagcgggaaguaccaggcccggauugucgcuuucuaaucguggcucaugacgauggucgauggagccuccaguccgaggcccaccguagauacuucgggggaacagaggacaggcugucuugcuuugcgcaaacugucucgcccgcagaaaaguggucagugcauauugccaugcacccucagguuaauaucuauagcgugacccggaagcgcuacgcucaucuuagugccagaccagcagaugagauugcugucgacagggaugugcccuggggcguagacucccugaucacauuggccuuccaggaucagcgguauucuguucaaaccgcggaccaccgcuuucuccgacacgauggcagacugguggccaggccugaaccagcaacuggguacacacuggaguuccggagcggaaaagucgcuuuucgugacugugagggucgcuaucucgcccccuccggcccuucagggaccuuaaaggcuggaaaagccacgaaggugggcaaagacgaacuguucgcacuugagcagaguugcgcccagguggucuugcaggcugcgaacgaaagaaauguuagcacuaggcaagguauggaucugucugcaaaccaggacgaggaaaccgaucaggagacauuucaacuagagauagaccgggauacuaagaagugugccuuccgaacccauacagggaaauacuggacccucacggcuacuggaggcgugcaguccacagccucaagcaagaaugcaaguugcuacuuugacaucgaauggcgcgauagaaggauuacccugcgggccucuaacggcaaauucguaacuuccaagaaaaaugggcagcuugcugccagcguggagacagcaggagacucggaacuguucuugaugaagcucaucaaccgcccaauuaucgucuuuagaggugagcacggcuucauaggguguaggaaagugaccggaacgcuggaugcgaaucguucuuccuaugacguuuuucaguuagaauuuaacgauggcgcuuacaauauuaaggacucaaccgguaaguauuggacaguggggagugacagcgccgucacuuccucuggcgauaccccgguggacuucuucuuugaguucugcgauuacaacaaaguagcaaucaagguuggaggccgguaucugaaaggggaccaugccggagugcucaaggcuagcgccgagacagucgaucccgcaucacuuugggaauacuga

SEQ ID NO: 56427 - RNA, 1551 nt, Artificial Sequence
  derived and/or modified sequence opt3 from FSCN2__Homo_sapiens__XP_011522894
augcccaccaacggccugcaccaggugcucaagauccaauucgggcuugucaaugacacagauagauaccugacugccgagagcuuuggauucaaaguuaacgcuuccgcaccuucuuugaagaggaaacagacguggguguuagaaccagacccgggucagggcaccgccguacugcuacggucaagucaucucgggcgcuaucugagcgcggaggaagauggacgaguggcuugcgaggccgaacagcccggccgugacuguagauuucuuguccugccucaaccagaugguagguggguguugcgguccgagccccacgggcgcuucuuuggaggcacagaggaccagcucucuugcuucgcaacugccguuucgccugcugaacuguggaccgugcaucuggcaauucacccacaggcccaucucuuaucagucagcagaaggcgguacgugcaccuguguccccgcgaggaugaaauggcugccgacggcgauaagccuuggggaguagacgcgcuuuugacacugauauuucgaaguagaagguauugccuaaaauccugugauucucgguaccuccguagcgacgggcgccugguuugggagccagagccgagagcaugcuauacccuugaguucaaggccgguaagcuggcuuuuaaagauugugacggccacuacuuggcccccguggggccugcaggaacucucaaggcuggcaggaauacacggccagguaaagacgaacuguucgauuuagaagagucccauccccaggucgugcugguggccgcgaaccaccgauaugucucaguucgccaaggggugaauguaagugccaaccaggacgaugaacucgaccaugagaccuuucuuaugcagaucgaucaggagacgaagaaaugcacuuucuacagcucuaccggaggcuacuggacacuggugacucacggcgggauucacgcaaccgcuacacaagucuccgccaauaccauguuugaaauggaguggagaggaaggcggguggcuuugaaggccucaaacggucgcuauguuuguaugaagaaaaauggccagcuagcagccaucagcgacuucguggggccuccacccagaccggcuuggacgggaaaggucgcgggcggugcagcccagcaaacucugaguccucccgggaaagaugaagaguucacacucaagcugauuaacaggccaauccuugugcugcguggcuuggacggauuuguaugccaucaccggggcucuaaucagcucgauaccaaccgauccguuuacgacguguuccaucugagcuuuucggauggggcuuauagaauaaggggacgcgacgguggcuucugguacacugggucucacggauccgucuguucagacggcgaacgggccgaggauuuuguguucgaguuuagagaaaggggucgcuuagcaauccgagcccggagugggaaauaucugcguggcggagcuagcggccuacucagagccgacgcagaugcgccugcugggacagcccugugggaguacuga

SEQ ID NO: 56428 - RNA, 1491 nt, Artificial Sequence
  derived and/or modified sequence opt3 from FSD1__Homo_sapiens__NP_077309
auggaggaacagagagaggcccugaggaagaucauuaaaacccucgcugugaagaacgaagagauacagagcuucaucuacucccuuaaacaaaugcuguugaaugucgaagcaaacucugccaagguucaggaggacuuagaggcggaauuucagucacuguucagucuacucgaggaacugaaagagggcaugcuuaugaagauuaagcaagaucgggcuagccgcacauaugagcugcagaaucaguuggccgcaugcacucgagcccucgaauccucugaggaacugcuggagacggcuaaccagacccuccaagcaauggacucggaagauuuuccccaggccgcuaaacagaucaaggacggggugacaauggccccugcguuccguuuaucacugaaagcaaagguaagcgauaauaugagucaccuuaugguggacuuugcccaggagagacaaauguugcaggcucugaaauuccuaccagucccguccgcccccgugauugaucucgcagagucucugguugcugacaacugugugacucuugucuggaggaugccugaugaagacagcaagaucgaucauuacgugcuggaguaucggcgcaccaauuuugaaggaccacccagauugaaggaggaccagccuuggaugguaauagaagguaucaggcaaacagaguacacccucacuggccugaaauucgauaugaaguauaugaacuuucggguuaaagccugcaauaaggcgguggccggggaguucuccgaaccagucacauuagagacccccgcauuuauguuccgccuggacgcuucaacgagucaccagaaccuccgaguggacgaucuuagcguggaaugggacgccaugggaggcaaaguccaggauauuaaggcuagagagaaagacgguaaggggaggacugccucuccuaucaauuccccagcacggggaaccccgucacccaagcguaugccuagcggccgcggcgggagagauagguuuacagccgaaaguuacacuguucugggagacaccuugauugaugguggcgagcauuauugggaggugcgguacgaaccagacucuaaggcuuucgggguaggaguggcguaccgaucccuaggccgcuucgagcagcuggguaaaacagcagccagcuggugucuccacgucaacaauuggcugcaagugucguuuaccgcuaaacaugccaacaagguuaaagugcuugaugcacccgucccugacugccugggggugcacugugauuuccaccagggauugcucucuuuuuauaaugccagaacgaagcagguacugcauacuuucaagacaagguuuacccagccauuacugcccgcuuucacuguuuggugcggcuccuuucaagugacaaccggccuacaggucccgucagccgugcggugucuccagaaacgcgggagugcaacgagcuccucuaacaccagccugacauga

SEQ ID NO: 56429 - RNA, 1593 nt, Artificial Sequence
  derived and/or modified sequence opt3 from FSD1L__Homo_sapiens__NP_001138785
auggacagccagaaguacugcuucaaagagaacgaaaaugugaccgucgauaaggccuguuuucugaucuccaacauuacaauaggccccgagucuaucaaucuccaacaggaagcacuucagagaauuaucucaacucuggcuaacaaaaaugacgagauucagaacuucaucgauacguugcaccauaccuuaaaggggguucaagaaaauaguagcaacauacuguccgagcuagacgaggaauuugauucucucuauucgauccuggacgaggugaaagaaucaaugauuaauugcaucaagcaggagcaggccaggaaaagccaggagcuucaaagucagauuucccaguguaacaaugcgcuggaaaacucugaggaauugcucgaguucgcuacacggagccuggauaucaaggaaccugaggaguuuuccaaggccgcacgccagauaaaagaccgaguaacuauggccucagcuuuccgucugagucucaagccaaaagugagcgauaauaugacccacuuaauggucgacuuuucucaagaaagacagaugcugcagacacuuaaguucuugccggugcccaaggcaccugagauugauccaguugaaugccugguggccgacaacuccgucaccguggcuuggaggaugcccgaggaagauaauaaaaucgaccauuuuauucuagagcaccggaagacuaacuucgacggacucccucgcguaaaagaugagagauguugggaaaucaucgacaacauuaaggguacagaguacacccugucaggccuuaaauuugauagcaaguauaugaauuucaggguucgggccugcaacaaagcgguggcaggggaauacagugacccagucacgcuggagacuaaggccuugaauuuuaaccucgauaauucuuccagccaucugaacuuaaagguggaagacaccuguguggagugggaucccacaggaggcaaaggucaagagucgaagauaaaagggaaggaaaauaaaggacgcucuggcacuccuuccccaaagcgaaccucagucggcaguagaccgcccgcuguuagggggagccgggaccguuucacaggagaguccuauaccgugcugggugauacggccaucgaaucuggccagcacuacugggagguaaaggcacagaaagacugcaagagcuauucagugggggucgcuuacaaaacucucggaaaguucgaucagcuuggcaaaacaaacaccaguugguguauucacgugaauaacuggcugcaaaauacuuuugccgcgaagcauaacaauaagguuaaagccuuggacgugacagucccugagaagaucgguguguucugcgacuuugaugggggacagcuauccuucuacgacgcaaacagcaaacagcugcucuauucuuuuaagaccaaauucacgcagccaguacugcccggcuuuaugguuugguguggcgggcuuucacugaguaccggaaugcaagugccuagcgcuguccgcacauugcagaaguccgaaaaugguaugacuggcucugccucgagccucaacaacguggucacccaguga

SEQ ID NO: 56430 - RNA, 2250 nt, Artificial Sequence
  derived and/or modified sequence opt3 from FSD2__Homo_sapiens__NP_001007123
auggaggaagagagcggcgaagaacuggggcucgacagauccacccccaaggauuuccacuuuuaccauauggaccuuuaugauucugaagacaggcugcacuuguucccugaggagaacacacggaugcgcaaagugguccaggccgaaauggcuaaugagucacgaggagcuggugauggcaaggcccaacgugacuuacaggaagagguugaugagcuggugcaucuauacgggcucgaagacgaucacgagcugggagacgaauuuguagaugagaacaucccaagaacuggcgugagugaauauccgcccuacaugaugaaaaggcgggacccugcgcgcgagcagagagauuggaggcuuagcggugaggcugccgaagcagaggaccugggguucggaggcuggggcuccgccgggcagugccaagacuugcgggaagcauaucgcuacacgcauggacgagcaucugaggaauaugaguguuacgucauuccagaggaagaggaugaagaggaagccgcugacguguuuugcguuaccuguaagacacccauaagagccuuccagaaaguguuugaugagcacaaggagcacgaagucaucccucucaaugaggcgcuggaaucggcaaaggacgagauucauaaaaacauguacaagcuggagaaacagaucauugaaauggagaauuucgccaaccaccucgaagagguguuuaucacuguagaagagaauuucgguaagcaggagcaaaacuuugaaucacauuauaaugagauauuagaaacccuggcucagaaauacgaggaaaagauccaggcccuuggcgagaagaaaaaggagaaauuggaagcacuguaugggcagcuaguuagcugcggagagaaccucgauacauguaaggaacugauggagaccauugaagagaugugccacgaggaaaaaguggacuucaucaaggaugcugucgccauggcggacaggcuuggcaaauuucugaagacuaagacagauguggagauuagugcccaaccagaguucgaggaccagaccuuggauuucuccgacguggagcagcucauggguucuaucaauacgauacccgcaccuagcgcuccagucauuaacccgcaaguucccaauuccgccacugggucaagugugcggguauguuggagccuguacucugacgauaccguggaauccuaucaguuaucauaccguccuguccaggacagcaguccaggaacagaucaggcugaguuuacugugaccguuaaagaaacauauugcucugugaccaaccugguccccaauacgcaauacgaguucugggugacugcccacaaccgcgcaggcccuuccccaagcucggaaagagccguauacaugacagcucccucuccgccuaucauuaagaccaaagagaucagguccugugaggaagcgguucucaucugcugggagucaggcaaccuuaaucccguggacaguuauacugucgaacugacacaggcagagagcccagaagccuccggggugaccgagucugucguggguauuccuacgugugagagcguugugcaguugcagcccggacggucauacauaaucuauguacgagcucuaaacaugggcgggccaaguguccgcuccgaacccgccaccgugcauacaauuggaagcuacuuuagacugaauaaggauacuugccacccuuggcucaccaucucugaggacggccugacagcaguuaggucagaacggcgcacuccagccagagagcuuaguccgagcgauacccauuucacaaggugcguggcugucauggguaaccugauacccgugcgugggcaccauuauugggaaguagagguggacgagcacuuggauuaccggguuggcgucgccuuugcagacgugcgaaaacaagaagaucucggagcgaauugucuguccuggugcaugagacacaccuucgcuucuucgaggcauaaguaugaguuuuuacacaaccgcacuacgccugacauucggaucacagugccacccaagaaaaucggcauucugcuagauuacgaacauagcaagcucuccuucuuuaaugucgaccugucacagcaccuuuacaccuucaguugucaguugcacgaguuuguucauccuugcuucucucuggagaaaccagggugucucaaggugcacaacggaaucagcaugcccaaacaugugacuuuuuauuga

SEQ ID NO: 56431 - RNA, 390 nt, Artificial Sequence
  derived and/or modified sequence opt3 from FSHB__Homo_sapiens__NP_001018090
augaagacccugcaguucuuuuuccucuuuugcuguuggaaagccaucugcuguaacagcugcgagcuuacaaauauuacuauagcuaucgaaaaggaggaauguagauucugcauuuccaucaacacgaccuggugugcaggcuacugcuauacaagggaccugguguacaaagaucccgcccggccuaagauucagaaaacuuguaccuuuaaggaguuggucuaugaaacaguucgcgugccagggugcgcgcaccaugcugacucuuuauacaccuauccgguagccacucaaugucacugcggaaagugcgauucagacaguacagauuguaccgugcgaggucugggccccagcuacugcuccuucggggagaugaaagaguga

SEQ ID NO: 56432 - RNA, 2088 nt, Artificial Sequence
  derived and/or modified sequence opt3 from FSHR__Homo_sapiens__NP_000136
auggcccugcuccuugugagccuguuggcuuucuuaucccugggcucugggugccaccauagaaucugucacugcucaaacagggucuuucuaugucaggagaguaagguuaccgaaauucccagcgaccucccucggaaugcaauagagcugcgcuucgugcuuacaaaacugcgaguaauccaaaagggagccuuuuccgguuucggcgauuuggagaaaauugaaaucucucagaacgacgugcucgaagucauugaggcggauguguuuucgaaucugccaaagcugcaugagauccguauagaaaaagcuaacaaucucuuauacaucaacccggaggccuuccagaaucugcccaaccuucaguauuugcugauuucaaauacugggaucaagcaccuaccugacguucauaagauucacagccuccaaaaagugcugcuugauauccaggacaacauaaauauucacacgaucgaaagaaacaguuuugucggacuguccuucgagucugugauuuuguggcucaauaagaacggcauccaggagauccauaauugcgcauuuaacgguacccagcuggaugaauuaaaccugagcgacaauaacaaucucgaggaacuuccaaacgauguauuccacggggccuccggacccguuauucuggacauaucaaggacacggauccauaguuugccuagcuacggccuagagaaucugaaaaagcuccgcgcuagaucuacuuauaaccugaaaaagcugccaacccuugaaaaguugguggcacucauggaggccucccugacauaccccucacacuguugcgcuuuugccaauuggaggcggcaaauuagcgaguuacacccuaucuguaacaaaaguauacugcgccaggaagucgauuauaugacccaggcgcgaggccagagaucuucccuagcagaggacaaugaaagcucguacucuaggggguucgauaugacuuauacagaguuugacuacgaccucugcaacgaagugguggaugucaccuguuccccaaagccggacgccuucaaucccugcgaggauauuaugggauacaacauccugcggguucuuaucugguucauuucaaucuuggcuauuacggguaauauaaucgugcugguaauucucacuaccagucaauauaaacugacagugccucguuuucuuauguguaaccuggccuucgcagacuugugcaucggcaucuaccuccuguuaauugcuagcgucgauauacauacuaagucccaguaucacaauuacgccaucgacuggcagaccggggcgggaugcgaugccgcaggcuuuuucacaguguuugcuucugagcugagcguuuauacccuaacggccauuacucucgaacgcuggcauacaaucacccacgcuaugcaacuggacuguaaagugcagcuuagacaugccgcaucagucauggugauggguuggauuuucgccuuugcugcggcauuguucccaaucuuugggauaaguuccuacaugaagguaagcaucugccugcccauggauauugacucuccucucucacagcuguauguuaugaguuuacuggugcuuaacgucuuggccuucguggucaucuguggaugcuacauucacaucuaccucacugugaggaacccaaauauaguuagcuccucuucggauacacggauugcuaaacgaauggccaugcugaucuuuaccgacuuccuauguauggcacccauuagcuuuuucgccaucuccgcuucacugaaggugccgcucauaacgguaaguaaggccaaaauccugcuugucuuguuccacccuauuaacucuugcgcaaaucccuuucuguaugcgaucuucaccaagaacuuucgcagagacuucuuuauuuuacucagcaaauguggcugcuacgagaugcaggcucaaaucuauaggacagaaacuuccucaaccgugcauaauacacacccacggaacggccauuguagcucugccccucgcguuacuuccgggaguaccuacauacuggugccccuuagccaccuggcacagaauuga

SEQ ID NO: 56433 - RNA, 1746 nt, Artificial Sequence
  derived and/or modified sequence opt3 from FSIP1__Homo_sapiens__XP_011519608
auggacaucauuaagggcaaccuggaugggauaagcaaacccgccuccaauucuagaaucaggccuggaucacggaguagcaacgcuucccucgaggugcuuucuaccgaaccagguucguucaaggucgacacagcaucaaaucugaacagcggcaaagaggaucacagugaauccucuaauacugagaaccgccgaacgagcaaugacgauaagcaggaauccugcucagagaaaauuaaguuggccgaggaagggagugacgaggauuuagaccugguucaacaucagaucauuagcgaauguucugaugagccgaagcuaaaagagcucgacucccagcugcaggaugcgauccaaaagaugaaaaagcuggacaaaauacuugcuaagaagcagcguagagaaaaagagaucaagaaacagggauuggaaaugaggauuaagcucugggaggaaaucaaaucagccaaguacagcgaggcauggcagaguaaagaggaaauggagaacaccaagaaguuucugucucugacagccguguccgaagagacuguaggccccagccacgaagaggaggauaccuucucgucuguguuucauacacaaauuccuccagaagaguaugaaaugcagaugcagaaacucaauaaggacuuuaccugcgacgucgagcggaacgaauccuuaaucaaaucagguaagaaacccuucaguaauacugagaagauagagcugcgcgggaagcacaaccaggauuucauuaaaagaaauaucgaacuugcuaaggagagcaggaacccugugguuaugguggaccgggaaaagaagcgcuuggucgagcugcuaaaagaucucgacgagaaggauuccggacugucuagcucagaaggcgaccaaaguggcugggugguaccaguuaagggguacgagcuugcagugacacagcaucagcaacuggccgaaauugauaucaaauugcaggagcucuccgcugccagccccaccaucucuucauuuaguccucgacuggaaaauagaaacaaccagaagccagacagggauggagagcggaauauggaggucacgccgggugagaaaauuuuacguaacacuaaggaacagcgcgaccugcacaauagacucagggaaauagaugagaaacuuaagaugaugaaggaaaacgugcuggagagcaccuccuguuugucugaggaacaacuaaaaugccugcucgacgaguguauccugaagcagaaaucgauuaucaaacuuagcuccgaacggaaaaaggaggacauagaagaugugacacccgucuucccucagcugucacgaaguauuaucucuaaauugcucaaugagagcgagacuaagguucagaagaccgaaguggaggacgcggauaugcuggaauccgaggagugcgaagcaucaaaaggcuauuacuuaacaaaggcccugaccgggcacaacaugagcgaggcucuaguaacggaagccgagaauaugaaaugucuccaauuuucuaaggacgugaucauuuccgauacuaaagacuauuucaugaguaagacacugggaaucggccgccuuaagagacccagcuuuuuggaugacccacuguacgguauuucugucucccucucaagugaagaucagcaucugaaacuuagcucgccugagaacaccauagcagacgagcaggaaacuaaggaugcugccgaggaaugcaaagagccauga

SEQ ID NO: 56434 - RNA, 954 nt, Artificial Sequence
  derived and/or modified sequence opt3 from FST__Homo_sapiens__NP_006341
auggugagagccaggcaccagcccggcgggcugugccuccuucuguuguuacugugucaauucauggaggaccggagcgcucaggcaggaaacugcuggcuacgccaggccaagaauggucgaugucagguccucuacaaaaccgaacuguccaaggaggaaugcuguucuacaggccgucuuucaacuucuuggacggaggaagauguuaacgacaauacccuguuuaaauggaugaucuucaacgggggagcgccuaauugcauuccauguaaggagacaugcgagaacguggauuguggcccggguaaaaagugcagaaugaauaagaaaaacaagcccagguguguaugcgcuccugacugcagcaauauaacuuggaaagggccaguguguggauuggauggcaagaccuaucggaacgaaugcgcccuccugaaagcacgcuguaaggagcaacccgaacuggagguccaguaccagggcagaugcaagaaaacauguagggacguguuuugcccuggguccucuaccuguguuguggaucagacuaauaacgccuauugcgucacauguaaucggaucugcccagagcccgcuucgucagaacaauaccucuguggaaacgacggugugaccuauagcagugcaugccauuuacgcaaggccacgugccugcuuggccgauccauuggguuggcuuacgagggaaaauguaucaaggccaaaucuugcgaagauauucaguguacuggcgguaagaaaugccugugggacuucaagguagggagaggaagguguagccuaugcgaugagcucuguccugacuccaagucagaugaaccaguuugcgcgagugacaaugcaaccuaugccagcgagugugcuaugaaagaggccgcaugcaguuccggcgugcugcuugaagucaagcacucaggcagcuguaacuga

SEQ ID NO: 56435 - RNA, 927 nt, Artificial Sequence
  derived and/or modified sequence opt3 from FSTL1__Homo_sapiens__NP_009016
auguggaagagauggcuggcccucgcucuugcacugguggccgucgcguggguuagggcugaggaagaguugcggagcaaauccaagaucugcgccaacguguucuguggcgcagggcgcgaaugcgccguaaccgagaaaggagaacccacauguuuaugcauugagcaguguaagccucacaaacgaccagugugcgguucuaauggcaagacuuaccugaaccauugugagcuacaccgugacgcuugccucacggggucaaagauacaagucgauuaugacggacauuguaaagaaaagaaaagugugagcccguccgcaucucccguugugugcuaccagucgaauagagaugagcugaggcggcgcaucauucaguggcuugaagccgagaucauuccugacggcugguuuucaaaggguagcaacuauagugagauccuggauaaauacuucaagaauuuugacaacggggauuccagauuggacucuagcgaguuccucaaguuugucgaacagaaugaaaccgcuauaaacaucacaacuuauccagaucaagagaauaacaaacugcugaggggacucuguguggacgccuuaauugaacuguccgaugagaaugcggacuggaaacuuucauuccaggaguuuuugaagugccugaaccccaguuucaauccuccagaaaagaaaugcgcacuagaggaugaaaccuacgccgacggcgcugagacagaaguagacuguaaccggugcguuugugccugcggcaauuggguguguaccgcaaugacuugcgaugggaagaaccagaaaggagcucagacacaaaccgaggaggaaaugacgcgcuauguccaggagcuccagaagcaccaggaaacugccgagaagaccaaacgagugagcacaaaggaaaucuga

SEQ ID NO: 56436 - RNA, 792 nt, Artificial Sequence
  derived and/or modified sequence opt3 from FSTL3__Homo_sapiens__NP_005851
augagacccggcgccccugggccacuguggccgcuccccuggggagcucuugcaugggccguggguuucgucagcuccaugggcucugggaacccugcgccaggaggcguuugcuggcugcagcaaggucaggaggcuaccuguucauugguguuacagacagacguaacuagggccgaaugcugugcaagugggaauaucgauacggccuggagcaaccugacccaccccggaaauaagauuaaccuacucggcuuucugggccuugugcauugccugccuuguaaagacuccugcgauggggucgaguguggaccagguaaggcuugccggauguugggcgggcgcccccgaugugaaugcgcaccugacuguucuggacucccagcccgucuccaggugugcggcucggauggugcuacauacagagacgagugcgaacugagggccgcgcggugucgcgggcacccggaucugucaguuauguauagaggaaggugccggaaaagcugugagcauguggucugcccccgcccucaaaguugugugguagaccagacuggcuccgcacacugcguugugugucgagccgcuccaugccccgucccuucuagcccaggccaggaguuaugugggaauaacaaugugaccuacauauccucaugccauaugagacaggccacauguuuccugggaaggaguaucggugugcggcacgcaggcagcugcgcugggacccccgaggaaccgccuggaggcgaaucugccgaggaggaagagaacuuugucuga

SEQ ID NO: 56437 - RNA, 2529 nt, Artificial Sequence
  derived and/or modified sequence opt3 from FSTL4__Homo_sapiens__NP_055897
augaagcccggcggguucuggcugcaccucacccuucugggagccagcuugccugcugcauuagguuggauggacccaggcacauccagagggccggaugugggagucggcgagucucaggccgaagaacccaggucauuugaaguuacucggcgcgagggucugaguagccauaacgaacuacucgcguccugcgggaaaaaguucuguucucgaggaucgcguugcgugcugucaagaaaaacgggcgagccugagugucaaugccuugaggcuuguaggccaagcuacguacccgugugcggcagugacgggcgguuuuaugagaaucacuguaagcugcaucgcgccgcaugcuugcucggaaaaagaaucaccgucauucacuccaaggauuguuuccugaagggugacacaugcacuauggccggcuacgcuaggcugaaaaacgugcucuuagcacugcagacccggcuucagccuuugcaggaaggggauucucgccaagacccagccagccagaagcgacugcuaguugagucccucuuuagagaucuggacgcugauggaaauggccaucuuucaaguagcgagcuggcccagcacguguugaaaaagcaggaccucgaugaagaccuguuagguuguucucccggggaucugcucagguucgacgacuauaacuccgauucaagccuuacacugcgggaguuuuacauggcguuccaagucgugcaguugagucuagcaccugaagaccguguaucuguuaccacugugacagucggacuguccaccgugcucacgugcgccgugcacggcgaucugcgcccaccgauaaucuggaaaagaaauggccuuacucugaacuuuuuggaccucgaggauauuaaugacuucggggaagaugacagccuguauaucaccaaggucacaacuauucauaugggaaacuauaccugccacgcuucgggucaugagcaguuauuucagacacacguucugcaagugaauguacccccugugaucagggucuacccagagucucaggcccaggaacccggcguggcagcuucccuacggugucacgccgaggggauaccuaugccacgaaucaccuggcucaagaacggaguugaugugucaacgcaaaugaguaaacagcugagccuuuuggcgaauggcuccgaacugcauauuucuagcguccgcuacgaggacacuggugccuacacaugcaucgcaaagaacgaaguggggguagaugaggacauuucaagucucuucaucgaggacuccgcuagaaaaacccuggccaauauacuuuggagggaagagggccugagcguuggaaacauguuuuauguguucucugaugacggcauuaucgucauucaccccguggauugugaaauccagcggcauuugaagccgacugagaaaaucuucaugucauacgaagagauuugcccucagcgcgagaagaaugcuacacaacccugucagugggucagugccgugaacguuagaaacagguauauauacguggcacagccagcccucagccguguacuggucguggacauccaggcucaaaaaguuuuacaguccauugggguggauccucugcccgcgaagcuaucuuaugacaagucgcacgaucaggucugggugcucagcuggggagacguacauaaaucccggccaucacuucaggugaucaccgaagcaaguacgggucaaucucagcaccugauacgaacccccuuugccggcguugaugacuucuuuauuccuccaacaaauuugaucaucaaccacauuagauucggguuuaucuucaauaagagcgauccggcuguccauaaaguggaccuggagacuaugaugccccucaagaccauuggacugcaccaucacggcugcgugccucaggccauggcacacacacauuuagguggguacuuuuucauacaguguaggcaagauuccccagccucagcugcccgccagcugcuugucgacagcguuacugacucuguguugggccccaacggagaugugaccggcacaccucacaccuccccagacgggcgguuuaucguaagugcagcggcugauagccccuggcuccauguccaggaaauuacugugagaggagagauccaaacgcuguaugaccuacagaucaauucugguauuuccgaucuggccuuccagaggucauuuacagagaguaaccaguacaauauauacgcagcccuccacaccgaaccggaccugcuuuucuuggagcugagcacuggcaaaguugggauguuaaagaaccucaaggaaccuccagcuggacccgcccaaccuuggggcgguacccaucgcaucaugcgagauucggggcuguuuggccaguaucuucugacacccgcacgggaguccuuguuccucauuaauggacgucagaacacccugagaugcgaagugucuggcaucaaagggggaacuacagucguguggguuggcgagguguga

SEQ ID NO: 56438 - RNA, 2541 nt, Artificial Sequence
  derived and/or modified sequence opt3 from FSTL5__Homo_sapiens__NP_001121899
auguucaagugcuggagcgugguccugguucucggcuuuaucuuccuugaguccgaagggagacccaccaaagagggagguuacggccugaagucuuaucagccuuugaugagguuacggcacaaagaaaagaaccaagagucaagucgcgugaaaggguuuaugauucaggacggaccauucggcagcugugaaaauaaguacugcggucuggggcgacauuguguaacaucccgugagacuggacaggccgagugcgcuuguauggaucuaugcaagagacacuauaaaccgguguguggcucugacggcgaauuuuacgagaaccauugcgaaguccacagggcagccugucucaagaaacagaagauaacgaucgugcauaaugaggauugcuucuuuaaaggggacaaguguaagaccacagaguauucgaaaaugaagaacaugcugcuugaucugcaaaaucagaaauacauuaugcaggaaaacgagaaucccaacggagacgauaucucacggaagaaauugcucguugaccagauguucaaguauuuugaugcggacagcaauggucugguggauauuaacgaacugacucaagucaucaaacaggaggaacucggcaaggacuuauucgauugcacccuguacgugcuuuugaaguacgacgacuuuaaugcugauaaacaccuggcccuagaggaguucuaucgcgcauuucagguaauacagcucagucugccugaagaccaaaaacuuuccaucacagccgcuaccguugggcagucugcagugcugagcugcgccauucagggaacuuugagaccacccaucauuuggaagaggaacaauaucauacucaacaaucuggauuuagaggacauuaacgauuucggcgacgaugguucccuguacaucacaaaggucaccacgacucacguggggaacuauaccuguuacgcugacggauaugaacaaguguaccagacacauauuuuccaggucaauguuccuccagugauccggguauaucccgagucacaggcccgcgaaccuggcgugacugcgagucuccgaugccacgcagagggcaucccaaaaccgcaacuuggguggcugaagaacggaauugauauaacccccaaguugagcaaacagcuaacacugcaggccaaugguucugagguccauaucuccaacgugagauacgaagacaccggcgcuuacacguguauugccaagaaugaggcagggguugaugaagacaucucaagccucuuuguggaggacagugcuaggaaaacucuggccaacauacuuuggcgggaagagggacugggcauugguaauauguucuaugucuuuuacgaggaugggaucaaggugauccagccuauugaaugcgaguuccaacgucacaucaaaccaucugaaaaguugcucggcuuucaggacgagguaugucccaaggcggagggagaugaaguucagcgcugcgugugggccuccgcagucaacgugaaagacaaguucauuuaugucgcucagccuacacuggauagaguguuaauaguugacgugcaaagccagaaaguaguccaggccgugucgaccgauccaguucccgugaagcugcacuacgacaaaucucaugaucaggucugggugcuauccuggggcacucucgagaagacaucaccgacccugcaaguaaucacgcuugcuagugggaaugugccucaccauaccauucacacacagcccguuggaaagcaguuugacagggucgaugacuucuuuaucccaacuaccacauugaucauuacucauaugcgguucgguuuuauacugcacaaagaugaagccgcacuccaaaagaucgaccuggagaccaugagcuauauuaaaacaaucaaccuuaaggacuacaaaugugugccucagucccuggccuauacccacuugggcggguacuacuucauuggaugcaagcccgauucuacuggcgcugugagcccacaggucaugguugacggugugacggauucagugaucggguuuaauagugacguaacaggcacccccuaugucuccccugauggacauuaccucgugagcauaaacgacguuaaaggccuggugcgaguccaguauaucacuauucgcggggaaauccaagaggcguucgauauuuacaccaauuuacacaucucugaccuggcauuccagccaucauuuacagaggcccaucaguauaacauauacggaaguagcuccacccagacugaugugcuauucguugaacucucuucggguaaggugaagaugauuaaaagccugaaggagccgcuuaaagcugaagaguggcccuggaauagaaagaacaggcaaauccaggacuccggcuuguuugggcaguaucugaugacaccuucaaaagauagucucuucauucuggacggacgguuaaacaagcugaauugugaaaucacggagguagagaagggcaacaccgucauaugggugggugaugccuga

SEQ ID NO: 56439 - RNA, 1626 nt, Artificial Sequence
  derived and/or modified sequence opt3 from FTCD__Homo_sapiens__NP_996848
augagccagcugguggagugcguccccaacuucuccgaaggcaagaaucaagagguuaucgacgccauuucuggggcuauaacccagacaccuggaugugugcuccuugauguagacgcagguccaucaacuaacagaacgguguacaccuuugucggcccgcccgaaugcgugguugagggggcccugaaugcggcuaggguggccagucgguugaucgauaugagccgccaccagggagaacauccucgaaugggcgcauuagacgucuguccauucauucccgugcgugguguauccguugaugagugcgugcugugugcccaggcuuuugggcaaagacuagcagaggaacucgacgucccuguguaucuguacggagaggccgcuaggauggauucucggcgcacacuuccagccaucagagcgggcgaauaugaggcacugcccaaaaaguugcagcaggccgacugggcuccugauuucggcccaucgucauuugugccgagcuggggagccacugcaaccggggcuaggaaauuccucauugccuuuaacaucaaucugcuggguacaaaggagcaggcgcaccggauagcccucaacuuacgcgaacaaggccgagggaaagaccagcccggaagacugaagaagguccagggcaucgguugguaccuugaugagaaaaauuuggcacagguuaguaccaaccugcuagacuucgaagugacugcucuccauacaguauaugaggaaaccugcagggaggcccaagagcugucccuuccuguggucgggucucagcuggugggauugguuccacucaaggcucuguuagaugccgcagccuuuuacugugaaaaagagaaucuguucauucucgaagaggaacagcggauccgucuuguggucagccgccugggcuuggacucccuaugccccuuuucaccuaaggagagaauuaucgaguaucuggugccagaaaggggccccgagcgggggcucggaaguaaaagccugcgagcuuucguaggugaaguuggcgcgcgcucugcagccccugggggaggcuccguggcugccgcagccgcugccaugggugcagcgcuugggucaauggucggccugaugacguacggaagaaggcaauuucagagcuuggacacuaccaugcggcgccucauaccgcccuucagagaggcuagugccaagcugacaacuuuaguggaugcagacgccgaggcuuucaccgccuaccuggaagcaaugaggcuaccaaagaacacaccugaggaaaaagaucgucggaccgcugcccuccaggagggccugagacgagcggucucugugccccuuacguuggccgaaacuguugcuucccuguggccagcacuccaggagcuggccaggugugggaaucuugcuugccgcagcgaccugcaaguggccgcaaaggcguuggagaugggaguauuuggugccuauuucaacguccucauuaaucugcgggauaucacagacgaggcuuuuaaagaucagauucaccauagagugucgucuuuacugcaggaagccaagacccaggcagcucuaguucucgacugucuggaaacuaggcaagaguga

SEQ ID NO: 56440 - RNA, 552 nt, Artificial Sequence
  derived and/or modified sequence opt3 from FTH1__Homo_sapiens__NP_002023
augaccacagccagcacuucccaggugagacaaaacuaccaccaggacucugaggcugcaaucaauaggcagauuaaccuggaacucuaugccucauacgucuaucuuaguaugagcuacuauuucgaucgggacgauguugcgcugaagaauuuugcuaaauacuucuugcaucagucccacgaggaacgcgagcaugccgaaaaguuaaugaaacugcaaaaccagcgaggcgggcguauauuucuacaggacaucaagaaacccgauugcgacgauugggagucuggacucaaugcaauggagugugcccugcaccuugaaaagaacgugaaucagucgcuguuggagcuccauaagcuggcuacggacaaaaacgauccucaccugugcgacuucauugaaacccacuaucucaaugagcaaguaaaggcaaucaaagaguuaggugaucaugugacaaaccugagaaagaugggcgccccagaaucagggcuugcugaguacuuguuugacaaacacacucugggagauagcgacaaugaaaguuga

SEQ ID NO: 56441 - RNA, 528 nt, Artificial Sequence
  derived and/or modified sequence opt3 from FTL__Homo_sapiens__NP_000137
augagcucccagaucagacaaaacuacucuaccgacguggaggccgcugucaauucacugguuaaccucuaucuucaggcaaguuacacauaucugagcuugggcuucuacuuugauagggacgauguggccuuagaagggguaucccacuucuuucgggagcuggcggaagagaagcgcgaaggauaugagcgacuacucaaaaugcagaaucagcgugguggcagagcucuguuccaagacauuaagaaacccgccgaggaugaaugggggaagacuccugacgcaaugaaagccgcuauggcacuugagaagaagcugaaccaggccuugcucgaucugcaugcucugggaucugccaggacggacccacaccucugcgacuuuuuagaaacccauuuccuggaugaggaggugaaacuuauaaagaaaaugggcgaucacuugacaaaucugcaucggcuaggugggccggaagcgggacucggcgaguaccuguuugaacgccuuacucugaagcacgacuga

SEQ ID NO: 56442 - RNA, 729 nt, Artificial Sequence
  derived and/or modified sequence opt3 from FTMT__Homo_sapiens__NP_803431
augcugagcugcuucagacuccuuuccaggcacaucucucccucacuggccaguuugcggccugugcgcuguugcuuugcuuuaccacugcgaugggcaccgggccguccccuagacccuagacagauugccccaaggcggccccucgcggcugccgcaagcucccgcgauccuaccgggccagccgcuggacccucuagagucaggcaaaacuuccauccugacucggaggcagccauaaaucggcagaucaaccuggaacuuuacgcuucauauguuuaccugagcauggccuauuacuuuagucgcgaugacguggcguugaauaacuucucccgauauuuucuccaccagucuagagaggaaacagagcaugcagaaaagcugaugaggcugcagaaucaacgggguggccguauucgccuccaggauaucaaaaagccagagcaggacgauugggagagcggguuacacgccauggaaugugcucugcuuuuggagaaaaacguaaaucagucccugcuagaacuccaugcccuggcaucagacaagggagauccgcaccuuugcgacuuccuggagacuuacuauuugaacgagcaagugaaaaguauuaaggaacucggcgaucacguccauaaucuggugaagaugggugcucccgacgccggguuagcggaguaccuguuugauacgcacacccucggaaacgaaaauaaacagaacuga

SEQ ID NO: 56443 - RNA, 1518 nt, Artificial Sequence
  derived and/or modified sequence opt3 from FTO__Homo_sapiens__NP_001073901
augaagagaacccccacagccgaggaaagggagcgggaagcuaaaaagcugcgccuccuugaggaacuggaggacacuugguugccuuacuuaacgccaaaagaugacgaguucuaucagcaauggcagcugaaguacccgaaacuaauccuccgagaagcaagcuccgugucugaggaacugcacaaggagguccaggaggccuuucuuacccugcauaagcacggcugcuuguuccgugaucucguuaggauucaggggaaagaccugcugacacccgugucaagaauacucaucggaaacccugguuguacuuauaaguacuuaaauacccggcuguuuacaguaccauggcccgugaaaggcaguaacauuaagcauaccgaagcggagaucgcugccgcaugcgaaacuuuccuuaaauugaaugauuaucugcaaauugagacaauccaggcccuagaagaacucgcugcaaaggagaaggccaacgaagacgcugucccucuguguaugagcgccgauuuuccacgcguggggaugggauccucuuacaauggccaggacgagguugauauaaaaucgagagcggcauauaacgugacccuucugaauuucauggacccccagaagaugccuuacuugaaagaggagccauacuuugguauggggaagauggccgucucauggcaccaugaugaaaaccucguggacaggagcgcuguagccguuuauaguuacuccugcgagggaccggaggaagagucugaagaugacagccaccuggagggccgggaccccgauaucuggcacgugggcuucaaaauuuccugggacaucgaaacgccuggguuagcaauuccacugcaucaaggagauuguuauuuuaugcucgacgaucuuaaugcuacucaccagcauugcguccuggccgguucacagccccgcuucaguagcacccaccgaguggcggaguguucuacaggcacuuuggacuacauccuacagagaugccaacuggcccuccagaacgugugugaugacgucgauaaugacgauguuucccugaagucauuugagccugcagugcuuaaacagggggaagagauacacaacgaaguagaguucgaguggcugaggcaauuuugguuccagggaaaucgguaucguaagugcaccgacugguggugucagccaauggcucaguuggaagcccucuggaagaaaauggagggcgugacaaacgcuguccugcaugaagugaagcgcgaggguuuacccguugaacaaagaaaugagauucugaccgccauccuagcaagccucacggccaggcagaaccugcggcgagaguggcacgcucgcugccagaguagaauugcgaggacucuuccggcagaccagaaaccugaaugccggcccuacugggagaaggaugacgccucuaugccauugccuuucgaucugacagacaucguguccgaacuccgcgggcaacugcuugaggcuaaacccuga

SEQ ID NO: 56444 - RNA, 579 nt, Artificial Sequence
  derived and/or modified sequence opt3 from FTSJ1__Homo_sapiens__NP_001269086
auggcccugaacaucgcuacccacgugcucaagcccggcgggugcuucgucgcaaaaauuuuuagaggaagggacguuacacuucuguacagccaguugcaaguguucuuuuccucuguauuaugugccaagccucggucaagucgcaauagcuccauagaggcguucgcugugugccaggguuaugauccaccggaaggcuuuauccccgaccugucuaaaccucuacucgaucauucguacgacccagauuucaaccagcuggacgggcccacucgaauuaucgucccuuuugugacguguggagaucuuucaagcuaugacagugaucguuccuacccacuggacuuggagggcgguucugaauauaaguacacacccccuacccagccaccgauuagcccucccuaucaagaggccugcacucucaaaagaaaggggcagcuggcaaaggaaaucaggccacaggauugucccauaucccggguugacaccuucccucagccacuggccgcuccccaaugccacacacucuuagcaccggagauggaggauaaugaaaugucauguaguccuuga

SEQ ID NO: 56445 - RNA, 741 nt, Artificial Sequence
  derived and/or modified sequence opt3 from FTSJ2__Homo_sapiens__NP_037525
auggccggcuaccugaagcucgugugcgucagcuuccagagacaaggguuucacaccguuggauccagguguaaaaaccggacaggugcugagcaucuuuggcugacucgccacuugcgagaccccuucgugaaggcagccaaaguagaaucuuaucguugcagaucagcguuuaaguuacuggaggugaaugaaaggcaucagauccuacggccuggccuccgcguccuggauuguggggcugccccaggagcauggagucagguggccguucagaaagugaacgcugcaggcacggacccgagcucccccgucgguuucgugcuugggguagaucuguugcacauuuuuccucucgagggagccaccuuccugugcccagcugacguuacagaucccagaacuucucaaaggauacuggaagugcucccuggccggcgcgccgacgucaucuuaucggauauggcgccaaaugcaaccggcuuucgagaccuggaucaugacagacuuauuucauugugucugacacuacucagcgugacccccgauauccugcagccugggggaacuuuccuuugcaagacaugggccgguagucaguccaggcggcugcagcgucgcuugaccgaggaguuucaaaacgugagaauuaucaagccagaggcuucuaggaaagaaagcuccgaagucuacuuccucgccacgcaguaucacggccggaaggggacuguuaaacaguga

SEQ ID NO: 56446 - RNA, 2544 nt, Artificial Sequence
  derived and/or modified sequence opt3 from FTSJ3__Homo_sapiens__NP_060117
augggcaagaaagggaaggugggaaaaagcagaagggacaaguucuaccaccuggccaaagagaccgguuaucggucccgcucugcuuuuaagcucauccagcuuaaccgacguuuccaauuucugcagaaggcaagagccuuguuagaucugugcgcggcucccggcggguggcuacaggucgccgcaaaauucaugccuguuucaagucucauugugggaguagaccuggugccaauaaagccgcuucccaaugucgugacacugcagcaagauaucacuacggaaaggugucggcaggccuugcgcaaagagcucaagaccuggaaaguugacgugguccugaacgauggcgcuccuaaugugggugcaagcuggguacaugacgccuacucccaggcucaccugacacucauggccuuaagacuggcgugcgauuuucuugcaaggggagggucuuucauuacuaagguuuuucggucgcgcgacuaucagccauugcuguggaucuuccaacagcuauuucgaagagugcaggccaccaagccccaggcuucaaggcaugaaagcgccgagauuuucgucgugugucaaggcuuucucgcaccugauaaaguggacaguaaguucuuugauccaaaauucgcuuucaaggaagucgagguucaggccaaaacagugaccgagcugguaacuaagaaaaagcccaaggcggaaggcuacgccgagggggaccuuacacuguaucaccggaccuccgugacggacuuuuugcgugcagcuaacccugucgauuuccucucuaaagccagcgaaaucaugguggacgaugaggagcuggcucagcauccagccacuaccgaagacauacgcguuugcugucaagauaucagaguguuaggaaggaaggagcugcggucccuccuuaauuggcgaacaaaacugcgcagauacgucgcaaagaaauugaaggaacaggccaaggcucuagacauuucacugaguagcggugaggaagaugagggcgacgaggaagauucuacugcggggaccacaaaacagccguccaaggaggaagaggaagaggaggaagaggaacagcucaaccaaacccuggcagagaugaaagcccaggaaguggcugagcuuaagaggaaaaagaagaaacuguugcgggagcagcgcaagcagagagaaaggguagagcucaaaauggaccugcccggaguuucaaucgccgaugaaggcgagacggguauguuuagcuuaaguacuauucgugggcaccaacugcuagaggaagugacacagggagacaugucugcagccgauaccuuccucuccgaccugccucgggacgauaucuaugucagcgacguggaggaugacggcgaugacacuucgcuugauucugacuuggauccagaggaacuggcuggcguccgagggcaccagggacucagagaccagaagaggaugcgccugacagaagugcaagaugacaaagaggaggaagaggaagagaauccccuucugguuccuuuggaagagaaggccgugcuccaggaggaacaggcaaaccugugguuuuccaaggguucauucgcgggcauagaggaugacgcugacgaagccuuagagauuagucaggcacaacugcuauuugaaaaucggagaaaagggaggcagcagcaacagaagcagcagcucccacaaacgcccccgagcugccugaaaaccgagaucauguccccucuuuaccaggaugaggcccccaagggaaccgaggcuucuagcggcacagaagccgcaacugguuuggaaggggaggagaaagacggcauuucagauagugacuccagcaccucuucagaagaggaagagaguugggaaccacugcgcggaaagaaacgaagccggggcccuaaguccgaugacgauggguucgagaucguacccaucgaggacccagcuaagcaucguauucucgaucccgaaggacuggccuuaggugcggucauagccucuucgaaaaaggcuaaaagagaccugaucgauaacagcuuuaauagguacacauucaacgaggacgaaggcgagcuuccugaaugguuugugcaggaggagaagcagcaccgcauucggcaauugccaguugggaaaaaggaaguggagcauuauagaaagagguggcgagaaaucaaugcacgcccgauuaaaaaggucgccgaggcuaaagcccggaagaaaagaaggaugcucaagcgucuggaacagacucgcaagaaagcagaggcggugguaaacaccguggauauauccgagcgggaaaagguugcccagcuaagaucacuguacaaaaaggcuggacucggcaaagagaagaggcacgucacauaugugguggccaagaaaggugucgggcgaaagguucggcgccccgcaggcgugagaggacacuucaaagugguagacaguaggaugaagaaagaccagcgggcucaacagcgaaaggaacagaaaaagaagcauaaaagaaaguga

SEQ ID NO: 56447 - RNA, 1998 nt, Artificial Sequence
  derived and/or modified sequence opt3 from FUBP1__Homo_sapiens__NP_001290362
auggccgacuacagcaccgugcccccuccauccucuggcucagcugggggagguggcgggggaggcggugggggaggcgucaacgaugcauucaaggacgcccugcagagagcgaggcaaaucgcugccaaaauuggcggggaugcaggaacaagucucaauagcaacgacuaugguuacggcgggcagaagcggccgcuugaggauggagacggcuccuggacuucucccucgucaacgacccacugggaagguaugccuagcccauuuaaagaucagcccgacgccaagaaaguugcuccucagaaugauaguuucgggacacaacugccacccaugcaucagcagcagucccgcucugugaugacugaggaauauaagguaccugacggaauggugggcuuuauaaucggccgagggggagagcaaauuagccguauccagcaggaauccgguugcaagauucagaucgcaccagauucaggcggguugccggagagaaguuguauguuaaccggaacacccgagagcguccaaucugccaaaaggcugcuagaccagauaguggaaaagggccggccugcuccagguuuccaccauggggauggccccggaaacgccguucaggagaucaugauuccugcguccaaagcaggccucgugaucgggaagggaggugaaaccauuaaacaacugcaggagcgcgccggcgucaagauggugaugauccaggacgggccacagaauacuggagcugacaagccccuuagaauaacaggcgauccguacaaaguacaacaggccaaggagaugguucuggaauugauuagggaccaggguggguuucgggaggugcgcaacgaauauggcucacgaaucggaggcaaugaggggauugaugucccuauccccagauucgcagugggaaucgugauugguaggaacggcgaaaugaucaaaaagauacagaaugacgcugggguccggauucaauuuaaaccagaugacggaaccacgccugagcguaucgcccagauaacuggucccccagaucgcugccagcacgcggccgagauuaucaccgaccuccugagaagcguucaggcaggcaaccccgggggcccuggaccaggcgggaggggacggggccgaggucaagggaauuggaacaugggaccgcccggcggucugcaggaguucaauuuuaucgugccuacaggcaagacugggcucauuaucggaaaaggcggggaaaccauuaagaguauaucucagcaguccggagcucgcaucgaauuacaaagaaacccacccccuaaugccgauccaaacaugaagcuguucacaauuaggggcacgccccagcagaucgacuacgcucggcaacuuaucgaggagaaaauuggugggccgguaaacccuuugggaccacccgugccucauggcccccacggugucccaggcccucacgggcccccaggaccgccuggccccgggaccccaaugggacccuauaauccugccccauacaaccccggcccuccggguccagcaccccaugggccuccagcccccuacgcuccucagggauggggcaaugcguauccgcacuggcagcagcaagcacccccagauccugccaaggcugguacugaccccaacagcgccgcaugggccgcuuacuaugcccauuacuaucagcagcaggcacaaccaccucccgcggcuccagccggcgcaccgacaaccacucagacaaaugggcagggagaccagcaaaacccugcccccgcuggccagguggauuacaccaaagccugggaagaguauuacaagaaaauggggcaggcaguuccagcucccacgggagccccuccaggcggucaacccgacuacucggcggccugggcugaauauuaccgccagcaggcagccuauuacgcucagaccucuccucaagggaugccgcagcacccacccgccccucagggacaguga

SEQ ID NO: 56448 - RNA, 1719 nt, Artificial Sequence
  derived and/or modified sequence opt3 from FUBP3__Homo_sapiens__NP_003925
auggccgagcuggugcagggccaaagcgcucccgucgggaugaaggcagaaggauucguugacgcccuccacagagugaggcagaucgcggcuaaaauugauuccauaccucaucuuaacaauucuaccccacugguagacccgucaguguacgguuauggcguccagaagcggcccuuggaugacggggugggaaaccaguuaggcgcccugguucaccaacgcacagugaucacugaggaauuuaaagucccugauaagaugguggguuucauuaucgggcgaggaggcgagcagauuagucguauccaggcagaaagcggcugcaaaauacagaucgccuccgagucuucggggauuccagagagacccuguguacuaacgggaaccccugaaucaaucgagcaagcuaagaggcuccugggucagauuguugaccggugccgcaauggcccaggguuucauaacgauaucgacagcaauaguacaauacaggaaauucuuauccccgcauccaaggugggacuggucauuggcagagguggggagacuaucaaacaguugcaagagaggaccggagugaagauggugaugauccaggauggcccucucccaacaggcgccgacaaaccgcugcggauuaccggggaugcuuucaagguccagcaagcccgcgaaaugguucuggagauaauccgagaaaaagaccaggcggauuuuagaggagugaggggugacuucaacucucggaugggcgggggaagcauugagguauccgugccccguuuugcagucggcaucgugauaggucgcaauggggaaaugauuaagaagauccagaacgacgccggcguuagaauccaguucaaaccugaugacggaauuucaccagagagggcugcccaagugauggggcccccugaucggugucagcacgcagcucauaucauuagugagcucauauuaacugcccaggaacgagacggcuuuggaggucuggcggccgcacgcggcagagggaggggacggggcgauuggagcgucggugcuccagggggcgugcaggagaucacauacaccguacccgccgacaagugcggacuuguuauuggcaaagggggagaaaauaucaagucuaucaaccaacaguccggugcucacguggaguugcagcgcaauccgccucccaacucagauccaaaucugagaagguucacgauucguggcgucccucagcaaauagaaguggcccggcagcuaaucgacgagaaagucgggggaacuaaccucggcgcacccggugccuuugggcagagcccauucagucagcccccugcuccaccgcaccaaaauaccuuucccccucgaucuuccggcuguuucccaaacauggcggcaaaggugaacggaaauccccauagcacaccuguuucgggcccacccgccuuccugacucagggguggggaucuaccuaucaggcuuggcaacagccgacacaacaggugccuucccagcagucacagccacagaguagccaacccaacuacuccaaagccugggaggauuauuacaagaagcagucucacgcagccagcgcugccccucaggcaucaagucccccagacuauaccauggcgugggcugaauacuacagacagcaaguagccuuuuauggccagacgcuuggucaggcacaagcccauucccaggagcaguga

SEQ ID NO: 56449 - RNA, 768 nt, Artificial Sequence
  derived and/or modified sequence opt3 from FUCA1__Homo_sapiens__XP_011539469
augcccgaacuguacgaccucgugaacagcuauaagccugaucuuaucugguccgacggcgaaugggagugcccagauaccuacuggaacucuacaaauuuccugucaugguuguauaaugacaguccggucaaagaugaaguugugguaaacgacagaugggggcagaauuguagcugccaccauggagguuacuauaacugugaggauaaguuuaaaccccaauccuuaccugaccacaagugggaaaugugcacuucuauugauaaauucucguggggcuacaggcgggacauggcccugucagaugugacggaggagagcgaaauaaucagugagcuaguccagaccgugucccucgggggaaauuaucugcuuaacauuggcccaacaaaggacggucugaucguucccauuuuucaggaacgcuugcucgcuguggggaaguggcugucuaucaauggagaggcaauauacgccagcaaaccuuggcgaguccagugggagaagaacacuaccuccgugugguacacaucaaaaggcagugcgguauaugcuaucuuccugcauuggccagaaaauggcguucucaacuuagagagccccauuaccacuucuacaaccaagaucacgaugcuggggauucaaggagaucuuaaaugguccacugacccugacaaggguuuguuuaucucacugccacagcuaccgcccagcgccgugccugcagaguucgccuggaccauaaagcucacaggcgucaaauga

SEQ ID NO: 56450 - RNA, 1404 nt, Artificial Sequence
  derived and/or modified sequence opt3 from FUCA2__Homo_sapiens__NP_114409
augagaccccaggagcugccuaggcucgccuucccacuucuguuguuacugcuacuccugcuuccgcccccuccaugccccgcucacagcgcaacccgguuugacccuacaugggaaucccuggaugcccgccaauugccagcgugguucgaccaggcuaaguuuggcaucuucauucauuggggaguguuuucuguccccucauucgggagugagugguuuuggugguacuggcagaaagaaaagauaccuaaauauguugaguucaugaaggauaacuacccaccgagcuuuaaauaugaagacuucgguccccucuuuacugccaaguucuuuaaugcaaaccagugggccgauaucuuccaggcuuccggcgcaaaguacauugugcugacgucuaaacaccaugagggguucacccuguggggaucggaguauucauggaauuggaacgccaucgacgaaggcccuaagcgagauauuguaaaagagcucgaaguggcuauccguaauagaacagacuuaagguuuggucuguacuauagccuuuucgagugguuucacccauuguuccuggaggaugaaaguuccucuuuucauaagcggcaauuccccgucagcaaaacucuaccugagcucuacgaacuggugaacaauuaccagccagagguucuuugguccgacggggauggaggcgcccccgaccaguauuggaacucaaccggcuuucuggcgugguuguacaaugaaaguccggugcgcgggacagucgugaccaacgauagauggggagcagguagcauauguaagcacggcggguucuauacuugcucugacagguacaauccuggacaccuccugccccauaagugggagaacuguaugacaaucgacaaauuauccuggggcuaucggcgcgaggccgguauuucagauuaccugaccaucgaggaacucguaaagcaacuuguugaaacggugagcugcgggggaaaucuguugaugaacauuggcccaacucuagacggcaccaucagugucguguuugaggaacgacugagacagauggggucuuggcucaaagugaauggagaggcuauauaugagacacacacuuggaggucccagaacgauaccgucacaccugacguuugguacaccagcaagcccaaagaaaagcugguguacgccauuuuccuuaaauggccaacgucgggucagcuguuuuugggccaucccaaggcaauccucggggcuacugagguaaagcuguuaggacacggccaaccucugaacuggauuucucuagaacagaaugguaucaugguggagcucccacagcugacaauccaccaaaugccguguaaaugggggugggcccuugcguugaccaacgucauuuga

SEQ ID NO: 56451 - RNA, 468 nt, Artificial Sequence
  derived and/or modified sequence opt3 from FUNDC1__Homo_sapiens__NP_776155
auggccaccagaaaucccccuccacaggacuacgaaagcgaugacgauuccuaugaagugcuggaccucacagaguacgcuaggcggcaccaaugguggaaccgcgucuucggccauucuucagggccgaugguugaaaaguauaguguggcaacucagaucguaaugggaggugugacgggcuggugcgccggguuucuuuuccagaaagucggaaagcuggcggcuaccgccgugggcgguggguuuuuguuacugcagauugcaagccacuccggauacguucaaauagauuggaaacgaguggagaaggacgucaacaaagccaagcgucagaucaagaaaagagcuaauaaggcagcccccgaaauuaacaaucuaaucgaggaggcuacagaguucauuaaacagaacaucgugauaucuucgggcuuuguaggcggguuccuccugggacuugccucauga

SEQ ID NO: 56452 - RNA, 570 nt, Artificial Sequence
  derived and/or modified sequence opt3 from FUNDC2__Homo_sapiens__NP_076423
auggagaccagcgcccccagagcuggcucccagguggucgcaacaacugccaggcacucugcggcuuaccgggccgacccucugcgcguuucaagucgagauaagcucacggaaauggcagccagcucccaagggaacuucgagggaaauuuugaaucucuugaccuggcugaguucgccaaaaagcagccaugguggcguaaauuguuuggucaggaaucgggcccgucagcagagaaguauagcguggcuacccaguuauucaucgggggaguaacaggcuggugcacugguuuuauuuuccaaaaaguggggaagcuggccgcgaccgcagucggaggcggcuuuuuccuacuccagcuggccaaccauacaggguacauaaagguggauuggcagagaguugagaaagacaugaagaaagcuaaggaacagcuuaaaaucaggaagaguaaucaaauucccaccgaggugcgguccaaggccgaagaggucgugucuuuuguuaaaaagaacguacuggugacuggagguuucuuuggcggguucuugcucggaauggcaagcuga

SEQ ID NO: 56453 - RNA, 2385 nt, Artificial Sequence
  derived and/or modified sequence opt3 from FURIN__Homo_sapiens__NP_001276752
auggagcugagacccuggcuccuuuggguggucgccgcuaccggcacacugguuuuguuagcagccgacgcgcaggggcaaaagguguucacuaacacgugggcuguaaggaucccuggagguccagccguggcaaauagcgucgcccggaaacacggcuuucugaaccuagggcagauuuucggagauuacuaucauuuuuggcaccgcggcgugaccaagcgaucccucucuccgcaucgucccagacacucaaggcugcagcgggaaccucagguucaauggcuugagcaacagguggcuaaacgcagaacaaagagggacgucuaccaggaaccaacugaucccaaauucccucagcagugguaucugaguggugugacccagcgggacuugaauguaaaggcagccugggcucagggguacacaggacauggcauaguugugagcauccucgaugacggcauugagaagaaccacccagaucuggccgggaauuaugaccccggagcguccuuugaugucaacgaccaagauccugacccacagccgcgcuacacccagaugaaugauaaccgacacgguacuagaugcgcaggcgaaguggccgcuguggccaauaacggggucuguggaguuggcguggcauauaaugcuaggaucggugggguacggaugcuggacggagaggugacagacgccgucgaggcgcguucucucggcuuaaaccccaaucauauucacaucuacucggccucauggggcccugaagaugacgggaaaaccguggauggaccagcacgccuggcugaggaagccuucuuuagagguguuagccaaggcaggggagggcuuggcaguauauucgugugggcuuccgguaacgggggccgggagcaugacucuugcaauugugauggauacacgaacagcaucuauacuuuguccauuucaagugccacccaguuuggcaacguccccugguacagcgaggcauguucuuccacacuggccacuaccuauucaagcgggaaucagaacgaaaagcagaucgugacaaccgaccuacgacaaaaaugcacggagagucacacuggaacaucugcuuccgcgccucucgcagccgguauuaucgcucugacccuugaagccaauaagaaccugacuuggcgcgauaugcagcacuugguaguucagacaagcaaaccagcacaucucaaugccaacgacugggcuaccaauggcguggggagaaaggucucgcacucuuacggauauggccuguuagaugccggugcaaugguggcgcuggcucagaacuggacgaccgucgcaccccaaaggaagugcauaauugacauccucacagagccgaaagauauugggaagcggcuugaagugcgcaaaacuguuaccgccugucugggcgagccuaaucauaucacaagauuggagcacgcccaggcuaggcuaacucuguccuacaaccgucggggagaccucgccauccaucuggugucacccaugggcacccgaaguacacuucuggcagcuagaccacacgacuauagcgccgauggguucaaugacugggcguuuaugaccacucacuccugggaugaagacccuucuggagaguggguauuggaaauugagaacacgagcgaagccaauaacuacgguacacucaccaaguucacucuggucuuauacggcaccgcucccgaggggcugccagugcccccugagucaaguggaugcaaaacacuaaccuccagccaggcauguguugugugcgaagagggcuuuucucuccaucagaagucauguguccaacacugcccaccggguuucgcuccccaggugcuggauacucauuauaguacagaaaaugacguagagacgauaagggccagcgugugcgccccuugucacgcauccugcgcgaccugucaggggccagcccuuacugauugcuugucuugucccucgcacgcuagccuggacccuguugaacagacaugcucccgccaaucacagaguucucgggagagcccaccccagcaacagccgccuagacucccacccgaggucgaagccggccagaggcugcgcgcaggacuucugccuucccauuugcccgaggugguggcuggccucucaugugccuucaucguccugguuuuugugaccguguucuuaguacugcagcuacgaagcggguuuucuuuccggggagucaaaguguacacaauggaucguggccucauuuccuauaagggucugccaccugaagcauggcaagaggagugccccagugacagcgaagaggaugaagggagaggagagaggacugccuuuaucaaggaccagucugcucuuuga

SEQ ID NO: 56454 - RNA, 1569 nt, Artificial Sequence
  derived and/or modified sequence opt3 from FUS__Homo_sapiens__NP_001164408
auggccagcaacgacuacacccagcaagcuacacaguccuauggcgcauaccccacucagccugggcagggauauucucaacagucaagucagccauacggucagcaaagcuauuccggcuacucucagucgacggauaccucaggguauggacagagcaguuacuccucuuacggccagagccaaaauacagguuaugggacucaguccaccccgcagggauacggcucaacaggcggguauggaaguagccaaucuucccagucaagcuacggucagcagaguucuuaucccggcuacgggcaacagccugccccauccagcaccucgggaucuuauggcuccucaagucagagcuccucuuacggucagccccaaagcgggucauacagucagcagccuuccuauggaggccagcaacagagcuacggccagcagcaaucuuauaacccaccccagggguacggacagcaaaaucaguauaacucaaguagcgguggcgggggaggcgguaauuacgggcaggaccaguccucuaugucgagcggcggaggcuccgggggagguuauggcaaccaagaucagucagggggaggcgguagugggggcuacggacagcaggacagaggcgggaggggacgggguggcucugggggaggcggugggggcggaggcgggggauacaaucgcagcuccggcgguuaugagccucgagggcguggaggcgguagaggcgggaggggaggcaugggagggucagaucggggcgguuucaacaaguuugggggaccacgcgaccaaggcagcagacacgauucugaacaggacaauuccgauaacaauacuaucuucgugcagggucugggcgagaacgucacaauugaaaguguugcggacuacuuuaaacagauagggaucauuaagaccaauaaaaagacgggacaaccgaugaucaaccucuauacugauagggagaccggcaaacuuaagggggaagcuacagugagcuucgacgaucccccuucugccaaggcagccauugacugguuugacggaaaagaguucuccggcaauccaaucaagguaucauuugcuacucggcgcgcagauuucaaccgaggugggggaaacggcagagguggcagggggcggggaggccccauggggcguggaggcuacggugggggaggcaguggcgggggaggucgcggcggguuuccuagcggaggcggugggggaggcggccagcagagagccggggacuggaaaugcccaaaucccaccugugagaacaugaauuucucguggaggaacgaaugcaaucaauguaaggcuccgaaaccugauggacccgguggcgggccaggaggcucccauaugggugggaacuauggagacgaucggcgaggcggccgcgggggauacgacagagguggcuauagggggcggggaggcgaucgcgguggguuuagaggaggcaggggcgggggagaccgugguggcuucgggccuggaaagauggauucucggggcgagcaccgacaggacagaagggaacgccccuacuga

SEQ ID NO: 56455 - RNA, 1440 nt, Artificial Sequence
  derived and/or modified sequence opt3 from FUT10__Homo_sapiens__NP_116053
auggugagaauccagaggcggaagcugcucgccagcugccuuugugucaccgcuacaguuuuccuguuggugacuuuacaaguaaugguggagcugggcaaauuugaacgcaaggaguucaaauccucuucacuacaggacgggcacacgaagauggaagaggcacccacccaucucaacaguuuucugaaaaaggaaggacuuacauucaaucgaaagcguaaaugggagcuggauagcuacccuauuauguuguggugguccccacucacuggugagaccggcagacuggggcagugcggagccgacgcgugcuuuuucacaauaaacaggaccuaucugcaccaucacaugacuaaggcuuuucucuucuacggcacagauuuuaauaucgacucuuuaccgcugccccggaaagcccaucacgauugggcagucuuccacgaagagucgccuaagaacaauuauaaacuuuuucauaagccagugauuaccuuguucaacuacacggccacuuuuucacgccacagccaucugccccuaaccacacaguaucucgaaaguaucgagguucugaagucccuuagauaccuggugccuuugcaaucuaaaaauaagcucaggaaacggcuggcuccauuagucuaugugcagagcgacugugaucccccuuccgaccgcgauucauacguacgagagcugaugacuuacauugaaguugacaguuauggugagugucucagaaacaaggaucuuccacagcagcugaaaaauccggcaagcauggacgccgauggguucuacaggaucauagcucaauauaaguucaucuuggccuuugaaaacgcggugugcgacgacuacauuaccgagaaauucuggcggccccuaaagcugggagucgugccuguguauuacggcucuccauccaucacagauuggcuccccucaaauaagagcgcaauucuggucagugaauuuucucacccucgugagcuugccuccuauauccgcagacuggacagcgaugacagguuguacgaggcuuacguugaauggaaacucaagggcgagauaucgaaccagcggcuguuaaccgcccugcgagaacgcaaauggggagugcaggauguaaaucaggacaacuauauugaugcauucgaguguauggugugcacgaaggucugggcuaauaucagacuacaagaaaaagggcucccacccaagaggugggaggccgaggacacucaccugucuuguccggaaccuacaguguuugcguucucaccccuucggaccccaccuuuguccagucugcgcgagauguggauuagcuccuuugaacagucuaagaaagaggcccaggcacucagauggcugguugauaggaaccaaaacuucagcucacaggaauuuuggggucuuguguucaaggacuga

SEQ ID NO: 56456 - RNA, 1431 nt, Artificial Sequence
  derived and/or modified sequence opt3 from FUT11__Homo_sapiens__NP_001271123
auggccgcuggccccaucagagugguccugguucuccuuggggugcugagcguaugcgcagccuccggacacgguucuguggcggagagggaagcuggcggggaggccgaaugggcagagccuugggacggagccgucuuccggccaccgucagcuuugggcgcaguggguguuacccgcaguagcgggacaccccgaccuggacgugaagaggccggcgauuuaccagugcugcuaugguggucccccggccucuuuccucauuucccaggggacucugagagaauugaaugugcuaggggagccugcgucgcgucgcggaaccgcagagcacugagggauucacggacucgcgcccuucuguuuuacgguacggacuuccgagcuagcgccgcacccuugccuagacucgcucaccagaguugggcccugcugcaugaggaauccccacucaauaacuuuuuacugucucacggcccggggauaaggcuuuucaauuugaccagcacauuuucccggcauucagauuauccccugagucuacaauggcucccuggaacugcguaccugcgucgcccagugcccccuccaauggagagagccgaguggaggcggcgaggcuaugcaccccuucuguacuugcagagccacugugacguaccggcugaucgcgacagauauguuagggaacucaugcggcacaucccuguggauucuuacgguaagugccugcagaaccgcgaguuacccaccgccagacugcaggacacagcuaccgccacuacagaagauccagagcuccuugcauuccuguccagguauaaauuucauuuggcccuagaaaaugcuauuuguaacgacuacaugaccgagaagcuguggcguccuaugcaccucggggcgguccccguguaccggggaucaccaagcgugcgagauuggaugcccaauaaccauagugucauccugauugacgacuucgagucuccucaaaaacuugcagaauuuaucgauuuccuggacaagaaugaugaggaauauaugaaauacuuggccuauaagcagccaggcggcauaacgaaccaguuucuccuggacuccuuaaagcacagagaguggggaguuaaugauccgcugcuacccaacuaccucaauggguucgaaugcuucgugugugacuaugagcuggcuaggcuugaugccgagaaagcacacgccgcuagcccuggugacucgccaguauuugaaccccauaucgcccagccuucucacauggauugcccagugcccacuccgggcuucgggaacgucgaggaaauuccugagaaugacuccucauuggugcaaguucgcgaucauuguaucugccugcgguuucucuggccacacagugaaaagggaagaacccauaacuacgcagcggugcccuga

SEQ ID NO: 56457 - RNA, 1098 nt, Artificial Sequence
  derived and/or modified sequence opt3 from FUT1__Homo_sapiens__NP_000139
auguggcugagaagccacaggcagcucugccuugccuuccuguuggugugugucuuauccguuaucuuuuuccugcauauucaccaagacucuuuuccccauggccuagggcucucaauacugugcccugaucggcgccuugugaccccaccgguagcuaucuucugucugcccggaacagcaauggguccuaacgccaguagcuccugcccacagcaccccgcgucuuugucgggcacuuggacgguguacccuaaugggcgauuuggaaaccagaugggccaguaugcuacccuccuggcccuggcacaacucaauggucguagagccuucauuuuaccagcuaugcaugcagcccuggcucccgucuuuaggaucacacuuccuguguuggccccagagguugacucacggacuccguggcgcgaacugcagcuacacgauuggaugagcgaggaauacgcggaccucagagaucccuuccugaaacuuaguggguuuccuuguuccuggaccuucuuucaccaucugagggagcagauucggcgcgaguucacauugcacgaccaucuccgagaagaggcacagucugugcugggacaauuaagacugggcaggaccggcgaucggccacguacuuuugucggggugcacguacgcagaggagacuaucuccagguuaugccccagagguggaaggguguggucggcgauagcgccuaccuucggcaggcuauggacugguuccgagcccgccacgaagcaccuguguucguggucacauccaacgggauggaguggugcaaggaaaauaucgauaccucacaaggagacguuacguuugcuggcgauggucaggaggccacuccauggaaagacuucgcgcuguugacccaguguaaccauacaauaaugacuaucgggaccuuuggauucugggccgcauaucuagcuggcggcgacacaguguaccuggccaauuuuacccuccccgauagugaguuccugaagauuuuuaaaccggaagcugccuuccuuccugaguggguagggaucaacgcagaccugagccccuuguggacgcucgccaagccauga

SEQ ID NO: 56458 - RNA, 1032 nt, Artificial Sequence
  derived and/or modified sequence opt3 from FUT2__Homo_sapiens__NP_001091107
augcuggugguccagaugcccuucagcuuuccuauggcccacuucauccucuuuguuuucaccguguccacaauuuuucauguacaacagagacuugcuaagauacaggcaaugugggagcugccagugcagaucccggucuuggccucuacuucaaaagcguuaggccccagucaacugagggggauguggacgauuaacgcuaucggacggcuagguaaucagaugggcgaauacgccacccucuaugcacuggccaagaugaacgggcgcccugcuuucauuccagcacagaugcacagcacacuugcccccaucuuucgaauaacucugccuguguugcauuccgcuaccgccucucguaucccauggcagaauuaccaccucaacgacuggauggaggaagaguauagacauauucccggagaauacguuagguucacaggcuauccuugcucguggaccuuuuaccaccaucugcggcaagagauccugcaggaguucacucuccacgaucacgugcgcgaagaggcgcagaaauuuuuaagaggucugcaggucaaugggucaaggccaggaacauucgugggcguacauguucggcgcggcgacuaugugcacgucaugccgaagguguggaaagggguggucgcagaucgaagauaccuucaacaggccuuggacugguuuagggcucgguacagcagucugauuuucguugugaccuccaacggaauggccuggugucgugaaaauaucgauacgucucacggugacguaguguucgcaggcgaugggauagagggaagccccgcuaaggacuuugcccuacucacucagugcaaccauaccauuaugacaaucggcacuuucgguauuugggcggccuaucugaccgggggagauacaaucuaccuugcaaauuauacccugccugacuccccauuuuugaagaucuucaaacccgaggcugccuuucucccugaauggacgggcauugcugccgaucugucaccauuacugaagcacuga

SEQ ID NO: 56459 - RNA, 1086 nt, Artificial Sequence
  derived and/or modified sequence opt3 from FUT3__Homo_sapiens__XP_011526169
auggacccccugggcgccgcuaagccucaguggccauggagaaggugccucgcagcccuucuguuccaauuguuaguggcggucugcuuuuucagcuaccugcggguuucccgcgaugacgcuaccgggucuccgcgagcccccucaggaaguagccgucaggauacaacuccuacgagaccaacccuacucauccugcuuaggacauggcccuuucacauuccuguggcacugucccgguguucugagaugguaccagguacugccgacugucauauaaccgcugaucgcaaaguguauccccaggcagacauggucaucgugcaccauugggauauuaugucgaacccuaagucaagauugccaccgagccccaggccucagggccaacgguggaucugguucaaucucgaaccacccccuaacugccagcaccuggaggcccuggaccgcuacuuuaaucucacaaugaguuaucgauccgauucugacauuuucaccccauacgggugguuagaacccuggagcggacagccggcucauccuccccugaaccuuuccgccaaaacugaguugguugcgugggcagugucaaauuggaagccagauagugccagagucagguauuaccagagccugcaagcucaccuaaaaguggacguauauggccggucucacaagccucuccccaaggguacaaugauggaaacccugucccguuacaaauuuuaccuugccuucgagaacucacugcauccagauuauaucacggagaaguuguggcgcaaugcacucgaggcuugggccguucccgugguccuggggccuagcagaaguaacuacgaaagguuuuuaccaccggacgcguucauacacguggacgauuuucagucucccaaagaccuggcccgguaucuccaggaacuugauaaggaccaugcacgauaccuguccuauuuccgcuggagagagacuuugaggccucggagcuuuucgugggcucuagauuucuguaaagccugcuggaagcugcagcaagagucucgcuaccagaccgugagauccaucgcugccugguucacauga

SEQ ID NO: 56460 - RNA, 1593 nt, Artificial Sequence
  derived and/or modified sequence opt3 from FUT4__Homo_sapiens__NP_002024
augagaaggcuguggggcgccgcucggaagcccagcggggcaggaugggagaaagaaugggccgaggcgccucaggaagcuccaggugccugguccggccgccucgggccgggacgaucuggccguaaggguagagcagugcccgggugggccucauggccugcucaccuugcacuggccgcuaggccagcccggcauuugggaggcgcgggccaagggccccgcccuuuacacaguggaaccgcaccauuccauagcagagccuccggugagaggcagcggcgccuggaaccccagcuacagcacgagucucgaugcagaucgucaacacccgcugacgccuggagggcagaggcugcccucccaguccgggcgaugggcgccccgugggggagccccacugcagcugccggaggccgucgcgguuggagaagggggcggggacugccuuggacgguuugugugcuugcugccgcaggccugaccugcacagccuugaucacuuacgcuuguuggggccaacucccaccccugccuugggcgaguccaacccccucccgaccgguaggggugcugcucuggugggaaccuuuuggaggucgcgauucugcacccagaccaccucccgacugcagguuacgguucaacauuagcggcugucgccugcuuacagauagagccuccuauggggaggcucaggccgucuuguuucaucacagggaccuggugaaaggaccacccgauuggccuccaccguggggcauacaggcacacaccgccgaagagguugaccuacgugugcucgauuacgaggaagcugccgcagcggcugaggcccuggcaacuucaaguccccggccuccaggucagcgaugggucuggaugaauuucgaaagccccucucauuccccugggcuuagaucacuggccagcaacuuguuuaauuggacacucaguuauagggcugacucugauguguucguaccauacggcuaucuguacccccgcucccacccgggagacccuccaagcggcuuagccccuccucugucgcggaagcaagggcucguugcauggguggucucucauugggaugagagacaggcuagggugcgcuauuaccaccagcuuucccagcacgugaccgucgacguuuuuggacgagguggccccgggcaaccagugccugaaaucggacuguugcauacgguagcccgguacaaauucuaucuagcguuugagaacucacagcaccuggauuacauuacugagaagcucuggcguaaugcccugcuugcuggcgcagugcccgucgugcuggguccagacagagccaacuaugaaagguucguuccgcgcggggcuuuuauccauguggacgauuucccuagugccagcuccuuggcaucuuaccuccuguuuuuagaccggaaucccgcggucuauagaagguacuuccacuggcgacgcagcuaugccgugcauauuaccucauucugggaugagccauggugccggguaugucaggcuguucaaagagccggcgacaggcccaagaguauccguaaccuggcauccugguuugaacgcuga

SEQ ID NO: 56461 - RNA, 1125 nt, Artificial Sequence
  derived and/or modified sequence opt3 from FUT5__Homo_sapiens__NP_002025
auggacccccugggcccugccaagccacaguggcucuggagaaggugccuugcugggcuguuguuccaauuacugguggcagucugcuuuuucagcuaccuacggguuucccgcgaugacgccaccggaucuccgcgacccggucucauggcgguggagccuguaacaggcgcuccaaacgggucacguugucaggauaguauggccacucccgcacacccuacgcugcuuauccuguuguggaccuggccauuuaauacacccguggcccucccuagauguagcgaaauggucccaggagcugcagacugcaacauuacugccgauuccucuguguauccgcaggcugacgccguuauagugcaucacugggauaucauguacaaucccucggcgaaccugccuccacccaccaggccucagggccaacgguggauuugguucucaauggagagcccaaguaauugucgccaucuggaagcacucgacgguuauuuuaacuuaacaauguccuacagaucugauagcgacaucuucacccccuauggguggcuggagccgugguccggacagccugcccaucccccacuuaauuugucagcuaaaacugaacuggucgccugggcagugaguaacuggaagccugauagcgcuaggguacgguacuaucagucucuacaggcccaccucaaaguugacguguacggccgcucccacaagccccugccaaaaggcacaaugauggagacccuuucacgauacaaguuuuaucuggcguucgagaauagcuugcaccccgauuacauuacggaaaagcucuggagaaacgcccuggaggcaugggcugucccugugguguuagggccaaguaggucuaauuaugaacgguuucugccgcccgacgccuucauccaugucgacgauuuucaauccccuaaagaccucgcucguuaccuucaggagcuggauaaggaccacgcccgcuauuugagcuacuuccauuggagagagacucuaaggccacggucguuuucuugggcacuggccuucugcaaggcuuguuggaaacuccagcaggaaucccgauaucaaaccguucgcucaauagcggcaugguucacauga

SEQ ID NO: 56462 - RNA, 1080 nt, Artificial Sequence
  derived and/or modified sequence opt3 from FUT6__Homo_sapiens__NP_001035791
auggacccccugggcccugccaagccacaguggagcuggagaugcugucucaccacacuucuguuccaauuguuaauggcugugugcuuuuucuccuaccugagggucucucaggaugacccgacuguuuaucccaacgggucacgguuuccugauaguacgggaaccccagcacacagcaucccccuaauucuccuguggacauggccuuucaauaaaccaauagcccuuccccgcuguuccgagauggugccugguacugcggacugcaacaucaccgcugaucgaaagguauacccacaggccgacgcagugauuguccaucaccgugaagugauguauaauccgucugcccagcugcccagaucgccuaggcggcaaggccagcgcuggaucugguuuucaauggagagcccaagucauuguuggcaguugaaagcuauggauggguacuucaaccucacaauguccuauagaucugacagcgauauuuuuacccccuacggauggcuggaaccuugguccggccagccagcacaucccccgcugaaucucucagccaagacugaguuaguugcuugggccgugaguaacugggguccuaauagcgcgaggguccgguauuaccaaucucugcaggcacaccuuaaaguggacguauacgggcgcucccacaagcccuugccacagggaacaaugauggaaacccugucacgauauaaguucuaccuagccuuugagaacagccuccacccugauuauaucacggagaaacuguggagaaaugcucuugaagccugggcaguucccgugguccugggcccaaguaggucuaacuacgagcgguucuugcccccugacgcuuuuauacauguggaugacuuccaguccccaaaggaccucgcccguuaucugcaagaauuagauaaagaccacgcgcgcuaccugagcuauuuuagauggagggagacucuccggccgcgaucguucucuugggcccuugcauucugcaaggcuuguuggaaacugcaggaggaaucccgcuaccagaccagaggcaucgccgcuugguuuacauga

SEQ ID NO: 56463 - RNA, 1029 nt, Artificial Sequence
  derived and/or modified sequence opt3 from FUT7__Homo_sapiens__NP_004470
augaacaaugccggccacgggcccaccagaaggcugcggggacucggugugcuugcuggcgucgcacuguuggccgcguuauggcugcuauggcuccuggggagcgcuccucgcggaacaccagccccgcagcccacuaucacgauucuuguuuggcauuggccuuucaccgaccaaccacccgagcugccuuccgauacaugcacucgauacggcauagcacguugucacuugucugccaacagaucacuccuggcuagugcagacgccgugguauuucaucacagggaacugcagacccggcgcagccaucucccauuagcucagagacccaggggucagccuugggugugggccuccauggagucuccaucgcacacacacgggcugucacaucuucggggaaucuucaauugggucuugagcuaucgccgagauagugacauuuuugugccguacggcagacuggaaccccacuggggcccuuccccaccccuaccugcgaagucuaggguugcagccuggguggucagcaacuuccaagagcggcagcuccgugcucgccuguauagacagcuugccccacaucugaggguggauguauuugggcgggcaaauggacgacccuugugcgcuuccugucucguuccgaccguggcccaguaccgcuucuaucugucauuugaaaacagucaacacagagacuacaucacugagaaauucuggaggaaugcguuagucgccgguacagugccugugguccuggggcccccacgggcaaccuaugaggcuuuuguuccugccgaugcuuucgugcacguagacgauuuuggcagcgcccgcgaacucgcagccuuccuuacgggaaugaacgagucuagauaccagagguuuuucgcuuggcgugaccggcugcgagugagauuguucacugauuggagggaacgcuuuugcgcgauuugugaccgguacccccaucuaccaagaucccaggucuaugaggaucuggagggcugguuccaggcauga

SEQ ID NO: 56464 - RNA, 1239 nt, Artificial Sequence
  derived and/or modified sequence opt3 from FUT8__Homo_sapiens__NP_004471
augaccgaccuguacuaucucagccagacagauggcgccggggacuggagagagaaggaagcuaaagaucuuacugagcuggugcaaaggcggaucacguacuugcagaaccccaaggacugcuccaaagcaaagaaauuagucuguaauauuaacaagggaugcgguuauggcugucagcugcaccauguuguguacugcuucaugauagccuaugggacccagcgcacacuaauccucgaaucucaaaauuggcgauacgcgacuggaggcugggagaccguauuucguccugugucagaaacauguaccgauagaagugguauuagcacugggcacugguccggagaggucaaggacaaaaacgugcagguuguggagcugccaaucgucgauucucuucauccgaggcccccuuaucugccauuggcugugcccgaagaccucgccgaucggcugguacgcguucacggcgacccugcaguguggugggucucgcaguucgugaaguaccugauuagaccacagcccuggcucgagaaagaaaucgaggaggccacaaagaaauuaggcuuuaagcauccugugauagggguccacguuaggcggaccgauaaggugggaacggaagcugcauuccacccaaucgaggaauacaugguacauguggaggaacacuuucaacugcuugcccgccgaaugcaggucgacaaaaagagaguguauuuggcuacugaugacccgucacugcuaaaagaggccaagaccaaauaccccaauuaugaguucauuagcgacaacaguaucuccuggucugcgggucuccauaauagguacacagaaaacagccugcggggcguuauucuugauauccacuuucugucccaggcagacuucuuggugugcacuuuuucaagucaggucugucguguggccuaugagauaaugcaaacccuccacccugaugcuagcgccaauuuccauucucuggacgauauuuacuauuuugggggacagaacgcacacaaucagaucgcuauuuacgcccaucaaccacgcacagcggacgaaauccccauggagccuggcgauaucauugguguagccgggaaccacugggacggauacuccaagggcguuaauagaaaauuaggcaggaccgggcuguauccaucauacaaggugcgggaaaagauagagacggucaaauaucccacuuacccggaggcagaaaaguga

SEQ ID NO: 56465 - RNA, 1080 nt, Artificial Sequence
  derived and/or modified sequence opt3 from FUT9__Homo_sapiens__XP_011533687
augaccagcacauccaagggcauccugagacccuuccucauugugugcauaauccuuggguguuuuauggccugccuguugauuuacaucaaaccuacuaacucuuggauuuucucaccaauggagagugcuagcuccgucuuaaagaugaaaaacuuuuucucuacgaagaccgacuauuuuaaugaaacaacuauccugguuuggguguggccguucggacagaccuuugaucuaacaucgugucaagcaauguucaauauacaggguugccaccucaccacugacaggucacuguacaacaaaagccaugccguacuuauccaccaucgggauauuaguugggaccugacaaauuugccccagcaggcgcgcccuccauuucaaaaguggaucuggaugaaccucgagucccccacccacacgccucagaagucuggcauugaacaucuguucaaucugacucucaccuaucgacgugauagcgacauccaggugccauacggguuuuuaacagucuccacuaaccccuucguguuugagguuccuucaaaagaaaagcugguguguugggucgugaguaauuggaacccagagcacgcuagaguaaaauauuacaaugagcuuagcaagucuauagaaauucacaccuauggacaggccuucggcgaguacguuaacgauaaaaauuugaucccgacaauuucaaccugcaaguucuaccuguccuuugaaaacagcauccauaaggacuauaucacggagaaacuauacaaugcauuccucgccgguagugugcccgucgugcuggggccuucuagggagaacuaugaaaacuacauuccagcugauuccuuuauacacguggaggacuauaauagccccucggaacuugcaaaguaccugaaagaggucgauaagaacaauaaauuguaucucucuuacuucaacuggcggaaggacuuuacuguuaaucugccucgcuucugggaaucccaugccuguuuagcuugcgaucacgugaaaagacaccaagaguacaagucaguaggaaaccuggagaagugguuuuggaauuga

SEQ ID NO: 56466 - RNA, 1149 nt, Artificial Sequence
  derived and/or modified sequence opt3 from FUZ__Homo_sapiens__NP_001165408
augggcgaggaagggaccggagguacagugcaucugcucugccuugccgcuagcuccggcgucccccuguucuguagaucuucaaggggaggggccccugcacggcagcaauugccauuuaguguuaucggcagcuuaaacggugugcacauguucgggcagaaucuggagguacagcuauccucugcgcgcacugaaaacacgaccgugguccuccuggugggacuugaggaacugacaaauauucgaaacguugagcguuugaagaaagaccucagagcuucguacugccugauagauucauuucugggcgacagcgagcucaucggcgauuuaacucaguguguggacugcgucauuccgcccgaagggagucugcuucaagaggccuuguccggauucgcagaagccgcugguaccacauuugugucucugguaguuagcggcaggguggucgcagccaccgaggggugguggcggcuaggaacuccugaggcugugcuccugccauggcuugugggcucccugcccccucagacagcccgcgauuauccagucuacuugccccacgguucaccuaccguuccacauagacuccugacguuaacucugcucccgagucuugaacuguguuugcuaugcgggcccagcccuccacugucucagcucuauccccagcugcuugagaggugguggcaaccucuguuggacccacuccgggcgugucugcccuuaggaccgcgcgcacugccuuccggcuucccccuacacaccgauauccucggccugcuuuugcugcaucucgaacugaagcgaugccuuuuuacaguggagccacugggggacaaagaaccuucacccgagcagagaaggcgguugcuccguaauuucuacacucugguaaccagcacacacuuuccacccgagccuggaccaccggaaaagaccgaggaugaaguguaucaggcccaguuaccccgcgcuuguuaccugguccuagguacggaggaaccuggcacuggggugagacucguugcccugcaacuuggauugaggcggcugcuccuguuacugaguccacagucucccacacacggccuucgauccuuggcaacccauacucuccacgcucugacaccucuacuguga

SEQ ID NO: 56467 - RNA, 633 nt, Artificial Sequence
  derived and/or modified sequence opt3 from FXN__Homo_sapiens__NP_000135
auguggacccugggcagaagggccguggcugggcuccuugcaagccccuccccugcccaggcgcaaacacugacucgggucccacgcccggcugaguuggcccccuuaugcggacgacguggucugagaacggacaucgaugcaaccuguacaccuaggcgggccucuucaaaccagcgcggccuaaaucagauuuggaacguuaagaaacagaguguguaccucaugaaucugagaaagagcgggacucuuggacacccaggcucccuggacgaaaccacauaugagagguuggcugaagagacccucgauucucuggcagaguucuuugaagaccuggccgauaaacccuacacuuucgaggacuaugauguaucguuugguucaggggugcucacagucaaguuaggaggcgaccugggcaccuacgugauaaacaaacaaacgccuaauaagcagaucuggcuuagcaguccauccucugggcccaagcgguaugauuggacuggaaagaacuggguuuacagccaugacgguguguccuugcacgaacugcuagcugccgagcucaccaaggcgcugaaaacaaaacuugaucugucaaguuuggcauauagcggcaaagacgccuga

SEQ ID NO: 56468 - RNA, 1620 nt, Artificial Sequence
  derived and/or modified sequence opt3 from FXR1__Homo_sapiens__NP_001013456
auggccgagcugaccguggaagucagaggcagcaacggggcuuucuacaagggauuuaucaaagacguucacgaggauucccucacagugguauucgaaaauaacuggcagcccgagaggcaagugccuuuuaaugaaguccggcuuccaccgcccccugacauuaagaaagagauaucugagggugaugaaguggagguuuauucacgcgcaaacgaccaggaaccaugcggcugguggcuggccaaggugcgaaugaugaaaggggaguucuacgucaucgaguaugcggcuugugaugccacuuacaaugaaauugugacguuugagcguuugagacccguaaaccagaauaagaccguuaagaaaaacacauucuuuaagugcacuguggacgucccugaagauuuaagggaggcaugugccaaugaaaacgcucauaaagacuucaagaaagcagugggagccugccggaucuuuuaucacccagagaccacacagcugaugauucuaagugcuagcgaggccaccgugaagcgcgucaauauccucuccgauaugcaucugagaucuauaaggacuaaacuuaugcugaugucgcggaacgaagaggcgacaaagcacuuggaauguaccaagcaacucgcagccgcuuuccaugaggaauuuguugugcgcgaggaccugaugggccuggccaucgguacgcacgggucaaauauucagcaggcacgaaaaguacccggagugacugcuaucgagcucgaugaagacaccggcacauucagaauuuacggcgagagcgccgaugcggucaagaaagccaggggguuuuuagaguucguggaagacuucauccagguuccucggaaccuggugggaaaggucauagguaaaaauggcaaggugauucaagaaaucguagacaagagugggguugugcguguccgcauugagggagauaacgagaacaaacuuccaagagaagacggcauggugccguuugucuucguggguacuaaggaguccaucgggaauguucagguguugcuggaauaucacaucgcauaccuaaaagagguagagcagcucaggauggaacggcugcagauugaugagcaacuucgacagauaggaucucgcagcuacuccggcagaggcagggggcggcgcggacccaacuauaccucagguuacggcacaaauagugaacugagcaacccuucugagaccgaauccgagagaaaggacgaguugucagauuggagccucgcuggggaagacgauagggacagucgucaucagcgggauucucgaagaaggccaggaggccgcggucgguccgucagcgggggcagaggaaggggcgggccccgcggagguaaaucgucuaucuccucagugcugaaggacccugauaguaauccauauagcuuacuggacaacacggaguccgaccaaacugccgauacagacgcuucugaaagccaccauucaaccaaucgacggcguagaaguaggcgccggagaacugaugaggacgccguucucauggauggcaugacagaauccgacaccgcaagcgugaacgagaaugggcuuggaaagaggugcgauuga

SEQ ID NO: 56469 - RNA, 2022 nt, Artificial Sequence
  derived and/or modified sequence opt3 from FXR2__Homo_sapiens__NP_004851
augggcgggcuggccagcggaggugacguggagcccggccucccugucgaaguuagaggguccaacggagcuuucuacaagggcuuugugaaagauguacacgaggacucugugaccaucuucuuugaaaauaacuggcagucagagaggcaaauuccauucggugauguccggcuuccgcccccugcagacuauaauaaggaaauaacagagggggaugagguggaaguuuacagucgcgccaacgagcaggaaccaugcggaugguggcuggcgcgagugcguaugaugaaaggcgacuuuuaugucaucgaguacgcugccugugaugcaacuuauaaugagauugugacguuggaaagauuaaggcccguaaacccuaauccacuggccaccaagggcagcuucuuuaaaguuacaauggcugugcccgaggaccuacgggaagcaugcuccaacgagaauguccauaaggaguucaagaaagcccucggggcuaacuguaucuuucugaauauuacuaacucugaacuuuucauccugucgaccacagaggccccugugaagcgcgcgucauugcucggagauaugcacuuuagaagccugaggaccaaacugcucuuaaugagucggaaugaagaggcaacuaagcaucuggaaacauccaaacagcuugccgcugccuuccaggaggaauuuaccgugcgcgaggacuugaugggucuggcaauaggcacgcacggggcuaacauccaacaggcccgaaaggucccaggaguuacugcgauugagcuaggcgaagagaccugcacauucagaaucuacggugaaacuccggaggccuguaggcaggcacggucuuaucucgaguucagcgaagauuccgugcagguaccccguaaucugguggggaaggucauuggcaaaaacggaaaggugauccaagagauaguugacaaaucaggcgugguccgcgugagaguagaaggggauaacgacaagaaaaauccuagggaggaaggaaugguuccauuuauuuucguggguacccgggagaacaucaguaaugcucaggcccuucuggaguaccauuugagcuaccuccaggaagucgagcagcugcgauuagaacgccugcaaauugacgagcagcucagacagaucggccuuggguuuaggcccccuggaucuggccgggguuccgggggcucagauaaggcuggauauagcacagacgaaaguucuuccagcucgcugcacgccacccgcacguacggcgggucuuauggagguagaggcagggggcgucggacuggaggcccagcauacggucccuccucagaugugaguacagccagcgagaccgaguccgaaaaacgagaggaaccgaacagagcugggccuggcgacagggaucccccaacucgcggagaggaaucucggagaaggccuacaggcgggcgcggacgaggucccccacccgcgccucggccaaccagccguuauaauucaaguuccaucagcucugucuugaaggacccggauucaaaccccuacagucuacuggacacgagcgagccugagccacccguggauuccgaaccuggcgagccacccccggcaucugccagaaggcgccggucgagaaggcgacgcaccgacgaagaucggacaguuauggacgggggacucgagagcgacggcccuaauaugacugaaaacggucuggaggaugaguccagaccacaaaggcguaaucgcucacggagaaggcgaaaccgggggaaucgcaccgacggcaguauuucuggagauagacagcccgugacaguagcugacuauauaagcagggccgaaucccagucacggcagcgaccuccccuugagagaacuaagccaagcgaagauucucuguccggccaaaaaggggacagugucagcaaguugccuaaaggacccucugagaacggcgagcucuccgcaccacuggaauuagguucaauggugaaugggguuaguuga

SEQ ID NO: 56470 - RNA, 279 nt, Artificial Sequence
  derived and/or modified sequence opt3 from FXYD1__Homo_sapiens__NP_001265647
auggccagccugggccacauccucguguucugcgucgggcuucugaccauggcuaaggcagagucccccaaagaacaugacccuuuuacauacgauuaucagucuuugcaaauuggagguuuaguuauagccggcauccuguucauucuagggauccucauugugcugucaagaaggugucggugcaaguuuaaccagcagcagcgcacuggagagccagacgaagaggaaggcacguuccgaaguagcauccguagacuuuccaccaggcggcgcuga

SEQ ID NO: 56471 - RNA, 201 nt, Artificial Sequence
  derived and/or modified sequence opt3 from FXYD2__Homo_sapiens__NP_001671
augaccggccugagcauggacgggggagguucccccaagggcgauguggacccuuucuacuaugauuacgagacagucagaaacgggggacucaucuuugccggccuugcuuucauuguuggucuguugauauuacugucuaggcgguuucgcugcgggggaaauaaaaagcgacgucagaucaacgaagacgagccauga

SEQ ID NO: 56472 - RNA, 435 nt, Artificial Sequence
  derived and/or modified sequence opt3 from FXYD3__Homo_sapiens__NP_001129479
augggcagaggguacagcggagcccugcaggcuagggguggccucgaggaaccccuugagcgggggcugcgcggaccuuccuucacccaaucuccauugcacggcgcagccgcggcuuauuuaucagcccagcgagacgcaagucugccggugcccggucagcguagcgauaugcagaaggucacacuagggcuccugguuuuucuugccggauucccugugcuggacgcuaacgauuuggaagacaaaaauuccccauuuuacuaugauuggcauucucuccaaguaggcggccugaucugcgcaggggugcugugugccaugggaauuauaaucgucaugucggcuaagugcaaauguaaguucggucagaaaucaggccaccaucccggggagacuccuccacucauuacgcccggaagcgcccagaguuga

SEQ ID NO: 56473 - RNA, 537 nt, Artificial Sequence
  derived and/or modified sequence opt3 from FXYD5__Homo_sapiens__NP_659003
augagccccuccggcagacugugccuccuuaccaucguggggcugauuuugccuacaaggggacagacuuuaaaggacacgaccucuucaaguagcgccgauuccacaauaauggacauccaagucccaacucgggcuccggaugcaguuuacaccgagcugcagcccacaucuccuaccccaacuuggcccgccgacgaaacaccucagccacagacccaaacgcagcagcuagaggguacugauggcccccucgugaccgacccugaaacacacaaaucgacuaaggcggcucauccaaccgaugacacaaccacgcugucagagcgcccgagccccaguacugauguacagacagacccucaaacccuuaaaccauccggguuccacgaagaugaccccuuuuucuaugaugagcauacucugcgaaagcguggauugcucguggccgcaguccuguuuauuacaggcaucauuauccugaccucugguaaauguagacagcucagcagguuaugccggaaccgcuguagauga

SEQ ID NO: 56474 - RNA, 288 nt, Artificial Sequence
  derived and/or modified sequence opt3 from FXYD6__Homo_sapiens__NP_001158303
auggagcuggugcucgucuuccuuugcagccuguuggcccccaugguuuuagcuuccgcagccgaaaaggagaaagaaauggacccuuuucacuacgauuaucagacccugagaaucggcgggcuaguguucgcgguagugcucuuuucugucgguauucugcuuauacugucaaggcgguguaagugcaguuucaaccaaaaaccacgcgcuccgggagacgaggaagcccagguggagaauuugaucacagcaaacgccacugagccccagaaggcugaaaauuga

SEQ ID NO: 56475 - RNA, 2520 nt, Artificial Sequence
  derived and/or modified sequence opt3 from FYB__Homo_sapiens__NP_001230022
auggacggcaaggccgaugugaaaagccugauggcuaaguacaacaccgggggaaaucccacagaggacgucuccguuaacucuagaccuuucagggugacugguccaaauucaaguagcggcauccaggcacggaaaaaccucuuuaauaaccaagggaaugccuccccgcccgcgggaccuucuaacguaccaaaguucggcucgcccaaaccuccaguggcugucaagcccucaagcgaagagaagccugauaaagaaccaaagccgcccuuucuuaaaccuacgggugccgggcagcgcuucggaaccccagcaagucugacaacucgagaccccgaggccaaggugggcuuuuugaaaccuguuggcccaaagcccauuaauuuaccgaaggaagauuccaaaccuaccuuccccuggccaccugggaacaagcccucucugcacagcgugaaucaggaccaugaucuaaaaccacucggacccaaguccgguccuacaccaccgaccucagagaacgagcagaaacaggcuuuucccaagcugacuggcgucaaagggaaguucaugagugcaagccaagaccuugaaccuaagccacuguuucccaaaccugccuucggacagaagccacccuugucuacagaaaauucccacgaggaugagucaccgaugaaaaacgugagcaguucuaagggcuccccugcuccacucgguguacguagcaaaucggggccccugaagccugccagagaggacucugaaaauaaggaucaugcgggagagauauccucacugcccuuuccaggcguugugcucaaaccugcagccaguaggggcgggcccggauuaagcaagaacggugaagagaaaaaggaagaccggaaaaucgaugcugccaagaacaccuuccaguccaagauuaaucaagaggagcuggcaucuggcacgccaccggcucgcuuuccuaaagcccccagcaaacuuacugucgggggaccauggggccagucacaggaaaaggagaagggugacaaaaacagugcgacccccaagcagaagccuuugccaccccuguucacacuagggccuccgccacccaaaccuaauagaccacccaacguggaccucacuaaguuccacaaaaccuccagcggcaauucuacaucaaagggacaaaccaguuauagcacgacuucccugccuccgcccccaccuucucaucccgccucgcagccaccucuucccgcaagccacccaucccagccgccugugcccucacugccacccaggaacaucaaaccuccauuugauuugaagagucccgucaaugaagacaaccaagauggcguuacacacucugacggggcuggaaaucucgaugaggaacaggacagcgagggugagaccuacgaagauauugaggccuccaaagaacgggagaagaagcgcgaaaaagaggagaagaaacgacuggaauuagagaagaaagaacagaaggagaaggagaaaaaggaacaggagaucaaaaagaaauucaagcugacuggcccuauacaagugauccaucucgcuaaggccugcugugacguaaaagggggaaagaacgaacuuucauuuaaacagggcgagcagauugaaaucauuagaaucacagauaauccggaggguaaguggcuggggaggaccgcacggggcagcuauggauacauaaaaacgaccgccguggagauugacuaugauucuuugaagcuaaagaaagacucccugggcgcuccaagucgucccaucgaagacgaucaggaggucuacgacgauguggcggaacaagacgauauuagcucucacucccagucagggaguggagguaucuucccucccccaccugacgaugacaucuaugauggcauugaggaagaggacgcagaugacgggagcacacuccagguucaggagaagucgaacacuugguccuggggaauacugaaaaugcuuaagggcaaagaugaccgcaagaaaucuaucagagaaaagcccaaggugagcgacucagauaauaacgaggguaguuccuuuccagccccuccgaaacaacuggacaugggggaugaagucuacgacgauguggacaccucugauuuccccguaagcuccgcugagaugucacagggcacaaauguuggaaaggccaaaacugaagagaaggacuugaaaaagcucaagaaacaggagaaggaagagaaagauuuuaggaagaaauucaaguacgacggcgaaauucgggugcuguauagcaccaaggucacaaccaguaucacuucuaaaaagugggggacgcgagauuuacaggugaaaccaggagagucccuggaggucauacaaacaaccgacgauacuaaggugcuaugccgcaacgaagagggcaaauacgguuauguucucagaagcuaccuggcagacaacgacggggaaauuuaugaugacaucgccgauggauguaucuacgacaaugauuga

SEQ ID NO: 56476 - RNA, 4437 nt, Artificial Sequence
  derived and/or modified sequence opt3 from FYCO1__Homo_sapiens__NP_078789
auggccagcaccaacgcugagucccagcugcaaagaaucauuagggaccuccaggaugcagugacagaacuuucuaaggaguuccaggaagccggcgagcccauaacugacgauucaacgagucugcacaaauuuagcuacaaguuggaauauuuacugcaguucgaccaaaaagagaaggcgacccuacucgggaauaaaaaggauuacugggacuauuuuugcgcuugucuggccaaggucaaaggagcaaacgaugguauccgguucguuaaguccauuucugagcuucgcacaucgcugggcaaagggcgagccuuuauccguuacucauuggugcaucagagacucgcugacacucugcagcagugcuucaugaauaccaagguaacaagcgauugguauuacgcaaggaguccuuuucugcaaccaaaacucuccucugacauugugggacaguuauaugaacugaccgagguccaguucgaucuugccagccggggcuuugacuuggaugcugccuggccgacuuucgcgcgcagaacacugaccacggguuccucagcauaccuauggaagcccccuaguaggucuagcuccaugucaagccucgugaguucuuaccugcagacucaagaaaugguuuccaacuuugaccuuaauagcccacugaacaaugaggccuuggagggguucgacgaaaugcggcucgagcuggaucaguuagaagugcgcgagaagcagcugcgagaaagaaugcaacagcucgacagggagaaccaggagcuucgggcugccgucucgcagcaaggagaacagcugcagaccgagcgugaacgcggcagaacagcagcugaggauaaugugagguugacuugucuaguagccgaacugcagaaacaaugggagguuacccaggcgacacagaacaccgugaaggagcuccagacgugccugcaaggccuugaacugggggccgcagagaaagaagaggacuaucacacugcuuugcggcgacucgaaucuaugcugcagcccuuagcccaggagcuggaggcuacacgcgauucccuagacaagaaaaaucagcaucucgccucauuuccuggauggcuggcaauggcccaacagaaggcugauaccgcgagugacacuaaagguagacaggaaccaauccccagcgaugcagcccaagagaugcaggaacuuggcgagaaguugcaggcucuggagagggaacggacaaaggucgaggaagugaaccgccagcaauccgcccagcucgagcagcuggugaaagaacuucagcugaaggaggacgcaagagccucuuuggagaggcucgucaaagaaauggcuccucugcaagaggaauuaagcgggaagggacaggaggccgaucagcuguggcgucggcuacaggaacuccuggcacacaccucaaguugggaggaggaacuugcggaguugcgaagagaaaagaagcaacagcaggaggaaaaggagcugcucgagcaagaaguuaggucccugacgcgccaguuacaguuccuggagacccagcuugcucaagugagccagcauguaucugacuuggaagaacagaaaaagcagcucauacaagacaaagaucaccugucacaacaggugggcaugcuagagcggcuggccgguccaccggggcccgaacucccugucgcaggagagaagaaugaagcccuggugccaguuaacaguagccuucaggaggcuuggggcaaacccgaagaggagcaaagaggcuugcaggaagcccagcuggacgauacaaaggugcaggaggggucccaagaagaggaauuaaggcaggcaaaucgcgagcucgagaaggaacugcagaacgucgugggacgaaaccaacuucuggaggguaaauugcaggcucuccaggccgacuaccaggcgcugcaacagcgggaaucugccauccagggcucgcuagcuagccuggaggcagaacaggccuccauucgucaccucggggaucaaauggaggcuucacugcuugccguaagaaaggcaaaagaggcgaugaaggcccagauggcugaaaaagaggccaucuugcagaguaaggaaggagagugucagcaacugagggaggaaguugagcagugccagcaauuagcagaagcucgccaucgggagcucagagcccuggaaucucagugucagcagcaaacucagcuuauugaggugcugaccgcagagaagggccagcagggugucgggccuccaacagacaaugaagccagggagcuagcugcgcaacucgcccugagccaggcacaguuggaagugcaccagggcgagguccaacgacugcaggcucaggugguugauuuacaggccaaaaugcgcgccgcucucgacgaucaagacaaggugcagucccagcugucaauggcagaagccguacuucgggagcauaaaacucugguccaacaguugaaggagcagaacgaagcgcucaauagagcucacgugcaggagcugcuacaaugcagcgaaagggagggagcccugcaggaggagcgugcagaugaggcccagcagcgcgaagaggaacuucgggcucuccaagaggagcugucucaggcaaaauguuccagugaagaggcccaguuggaacacgcggagcugcaggaacaauuacauagagcuaacaccgacacagccgagcucggcauccagguuugcgcacugaccguggagaaggaaagggucgaggaagcccuugcuugugccgugcaggagcugcaagaugcaaaagaagcugccagccgagagcgggagggguuggaacgccagguagcgggacuccagcaggagaaggaaucucugcaagagaagcuaaaagccgcaaaggcugccgcugguucccugcccggccuucaggcacagcucgcccaggccgaacaaagagcucagucacugcaggaggcggcacaccaggaguugaauacuuuaaaauuccaacugagugccgaaauaauggacuaucagagcaggcucaagaacgcuggggaggaaugcaaaucgcugcggggacagcuugaggagcaaggccgacagcugcaggccgcagaagaggccguggaaaaguugaaggcuacgcaggcggacaugggugagaaacuauccugcacaucuaaucaucuggccgaaugucaagcagcuaugcucagaaaggauaaagagggggccgcacugcgcgaggaccuugaaaggacccagaaggaguuagaaaaagccacuaccaagauucaggaguacuauaacaagcugugccaggaaguuacaaaucgugagcggaacgaucagaaaaugcucgcugacuuggaugaccugaauagaaccaagaaauaccucgaggaaaggcugaucgagcuucugcgcgauaaggacgccuuguggcagaaaagcgaugcgcuagaauuucagcagaagcugucagcagaggaacgauggcucggcgacacugaggccaaccacuguuuagauugcaagagagaguucaguuggaugguccggaggcaucacugucgcauuugcggacguaucuuuuguuauuacugcuguaauaacuacgugcuguccaaacacggcgggaagaaagaaagaugcugucgggcuugcuuccaaaaacuuucugagggaccggguagcccugacuccucaggcagcgggacaagucagggagaacccucuccagcccuguccccugcuagccccggcccacaggcaacgggugggcagggcgccaauaccgauuauaggcccccugacgacgcuguguuugauaucauuacugacgaggagcucugccaaauacaggaaucgggaucaucuuugccagagacaccgaccgaaacagauagucuggaccccaacgccgcagagcaggauacuaccuccacgagccucaccccugaagacacagaggauaugccagucggccaagacucugagaucugucugcuuaaaagcggggaacuaaugauuaagguuccccugacuguggaugagaucgcguccuucggagaaggcucacgcgaguuguuugugcgaaguagcaccuacucuuuaauaccuauuacaguagccgaagcuggucugacuaucuccugggucuucucaagugacccaaaaagcaucuccuuuucugugguuuuccaggaggccgaggauacgccccucgaccagugcaaggugcugauuccgaccacaagauguaacucgcauaaggaaaauauccaggggcaacuuaaaguccggaccccuggaauuuauaugcugauauuugacaacacuuucagcagguuugugucaaagaaaguuuucuaccaccucacaguggaucgcccaguaaucuaugacggcuccgauuucuuguga

SEQ ID NO: 56477 - RNA, 1614 nt, Artificial Sequence
  derived and/or modified sequence opt3 from FYN__Homo_sapiens__NP_002028
augggcugcgugcaguguaaggacaaagaggccaccaagcugacagaagagagagaugggagccucaaccaauccucuggauacagguaugguacugaccccacgccucagcacuacccaucauucggcgucaccaguaucccgaauuauaacaauuuucaugcugcagggggacagggccuuacaguuuucgguggggugaacagcuccucucacacuggaacccugcggacacgcggcggcaccgggguaacuuuguuuguggccuuauacgauuaugaagcgcgaacagaggacgaucugucguuccauaaaggagaaaaguuucagauucuaaauucaagcgagggugacuggugggaggcucguagucucaccacgggcgaaacuggguacauacccuccaacuaugucgccccuguggauucuauccaagcagaggaaugguacuucggaaaacugggcagaaaggacgccgagaggcagcuucugagcuuugguaauccacgggggaccuucuugauucgcgaguccgaaacaacuaagggagcuuacucacucaguaucagagauugggacgauaugaaaggcgaccacguuaagcauuauaaaauuaggaagcuggauaacggcggguacuauaucaccacacgggcacaguuugagacccugcagcaacucgugcagcacuacagcgaacgcgccgcuggauuaugcugucgacuggucgugcccugccacaaagguaugccuagacuuacggacuugucuguaaagacuaaggacguuugggagauaccaagggaaucccugcagcuaaucaaacggcucggcaaugggcaguucggagagguguggaugggcacauggaacgguaauaccaaggucgccauuaaaacucugaagcccgggacaaugucaccugagagcuuucuugaagaggcgcaaaucaugaaaaagcugaaacaugauaaguuggugcagcucuaugcaguggucagugaggaaccaauuuacaucguuaccgaauauaugaacaagggcucucuguuagacuuccugaaagauggagagggccgugcccucaaacuuccgaaucugguggacauggcugcccagguagcagcugggauggccuacauagagcgcaugaacuacauucacagagauuugagguccgcgaauauccuagugggaaacggucugauuuguaagaucgccgacuuuggccucgcacggcugaucgaagauaacgaguauacggcucgacaaggggccaaguuccccauuaaauggaccgcuccugaagccgcacuuuacggacgcuucacaauaaagagcgacgucuggucguuuggcauccuguugacugagcucgugaccaaggguagaguuccauaucccgggaugaauaacagggaagugcuggagcaggucgagcggggcuaccgcaugccuugcccacaggauugucccauuucuuuacaugaacugaugauccacugcuggaaaaaggacccggaggaaagaccuacauucgaguaucuacaguccuuucucgaggauuacuucacugccaccgaaccccaauaucagccaggagagaaucuguga

SEQ ID NO: 56478 - RNA, 1746 nt, Artificial Sequence
  derived and/or modified sequence opt3 from FZD10__Homo_sapiens__NP_009128
augcagagacccggcccuaggcuguggcucgugcuucaagucauggggagcugcgccgcuaucuccucuauggacauggagcggccaggagaugguaagugucagccgauugaaauacccaugugcaaagacaucggcuacaacaugacccgcaugccuaaucugauggggcacgagaaccagcgagaagcagccauucaguugcaugaguucgcgccauuaguugaauauggaugucacggccaucugagauuuuuccuaugcucacucuacgcucccauguguacagagcaagugaguacuccuaucccagccugccguguaaugugugagcaggcaaggcugaagugcagccccauuauggaacaguuuaauuucaaauggccugauucccuugacugucggaagcugccaaacaaaaaugauccgaacuauuugugcauggaggcccccaauaacgguucugacgaaccuacgcgcgggucgggacucuuuccaccccuguucagaccucagaggccacacucagcucaagagcauccccugaaggauggcggcccggggcggggagguugugacaauccuggcaaguuucaccacguggagaaaagcgcaaguugcgcuccccucugcaccccaggggucgauguguacuggucccgcgaagacaagcgauucgccguugugugguuagccaucugggcgguccugugcuuuuucucuagcgcauuuacagugcuuacuuucuugauagauccugccagauuuagguaucccgagcggccaaucauuuuccuguccauguguuacuguguauauucaguuggauaccuaauccgucucuucgcuggcgccgaaaguauugcaugcgaccgcgauagcggucagcuguacgugauccaggaggggcuugaaucuaccggauguacacuggucuuuuuggugcucuauuacuucggcauggcuuccucacugugguggguggucuuaacccugacuugguuucucgccgcgggcaaaaagugggggcaugaggccauagaggcaaacagcaguuauuuccaccuugcugccugggcuauucccgccguuaaaacaauccugauuuuggugaugagaaggguagcaggagacgaacuaaccggugugugcuacgucggcucuauggacgugaaugcccugacgggguuuguucucaucccucuggcuuguuaucuugugaucggaacuuccuucauucugagcggcuuugucgcguuguuccauauacggcgagugaugaagaccgguggggagaacacagauaagcucgaaaaacugaugguacgcaucggcuuauuuucgguucuguacacugugccagcaaccugcgucauugccuguuauuucuacgagagacuaaauauggacuacuggaagauccucgcugcccagcacaaaugcaagaugaacaaucaaacaaaaacccuggauugucuuauggcagccucuauaccggcuguggaaauuuuuauggucaagaucuucauguugcuggugguuggaaucacguccggcauguggauuuggacuucaaaaacacuccagaguuggcagcaagugugcagcaggcggcugaagaagaaaucccgcagaaagcccgccucuguaaucaccagcgggggaauuuauaaaaaggcacagcacccucagaaaacucaucacgguaaguacgagauaccagcgcagucacccacaugcgucuga

SEQ ID NO: 56479 - RNA, 1944 nt, Artificial Sequence
  derived and/or modified sequence opt3 from FZD1__Homo_sapiens__NP_003496
auggccgaggaagaggcucccaagaaaagcagagcagccggcgggggagcguccugggaacugugcgcuggugcccucucugcaaggcuugccgaggaaggcucaggggacgcuggaggccggcgccgaccuccaguggauccgcguagacuggcaaggcaguuguuacugcuacucuggcugcuugaggcuccccuguugcucgguguccgggcccaagccgcggggcagggaccuggccagggcccagggcccggacagcaaccuccacccccuccacagcagcagcaaaguggucagcaguacaacggcgagcgcgggaucagcguuccggaccacggauauugucagcccauuuccauaccucugugcaccgauaucgcauacaaucaaacaauuaugccaaaccugcucggccacacuaaucaggaagacgccgguuuagaggugcaccaguucuauccccugguaaaggugcaauguucugcugaacuuaaauuuuucuugugcucgauguacgccccugucuguacggugcuggagcaggcacuaccacccugcagaucacucugugagagggcucggcaggggugcgaagcccugaugaacaaguuuggauuccaguggccggauacccuuaaaugugagaaguuuccuguucauggcgcgggcgaacugugcguggggcaaaauacaagcgacaagggaacucccaccccaaguuugcucccugaguucuggacauccaacccccagcacgguggcgggggacaucgcggcgguuuuccagggggcgccggagcaucugaacgaggcaaauucagcugucccagagcucugaaggucccuuccuauuuaaauuaccacuuucugggggagaaagauugcggagccccaugcgagccgaccaagguguauggucucauguacuucggccccgaggaacuuagguuuucacggacuuggaucgggauuuggaguguacuguguugcgcuagcacauuguucaccguucuaacguaccugguggacaugcgucgcuuuucuuauccugaaagaccaaucauauuccucuccggauguuacacugccgucgcaguggccuauaucgcuggcuuccugcuugaggauaggguggucugcaacgacaaauuugcggaagauggugcacggaccguugcccaggggacaaagaaggagggcuguacuauucuguucaugauguuguacuuuuucucaauggcuagcaguaucuggugggugauucucucucugaccugguuuuuagccgcaggaaugaaauggggccacgaggccaucgaagcuaauucccaguauuuccaucuggccgcaugggcgguacccgcuauaaagacaauuaccauccuagcccucgggcaaguggacggagauguccugagcggugugugcuuuguuggccuuaacaauguggacgcauugcgaggguucguccuggccccucucuuuguguaccuguucauuggaacgucguuucuucuggcuggcuucguaucuuuguuucgcaucagaacuaucaugaaacacgacgguacaaagaccgagaaacucgaaaagcugaugguuaggauugggguguucuccgucuuauauacugugccagccacaauagucaucgcauguuacuucuacgagcaggcuuuucgggaucagugggaacgcucauggguggcccagaguugcaaaagcuaugcgauucccuguccgcaucugcaagccggcggaggcgcuccuccacaucccccuaugucccccgacuucaccguuuuuaugaucaaguaccuaaugacgcucauaguggggauuaccucuggauucuggaucuggagcggcaagacacugaacucauggagaaaauuuuauacuaggcuuaccaauaguaagcagggugagacaacuguauga

SEQ ID NO: 56480 - RNA, 1698 nt, Artificial Sequence
  derived and/or modified sequence opt3 from FZD2__Homo_sapiens__NP_001457
augagacccaggagcgcccugccucggcuccuucugccauuguuacugcuaccggcugcaggccccgcccaguuccacggggagaagggaaucuccauuccugaccaugguuuuugccaaccaauaucuaucccccucuguaccgauauugcguacaaccagacaaucaugccuaaucugcuuggccacacuaaccaggaagacgcugggcuggaggugcaucaguucuauccauuggucaaaguucaaugcucacccgaacuccgcuuuuuccuguguaguauguacgccccugugugcacgguacuggagcaggcaauuccaccgugucgaagcaucugcgaacgugccagacagggaugugaggcucucaugaauaaguuuggcuuccaguggcccgagagguuacggugcgaacacuuuccucgccauggugcagagcaaauauguguggggcagaaccacuccgaagauggagccccagcucugcuuaccacagcgcccccuccaggcuugcagcccggcgccgggggaacuccggguggcccugggggaggcggugcacccccaagauaugccacccuggagcacccuuuccauugccccaggguccuaaaagugccaucuuaccucucguauaaguuucugggggagcgggacugugcugcccccugcgaaccugcacgcccagauggaucaauguucuuuagccaggaggaaacacgauucgcuagacuuuggauccugaccuggaguguuuugugcugugccuccacauuuuucacagugaccacguaccucgucgacaugcaaagguuccgguauccggagcgucccauuaucuuucugucuggcugcuacacuauggugagcguagcguacauugccggcuucguuuuacaggaacgcguggucuguaaugagagauuuuccgaggauggguauaggaccguggugcagggaacuaaaaaggaagguugcacuauccuguucaugaugcucuacuuuuucucaauggcaaguagcauauggugggucauucuuucucugaccugguuuuuggcugccggcaugaagugggggcacgaggcuaucgaagccaacucccaauauuuccaucuagcagccugggcuguuccugcggugaaaacaauuaccauccuggcaaugggacagaucgacggcgaucuccugucagguguauguuuuguggggcuuaauagccuggacccauugcggggcuucguccucgcuccccuguuuguguacuuauucauuggaacgaguuuucugcuagccggcuucguuucucucuuccgaauacgcacuaucaugaagcacgaugggacaaaaaccgagaagcuggaaagacuuauggugaggauuggagucuuuuccguguuguauacuguaccugccacaaucguuauagcaugcuacuucuaugagcaggccuuucgggagcacugggaacgcagcugggugucgcagcauuguaaaucucuggcuauuccaugccccgcccacuacaccccgagaauguccccugacuucacggucuacaugaucaaguaucucaugacccugaucguggguauuacaucaggcuuuuggaucuggagugggaagacucuucauagcuggaggaaauucuacacccgucugacaaacucccggcacggagagacuaccgucuga

SEQ ID NO: 56481 - RNA, 2001 nt, Artificial Sequence
  derived and/or modified sequence opt3 from FZD3__Homo_sapiens__NP_665873
auggccaugaccuggaucguguucagccuguggccccucacagucuuuaugggccacauugggggacauucccuuuucucuugcgagccuauaacucugagaaugugucaggacuugccauacaacacgaccuuuaugccgaauuuacugaaccacuaugaucaacagacagcugcacuagccauggaacccuuccauccuaugguuaaucucgacugcucaagggauuuucggccauuccugugugcgcuuuacgcucccaucugcauggaguauggucgcgugacucugccuugucgacguuugugccagagagccuacagugaauguagcaagcucauggagauguuuggcguaccauggcccgaagacauggagugcuccagguucccugauugugacgagccauauccgcggcugguggaucugaaccucgcaggggaacccaccgagggagccccugucgcugugcagcgcgacuacggcuuuuggugcccaagagaauuaaaaauugaucccgaccuggguuauucuuuccuucacguuagggauuguucgccuccaugccccaauauguacuuucggcgcgaggaguugucauucgcacgauacuuuaucgggcugauuagcaucauaugccuaagugccacacucuucaccuuccugacuuuucuuaucgacgugacaagauucagguauccggaacggccuauuaucuuuuacgcugucuguuauaugauggugucccugauuuucuuuaucggauucuugcucgaggaucguguagccugcaacgcgucuauacccgcacaauacaaggccagcaccguuacgcagggcucccauaauaaggcuuguacuaugcuguuuaugauuuuauauuucuuuaccauggccggcucaguguggugggucauccugacaauuacuugguuccucgcagcugugccaaaaugggggagugaagccaucgagaaaaaggcgcuucuguuucacgccagcgcauggggaaucccugguaccuugacaauuauacuacuggcuaugaacaagaucgaaggcgacaauauuucuggggugugcuucgucggacucuacgacguugaugcccugcgcuauuuugugcuugcuccccuguguuuguacguaguggucggcgugucccuccuguuagccgguaucauaucacugaacagaguuaggauugagaucccacuagagaaagaaaaucaggacaagcucgugaaauucaugauccggauuggggucuucagcauccuguaccuugugcccuugcugguaguuauuggaugcuauuuuuacgagcaggcauaucgaggcauaugggaaaccacguggauccaagagcgcuguagagaauaccacauuccuugcccauaucaggugacucagaugaguaggccggaucucauccuguuccuuaugaaguaccugauggccuugaucgucggcauucccucuguguuuugggucggguccaaaaagacauguuucgagugggcuagcuuuuuccauggacggcgcaagaaagagauagugaacgaaucgagacagguucuccaagagccugacuuugcgcagucucuguuaagggauccaaauacccccaucauucguaagucccgggguacuucaacacagggcaccaguacgcacgcaagcuccacccaacuggccaugguggacgaucagcgaucuaaagcugggagcauccauucaaagguaaguuccuaucacggaagccuacacagaucuagggacggccgcuacacaccuugcucauaccgggguauggaagagagacucccacaugggaguaugagcaggcugacugaucacucccgccauucuucgagccaccgacuuaacgaacagucccggcauucaaguauucgugacuugucuaauaaccccaugacccacaucacacacggcacuagcaugaacagagucauagaggaggauggaaccuccgccuga

SEQ ID NO: 56482 - RNA, 1614 nt, Artificial Sequence
  derived and/or modified sequence opt3 from FZD4__Homo_sapiens__NP_036325
auggccuggagaggcgcugggcccagcgugccuggagcaccagguggcgucgggcugucccucggacuucuguugcaguuacugcuacuccugggcccggccagggguuucggggacgaggaagaacggcgcugcgaucccauccgaauuucuaugugucaaaaccuuggauacaauguuaccaagaugccuaaccuggugggccacgaauugcagacagacgcggagcuccagcugacuacguuuaccccacugauacaguauggcugcucaagucaacuccaguucuuuuuauguagcguauacgugcccaugugcacagagaaaaucaauauuccuaucgggccauguggagguaugugccuguccgucaagcguagaugugagcccgugcuuaaagaguucggcuuugcuuggccugaaucuuugaacugcucgaaguucccaccgcagaaugaucauaaccacauguguauggaggggcccggagacgaagagguuccucugccacauaaaacucccauucagccuggcgaggaaugccacucaguggguaccaauagcgaucaauauaucugggucaagaggagucuaaacugugugcucaagugcggguacgacgccggacuguauucccggucugcaaaagaguuuacagauauauggauggccguaugggcuagccuuugcuucaucuccaccgcauuuacuguucugacauucuugauugacucaagucgcuuuagcuacccagaaagacccaucauuuuccucucuauguguuauaauaucuacuccauagccuacauugugaggcugaccgucggccgggagcgcaucucaugcgauuuugaagaggcugccgagccgguguuaauucaggaaggccugaagaacacggggugugcgaucaucuuccuccuuauguauuucuuuggaauggcaagcaguauuuggugggugauacugacuuugaccugguuccuagccgcuggucugaaauggggccaugaggccaucgaaaugcacucuuccuacuuucacauugcagcuugggccaucccugcggucaagacaauaguuauucucaucaugcgacugguggacgccgaugagcuuacugggcugugcuauguaggaaaucagaacuuggacgcacucaccggcuucguggucgcuccccuguuuacauacuuagugaucgguacccuguucauugccgcugggcuaguugcccucuuuaaaaucagaagcaaucugcagaaggauggcacgaagacugacaaacuugaaagguugauggugaagauuggagucuucucggugcuguauacaguaccagcaaccuguguuauagccugcuacuuuuaugagaucucuaacugggcucucuuccgguacuccgcggacgauucaaauauggcaguggagaugcugaaaauuuuuaugagucuucuggucggcaucacuagcgggauguggaucugguccgccaagacauugcauaccuggcaaaaauguucuaaccgucucgugaacagcggaaaggucaaacgcgaaaagagagguaauggcugggugaagccugggaaaggaucagagacgguuguguga

SEQ ID NO: 56483 - RNA, 1758 nt, Artificial Sequence
  derived and/or modified sequence opt3 from FZD5__Homo_sapiens__NP_003459
auggccagacccgacccuagcgcuccaccgucccugcuccuucuguuguuagcacagcuggugggcagggccgcggcugccucuaaggcacccgucugccaagagaucaccguuccuaugugucgggggauuggauacaaccuaacacacaugccaaaucaguucaaccaugauacucaggacgaagccggucucgaggugcaccaguuuuggccccugguagaaauacaaugcucaccugaucuucgcuucuuucuguguaguauguauacgccaaucugcuugcccgacuaccauaaaccucucccaccgugucgaagcgugugcgagcgugcuaaggcaggcuguucuccccugaugagacaguauggguucgccuggccugaaaggauguccugcgaucggcugccaguccucggacgcgacgcugagguguuauguauggauuacaauagaucggaggccaccacagcgcccccuaggccauuucccgcaaaaccgacucugccugggcccccaggugccccugcuucagggggagaaugccccgccggcggcccauucguuuguaagugccgggagcccuuugugccuauucuuaaagaaagccacccauuguauaacaagguccgcaccggccaggugccgaauugcgcaguacccuguuaccagccuaguuucuccgcugacgagcgaacauuugccaccuucuggaucggacuguggucuguucuaugcuuuauuagcacuuccacaaccguggcgacguuccucaucgauauggagagauuuagguauccagaacggcccauaaucuuccugucagccuguuaccuuugcgucagucuggguuucuuggugcgucucguggucggccaugcaagcguugcuuguucucgcgagcacaaccacauucauuacgaaacuaccgggccugcccugugcacaaucguguuuuuacugguauauuucuuuggaauggcuuccucaauuuggugggugauccucagccuuacuugguuccuggccgcaggcaugaagugggguaaugaggccauagcuggguacgcgcaauauuuucacuuggcagccuggcuaauuccaagugucaaaucuaucaccgcucuggcccucuccagcguggacggagaucccguugcaggcauuuguuacgugggcaaccagaaucugaacucgcuuagaggguucguccugggaccguuggugcucuaucuguuaguagguacacuguuucuacucgccggcuucguuucucuguuuaggauccgguccgugaucaagcaagggggaaccaaaacggacaaacuugaaaaguugaugauucgaauaggcaucuucacucugcucuacacagucccugcuucaauuguggucgccugcuaucuguacgagcagcauuaccgcgagaguugggaagcagcgcuuaccugugcuugcccaggucacgauacugggcagcccagagccaagccugaguauugggugcugauguugaaguacuuuaugugucucguugugggcaucacaagcggaguauggauaugguccggcaaaaccgucgaaucuuggaggcgguucacgagccgcugcugcuguagacccaggcgugggcacaagucaggaggugcaauggccgcuggcgacuauccagaggccagugcagcucugaccgggcggacaggaccucccggcccagccgcgacuuaccauaaacagguguccuuaagccacguuuga

SEQ ID NO: 56484 - RNA, 2025 nt, Artificial Sequence
  derived and/or modified sequence opt3 from FZD6__Homo_sapiens__NP_001158088
augaagauggccuacaacaugaccuucuuucccaaucugaugggccacuaugaccagagcaucgcugcaguggagauggaacauuuccucccucuugccaaccuggagugcuccccaaauauugaaacauuuuuguguaaagcguucgucccgacuugcauagagcaaauccacguugugcccccuuguagaaaguuaugcgaaaaaguauacucugauuguaagaaacugauugacacguuugggaucagguggccagaggagcuagaaugcgaucggcuccaguauugugacgagaccgugcccgucacauucgauccucauacugaauuucugggaccacagaagaagaccgaacaggugcaacgcgacauugguuucuggugcccccgacaccuuaaaacaucaggcgggcagggauacaaguuucugggcaucgaucagugugcuccuccaugcccgaacauguauuucaaaagugacgaguuggaguuugccaagagcuucauagguaccguuuccaucuuuugucucugcgcaacucuguucacauuccugaccuuucucauugaugugcguagauucagguaccccgagcggccuaucauuuauuacucugucugcuacucgaucgugucauuaauguauuuuauaggguuccugcuuggagacagcacggccuguaauaaagcugaugaaaaguuggagcugggcgacacuguaguucuaggcagucagaacaaggcaugcaccgugcucuuuaugcugcuuuacuucuuuacaauggccgggacugucuggugggugauucugaccaucacaugguucuuggcugccggacgcaaaugguccugugaagcgauugagcaaaaggcagugugguuucaugccgucgcuugggguaccccaggcuuccucacgguuaugcuguuagccaugaauaaaguggagggggauaacaucucuggaguaugcuuugugggccuguaugaccucgacgcaagcagauacuucguccuucugcccuugugucuaugcguguuuguuggucugucccuccugcuugcugggaucauuucacugaaucacgugaggcaggucauacagcacgauggacggaaccaggaaaaguugaaaaaguucaugauccgcauuggcguguucaguggccucuaucugguaccuuuaguuacucugcuaggguguuacguguaugagcaagucaaucgaaucacaugggaaauaaccugggugagcgaccauugcagacaguaccacauuccaugucccuaccaggccaaagcgaaggccaggccggagcucgcacuguuuaugaucaaguaucuuaugacuuugaucgucggaauuucugcuguguucuggguugguuccaaaaagacaugcaccgaaugggccggcuuuuucaaacggaaccguaagcgcgauccuaucucagagagcagaagggugcugcaagagaguugugaauuuuuccucaaacauaauucuaagguaaagcacaaaaagaaacacuacaagcccuccagccauaaacugaaggucauuucgaagucuauggggacguccaccggagcuacagccaaccacggcacuucagcaguggccauaaccagucaugacuaucuuggucaggagacacugacugaaauccagaccagcccagagacauccaugcgggaaguuaaagcugauggggcgucuaccccucgauugcgcgagcaggacugcggcgagcccgcaagcccagccgcuucaauuaguagacucuccggagaacaaguggauggcaaggggcaggccggaagcgucucugagucagcaaggagugaaggucggaucagccccaaauccgacaucacugauacgggccuggcccagucuaauaacuuacaggugccuucgagcuccgagccaucaagucugaaggggucuacaagccuacucguacacccgguguccggaguucgcaaagagcaaggcggugggugccauucagacaccuga

SEQ ID NO: 56485 - RNA, 1725 nt, Artificial Sequence
  derived and/or modified sequence opt3 from FZD7__Homo_sapiens__NP_003498
augagagaccccggcgccgcugcaccucugagcucccucgggcuuugcgcccugguguuggcguuacugggagcucuaucugccggugcaggcgcccagccauaccacggggagaagggaaucucagucccggaucauggcuucugucaacccauuaguauaccucucugcaccgacaucgcuuauaaccagacaauucugccaaaucuucugggucacacuaaccaggaagaugcaggguuggagguucaucaguuuuacccccucgugaaaguacaauguagcccugaacugagguucuuucugugcuccauguaugccccaguguguacgguccucgaccaggcuauucccccuugccggucuuuaugugagcgcgcccgacagggaugcgaagcgcugaugaauaaguucggcuuucaguggccagagcgucuuagaugugagaacuucccggugcacggcgcaggggaaaucugcguuggacaaaauaccucggaugguucaggcgggcccggaggcgguccuacagccuacccaacugcucccuauuugccugaccugccauuuaccgcccuacccccgggggcaagcgauggaaggggccggccugcuuuccccuuuaguuguccacgccagcucaaagugccucccuaccugggcuauagauuccuuggggagagggacugcggagccccaugcgaacccggucgggcgaacggccugauguacuuuaaggaggaggaacgccgauucgccagauugugggucggggugugguccguacucuguugcgcaucuacacuguuuaccguuuuaacuuaccugguggauaugaggcgguucagcuauccugagcguccaaucauauuccucuccggauguuacuuuauggucgcuguggcccauguggcuggcuuccuucuggaagaccgcgccgucugcguugagagauuuucagaugacgguuauaggacaguggcacaggggaccaaaaaggaaggcuguacgaucuuguucaugguacuauacuuuuucggaauggccaguagcauuuggugggugauccugucucucacuugguuucuggcugcgggcaugaagugggggcacgaggcaauugaggccaauucccaguauuuccaccuugcugccugggcagucccggccgugaaaaccaucacaauacuggcuaugggacaaguugauggugacuugcucucaggcgugugcuacgucgggcugagcaguguggacgccuuacggggauuuguacuggcaccccuauucguuuaucucuuuauuggcacuucuuuccugcuugcggguuuuguguccuuguuccgaauccgcaccauuaugaagcaugaugggacaaaaaccgaaaagcuggagaaacucauggucagaaucggcguguucagcguccuguacacggugccugcuacuaucguucuugccuguuacuuuuaugaacaggcauucagggagcacugggaacggacauggcuguugcagaccugcaagucguacgccgugccaugucccccuggacauuuuccacccaugucuccggacuucacuguauuuaugauuaaguaucucaugacaaugauagucggcaucaccacgggguucuggauuugguccggaaaaacccugcaaucauggcgcagauuuuaccacagguuaagucacagcuccaagggugagacagcuguguga

SEQ ID NO: 56486 - RNA, 2085 nt, Artificial Sequence
  derived and/or modified sequence opt3 from FZD8__Homo_sapiens__NP_114072
auggaguggggcuaccugcucgaagugaccagccuucuggccgcuuuggcauuacugcagagauccucuggggccgcggcugccucagcaaaggagcuagccugccaagaaaucacagucccccucuguaaaggaauugguuauaacuacacuuauaugccuaaucaguucaaccacgacacgcaggaugaggcuggccuggaaguucaucaguuuuggccacuuguggagauacaaugcaguccggaccugaaguucuuuuuguguagcauguacacccccaucugccucgaggauuauaaaaagccucugccacccuguagguccguaugcgaacgggcaaaagccgggugugcuccucugaugcgccaguacggauucgccuggccagaccgaaugcguugcgauagacuccccgagcagggcaauccugacacauuauguauggauuauaacaggacugaccugaccacagcggcaccaucuccgccccggcgccuuccuccacccccuccaggugaacagcccccgucggggucaggacacggcagaccucccggcgccaggccaccucaucgcgggggaggucggggcgggggaggcggugaugcugccgcacccccagcucgagggggaggcggcgggggaaaggccagacccccugguggcggggcggccccaugcgagccgggaugucaaugcagggcacccauggugagcgucaguuccgagcggcacccuuuguacaaucgugugaagaccggccagauugcuaacugcgcccugccaugucauaaucccuuuuucucucaggacgaacgcgcuuuuacuguuuucuggaucggucuauggagcgugcucugcuuugucuccacauucgccaccgugucaacguuucugauugauauggagagauucaaauacccugaaaggccaaucauauuucuuagugcauguuaucuguucguaagcguuggguacuuggugcggcucgucgccggccacgagaagguggcuugcucuggaggcgcgcccggggcaggaggugccggcggggcuggaggcgccgcagccggugcuggggccgcaggcgcgggagcuggcgggccgggaggucgaggcgaauaugaggagcugggggccguggaacagcacguccgcuacgagacuaccggaccugcauuauguacaguuguguuccugcucguauacuuuuucggcauggccuccucaaucuggugggugauucuuagccugacuugguuuuuggcugccgguaugaaaugggggaacgaagcaaucgcuggcuauagucaauauuuccaucuagccgcguggcuggucccaucugugaaguccauugccguucucgcucugagcucgguggacggagaucccgucgcaggcaucugcuacguggggaaucagucucuugacaaccugagaggauuuguauuggccccucucguuauauaccuguucauuggcaccauguuuuuacuggcugguuucgugucccuauuuaggauccggucagucauuaaacagcaagacgggcccacaaagacccacaagcucgagaaacugaugauccgccuuggauuguucacggugcuguauacugucccagccgcagugguuguggcgugucucuuuuacgaacagcauaauagaccuaggugggaggccacacacaacugccccugucugcgugaucuucagccagaccaggcucggcgaccggauuaugccguauucaugcugaaguacuuuaugugcuuggucgugggcaucaccagugguguuuggguguggagcggcaaaacucucgaguccuggagaucucuguguacaaggugcugcugggcaagcaagggggcugccgucggaggcggggcaggagccaccgcugcgggcggugggggaggcccugguggcgggggaggcgggggacccggcggugggggaggcccagguggcgggggaggcucauuauauagugacguguccacggggcugaccuggcgcagcggaacagccucuucaguaaguuaccccaaacaaaugccucuaagccagguguga

SEQ ID NO: 56487 - RNA, 1776 nt, Artificial Sequence
  derived and/or modified sequence opt3 from FZD9__Homo_sapiens__NP_003499
auggccguggcuccccugagaggcgcacuccuucuguggcaguuguuagccgcagggggagcugcccuggagaucgguagguucgacccugaacggggccgcggggcagccccaugccaagcugucgagauuccgaugugucgaggaauaggcuacaaccuaacccguaugcccaaucuccugggucacacaagccagggggaagcagccgcugagcuugccgaauuugcgccucugguucaguauggaugccauucccacuugagauucuuucucuguucucuguacgcaccaaugugcacugaucaggugucaacgcccaucccugccuguaggccaaugugcgagcaagcucggcugcgcugugcccccauuauggagcaguucaacuuuggcuggccugacagucucgauugcgcaagauuaccaaccaggaaugacccgcaugcucuguguauggaagcccccgagaacgcgacagccggcccugcagaaccacacaaggggcuuggaauguugcccguagcuccucggccagcccgacccccgggugaucugggcccuggggcuggaggcagcgguacuugcgagaaucccgagaaauuccaguauguggaaaagucccgcucuugugccccaagaugcgggccuggagucgagguguuuuggucgaggcgggacaaagauuucgcgcuaguuuggauggccguguggucagcucucugcuuuuucagcaccgcguuuacaguccugaccuuccuucuggaaccccaucguuuucaguacccagagcgccccaucauuuucuugaguauguguuauaacguguacucccucgcauuccugaucagagccguagcuggcgcccaaucuguugcaugcgaccaggaagccggcgcuuuauaugugauacaggaggggcuggagaauacuggauguacacucgucuuucuucuguuguacuacuucgguauggccagcucccuaugguggguggugcugacccucacgugguuucuggcagcgggcaagaaaugggggcacgaagcuaucgaggcccacggaucauauuuccauauggcagccuggggccuuccugcucugaagacuauugucaucuugacccucaggaagguugccggugaugaacugacaggguuaugcuacguggcaaguacugacgcugccgcgcugaccggcuuuguacuugugccacucagcggauaucugguccuugggucuuccuucuugcugacaggcuuuguggcccucuuccacauucggaaaaucaugaagaccggagguacgaacacugagaaacuggaaaagcuaaugguuaaaauaggcguguuuucaauucuguacacagucccggcuaccugugugaucguaugcuauguuuacgagcgauugaauauggauuucuggcgccucagagcaacugagcagcccugugccgcugccgcagggccuggaggcaggcgggacugcagccugccaggugggagugugcccacagucgcgguguuuauguuaaagauuuucaugucucuggucgugggcaucaccuccggaguuuggguguggagcucgaagacguuucaaaccuggcagucucuauguuaucgcaaaaucgccgcuggcagagccagggcaaaggcuugccgugccccuggguccuacggacgggguacacauugucacuacaaagcaccaacuguaguccuccacaugaccaagacagaucccucacuggaaaacccgacucaucuuuga

SEQ ID NO: 56488 - RNA, 1215 nt, Artificial Sequence
  derived and/or modified sequence opt3 from FZR1__Homo_sapiens__NP_001129669
auggaccaggauuacgagagaaggcugcuccggcaaaucgugauucagaacgaaaauaccaugccccgcgucacagagaugcgacguacucuuacgccugccagcuccccaguuucuucaccgaguaagcacggcgacagauucauacccagcagggcuggggcaaacugguccgugaauuuucaucggaucaacgaaaaugagaaaucuccuucgcagaaccgcaaggccaaagaugcgaccucagacaauggaaaggauggucuggcuuauagcgccuugcugaaaaacgaauuacuaggcgcagggauugagaagguacaggacccacaaacagaggauagaaggcuccagcccaguacuccugaaaagaaaggacuguucaccgugacacggcuuugcgaccuguccgucgagggcgauucugugaccagcguugguugguccgaacgcgggaauuugguggccgucggaacucacaagggcuuugugcagaucugggacgcugcagccggcaaaaagcucucaaugcuggaggggcauacagcucgaguaggagcccuggcguggaacgcagagcagcucaguagcgguucuagagauaggaugauuuuacaacgggacauccguaccccaccccugcaguccgaacgcagacuucagggccacaggcaggagguuuguggguugaaauggucaacggaucaucaacugcuagccagcggaggcaaugacaacaagcuccugguguggaaucacaguucucuuuccccuguccagcaguacacugaacaccuggcugccgugaaggcaauagcuuggagcccacaucaacacgguuugcucgccucgggagggggcaccgcggaccggugcauccgauucuggaacacacugacuggccagccguuacaguguauugauaccgggucucaggugugcaaucuggccugguccaaacaugcaaacgagcucgucucaacacacggauauagucaaaaccagauccuuguuuggaaguaccccagccugacccagguggcuaaauugacgggucacuccuaucgcguacuauaccuggccaugucuccugacggcgaagcuauugugacuggggccggagaugagacacucagauuuuggaaugucuucagcaagaccaggucaacuaaagagaguguguccguucugaaccuuuuuacacggauccgcuga

SEQ ID NO: 56489 - RNA, 312 nt, Artificial Sequence
  derived and/or modified sequence opt3 from G0S2__Homo_sapiens__NP_056529
auggagaccgugcaggaacugaucccccucgccaaggagaugauggcucaaaagagaaagggcaaaauggucaaacuuuacguucuggggagcguguuggcauuauucggaguagugcugggucuaauggaaacagucugcuccccuuuuacugccgcgaggcggcuccgcgaccaggaggcugccguggcagaacugcaggccgcucuugagcgacaggcacugcaaaaacaggccuugcaggagaagggcaagcagcaagauacgguucucgggggacgugcucugucuaacagacagcacgccucauga

SEQ ID NO: 56490 - RNA, 2121 nt, Artificial Sequence
  derived and/or modified sequence opt3 from G2E3__Homo_sapiens__NP_060239
augaacgagagcaagcccggcgacucccagaaucuggccugcguguucuguagaaaacacgaugacugcccuaacaaguacggggagaaaaagaccaaagagaaguggaaucucacaguccauuauuacugucuucugaugucuucaggaaucuggcaaagggguaaggaagaggaaggcguuuauggguuuuugauugaggauauacggaaagaggugaaccgcgcuaguaaguuaaaaugcuguguaugcaagaaaaauggagcaagcaucggcuguguggccccacgaugcaagcguuccuaccacuucccguguggucugcagagagaaugcauuuuucaguucacugggaacuuugcgucuuucuguugggaccauaggcccguccagaucauuacgucgaauaacuaucgggagucacuaccuugcaccaucugccucgaauuuauagagccaauccccagcuacaauauucugcgcaguccuuguugcaagaacgcuugguuccacagagauugucuucaagugcaggccaucaaugcaggaguuuucuucuuuaggugcacaauuuguaacaauuccgacaucuuccagaaagagaugcugcggaugggcauacauauuccagaaaaggaugccucuugggaguuggaagagaacgcuuaucaggaacuccugcaacacuacgagcgcugcgacgugcgaagauguaggugcaaagagggccgggauuacaaugcacccgacagcaagugggaaaucaaacguugucagugcuguggguccucaggaacucaccuggccugcaguagccuccgcucuugggagcagaacugggaaugcuuagaguguagagguauuaucuauaacuccggcgaauuucagaaggcuaaaaagcauguccugccuaauucaaacaauguggggaucaccgauugccuuuuggaggagagcaguccaaagcugccgaggcaaucucccggaucccagagcaaagaccuacuccggcagggcucgaaguuccgacgcaacguaucuacacugcuuauugaacuggguuuccaaaucaaaaagaaaaccaagagauuguacauaaauaaggccaacauuuggaacuccgcgcucgaugcauuuaggaaucggaauuucaacccuucauaugccaucgagguugcuuacgugauagaaaaugacaacuuugggagugagcacccaggaagcaaacaggaauuucuguccuuacugaugcagcaucucgaaaauucuagccuuuuugagggcucacugaguaagaacuugucccuaaauagccaggcccugaaagaaaaccucuauuacgaggcaggcaagaugcuggcuauuucucuuguccacgggggacccucaccugguuucuuuaguaaaacucuguucaacuguuugguguauggcccagaaaauacacaacccauccucgacgaugugagcgacuuugaugucgcccagaucauuauccgcauuaacaccgcgacgacuguugccgaccugaaguccauaaucaaugagugcuacaacuacuuagagcugauugggugucuaagacucaucaccacacugucugauaaguauaugcuugugaaagacaucuugggauaccacguaauucagagggugcauacuccguucgaaucguuuaagcagggccugaaaacccucgguguccuggagaagauacaagcauauccugaggcuuucugcagcauccuuugucacaaacccgaaucccugucagccaagauuuugagugaacucuuuacagugcauacccugccagauguuaaggcuuuaggguucuggaacucuuaccugcaggccguggaggacggcaaaagcacgacuacaauggaggauauccuaauuuucgcaaccggaugcuccucaaucccucccgccggcuuuaagccaacucccagcauagaaugucuccacgucgacuucccuguggggaauaaaugcaauaacugucuggcuaucccaauuacaaauaccuauaaggaguuucaggaaaacauggauuucacgauccguaauacccuucgguuggagaaagaagagucuucccauuacauuggacacuga

SEQ ID NO: 56491 - RNA, 1401 nt, Artificial Sequence
  derived and/or modified sequence opt3 from G3BP1__Homo_sapiens__XP_006714813
auggugauggagaagcccagcccucugcucgucggcagagaguucguuaggcaguacuauacccuucugaaccaagccccagacauguugcaccgguuuuacgggaaaaauuccucuuaugugcauggagguuuagauucaaacggcaagccggcugacgcaguauacgggcagaaagagauccaccgcaaggugaugagucagaauuucacaaacugccauacuaaaauucgacacgucgaugcccaugcgacgcugaaugacggagugguugugcaggucaugggccuacucagcaacaauaaccaagcucugcguagauuuaugcagaccuucgugcuugcccccgaagguuccguagcaaauaaguuuuauguucacaacgauauauucagguaccaggacgagguguuugggggauucgucacagaaccucaggaggagucugaagaggaaguggaggagccagaagaacggcaacagacucccgaaguggucccugaugacucgggcaccuuuuaugaucaggccguugugucaaaugacauggaggaacaccuggaggagccaguagcugaacccgagccugauccagaaccggagcccgaacaggagccugugagcgagauccaagaagagaagccagaacccgucuuggaggaaacagcaccugaggacgcccagaaaaguuccucuccagcucccgccgauauugcgcagaccgugcaagaggaccuccgcacuuucagcugggcauccguuacaucaaagaaccugccgccuaguggcgccgugcccgucaccgggaucccaccucaugugguaaaaguucccgcuagccagccaagacccgaaucuaagccugagucccagauuccaccgcagaggccccaacgggaccagcgcgugcgagaacagagaaucaauauaccuccacagaggggaccccggccuauccgugaggccggugagcaaggcgauauugaaccacgcagaauggucaggcaccccgacucacaucagcuguuuaucgggaaccucccgcacgagguggauaaaagcgaauuaaaggacuucuuucagaguuacggaaaugucguggagcugcggauuaacucuggcgguaaacuuccuaacuucggguucguuguguuugaugacuccgaaccaguacagaaggucuugagcaaucgacccaucauguuccgcggagaggugagacugaacguugaggaaaagaaaacgagggcagcucgggagggcgaucgcagagacaauaggcuacguggcccugggggaccccgggguggccucgggggaggcaugcgagguccaccuagagggggcauggugcaaaagcccggauuuggcgucgggaggggacuggccccacgccaguga

SEQ ID NO: 56492 - RNA, 465 nt, Artificial Sequence
  derived and/or modified sequence opt3 from G6PC2__Homo_sapiens__NP_001075155
auggacuuccugcacagaaacggcgugcucaucauucagcaucuucaaaaggauuacagggccuauuacaccuuucugaauuucaugagcaacgucggggacccccggaauauauuuuucaucuauuuuccuuugugcuuccaguuuaaccagacaguuggaacuaaaaugauuuggguggcuguaaucggugauugguuaaaucugauuuucaaguggauccuauuuggccaccgcccauacuggugggugcaggagacgcaaauauauccgaaccauuccucucccugucucgaacaguucccuaccacaugcgagacugggccaggaucacccaguggccacgcaaugggugccagcugugucugguacgugaugguuaccgcggcucugucccauacagugugcgggauggacaaauuuucuaucacccuucaccgacacgccggaggccguggccuguga

SEQ ID NO: 56493 - RNA, 1041 nt, Artificial Sequence
  derived and/or modified sequence opt3 from G6PC3__Homo_sapiens__NP_612396
auggagagcacccugggcgccgggaucgugauugccgaagcacuccagaaccaacuugccuggcuggagaaugucugguuguggauaacauucuuaggagaccccaagauccuguuucuauucuacuuuccugcggcuuauuacgccuccagaaggguugguauugcagugcucuggaucucucugauuacugaauggcuuaaccugaucuucaaaugguuuuuguucggcgaucggccauuuugguggguacacgagucaggguauuacagucaggccccggcucaggugcaucaguuccccagcuccugcgaaacgggaccuggcucuccaucgggucacuguaugauaaccggggcagcccucuggcccaucaugacagcucugucaagccaagucgccacucgcgcgcgaagucguugggugagaguuaugccuucccuggcauauugcaccuuucucuuagccgugggacugucuaggauuuucauccuugcucauuuuccacaccaggucuuggccggccugauuacaggcgcagugcuaggguggcucaugacuccccggguaccuauggagcgcgagcugagcuucuacggacuuaccgcucuggccuugaugcucgguacaucccugaucuauuggaccuuauuuacgcugggccucgaccuuucauggaguauaagccuggcguucaaguggugugaaagaccagaguggauucauguugauucuaggccguucgccuccuugucacgggacagcggggcagcucuaggacugggcaucgcccuccacagucccugcuacgcucaggugcgccgagcccagcuggguaaugggcagaaaauugcaugucuuguccuggccaugggauugcucggcccucuggauugguuaggccacccaccccaaaucucucuguuuuacaucuucaacuuucuaaaguauacucucuggccuugccuggugcuugcuuuggugccaugggcgguccauauguucuccgcacaggaagcucccccgauucacagcucguga

SEQ ID NO: 56494 - RNA, 1074 nt, Artificial Sequence
  derived and/or modified sequence opt3 from G6PC__Homo_sapiens__NP_000142
auggaggaaggcaugaacgugcugcacgacuucgggauccagagcacccauuaccuccaagucaauuaucaggauucccaggacugguuuauucuuguuucugugauagccgaucugagaaacgcuuucuacguauuguuucccaucugguuccacuuacaggaggcagugggaauuaagcugcuaugggucgccgugaucggugacuggcucaaucugguuuuuaaauggauucuuuucggccaaaggccuuauuggugggugcuggauacagacuacuauucaaacacuucagucccauugaucaagcaguuuccggugacgugcgaaaccgggcccggaagcccuuccggccaugcgauggguacagcugggguauacuauguuauggugacuucuacccucucgauauuccagggaaaaaucaagccaacauaccgguuucgcugucugaaugucauucuguggcucggcuucugggccgugcaguuaaacgugugccugucacgaaucuaccuugcagcccacuuuccccaucaagucguugcuggcguguugagcgggauugcaguagccgagaccuucagucacauccacuccauauauaaugcuucucugaaaaaguacuuucuaauuacuuucuuccucuuuagcuucgccaucggauuuuaucugcuucugaaggguuugggcguggaucuccuguggacauuagaaaaagcgcagcguuggugugagcagccugaguggguccauauugacaccacgccauucgcaucccugcucaagaaccuugggacucuguuuggauugggccuagcccugaauaguaguauguacagagaaagcugcaaagguaagcucucuaaauggcugcccuucaggcuuuccucaaucguggcuagccugguuuugcuccacguguuugauagucugaagccuccaucucaggucgaguuaguguucuauguacuguccuuuuguaagagcgccguugugccgcuagcaucggucucugugauccccuacugccucgcucaaguccuggggcagccucauaaaaagucccuuuga

SEQ ID NO: 56495 - RNA, 1638 nt, Artificial Sequence
  derived and/or modified sequence opt3 from G6PD__Homo_sapiens__NP_000393
augggcagaagggggagcgcccccggaaacggucggacccugcgcggcugcgagcgagggggacguagaaggcgguccgcugacucugugauggcagaacaggucgcccucucacgcacacaaguuuguggcauccuuagagaggaacuguuccagggugaugcguuucaccagagugacacucauauuuucauaaucaugggggcuagcggagauuuggccaagaaaaagauuuacccuacgaucuggugguuauuuagggacggccugcuaccagagaauaccuucauugugggcuaugcacggucccgccucacaguagccgauauccgaaaacagucugaaccguuuuucaaggcuacucccgaggagaaacugaagcuggaagacuuuuucgcaagaaacucguacguggccgggcaauaugaugacgcugccucauaccagaggcugaauagccacaugaacgcguugcaucucggaagucaggcaaaucggcuguuuuaucuggcccucccuccaaccgucuacgaggcugugacaaagaacauacacgaauccugcaugucucagaucgguuggaaucguauuaucguugagaaacccuucggccgcgauuuacaaagcuccgacagacugucaaaccauauuaguagccuuuuuagggaggaucagaucuaucggauagaccacuacuuggggaaggaaauggugcagaaucugaugguccuacgauucgccaaccgcauuuuuggaccuaucuggaauagagauaacauugcaugugugauccucaccuucaaagagccauucggcacugaagguagggguggauacuuugacgaguucggcaucauucgggacguaaugcagaaucaccuucuucaaaugcugugcuugguugcuauggaaaagcccgccucuacaaacuccgaugacgugcgcgaugagaaagucaaggugcucaaguguauaucagaggugcaggcgaauaacgucguucugggccaguauguggggaacccugacggagaaggugaggccaccaaaggcuacuuagaugacccaacgguaccgagagggagcacuaccgcaacauuugcugccgugguccuguauguggaaaaugagaggugggauggaguucccuucauccuccguugcggcaaggcucuuaacgaacggaaagccgaggugcgacugcaauuucaugacgucgcaggggauauuuuccaccagcaguguaagagaaaugaguuggugaucaggguacagccuaacgaagccguuuacacuaaaaugaugaccaagaaaccagggauguuuuucaaucccgaggaaagugagcuagaccugacauauggcaaccgcuacaagaaugugaagcucccugaugcuuaugaacggcugauacuugacgucuuuugcggaucucaaaugcauuucgugagauccgacgagcugagggaggcguggcgcauuuuuaccccauugcuccaccagaucgaacuggagaaacccaagccgaucccuuacauuuacggcagccgagggcccacggaagcagaugaguuaaugaaacgggucggauuccaguaugaggguacuuacaagugggugaacccacacaaacuguga

SEQ ID NO: 56496 - RNA, 2859 nt, Artificial Sequence
  derived and/or modified sequence opt3 from GAA__Homo_sapiens__XP_005257251
augggcgugagacaucccccuugcagccacaggcugcucgccgucugugcucuuguuucccuggcaaccgccgcguuguuagggcacauccugcuacaugacuuccuccuggugccacgggagcuuucuggaucaaguccgguacuggaagagacacaccccgcucaucagcaaggugccagccgcccuggcccacgagaugcacaggcccaccccgggcguccuagagcugugccaacucagugcgacgugcccccuaacuccagguuugauugugcaccagacaaggccauuacgcaggaacaaugcgaggcucggggauguugcuacauaccggccaaacagggcuugcagggugcgcagauggggcaacccugguguuucuuuccuccaucuuaucccucguacaagcucgaaaaucugucaagcagugagaugggauauaccgcaacacugacucgcaccacaccuaccuucuuuccaaaagauauccucacuuuaagacuggacgucaugauggagacagaaaacaggcuucacuucaccauuaaggaucccgccaaucggcgcuacgagguuccguuggaaacgccucaugugcacucccgagcucccucuccacuguauagcgucgaguuuuccgaggaaccuuucggcgugaucguaagaaggcagcuagacggccggguucuccugaacacuaccguggcaccccuguuuuucgccgaucaguuucugcaguugucaacaagucucccaagccaauacauuacugggcuggcugagcauuuaucuccccugaugcucuccaccucauggacacguaucacccuuuggaaucgcgaccuggccccuacgccaggagcgaacuuguaugguagccacccguucuaccuagcccuggaagauggcgggagugcacacggagucuuucuccuuaauucuaacgcuauggacguggugcuucagcccuccccugcccugagcuggagaucgacuggcgguauauuggaugucuacaucuuccucgggccagagcccaaaucuguugugcagcaauaucuggacguagugggauacccuuucaugccacccuauuggggcuuaggcuuucaucuguguagguggggguacuccucaacagcuauuacccggcaggucguggaaaauaugacucgagcccacuucccgcuagacguucaguggaacgaucucgacuauauggauagucgcagagacuuuacauucaauaaggauggauuuagggacuucccugcaauggugcaggagcugcaucaagguggccggcgcuacaugaugaucgucgauccagccauuagcuccucugggcccgcuggaagcuauagaccuuacgacgagggccuuaggcgugguguguuuaucaccaacgaaacggggcagcccuugauaggcaagguauggccaggaucaaccgcguucccugauuuuacaaaucccacugcacuggccuggugggaggacaugguugcugaguuccacgaucaggugccauuugacggcauguggauugacaugaacgaaccgaguaauuucauccggggguccgaagauggaugcccuaacaacgagcucgagaaucccccauacguccccgguguggucggcgggacccugcaggccgcaacaauuugcgccagcucucaucaauuucuuucaacucacuauaaccugcacaauuuguacggacucaccgaagcuaucgccagucaucgagcacuggugaaagcgagaggcacaaggccuuucguuaucagccgcuccaccuucgcuggucacgggcgguaugccggccauuggacuggagacguguggucuucgugggagcaguuagcaagcuccguaccagaaauucugcaguuuaaccuacucggcgucccccuggugggggccgauguuuguggauuccuugguaauacgucagaggaauugugcgugagauggacacagcugggcgcuuuuuacccuuucaugaggaaccacaauagucuccugucuuuaccgcaagagccauauagcuuuuccgagcccgcccagcaggcaaugcgcaaggcucugacccuucgauacgccuugcucccucaccuguauacucuauuccaucaggcgcacgucgccggggaaaccguggcucggccacuguuucucgaguuccccaaagacucaagcacauggaccguagaucaucaacugcuuuggggagaagcauugcugauaacuccuguguuacaggccggcaaggcugagguuacagguuacuuuccgcucgggacgugguacgaccugcagaccguccccguggaggcccuuggcucucugccaccucccccagcagcgccucgugaacccgccauccacuccgagggacaaugggugacuuugccagcuccgcucgauacaauuaacguccaucugagagccggcuauaucauaccucuacaggggcccggacugaccacaacugaaaguaggcagcagccaauggcacucgcuguugcccugaccaaaggcggugaggcacgcggggaacuuuucugggacgauggagagagcuuggaggugcuggaacggggcgccuacacgcaagugaucuuuuuagcuagaaauaacaccauuguaaaugagcucgucagggugacaucugaaggugcgggccugcagcuucagaagguuacugugcugggggucgccaccgcaccccagcaagugcuauccaacggaguuccugugucaaauuucacauauaguccagacacuaagguacucgauaucugcgucagccuguugaugggcgagcaguuucuggugucgugguguuga

SEQ ID NO: 56497 - RNA, 2085 nt, Artificial Sequence
  derived and/or modified sequence opt3 from GAB1__Homo_sapiens__NP_002030
augagcggcggggagguggucugcuccggauggcugagaaagucucccccugagaaaaagcucaaaagguacgccuggaagcggcgcugguucguucuucgaucaggucgucugaccggcgacccagauguguuggaguauuacaaaaacgaccacgcuaagaagccgaucagaauuauagauuuaaaucugugucagcaaguagacgcagggcuaacauuuaacaaaaaggaguucgaaaauaguuauaucuuugauauuaacacuaucgacaggauuuucuaccucguggccgauagcgaagaggagaugaauaaauggguccggugcaucugugacauaugcggauuuaaccccacggaagaggauccugugaagccacccggcuccucucugcaggcgccugcugaccuuccacuggccaucaauaccgcacccccuucgacacaggccgauucaagcagugcuacuuugccaccgcccuaucagcucauuaacguuccuccacaucuggaaacccuggguauccaagaggacccccaggauuaccucuuacugauuaauugucaguccaaaaagccugagccaacacgcacccacgcagacucugccaagagcacuuccucagaaacagacugcaacgauaaugugcccagucauaaaaacccggcuagcucucaguccaagcacgggaugaauggauucuuucaacagcagaugaucuaugacucaccucccagcagagccccaagugcgucugucgauuccagccuuuacaacuugccuaggucguacucucaugacgugcugcccaaaguauccccaucaaguaccgaggcagauggcgaacuauauguuuucaauacgcccagcggcacuuccucuguggagacccagaugcggcacgucagcauaucauacgacauuccuccaacaccggggaacacuuaucaaaucccccgcaccuuuccugaaggaacacucggucagaccaguaagcuggauacgauuccagacauucccccuccacgacccccgaaaccucacccagcccaugauagaucccccguggagacuuguagcaucccuaggacagcuucugacaccgauucaaguuacugcauccccacugccggcaugagcccaucccggucuaacacaauaucgaccguggaccuuaauaagcugcguaaagacgcaagcucccaggauuguuaugacaucccucgcgcuuuccccucagauagaaguucuagcuuggagggguuucacaaccauuucaaggucaagaauguucucacggugggauccguaucaagcgaagaacuggacgaaaacuacgugccaaugaauccgaacucuccucccaggcaacacuccaguagcuuuaccgagccaauucaggaagccaauuauguccccaugacaccuggcacuuucgauuucucuuccuuugguaugcaagugccacccccugcgcacaugggguuccggucaaguccgaaaaccccaccccgacgcccuguuccaguggccgacugcgagcccccuccggucgauagaaacuuaaagcccgacaggaaagugaagccagcaccucuggagaucaaaccccucccagaaugggaggaacuucaggcuccuguacggagccccauaacacgcucguuugccagagauuccucuagguucccaaugagcccgcguccugacucaguucauaguacuaccuccucuagcgauucccacgacucagaggaaaauuacgugcccaugaacccaaaucugagcagugaggaucccaacuuguuuggaucuaauucccuagacggcggcagcucgccuaugauuaagccaaagggggacaaacaggucgaguaccuggaucucgaccuggauucaggaaagucuacacccccucggaaacagaagaguuccgguagcggcucuagcguggcugacgaacgagucgauuaugugguuguggaccagcagaaaacccuugcccugaaguccacuagagaggcauggacggaugggaggcaaucaacagaaagugagaccccggccaagagcguaaaauga

SEQ ID NO: 56498 - RNA, 1917 nt, Artificial Sequence
  derived and/or modified sequence opt3 from GAB2__Homo_sapiens__NP_036428
augagcggcgaccccgaugugcuggaguacuauaagaacgaccacuccaaaaagccucucagaaucauuaaucuuaacuucugcgaacaggucgaugccgggcugaccuuuaauaaaaaggaguugcaagacucuuucguuuuugauauaaaaacaucagaaaggacuuucuacuuaguggcugagacggaagaggacaugaacaaguggguacagaguaucugucagauuugcggauuuaaucaggcagaggaaagcaccgauucccugcggaacgugucuucggccggucauggcccacgcucaagcccggcggagcuaaguuccucuagccaacaccuccugcgagaacguaaguccucagcucccagucauagcucucagccuacacuuuucacuuuugagccacccgucuccaaucacaugcagccuacccugucaacaagcgccccacaggaguauuuguaccuccaucaauguaucaguagaagggcagaaaacgcccggucugcuuccuucagccaggggacccgcgcaucguuucugaugagaucugacacugccgugcagaaacuggcucagggaaauggccacugcguuaacgguauuuccgggcaagugcacggauucuauucacuccccaagccuaguaggcauaauacagaguuucgggauagcaccuacgacuuaccacgcucccuggccucucacggccauacgaaaggcagccuuacugggucagaaaccgauaacgaggacgucuauacauucaagacuccgaguaauaccuugugucgagaauuuggagaucugcuaguggacaacauggacguacccgcgacaccucucuccgcauaccagaucccaagaaccuucacgcuggauaaaaaucacaacgccaugacuguugcuacacccggugacagcgccauagcaccuccacccaggccgccuaagcccucucaggcugagaccccacgguggggcucaccucaacagcgucccccaaucagugagaacagccgcuccguggccgcgacuauucccagaaggaauacacuuccugccauggauaacucucggcugcaccgagcaucgagcugcgaaaccuacgaguauccacagcgcgggggagaauccgcuggcagaucagccgagaguaugucugacggugucgggagcuucuugccgggaaagaugaucgugggcagguccgauucaacgaauagcgaagacaacuacgugcccaugaauccuggcuccuccacccuccuggcuauggagcgggccggggauaacagucagagcgucuauauuccaaugucucccggagcacaucacuuugacuccuuagguuacccuucaacaacucugccaguucaucgcggccccaguagagggagcgagauccaaccgccuccagugaauaggaaccucaaacccgaucguaaggccaaaccuacaccccuugaccugcggaauaacaccguaauagaugaauugccauucaagucgccuauuacuaaauccuggucucgagcuaaucacaccuuuaacagcucaaguucccaguauuguagacccaucucuacacagagcauuaccuccacugacucaggagacagcgaggaaaauuacgugccaaugcagaacccggucagugcgucuccugugcccuccggcacgaauagcccagcacccaagaaaucgacagguucaguugauuaucuagcccuggacuuccaaccuucuaguccaucuccccauaggaagccuagcaccucuagcgugacuuccgaugagaaggucgacuacgugcagguagauaaagaaaagacccaggcucuccagaacacaaugcaagaguggaccgacguucgccagucaagugagccgagcaaaggggccaagcuguga

SEQ ID NO: 56499 - RNA, 1764 nt, Artificial Sequence
  derived and/or modified sequence opt3 from GAB3__Homo_sapiens__NP_001075042
augagcgccggcgacgcugugugcaccggguggcuggucaagucucccccugagagaaaacuccagagguacgcauggcggaagcgcugguucguucuucgacguggaagaauguccgguaacccagaugugcuggaauauuacaggaauaaacacucaaguaagccgauccggguaauugacuugagcgagugugccguguggaaacaugucggccccuccuuugugcgcaaggaguuccaaaacaauuuuguuuucauagugaagacaacuucuagaacguuuuauuuagucgcgaaaaccgagcaggaaaugcaaguguggguacacucgaucucacagguuugcaaccuggggcaucuagaggauggagcugccgacagcauggagagucucuccuacacaccuucuagccugcaaccauccucagcaaguagccuucugacugcccacgcugcaucuuccucauugcccagggaugacccuaauaccaacgccguggcuacagaagagacccggagcgaaagugagcuccuguuccugccagauuaucucgucuuaucuaauugugagacuggccgccugcaucacacaucccuucccacccgaugcgacagcuggucgaacucugauagauccuuggaacaggccucauuugacgauguguucguggacugucugcagccucuaccaaguagccaccucguccauccguccugccacgguucuggggcgcaggagguucccagcucaaggccucaagcagcccugauuuggagucgggaaaucaauggaccaccccgugaucaucuuuccagcucuccucuguuggagucaagucucagcuccacgauucagguggacaagaaccagggcucucugccauguggcgcuaaagaauuagacaucaugucgaauacucccccgccuagacccccaaagccuagccaccuguccgagcgcaggcaggaggaauggucaacccacagugggucuaaaaagcccgagugcacacucguaccacggcgaauaagccuuuccggacuggauaacaugcgcacuuggaaggccgacguggaaggucaaucauugagacauagggauaaacggcuaagccugaaucuccccugucgcuuuucuccuauguacccaaccgcauccgcuaguaucgaggacagcuaugucccgaugucuccccaggccggcgcguccgggcugggaccucacugcucaccagaugacuacauucccaugaacaguggcagcaucucguccccucuuccagaacugcccgccaauuuggagccgccuccagugaacagagaucucaagccccagaggaaaucucguccucccccacuggacuuacggaaccugagcauuauccgagagcaugcaucacuaacaagaaccaggacgguuccuuguagucgcacuuccuuccucucucccgaacggaaugguauaaacagcgcuagauuuuucgccaauccaguguccagggaggaugaagagucauacauugaaauggaggagcaccgcacagcuagcagucugucuuccggggcccuuaccuggacuaagaaauuuagcuuggacuaucuggcacucgauuucaacucggccucaccggcuccuaugcaacagaagcugcuucugucugaagaacagcgagucgacuacgugcagguagacgaacagaaaacacaggcguugcagaguaccaagcaggaguggacggaugagcggcaauccaagguuuga

SEQ ID NO: 56500 - RNA, 354 nt, Artificial Sequence
  derived and/or modified sequence opt3 from GABARAP__Homo_sapiens__NP_009209
augaaguucguguacaaagaggaacaccccuuugagaagagaaggagcgaaggcgagaaaauccggaagaaauauccugaccgcgucccaguuauuguggaaaaggccccgaaggcucgaauaggggaucuggacaaaaagaaauaccucguacccuccgaucuuaccgugggacaguucuauuuucugauccguaagaggauucauuugagagcagaggacgccuuauucuuuuucgucaacaaugugaucccuccaacaucugcgacuaugggucaacuguaccaggagcaccaugaagaggacuuuuuccuauauauugcuuacucagaugaaaguguuuauggccucuga

SEQ ID NO: 56501 - RNA, 354 nt, Artificial Sequence
  derived and/or modified sequence opt3 from GABARAPL1__Homo_sapiens__NP_113600
augaaguuccaguacaaagaggaccaccccuuugaauauagaaagaaagagggcgaaaagaucaggaaaaaguacccugaucgggugccagucauuguugagaaggccccgaaagcucgcgugcccgaccuggauaagcgaaaauaucucguaccuagcgaccuuaccguggggcaauucuacuuucugauacguaagagaauccauuugaggccagaagaugcauuauucuuuuucgucaacaauacaauucccccuacuuccgccacgaugggacagcuguaugaggacaaccacgaggaagauuacuuucuauauguggcguacucugacgagucaguuuacgguaaauga

SEQ ID NO: 56502 - RNA, 354 nt, Artificial Sequence
  derived and/or modified sequence opt3 from GABARAPL2__Homo_sapiens__NP_009216
augaaguggauguucaaagaggaccacagccuggaacauagaugcguggaguccgccaagaucagggcuaaauaccccgaucgggucccuguuauuguggaaaagguaucuggcucacagauaguggacaucgauaaacgcaaguaucucgucccaagugacauuaccguggcacaauuuauguggaucauucgaaagcguauccagcuuccgagcgagaaagccauauuccuguuuguugauaagacagugccccaguccucuuugacuauggggcaguuauacgaaaaagagaaggacgaggauggauuccuguaugucgcguacucgggugaaaacacguuuggcuucuga

SEQ ID NO: 56503 - RNA, 2886 nt, Artificial Sequence
  derived and/or modified sequence opt3 from GABBR1__Homo_sapiens__NP_001461
augcugcuccuucuguuguuagcuccccuguuccuaagaccuccaggcgccgggggagcacagaccccgaacgccaccagcgaggguugccaaaucauucaucccccuugggaaggcgggauaagguaccggggacucacucgcgaccaggugaaggcgaucaauuuucugccagucgauuaugagauugaauacguuugucgaggcgagcgugaagugguaggucccaaagugagaaagugccuugcuaacggguccuggacggacauggauaccccuucuagguguguccggaucugcucaaaaaguuaucugacauuggagaauggaaagguguuccucacuggcggcgaccugccagcccuggauggggcacgcguugacuuuagaugugaucccgacuuccaccucgugggaagcuccaggucuauuugcucgcagggucaguggucaaccccuaaaccacacugucaagucaaccggacaccgcacagcgagcgccgagccguguacaucggcgcuuuauuucccaugagugggggauggccuggcggucaggcaugccagccagccguagaaauggcucuggaggauguuaauuccagaagggacauacuucccgauuaugaauugaagcugauccaccaugacucuaagugugauccugggcaggccaccaaauaccuauaugagcuccuguacaacgacccaauuaagaucauucuuaugcccggaugcagcuccgugucaacucuggucgcggaggcagcccggauguggaauuugaucgugcucaguuacggcucuagcuccccggcucugucaaaccgucaacgcuucccuacauuuuucagaacccaccccagcgccacguuacacaauccaacuagggugaaacuguuugaaaaguggggcuggaaaaagauagcaaccauucagcagacaacugaggucuucaccaguacacucgacgaucuugaggaacggguuaaggaagcugggaucgagauuaccuuucgacagucuuucuuuuccgacccugccgugcccgugaaaaaccugaagcgccaagaugcgagaaucaucguaggauuguucuaugagacggaagccaggaaagucuucugugagguguacaaggaacggcuauuugguaaaaaguauguuugguuccugauuggcugguacgcagacaauugguuuaaaauauaugauccaagcaucaacugcacuguggacgagaugacagaagcugucgaggggcauauuaccacugagaucgugaugcucaaucccgccaacacacgcucgauaucuaauaugaccucccaggaguucguagaaaagcugacgaagagacuuaaaaggcacccugaagagaccggaggcuuucaggaagcuccacuggccuacgaugcaauuugggccuuggcucucgcgcugaacaagacaucaggugggggcggacguaguggcguucgguuagaggacuucaacuauaauaaccaaacuaucaccgaucagaucuaccgagcaaugaauagcuccucuuuugagggggugagcggacaugucguguucgacgccucagguaguagaauggcuuggacacugauugaacagcuacagggcggguccuacaaaaagaucggauauuacgauagcacuaaagacgaccucucuuggucaaagaccgauaaguggauuggcgguaguccgcccgccgaccaaacacuggucauaaaaaccuuuagguuccuuagccagaaguuguuuaucuccgugucuguucugucgagccucgggauugugcuggcaguagucugccuuuccuucaacaucuauaauucacacgugcgcuacauccagaacagucagccuaaucugaacaauuugacugccguuggcuguucucucgcucuggccgcaguguuuccauuaggacuggauggcuaucacauugggcggaaccaauuccccuucgucugccaggcgagacuauggcuccugggacuugguuuuagcuugggcuacggguccauguucacgaaaauauggugggugcauacaguauuuaccaagaaagaggaaaagaaggaguggaggaaaacucuggagccuuggaagcucuaugcuaccgugggacuguuaguuggcauggacguccugacacuugccaucuggcagauuguggauccauugcaccgcaccaucgaaacuuucgcaaaagaggaacccaaggaggacauugaugugucaauccucccgcagcuggaacauuguagcucucgaaaaaugaauacauggcuagguauauuuuacggguacaagggccugcuccugcuuuugggaaucuuccuggccuaugagacgaaguccgucaguaccgagaaaauuaacgaccaccgggcuguuggcauggccaucuacaauguggcaguguuaugccucauuacugcuccuguaacaaugauccugagcucucaacaggaugccgcguuugccuucgcuucccuugcaauagucuuuucaaguuauauuacccuggugguuuuguucgugccaaagaugcguagacucaucacacgcggggaauggcagagcgaggcccaggacacuaugaaaaccggaucguccacgaacaauaacgaagaggaaaagucuaggcugcuagagaaagagaaccgggaacuggagaagauuaucgcugaaaaagaggaaagagucagcgagcucaggcaucaacugcagucacgacagcaacuucgcagucggagacaucccccuacacccccagagccuuccggcgguuugcccagggggccaccggaaccucccgaucgucugucuugugacggaagccgcgugcacuuacucuacaaguga

SEQ ID NO: 56504 - RNA, 2826 nt, Artificial Sequence
  derived and/or modified sequence opt3 from GABBR2__Homo_sapiens__NP_005449
auggccagccccagauccucuggccagccugggccaccgcccccuccacccccuccacccgcuaggcugcuccuucuguuguuacugccucuacuccugccacuugcaccgggagccugggguugggcgcggggcgcuccccgcccuccacccucaaguccuccacugagcaucaugggguugaugccccucaccaaggagguggccaaaggauccauuggccgagguguccugccggcaguugaacuggccauagagcaaauccguaacgaaucucucuuaagaccuuacuuccuggaccuuagguuguaugauacagagugcgacaaugcuaaggggcugaaagcauuuuacgaugccauuaaguauggacccaaccaccuaaugguguucggcggcguauguccaucggugacuucaaucauugcugaaagccuccagggguggaaucugguccagcuuaguuuugccgcgacgaccccugugcuggcagacaaaaagaaguaccccuauuucuuucggacaguuccauccgauaacgccgugaaucccgcuaucuugaaacuccugaagcauuaccaguggaaacgcgucggaacuuuaacccaagacgugcagagauucucugagguaaggaacgaucugacagguguucucuauggcgaggacauagaaaucagcgauaccgaguccuuuucaaaugacccuugcacaagugugaagaaacuuaaggggaacgauguccggauuauccugggacaguucgaccagaauauggccgcaaagguguuuuguugcgcuuacgaagagaacauguacggcagcaaauaucaauggauuaucccagguugguacgagccgucuuggugggaacaggugcacacugaggccaauuccucacgcuguuugcgaaagaaccuacuggcggccauggaaggguauauaggagucgauuucgagccccucagcaguaaacagauuaagaccaucucuggcaaaacgccucagcaauacgaaagagaguauaauaacaagagguccggcguugggccaagcaaauuucauggauacgcauaugacgguauuugggugaucgcuaagacucugcagcgggccauggagacccuucacgcuucgucucgucaucagcgcauccaagacuucaauuacacagaucacacucugggcagaauuauauugaacgccaugaacgaaaccaacuuuuucgggguaacaggacagguggucuucaggaauggcgagcggauggguaccaucaaguuuacgcaguuccaggacucccgagaagugaaaguuggggaguacaaugcaguggccgauacucucgaaauuaucaacgacacaauacgcuuucaaggcucagagcccccuaaggauaaaaccauuauccuggagcaguuaagaaagaucagucugccacuauauagcauucucuccgcucugacuauccuuggaaugauuauggcgucugcauucuuguuuuucaauaucaaaaacaggaaucagaagcugauaaagaugagcucacccuacaugaacaaucucauuauccugggcgggaugcuuaguuaugccuccaucuuucuguucggauuggacgguagcuuugucucugagaaaacauucgaaacccucugcacggugcggaccuggauucugacaguaggcuacacuaccgcuuuuggggccauguucgcaaagacauggcgcguucacgccauauuuaaaaacgugaagaugaaaaagaagaucauuaaagaucagaaguuacuggucaucgugggaggcaugcuacucauugaccuguguauccuuauaugcuggcaagcugucgauccguugagaaggacuguggaaaaauauucaauggagccugacccagccggucgugauaucaguauucggccccugcucgaacauugugagaauacccacaugacaaucuggcuggggauuguuuacgcauauaagggcuuacugaugcuuuucggaugcuucuuggcgugggagacccgaaacgugagcaucccugcucucaaugacuccaaauacauaggcaugucuguauacaacgucgggauuauguguaucauuggagccgcagugucguuucugacuagagaccagcccaauguucaguucugcaucguggcccuagucauaaucuuuugcagcacgauuacacugugucucguguucguaccaaagcugaucacccuuaggacuaacccugaugcugccacccagaaccgccgguuucaauucacacagaaucagaagaaagaagacuccaagaccucaacaagugugacuucuguuaaccaggcaagcacguccagauuggagggucugcaaucagaaaaucauagguuacgcaugaaaauuaccgagcucgauaaggaccuggaggaagucacuaugcagcuucaggauacacccgagaaaaccacauauaucaagcaaaaccacuaccaggaacugaaugacauauugaaccucggcaauuuuacugagagcaccgaugggggaaaagcuauucugaagaaccaccuagaccagaauccacagcugcaauggaacacgaccgaaccgucucgaacaugcaaggauccuaucgaggacaucaauucccccgagcauauucagcggcgucucagucugcagcuuccaaucuugcaccaugccuaucugcccagcauuggcgguguggaugcgucuuguguguccccuugcgucucaccaacugccagucccagacacaggcauguuccuccgagcuuccgcgugauggugucgggguuauga

SEQ ID NO: 56505 - RNA, 1365 nt, Artificial Sequence
  derived and/or modified sequence opt3 from GABPA__Homo_sapiens__NP_002031
augaccaagagagaggccgaggaacugaucgaaauugagauagacggcacagaaaaagcugagugcacugaggaaagcaucguggagcagacguacgcacccgccgaaugugucucccaagcgauugauaucaacgagccuauugggaaucucaagaaacuucuggagccaagguugcagugcucuuuagacgcucacgaaaucugucugcaggauauacagcuagacccggagcggucacucuucgaucaaggaguuaagaccgacgguacagugcagcugaguguacaggugaucagcuaucagggcauugaacccaaacuuaacauccuggagauugucaagccugccgauacuguggaaguugugaucgacccagaugcacaucacgccgaguccgaggcucauuuggucgaagaggcacaagugauaacccucgacgggacaaagcacauuaccacuaucucugaugaaacaucggagcagguaacccgcugggccgcugcccuggaaggauaccgaaaagagcaggagcgucugggcauucccuaugacccuauccaguggucaacggaucaaguucuccauuggguggucugggugaugaaggaauuuagcaugacugacaucgacuuaaccacacugaauauuagugguagagagcuuugcuccuugaaccaggaagauuucuuucagagggugccaagaggggagauacuguggucucaccuagaacuccugcgcaaauacguccuugcgagccaagagcagcagaugaaugagaucguuacuauugaccagcccgugcaaaucauaccugcauccguacagucagccaccccaacaaccauuaaggugaucaacaguagcgcuaaagccgcaaagguccagagagcuccgaggaucucuggagaagaucgguccucacccggcaaucgcacgggcaacaaugggcagauucaacuguggcaguucuugcucgagcuguuaacugacaaggaugcccgagacuguaucagcugggugggagaugaaggugaguuuaaacugaaccagccugagcucguugcgcagaaguggggccaacggaaaaauaagccaacaaugaacuaugaaaaacuuaguagggcccugcgguacuauuacgacggggauaugauuugcaaggugcagggaaaacguuucgucuacaaguuugugugugacuugaagacccuaauaggcuauucugcagcugagcugaaucgccucguaacugaaugcgagcagaaaaagcuggccaaaaugcagcuucacgguaucgcucaacccguuacagccguggcacuggccaccgcuuccuugcagacggaaaaggauaacuga

SEQ ID NO: 56506 - RNA, 1083 nt, Artificial Sequence
  derived and/or modified sequence opt3 from GABPB1__Homo_sapiens__NP_002032
augagccugguggaccucggcaagaaacuucuggaggccgcuagagcagggcaggaugacgaagucaggaucuugauggccaacggagcgcccuucaccacagauugguuagguacuuccccucugcaccuagcugcccaauacggccauuauucuacgaccgagguucuccugcgggcaggggugucacgcgacgcccgaacaaagguagaucguacuccacuucacauggcugcaagugaaggacaugccagcauuguggagguccuguugaaacacggcgcugacgugaaugccaaggauaugcucaaaaugaccgcgcugcauugggcaacagaacacaaccaccaggagguuguggagcugcucauaaaguacggugccgacguccauacccaguccaaguuuugcaaaacugcuuucgauaucucuauugacaaugggaacgaagauuuagccgagauccugcagauugcaaugcaaaaucagaucaacacaaauccggaaucgcccgacaccgugacgauacacgcugccacuccucaguuuaucauuggaccaggcggcguaguuaaccuuaccggguuggugucaagcgagaauaguuccaaggcgacagaugagacuggagucucugccgugcaguucgguaacagcuccaccucagugcuggcaacacuagcugcccucgcugaagccagugcaccccugagcaauucuuccgagaccccugucguugccacggaagaggugguaacugcugaaucaguggacggcgcgauccaacaggucgugagcagugggggacagcagguuauuacaaucgugaccgacggcauacaacuugguaaccugcauucuauuccaacuuccgggaucggacagcccauuaucgucacaaugccugauggccagcaaguguugaccguaccagcaacggacaucgccgaggagaccguuauuagcgaggaaccgcccgcuaaaagacaguguauagaaaucauugagaauaggguggaaucggccgagaucgagguccggucucuccugccuggcguguuaugccgcucccacccaaaguga

SEQ ID NO: 56507 - RNA, 1371 nt, Artificial Sequence
  derived and/or modified sequence opt3 from GABRA1__Homo_sapiens__NP_001121120
augagaaagagccccggccuguccgacugccucugggccuggauccuucuguugucuaccuuaacagggaggucauacggacagccuagucugcaagaugagcuaaaagacaacacuacgguguucacccggauucucgaucgccugcuugacgguuaugauaaucgacugcguccaggcuugggggaaagagucacagagguuaagacugacauauuugugaccagcuucggaccgguauccgaucacgacauggaauacacaaucgauguguuuuucaggcagucuuggaaagacgagcggcucaaguuuaaaggccccaugaccguccugcgccugaacaaucucauggcuucgaagauuuggacuccugauacauucuuucauaacgguaagaaaucaguggcacacaauaugaccaugccaaacaaguuacugagaaucacggaagacgggacucuuuuguauaccaugaggcugacaguucgggccgagugucccaugcaucuagaggauuucccuauggacgcgcacgcuugcccacucaaauuuggaagcuacgccuauacucgcgcagaaguggucuacgaguggacccgagaacccgccagaagugugguaguugcugaggacggcuccaggcugaaucaguaugaucuucugggccagacaguggacucugggauuguccaaagcuccaccggagaguacguggugaugacgacucauuuccacuugaagcggaaaaucgguuacuuugucauacagacauaucucccuuguaucaugaccguuauucugucacaggugaguuucugguuaaaccgugaaagcguaccagcacgcacuguguuuggcgucacaaccgugcugacgaugaccacacucucuaucuccgccagaaauucacuuccgaagguugcuuacgccacugcgauggauugguucauugcagugugcuaugccuucgucuuuagcgcucugaucgaguucgccaccgugaacuacuuuacaaagaggggguaugcaugggacggaaaaaguguaguucccgaaaagccuaaaaaggugaaagauccauugauaaagaaaaauaacacuuacgcucccaccgccacaucuuauaccccuaaucuagcgcggggcgacccaggucuggccacuauugcaaaguccgcuacgaucgagcccaaggaagucaaaccggagacaaagccucccgagcccaaaaagaccuucaacagcgugucgaaaauugaucgacucucucgcaucgccuuuccucugcuuuucgggaucuuuaaucuggucuacugggcuacuuacuugaacagagaaccccagcucaaggccccaaccccacaccaauga

SEQ ID NO: 56508 - RNA, 1356 nt, Artificial Sequence
  derived and/or modified sequence opt3 from GABRA2__Homo_sapiens__NP_000798
augaagaccaaacugaacaucuacaauaugcaguuccuccuuuuuguguuccuggucugggaccccgccagauugguuuuagcuaacauucaagaggaugaagcaaagaauaacauaacaaucuuuacuaggauucuggaccggcuacucgauggcuaugacaaucgccugcgaccugggcuuggagauagcaucacggagguguucaccaacauuuacguaacauccuuugguccagugucugacacugauauggaauauaccaucgacgucuucuuucgucagaaauggaaggaugagagacugaaauucaagggcccgaugaauauauugaggcucaacaaucugauggccucaaagaucuggacacccgacaccuuuuuccacaacgggaaaaagaguguggcgcauaauaugacuaugccuaacaaacugcuccggauucaggaugacggaacauuacuguacaccaugcgccuuacgguucaggcugaaugcccaaugcacuuggaggauuuucccauggacgcccauagcuguccucugaaguucggcuccuaugcauacacuaccucugaggugacauauaucuggacuuacaaugccucggacucaguccaaguggcuccagaugguagcagacuaaaccaguacgaccuccuggggcagaguauuggaaaagaaaccaucaaguccucuacaggcgaguauaccguaaugacggcacacuuucaucuuaagaggaaaauaggcuacuucguuauucagacuuaucugcccugcaucaugacagugauuuugagccaagucuccuucuggcucaaucgggaaucagugccugcccgcaccguguuuggggucacuacaguucugaccaugacgaccuuaaguaucagcgcucgaaacucucugccaaagguggccuacgcgacagcaauggauugguucaucgccguauguuaugcuuuuguguucuccgcccucauugaguuugcaacugucaacuacuucaccaaaagaggaugggcuugggacgguaagucagugguuaaugauaaaaagaaagagaaggccagcgugaugauacagaacaaugcguaugccgucgcaguggcuaacuacgccccgaaucuuaguaaggaccccguacugucuacaaucuccaaaagcgcuacuaccccugaaccaaacaagaaacccgagaauaagccugccgaagccaaaaagacauuuaacucgguuucuaagauugauaggaugucccggaucguguucccagucuuguuuggcaccuucaaucuaguguacugggcaacuuaucugaaccgugagcccguccucggggugucaccguga

SEQ ID NO: 56509 - RNA, 1479 nt, Artificial Sequence
  derived and/or modified sequence opt3 from GABRA3__Homo_sapiens__NP_000799
augaucauuacccagacaagccacugcuacaugacuucccugggcauacucuuccuuaucaacauucugcccgggacgaccggacaaggugagucuagaaggcaggaaccuggcgacuuugugaagcaggauaucgggggauugucaccaaaacaugccccggacauucccgaugacaguacagauaauaucacuauauucacccggaucuuagaccgccugcuagauggcuaugacaaccgacuccguccuggucugggggaugcugucacagagguuaagaccgacauuuacgugacuagcuuuggaccaguauccgauacagacauggaauauaccaucgauguguucuuuagacagacguggcacgacgagaggcuuaaauucgacggccccaugaagauucugccuuugaauaaccuccuggcaucuaaaaucuggacuccagauaccuuuuuccauaauggcaagaagucggucgcccacaacaugacaacucccaauaaacugcuccgguuaguggacaacgggacccugcuuuacacaaugcgcuugaccauacaugcggaauguccuaugcaccuggaggauuuuccaauggacguucacgcuugcccgcuaaaguucggaucauaugccuacacgacugcagagguggucuauagcuggacacucgguaaaaauaagaguguggaaguagcccaagauggcuccagacugaaccaguacgaccuucuggggcauguugugggaaccgagauuaucaggucuagcacuggcgaauacgucgugaugacaacccacuuucauuugaaacggaagauugguuauuucgugauccagacguaccuccccuguaucaugaccgucauucugucccagguuucauuuugguuaaaucgcgagagugugccugcucgaacaguauucggggugacuaccguccugacaaugacuacccucagcauaucugcaagaaacucccuuccaaagguggccuaugcuacagccauggauugguucaucgcgguuugcuacgcauuuguguucucagcccugauugaguuugcuaccgucaauuauuucacuaaaaggagcugggccugggaaggaaagaaagugcccgaggcauuggaaaugaagaaaaagacgccugcugccccagcgaaaaagacaaguaccacuuuuaacaucguaggcaccacauaccccauaaaucuagccaaggacaccgaguucucuacuauuuccaaaggcgcagcuccgagcgccucgucuacaccuacgaucaucgcuucccccaaggccaccuauguucaagauucaccaacugaaacaaaaaccuacaacagugugagcaaggucgacaaaauuucccggaucauuuuuccugugcuguucgcaauauuuaaccucgucuacugggccacauaugugaaucgugagucugcuaucaaggggaugauucgcaagcaguga

SEQ ID NO: 56510 - RNA, 1665 nt, Artificial Sequence
  derived and/or modified sequence opt3 from GABRA4__Homo_sapiens__NP_000800
auggugagcgccaagaaaguccccgcuauugcacuguccgccggcguuucuuucgcgcuccuuagauuucugugcuuggcuguguguuuaaacgagucaccugggcagaaucaaaaggaagagaaacugugcaccgaaaacuucacaaggauucuagacagucuccuggauggauacgacaaucggcuucgcccagguuuuggcgggccgguaacugaggugaagacggauauauaugucaccagcuucggacccguguccgacguugaaauggaguacacaauggauguguuuuuccgacagacuuggaucgacaaacgucugaaguaugauggcccuauugagaucuugagacucaacaauaugauggucaccaagguguggacaccagacaccuuuuucaggaacgguaaaaagucuguaucgcacaauaugacugcccccaacaaacuguuucggauuaugcgcaaugggacaauccuguacaccaugagacucacgauaucagcagaauguccuaugagguuaguugauuucccaauggacggacaugccugcccccugaaguuuggcagcuaugcuuacccuaaaagugagaugaucuauacuuggaccaagggcccagaaaaguccguggaggucccgaaagagucuagcucccuugugcaguacgauuugauugggcagacagugucaagugaaacuaucaagagcauuaccggagaguacaucgucaugacaguuuauuuccaccuucggcgcaaaauggguuacuuuaugauacaaaccuauauucccuguaucaugacggugauucuaucucagguauccuucuggaucaacaaggaaucagugccugcacgaacugucuucggcaucacaaccgugcucacuaugacaacccugagcauuagugccagacauucucuuccaaaaguuuccuacgcuacggccauggacugguuuauagcggugugcuucgcauuugucuucagcgcccugaucgaguuugcugccgugaauuauuucaccaacauucagauggaaaaggcaaaaaggaagacaucgaagcccccucaggagguaccagcugcccccguucaacgggagaaacacccggaagcgccuuugcagaauacuaacgccaaucucaacaugcguaagcgcaccaacgcacuggugcauucugaguccgaugucgggaauagaacagaagugggaaaccacucaaguaaaagcuccacugucgugcaggagucuagcaagggcacccccaggucauacuuagcuaguuccccaaauccuuuuagccgggccaacgcugccgaaacaaucucugcagcccgagcucugcccucagcgaguccaaccagcauacgcacugguuauaugcccagaaaagcauccguugggucugccucgacgaggcacguguucggaagccggcuccagcgcauuaagacaaccguaaauacuaucggcgcuaccggcaagcuguccgccacaccuccaccgucagcacccccuccaagugggucuggaaccagcaaaaucgacaaguacgccagaauccuguuucccgucacuuucggugcuuuuaacaugguguacuggguuguguauuuguccaaagacacaauggagaagucagagagccuaauguga

SEQ ID NO: 56511 - RNA, 1389 nt, Artificial Sequence
  derived and/or modified sequence opt3 from GABRA5__Homo_sapiens__XP_005268315
auggacaacggcauguucagcggguuuaucaugauuaagaaucugcuccuuuucugcauauccaugaaccugucuucacacuuuggauucagucagaugcccaccagcuccgugaaagaugagacaaaugacaacaucacuauuuuuacgagaaucuuggaugguuuacuggacggcuacgauaauaggcuacggccugggcucggagaacgcauuacccaaguccgaacagacaucuauguuacuucuuucggcccagugucggauaccgagauggaauacacaauagacguauuuuuccgucagucauggaaggaugagagacugagguuuaaagguccgaugcagcggcuuccccugaacaauuugcucgccagcaagaucuggaccccugacacuuucuuucacaacgggaaaaagaguauugcucacaauaugacaaccccaaacaagcugcugcgccucgaagaugacggaacguuacuguauacuaugagacuuaccaucuccgcagagugucccaugcaguuggaggauuucccuauggacgcccaugcgugcccacugaaauuuggcucuuacgcuuaucccaauagcgaaguggucuacguguggacaaacggcuccacuaagucaguuguggucgccgaggacgggaguaggcuaaaucaauaucaccucaugggacagaccguggguacagaaaacauuagcaccucuacgggcgaguacacuaucaugacagcacauuuccaccugaaacggaagauaggguacuucguaauucagaccuaucuuccuuguaucaugacuguuauucugucccaggugucauuuugguugaaucgcgagagcgucccagcccgaacaguguucggagugaccacgguccucaccaugacaacucugaguaucucugcuagaaacuccuuaccgaaaguugcauacgccaccgcuauggauugguuuaucgccgugugcuaugcguucguauuuagcgcacugauugaguucgccacagugaacuacuuuacuaagaggggcugggcuugggacgguaagaaagcccucgaagcagcuaagaucaaaaagaaacgggaagucauacuuaauaagucgaccaacgccuucacaaccgggaaaaugucucaucccccuaauauuccaaaggagcaaacucccgcgggaacguccaacacaaccucagugaguguuaagccuagcgaagagaaaacuuccgagucuaagaaaaccuauaauagcaucucaaagauagauaaaaugagucguauuguguuuccaguccuguucggcacauuuaacuugguguacugggccaccuaucuaaaucgcgaacccguaaucaagggcgcagcuuccccgaaguga

SEQ ID NO: 56512 - RNA, 1362 nt, Artificial Sequence
  derived and/or modified sequence opt3 from GABRA6__Homo_sapiens__NP_000802
auggccagcucccugcccuggcucugcaucauucuuuggcuggagaacgcuuugggcaaguuagaaguggaggggaauuucuacucugaaaacgucucaagaauacuggacaaucuacucgagggauaugauaacaggcugcggccugguuuuggcggggcaguuaccgaagugaaaacagacaucuacguaacgaguuucggaccagugagcgaugucgagauggaguauacuauggacguguuuuuccgccagaccuggacagaugaacgacuuaaguuuggcgguccgacugagauucuguccuugaauaaccucaugguuucuaaaaucuggacccccgacacauucuuucguaaugggaagaaaucgauugcccacaacaugaccacuccuaauaagcuguucagaaucaugcaaaacggaacaauacuguacaccaugaggcucacgaucaaugcggauuguccaaugcgguuagugaacuuucccauggacggccaugcuugcccucugaaguucggcucauaugccuacccaaaaagcgaaauuaucuauacuuggaagaaagggccccuuuacagugucgaggugccugaggaauccucuagcuugcugcaguacgaucuaauuggacagaccguauccucagagacaaucaagaguaauacuggugaauauguuauaaugaccguguacuuucaccuccagcgcaaaaugggcuauuucaugauucaaaucuacacaccauguauuaugaccgucauccugagccaggugucuuuuuggaucaacaaggaguccgugccggcaagaacggucuucgggauuacuacaguucuuaccaugacuacacugucaauaagcgccaggcauaguuugcccaaggugucuuaugcuaccgcaauggacugguucaucgccguaugcuuugcuuucguguuuuccgcccucauugaguucgcggcagucaauuacuuuacgaaccugcagacccagaaagccaagcggaaagcucaauucgccgcaccuccaacagugacuaucagcaaggcuaccgaacccuuagaggccgaaauaguucugcacccugauucgaaauaucaucucaagaaacgcauuacaucucuuucccugccaaucgugucaaguagcgaggcgaacaaggucuugacucgagcccccauccuacaguccaccccggugacaccucccccacugucuccugcauuuggaggcaccagcaagauugaccaguacucaagaauccucuuccccguagcuuuugccgguuucaaucugguuuacuggguggucuaucuuaguaaagauacuauggaaguguccagcucugucgaguga

SEQ ID NO: 56513 - RNA, 1425 nt, Artificial Sequence
  derived and/or modified sequence opt3 from GABRB1__Homo_sapiens__NP_000803
auguggaccgugcagaacagagagagccugggccuccuuuccuuccccgucaugaucacaaugguuugcugugcccacucuacuaaugaaccuucaaacaugaguuacgugaaggagacgguagacaggcuguugaaaggguaugauauucgguuacgcccagacuuuggagguccgcccguggaugucggcaugcgaauagacguggcuagcaucgauaugguuuccgaagugaauauggacuacacccugacaauguauuuccaacagucuuggaaggauaaacgucuaucguacucagggauuccucucaaccugacucuugacaauagagucgcagaucagcugugggugccagacaccuacuuuuugaacgauaagaaaaguuucguacauggaguuacagugaagaauaggaugauccggcuccaccccgacggcaccguccuguauggucugcgcauuacuacaaccgccgcgugcaugauggaucucagaagguauccuuuagacgagcagaacuguacgcuggaaaucgagagcuacggguacacuaccgacgauauagaguuuuauuggaauggaggcgaaggcgcugugacaggggugaacaagaucgagcuuccacaauucuccauugucgacuacaaaaugguuucuaagaaaguggaauuuacuaccggagccuauccccgguugagccuguccuuccgccuaaagcgaaauaucgguuacuuuauucuccagacauauaugccuucaacccugaucacgauacuuaguugggugagcuucuggauuaacuacgaugcaucugccgcuagaguagcacugggcaucacuacagucuugaccaugacuacaauuuccacccaucucagggagacgcugccaaaaaucccguaugugaaggccaucgacauuuacuuaauggggugcuuuguuuucguguuucuggcucuccuugaguacgccuucgucaauuauauauucuuuggaaagggcccccagaaaaagggugcgucaaaacaggaucaaagcgcaaacgaaaagaauaaacuggagaugaacaaggugcagguagacgcccacgggaacaucuugcuaaguacccuggaaauucggaaugagacaucuggauccgaaguucucacuagcgugucggauccuaaagcuaccauguacucuuaugacuccgccucaauccaguaccguaagccacugaguagccgcgaggcauauggcagagcucuugauaggcauggcguccccuccaaggggcggauacgacgcagagccucucagcugaaagugaagauuccugacuugacagaugucaacagcaucgacaaauggucaaggauguucuuuccaaucacuuucagucucuuuaaugugguuuacuggcuguauuacgugcacuga

SEQ ID NO: 56514 - RNA, 1425 nt, Artificial Sequence
  derived and/or modified sequence opt3 from GABRB2__Homo_sapiens__NP_000804
auguggagagugaggaagcggggcuacuucgggaucuggagcuuuccccugauuauagccgcugucugcgcacaguccguuaacgacccuucuaauaugucacucgugaaagagaccguagaucgccuucugaagggauaugacauccgauugcguccagauuucgguggcccgcccguggccgucgggaugaacauugacaucgcgaguauugauauggugagcgaaguuaauauggacuacacauuaacuauguauuuucaacaggcuuggagagauaaaaggcuguccuacaacgugaucccucuaaaucucacgcuggacaaccgggucgccgaucagcuuugggugccagacaccuauuuccugaaugauaagaaaucuuuuguacacggaguuacagugaagaaccgcaugauaagauugcaucccgacggcacuguccucuacggucugaggaucaccacaaccgcagccuguaugauggaucugcggcgcuauccucucgacgagcagaauugcacuuuagaaauugagucguacggguacacaaccgacgauaucgaguucuauuggcgaggagacgauaacgcugugacgggcgugacuaagauugaacugccacaauuuucaaucgucgacuacaaacuuauaaccaagaaaguuguguucagcacaggcaguuaucccagauugucccugucuuuuaagcuaaaaaggaauauuggguacuucauccuccagacuuauaugccuagcauucugaucaccauccuuuccuggguaucauuuuggauuaacuacgaugcaagugccgcucggguggcccugggaauaacaaccgucuugacgaugacuacaaucaauacccaccuccgugagacucugccaaagauuccguaugugaaggcgaucgacauguacuuaauggguuguuucguuuuuguguucauggcacugcucgaauacgcccuugucaacuauauauucuuuggccgcgggccccagagacagaaaaaggcugccgagaaagcagcuagcgccaauaacgaaaagaugaggcuggaugugaacaaaauggacccucaugagaauauuuugcuaucuacacuggagaucaagaacgaaauggcgaccuccgaggccguaaugggacucggcgauccacggucaacgaugcuggcauacgacgcuagcaguauccaauaucgaaaagccggucuuccccgccacucuuucgggagaaaugcucuggaaaggcauguugcccagaagaagucccgguugcgcagaagggcaagccagcucaaaauuaccaucccugaucugacagacgugaacgccauugaccguuggucgcggauauuuuucccagucguguuuucuuucuuuaauaucgucuacugguuauauuacgugaacuga

SEQ ID NO: 56515 - RNA, 1422 nt, Artificial Sequence
  derived and/or modified sequence opt3 from GABRB3__Homo_sapiens__NP_000805
auguggggccuggccgggggaagacucuucgguaucuuuagcgcucccgugcuugucgcaguugugugcugugcccaguccguaaacgacccuggcaauaugucuuucgugaaggagaccgucgauaaacuguugaagggguacgacauuagguuacggccagauuuuggaggcccgcccgugugcguugguaugaacauagacaucgcgucaauugauauggugagugaagucaauauggacuauacacugacuauguacuuccaacaguauuggcgcgauaaacgacuagcuuacagcgggaucccucucaaccugacgcuugacaaucguguggccgaucagcuguggguaccagacaccuauuuucuuaacgauaagaaauccuucguucacggagugacagucaagaauagaaugauuaggcuccaucccgacggcacugugcuguacggccugcggaucaccacaaccgcagccuguaugauggaucuccgcagauauccuuuagacgagcagaacugcacucuggaaauagagucuuacggguacacaaccgacgauaucgaauuuuauuggaggggaggugacaaggcugugacgggcgucgagcggauugagcuuccacaauucucgaucguugaacaccgcuuggugucacgaaauguaguguuugcaacuggggccuaccccagacugagccuaaguuucaggcucaaacggaacauuggauauuuuauccugcagaccuacaugccuuccauacuuauuacaauccugucuugggucagcuucuggauuaauuaugaugcuuccgccgcgcguguggcauugggcaucacuaccguucucacaaugaccacgaucaacacucaucugcgcgagacauuaccaaagauuccguacgugaaagccauagacauguaucugauggguuguuuugucuucguguuccucgcuuugcuggaauacgccuuuguaaauuacaucuucuuugggagaggaccccagaggcagaagaaauuggcagagaagaccgcuaaggccaaaaacgaucggucaaagagugagagcaaucgaguugacgcgcacggcaacauucuacugacuucucucgaagugcauaacgagaugaaugaagucuccggcgggaucggagauacacgcaacucagccauuagcuucgacaauagugguauacaauauagaaaacagucuaugccuagggagggccacgggcgguuucugggagaucgcucccuuccacacaagaaaacccaucugagaaggcguagcucgcaguugaagaucaaaauccccgaccucacggaugugaacgcaauugaccgguggucucgaaucgucuucccuuuuaccuucucccuguuuaauuuaguguacuggcuguauuacguuaacuga

SEQ ID NO: 56516 - RNA, 1521 nt, Artificial Sequence
  derived and/or modified sequence opt3 from GABRE__Homo_sapiens__NP_004952
augcugagcaaggugcuccccguccuucugggcaucuuguuaauucugcaguccagaguugaggggccucaaaccgaaucuaaaaacgaggccucaaguagggacgugguauacggaccacagccgcagccccuagaaaaucagcuccugagcgaggaaacaaaguccacugagacggagaccgguucucgggugggcaaacuuccugaagcuagccgcauacugaacacaaucuugucaaauuaugaucacaagcuccgaccagggauuggagagaaacccacugucgugaccguugaaaucagcgugaacagucugggcccucuguccauucucgacauggaguacacaaucgauauaaucuucucucaaaccugguaugacgagcguuuaugcuacaaugauacuuuugaaagccugguccuuaacgguaaugugguaucccaguuguggauuccagacacauucuuuagaaacucaaagaggacccaugagcacgaaaucacgaugcccaaucagaugguucggauuuauaaggaugggaaagugcuguacacuauccgcaugaccauagacgcaggauguagucuacauaugcucagauucccuauggauagccacucuugcccacuguccuuuucaucguucaguuauccggagaacgaaaugauuuacaagugggagaauuuuaaacuugagaucaacgaaaagaacucuuggaaacuguuccaguuugacuucacaggcgucuccaauaagacugagauuaucaccacacccgugggcgauuuuauggugaugaccaucuucuuuaaugucagcaggcgguucggguacguugccuuccaaaacuaugugccuucgucuguaacgacuauguuguccugggugucauuuuggauuaagacagaaagugcgccagcucgcaccagccucggaauaacuuccguccugacaaugaccacguuagguaccuucucucgaaagaacuuucccagagugagcuacaucacagcccuggacuucuauauugcaaucuguuuuguuuucugcuuuugugcccuccuugaguucgcugugcugaacuuuuugauauacaaucagacuaaagcacaugccucaccuaaacuaaggcacccacggauuaauagucgugcucacgcccgcaccagagcgaggucccgggcaugcgcccgacagcaucaggaggcuuucgucugucaaaucgugacaacugaaggcagcgauggggaggaacgccccucuugcucagcccagcagccgccuagucccggaagcccagagggcccuagaucccuguguucuaagcucgcaugcugugaauggugcaaaagguuuaagaaauauuucugcaugguacccgacugugaggguucgaccuggcaacaggggcggcugugcauccacguuuaccgccuugacaacuauagcagaguggucuuuccagugacauucuucuuuuucaauguccuguacugguuggugugucucaaccuguga

SEQ ID NO: 56517 - RNA, 1398 nt, Artificial Sequence
  derived and/or modified sequence opt3 from GABRG1__Homo_sapiens__NP_775807
augggcccccugaaggccuuccucuuuagcccuuuccuucugagaucccagucuaggggagugcgguuggucuuuuuacugcuaacccuccaccuggggaacugcguugacaaagcugaugacgaggaugacgaagaucuuacagugaauaagacuuggguacuggcaccaaaaauccaugagggugacauuacgcaaauauugaacucacuccugcagggcuacgauaauaagcugcgcccggacaucggggugcgacccaccgucauugaaacagauguguauguuaacaguaucggaccuguggacccaauuaauauggaguacacuaucgauauaaucuucgcccagaccugguuugacagccgucucaaauucaacuccacaaugaaggucuuaaugcuuaauucuaacauggugggcaagauuuggauccccgauaccuuuuucagaaauucgaggaaaucagacgcgcacuggauuacuacaccuaaccggcuguugcgcaucuggaaugacgguagaguacuguauacccuaaggcucacgauaaacgcugaauguuaccugcagcuucauaauuuuccaauggaugagcacagcugcccccuggaguucaguuccuauggguacccuaagaacgaaauugaguauaaauggaagaaaccaucuguugaaguggccgacccgaaguacuggcgguuguaccaauuugcauucgucggacuccgcaauagcacugagaucacccauacaauuuccggcgauuaugugaucaugacuaucuuuuucgaccugucacgaagaaugggcuacuucaccauucagacauauauacccuguaucuuaaccgugguccugaguuggguuagcuuuuggauuaacaaggaugccgugccugcuaggacgucucucgggaucacuacaguacuuaccaugacuacacuguccaccauagcacggaaaucauugccaaaggugagcuacgucacggccauggaccuauucgugaguguuugcuuuauuuucguguuugcugcccugauggaguauggaacccuccacuacuucacaucuaaccagaaagguaagacugcgaccaaagaucguaagcugaaaaauaaggcauccaugacacccggccuucacccugggagcacucugaucccaaugaacaauaucucggucccccaggaagacgauuauggauaccaauguuuggagggcaaggacugcgccuccuuuuucuguugcuuugaagauugucgcaccgguucuuggagagaggggaggauucauauccggauugcuaaaauagacucauacagucgaaucuucuuuccgacagccuucgcacucuuuaaccugguguauuggguaggauacuuauaucuguga

SEQ ID NO: 56518 - RNA, 1404 nt, Artificial Sequence
  derived and/or modified sequence opt3 from GABRG2__Homo_sapiens__NP_000807
augagcucccccaacauuuggucuaccggcucaaguguguacagcacaccugucuucucccagaagaugacuguuuggauucugcuccuucugucuuuguauccaggguuuacgucgcaaaaaucagacgaugacuacgaggauuaugccagcaauaagaccuggguguuaacaccgaaaguacccgaaggagacgugacugucauacugaacaaucuacucgaggguuacgauaacaagcugagaccugacaucggcgugaaaccaacccuuauucacacagauauguauguuaauaguaucgggcccgugaacgcuauuaauauggaauacaccaucgacauauucuuugcacagacuugguaugauaggcggcugaaguucaacuccacaaucaaggucuugcgccucaauucuaacauggugggaaaaauuuggaucccugacaccuuuuuccgaaauagcaagaaagccgaugcgcauuggauuacgacuccaaaccguaugcugagaaucuggaaugacggcaggguacuguacacccuccgguuaacaauagaugcugagugccagcugcagcuucacaacuuucccauggacgaacauuccuguccuuuggaguucucaaguuacgguuauccacgcgaggaaauuguuuaccaauggaagagaagcucuguggaggucggggacacuagguccuggcggcuguaucaguuuucauucgugggacuacgcaauaccacagaaguggucaaaaccacgagcggcgauuacguugugaugaguguauauuuugaccucucucgaagaaugggcuacuucacuauccagacauauauuccgugcacccugaucgugguccuuuccugggugagcuuuuggaucaacaaggaugccguucccgcaaggacuucgcuggggauuacaaccguguugacgaugaccacacucucuacuauagcccggaagucccugccuaaagucucauacgugaccgcuauggacuuauucguaaguguuuguuucaucuuuguguucagcgcacuggucgaguacggaacacuccacuauuuuguguccaaccguaagccaucuaaagauaaggacaaaaagaaaaagaaucccgccccuacuauugauauccgcccaagaagcgcuaccauacagaugaacaaugccacacaucuucaagagagggacgaagaguacgguuaugaaugccuggauggcaaggacugugcgucauucuuuugcuguuucgaggauugccggaccggggcauggcgacacggacgcauucacaucagaaucgccaaaauggacaguuacgcuaggaucuuuuuccccacugccuuuuguuuguucaaccuagucuauuggguguccuaccuguaucucuga

SEQ ID NO: 56519 - RNA, 762 nt, Artificial Sequence
  derived and/or modified sequence opt3 from GABRG3__Homo_sapiens__NP_001257802
auggcccccaagcugcuccuucuguugugcuuauucagcggccugcacgcuagauccaggaaaguggaggaagacgaguacgaagauucuucaaguaaccagaaguggguccuagcaccuaaaagccaagacaccgauguuacacucauccugaauaaacuucugcgggaguaugacaaaaaguugcgcccagauauugggauaaagccgacugugaucgacguagauauuuacgugaacuccaucggacccgucucuucgauuaauauggaauaucagaucgacauauuuuucgcccagacguggaccgauucacgacuccguuuuaacagcacaaugaaaauccugacucugaauaguaacauggugggucucauuuggaucccugacaccauuuucagaaauuccaagacagcggaggcucauuggaucaccacuccaaaccaguuacugaggauauggaaugauggcaaaauucuuuacacauugcggcugaccaucaacgccgagugucaacuacagcuccacaauuuucccauggacgaacauucuugcccucugauuuucagcuccuauggguacccaaaggaggaaaugaucuaucgcuggagaaagaacucaguugaggcagccgaucagaagaguuggaggcuuuaccaguuugacuucaugggacugcggaauacgacugagaucgugaccacaagcgcuggccgcaacuugcucaaggaagcacaacugucuaaagcccgagaggcuuga

SEQ ID NO: 56520 - RNA, 1323 nt, Artificial Sequence
  derived and/or modified sequence opt3 from GABRP__Homo_sapiens__XP_011532807
augaacuacagccugcaccucgccuucgugugccuuucccuguuuaccgagagaauguguauccagggcucucaauucaaugucgaaguugggaggucagacaaguugaguuuacccggauuugagaaccugacagcugguuauaauaaauuccuacggccuaacuuuggcggggaaccagugcagauugcacucacucuggauauagccagcaucuccucuauuucggagucaaauauggacuacacggcgaccaucuaucuucgccagcgauggauggaucagcgucugguauucgaaggaaacaagagcuuuacauuggacgcuagacucguggaguuccugugggucccggauacuuacauuguggagaguaaaaaguccuuucugcaugaaguuaccgugggcaauaggcucauccgguuauucucuaacgguacaguccuguaugcccuucgcauaaccacuacaguggcaugcaauauggacuugagcaaauaccccauggauacccaaacguguaagcugcagcuagaguccuggggguaugacggaaacgauguagaauuuacuuggcucagaggcaaugacucaguuaggggccuggagcaccuucggcuggcccaguacaccaucgagcgcuacuucacauuggugacucgaagucagcaagaaaccgggaacuauacaagacucguccugcaguuugaguuaaggcggaaugugcuguacuucauucucgaaaccuaugugccuagcacguuccuugucguucugucuuggguguccuuuuggaucucauuggauagcguaccagcucguacuugcauuggagugacaaccguccuaaguaugacuacacugaugaucgguucucgcaccucccuccccaacacgaauuguuucauaaaggcaauugacguguaccugggcaucugcuuuagcuucguuuuuggggcccuucuggaguaugcuguggcccauuacucgucuuugcagcagauggcggcaaaagauagaggaaccacaaaggaagucgaggagguguccauuacuaacaucaucaacucaaguauuagcuccuucaaaaggaagauaucuuuugccagcaucgaaauuucaagugacaauguagacuauuccgaucucaccaugaaaacaagcgacaaguucaaguuuguuuuccgggagaaaaugggccgaaucguggauuacuuuacuauacaaaacccuucuaaugucgaccacuacucaaagcuguuauucccacugauuuuuaugcuagcuaacguguucuauugggccuacuauauguacuucuga

SEQ ID NO: 56521 - RNA, 1899 nt, Artificial Sequence
  derived and/or modified sequence opt3 from GABRQ__Homo_sapiens__NP_061028
augggcaucagagggaugcugagggccgcugugauucuccuucugauacggaccugguuggcagagggaaacuaccccagcccuaucccaaaguuccacuuugaguucuccucugccgucccggaaguuguguuaaaucuguuuaacugcaaaaauugugcgaacgaagcuguagugcagaagauucuagaccgcguccucucacgauaugaugugcgucugagacccaauuucgguggcgccccuguuccagugaggaucaguauuuacgucacaagcaucgagcaaauauccgaaaugaacauggacuauacuaucacgauguuuuuccaucagaccuggaaagauucucggcuugcauacuaugagacaacucugaauuugacccucgacuaccgcaugcacgagaagcugugggugcccgauugcuauuuucugaacucgaaagacgccuucguacaugauguuacaguggaaaauagagucuuucagcuccacccugacgggaccgugagguacggcauucgguuaacuacaaccgcugcauguucacuggaucuucauaaguucccaauggacaagcaggccugcaacuugguggucgagagcuacggauauacgguugaagauaucauucuguuuugggacgauaaugguaacgcuauccacaugacugaggagcuacacauaccccaauucaccuuucucgggcgcacaauuacuagcaaagaaguguacuucuauaccggauccuacauccgacugauucuuaaguuccagguacagagagaggugaacucuuaucugguccagguguacuggccuacaguuuugaccacgaucacuagcuggaucuccuuuuggaugaauuaugacucaagugccgcgagggugacaauuggccucaccagcaugcugauauuaacuacaaucgacucucaucugcgggauaaacucccaaauauuuccuguaucaaggcaauagacauuuacauccuugucugccuguucuuuguguucuugucacuacuggaauacguauauaucaacuaccucuuuuauagccguggcccgcgcagacaacccaggcggcaccgacgcccuagaaggguuauugcccgguaccgcuaucaacagguggucguggggaacguccaggauggacugaucaauguggaggacgguguuaguucucuuccaauuacccccgcucaggccccucuggcauccccagaaaguuugggcucgcucacgucuaccuccgagcaggcucagcuggccacaucagagaguuuaagcccccugacuucccuaucugggcaagcgccgcucgccaccggagaaagccugucagaucuuccuaguacauccgagcaggcaagacauagcuacggcgugagguucaacgguuuucaggcugacgauucuauaauccccacugaaauucguaaucggguagaggcccacgggcacggagucacccaugaccacgaagauucaaacgagaguuugagcuccgacgagcgacauggccacggcccaucugggaaaccuaugcugcaucacggagaaaagggugugcaggaggcuggcugggaucucgacgacaauaacgauaagucggacugucuggccaucaaagaacaauucaagugcgauacaaauagcaccugggggcuuaacgacgaugagcugauggcacacggacaggaaaaagacuccucaagugagucugaggauagcugucccccaucccccggcugcucauuuacugaagguuucagcuuugacuuguucaauccugauuauguuccaaagguggacaaauggucuagauuucucuucccgcuggccuucggguuauuuaacaucgucuacuggguguaccauauguauuga

SEQ ID NO: 56522 - RNA, 1389 nt, Artificial Sequence
  derived and/or modified sequence opt3 from GABRR1__Homo_sapiens__NP_001243632
augcuggccgugcccaacaugagauucggcaucuuucuccuuugguggggguggguccuggcuaccgagagcaggaugcacuggccuggacgggaaguucaugagauguccaagaaagguucuccaauuuugcgccgaucaccggacauaacaaagagucccuuaacuaaaagcgaacagcugcuacguaucgaugaccacgauuucuccaugagaccuggcuuugggggaccagcaauucccgugggcguagacgugcaagucgagucucucgauucgaucucagaaguggacauggauuucacgaugacccuguaccuuaggcauuauuggaaggacgagcggcugagcuuuccuaguacaaauaacuuguccaugacuuucgauggucgccucguuaaaaagauuugggugccagacauguuuuucguccacucuaagaggagcuuuauccaugauaccacaaccgacaaugugaugcugagaguacagcccgaugggaaaguucuguacucccuccgggugacugucacagccaugugcaacauggacuucucacgcuuuccuuuagacacccagacguguagucuggagauagaaagcuaugcguacacugaggaugaccuuauguuguauuggaagaaaggaaaugauucucugaagaccgacgaacgaaucucccuaucacaguuccucauucaagaguuucacacaacuaccaaacuggcuuucuacagcaguacaggcugguauaacagacuuuacaucaauuucacccugaggcggcacaucuuuuucuuuuugcuccagacguacuucccagccacucugauggugauguuaucuuggguguccuuuuggauugaucgucgcgcagucccggccagaguuccccugggcauaacaaccgugcucacuaugagcacaauuaucaccgggguaaacgcuucgaugccuagggugucuuauauuaaggcagucgacaucuaccuuuggguguccuucguuuuuguguuccugucagucuuggaguaugccgcugugaauuaccuaacgaccguacaggaacggaaggagcagaaacugcgagaaaagcucccaugcacaaguggacugcccccuccacgcacugccaugcuugaugguaacuauagcgacggcgagguuaaugaucuggacaacuacaugcccgaaaauggggagaaaccggauagaaugauggugcaauugacccucgcguccgagaggucuagcccucagcggaagucacagcgcaguuccuaugucagcaugagaaucgacacacaugcaauugacaaauacucuaggauaaucuuucccgccgcuuacauucuguucaacuuaaucuauuggucaauauuuaguuga

SEQ ID NO: 56523 - RNA, 1398 nt, Artificial Sequence
  derived and/or modified sequence opt3 from GABRR2__Homo_sapiens__NP_002034
augcccuacuucaccagacugauccucuuucuuuucugccugaugguguuggucgagagcaggaagccuaaacggaagcgcuggacaggccagguugaaaugccaaaaccgucccacuuauauaagaaaaaccuggacgugacuaagauucgaaaggggaaaccccaacagcuacuccguguagaugagcaugacuuuucuaugagaccugccuucggagguccagcuauacccgugggcgucgaugugcagguugaaucacuggacaguaucagcgagguggauauggacuuuacgaugacccuuuaccugaggcacuauuggaaggaugaacgguuggcauucuccucugccucgaauaaaucaaugacauuugacgggcgccucgucaagaaaauuugggugccugauguauucuuuguucauagcaagagaaguuucacucacgacaccacaaccgauaacaucaugcugaggguguuuccagacggacauguccuguacuccaugcggauuacugugacagcgauguguaauauggauuucucucacuuuccccucgacagccagaccugcuccuuagagcuggagucauaugcuuacacggacgaagaucuuauguuguauuggaagaacggcgacgagagucugaaaacugaugaaaagaucagccuaucucaauuccucauacagaaauuccacaccacaucccgccuggccuuuuacucaagcacugguugguacaaucgacuuuauaucaacuucacccugagaaggcauaucuuuuucuuuuugcuccagacauacuucccugcaacccugauggugauguuaaguugggucucuuuuuggauugaccggcgugccguuccagcucgcgugucccuggggauuacgacuguacucacaaugaccacuaucauaacaggagugaaugcaagcaugccgagagucucguaugugaaggccguugauauuuaccuuugggugucuuucgucuuuguguuccuguccguauuggaguaugcugccguuaacuaccuaaccacggugcaggagaggaaagaacggaagcugcgagagaaauuucccuguaugugcggcaugcuccacucaaagaccaugaugcuggacggcaguuauagcgaauccgaggcaaauucucuugcgggguacccucgcagccauauccugacagaagaggagagacaagauaagauugucgugcacuugggacucucaggugaagccaacgcugccaggaaaaagggccuguuaaaagggcagacuggauuccggaucuuucagaauacccacgcaaucgacaaguacagucgccugauuuucccagcuuccuauauauucuuuaaccuaaucuacuggagcgucuucucuuga

SEQ ID NO: 56524 - RNA, 1785 nt, Artificial Sequence
  derived and/or modified sequence opt3 from GAD1__Homo_sapiens__NP_000808
auggccagcuccacccccucuucaagugcuacaagcuccaacgcaggcgccgacccuaauacuacgaaccugagaccaaccacauacgauacuuggugcgggguggcgcacggauguaccaggaagcucggucuuaaaaucugcggcuuccugcagcggacaaauucuuuggaggaaaagucgcgcuuagucucagcuuuuaaagagcgacaaagcaguaagaaccugcuauccugugaaaauucugaccgugaugccagauucaggcggaccgagacugacuuuagcaaccucuucgcacgcgaucugcuuccggccaaaaauggggaggaacagacaguucaguuucuguuggaggugguagacauucuccugaacuaugugagaaagaccuucgauagguccacgaagguccuggacuuucaucacccccaucagcucuuagaaggaauggagggcuucaaucuggaacuuucagaucacccugagaguuuggagcaaauacugguggacugccgggauacucuaaaauacgguguucgcaccgggcauccacgauuuuucaaccagcucagcacaggacuggacaucauuggccuugcuggcgaauggcugacuucuaccgcaaauacaaacauguuuaccuaugagaucgcccccguguucgucuugauggaacagauuacgcucaagaaaaugagagagaucguggggugguccucaaaggauggagacgguauauuuagcccuggcggggcuaucaguaauauguacucuauuauggccgcgagguauaaauacuucccagaaguaaagacuaagggaauggcagccguucccaaacugguguuauucacauccgagcagagccacuauucgaucaagaaagcuggcgccgcacuggguuuugggaccgacaacgucauucucaucaaguguaaugagcggggaaaaauaauuccugcugauuucgaagccaagauccuugaggcgaaacaaaagggcuacgugccauuuuacgugaacgccacugcaggcacaaccgucuauggggcuuucgacccgauucaggaaaucgccgauaucugcgagaaguacaaccugugguugcacguugacgcugccuggggagguggccuacugaugucucguaaacaucgccacaagcucaaugggauugaaagagcaaacuccgugacguggaauccccauaaaaugaugggaguacugcuucaguguucagccauacuggugaaggagaaaggcaucuugcaggguugcaaccaaaugugugcuggguaucucuuucagccugauaagcaguacgacgucaguuaugauaccggcgacaaggcgauucaaugcggaaggcacguggauaucuucaaauuuuggcugauguggaaggcaaaaggcacaguuggguucgagaaucagauaaacaaguguuuagaacuggccgaguaccuauaugcuaaaauuaagaaucgggaagaguuugaaaugguguucaacggagagccagagcacacuaaugucugcuuuugguacaucccccagagccuccgaggugugccugacuccccacagcgcagagaaaagcugcauaaaguagcccccaagaucaaagcacuuaugauggagucuggcaccacaaugguuggguaccaaccgcagggagauaaggccaacuucuuuaggauggugauuagcaauccugcugccacucagucagacaucgacuucuugauugaagagauagagcggcugggccaggaucucuga

SEQ ID NO: 56525 - RNA, 1758 nt, Artificial Sequence
  derived and/or modified sequence opt3 from GAD2__Homo_sapiens__NP_001127838
auggccagccccggcuccggguucuggucuuuuggaucagaggacgguaguggcgauagcgaaaacccugggaccgcuagagcauggugccagguggcccaaaaguucacaggaggcaucgguaauaaacugugugcgcuccuuuacggggacgcugagaagccagccgaauccggaggcucucagccgcccagggcagccgcucggaaagcagccugcgcuugugaucagaagccuugcucguguucaaaagucgacguuaacuaugccuuucugcacgcgacugauuuguuaccagcaugcgacggcgagcgccccacgcuggccuuccuacaggaugugaugaauauucuccugcaauacguagugaagaguuuugaccgaaguaccaaggucauagauuuccauuauccuaacgaacuucugcaggaguacaauugggaguuggcugaccagccacagaaccucgaagagauccugaugcacugucaaacaacucugaaauaugccauuaagaccgggcauccccguuacuuuaaucagcucuccacaggauuagauauggugggucuggcagcugacuggcuuaccucuacugccaacacaaauauguucaccuaugaaaucgcgccuguuuuuguguugcuggaguacgucacgcucaaaaagaugagagagauuaucggcuggccagggggaagcggcgaugguauauucucccccgggggagccaucucaaacauguacgcaaugaugauugcuagguuuaaaauguucccggaagugaaggagaagggcauggccgcucuaccucggcugaucgccuuuacuagcgaacacagccauuucucucuuaaaaagggcgcagccgcucuggggauuggaaccgacuccguaaucuugauaaaaugcgacgagcgcgguaagaugauuccaucagaucucgaaagaaggauccuggaggcgaaacagaagggcuucguucccuuuuuagugagcgcaacagccgggacuaccgucuauggagcuuucgacccucugcucgccguggcagauauuuguaaaaaguacaagaucuggaugcacguggacgccgcuuggggcggugggcuucugaugagucggaaacacaaguggaaauugucuggcgucgagcgcgccaauuccguuacauggaacccacauaagaugaugggagugccccuacagugcagcgcacugcucguacgagaagagggccugaugcaaaauuguaaccagaugcacgcgucguaucuuuuucagcaagauaaacauuacgaccugucuuaugauaccggggacaaggcuuugcagugcggaagacacguggaugucuucaagcucuggcugauguggagggccaaagguacgacuggcuuugaagcacacguggacaagugcuuagagcuggccgaauaccuauauaauaucauuaaaaaccgggagggguacgagaugguuuucgauggaaagccgcagcauacaaacguguguuuuugguacauaccucccucccuccguacccuggaagacaaugaggaacgcaugucaagacuuaguaaagucgcuccagugaucaaggccaggaugauggaguauggcacuacaaugguaagcuaccagccuuugggugacaagguuaacuucuuucggauggugauuuccaaucccgcagcuacccaccaagauaucgacuuccugauagaagagauugagcgacucgggcaggaucuguga

SEQ ID NO: 56526 - RNA, 483 nt, Artificial Sequence
  derived and/or modified sequence opt3 from GADD45B__Homo_sapiens__NP_056490
augacccuggaggaacucguggccugcgacaacgcugcacagaagaugcaaacagucacugccgcgguugaggaacuucugguggcugcccagagacaggauagguugacgguaggcguguacgagagcgcaaaauuaaugaaugucgaccccgauuccgugguucugugucuacucgccaucgacgaagaggaggaagaugacauugcucugcagauacacuucacccuuauccaaucuuuuugcugugauaacgacauuaauaucgugcgggucucagggaugcagcgccuggcacaguugcucggagagccugccgaaacacaggguacuaccgaggcucgagaucugcauugccugcucgugacaaacccacacaccgacgccuggaagagucauggcuuaguagagguugcgagcuauugugaagagucccgugggaauaaccaaugggugccguacauuucucugcaggaaagauga

SEQ ID NO: 56527 - RNA, 480 nt, Artificial Sequence
  derived and/or modified sequence opt3 from GADD45G__Homo_sapiens__NP_006696
augacccuggaggaagugagaggccaggacacaguccccgagagcacugccaggaugcaaggggcuggaaaggcacuccacgaacuucuguuguccgcccagcggcaggguugcuuaacggcgggcguuuacgagucugcuaaagugcugaacguagauccugacaaugugaccuucuguguccuagccgcaggggaagaggaugagggagacaucgcccuccagauucauuuuacacugauacaggcuuucugcugugaaaacgauaucgacauugugcgcguuggcgaugugcaacgacuugcagccaucgucggugcuggggaggaagccggagcgccaggcgaccugcacugcauuuugaucucaaauccgaacgaggaugcauggaaggaccccgcccucgagaaacugagucuguuuugugaagagagccguuccgugaaugauuggguaccuucuauaacucucccagaauga

SEQ ID NO: 56528 - RNA, 669 nt, Artificial Sequence
  derived and/or modified sequence opt3 from GADD45GIP1__Homo_sapiens__NP_443082
auggccgcuagcgugagacaggcaaggucccugcucggcgucgccgcgacccuugcucccgggucucggggauaccgcgcccgaccuccaccgcguagaaggcccgguccucgguggccagaccccgaggaucuguugacaccucgcuggcaauuaggcccaagauaugcagccaagcaguucgcuagguacggggcagccucaggaguugugcccggcagucuguggccuagcccagaacagcuacgggagcucgaagcugaggaacgcgagugguauccgucccuggccacuaugcaggagucucuucgaguaaaacaacuggcggaggaacagaagagaagggaacgggagcagcacaucgcagagugcauggccaaaaugccccagaugauugugaacuggcaacagcagcagcgugaaaauugggagaaggcucaagccgacaaagaacgcagagcaagguugcaggcugaggcccaggaacuccuggguuaccaagucgauccucggucggcgcgauuucaggagcugcuccaggacuuagagaagaaggaacgcaaaagacugaaggaggaaaaacagaagaggaaaaaggaggcccgggcagcugcccuugcugccgcaguggcccaagauccagcugcgucaggggcacccagcaguuga

SEQ ID NO: 56529 - RNA, 1566 nt, Artificial Sequence
  derived and/or modified sequence opt3 from GADL1__Homo_sapiens__NP_997242
augagcuccgacucugauagacagugccccguggacggcgauaucgaccaacaggagaugauuccuucaaagaaaaacgccguccugguugauggggugguacucaauggaccaaccacagacgcuaaggcuggugaaaaauucguggaggaagccuguaggcuuauaauggaggaagucgugcugaaggcgacugauguuaacgagaaagugugcgaguggcggccgcccgaacaguugaagcaguuacuggaccuagagaugcgcgauaguggcgaaccuccacacaagcuccuggagcuuugucgagacgucauccauuacagcgugaaaacgaaucaccccagauuuuucaaccaacuguaugcuggguuggauuacuauucccucguagcccguuuuaugaccgaggcacugaauccuucuguuuacacauaugaagugucgccagucuuccugcucguggaggaagccguguuaaagaaaaugauugaguuuaucggauggaaggaaggcgacgguauuuucaaccccgggggaucagucagcaauauguacgcuaugaaccuggcaagguauaaauacugcccugauaucaaggagaagggccuuaguggcuccccacgguugauacuguuuacuucugccgagugucauuacagcaugaaaaaggcugccuccuuccuagggaucggaaccgaaaauguuugcuuuguggagacagacggucgcggcaaaaugauuccggaggaacucgaaaagcagguauggcaggcgagaaaagagggggcagcccccuuccuggugugugcuaccucaggaacuacaguccuuggcgccuuugacccucuggaugagaucgcagacauuugcgaaaggcacaguuuguggcuccauguggaugcuagcuggggugggucugcccugaugucccggaagcaccgcaaauuacugcacggaauccaucgagcggacucaguugccuggaacccacacaagaugcucauggcaggcauacaguguugcgcacuucuggugaaggauaaaagcgacuugcuaaagaaauguuauagugccaaggcuucuuaccuguuccaacaggauaaauuuuaugacgucuccuacgauaccggcgacaagagcauucagugcucgagaaggcccgaugccuucaaguucuggaugacguggaaagcacucgggacucugggacuugaggaacgggugaaucgugcccuggcuuugucucgcuaucucguagacgagaucaagaaaagagaagguuuuaagcuguuaauggagccugaguacgcgaacauuugcuucugguauaucccacccucccugagggaaauggaggaaggcccggaguuuugggcaaaacuaaaucucguugccccugcuaucaaggagcggaugaugaagaaagggucacugaugcuuggauaccagccccaucgaggcaaggugaacuucuuucgccaagucgugauuaguccacaggucagcagagaagacauggauuucuugcuggacgagauagaucuccuggguaaagacauguga

SEQ ID NO: 56530 - RNA, 351 nt, Artificial Sequence
  derived and/or modified sequence opt3 from GAGE10__Homo_sapiens__NP_001091883
augagcuggagaggcagguccaccuaccggccccgcccucgacguuauguggagccaccggaaaugaucgggcccaugcugccugagcaguucucugacgaagucgagccagccacacccgaagagggagagccugcuacucaaagacaggauccagcagccgcgcaggaaggugaggacgaaggcgcuucagccgggcagggacccaagccugaggcagauagucaagagcagguucacccaaaaacgggcugcgaauguggugacgggccggauggacaggagaugggccuccccaacccugaagaggugaagaggccagaagagggcgagaaacagagccaaugcuga

SEQ ID NO: 56531 - RNA, 354 nt, Artificial Sequence
  derived and/or modified sequence opt3 from GAGE1__Homo_sapiens__NP_001035753
augagcuggagaggcagguccaccuacuauuggccccggccucgccgauacgugcagccaccggagaugaucgggcccaugcguccugaacaauucucugacgaggucgaaccagccacacccgaggaaggagagccugcuacucagagacaggacccagcagccgcgcaggagggugaagacgagggcgcuucagccgggcaaggacccaagccugaagcagauagucaggagcagggccacccacagacggguugcgagugugaagacgggccggauggacaagagauggaucccccuaacccagaagagguuaaaacccccgaagagggcgagggccagagccagugcuga

SEQ ID NO: 56532 - RNA, 3936 nt, Artificial Sequence
  derived and/or modified sequence opt3 from GAK__Homo_sapiens__NP_005246
augagccugcuccaguccgcccuugacuuccuggcuggccccgggucuuugggaggugcaucaggcagagaucaaagugacuuuguggggcagaccgucgaguuaggagaacugaggcuacggguucgccgagugcucgccgagggcgguuucgcguuuguauacgaagcucaggauguggggagcggacgugaguaugcccugaagagacuucuguccaacgaagaggagaaaaauagggcaaucauucaggaagucugcuucaugaagaaauugucuggccacccuaacauagugcaauuuuguucggccgcuucaaucggcaaggaggaaagcgacacagggcaggcagaguuccuccugcugacugagcucugcaaaggacaguuaguugaauuucugaagaagauggagagucgggguccacuuuccugugauacgguguugaaaauuuucuaccagaccugccgcgccguccaacauaugcacagacagaagccgcccaucauucauagggaccugaaaguggaaaaucuacuccugucuaaccagggcacaaucaaacuuugugauuuugggagcgcuacuaccauaucccacuauccugacuacucauggagugcccagcggcgcgcgcugguagaggaagagaucacacgaaauaccacuccaauguauagaacacccgagauuaucgauuuguacagcaacuucccuauuggagaaaagcaagacaucugggcacucggcugcauacuguauuuacuguguuuuaggcagcauccauucgaggauggugccaagcuccggauuguuaaugggaaguacucuaucccaccucacgacacccaguacacgguguuucacucccuuauucgugcuaugcugcaagucaacccagaggagcgcuugucaaucgccgaaguggugcaucagcuacaggagaucgcagcugccagaaaugucaacccgaaaagccccauuacugagcugcucgaacagaauggaggcuauggcagugcgacccugucuagggggccuccacccccuguuggaccagccgguuccggcuacagcgggggacuugcacuggcugaguaugaucaacccuacggcgguuucuuggacauacuccgagggggcacagaacgacuguucacuaacuuaaaggacaccucgucuaaagugauccaguccguagccaauuaugcuaagggagaucuggacauuucauacaucacaagucgcauagccgugaugagcuuuccggcagagggcgucgaauccgcccugaaaaacaauauugaggaugugagacucuuccuggacucuaagcacccugggcauuaugcuguuuacaaccuuagccccaggaccuaccggccaucacgcuuucacaacagagugagugagugcggaugggcggcaaggcgugccccucacuugcauacgcuguauaauaucugucggaacaugcacgcuuggcuccgacaggaucauaaaaaugucugcgugguacacuguauggacgguagagccgcauccgccguugcugugugcagcuuccugugcuuuuguaggcuuuucucuacugccgaagcagcggucuacauguuuucaaugaagcgcugucccccaggcaucuggcccagucauaagcgguauauugaguacaugugcgauaugguggcugaggaaccuaucacaccacacagcaaaccgauucuggucagagccgugguuaugacccccgugccuuuguucuccaagcagaggucugggugccgcccauuuugugagguauaugucggagacgaacgaguggcaucgacuagccaagaguacgauaaaaugcgggacuucaagauagaagauggcaaagccguuaucccccucggugugacaguccagggggacgugcugauuguaaucuaucacgcucguuccaccuuaggcggaagacugcaggccaagauggcaucaaugaagauguuucagauccaauuccauacgggcuuugugccuaggaacgcuaccacaguuaaauucgccaaguacgaccuagaugcgugcgacauucaggagaaauacccagaucucuuccaggucaaucuggaaguggagguggagccccgcgaccggccgaguagagaagccccuccaugggagaacucuagcaugagggggcuuaaucccaagauauuguuuuccucacgagaggaacagcaagauauccugagcaaauucggaaagccugaacucccccgccagccagguucuacugcucaguaugacgcaggcgccggguccccugaggcugagcccaccgauagugacagcccaccgucuuccucagccgaugcaagucgguuucugcacacauuagacuggcaagaagagaaggaagcggagacuggagccgaaaacgcuagcucgaaagaguccgagucugcccugauggaagauagagacgagagcgaagucucagaugagggcgguaguccuauuuccucugaggggcaggaacccagggcagacccagagcccccuggccuugcugccggauugguucagcaggaccucguguucgaaguggagaccccagcaguacugcccgaaccugucccgcaagaggauggcguggaccuacuggggcuccauagcgagguuggagccggcccagcugugcccccucaggcguguaaggccccauccucaaauacagaucugcuuagcugcuugcugggucccccugaagcagcuagucaggggccgcccgaggacuuacucucugaagauccacugcuucuggccuccccugcucccccauugagcguccagucgaccccucguggaggucccccagccgcagccgacccguuuggcccucuccugcccucaucuggcaacaauagucaaccauguuccaaccccgaucuauucggggaguuucugaauagcgacucugugacuguuccucccagcuuccccuccgcgcacucagcuccuccgccaaguugcagcgccgauuuucuccaccugggagaccuucccggcgaaccuucuaaaaugacggcauccucaaguaaccccgauuugcuagggggaugggccgcuuggacagagaccgcagccagcgcgguggcuccaacuccugccaccgagggccccuuauucuccccaggugggcagccugcaccguguggaucucaggccucguggacaaagagccagaaucccgacccauuugcugaucucggcgaccugucauccggucuucaaggcaguccugccggguuucccccaggaggcuucaucccuaaaaccgcaacuacacccaaggggucuagcuccuggcagacgucacgcccgccagcucagggagccucuuggccuccccaagcgaagccacccccuaaagccugcacccagccgcggcccaacuacgcaagcaacuucaguguaauuggcgcuagagaagagagggguguccgagccccauccuucgcucagaagccuaaagugagcgaaaaugacuuugaggaucugcuaucuaaccagggguucucaucccggagugacaagaaaggacccaagacuaucgcagaaaugcgcaaacaagaucucgccaaggacacagauccucugaaguugaaacuguuagacuggauagagggcaaggagagaaauaucagggcccuccugagcacccuucauacagugcugugggauggugaaucgcgguggacuccagucggcauggcugacuugguugcgcccgaacaggugaaaaagcacuaucggagagcaguacucgccgugcauccugauaaagcugccgggcagccauacgaacagcacgcaaagaugauuuuuauggagcugaacgacgccuggucugaguucgaaaaucaaggaucccgcccccuauuuuga

SEQ ID NO: 56533 - RNA, 2058 nt, Artificial Sequence
  derived and/or modified sequence opt3 from GALC__Homo_sapiens__NP_000144
auggccgaguggcugcucagcgcuuccuggcagagaagggcaaaggccaugaccgcggcugccggcucugcagggcgggccgcugugccccuucuguugugcgcauuacuggccccuggaggugcuuacguccuagacgauucagacggccucgggcgcgaguucgauggaaucggcgccguuaguggugggggagcgacaagccgacugcuugugaacuauccagagccguaccguucccaaauucuggacuauuuguuuaaacccaauuucggcgcaucucuccacauacugaagguagaaaucggcggggauggacagacuacggacgguaccgagccuucgcauaugcacuacgcccuggaugaaaacuauuuuagaggcuacgagugguggcucaugaaagaggcuaagaaaaggaauccaaacauuacauuaaucgggcugcccuggucauucccuggauggcuuggcaaggguuuugacuggccauaugugaauuugcagcugacugccuacuacgucgugaccuggauuguuggggcaaagcgguaucaugaucuagacaucgauuacauaggaaucuggaacgaacgcagcuauaaugcuaacuacauuaaaauccucagaaagaugcugaauuaucagggccuucaaagggugaaaauuaucgccagugacaaccugugggaguccauaucugcgagcauguugcucgaugccgaacuguucaaggucguggacguaauuggcgcacacuaccccgggacacauuccgcuaaagacgccaaguuaaccggaaagaaacuguggucaagugaggauuuuagcacucucaauucugacaugggugcuggcuguugggggcggauccuuaaccagaauuauauuaacggauacaugacauccaccaucgccuggaaucugguugcaucauacuaugagcaguugccuuacggccgcugcggucuaaugacggcccaggaaccauggagcgggcacuauguggucgagaguccggugugggugucugcucacacuacccaauucacacagcccggcugguacuaucugaagacugucggacaucucgaaaaaggcggguccuacguugcgcugaccgauggacuugguaaccugacaaucauuauagagaccaugagccacaagcauucgaaauguauccgaccauuuuugccuuauuucaacgugucucagcaguuugcaacguucguacucaagggcuccuuuucagaaauucccgagcugcaagugugguacacuaaauuagggaagacaagugagagauuccuguucaagcagcuagacagccucuggcugcuugauuccgacggaucuuuuaccuugagccugcacgaagaugaacucuucacucugacaacccuuacgaccggcaggaaagguucauacccucugccacccaagagucagccguuuccuuccacauauaaagacgauuucaaugucgacuaccccuuuuucagcgaagccccaaacuuugcugaucaaacugggguguucgaguauuuuaccaauaucgaagacccuggcgagcaccauuucacauugcggcagguucucaaccagcgucccauaacuugggccgcagacgccucuaauaccauuucaaucaucggagauuacaacuggacaaaucugaccauuaagugcgacguguauaucgagacuccagauacgggcggggucuuuauugcuggacgcgugaacaaagguggcauauuaaucagaagugccagggggauuuucuuuuggaucuucgcaaauggaagcuaccggguaacaggcgaccuggcggguuggaucauuuaugcucuagggcgaguugaagugaccgccaagaagugguacacucucacccugacaauaaaaggccacuucaccuccggaaugcuuaacgauaagucuuuguggacugacauccccgucaauuuuccuaaaaacggcugggcagccauugggacacauucguucgaguuugcucaguucgauaauuuucugguggaagccacgcgcuga

SEQ ID NO: 56534 - RNA, 372 nt, Artificial Sequence
  derived and/or modified sequence opt3 from GAL__Homo_sapiens__NP_057057
auggccagaggcagcgcucugcuccuugcaucccuguuguuagccgcggcucugucugccucagcagggcuauggagucccgccaaggagaaaaggggauggacccucaacagcgcugguuaccugcuuggcccucacgcaguggggaaucaucgguccuucucugacaagaacggacugacaucgaaacgcgaauugcgaccagaggaugacaugaagccgggcucauuugaucguagcauccccgaaaauaacauuaugagaacuauaaucgaguuccucaguuuucugcaccugaaagaagccggugcucucgacagguuacuggaucuuccugccgcggcauccucugaggacauugagcggagcuga

SEQ ID NO: 56535 - RNA, 1179 nt, Artificial Sequence
  derived and/or modified sequence opt3 from GALK1__Homo_sapiens__NP_000145
auggccgcucugagacagccccaaguggcagagcuccuugccgaagcgaggcgggcuuuccgcgaggaauuuggcgccgagccugaacuggcagucagcgccccagggcgaguuaacuugaucggagagcacaccgacuacaaucaggguuuagugcugccgauggcucuagagcucaugacaguacuggugggcucuccccguaaggaugggcuugucucccuguugacuacgucagaaggagcagacgagccucagagacuccaguucccacugcccaccgcccaaaggagucuggaaccuggcacaccacggugggcuaacuaugugaaagguguuauucaguacuaucccgccgcgccucucccaggguuuagcgcaguggucguguccucuguaccguuaggaggcggccugucgucaagcgccagucuugagguugcuacuuacaccuucuugcagcagcugugccccgauuccgggacaauagccgcacgcgcucaagugugucagcaggccgagcauucuuuugcgggaaugccuugcgguaucauggaccaguucauuagccuaaugggccaaaaggggcacgcccuccugaucgauuguagaucccuugaaaccucacuggucccauugagugaccccaaacucgcagugcugauuacuaauagcaacgugaggcauucuuuagcuuccucagaguauccuguccggcgccgacagugcgaagagguugccagagcucugggaaaggaaagccucagggaggugcagcuugaggaacuggaggccgcacgggauuugguaaguaaagaaggcuuucgucgcgccagacacguggucggugagaucaggcggacagcucaagcggcagccgcucuacgacgcggggacuacagagccuucggaaggcugaugguggaaucucaucggucccuccgcgaugacuaugagguuagcuguccagagcuggaucagcuuguggaagcagcccuggcuguccccggcguguacggcucgagaaugaccgggggagguuuuggcgggugcacgguaacuuugcucgaggccucugcagcgccgcacgcuaugaggcacauacaggaacauuacggaggcaccgccacauucuaucugucccaggcagccgacggugcuaagguuuuaugucuguga

SEQ ID NO: 56536 - RNA, 1344 nt, Artificial Sequence
  derived and/or modified sequence opt3 from GALK2__Homo_sapiens__NP_001001556
augcccgugcuguacgacagacuccuuaagcugaaagagauguucaacagcaaguuuggcuccaucccuaaauucuaugucagggccccagggcggguuaauauuauaggagaacacaucgauuacugcgguuauucuguguugccgauggcuguagagcaggacguguuaauugcagucgaacccgugaagaccuacgcccugcaacuagcgaacacaaauccucucuauccagauuuuucaacgagugcuaacaauauccagauugacaaaacuaagccccuguggcauaacuacuuccuuuguggccugaaggggauccaggagcacuuuggauugagcaaucucaccggcaugaacugccugguugaugguaauauaccuccauccucugggcugucgucaagcagugcccucguguguugcgcaggauuagucacacugacugugcuuggccgcaacuuguccaaaguagaacuggccgagaucugugcuaagucugagcgauauauuggcaccgaagggggagguauggaccagagcaucuccuuccuagcagaggaaggcacagccaaacucauugaguuuucaccccugcgugcuaccgauguuaaacuuccuaguggggccguguucgucaucgcgaauagcugcguggagaugaacaaggcagccacuucucauuuuaauauaagagugauggaauguaggcuggcugccaaguugcucgcaaaguacaaaucccugcaaugggacaaggucuuacggcuggaggaaguucaggcuaaacucggaauuucacuugaggaaaugcuguuggugacagaggaugcccuacacccagagccguacaaccccgaagagaucugccgcugucugggcauuagccucgaggaacugagaacccagauccuuaguccuaauacgcaggacguacugaucuucaaguuguaucaaagggcgaaacauguguacucugaagccgcacggguccuccaguuuaagaaaauuugcgaggaggcuccagaaaacauggugcagcuguuaggugagcugaugaaccagucccacaugagcugucgcgauauguaugaaugcucgugccccgagcuagaccaacucguugauauaugucgaaaguucggggcccagggaucuagacugacuggcgcuggcuggggagggugcaccguguccauggucccugccgacaaacuuccaucauuuuuggcaaaugugcacaaggccuacuaucagaggagugacgguagccuggcucccgaaaagcaaucccucuucgcgacaaaaccgggcgggggagcacugguacuucuggaggccuga

SEQ ID NO: 56537 - RNA, 1029 nt, Artificial Sequence
  derived and/or modified sequence opt3 from GALM__Homo_sapiens__NP_620156
auggccagcgugaccagagcugucuucggcgagcugcccuccgggggagguacaguugaaaaguuucagcuccaaucugaccuucugaggguggauaucauuucauggggcugcacuauaacggcauuggagguaaaagaccggcaggggcgcgccagugauguggucuuaggauucgcggaacuggagggcuaccuacagaagcagccuuauuuuggugcugugaucgggcgaguugccaaccguauugcaaaaggaaccuucaagguggacggcaaagaauaccaccucgccaucaauaaggagccaaacagccugcauggcggggucagaggauuugauaaggugcuuuggacaccgaggguacuguccaaugguguucaauucucucggauuucgcccgacggcgaggaaggguauccuggagaguugaaagugugggucacuuacacccucgauggcggugaacugaucgugaacuaucgcgcucaggcaucacaggccacaccagugaaucugaccaaccacagcuacuuuaaucucgcugggcaggccagucccaacauaaaugaccaugaggucacuaucgaggcggauacauauuuaccuguugacgaaacccugauuccaacgggagagguggcacccguacaaggcacugccuucgaucuuagaaagccuguggaauugggcaaacaucugcaggacuuucaccuaaacggguucgaucacaauuuuugucucaagggauccaaagagaagcacuucugcgcuaggguccaucacgccgcaucuggucgggugcuggaaguuuacaccacacagccaggcgugcaguuuuacacugggaacuuccuugacggaacccugaagggcaaaaauggugcugucuauccgaagcauagcggguucuguuuggagacacaaaacuggcccgacgccgugaaucagccucgcuuuccacccguacuccugcgaccuggcgaggaauacgaucacaccacgugguucaaauuuuccguugcguga

SEQ ID NO: 56538 - RNA, 1569 nt, Artificial Sequence
  derived and/or modified sequence opt3 from GALNS__Homo_sapiens__NP_000503
auggccgcuguggucgcagccaccagaugguggcagcugcuccuuguucugagcgcggcuggcaugggggccuccggagcaccccaaccuccaaacaucuuguuacugcuaauggacgauauggguuggggcgaccucgggguguacggagagccgucuagggaaacccccaaucuggaucggauggccgcugagggccuucuguucccuaacuuuuauucagcaaauccauugugcagucccagccgcgccgcucuccugacuggucgacugccuauucguaacggguucuacacgaccaaugcccacgcgagaaacgcauauacaccacaggaaauaguaggaggcauccccgacuccgagcagcucuuaccugaacugcuuaagaaagccggcuacgugucuaagauugucgggaaauggcauuugggacacaggccacaguuucauccgcugaagcacgguuucgaugagugguuuggcucgcccaauugucauuucgggccuuaugacaacaaagcucggccaaauauccccguguaccgcgauugggagaugguuggaagauauuacgaagaguuuccuauuaaccuaaagacuggcgaagccaaucucacccaaaucuaccugcaggaggcacuugacuucauaaagaggcaggcucggcaccacccauuuuuccuguauugggccguggaugcgacacaugcccccgucuacgcaucaaaaccguuuuuggguaccagccagcgcgggcgauauggagacgcugugagagagaucgaugacaguauuggcaagauccucgaacuguuacaagaucugcacguagccgacaacacuuucguguuuuucacauccgacaauggcgcugcccucauuucugcaccugagcaagggggaagcaacggucccuuccuuugcggcaaacagaccacguuugaagggggaaugagggagccagcccuggcuugguggccuggccauguuacugcgggucaggucucccaccaguuggggucaaucauggaucuauucaccacaagucuggcacucgccggccugacucccccaagcgaccgggcuauagauggacuuaaucuguugcccacccuccugcagggccguuuaauggaccgcccuaucuuuuacuauagaggggauacacugauggccgcaacccuaggacagcacaaggcccauuucuggacguggacuaacucuugggaaaacuuuaggcaagguauugacuucuguccaggccagaauguguccggggugacaacccacaaccucgaggaucauacuaaacugccgcuuauuuuucacuugggacgggaccccggcgagcgauucccucugucauuugcuagcgccgaauaccaggaggcacucagucgcaucacaucugucguucagcaacaucaggaagcgcuggugccagcucagccccagcuuaauguaugcaacugggccgugaugaauugggcaccuccagguugugagaagcuggggaagugcuugacacccccggaauccaucccuaaaaagugucucuggagccacuga

SEQ ID NO: 56539 - RNA, 1746 nt, Artificial Sequence
  derived and/or modified sequence opt3 from GALNT12__Homo_sapiens__NP_078918
auguggggcagaaccgccaggcggcgcugcccccgagagcugcguagagggagggaagcucuccuugugcuguuggcauuacuggcccuagcgggacucgguagcguccugcgggcucagcgcggcgccggggcaggagccgcugagccuggcccaccgagaacacccaggccuggucggcgcgaaccaguuaugccccgaccuccagugcccgcaaacgcccuuggggcuagaggagaggccguaaggcugcaauugcagggcgaagaacuccggcugcaggaggaauccgugcgucugcaccagaucaauauuuaccucucugaccgcauaucauuacauagaaggcugccugagcgguggaacccacuuuguaaggagaaaaaguaugauuacgacaauuugccgcgaacgagugucaucauugcguucuauaacgaggcauggagcacucugcuacgcaccguguacuccguucucgagacaucucccgauauccugcuugaagaggugauucuggucgacgauuauucggacagagaacacuugaaagagaggcucgccaaugaacugucaggcuuaccuaaggugcggcugauccgcgcuaacaaaagagaggggcucguaagggcccgucuucugggagcaagcgcugcccggggugauguuuugacuuuucuagacugccauugugagugccacgaaggcuggcuggagccacuccugcaacgaauacaugaagaggaaagugcgguggucugucccgugaucgaugugauugacuggaauaccuucgaguaccuugggaacuccggagagccucagaucggcgguuuugauuggagacuggucuucacauggcacaccguuccagaaagggagcgcauucggaugcagucucccguggacguaaucagaagcccgacuauggccgggggauuguuugcaguguccaagaaguauuucgaauaccucggcucauacgauacaggcauggaggucuggggaggggaaaaucuggaguuuaguuucaggauauggcagugcgguggcguguuagagacccacccuuguagccauguugggcacguguuucccaaacaagcuccauauucucgcaacaaggcccuggcuaauuccguccgagccgcagaaguguggauggacgaguucaaagaacuauacuaucaucggaacccucgugccagacucgagcccuuuggagacguaacggagaggaagcagcugcgcgauaaacuucagugcaaggacuucaagugguuuuuggaaacuguuuacccagagcugcacgugcccgaagaucggccuggcuucuucgguaugcuccagaauaaagggcugaccgacuauuguuuugauuacaacccaccggacgagaaucaaauugucggccaccaggugauccuuuaucugugccauggaaugggccagaaccaauucuuugaauacacaucacagaaggagauuagauacaacacucaccagcccgagggguguaucgcugucgaagcgggaauggauaccuugaucaugcaucucugcgaggaaacagcaccugagaaucagaaauucauucugcaagaagacgguagcuuauuucacgagcagaguaagaaaugcgugcaggccgcuaggaaggagucuuccgauagcuucguuccacugcuacgagacuguaccaacucggaucaucagaaaugguuuuucaaggaacgcaugcucuga

SEQ ID NO: 56540 - RNA, 1686 nt, Artificial Sequence
  derived and/or modified sequence opt3 from GALNT13__Homo_sapiens__NP_001288556
augagaagguucguguacugcaaggucguucuggccaccagccucaugugggugcuuguagacguguuucuguuguuauauuucuccgaguguaacaaaugcgaugacaagaaagaacggucucugcuacccgcucuccgcgcagucaucucacgaaaucaggagggcccuggggaaaugggaaaggccgugcugauuccaaaagaugaccaagagaagaugaaggaacuuuuuaaaauaaaccaguucaaucugauggcgagugauuugaucgcucucaaccguagccugccggacguuagacuggaggguuguaagacaaaaguguaccccgaugagcucccuaauacuuccgucgugauuguauuucacaacgaagccuggucuacguuacugaggaccguuuauucggugaucaaucggucaccacauuaccuuuugagcgaggucauucugguggacgaugcaagugaacgcgacuuccuaaagcucacacuggagaacuaugugaaaaaucuugagguccccguuaagaucauaagaauggaagagagguccggccugauccgggcccgcuugcgaggggcugcagccucuaagggacaggugauuacuuuucucgaugcucacugcgaauguacccugggcugguuagagccucugcucgccagaaucaaagaagacaggaagacaguagugugcccaauuaucgaugucauaagcgacgacaccuucgaguacauggcggguuccgauaugacuuaugggggauuuaacuggaaacuuaauuuccggugguaccccgugccucagcgugagauggaccgcagaaagggcgauaggacacugccaguucggaccccgacgauggcaggcggguuguuuucaauugaccgaaacuacuucgaagagaucggaacuuaugaugccgguauggacauuuggggcggggaaaaucuagagaugaguuuucgcaucuggcaauguggaggcagccuggaaaucgugaccugcucucaugucggucacguguucagaaaagcuacacccuacacuuucccugggggaaccggccauguaauuaacaagaauaacaggcggcucgccgagguuuggauggaugaguuuaaagacuucuuuuauauaaucuccccaggcguggucaagguggauuacggggacgucucagugcgcaagacacugagagaaaaccuuaaauguaagcccuucagcugguaucuggagaauauuuacccugauagucagaucccaaggcguuauuacucuuugggagaaauacggaacguugagaccaaucagugccucgacaacaugggucgaaaagaaaaugagaaggugggcauuuuuaacugucacgggaugggaggcaaucagguauucuccuacacggcagacaaagagaucagaacugaugaccugugcuuagaugucagcaggcugaacggucccgugaucaugcuaaagugccaccauaugcgcgggaaucaacucugggaauaugacgcugagucgugucugucuguuaacaagguggccgauggcucccagcacccgacagucgaaaccugcaaugacucaacucuucagaaaugguugcugcggaacuacacaagaauggagauuuuuaggaauaucuucggaaacaguaccgauuauauucucuga

SEQ ID NO: 56541 - RNA, 1674 nt, Artificial Sequence
  derived and/or modified sequence opt3 from GALNT14__Homo_sapiens__NP_001240755
augagaaggcugacccggcgccucgugcuucccgucuucggcguucuguggaucacaguguuguuauuuuucuggguaacuaagcgaaaacuggaggugccuacggggccagaaguccagaccccgaagguguggagccuauuuuucaaaguugccggaaugucccccugggcuccucaagugccagucucucccacaccuccauaccagcguggucaccuccccacuggcgggcaucuggcagugugccacuuuccuugucuucugcaggaggcccaguuccauuugcaaacccagguauuucuccagguuagaugcacacugcugguguauuguaccgaccucccaccgacuucaauuauaaucacauuccacaacgaagcgaggaguaccuuacugcggacgauucgcagcguccuuaauagaacucccacccauuugaucagggagauuauccugguggaugacuuuuccaacgauccugacgauugcaagcagcuaauaaaacucccaaaggugaagugucugcggaauaacgaacgccaaggacuuguccgaucuagaaucaggggcgcugacauugcccaggguacaacucugaccuucuuggauucgcacugcgagguuaaucgggacuggcuccagccccuguuacaccgugugaaagaggauuacacacgcguaguguguccugucaucgacauuaucaaccuggauaccuuuacguauauagaaucagcaagcgagcucagagggggauucgacuggagucuucauuuucagugggaacaacuguccccagagcagaaggccaggcgguuggaucccacugagccgauucgaacaccuaucauugcuggcggccuauucgugaucgacaaagcaugguucgacuaccuggggaaguaugauauggacauggauaucuggggaggugaaaauuuugagauuucuuuccgcguuuggaugugcggcgggagccucgaaauagugcccuguuccagagucggacacguguuuaggaaaaagcauccauacguauucccugacggcaacgccaauaccuauaucaagaacacuaaacggacagcugagguuuggauggaugaauacaagcaguacuauuacgccgcgcgccccuuugcacuggagagaccauucgguaauguggagucaaggcuugaccugcguaaaaacuugcggugccaaaguuuuaagugguaucucgaaaauauuuaccccgagcugagcaucccuaaagaaucuuccauacagaaggggaacauucgacagagacagaaauguuuagagucacaaaggcagaauaaccaggaaaccccaaaccugaagcuaagcccgugcgccaaggucaaaggagaggaugcuaagagucaggugugggccuucacguauacccaacagauccuccaggaggaacugugccuuucugucaucacauuguuucccggcgcaccugugguucuggugcucuguaaaaauggcgacgaucgccagcaauggacuaagaccgggucccacauugagcacaucgcuagccaucugugccuugacacagauauguucggagacgguacugaaaacggcaaagagauuguagucaauccaugugaaucgucucugaugucccagcacugggacauggugucaaguuga

SEQ ID NO: 56542 - RNA, 1920 nt, Artificial Sequence
  derived and/or modified sequence opt3 from GALNT15__Homo_sapiens__NP_473451
augcugcucagaaagagguaccggcaccgccccugccgacuucaguuccuguuguuacugcuaaugcucggcugugugcugaugauggucgccaugcuucauccuccacaccauacccugcaccaaacaguuacugcucaggcaagcaaacauuccccggaggcccguuauagauuggacuuuggggaaucucaggauugggugcucgaggcggaagacgagggagaagaguacucaccccuggagggucugccuccauucaucagucucagggaagaucaguuacugguagcuguggcccuuccccaagcacggcgcaaccagagccagggcagaaggggaggguccuaucgguugauuaagcagccucgccgacaagacaaagaggccccaaagagagauuggggcgcugacgaagauggugaggucucugaggaagaggaacugacgcccuuuucgcuagacccuagggggcuccaggaggcacugucagcccggauaccacuucagcgugcucugccggaagugcgccaccccuugugccuccagcaacacccucaggauagccugccaaccgccaguguuaucuuauguuuccaugacgaggcgugguccacacugcucagaacugugcacucuauucuugauaccguccccagggcauuucugaaagagaucauuuugguggacgaucuaagccagcaaggacagcugaaguccgcccucucagaauacguagcucggcuggagggcguuaaacuucugcgaaguaauaagcgcuugggcgccaucagagcaaggaugcucggggcuacacgggccaccggagacgugcuggucuucauggacgcgcauugcgaaugucacccugguugguuagagccacugcuaagccgcauagccggcgauagaucuaggguggugucccccgucaucgacguuauugauuggaagacuuuucaguauuacccgucaaaagaccuccagcguggggugcuggauuggaaacuugacuuccacugggaaccuuugcccgagcauguacggaaggcacugcaaagcccaaucaguccuauucgaucucccguggucccaggagaggugguugcuauggauagacacuauuuucagaacacaggcgccuacgacucccucaugagccugagggguggggaaaaucuugagcugucguucaaggcuugguugugcggaggcucuguggaaauccuccccuguucccgcgucggccauauauaccagaaccaggauucacacaguccucuggaccaagaggccaccuuacggaauagagugaggauugcagaaacguggcuggggagcuuuaaggagacuuucuauaaacauuccccagaggccuuuucucuaagcaaggcugaaaaaccggauugcauggagcgccuccagcugcagcgacggcuuggaugucguaccuuccacugguucuuggcgaacguauaccccgaacuguauccuucagagccaagacccaguuuuuccgguaagcuccacaauacaggccugggguuaugcgcagacugucaggccgagggagacauccugggcugcccuaugguucuugcuccaugcagcgauucuaggcaacagcaguacuugcagcauacuucacgcaaagaaauucacuucgguaguccccaacaucucuguuuugccgugcggcaggagcaggucauccugcaaaacugcaccgaagaggggcuagcaauccaccagcagcacugggacuuccaggaaaauggcaugauugugcauauacugagcggaaaguguauggaggccgucgugcaagagaacaauaaagaucucuaucugagaccgugcgacggcaaggcuaggcagcaguggcgauuugaucagaucaacgccguugacgaacgcuga

SEQ ID NO: 56543 - RNA, 1824 nt, Artificial Sequence
  derived and/or modified sequence opt3 from GALNT18__Homo_sapiens__NP_940918
auggugugcaccagaaagacaaaaacucuggucagcacguguguuauccucuccggcaugaccaacauuauaugccuucuguacgugggguggguaacaaauuauaucgccucuguguacgucaggggacaggagcccgcuccugacaagaaauuggaggaggauaagggugacacuuuaaaaauuaucgaacggcuggaucaccuagagaacgugauuaagcaacauauccaggaagcaccagccaagccggaggaggcggaagcugagcccuucaccgacucaagucucuuugcccacuggggccaggaacugagcccugaggggcgccgaguugcacuuaaacaguuccaauauuacggauauaaugccuaccuguccgaucguuugccacucgacagaccccugccugaucugaggccaucuggcugucggaaccucucguuucccgacucauuaccugaggugagcauagucuucaucuuugugaaugaagcucugaguguacuuuugcgcuccauucauucugcaauggagagaacaccaccgcaccuucuaaaggaaaucauucucguugaugacaacagcuccaaugaggaacugaaagagaagcugaccgaguauguggauaaagucaacucacagaagcccgguuucaucaagguggugaggcauaguaaacaggaagggcugauacggagccgcgucucuggauggcgagccgcuacugccccuguuguggcguuguuugacgcacacguagaguucaaugugggcugggccgaaccaguccucacaagaauuaaggagaacaggaaacggaucauuucccccucauuugauaauaucaaguacgacaacuucgaaaucgaggaguacccucuggcugcccagggcuuugacugggaauuauggugccguuaucugaauccacccaaagcaugguggaagcucgagaacagcaccgcuccgauucgcaguccugcccuuauaggguguuucaucguggauagacaauacuuucaggaaauuggacuguuggacgaggguauggaaguuuauggcggggagaauguggagcuaggaaucagggucuggcagugcggcgguucuguggaaguacugcccuguucccggauagcgcacauugagcgagcccauaaaccauacacggaagaucucacugcacacguucgcagaaacgcucugaggguggccgaggucuggauggacgaguucaagagccauguguauauggcuuggaacaucccucaggaagauucggggaucgacauuggagauaucaccgcccggaaggcacuucgcaaacaacugcagugcaagacauucagaugguacuuggucucuguguaucccgagaugaggauguacuccgacauuauagccuacggcguucuccaaaauucacugaaaacugauuuaugucuggaccagggcccagauaccgaaaacgugcccaucauguauauuugccacgggaugacaccucagaauguauacuauaccaguagccagcagauccacgucggaauccuauccccaacgguggacgacgaugacaaccguugucucguugaugucaauucucggccgcgacugauugagugcagcuacgcuaaggcgaaaagaaugaaacuucauuggcaauuuucacaggguggccccauacagaacaggaagaguaagcgcugcuuggaacugcaggaaaauuccgaccucgaguucggguuucaacuggugcuucagaaguguagcggacagcacuggucuaucacuaacgugcugcggucauuggcaaguuga

SEQ ID NO: 56544 - RNA, 1680 nt, Artificial Sequence
  derived and/or modified sequence opt3 from GALNT1__Homo_sapiens__XP_005258296
augagaaaguucgccuacugcaaagugguccuggcuaccagccucaucuggguucuucuggacauguuuuuguuacuguauuucuccgaguguaacaagugcgaugagaaaaaggaaaggggccuacccgcaggggacgugcucgaaccuguacagaaaccacacgagggaccgggugaaaugggcaagcccguggucauuccuaaggaggaucaagagaaaaugaaggaaauguuuaaaauaaaucaguucaaccugauggccucugagaugaucgcgcuuaaucggucacugccagacgugcgcuuggaaggguguaagacaaaaguuuaccccgauaaccucccuacuacgaguguggucauuguguuucauaaugaggcuuggagcacccugcugcgaacaguacacuccguuaucaaccguucuccaagacauaugauugaggaaaucgugcucgucgacgaugccucggagagggacuucuuaaagcggccccuggaaucauaugugaagaaacuuaaggugccuguccacguuauacgcauggagcagagaagcggauugaucagggcacggcugaaaggcgccgcugugaguaagggucagguaauuacuuuucuagaugcacauugcgaauguaccgugggguggcucgagccacugcuugcccgcaucaaacacgaccgaagaacagucgugugcccgauuaucgauguuauauccgacgauaccuucgaguacauggcuggaucugacaugacuuauggcggcuuuaauuggaagcugaacuucaggugguaccccgugccucaacgggaaauggaccgucgcaaaggggauagaacauugccagucaggacccccacgauggccggaggucucuuuagcauugaccgggauuauuuccaggagaucggcacuuacgacgcggggauggauauuuggggaggcgaaaaucuggagaucuccuuucgaaucuggcaguguggugggaccuuagaaauugugacaugcucacacguaggacauguuuuccgcaaggcaacuccuuacaccuucccaggcggcacagggcagauaaucaacaagaauaacagaaggcuggccgagguguggauggacgaguuuaaaaauuucuuuuauauuaucagucccggagucaccaagguggauuacggugacauaagcucucgggucggccuccgccacaaacuucaauguaagccguucuccugguaucuggaaaacauuuacccugauucacagauccccagacauuauuuuagcuugggggagaucaggaauguggaaacgaaccagugccuagacaacauggcucguaaagagaaugaaaagguuggaauuuucaacugucacggcaugggugggaaucagguguuuaguuacacugccaacaaggagauccggacagaugaccugugccucgacguaucuaaacugaauggcccagucaccaugcuuaagugccaccaucugaaaggaaaccaauugugggaguaugauccugugaagcucacucugcagcacguuaauuccaaccaguguuuagacaaagcaacagaagaggauagccaagugcccucgauucgagacugcaauggcucuagaucccagcaguggcugcuaaggaacgucacccucccagaaauauucuga

SEQ ID NO: 56545 - RNA, 1602 nt, Artificial Sequence
  derived and/or modified sequence opt3 from GALNT2__Homo_sapiens__NP_001278795
auggccgacagagaggauuggaacgaaaucgaccccauuaagaaaaaggaucugcaccauagcaauggcgaggaaaaagcucaguccauggagacccucccuccagggaaggugagguggccggacuucaaccaagaagcauacgucggagguacaaugguucggucuggccaggaucccuaugcccgcaauaaauuuaaccagguggagucagacaaacuucgaauggaucgugcgauaccugacacuagacacgaucagugccaaaggaagcaguggcggguagaccugccagcuacgaguguggucaucaccuuccauaaugaggcccgcagcgcauuguuaagaacagugguuuccgugcugaagaagucucccccucaccuaauuaaagaaaucauucucgucgaugacuacucgaacgauccagaggacggggcccugcuuggaaagaucgaaaaagugaggguacugcggaaugaccgccgagagggcuugaugagaucaaggguucggggugcugaugcagcccaggcuaaggugcucacuuuucuggacagccauugugagugcaacgaacacuggcuggagccccucuuagaacgugucgccgaggaucgcaccagaguggugaguccuauaaucgacgucauuaauauggauaacuuccaguauguuggggcguccgcagaccugaagggaggcuuugauuggaaucuuguguucaaaugggacuacaugacaccagaacaaaggcggucucgacagggcaacccgguagcccccaucaagaccccuaugauugcugggggauuguuugugauggauaaauucuauuuugaggagcuggguaaguacgacaugaugauggaugucuggggcggggaaaaucuagagaucagcuuccgcguguggcaguguggaggcucccucgaaauaauuccaugcucaagaguuggucacguguuuaggaaacagcaucccuauacuuucccugggggaaguggcacagucuuugcccggaacacccgcagagcagcugagguguggauggacgaauacaagaauuucuacuaugccgcgguaccaagcgccaggaacguucccuacggcaacauccaaucucgucuggagcuucggaaaaagcuguccuguaagccguucaaaugguauuuggagaauguguacccugaacuccgaguccccgaccaccaggauauugcauuuggggcucugcagcaaggaacgaacugcuuagacacucugggucauuucgccgauggcguggucgggguguaugagugucacaaugcuggaggcaaccaggaaugggcccucaccaaggagaaaucaguuaagcacauggaccuuugccugacagugguagauagagcaccagguagcuugaucaaacuacagggguguagggaaaaugacagucgccagaagugggagcaaaucgagggcaacucuaagcugcggcaugucggauccaaucucugccuggauagcagaacugccaaaucgggcgggcuuucuguggaaguuuguggaccugcucugucccagcaguggaaguuuaccuugaaccuccagcaauga

SEQ ID NO: 56546 - RNA, 1902 nt, Artificial Sequence
  derived and/or modified sequence opt3 from GALNT3__Homo_sapiens__NP_004473
auggcccaccugaagagacucgugaaacuucauaucaagaggcacuaccauaaaaaguucuggaaacugggcgcugucauauuuuucuuuauuaucguuuugguguuaaugcagcgggagguaagcgugcaauauuccaaggaagagucucgcauggaacgaaacaugaagaauaaaaacaagaugcuggaccuaaugcucgaggcagucaauaacauuaaagaugccaugcccaagaugcagaucggggcgccugugcgucagaauauugacgcuggagaaagaccaugccugcaggguuacuauaccgccgcagagcuuaaaccgguucuggauaggcccccucaagacucaaacgccccaggcgcuagugggaaggcauucaagacaacuaauuugagcguggaggaacagaaagagaaggaacggggagaggccaaacacuguuuuaacgcuuucgccuccgaucgcaucucucuccauagagaccugggccccgauacgaggccuccagagugcauagaacagaaguuuaaacggugucccccucugccaaccacaucggucaucauuguguuccacaaugaggcguggucaacucucuuacgcaccguacacagcguucuguacaguuccccggcaauccuuuugaaggaaauuauccugguggacgaugccucugucgacgaguaucuacaugauaaacucgacgaauacgugaagcaguuuagcauagugaagauuguccgacaaagagagaggaaaggucugaucacagcucggcuucugggggccaccguugcaacugcugagacauugaccuuccucgaugcccacugcgaauguuuuuauggauggcuggagcccuuacuggcgcguauugccgaaaacuacacggcagugguauccccugacaucgcuucaaucgaccucaauacuuucgaguuuaacaagccaagucccuacggcagcaaucauaaccgcggcaauuucgauuggucucuuuccuucgggugggaaucacugccugaccacgagaaacagagaaggaaggaugagaccuauccaauuaaaacacccacuuuugccggagguuuguucagcauaaguaaggaauacuuugaguauaucggcucuuacgacgaagagauggaaauuuggggaggggagaacaucgagauguccuuccggguguggcagugcggcggucagcuagaaauaaugccguguagcgucguggggcacguuuuucgaucgaagucuccucauuccuuccccaaaggaacccaagugauugcucgcaaccaggucagacuggccgagguguggauggaugaauauaaggagaucuuuuacaggcggaauacagacgcagccaaaaucguaaagcagaaggcuuucggcgaucucucaaaacgcuuugagauuaagcacagacugcaaugcaaaaacuucaccugguaucuuaauaacaucuacccagaaguuuacgugccugaccugaaucccgucauuaguggcuauauaaagagcguggggcagccauugugucucgaugucggagagaacaaucaggguggcaaaccccugaucauguacacgugccauggguuaggaggcaaccaguauuuugaauacuccgcgcaacacgagauuaggcauaauauccagaaggaacugugucuacacgcagcccagggucucgugcagcugaaggcuugcacuuauaaagggcacaagacaguugugaccggcgagcaaaucugggagauucagaaagaccagcuuuuguacaacccuuuccugaagaugugccucucugccaauggagaacauccaagccugguaucauguaacccgagugauccccuucagaaauggauacugucccaaaaugacuga

SEQ ID NO: 56547 - RNA, 1737 nt, Artificial Sequence
  derived and/or modified sequence opt3 from GALNT4__Homo_sapiens__NP_003765
auggccgugagauggaccugggcuggcaagagcugccugcuccuugcauuccugacagucgccuacaucuuuguugaguuguuaguguccacuuuccacgcgucugcuggggccggaagggcacgggaacuggguucacgccgacuaagugaccuccagaaaaacacggaggaucugagccguccccuuuauaagaaaccuccagccgacuccagagcucugggcgaaugggggaaggcaucuaaauugcaacucaaugaggaugaacugaagcagcaggaggagcugauugaaagguacgccauaaacaucuaucucucggaccggauuucauuacaucgccacaucgaggauaagagaauguacgaauguaaaagccagaaguuuaauuauaggacccugccgacaaccaguguaauuaucgcuuucuacaacgaggccugguccacucuuuugcggacaauacauucugugcuggagaccagccccgcgguccuacucaaagaaaucauucugguggacgaucuuuccgaccgcguuuaucugaagacucaauuggagacauacaucucaaaucucgaucgagugagacugauuaggaccaacaaacgggaaggauuaguccgugcacgccugaucggcgccacguuugcuacuggugacgugcucaccuuccuugauugccacugugagugcaauaguggguggcuggaaccuuugcuagagagaauaggaagggacgagacagccguaguuuguccagugauugauacuaucgacuggaacaccuuugaguucuacaugcagauuggcgaacccaugaucggcggguuugacuggcggcugacauuccaguggcauagcgucccuaagcaggaacgagaucgcagaaucucuaggauugacccaauacggucccccaccauggcaggaggucucuuugcugugucaaagaaauauuuccaauaccugggcacguaugauacugggauggagguguggggaggcgaaaaucuugagcugagcuuucgcgucuggcagugcggugggaaguuggagauccacccuuguagucacguuggacauguguucccaaaaagagccccguacgcgaggcccaacuuccuccagaauacagcccgugcagcugaaguauggauggacgaguauaaggaacacuuuuacaaccggaauccuccagcccgaaaagaggcuuauggcgauauuucugaaagaaagcuguuaagggagcgccugcggugcaaauccuucgacugguaccuaaagaacguguuucccaaucuccaugucccugaggauagaccaggcuggcacggggccaucaggagccgcggaauaucgucugaaugucuggacuacaacucccccgauaacaauccgaccggugcaaaccuuucauuguucggcugccacgggcagggaggcaaucaauuuuucgaguauacaaguaacaaggaaauucgauuuaauagcgugacugagcugugugccgagguuccugaacagaaaaacuacguggguaugcagaauugccccaaggacggguucccagucccugcuaacaucaucuggcauuuuaaagaggauggcaccauuuuccacccccauuccggacucugccugucugcguaucggacgccagaaggccgucccgacgugcaaaugagaaccugugacgcacuugauaagaaucagaucuggagcuuugagaaauga

SEQ ID NO: 56548 - RNA, 2823 nt, Artificial Sequence
  derived and/or modified sequence opt3 from GALNT5__Homo_sapiens__NP_055383
augaacagaaucaggaaguucuuucggggcagcgggcgcgugcuggccuucauuuuugucgcuuccguuauauggcuccuuuucgacauggcagcccugcgauugucuuuuucagagaucaauacccgugugauuaaagaagauaucguaagaagggagcggauuggauuccgcgugcagcccgaccaagguaagaucuuuuacaguagcauaaaagaaaugaagccuccauuaagaggccacgggaaaggagcguggggcaaggagaacgucaggaagacagaagaguccgugcugaaaguugagguggaucuagaccagacucagcgggaacgcaagaugcagaaugcucucggucgagggaaagucgugccgcuguggcaucccgcccaccuucaaacgcugccuguaaccccaaacaagcagaaaacagauggaagaggcacuaagcccgaggcaucuucgcaucagggcaccccuaagcagacaaccgcccaaggggcuccaaaaacuucauucaucgcagccaagggaacacagguugugaaaauuagcguccacauggguagggugaguuugaagcaggaaccccggaaaucccauucuccuagcuccgacaccucaaagcucgcugccgagcgugaucugaaugugacgaucagucugagcacugaccgcccaaaacagagaucucaagcggucgcaaacgagagggcccacccggcuuccaccgccguucccaagucaggcgaagcaauggcucucaauaagacaaaaacucagagcaaggaggugaacgccaauaaacacaaggcgaacaccaguuuaccuuuuccaaaauucacaguaaauucuaaccggcugcgaaagcaguccauuaaugaaacgccccuugggagcuugucgaaggaugacggagcccgcggcgcacaugguaaaaagcugaacuuuucugagucccaccuagugaucauaaccaaagaagaggagcaaaaggcugauccuaaagaagucucaaauaguaagacuaagacaauuuucccaaaagugcucggaaagagccaguccaaacauaucucuagaaacaggagcgagaugucaaguuccagccuggcuccccaccggguuccgcuuucucagaccaaccacgcccugacugggggcuuggaaccugccaagauuaauaucacagcaaaagcccccucaaccgaguauaaccagagucauaucaaggcucuccugccagaagacagcggcacgcaccaaguguuacgcauugaugucacccuguccccuagagaccccaaggcgccagggcaguuuggaaggcccgugguaguuccucaugguaaagagaaggaggcagaacgucgguggaaagagggcaauuucaacguguaccucucugaccuuauaccagucgaucgagccaucgaagacacaagaccggcugggugcgccgagcagcuggugcacaauaacuugcccacuaccucggucauuauguguuucguggaugaaguuuggagcacacuacugagguccgugcauucaguaaucaaucgcaguccuccacaccucauaaaggagauucugcuugucgacgauuuuucuacuaaagacuaucugaaggauaacuuggacaaauacaugagccaguuccccaaggugcggauccucagacugaaggagaggcacggauuaauccgcgcacgacuggccggcgcucaaaaugccaccggugauguucuaacauuucucgacucccauguggaaugcaacgucggguggcuggagccucuuuuggaacggguguaucugucacguaaaaagguagcauguccagugauugagguuaucaaugauaaagacaugagcuacaugaccgucgacaacuuccagagaggcauuuuuguguggcccaugaauuucggauggaggacuauaccgccugaugugaucgcgaagaaccgcauuaaagagacggacacaauccggugcccagucauggcuggcgggcucuuuucuaucgauaaguccuauuucuuugaacugggaaccuacgaccccggucuugauguuuggggcggggagaauauggaacugaguuucaagguguggauguguggaggcgagauugaaauaaucccuugcagcagagugggucacauuuuuaggaacgacaaccccuacucuuucccaaaagaucgaaugaagacuguagagcgcaauuugguccggguggccgagguuuggcucgacgaauauaaagagcuguuuuacgggcauggcgaucacuuaaucgaccagggacuggaugugggcaaccuaacccagcaaagagaacucaggaagaaacugaaguguaaguccuucaaaugguaucuugagaaugucuucccugacuugcgugcacccauugugcgcgccucagggguucugaucaacguggcucucggaaagugcauaaguaucgaaaauacaaccguaauucuggaggauugugacgguagcaaagaguuacagcaguuuaacuacacuuggcugcggcuuaucaagugcggcgaaugguguauugccccaaucccggacaaaggggcagucagauugcacccuugcgauaauaggaacaagggacucaaguggcugcauaaaucgacauccguguuccaccccgagcuagugaaucauauagucuuugaaaacaaucagcaacugcucugccuggagggcaacuucucucagaagauucuuaaaguugcugccugugacccagugaagcccuaucagaaauggaaguuugaaaaauacuaugaggcguga

SEQ ID NO: 56549 - RNA, 1869 nt, Artificial Sequence
  derived and/or modified sequence opt3 from GALNT6__Homo_sapiens__XP_006719277
augagacugcucaggcggcgccacaugccccuucgacuggccauggugggcugcgcuuucgucuuguuuuuauuccugcuacaucgugacguuagcuccagagaggaagcaaccgagaagccuuggcucaaaucucuggugucaaggaaggaucacguacuugaccugauguuggaagccaugaacaaucuccgggauaguaugccaaaacugcagauccgcgcgccggaggcucaacagacacuguuuagcauuaaccaguccugucuccccggguucuacacuccugccgaauuaaagccauuuugggagagacccccucaggacccaaaugcacccggagccgaugguaaggcuuuccaaaaaucuaaguggacgccucuggagacccaggaaaaagaggaaggcuauaagaaacauugcuuuaacgcauucgccucggacaggauaucacuucagcggagcuuggggccagauacacgcccgcccgaguguguggaccagaaguuucgaagaugcccuccacuggcuacuaccagugucaucauuguguuccacaaugaggccugguccacacuacucaggaccguuuacucugugcugcauacuacacccgcgauccuucugaaagaaauuaucuuggucgaugacgcaagcaccgaggaacaccucaaggagaagcuggaacaauaugugaaacaguuacagguaguucgggugguccgucaggaggagcgcaagggacugauaacggccagacuccuuggcgcuuccguggcccaagcagaagugcugacuuucuuggaugcucacugugagugcuuccaugguuggcuagaaccucugcucgccaggaucgcggaggacaaaaccgucguugugucaccagauauuguaacaaucgaccugaacacuuuugaauuugccaagcccgugcagcgggggcgaguccacagucgcggaaauuucgacuggagccuuaccuuuggcugggagacacugccgccucaugagaaacagagaaggaaggaugaaaccuaccccauuaaaucuccaacguucgcaggcggguuguuuuccaucucaaagagcuauuucgagcacauaggaacuuacgacaaccaaauggaaauuugggguggcgagaauguggaaaugaguuuucggguuuggcagugugggggacagcucgagaucauuccuugcucuguggucggccacguguuccgcacaaagagcccccauaccuuuccaaaagguacuuccguaaucgcuagaaaccagguuaggcuggccgagguguggauggauucguauaagaaaaucuucuaccgucggaauuuacaagcugccaagauggcacaggaaaaaucuuuuggggacauuuccgagcgacugcagcuaagagaacagcuccacugucauaacuucucaugguaccugcacaaugucuaucccgagauguuugugccugaucuuacaccaaccuucuacggagccauaaagaacuugggcacgaaucaaugccuggacgucggcgagaacaaccgcgggggaaagccgcucaucauguauaguugucauggucugggcgggaaucaguacuuugaauauaccacacagagggaucuucggcacaacauugcuaaacagcugugcuugcacgugagcaagggagcgcucggccuggguuccugccauuucacugggaaaaauucucaaguucccaaggacgaggaaugggaguuagcacaggaucagcugaucagaaacagcggcucaggaaccugucuaacaagucaggacaaaaagccugccauggcuccaugcaaucccuccgauccucaccaacucuggcuguucguguga

SEQ ID NO: 56550 - RNA, 1974 nt, Artificial Sequence
  derived and/or modified sequence opt3 from GALNT7__Homo_sapiens__NP_059119
augagacugaagaucggcuucauucucaggagccuucugguggucggguccuuuuugggauuaguugugcuguggucuucacuaacaccccggccugacgauccaaguccgcucagccgcaugcgagaggaccgugauguaaacgaccccaugccuaauagagguggcaacgggcuggccccaggagaagauagguucaaacccguggucccuuggccacacguggagggcguugaaguggaccuugaguccauacggcgcaucaauaaggcuaaaaacgaacaggagcaucacgccgguggggauucucaaaaggacauuaugcagagacaguaccugaccuuuaaaccccagacuuucacguaucaugauccugucuugaggccaggaauccucggcaauuuugagccgaaggaacccgagccuccaggcgugguagggggacccggugaaaaggcaaaaccucugguucugggcccagaguucaagcaagcgauucaggcuucgaucaaagaguuuggguucaacaugguggccucagacaugauaagccucgaucggagugucaaugacuuacgccaggaagagugcaaguacuggcacuaugaugaaaaccugcuuaccuccucuguggugaucgucuuucauaaugagggauggagcacauugaugcgaacuguucacuccgugauuaaaagaacccccaggaaguaccuggcagaaaucguacuaauugacgacuucucaaacaaggagcaccucaaagagaagcuggaugaauauaucaaacuuuggaauggccuggugaaggucuuucggaacgagcgucgcgaagguuugauacaggccagaaguauuggggcucaaaaagcaaagcucggacaggugcugaucuacuuagacgcccauugugagguugcugugaauugguaugccccgcuggucgcgccuauuagcaaagauaggacaaucugcaccgugccccucaucgacguaauuaacggcaauacuuacgaaauaaucccacagggcgggggagaugaggacgguuacgcacggggcgccugggauuggucuaugcuuuggaagcgaguuccucugacaccccaggagaagcgcuugagaaaaaccaagacggaaccauauaggucccccgcuauggccgggggacuauucgcaauugagcgggaauuuuucuucgagcugggccucuacgacccuggucugcaaaucuggggcggggaaaacuuugagauaucauauaaaauuuggcaguguggaggcaaacuucuguucgugccaugcagccgcgucgggcacaucuacagauuggagggauggcaggguaacccgcccccuaucuaugugggcaguucuccaacucucaagaauuacgucagggugguugaaguguggugggaugaguauaaggacuacuuuuacgcuucccgucccgaaagccaagcccugccuuauggggauauuucggaguuaaagaaauuccgggaggaccauaacuguaagucuuuuaaaugguucauggaagagaucgcguacgacauuaccucccacuauccacugcccccgaagaauguagauuggggagaaauacgaggcuuugagacagccuacugcaucgacucaauggguaaaacuaacgggggcuucgucgaacuaggaccuugucacagaaugggcgggaaucagcucuuuaggauuaacgaggcaaaucagcugaugcaguaugaucaaugccuuaccaagggagcugacgguaguaaggugaugaucacacauuguaacuugaaugaguucaaagaauggcaguacuuuaagaaccugcaccgcuucacccauaucccaagcggcaaaugccucgaucgguccgagguucugcaccagguguuuauuucuaauugugacagcucaaagacgacucagaaaugggaaaugaacaauauacauagugucuga

SEQ ID NO: 56551 - RNA, 1914 nt, Artificial Sequence
  derived and/or modified sequence opt3 from GALNT8__Homo_sapiens__NP_059113
augauguucuggagaaagcugcccaaagcccucuuuaucggccuuacccuggcuauugcagugaacuuguuacuggucuucagcuccaaggggacacuacagaaucucuuuacuggaggucugcacagggagcuuccucugcauuugaacaaacgguacggcgccguuauaaagcgccucucucaccuggaaguggagcugcaagaccucaaagaaucaaugaaguuagcgcugcgacagcaggagaauguaaacaguacgcuuaagcgugcuaaagaugaagugagaccauugcugaaggccauggagaccaaagucaaugagacaaagaaacauaagacucagaugaagcuauucccgcacagccaacucuuuaggcaguggggagaagaccuguccgaggcacagcagaaagccgcucaagaucuuuuccggaaguuuggguauaacgcauaccugucuaaucaguugccccucaaccgcaccaucccugacacaagagauuauaggugccugcggaaaaccuacccaucgcaguuacccucacugagcgugauucucaucuucguuaaugaagcccuuaguauuauccagcgcgcuauaacuuccaucauuaaccgaacaccuucuagacuguugaaggagaucauucuaguggacgauuuuagcuccaauggcgagcugaaaguccaucucgacgaaaagaucaaacuguauaaccaaaaguacccaggucuucugaagauaauuaggcaccccgagcggaaaggguuggcccaggcgcguaauaccggaugggaagcagccacggcugaugugguagccauccucgacgcacacauugagguuaacgugggcugggcugaaccuauccuggcccgcauccaggaggauagaacugucauugugucaccaguguucgacaauauaagguuugauaccuucaaguuagacaaauaugagcuggcggucgacggcuuuaacugggaacuauggugucgguacgaugcccucccgcaagcauggaucgaccugcaugauguuacagcucccgugaagaguccuagcauuauggggauccuugccgcuaaccgacacuucuugggagagauagguucucuggacggcgggaugcucauuuacggaggcgaaaauguagagcugucccuucgcguguggcagugcggugggaaagucgaaauccugccauguucaagaaucgcccauuuggagaggcaccacaagcccuaugcacucgaucugacugccgcuuuaaagcggaacgcgcugcgcguggcagagauuuggauggacgaacauaaacacaugguuuaccuagccuggaauaucccucuccagaacagcggaauugauuucggcgacgugaguucuagaauggcucugagggagaaacuuaagugcaagaccuuugauugguauuugaaaaaugucuacccacugcucaagccccugcauacaauagugggcuaugggcguaugaagaacuuacuggacgaaaauguaugucuugaucagggaccgguuccugguaacacccccaucauguacuauugccacgaguucuccagccaaaauguguacuaccauuugacgggcgaacucuaugucgggcagcugauugccgaggcaucggccucugaccggugucuaacugacccaggaaaagcugagaagccuacacuggaacccugcuccaaagccgcaaagaaccgacuccacaucuacugggauuuuaaaccaggcggugcggugaucaauagagacaccaagaggugucuggagaugaagaaagaucuuuuggggucacacguccugguguuacagacuugcaguacacagguuugggaaauucaacauaccgugcgcgacuggggccagacgaacagccaguga

SEQ ID NO: 56552 - RNA, 1812 nt, Artificial Sequence
  derived and/or modified sequence opt3 from GALNT9__Homo_sapiens__NP_001116108
auggccguggcuagaaagaucaggacccugcucacagucaacauucuuguuuucgugggcauaguacuguuuagcguguacugccgguugcaggggcgcucccaagaguuaguccgaaucgugucuggagaccguagaguuaggucacggcacgcaaaaguggguacucugggcgaucgcgaagccauucuacagagacucgaccaucuggaggaagucguguauaaucagcuuaacgggcuggcgaagcccaucggauugguagagggcccuggugggcucggacagggcggccuggcugccacgcugagggaugacgggcaagaagcagagggaaaauacgaggaauaugguuacaaugcccagcucagugaucggauuagcuuagaccgcuccaucccagauuaucgaccgagaaaguguaggcagaugucuuacgcucaggaccugccccaaguuucgguggucuucauauuugugaacgaggcacuuucagugaucuugcggagcguccacaguguugugaaucauaccccuucccagcugcuaaaagaaguaauucucguggaugacaacucugauaaugucgagcugaaguucaaccuugaccaguaugugaauaagcguuacccaggccugguuaaaaucgugcgcaacagcagaagggagggguugauucgggcccgacuccagggauggaaggcugccacagcgcccgucgugggcuuuuucgaugcacacguagaauuuaauacugguugggccgagccugcucugucccgcaucagagaagacaggcggcgcauaguuuuaccagccauugacaacaucaaauacucaaccuucgaggugcaacaguaugcaaaugcugcccauggguacaacuggggacuguggugcauguauauuauucccccucaggauuggcucgacagaggcgaugaaagugcgccaaucaggacaccggccaugaucggcuguagcuuugucguggaccgugaguacuucggggauauaggacuucuggaccccgguauggaggucuauggcggggaaaauguggaguugggaaugcggguuuggcaaugcggcgguucuauggaagugcuaccuuguucccgaguagcacacaucgagagaaccaggaagccauacaacaacgauauugacuauuacgcuaaacgcaaugcccugcgggcugccgaagucuggauggaugacuuuaagucacacguguacauggcauggaacauccccaugagcaauccugggguugauuucggcgacgugagugagagacucgcccugaggcagcgccuuaagugccgaucuuuuaaaugguaucuggagaacgucuacccagaaaugcggguguauaauaacacuuugacauacggagagguacguaauuccaaggcuagcgcguauugucucgaccagggcgcagaagauggggacagagccauacuguaccccugccauggaaugucgucucaguuagugagguauuccgcugauggucugcuacaacucggcccgcuggggucaaccgccuuccuuccugacaguaaauguuugguugaugacggaacgggccgcaugcccacucugaagaaaugcgaggaugucgcacggccaacccagagacucugggacuucacacagagcgguccuauuguguccagggccacugggcgaugucuggaaguggagaugucuaaggaugcuaacuuuggccuucgccuggucguucagcggugcagcggacaaaaauggaugaucagaaauuggaucaagcacgccaggcauuga

SEQ ID NO: 56553 - RNA, 1806 nt, Artificial Sequence
  derived and/or modified sequence opt3 from GALNTL6__Homo_sapiens__NP_001030017
augaagagaaaacagaagagguuccugcaaaugacccuccuuuuuacaguggcccugaucuucuugcccaacgucggcuuauggagccuguacaaagacaagcaccuaguuaaauccgcugagccuggggaacagcagacuuuuccacucggacugggugauggccaguucuauucuuggacggacgggcuucggcgcaaggauuggcaugacuacgagucaauucaaaaggaagcaaugcgaaguggaaaaggcgagcacgguaagccguauccccugaccgaagaggaucaugacgauagcgccuaccgugagaauggguuuaacauauucguguccaauaacaucgcguuggaaagaucucucccugacauuaggcacgcuaauugcaaacauaagauguaucuggagcggcugccaaacacaucgaucauuauccccuuucacaaugaaggauggacuucacucuuacgcaccauacacagcaucauuaacagaacaccuggcagucugaucgccgagauuauccuuguagaugacuucuccgagagggaacauuugaaagauaagcuggaggaauacauggcacgguuuucuaaggugcgcauaguccgaaccaaaaagagagagggccuaauuaggacucggcuccugggggccagcauggcucguggagaagugcuuacauuccuggacucccacugugagguuaaugugaacugguugccaccccuccugaaucagaucgcauuaaaccauaaaaccauugucugcccuaugaucgaugugaucgaccacaaucacuuugguuaugaggcccaggcuggcgacgccaugcgcggggcguucgauugggaaauguacuacaagaggauuccaauaccgcccgagcugcagagagcagacccuucagauccauuugaaagucccguaauggccggaggccucuucgcuguugaccggaaaugguucugggagcuugguggguaugauccuggacuggaaaucuggggcggcgagcaauacgagauuagcuuuaagguguggaugugugggggagaaauguucgacgucccaugcucucgagugggucauaucuaucgcaaauacgugcccuauaaggucccguccggcacgucauuggccagaaaccuaaagaggguugcagagacuuggauggaugaauuugcugaguacauauaucagcggcgcccugaauacagacaccugagcaccggggacauuagugcccagaaagagcucaggaagcagcugaaauguaaggauuucaaaugguuuauggcggccguggcaugggacguacccaaguacuauccaccuguggagcccccacccgcugccuggggagaaauccguaaugucgcugccaaccuuugcguggauucuaagcauggcgcaacagguacugagcugcgguuggacaucuguguuaaagacggguccgaacgaaccuggagccacgagcaacucuucacauuuggcuggagagaggauauuaggccuggagaaccacugcauacccgcaaguucugcuuugacgccaucucgcacaacucuccggugacguuauacgauugucacggcaugaaagggaaucagcuguggggauaucggaaggacagaacucuauuccaucccgucuccaacucaugcauggauuguaauccugcugagaaaaagauuuuuauggcgaggugcgacccacucagugaaacacagcaauggauauucgagcacaucaacaugaccgugcuggaaaaguuuaaucaucacgcaaacagcuga

SEQ ID NO: 56554 - RNA, 150 nt, Artificial Sequence
  derived and/or modified sequence opt3 from GALP__Homo_sapiens__NP_001139018
auggcucccccuagcgugccacugguccuccuucugguuuuguuacugucccuagccgagaccccggcaucugcccccgcgcacagaucaaguacauucccuaagugggugacuaaaacggaaaggggccggcagccacuccgcagcuga

SEQ ID NO: 56555 - RNA, 1050 nt, Artificial Sequence
  derived and/or modified sequence opt3 from GALR1__Homo_sapiens__NP_001471
auggagcuggccgugggcaaccucagcgaagggaaugcuuccuggcccgagccuccagcaccggaacccggaccucuuuucgguaucggcgucgagaacuuuguuacccuggugguauucggguugauuuuugccuuaggagugcugggcaauucucuagucauaacagugcucgcgagaucaaagccagguaaacccaggaguacuacgaaccuguucauccuuaaucugagcauugcugacuuggccuaccuccuguuuugcaucccuuuccaggcaaccguuuaugcccugccaacaugggugcucggggcuuuuauuuguaaguucauccacuacuuuuucacugucuccauguuagugucuauauuuacccuggcagccaugucgguagaucgguauguugcuaucgugcauucacgccgaagcaguucccuucgugucucuagaaacgccuugcugggagugggcugcauuugggcgcuaagcaucgcaauggccucccccguggcuuaccaccaaggccucuuccauccuagggccucaaaucagacauuuuguugggaacaguggccagacccgcggcacaaaaaggcauaugucguuugcaccuucguguucggguaccugcuuccccuguugcucauuuguuuuugcuaugcuaaaguacugaaccauuuacacaagaagcugaaaaauaugaguaagaaaagcgaggccucuaagaaaaagacugcgcagacagugcucgucgugguuguggucuucggaaucuccuggcuuccucaccauauaauucaccugugggccgaguuugguguguucccauugacccccgcaucauuucuauuccgcaucacggcucauugucuggccuacagcaacaguucuguaaauccuauuaucuacgcuuuucucuccgaaaacuucagaaaggccuauaaacaaguuuuuaagugccacaucaggaaagauagccaccugucggacacuaaggagucuaaaucccggauugauaccccacccucaacaaauuguacucauguguga

SEQ ID NO: 56556 - RNA, 1164 nt, Artificial Sequence
  derived and/or modified sequence opt3 from GALR2__Homo_sapiens__NP_003848
augaacgugagcggcugccccggggccggaaaugcuucccaggccgguggcgggggaggcuggcacccugaggcagucaucguuccacuacucuucgcgcuuauuuuucugguggguaccguagggaacacauugguguuagcuguccugcuaagaggaggccaagccgugucuacuacgaaucucuucauacugaaccuuggcguugcagaccuguguuuuaucuugugcugugugccguuccaggccaccauuuacacacucgaugggugggucuuuggaucacugcugugcaaggcugugcauuuccucaucuuuuuaacuaugcacgcaaguagcuucacccuggccgcuguaucccuugacagguauuuggccauucgguacccccugcauucucgcgaacuacgaacaccucguaaugcgcucgcagccaucggucugauauggggccuuucgcuguuguuuucagggccauaucucagcuacuauagacagagucagcuggcuaacuuaaccguuugucaccccgccugguccgcaccuaggcggcgcgcuauggauaucugcacuuucguguuuucuuaccugcucccaguccuugugcugggauugacauaugccagaacccuaagguaccuguggcgggcgguggaccccgucgccgcaggcagcggugcucgccgagccaaaagaaagguuacgaggaugauucucaucguggcugcccuguucugucuuugcuggaugccucaucacgcacugauuuuguguguaugguuugggcaauucccacucacucgggccaccuacgcucugcguaucuuaucccaccuggugucauaugcgaauaguugcgucaacccgauaguguacgcacugguuagcaaacauuuccgcaagggauuuagaacaauuugugccggccuccugggcagggcucccgggcgggccucuggacgagugugcgcagccgcucgcgguacucacuccggcucaguccuugagagagaaagcagugauuugcugcauaugucugaggccgcaggggcgcucaggccuugcccaggagcuucccagcccuguauccuggaaccuugcccaggccccagcuggcaggguccgaaagccggggacucgauucuuaccguggauguagcauga

SEQ ID NO: 56557 - RNA, 1107 nt, Artificial Sequence
  derived and/or modified sequence opt3 from GALR3__Homo_sapiens__XP_011528770
auggccgacgcucagaacaucagccuggauucccccggcucugugggggcagucgccguuccugugguauucgcgcucauuuuucuucugggaaccguggguaauggcuuggucuuagcugugcugcuacaaccagggccgucagccuggcaggagcccggaaguacaacugaccucuucauacugaaccuugcaguugccgaucugugcuuuaucuuguguugcgugccuuuccaggcuacgauuuacacccucgacgcauggcuguuuggcgcccuggucuguaaggcugugcaccucuuaaucuaucugacaauguacgccagcuccuucacucuugcggcaguaucuguugauagauauuuggccgugaggcauccacugcggucgcgcgcucuacgaacccccagaaaugccagagcagcugucggucucguguggcugcuugccgcgcuguuuucagccccuuacuugagcuauuacgggacagugagguauggagcacucgaacugugcgucccagcuugggaggacgcccggcgcagagcuuuagauguugccaccuucgcagccggcuaccugcuccccguggcuguagugagucuugcguacggcaggacucugcgguuuuugugggcagccgucgggccugcuggagccgcagccgcugaagcccgccgacgugcaacagguagggcgggccgggcuaugcuagccguggcagcccuguaugcucucuguugggggccacaccaugcccugauucuuugcuucugguacggacguuuugcauucuccccggcuaccuaugccugucgccuggcgucucacugcuuggccuacgcuaacagcugucucaauccccugguuuaugcauuagccuccagacauuuuagggcucgguuccgacgccuguggccuugcggcagaaggcggcgccacagagccaggcgugcacuacggcgagugagaccagcgucaaguggucccccuggguguccaggagacgccaggcccagcggccgccuccuggcuggcgggggacaggguccggagccucgggaaggccccguccacgggggagaggccgcaagaggcccagaguga

SEQ ID NO: 56558 - RNA, 1140 nt, Artificial Sequence
  derived and/or modified sequence opt3 from GALT__Homo_sapiens__NP_000146
augagcagauccggcaccgacccccagcaaaggcagcaggccucugaggcugaugcagccgcggcuacauuccgggccaacgaccaccagcauauccgcuacaauccucugcaagaugaaugggugcucgucucagcacaccgaaugaagcguccauggcaggggcagguugagccgcagcuucugaaaacugugcccagacaugacccuuugaacccauuaugccccggagccauuagggcuaauggugaaguaaacccucaauaugauaguacguuucuguucgacaaugauuuuccagcacuacagcccgacgccccuagcccaggcccguccgaucacccccucuuccaggcuaagucugcccgcgggguguguaaagucaugugcuuucauccuuggucggacgugacccugccacuuaugucaguucccgagauacgggcgguggucgaugcaugggccagcgugacagaagaguugggagcucaguacccuuggguacaaaucuucgagaacaagggcgccaugauggguuguaguaauccacacccccacugccagguuugggcauccaguuuucugccggacauugcucagagagaagagaggagccaacaggccuauaaaucccagcauggggaaccucuccugauggaguacucacggcaggagcugcuccgcaaggaacgauuagugcugacuucugagcacuggcuugucuuggugcccuucugggcgaccuggccauaucaaacacugcuacucccuagaaggcaugugcggcgucugcccgaacuuaccccagccgagcgcgaugaccuggcaagcaucaugaagaaauugcucacuaaguacgacaaccuguuugaaacaucuuuccccuauuccaugggauggcacggcgcuccuaccggcucagaggccggggcuaauuggaaccacuggcaguuacaugcccacuacuacccaccgcugcucagaagcgcaacggucaggaaauuuaugguuggauaugagaugcuugcccaggcucagcgggaucugacucccgaacaagcggcagagcgauugcgcgcccuaccugaagugcauuaccaccugggucagaaggacagagagaccgcuacaauugccuga

SEQ ID NO: 56559 - RNA, 711 nt, Artificial Sequence
  derived and/or modified sequence opt3 from GAMT__Homo_sapiens__NP_000147
augagcgcccccuccgcuaccccuaucuucgcaccaggcgagaacugcucuccggccuggggagcggcucccgccgcauacgacgccgcugauacacaccugagaauacucgggaagccugugauggaaaggugggagacuccauauaugcaugcacuugccgcugccgcgucaaguaaagguggccggguccuggaaguuggguuuggaauggcaauagccgcuagcaaggugcaggaggcccccaucgacgaacacuggauuaucgaguguaaugauggcguauuccaacgcuugcgagacugggcaccucgucagacgcauaaagugauuccauuaaagggucugugggaggaugucgcucccacccuaccugacgggcacuuugauggaauccucuacgacacauauccacuguccgaagagacuuggcauacccaccaguucaacuuuauuaaaaaucacgccuucagacuucugaagccgggcggcguguugacauacugcaaccucaccucuuggggagaacugaugaagucgaaauauucagauaucacuauuauguuugaggagacacagguucccgcgcugcucgaagccggguucaggcgggagaauauccgcaccgaagugauggcauuagucccuccagcugacuguagauacuaugccuuuccccaaaugauuacgccucuggugacuaaggguuga

SEQ ID NO: 56560 - RNA, 2544 nt, Artificial Sequence
  derived and/or modified sequence opt3 from GANAB__Homo_sapiens__NP_001265123
augaccagauucaggaucgacgagcuggaaccccggcgcccucgauaccgugugccagauguccucguugccgacccgcccauugcuagacuuagcguguccggcagggaugagaacucuguagaacugacaauggcagaggggccuuauaagauaaucuugacugcccggccauuucgcuuagaccugcuagaagauagaucacuccugcuuagugugaaugcgaggggacuguuggaguucgagcaccagcgggcuccccgcgucagccaagguuccaaagacccugccgaaggcgauggggcacagccagaggaaacgccccgagacggagauaagccugaggagacccagggcaaagccgaaaaggacgagccaggugcuugggaagagacauuuaaaacucauucugauucgaagccguacgggcccaugucagugggacucgacuucagccugccuggcauggaacacguuuauggcauuccagagcaugcagauaaccugagacucaaggugaccgaagggggagaacccuacagguuauauaaucuggacgucuuucaguacgagcuuuauaacccuauggccuuguacgguagugugccaguacugcuagcucacaauccccaucgggaccucggcaucuucuggcugaacgccgcggaaacauggguugauauuuccucuaauaccgcagggaaaacucuuuuuggaaagaugauggacuaccugcaaggcagcggugagacaccgcagaccgaugugcguuggauguccgaaacggggaucauagacgucuucuugcuccugggaccuucaaucagugauguguuucgccaguaugccagcuuaacuggcacccaggcucugcccccacucuucucucuuggcuaccaccaauccagauggaacuauagggacgaggccgaugugcuggaggucgaccagggguuugaugaccacaauuugccuugcgauguuauuuggcuagacaucgaacaugcagacggaaaacgguacuucacaugggaucccucacgauuuccacagccccgcacuaugcuggagagacucgcuagcaagaggcggaaacugguggccauuguagacccucacaucaagguggauagugguuaucgcguccaugaggagcuuagaaaccugggcuuguacgugaagaccagggacgggucugauuaugaaggaugguguuggccaggcuccgcggguuacccggacuucacaaaucccaccaugcgugccuggugggcaaacauguucagcuacgauaauuaugaggggucggcuccuaaccucuuuguuuggaaugacaugaacgagccaucuguguucaacggccccgaagucacgaugcugaaagaugcccagcacuacggaggcugggagcaccgggacgugcauaauauauauggguuauacguacacauggcuacugccgauggacugcgacaaagauccgguggcauggaaaggccuuuuguucuagcacgcgccuucuuugcugggucacagcgguucggagcgguguggacaggcgacaacaccgcagagugggaucaucucaagauuaguaucccaaugugccugagccuugguuuggucgggcuguccuuuuguggcgccgacgugggaggcuucuuuaaaaaucccgagccggaacuccuggucagaugguaucagaugggggcuuaccaaccuuucuuuagggcccacgcacaucuugacacuggacgccgagagccauggcuguugcccucucagcacaacgauauuauccgggacgcccucggucagcguuauagccuguuaccuuucugguacacacugcuauaccaggcucacagagaaggcauccccgugaugaggccacucuggguucaauauccucaggaugugaccacguuuaauauugacgaucaguaccugcuuggggacgccuugcugguacaucccgucucagauaguggagcacacggcgugcagguuuaucucccaggucaaggggaggugugguacgacauacaguccuaucagaagcaucacggcccgcagacccuguacuuaccugucacacugagcucuauccccguguuccaacgcggaggcacuauuguaccacgguggaugagagugaggcgaucaagugaaugcaugaaagaugaccccaucacccuuuucguugcguugagcccucaggggacagcucagggagagcucuuucuggaugacggccacacuuucaacuaucagacccgccaagaguuucuacugcggagauucuccuuuucugguaauacacucgucucgagcuccgccgauccagaagggcauuucgagacccccauauggauugaaaggguggugaucaucggagcaggcaagccugccgcugucguucugcagacuaaagguucaccggagagucgucuuucuuuucagcacgacccagaaacgagcguguuggugcugcgcaagcccggcauuaacguagccuccgacuggucaauccauuuacgguga

SEQ ID NO: 56561 - RNA, 849 nt, Artificial Sequence
  derived and/or modified sequence opt3 from GANC__Homo_sapiens__NP_001288339
auggaggccgcugugaaggaagagaucagccuggaagacgaggcagucgauaaaaacauuuucagagacugcaauaagauagccuuuuacaggcggcagaaacaauggcucuccaagaaaucuaccuaucaggcgcuucuggauucaguuacaacugacgaagauaguacgcgcuuccagaucauuaacgaggcuagcaaggugcgaugucaggaccaaucccccaccacauuggaugccuuuaagggcaaagagacuaccguacaggaagagacacaggacuuaucuacccgucagcaccuggcacaaaaggaagccgaggagccugauaaacaggggcagaucacuugggacauuucgaauguggcuccaaagacagaaaacuucgaggaucuacucgaacagaccccgugcucagcaugucugcaaggauuuacgagagacaauacuagcaguuccuucucugaggaugccgguaucagccuuuccaccucagucaaacugcccuuggcuaguagcucuaagccuaacgaaaaugaggcccucccaaaccagcccccuucccagcaaauaaggcauaauuaccggcugcuggcgucaacagugagcgcagagauggcccgcaacagacagcucaucugggaauuagcuaggcagagugaggcccaccuggaccggccaguugugcuuggcgaacaggcaucugcucaacgcgaggucgccuccauuuugugccgaaagagcgugcuggcgaucaaucagcuagccgcaacuguagaagggaccauuucgguucuccagcaguuuaacgagcugcuugaccauccccuggauccuggaagaucuuga

SEQ ID NO: 56562 - RNA, 1794 nt, Artificial Sequence
  derived and/or modified sequence opt3 from GAN__Homo_sapiens__NP_071324
auggccgaaggcagcgcuguguccgacccccagcacgcagccagacugcucagggcgcuuucuucauuccgggaagagagucgcuuuugcgaugcucaucuggucuuggacggggaagagaucccuguucaaaagaacauuuuagccgcagccagcccauacauacgaaccaaacugaauuauaacccgcccaaggaugacggauccacauacaaaaucgaacuagaggguauuucugugaugguaaugcgugagauccucgauuauauuuucucgggccagaucagacugaaugaagacacuauacaggaugugguccaggcugcagaccuucuguugcucacggaucugaagacccuguguugcgaguuucucgaaggguguaucgccgcugagaacugcauuggaaucagggacuucgccuuacacuacugucugcaucacgugcauuaucuugcgacagaguacuuggaaacucacuuucgggauguuucaagcaccgaggaguuccuggaacuaaguccucaaaaacucaaggaagugauuucccuggagaaacuuaaugucggcaacgagcgcuauguguuugaagcaguaaucagauggauagcccacgacacagagauuaggaagguucauaugaaggaugugaugucugcucugugggucagcgguuuggacuccucauaccuccgggaacagaugcugaaugagccauuagugcgcgaaaucgugaaagagugcaguaacauuccccugagccagccucagcaaggggaggccaugcucgcaaauuucaagccacgaggauacucugaauguaucgucaccguuggcggcgaggaaagaguguccaggaaacccacugcugccaugcggugcauguguccucuuuaugacccaaaccgucagcuguggaucgaguuggcgccgcuaucaaugccccgcauuaaucacgggguacugagcgccgaaggauuucucuucguguuugguggccaggaugagaacaagcagacacugaguucuggggagaaguacgacccugaugcaaauaccuggacggcccuuccacccaugaacgaagcuagacauaauuucggaauagucgagaucgacggcaugcuguauauuuuggguggggaagauggagagaaagagcucaucuccauggaaugcuacgacauauauagcaagacuuggaccaaacaaccugaucugacaauggugaggaagauuggcuguuacgcugccaugaaaaagaaaaucuaugcaaugggcgggggaucguacgguaaguuauuugagucuguugaaugcuacgacccacggacucagcaguggaccgccaucugcccccugaaggagcgacgcuucggcgcuguggcguguggggucgcaauggaacuauauguguucggaggcguaagauccagggaggaugcccaagguucagagaugguuacaugcaaaagugaauuuuaccacgacgaguucaagcgguggauuuaucucaacgaucagaaccuguguaucccggcuagcuccucuuuuguguacggggccgucccuauuggcgcaagcauauaugugaucggagaccuugacaccggcacgaauuacgauuauguccgcgaguucaaaagaucaacugggacauggcaccauaccaagcccuugcugccaagugaccucaggcguacuggaugcgccgcucugcggauugccaacuguaaacuuuuucgacugcaguugcagcaaggucucuucagaaucagggugcacuccccuuga

SEQ ID NO: 56563 - RNA, 825 nt, Artificial Sequence
  derived and/or modified sequence opt3 from GAP43__Homo_sapiens__NP_001123536
augaccaagagcugcuccgagcugugucaccccgcccuccauuuccuuccuugccugggcggguugaggaaaaacuuacagagagcugugcggccaucuccguacucacugggauuucuaacauucuggaucagucgcgucgaaaagaaugacgaugaccagaaaauugagcaagaugguauaaagcccgaagacaaagcacacaaggccgcgacuaagauccaggcuagcuuucgaggccauauuacgcguaaaaagcucaaaggggagaagaaagaugacguucaggccgcagaagccgaggcuaacaagaaggaugaggcaccuguggccgacggaguagagaaaaagggcgaggguaccacaacugcugaagccgcgccagcaaccggguccaaacccgaugagccuggaaaggccggcgagacaccaucugaagagaaaaagggcgaaggggacgcugccaccgagcaagcagcuccccaggccccugcgucgucagaagagaaagccggaagcgcagagacugaaagugcuacaaaggccuccaccgauaauucuccaagcuccaaggcugaggacgccccggcaaaagaagaacccaagcaggccgaugugccugcugcggucacggcagccgcugccacuaccccagcagccgaagacgcugccgcaaaagcgacagcucagcccccuacugagaccggugagucaagucaagccgaagagaacaucgaagcaguggacgagacaaagccaaaagaaagcgccagacaggaugagggcaaggaggaggaacccgaagcugaccaggagcacgccuga

SEQ ID NO: 56564 - RNA, 882 nt, Artificial Sequence
  derived and/or modified sequence opt3 from GAPDH__Homo_sapiens__NP_001243728
augguguacauguuccaguaugacagcacccacggcaaguuucaugggacagucaaagccgagaacggaaagcugguuaucaaugguaaccccauuacuauauuccaagaaagagauccuuccaaaaucaaguggggcgacgcuggggcagaguacgugguagaaucuacgggaguguuuaccacaauggagaaagccggcgcgcaccuccaggguggggcuaagagggucauuaucucagccccaagugcagaugccccgauguucgugaugggaguuaaucaugaaaaguaugacaacagccuuaaaauuaucuccaaugcuucuugcacuaccaacugucuggcacccuuggccaaggugauacacgauaauuuuggcaucgucgagggcuuaaugacaaccgugcaugcuauuacugccacacagaaaaccguagacgggccuucgggaaagcuguggcgggauggucgcggcgcgcuacagaacaucauuccagcaucaacgggggccgcuaaagccguuggaaaggugauccccgagcucaauggcaagcugacugguauggcauuccgagucccuaccgcuaacgugagcguggucgaccuuacaugccgucuggaaaaaccagccaaguacgaugacauuaaaaagguugugaaacaagcgagugaggggcccuugaagggaauacucggcuauacugaacaccagguaguguccucugauuuuaauagcgacacccacuccucaacauucgaugccggcgcagggaucgcucugaacgaccauuuugucaaacugauuaguugguacgacaaugaguucggauauagcaacagagugguugaucucauggcccacauggcuucuaaggaguga

SEQ ID NO: 56565 - RNA, 1227 nt, Artificial Sequence
  derived and/or modified sequence opt3 from GAPDHS__Homo_sapiens__NP_055179
augagcaagagagacaucgugcugaccaacgucacaguugugcagcuccuuaggcaacccugcccuguaacucgggccccaccgcccccugagccaaaagcugaaguggagccccagccucagccagaacccacgccuguccgcgaggaaauuaagccaccgcccccuccacugcccccucacccagcaacacccccgccuaaaaugguguccguugcccgagaguugaccgugggcauaaauggguucggacguaucgguagauuaguccugagggcguguauggagaagggcgugaaaguaguugcugugaacgaucccuuuauugacccagaauacauggucuauauguucaaguacgauucuacucaugggcgguauaagggaucaguggaguuucgcaauggccagcuaguggucgacaaccacgaaaucaguguuuaccaaugcaaagagccuaagcagauucccuggagagccguggguagcccauauguaguggaguccaccggggucuaccucucuauccaggcagccucggaucauauaucagcuggagcacagagggugguuaucagcgcccccaguccugacgcuccaauguucgugaugggcgucaaugaaaacgauuauaauccgggcuccaugaacauugugucuaaugccagcuguacaaccaacugccuggcgccccuugcaaaaguaauccacgagcgguuugggauuguugaaggacugaugacuacagugcauuccuacaccgccacgcaaaagacugucgacgguccuucacgcaaggcuuggcgagauggcagaggggcccaccagaauaucauaccagcaaguaccggagcugccaaagcggugacaaaggucauucccgaguugaaaggcaagcucacugguauggccuucagggugccuaccccagacguuagcgugguagaucugacaugucggcuggcacagcccgcuccguacucugccaucaaagaagcugucaaggccgcagccaaagggccuauggcuggaauuuuagcguauaccgaggacgaggugguuuccacggauuuucucggcgacacucacucaagcaucuucgacgcaaaggccggcaucgcucugaacgauaauuuugugaaacuuauuaguugguacgacaacgaauauggguacucucaucgugucguggauuugcugcgcuauauguucuccagagacaaguga

SEQ ID NO: 56566 - RNA, 654 nt, Artificial Sequence
  derived and/or modified sequence opt3 from GAR1__Homo_sapiens__NP_061856
augagcuucagaggcgggggaagggguggcuuuaaccggggcggaggcggugggggauucaaucgcggcggcuccucuaaccacuuucgagggggagguggcgggggaggcggugggaauuuccguggaggcggcagagggggauuugguaggggcgggggacggggcgguuucaacaaggggcaggaccaagggcccccugagcgcgugguccugcucggagaauuucuucauccaugcgaggaugacaucguuuguaaaugcaccacagaugaaaauaaggugccguacuucaacgcccccguauaucuggagaauaaagaacagauuggcaagguggacgagauauuugggcaguugagagauuucuacuuuucagucaaauuaagugagaacaugaaggcuagcuccuucaagaaacugcagaaguuuuauaucgacccuuacaaacuacucccacugcaaagguuccuuccccggccuccaggagaaaagggucccccucgcggcgggggacgaggcgguagagggggcggaaggggcgggggaggucggggcgggggacguggcgguggguuccgcggcggaagaggcgggggaggcgguggguuuaggggaggccgggguggcggguuccgaggacgcggccacuga

SEQ ID NO: 56567 - RNA, 2631 nt, Artificial Sequence
  derived and/or modified sequence opt3 from GAREM__Homo_sapiens__NP_001229338
auggaccccgccccuagccugggcugcucccucaaggaugugaaauggucuucagucgcuguuccacuugaccuguuggugaguaccuacagauuaccgcagaucgcaaggcuggauaacggggaguguguagaaggacuacgggagaaugacuaucuccugauucacagcugccgccaauggacaacuauaacggcccauucccuugaagagggucacuacgugaucggccccaagauugaaaucccuguccauuaugcggggcaguucaaacuguuggagcaggaucgagacauuaaggagccagugcaguacuuuaacucuguugaagagguggcuaaagccuuccccgaacgugucuaugugauggaggauaucaccuuuaauguaaagguugcaucgggagaguguaacgaagacacagagguguacaauauaacucucugcaccggcgaugaacugacacugaugggucaagccgagauccucuaugcuaagaccuucaaagaaaagucaagauuaaacacuauuuuuaaaaagaucgggaaacugaauagcauuaguaaacuuggaaagggcaaaaugccuuguuugaucugcaugaaccacaggacaaaugaguccauaucucugccauuccaguguaagggccgguuuagcacccgcaguccccuagagcuccagaugcaggaaggggagcauacgauuagaaacaucgucgaaaagacuaggcugccugugaaugugaccgucccaucaccgcccccucggaacccauacgaccuucacuucauucgcgagggacaccgauacaaguuuguuaauauccaaacaaaaacugugguagugugcuguguccugagaaacaauaagaucuugcccaugcauuucccucuccaccugaccgugccaaaauuuaguuuacccgaacaucugguuaagggugagagcuggccggagacacucgugcaccacuggcuuggcauuugccaggaacaguucgauauagacgaguauucuagggcaguccgggaugugaagaccgacuggaacgaagaguguaaauccccuaagaaagggcguugcucaggacauaaccacguacccaauagccugaguuacgcccgcgacgaauugacgcagucuuuucauagacuauccguuugcguguauggcaacaaucugcacgguaacagcgaggucaaucuccauggguguagggaucugggaggcgacugggcuccauucccucacgauauccuucccuaccaagacucgggcgauucuggguccgacuaucuguucccagaggccucagaagagagugcggguauucccggaaagagcgaauugccuuacgaggagcucuggcuggaagagggcaaaccaucccaccagccguuaacucggucucugagcgaaaagaaccgaugcgaucaguuucgcgggucagugagaaguaagugugcaacaagcccccuaccuaucccaggaacccucggcgccgcugucaaauccucugacacugcccugcccccuccacccgugccgccuaagucagaggcaguuagggaagagugccggcuuuugaaugcuccacccgugccuccccgcagugccaaaccacugagcacauccccuucuauacccccaagaaccguaaagccggcgaggcaacagacgcguucgccuagccccacccucuccuauuacucaaguggucugcauaacauuucugucacaaaaacugauaccaauccaagcgaguccacacccgugucauguuacccuugcaaccggguuaagacugacagcguggaucuuaagucuccauucgggucccccagugccgaagcagucagcucucgacuguccuggccuaaucacuauucaggcgcuagugagagccagaccagaucggacuuuuugcucgacccguccaggucuuacagcuauccacgccagaaaacacccggaaccccuaagcggaacuguccagcccccuucgauuuugacggcugcgaacuguuagcuucaccuacuuccccggugacggccgaguucuccucuagcguauccgggugucccaaaucagcaagcuacagucuggaaucuacagaugugaagucccuagccgcuggaguuaccaaacaaagcacuucgugcccagcgcucccucccagagcaccaaagcuggucgaggagaagguggccucagaaaccucuccucuucccuugaaaaucgacggugcugaggaagauccaaagaguggcuccccggaccugagcgaggaucaguauuuugugaaaaaggggaugcaggacaucuucucugccagcuacccuuuuuccucaccccuccaucugcaguuagcaccaaggaguuguggagauggcagccccuggcaaccuccagccgaccugucuggucuuuccauugaagaggucucaaaaaguuugcgcuucaucgggcucagcgaggauguuauuuccuuuuucgugacagaaaagauagacggcaaucugcuagugcagcugaccgaggaaauccucucugaggauuuuaaacugucgaaacuucagguaaagaagauuaugcaguucaucaacggauggcgacccaagaucuga

SEQ ID NO: 56568 - RNA, 2976 nt, Artificial Sequence
  derived and/or modified sequence opt3 from GARNL3__Homo_sapiens__NP_001273708
augaaaagcuccgugucugaggaccugggcugcagaagaggggauuucucacggaaacacuacggaagugucgaacuccuuaucagcuccgacgccgauggugcuauucagcgcgcaggccgauuucguguugagaacgggucuucggacgaaaaugccaccgcgcugcccggaacauggagaaggacugaugugcauuuggagaacccugaauaucacacgcggugguacuucaaguauuucuuaggccaaguacaucagaauuacauagguaacgacgcugagaaaucaccauucuuucugagcgugacccuaagugaucagaauaaccagcgcgucccgcaauauagagccauccucuggaggaagacagggacucagaaaauuugucugcccuacuccccuaccaagacacuuucuguuaagagcauccuguccgcaaugaauuuggacaaauucgagaagggaccacgggaaauuuuucaccccgagauccagaaagaucuccuggugcuggaggagcaggagggcucagugaacuucaaguuuggcguccucuucgccaaagacgggcaauuaaccgaugacgaaauguuuaguaaugagauaggaagcgaaccuuuccagaaguuucugaaccuuuugggugauacuaucacacugaagggcuggaccggguaucgcggaggccuagacacgaaaaaugacacuaccgguauucauucuguguacacaguauaccaggggcacgagaucauguuccacguuuccacuaugcucccauauucaaaggaaaacaaacagcaaguggagcgaaagagacauauuggaaaugauaucgucaccauaguguuccaggagggcgaagagagcagucccgcuuuuaaaccuucuaugauuaggucccacuucacacauaucuuugcacuggugcgguacaaccagcaaaaugacaacuaucgucuuaagauuuucagcgaagagucggucccacuguuuggcccgcccuugccuaccccacccguuuucacggaucaccaggaauuucgcgacuuccuccuggugaaauuaaucaacggggagaaggccacucuggagacaccuaccuuugcucagaagagaaggcggacucucgauaugcuuauccgaucucugcaccaggacuugaugccagaucuacauaaaaauaugcugaaccgcagauccuucucagacguacuccccgaaagucccaagagcgccaggaaaaaggaggaagcgcggcaagcagaguuugugcgcauuggacaggcccugaaacuuaaguccauagucagaggugaugcuccuucuagccuggccgcaucaggcaucugcaagaaagaacccugggagccacaguguuucugcaguaauuuuccucacgaggcugugugugccgaccccugggggcaggcguugcucguuuccacagaugccggagugcuguuagucgacgacgaucugccaagcgugcccguauucgacaggacccuaccuguuaagcaaaugcaugugcucgaaacgcuggaucuuuugguccugcgugcagacaaaggcaaggaugcucgacucuucguguuucggcugucugcccuucagaaaggucuggaggggaagcaggcuggcaagucaagaagugacugcagggaaaacaaauuggagaagaccaaaggaugucaccucuacgccauuaauacacaucacagccgcgagcugcggaucgucguggcaauaagaaacaaguuacugcuaauuacuaggaaacacaauaagccauccggcguuaccucuacaucgcuccugagcccgcuuuccgaaucacccguggaggaauuucaguauauccgcgagaucugcuugagugauucuccuaugguaaugacucuggucgacgggccagccgaagagagcgauaaccucauuuguguggcuuaccgacaucaauuugacguugugaaugaguccaccggagaagcguuccggcugcaccaugucgaggcaaaccgugugaauuuuguagccgcuaucgauguguaugaagacggugaggccggcuuacugcuuugcuacaacuacucauguauuuauaagaaaguuugccccuucaaugggggcagcuuuuugguccagccuucugcauccgauuuccaguuuugcuggaaccaggccccauacgcuauagugugugccuuccccuaucuccuggcauuuacaaccgacaguauggaaaucaggcuaguggucaauggaaaccugguucacacugcgguggugccgcaacuccagcugguagcuagcaggucugacauuuacuucacggccacagcagccgucaacgagguguccucaggugggaguagcaagggcgcuucggcccgcaauuccccucagaccccacccggacgggauacuccuguuuuucccucuagccuuggcgagggggaaauccaaucaaagaacuuguauaagaucccacugagaaauuuagugggaaggaguauugagcgaccucucaaauccccgcuggucucuaaggugauaaccccaccgacaccuaucagcguuggucuugcagcuauucccgugacccacucccugucauugagccgcauggaaaucaaagagauugccagucggacuagaagggaacuccugggccuaucugacgaagggggaccaaaguccgagggcgcgcccaaggccaaaagcaagccucguaaacgccuggaagagucgcagggugggccaaagcccggcgcuguacggucaucuaguuccgauagaaucccuagcggaucucucgaaagcgcauccacaucagaggccaacccggagggccauagugcuagcucugaccaggauccagucgccgacagggaagggucccccgugucaggaaguagcccuuuccagcugacggcauucuccgaugaggacauaaucgaucuuaaauga

SEQ ID NO: 56569 - RNA, 2220 nt, Artificial Sequence
  derived and/or modified sequence opt3 from GARS__Homo_sapiens__NP_002038
augcccagcccuagaccagugcugcucaggggcgcccgggcugcacuucuguuguuacugccgccccgccuacucgcccgaccuucccugcuucugcguagaucuuugucagcggcuaguugcccacccaucagccucccugccgcagccuccaggucuucgauggacggggcuggagcagaggaaguccuggccccacugcggcucgcuguucgccagcaaggugauuuagugagaaagcugaaagaggacaaggcgccccagguagauguggacaaagccgucgcagaacuuaaggccaggaaacggguguuggaggcuaaggaacuggcccuacagccuaaggaugacauuguugaucgcgcaaaaauggaggacacccucaagcgaagauucuuuuacgaucaggcuuucgccauauauggcggggugucaggacuguacgacuuuggcccagucgguugugcgcuuaaaaacaauaucauucaaacauggaggcagcacuucauccaggaggaacagauucuggagaucgauugcacuauguugacgccggaacccgugcucaagaccagcgggcauguagacaaauuugccgauuucaugguuaaggacgugaagaacggagaguguuuucgggcagaccaccuguuaaaagcucaucugcaaaagcucaugagugauaaaaagugcuccgucgagaaaaagucugaaauggagagcgugcuugcccagcuggacaauuauggccagcaggaauuggcugaucuauucgugaacuacaaugucaaauccccuauaacaggcaacgaccugucaccacccguuaguuuuaaucucauguucaagacuuuuaucgggccuggagguaacaugccaggcuaucugcgucccgagaccgcccaagggauuuuccuuaauuuuaagcgccuguuggaguucaaccagggaaaacucccguucgcagccgcucagaucggcaauagcuuuagaaacgaaauuucuccuagguccggucugauccgggugcgagaguucacaauggcggaaauagagcacuuuguagaucccucagaaaaggaccauccaaaauuccaaaauguggcagauuuacaccuguaccuauauagcgccaaggcucaggucagugggcagucugcccgcaaaaugagacucggagacgcaguggagcagggcguuauuaacaauaccgugcugggcuacuuuaucgggaggauuuaccuuuauuugacuaaggucggaaucuccccugauaagcugcgguuccgccaacacauggaaaacgagauggcccauuacgcuugugacugcugggaugccgagagcaaaacaucguaugguuggaucgaaauugugggcugugcagacagaucuugcuacgaccucuccugucacgcgagggcuaccaagguaccccugguugccgagaaaccacuuaaggaacccaaaacggugaacgucgugcaguuugagccuucaaagggggcaauaggaaaggccuauaaaaaggaugcuaaacuggucauggaauacuuggccaucugcgacgaguguuauauuacugagauggaaaugcuccugaaugagaagggcgaguucaccaucgaaacagaggguaaaacuuuucaguuaaccaaggauaugauaaacgugaagcguuuccagaaaacacuguacguugaagaggugguaccaaaugucauugaaccgaguuuugggcuaggccggaucauguacaccguguucgagcauacguuucacguucgagaaggagacgagcaaagaacuuucuucagcuuucccgcaguggucgcuccuuucaagugcuccgugcucccacugucucagaaccaggaguuuaugcccuucguaaaagaacuuagcgaggccuugacaaggcacggcgugucacauaagguugaugacaguuccgggagcaucggacgccgguaugcgagaaccgaugaaauuggugucgccuuuggcgugacuaucgacuucgauacagugaauaaaaccccucacacggcuacccugagggaccgcgauucuaugcgacagauucgggcagagauaucagaacucccaaguaucguccaagaccuggccaacgggaauauuacaugggcugauguugaggcccguuaccccuuauuugagggacaggaaacuggcaagaaagagaccaucgaagaguga

SEQ ID NO: 56570 - RNA, 1302 nt, Artificial Sequence
  derived and/or modified sequence opt3 from GART__Homo_sapiens__NP_780294
auggccgcuagagugcugaucauuggcagcgggggaagggagcacacccucgcauggaaacuugcccagucccaucacgucaagcaaguucugguggcgcccgguaacgcuggcacagccugcucugaaaagauaucaaauacugcaaucaguauuagcgaccauacggccuuggcucaguucuguaaagagaagaaaaucgaauuuguaguggucgggccugaggcaccauuagccgcuggaauugugggcaaccugcgguccgccgguguucagugcuucgggccgaccgcggaagcagcccagcuagagucuucgaagcgcuuugcuaaggaguucauggaucgacacggaauccccacagcccaauggaaagcauuuacuaagccugaagaggcuuguucauucauacucagcgccgacuuuccagcgcugguggucaaagccaguggccuugcagcuggcaagggggugaucguagccaaauccaaggaagaggcuugcaaggccguucaggagauuaugcaggaaaaagcauucggagccgcuggugagaccaucgugauugaggaacuguuggauggcgaagaggucucuugucucugcuuuacagacgggaagaccguggcgcccaugccuccagcacaggaucauaaacgucugcuggagggagacggcggucccaauacugggggaaugggcgccuacuguccugcuccacaagugagcaacgaucucuuacugaagaucaaagacacaguccuucagagaaccguugauggcaugcagcaggaagggacgccguauacuggaauauuguacgccgguauuaugcugaccaagaauggccccaaagugcuagaguucaacugcagguuuggggacccugaaugucaaguaauccucccacugcuuaaguccgaucuguaugaggugauucagucaacauuggacggacuccugugcaccaguuuacccgucuggcuggaaaaucacacugcacucacagugguuauggccagcaagggcuacccuggugauuauaccaaagggguggagaucacgggcuucccagaggcucaggcccuuggacuggaagucuuucacgcaggcacugcguugaagaacgggaaagugguaacacauggaggucggguucuagcugugaccgccauccgcgagaaucugauuucugcacucgaagaggccaagaaaggccuggcugccauaaaguucgaaggggcaaucuacagaaaggacgucggauucagggcuauugccuuucuucaacagccccgguga

SEQ ID NO: 56571 - RNA, 1038 nt, Artificial Sequence
  derived and/or modified sequence opt3 from GAS1__Homo_sapiens__NP_002039
augguggccgcucugcucggcgggggaggugaggcaagaggcgggaccguccccggagccuggcuuugccugauggcguuguuacagcugcuaggcagcgcuccuagggguuccgggcucgcccacggacggcgccugaucuguuggcaagcacuucugcagugccagggcgaaccagaguguucuuacgccuauaaccaguacgcugaagcaugcgccccgguuuuggcucaacauggcgggggagacgcccccggugcggcagccgcugccuucccugcaucagcugccaguuuuagcucccgauggcguuguccaucucacugcauuucggcgcucauacagcugaaucauacaagaaggggccccgcccuggaggauugugacugcgcacaggaugaaaacuguaagucaacuaaacgggcuaucgagccuugccucccacgcacgagcgggggaggcgccggugggcccggagcuggcggcgugaugggguguaccgaggccagaaggcggugcgaccgcgauagucgaugcaauuuagcacuguccagauaucuuacauacuguggaaagguauucaacgguuugaggugcacugacgaaugucggaccgugauugaggauaugcuggccaugccuaaagcugcgcuacucaaugacugcgucugugauggccuggaacguccaaucugcgagucugugaaggagaacauggcacgccuuuguuuuggggccgaacugggaaauggcccggguagcuccgggucagacggcggauuggaugacuauuacgaugaggacuaugacgaugaacagagaacaggcggggcuggaggugagcaaccccucgacgaugacgauggcguuccucacccacccaggccugggaguggagccgcagccagcggcggucgcggggaccugccauacggccccggacgacggucuuccggcgggggagguagauuagcuccgaggggcgccuggaccccucuggcaucaauucuccuucuguugcuagggccccuguucuga

SEQ ID NO: 56572 - RNA, 942 nt, Artificial Sequence
  derived and/or modified sequence opt3 from GAS2__Homo_sapiens__NP_001137302
augugcaccgcccugagccccaaggugagauccggcccugggcucucugacaugcaccaguacucacaauggcuugcuaguaggcaugaggcaaaccuguugccaaugaaagaagauuuagcccuguggcuaacaaaucuccugggaaaggagaucacugcggaaacguucauggagaaacuugacaacggugcucuguugugucagcucgccgaaaccaugcaggagaaguuuaaagagagcauggaugcaaauaagccgacaaagaaccugccccugaaaaagauuccuugcaaaacuuccgccccaucuggcucguucuuugcucgggacaauaccgcaaacuuccucucauggugucgcgauuuaggggucgacgaaacaugccuguuugagagcgaaggacuuguuuugcacaagcagccccgagaggugugucugugccuacucgagcugggccguauagccgcuagauaugguguagaaccuccagggcuuaucaaacuggagaaggaaauugagcaagaagagaccuugagugcccccuccccuucuccaagcccguccucaaagaguagcggcaaaaagucuacuggaaaucuccuggaugacgcggugaaaaggaucuccgaggaucccccuuguaagugcccaaacaaauucugugucgaacgguuaucacagggccgcuacagagugggggagaagauucuguuuaucaggaugcuccauaauaaacacguuauggugcgggucggagguggcugggaaacauucgcaggguaucuucugaagcaugaccccugccgcauguugcagauaagccgaguggauggaaagaccaguccuauccagucuaaauccccaacgcuaaaggacaugaaccccgauaauuaccugguaguuagcgccucguauaaagcuaagaaagagauuaaguga

SEQ ID NO: 56573 - RNA, 1365 nt, Artificial Sequence
  derived and/or modified sequence opt3 from GAS2L1__Homo_sapiens__NP_001265659
auggccgaccccguggcuggcaucgcagggagcgccgcgaaguccgucagaccuuucaggucuucagaggcuuacguugaagccaugaaagaggaucuggcagaauggcucaacgcccuuuauggacuggguuugccaggcgggggagacggcuuuuuaaccggucuggcuacagggacuacgcuaugccagcacgcaaaugccgugaccgaggcugcccgggcgcucgcagccgcucgcccggcccgaggaguagcauuccaagcucauagugugguccccggcagcuuuauggcccgugauaacguggcgacauucauuggcugguguagaguugaacugggggugccugagguccuuauguuugagacugaagaccugguguugaggaagaaugagaaauccguaguucucugccugcuggaaguggcccggcgcggagcaagacucgguuuacuggcuccaaggcuuguccaguucgagcaggagauagaacgggaguugcgcgccgcucccccugccccaaacgcacccgccgcuggcgaagauaccacagagaccgcgccugcaccagggacuccggcccgaggacccagaaugacaccuucugaccugaggaaucuagaugaacucgugcgggagauccugggccguuguaccugcccagaccaguuucccaugauuaaggugucggaggguaaauaccgcgucggggauucaagccuucugaucuucguuagaguguugaggagucacguaauggugcgggucggaggcggcugggacacgcucgaacauuaucuggauaagcacgacccuugucgaugcuccucuacugcucaucgcccaccccaaccgagaguguguaccuuuagcccucagaggguuucccccacaacuucaccacggccugccagucccgugccagggagcgagcgcagaggaucuaggcccgaaaugaccccugucuccuuacguucaacaaaggaggguccagaaaccccgcccagcaguucuuccagcucgcugucugugcucggcgggaaaugcggacagccuggcgauuccggucggacggcaaacgggcuuccaggcccccgaucacaggcccugaguagcuccucugacgagggaagcccuuguccaggcaugggagggcccuuggacgcuccggguucaccucuagccugcacugagccaaguagaacaugggcaaggggccgcauggauacccaacccgaccggaagccuuccaggauucccacuccaagagggccucgccgacccagcggaccagcggaacugggcacauggcacgcucuccacucuguaaccccgcgggccgagccugauucauggauguga

SEQ ID NO: 56574 - RNA, 2037 nt, Artificial Sequence
  derived and/or modified sequence opt3 from GAS6__Homo_sapiens__NP_000811
auggcccccagccuguccccuggcccagcugcacucagaagggccccgcagcuucuguuguuacugcuagcggcugagugcgcccucgcagcccugcuucccgcucgggaagcaacccaauuccugcgcccucgacagcguagagccuuucagguguucgaggaagcuaagcaggggcacuuggagagggaaugugucgaggagcucugcucucgggaagaggcccgcgaaguuuuugagaacgacccagagacagauuacuucuaucccagauaccuggacuguaucaauaaauauggaucaccuuacacuaagaacagugguuuugcgacgugcgugcaaaaucugccagaucaguguacccccaacccuugcgacaggaaaggcacacaggcaugucaggaucucauggggaauuucuuuugcuuauguaaggccggauggggcggucggcugugcgacaaagauguaaacgaauguagccaagagaaugggggaugccuucagauuugccauaacaagccaggcuccuuccacuguucuugccauucgggcuuugaauugucaagcgacgggcgcacuugucaggauauagacgagugcgcugauagugaagccuguggagaggcacgaugcaagaaucugccggguuccuauucuugucuaugcgacgagggcuucgcuuacagcucccaggaaaaagccuguagagauguggacgagugccuccaagggaggugugaacaggucugcgugaacucacccggaaguuauaccugccacugugacggccggggugggcugaaacuuagccaggauauggacacaugcgaggauauccugccuuguguuccauuuucuguggcgaaguccgucaagucauuguaccucggacguauguucagcggcacccccgugauucgccugagauuuaaaagguuacaaccuacucggcugguagccgaguucgacuuccgaacauuugauccagagggcauccuccuuuucgcagggggacaucaggacaguaccuggauuguucuggcuuugcgcgccgguagacuagagcugcagcucagguacaauggcguggggcgggucacgucuuccggacccgugaucaaccacggcauguggcagacuauaagcguggaagaacuggcucgcaaucuugucaucaagguuaacagagaugccgugaugaagauugcaguagccggugaccuguuucaaccggaaaggggguuguaucaccucaaucugaccgugggcggaaucccuuuccaugagaaagauuuaguccagcccauuaacccacgucuggacggcugcaugcggucguggaacuggcuaaauggggaagauacaacuauccaggagaccgugaagguuaacacacgaaugcaguguuuuucugugaccgagagaggauccuucuacccugguucaggcuuugcuuucuauagucucgacuacaugaggacgccccuggacgucgggacugaaagcacaugggagguggaaguaguugcgcacauacgcccagcagccgauaccggagugcuuuuugcuuugugggcccccgaccugcgggcagucccucucuccguggcccuggucgauuaucauucuacuaaaaagcugaaaaagcaacuugugguuuuggcuguggagcacacagcccucgcacugauggagauuaaaguaugcgacggccaggaacacgucgugaccguuagcuuaagagauggugaggcgacgcuggaaguggacgggaccaggggccagucagaggucagugcugcccagcuacaagaacgccucgcagugcuggagcgacaucuucgguccccaguauugacauucgccggaggccugccggaugugcccguuacuagcgcuccugucaccgccuuuuaccguggguguaugacacucgaggugaauagaaggcuguuagaccuggaugaagcagcuuauaagcacucugacaucacugcccauucaugcccacccguggagccugcggccgcuuga

SEQ ID NO: 56575 - RNA, 1239 nt, Artificial Sequence
  derived and/or modified sequence opt3 from GAS7__Homo_sapiens__NP_001124303
auggugcccccuccaccgggcgaggaaagccagaccgucauccugcccccuggguggcaauccuaccucucuccacagggaagaagguauuacguuaacacaacuacgaaugagaccacaugggaacggcccucaaguagcccugguauuccagccucccccggcucucaccgcucgucacuuccuccaacugugaacggguaucaugcuagcggaaccccggcacaucccccugagacagcccacaugaguguacgaaaguccaccggcgacucucagaaucuggguagcuccucaccaaguaaaaagcagagcaaagaaaacacuauaacaaucaauugcgugaccuucccccacccugauacgaugccagagcaacaguuguuaaagcccacugaguggucuuacugugacuauuuuugggcggauaaaaaggacccgcaggggaacggaaccgucgcuggcuucgaacugcuacuccagaagcaacugaaaggcaagcagaugcagaaagagauguccgaauuuauucgugagagaaucaagauugaggaagauuacgccaaaaaucuugcaaagcugucacagaacagcuuggccagucaagaggaagggucucucggagaggcuugggcacaggugaagaaaucccuggccgacgaagcugagguucaucugaaguucagcgccaaacuccacucggagguggaaaagccuuuaaugaauuuuagggagaacuucaaaaaggauaugaaaaagugcgaccaccauaucgcggaucugcggaagcagcuugcaucucgcuaugccuccgucgaaaaagcuagaaaggccuugacagagaggcaacgggaccuggaaaugaaaacucagcagcuagagauaaagcucucaaauaaaaccgaggaagauaucaagaaggcacgccgaaaaaguacacaggcuggugacgaucugaugagauguguggaccuuuacaaccaagcccagagcaagugguuugaggaaaugguaaccacgacucuggaguuggaaaggcucgagguugagcggguggaaaugauucgucagcaccugugccaguacacacaauuacgccaugagaccgacauguucaaucaguccacugucgaacccguggaucagcugcucagaaaaguggacccagcgaaggauagggagcuuuggguccgggagcacaaaacaggcaacauccgaccuguugacauggaaauuuga

SEQ ID NO: 56576 - RNA, 861 nt, Artificial Sequence
  derived and/or modified sequence opt3 from GAS8__Homo_sapiens__NP_001273137
augaagaugcugagagacgagcucgaucuuaggcggaaaaccgaacugcacgagguggaggaacgcaagaacggccagauccauacauugaugcaacgacacgaagaggccuucacugacauuaaaaauuacuauaacgauauaacguuaaauaaccuggcucuaaucaauagccucaaggagcagauggaagacaugcguaaaaaggaggaucaucuggaaagagagauggcagaggucuccgggcagaacaagaggcuugccgacccccugcagaaagcgcgggaagagaugucugaaaugcaaaagcaguuggcuaauuacgagcgcgauaaacagauucuccugugcaccaaggccagacugaaaguuagggaaaaggagcucaaggacuuacagugggagcacgaagugcuggagcaacgguuuacaaaaguacagcaggaacgcgaugagcuuuaucgaaaguucacugcagccauccaggaagugcaacagaaaaccggauuuaagaacuugguccuggagagaaaacuacaggcucucucagcagccguggagaagaaagaaguucaauucaaugaggugcuggcugccaguaaccuugacccugcggcacugacauuggucagcaggaagcucgaagaugugcuggaguccaaaaauucuaccauuaaggacuuacaguacgaacuggcccagguauguaaggcucauaacgaucuccuucggacuuaugaggccaaacuguuggcauuugguaucccacuagacaauguuggcuucaagccgcuggagacagcugugauagggcagacccucggacaaggccccgccggucuggucgggacgccuacuuga

SEQ ID NO: 56577 - RNA, 306 nt, Artificial Sequence
  derived and/or modified sequence opt3 from GAST__Homo_sapiens__NP_000796
augcagagacugugcguguacguccucaucuucgcccuugcucuggcagccuuuagcgaggcguccuggaagcccaggucucaacagccugacgcuccauugggcaccggggccaaccgggauuuagaacugccguggcuagagcagcagggacccgcaucacaccaucgccgacaacucgguccucagggcccaccccaccugguugccgacccuaguaaaaagcaggggccauggcuugaagaggaagaggaggcuuauggauggauggauuucggccguagaagcgcagaagacgagaauuga

SEQ ID NO: 56578 - RNA, 1242 nt, Artificial Sequence
  derived and/or modified sequence opt3 from GATA1__Homo_sapiens__NP_002040
auggaguuccccggccuggggagccucggaaccuccgaaccucuuccacaguuuguggacccggcccuggucucuucaacacccgagagugguguuuucuuuccuagcggcccagaaggguuggaugcugcagccuccucuacugcgcccucgacggcuaccgccgcagccgcugcauuagccuacuauagagacgcugaggccuacaggcacucaccuguguuccaaguauauccacugcuaaacugcauggaaggaauccccggcgguagcccuuacgcggggugggcauauggaaagacaggccucuacccagccaguacuguguguccgacccgggaggauuccccaccucaggcugucgaggaccuggauggcaaagggucuaccagcuuucuugaaacacugaagacugagcgcuuguccccagaccuccugacacugggacccgcccucccuucaaguuuaccagugcccaauagcgcauaugguggcccggauuucucuuccaccuuuuucucaccuacggggagcccccugaacagugcugccuacucuuccccaaaacuucgaggaacuuugccucugcccccaugcgaagcgcgugaguguguuaauugcggcgccaccgcaacaccccuauggagaagggaccggacuggucauuaccucuguaacgcuugcgggcuguaucacaagaugaauggacagaaccgcccucuuauuagacccaaaaagaggcugauagugagcaagcgggccggcacccaguguacaaauugccaaaccacgacuacaaccuuguggcgccgaaacgcuucgggcgauccggucuguaaugccugcgggcucuacuauaaacugcaucaggugaacagacccuuaacuaugaggaaggacggaauccagacacggaaucguaaagcaucugguaagggcaaaaagaagcgcggguccucacugggaggcaccggugccgcugaggggccugcgggcggauuuaugguaguugcaggcgggaguggaagcgguaacuguggcgaaguggccuccgggcucacgcuuggaccacccggcaccgcucaccuguaccaggguuuggggccugucgugcuaucuggcccagugagccaucugaugcccuucccgggaccucuccugggcucaccaacagggaguuuucccacuggaccuaugcccccaaccacauccacuaccgucguugccccucuuagcucuuga

SEQ ID NO: 56579 - RNA, 1443 nt, Artificial Sequence
  derived and/or modified sequence opt3 from GATA2__Homo_sapiens__NP_001139133
auggagguggcccccgaacagccuagauggauggcucacccagcaguccugaacgcccaacauccggacagccaccaucccggccucgcgcacaauuacauggagccugcucagcuucugccacccgaugaaguugacguguucuuuaaccauuuggauucccaggggaauccuuauuacgccaacccagcacacgccagggcucggguaucuuauucacccgcacacgcccgcuuaaccggaggucagaugugccgaccucaucugcuacacaguccaggccucccguggcuggacgggggaaaggcugcccuuagcgcggcagccgcucaucaccacaaucccuggacaguguccccuuucucuaaaacuccacugcaucccucggccgcaggcgguccugggggaccauugucagucuaccccggcgcuggcgggggaagcgguggcgggaguggauccucuguggccagccucacgccgaccgcggcccacuccggcucacaucuguuugguuucccucccacaccaccuaaggagguuagucccgauccaagcacuaccggggcagcuucucccgccuccucaagcgcuggaggcagugccgcacguggcgaagacaaagauggggugaaguaucaagucucucugacagaguccaugaaaauggagagcggaucgccucucagaccagguuuagccaccaugggcacucagccggcuacacaccaucccaucccuaccuacccaucuuaugugcccgcggcagcccacgacuacuccucagggcuguuucacccuggaggcuuccuuggugggccagcuaguagcuuuacgcccaagcagagguccaaggcccggucuuguagcgaaggccgcgagugcguaaacuguggagcaacugccaccccguuguggagaagggauggcacagggcauuaccugugcaaugcuuguggacuauaucacaaaaugaacggucagaaucggccucucauuaagccaaaacgccgacugucagccgcaagaagggcgggcacuugcugugcuaacugccaaaccacaaccacgacucuuuggcggcguaaugccaacggggaccccguuuguaaugcaugcggacuguacuauaaguugcauaacgugaaucgcccucucacaaugaaaaaggaaggcauacagaccagaaacaggaagaugaguaacaaauccaagaaaagcaagaaaggugccgaguguuucgaggaacugucuaagugcaugcaggagaaaucaagucccuuuagcgcugccgcauuagcugggcacauggccccagucggccaucugccucccuucucccacucuggacacauccucccaacuccgacaccuauucaucccucgagcucccuuucauuuggccacccacaucccaguucuauggugaccgcgaugggguga

SEQ ID NO: 56580 - RNA, 1332 nt, Artificial Sequence
  derived and/or modified sequence opt3 from GATA3__Homo_sapiens__NP_002042
auggaggugaccgccgaccagcccagaugggucagccaccaucacccugcuguucugaacggccaacauccagauacacaccauccggggcucucccacucuuacauggacgcagcccaguauccccuuccugaagagguggauguacuguucaauaucgacggacaggguaaccacgugccacccuacuauggcaauucagucagggcgacugugcagcgguacccuccaacgcaucacgggagucaaguuugccgacccccuuuguuacauggaagccugccauggcuagauggcgguaaggcucucgggucccaccacaccgccucuccguggaaccugucgcccuuuucaaaaacaagcauucaucacggaaguccuggcccacuuuccguguaucccccugcaucuagcuccucacugaguggcgggcaugccagcccacacuuguucacuuuucccccgaccccucccaaggacgucucuccagauccuucccucucaacacccggaagcgcugguagugcacgacaggacgaaaaagagugucugaaguaccaggugccacugcccgauucuaugaaacucgaauccagccauucgcguggcucuaugaccgccuuagggggagcuuccucaaguacucaccacccuauaacaaccuauccaccguacguacccgaguacagcuccggccuguucccuccaucuagccuuuugggugggucacccacgggauuuggcugcaagaguagaccuaaggccagguccagcacuggccgggaguguguuaauugcggggcgaccucuacaccacuguggcgcagagacggaacuggucauuaucuauguaacgcaugcggccucuaccacaaaaugaaugggcagaacaggccccugaucaagccgaaacggcgccuuucagccgcucgcagagccggaaccaguugugcaaauugccaaacaaccacgacuacacuguggaggcggaacgcuaauggcgauccuguguguaacgccugcgguuuguauuacaagcuccauaauauuaaccguccacugaccaugaaaaaggaagggauccagacucgcaauagaaagaugagcuccaaaucuaagaaauguaagaaaguccacgacucguuagaggauuuccccaagaacagcuccuuuaacccugcggcccugucaaggcacaugaguucucucagccauauuucccccuucucacacagcucucauaugcuuacaaccccaacgccuaugcaucccccauccagucugagcuuuggcccgcaccacccuucuuccauggugaccgcaaugggauga

SEQ ID NO: 56581 - RNA, 1329 nt, Artificial Sequence
  derived and/or modified sequence opt3 from GATA4__Homo_sapiens__NP_002043
auguaccagagccuggccauggcugcaaaccacgggcccccuccaggcgccuaugaggcgggagguccgggcgcuuucaugcauggggccggagcagccuccucucccguguacgucccuaccccaagaguucccucaagugugcucggccuuagcuaucugcaaggugggggagcuggcuccgcaucuggcggggccucgggagguucaagcggcggggcugccaguggagcgggcccugguacacagcagggguccccaggauggucucaggcaggcgccgacggcgcugccuacacucccccuccaguaagcccgagguuuuccuuccccgggacgaccggaucauuggcagcugccgcggccgcagcugccgcucgggaagccgcagccuauaguagcgguggcggggcugcgggagcaggcuuagccggucgcgagcaauacgggcgagcuggcuuugccggaucuuauuccucaccuuacccagcauacauggccgaugugggcgcuagcugggccgcagcggcugccgcaagugccgggcccuucgacucuccuguccugcacucccuaccaggacgugcuaaucccgccgcaagacauccgaaccucgauauguuugacgauuucagcgaagguagggagugcgugaauuguggcgcuaugucgacaccucuguggcggcgcgacgggacuggacacuaucuuugcaacgccuguggccuguaccauaagaugaaugguaucaacagacccuugauuaaaccacagaggcggcucucugcgucccgccgaguugggcugucaugcgccaauugucagaccacaaccacuacacuguggagaaggaacgcugaaggcgagccugugugcaaugcauguggacucuauaugaaguuacacggcgucccccggccacuggccaugcguaaagaggggauacagacccgcaagagaaaacccaagaaccuuaauaagaguaaaacgccugcugccccaagcggauccgaaucuuugccgcccgcaagcggugcgucaaguaacuccagcaaugccacuaccucuucaagugaggaaaugaggccuaucaagacagagccaggccugagcucccacuacgggcauucuucgagcgugucccaaacuuuuucaguaagugcuaugucuggacacggccccagcauucauccuguucuauccgcccucaaacugucaccacaggguuaugcaagccccgugucucaguccccgcagaccaguagcaagcaagauucuuggaacucccuuguccuggcugacucacacggggauaucauuacagccuga

SEQ ID NO: 56582 - RNA, 1194 nt, Artificial Sequence
  derived and/or modified sequence opt3 from GATA5__Homo_sapiens__XP_006723762
auguaccagagccuggcccucgcugcaucccccagacaagccgcguaugcugacucuggcucauuccuucacgccccuggggcaggaaguccaauguuugugccgcccgccagggucccuagcaugcuguccuacuugucugguugcgagccaucgccccagccuccagaauuagcugcacggcccggcugggcccagaccgcuacagccgauucaagcgcguucgggccuggaaguccacauccgcccgcagcccacccuccaggcgcuacugccuuucccuucgcacauuccccuucugguccagggagcggaggcuccgcuggcgggcgcgacggaucagccuaucagggugcgcugcuaccccgagagcaauuugccgcaccgcucggccguccuguugggacgaguuacagcgcuaccuaucccgccuacgugucuccagauguagcucaguccuggacagccggaccuuucgacggcucagugcugcacggucuucccgggagaaggccaacuuuugucagcgauuuccuggaagaguuucccggagaaggccgggagugugugaacugcggcgcauugaguaccccucucuggcgcagagacgggacaggacauuaucuguguaaugccugcggucuguaccacaagaugaacggcguuaauaggccacucgugcggccgcagaaacgcuuaucuuccagcagacgagcugggcuguguugcaccaacugucacacuacaaauaccacgcuuuggaggcggaacucggagggagaacccgucugcaaugcguguggcuuguacaugaagcugcauggugugccucguccacuagcaaugaaaaaggagucuauccagacucgcaaaagaaagcccaagaccauugccaaagcuaggggguccucaggcaguacacggaacgccagcgcauccccuucugccguagcuagcacugauucaagugccgcaaccuccaaggcgaaaccaagccucgcuucucccguuugcccgggaccuucaauggccccacaagcaaguggccaggaagacgauagccuggcccccgggcaccuugaguucaaguuugagccugaagacuucgcuuuucccuccacagccccaucuccucaggcaggacugcgaggugcuuugcgccaggaggccuggugugcgcucgcccuggcuuga

SEQ ID NO: 56583 - RNA, 1788 nt, Artificial Sequence
  derived and/or modified sequence opt3 from GATA6__Homo_sapiens__NP_005248
auggcccugaccgacggcggguggugccuccccaagagauucggagcugccggugcagaugcgagcgacuccagggcuuuuccugcccgggagccaucuacaccgcccucaccuaucaguagcuccucuucgucauguagccgcggcggggaacgaggaccaggcggugcaaguaacugcgggacuccccagcuugauacggaggccgcugcaggaccuccagcccguucccuguuguuaucuagcuacgcuucccaccccuucggcgccccucauggcccaucagcgccggggguggcaggacccgguggcaaucugaguagcugggaagaccuacuccuguuuaccgaucuugaccaagccgcuacagccucuaaacuguugugguccucaagaggggcaaagcucagcccuuucgcuccagagcagcccgaagagauguaucagacucuggccgcgcugaguucucagggaccugccgcauacgauggcgcuccagguggguuuguccacuccgccgcugccgcagccgcugcggcagccgcugccagcucgcccguuuaugugccgaccacaaggguaggaucuaugcucccuggcuuacccuaccaucugcaaggcuccgggucaggaccagcaaaccacgccgguggcgcuggggcccauccuggauggccccaggcaagugcggacagcccacccuauggcuccggugggggcgcugccggaggcggggcagccggaccugguggcgcugggucugccgcagcucacgugagcgcccgguucccauacucaccgagucccccuauggcgaauggagccgcucgcgagccaggcgguuaugcagccgcuggguccggcggagccggcggggucagcggaggugggucuucacuugcagcgaugggcggaagagaaccccaguacaguagcuuguccgccgcuaggccucugaacggcaccuaccaccaucaccaucaccaccaucaccaucacccaucucccuauucgccguacgugggugccccucuaacuccagcauggcccgcugggccuuuugagacacccguucuccauagccugcagucccgggccggcgcaccacuuccugugccccgcggaccaucagccgaucuguuggaagaccucagugagucucgagagugugucaauugcggcagcauucaaaccccgcuguggagaagggaugggacgggacacuauuuauguaacgcuugcggccuguacuccaaaaugaauggucucucacggccucuuauaaagccccagaaacgugugccaagcucucgcagacugggguuguccugugcgaacugccacacuaccacaacuacccuauggaggcggaaugccgaaggagagcccguauguaacgcaugcggccuguauaugaagcuccaugguguuccucgaccacuggcuaugaagaaagaaggcauccagacacgcaagagaaaacccaagaauauuaacaaaaguaagaccuguagcggaaauucuaacaauuccaucccuaugacgccgacuucaacaaguagcaacucggacgauugcuccaagaacaccucuccaacuacacagcccaccgccagcggggccggcgcuccugugaugacgggggcaggagagucaaccaauccagaaaacagugagcuuaaauacuccggccaagacggucuguauauuggggucucuuuggccagccccgcggaggugacauccucagugaggccugacagcuggugcgcucucgcccuggcauga

SEQ ID NO: 56584 - RNA, 810 nt, Artificial Sequence
  derived and/or modified sequence opt3 from GATAD1__Homo_sapiens__NP_066990
augccccugggccucaagccuaccugcagcguguguaaaacaacuuccucuucaauguggaagaaaggggcccagggagagauccuuugccaccauuguacggguagaggcggggcuggaaguggcggugcagggagcggagccgcgggcggcaccgggggauccgguggcgggggauucggcgcugccacauuugcaucuacuucggccaccccaccgcaaucaaacggugggggaggcggcaagcagagcaaacaggaaauucacaggcggagugcucgccugcgaaauacaaaguacaaguccgcacccgccgcugagaaaaaggucucuaccaaagggaagggacguagacauauauucaaauugaagaacccuaucaaggccccagaaagcguuuccacuauuaucacagcggagucaauuuucuauaaagguguguacuaucagaucggcgacguagugagugucauagaugaacaagacgggaagcccuacuaugcacagaucaggggauucauucaggaucaguacugcgagaaaagcgccgcuuuaaccuggcugaucccuacgcuaucuuccccacgggaccaauuugaucccgccucauauauuaucggcccugaggaagaccucccacgcaagauggaguaccuggaauuugugugucacgcaccgagcgaguacuuuaaaaguagaucuucccccuucccuacuguuccaaccaggcccgagaaggguuauauauggacacauguggggccuacuccagcuauuaccaucaaagaaagcgucgccaaucaccuuuga

SEQ ID NO: 56585 - RNA, 1905 nt, Artificial Sequence
  derived and/or modified sequence opt3 from GATAD2A__Homo_sapiens__NP_001287875
augaccgaggaagccugcagaacaaggagccagaagcgggcucuggagcgcgaccccacugaagaugacguggaguccaaaaagaucaaaauggaacgaggccuccuugcaucugaucugaacacggacggggauaugcgugucaccccugagccaggagccgguccgacacaaggcuuguuaagagcgacugaggcuaccgccauggcaauggggaggggagaaggccugguuggugacgggcccguggauaugcggacaucacacagugacaugaaaagcgagcgcagaccuccaucccccgauguaaucgugcuaucugacaaugaacagccuucgucaccaagggucaacggacucaccacuguggcccugaaagagacaagcaccgaggcucuuaugaagaguucccccgaggaacgggaacgcaugauaaagcagcugaaagaggaauugcgacucgaggaggcaaagcugguucugcucaaaaaguuaagacagucucaaauccagaaagaagccacggcucagaagccuacuggcagcgugggcuccaccgucacaacuccaccgccccuggugagggggacccagaauauuccugccggaaagccaucacuucaaacaaguagcgcgcggaugcccgguucuguaaucccuccacccuugguucguggcgggcagcaggcauccucaaaacugggaccgcaggccagcagucaaguggucaugccuccccuagugcgcggcgcucagcagauucauucuaucagacaacacuccagcaccgguccaccuccccuccugcuugccccaagggcaucggugcccucuguccagauacaggggcagcggaucauucaacagggacugauccgaguugcuaacgugccuaauacguccuugcucguaaacauuccacagccgacucccgccucacugaagggcacaaccgcgacuucugcccaggcaaauagcacaccuaccuccguggcuucugucgugacgagcgccgagucaccagcuagucgccaagccgcagccaaauuagcucugagaaagcagcucgaaaagacccuucuggagauacccccuccaaagcccccggcgccugaaaugaacuucuugccauccgcagccaauaacgaguuuaucuaccuaguuggccuggaggaagugguccagaaucuccuggagacacaggcugggaggaugagcgccgcaacugugcuuucucgggaacccuauaugugugcccaaugcaaaaccgauuucacaugucgcuggagagaggaaaagucaggagcuauuaugugcgagaacuguaugacuaccaaucagaagaaagcccugaagguagagcauacaaguagguugaaagcagcguuuguuaaggcucuccagcaggaacaagagaucgaacagcgucuguuacagcaagguaccgccccugcacaggccaaagcugagcccacugccgcaccacacccugugcugaagcaggucauuaagccccggcgaaaacuagcuuucagaagcggcgaggccagggacugguccaacggggcggugcuccaggccucuucgcaacugagccgcggauccgcuacgacaccacggggcguccuucauaccuuuucaccgaguccuaaguugcagaauagugcaagcgccacugcucugguguccagaaccgguaggcacucagaacgcacaguuagcgccgggaaaggcucugcaaccuccaacuggaagaaaacuccccucaguacaggaggcacgcuggcguucgugagcccaucucuugccguacacaaguccucaagugcugucgaucgacagcgggaguaccuguuggacaugauucccccucguagcaucccacagucggccaccuggaaguga

SEQ ID NO: 56586 - RNA, 1782 nt, Artificial Sequence
  derived and/or modified sequence opt3 from GATAD2B__Homo_sapiens__XP_006711532
auggacagaaugaccgaggaugcccugaggcucaaccuucugaagcggagcuuggaccccgcugaugaacgcgacgauguguuagcaaaacgacugaagauggagggccacgaagccauggagcgucuaaaaaugcucgcgcugcuuaagagaaaagaccuggcuaauuuggaagucccucaugagcucccaacaaagcaggauggguccggaguuaaggguuacgaggaaaaacugaacggcaaucugaggccgcacggggacaaccggacugccggacgccccggcaaggagaauaucaacgaugaaccuguggacaugucugcaagaaggucagagccagagcggggucgccucacgcccaguccugauauuauaguauuaagcgacaaugaagccuccucuccacgaucgucaagcagaauggaggaaaggcugaaagcugcaaaccuugagauguucaaggggaaaggaaucgaggaacggcaacaguugauuaagcagcugcgugaugagcuacgccucgaagaggccagacuggugcuucugaagaaauugaggcagagucaacuccagaaggaaaaugucgugcagaaaacccccguugugcagaacgcugccuccaucguccaaccuucuccagcgcaugugggccagcagggccugagcaaguuaccgucccggcccggggcacagggaguagagccucaaaaucugcgaacacuccagggucacucaguuauucgcagugccacuaacaccacacuuccacauaugcugaugagccagagagugaucgcucccaauccugcccaauugcagggccagagggggccacccaaaccgggccuaguccggaccacuacaccuaacaugaaucccgcaauaaacuaucagccacaaucuuccucaagcgugccuugccagcgcaccacgaguucugcuaucuacaugaaccuggccucccacauucagcccggaacugugaauagagucagcucgccacuccccucuccuuccgcgaugaccgacgccgcaaacucacaggcugccgcuaagcuggcccuuaggaaacaacuggaaaagacauugcucgagaucccaccgcccaagccuccagcaccccuguuacacuuucugccuagugccgcuaauagcgaguucauuuauaugguuggucuagaagaggugguacaguccgugaucgacucucaggggaaaagcugugcgucacuccugcgugucgaaccauuugugugcgcacagugucggacugauuucacaccccauuggaagcaagagaaaaacggaaagauacuuugcgaacaguguaugaccaguaaucagaaaaaggccuugaaggcugagcacaccaaccgacugaaaaaugccuuuguuaaggcacuccagcaagagcaggaaauugagcagagacugcaacagcaggccgcucuuuccccgacgacugccccugcagugagcucugucucaaaacaggaaacaaucaugaggcaucacacccugcgccaagcgccacagccccagaguagcuugcagcggggcauuccuacuuccgcuagaucuaugcucucgaacuucgcccaagcaccccagcugagcgugccaggcggguuacugggaaugccugguguaaauaucgccuaccuaaacacaggcaucgggggacacaagggccccucccucgcugacaggcagcgcgaguaucugcuugauaugauuccaccgcgaucaauaagucagucuaucagcggucaaaaauga

SEQ ID NO: 56587 - RNA, 1674 nt, Artificial Sequence
  derived and/or modified sequence opt3 from GATB__Homo_sapiens__NP_004555
auggccgcucccaugcugagauggggcugcagggggcggcgcugggcauucgcccgaguggacggagguagcugucaccguagaggcgcgccuaccggguccacaucuaaccagaucaggggagagucaagugucgcucaacagccacuccauacugcccagaagacgcggaaaggcgaacacaagugggcagccguugugggucuugagauucaugcucagauaagcuccaauucuaaacuguuuucggggucacaaguacgcuucagcgcaccgcccaacaguuugguguccuuuuucgaugccucuuuaccuggaacccugccaguccuaaauagaaggugcguggaagcugccguuaugacaggccucgcgcugaacugucacaucaauaagaaaagccuuuuugaccggaagcauuacuucuaugcagaucugcccgccggcuaccagauuacucagcagcgcuugccuaucgcugugaacgggucccucauuuauggagucugcgccgguaagaaacaaucacaggugaucccaaagaccguacgaauaaaacagauccagcuggagcaagacaguggcaagagccugcacgauaaucucagaucucagacauuaauugaccugaacagggcagggguuggacuuuuggaagugguccuggagcccgauauguccuguggcgaggaagcugccaccgcggugcgggagcuacagcucauccugcaagcccuugguacuucacaggcaaauauggcugaagggcagcugcguguggacgccaacauuagcguccaccauccuggagagccauugggcguucgcacagaggugaaaaaucucaacaguaucagauuucuggcuaaggccauagauuacgaaauucagaggcaaaucaaugaguuagaaaacggcggggagauucugaaugaaacccggucuuuccaccauaagcucggaugcacgauguccaugcgagacaaagaggguaagcaggauuaucgcuuuaugccggagcccaaccuuccuccacugguauuguacgacgcaacuagccuacccgccggcgcugauccucaacaggugaucaacaucgaccagauuagagaaacccugccagagcuccccucggucacaagggaaaaacuggugcagcaguaugggaugcuucuggagcacucuuucacuuugcucaaugaaguuggacuguuagaguuuuuccagaacgugauaaaggagacccgggcggaaccgaaaaaggucacauccugggugcugaauaccuuucuaggcuaccucaaacaacagaaccuggcaguaucagagaguccuguuacgcccagcgcccuugcugaauugcuggaccuccuggauucccgcacuaucucuagcucagccgcaaaacagguguucgaggaacuuuggaagagagaggguaagacaccagggcagauugucagugagaagcaacuggaauugaugcaggaccagggcgcccucgagcaacugugucacuccgugauggaagcucauccucaggucgugauggauguuaaaaauaggaacccccgugccaucaauaaguuaauaggacuggugcggaaagcaacccagagccgagcggacccaguaaugauuaaggagauccuagagaagaaacucucucuguga

SEQ ID NO: 56588 - RNA, 1272 nt, Artificial Sequence
  derived and/or modified sequence opt3 from GATM__Homo_sapiens__NP_001473
augcugagagugaggugccuccggggcgggagccgcggagccgaggcuguccacuacaucgguucccgacuuggccguacccugacaggguggguucagagaacuuuccaaucuacgcaggcagccaccgcgucaaguaggaacagcugugcugccgacgauaaggcaacagaacccuugccuaaagacugcccaguguccucuuauaaugagugggauccguuagaagagguaauugugggacgggccgaaaacgcuugugugcccccuuuuacuauagaggucaaggcaaauaccuacgagaaauauuggccauucuaccagaagcagggcggucauuauuuucccaaagaccaccugaagaaggccguugcugaaaucgaggaaaugugcaacauucuaaaaacagagggggugaccguccgcagaccugauccaaucgacuggucgcucaaguacaaaacucccgauuucgagucaacaggacuguauagcgccaugccuagggacauucuuaucgugguaggcaaugaaauaaucgaggcgccaauggcauggcggagucgcuuuuucgaauaccgagccuacagauccauuaucaaggauuauuuucauaggggcgcuaaauggaccacggccccgaagcccacuauggcagacgagcuguacaaccaagauuauccuauucacucuguugaagaccggcauaaguuggcugcccaggggaaauucgugaccacagaguuugagccauguuucgaugcggccgacuuuauccgugcaggacgcgacauauucgcucagagaagccaggucacuaauuaccucgguauugaauggaugaggcggcaccuggcccccgauuaucgagugcacaucauuuccuuuaaggacccuaacccaaugcauaucgaugcuaccuucaauaucauuggccccgggauagugcugucaaacccggaccgcccuugccaccaaaucgaucucuucaaaaaggccggauggacaauuaucacgcccccaaccccuauaauucccgacgaucauccauuauggaugaguagcaaauggcugucuaugaauguccuuauguuggacgagaagagaguuaugguggaugcaaacgaaguacccauccagaaaauguuugagaagcugggcaucacuacaauuaaggugaauaucaggaacgccaauucccuaggugggggauuccacuguuggaccugcgacguccggcgcagaggcacucuccagucauaccuggauuga

SEQ ID NO: 56589 - RNA, 2784 nt, Artificial Sequence
  derived and/or modified sequence opt3 from GBA2__Homo_sapiens__NP_065995
augggcacccaggaccccgggaacaugggaacaggugugccugccagcgagcaaaucuccugcgcuaaggaagauccacaggucuacuguccggaggaaacuggcgggacgaaagacguucaggugaccgauugcaagucucccgaggacucaagaccuccaaaagaaacagauuguugcaaucccgaggacaguggacagcugaugguaagcuaugagggcaaggcaauggguuaccaagugccuccauucggguggaggauuugucucgcccacgaauuuacugagaaacggaagcccuuccaggcgaacaaugucucccuuucuaacaugauaaagcauaucggaaugggccugcgcuauuugcaguggugguaccgaaaaacccacguggaaaagaaaacaccuuuuauugauaugaucaauucgguuccauuacgucagauuuauggcugcccgcuagggggaaucgguggcgggaccauaacuagaggauggaggggccaauucugucgguggcagcugaaccccgguauguaccagcaucgcacagugaucgcugaccaguuuaccgucugccucagaagggaggggcaaacgguguaucagcagguacugucacuugagcggccuagcguucugcgcaguuggaauuggggauuguguggcuacuucgccuuuuaccacgcacucuauccacgagccuggacuguguaccaacugcccggccagaacgucacccugacaugcagacagauuacuccuauccucccacaugauuaucaggacuccucuuuacccguggggguguucgucugggauguugaaaaugagggagacgaagcucuggaugugagcauuauguuuuccaugaggaacggucuuggcgggggagacgacgcaccgggcgguuuguggaaugagccuuucugucuggaacggucaggggagaccguacguggccuacuccugcaccaccccacacuuccaaacccuuacaccauggccguggcugcccgcgucacggcggcaacuacagugacccauaucacugccuuugaucccgacaguacaggacaacagguuuggcaggaucuguugcaggacggccaacucgauagcccaaccgggcagucuacgcccacccagaagggaguggguauagcuggcgccgucugcguguccucaaaacugagaccuagggggcagugccgguuagaguucagccuggcaugggacaugccacgaauuauguuuggagcuaagggccaaguacacuaucgcagauacacaagguucuucggucaggauggggacgccgcgccggcccucagucauuaugcacuuugucgguacgcugaaugggaggaacgcaucucugccuggcagucccccguucuggaugacagauccuugccugcuugguacaagucggcccuauuuaaugagcuguauuuccucgcagauggcggaacuguguggcuggaaguccuugaggacucucugccagaggaauugggcaggaacaugugccaccuccgucccacccugcgggacuacgggcgauuuggauauuuagagggucaggaauacagaauguauaauacauacgaugugcacuucuaugccuccuuugcucugauuaugcuauggccuaaacucgagcugucacuucaauacgacauggcguuggcaacucugagggaagaucucacccgccggagauaccugaugaguggcgucauggccccagugaagaggcgcaacguuaucccccaugacaucggggauccggacgaugagccuuggcuucgagugaacgcuuaucugauucacgacacagccgauuggaaagacuugaaucucaaguucguacugcaggucuaccgggauuauuacuuaaccggagaccagaacuuucugaaagauauguggccagugugucuagcaguuauggagagcgaaaugaaguucgacaaagaccaugauggccucauagagaaugguggguaugccgaccaaacuuacgauggcugggugacgacaggacccuccgcuuauugcggcgggcuguggcuugccgcagucgcggugaugguacagauggcugccuuguguggagcacaggacauccaggauaaguuuucuagcauucugucacguggccaagaagccuacgagagacuccuguggaacgguagguacuauaauuacgacaguuccagccgcccucagucucggucagugaugagugaucagugcgcugggcagugguucuuaaaggccuguggacugggcgagggugacaccgaaguuuuucccacucaacacgucgugagagcacuucagaccaucuucgaguugaacgugcaggcuuuugccggcggggcgaugggagccgucaauggcaugcagccacaugggguuccugauaaaagcuccgugcaaucugacgaaguguggguaggagucguguauggccucgcugcaacaaugauacaggagggucugaccugggaaggguuccagacugccgagggaugcuacaggacaguuugggagcgacuaggccuggcuuuccaaacgcccgaagccuauugucagcagcgcguguuucggucgcucgcauacaugagaccacugagcauuugggcgaugcagcuugccuugcaacagcagcagcacaagaaagcuagcuggccgaaggucaaacaagguaccggccugaggacugggccuauguucggacccaaggaggccauggcaaacuuaucaccagaauga

SEQ ID NO: 56590 - RNA, 1350 nt, Artificial Sequence
  derived and/or modified sequence opt3 from GBA__Homo_sapiens__NP_001165282
auggagcugagcaugggccccauccaggccaaccacaccgggacaggacuccuucugacuuugcaaccugaacagaaguuccagaaagugaaggguuuuggcggggcuaugacggacgcagccgcguuaaauauucuggcucuauccccaccggcccagaaccuccugcuuaaaucuuacuucucagaggaaggaauaggcuauaauaucauuagaguccccauggcaaguugcgauuuuagcaucaggaccuacacauaugccgacacuccugaugacuuccaacugcauaacuuuuccuugccagaggaagauaccaagcucaaaauuccccugauccaccgggcucugcagcucgcacagcgcccuguuucuuuacuggccucgccauggacaucacccaccuggcuuaagacuaauggugcugugaacgggaagggcagcuugaaaggacagccuggcgacauauaccaucaaacaugggcccgauauuucguaaaguuucuggaugcguacgcagagcacaaacuacaguucugggccgugaccgcugagaaugaaccaagugccgggcuccuguccggauauccguuucagugucuugguuucacgcccgagcaucagcgugacuuuaucgcaagagaucugggcccuacuuuggcuaacucuacccaccacaaugucaggcuccugauguuagacgaucaacggcugcuccuuccacauugggccaaggugguucugacagaccccgaagcggccaaauacgugcacgggauugcaguccauugguacuuggauuuccuagcuccugccaaggcuacucugggagagacccaccgccucuuuccaaacacaaugcuguucgccagcgaggcaugcgugggcuccaaguucugggaacagucaguaagacuugguaguugggacagggggaugcaguauagccacucuaucauuaccaaucuguuguaccauguugugggauggacggacuggaaccucgcccugaaucccgagggcggcccgaacuggguccggaauuuuguggauuccccuaucauaguggacauuacuaaagauacauucuauaagcaacccauguuuuaccacuuagggcauuucucaaaauuuaucccagaaggaagccagcgcgucggucugguugcuagucagaagaacgaccuagaugcgguggcacucaugcacccugacggcucugccguaguggucgugcugaaccgauccagcaaagauguuccccuuaccauuaaggacccagcugugggguucuuggagacuaucucgcccggauauucuauccauacauaccuguggagaaggcaguga

SEQ ID NO: 56591 - RNA, 744 nt, Artificial Sequence
  derived and/or modified sequence opt3 from GBAS__Homo_sapiens__NP_001189398
auggccgcuagagugcugagggcacggggcgccgcgugggcugggggacuccuucagcgcgccgcacccugcagccuguugccucgauuacguaccuggacauccucuucaaacagaaguagggaggacagcuggcugaagucccuauucguccggaaaguugauccacgcaaggacgcccacucuaaucuccuggcuaaaaaggaaacuucgaaccuuuacaaacugcaauuuaagagauguugccagagguucacgaagaucaauaccacauuggugcucugguggggucugggcacucgggggauggcaucacgcaccaaacuggaguuucucgaguuccgaaaggccagaagcgauauguuacugaguaggaaaaaccagcuuuugcuggaauuuuccuucuggaaugaaccgguaccccggucuggaccuaacauuuaugagcuacguagcuaccagcuccgcccaggcacaaugauagagugggguaauuauugggcuagagccaucagguuucggcaagacgggaacgaagcggugggaggcuucuuuucccagauuggccagcuguacaugguccaucaccuuugggcauaucgagaucugcagacccgcgaggacaucagaaaugccgcuuggcauaagcacgggugggaagaguugguguacuauacuguuccccucauucaagagauggaaucaaggaucaugauaccucugaaaacaaguccauuacaguga

SEQ ID NO: 56592 - RNA, 2109 nt, Artificial Sequence
  derived and/or modified sequence opt3 from GBE1__Homo_sapiens__NP_000149
auggccgcucccaugaccccugcagccagaccagaggacuacgaagcggcucugaacgccgcacucgccgaugugccggagcuugcuaggcuguuggaaaucgaccccuauuuaaagccuuacgcagucgauuuccagcggcgcuauaaacaauuuagccagauucugaagaauauaggcgagaacgaagggggaaucgacaaauucucccgagguuacgagucuuuuggcguucaccguugcgccgaugggggacuauauuguaaggagugggcuccaggcgccgaagguguguuccucacaggggacuuuaauggauggaaccccuucucauacccuuauaaaaagcuggauuacggcaagugggagcuuuacauuccacccaaacagaauaagaguguacuggugccucauggcagcaaauugaaggucgugaucacuuccaaaucuggggaaauucucuauagaaucucgccaugggcgaaguacguugugagggagggagacaacgucaauuaugauuggauacacugggacccggagcauucauacgaauuuaagcacagccggcccaaaaagccucgcagucugagaaucuaugagucccauguggguauuucuagccacgaaggcaaaguagcauccuacaagcacuucacgugcaacguucugccaaggaucaaagggcucggauauaauuguauucaguuaauggccaucauggagcaugcuuacuacgccucauuuggcuaucaaauaaccaguuucuuugcagcuagcucucgguacgguacacccgaggaacugcaggagcuuguggauacugcccacuccauggggauuaucgucuugcuggacguggugcauucacacgcgagcaagaacagugccgauggacuaaauauguucgacggcaccgacucuugcuauuuucacuccggcccucgcgggacacaugaucucugggacagccgacuguucgcauacucgucuugggaaguccuuagauuccuguuguccaacauuaggugguggcucgaggaauaucgguuugauggauuccguuuugacgguguuaccucaaugcuguaccaccaucacggcguggggcagggauucaguggcgauuauagcgaguacuuugguuuacagguagacgaagaugcucugacuuaccucaugcuugccaaucaucuggugcacacauuguguccagacuccaucaccaucgcugaggaugucucugggaugcccgcccuaugcagcccgauuucacaaggcggaggcggguucgacuaucgccuggcaauggccauaccugauaaauggauccagcuccugaaggaguuuaaggacgaagacuggaacaugggagauauuguguacacgcuuacuaauagaagguaucuggagaaauguaucgcuuacgcggaaagucacgaccaggcauugguuggugauaagucccucgccuucuggcugauggacgcugagauguauaccaacaugagcguguuaacacccuuuacuccagucauagaucggggcauucagcugcauaaaaugauccgacuaaucacccacgggcucggaggcgaagguuaccugaacuucauggggaaugaguuuggccauccugaguggcuugacuucccccgcaagggaaacaaugaaucuuaucacuacgccagaaggcaauuucacuugacagaugacgaucugcuccgguacaaauuccugaacaauuucgaccgcgauaugaacagacuugaggaaagguauggcuggcuggcagccccacaggcuuacgugucagagaagcaugaggggaauaagauuaucgccuuugaacgugcaggacucuuguucauuuuuaacuuccaccccaguaaaagcuauaccgacuaccggguagguacggcgcugccuggcaaguuuaaaauaguuuuagauuccgacgcugccgaguaugggggacaucagcgacuggaccacucuacugauuucuuuucggaagcauucgagcauaauggcagaccauacagccuacucguguauaucccguccagggucgcccugauucuucaaaacguggacuugcccaauuga

SEQ ID NO: 56593 - RNA, 5580 nt, Artificial Sequence
  derived and/or modified sequence opt3 from GBF1__Homo_sapiens__NP_004184
augguggacaagaacaucuacauuauacagggcgagaucaauauugucguuggggccaucaaacgaaacgcuagauggagcacccacacaccccuggaugaggaacgggacccucuccuucauuccuucggccaccugaaggaagugcuaaauucuauuacugaguuaucagaaaucgagccaaacguauuucugcgcccguucuuggaggugauacgaagugaagauacgaccggucccaucacaggccucgcucugacuagcgucaauaaauuucuuuccuaugcccugauugacccuacccaugaggggacagcggaaggaauggagaacauggcugaugccgugacccacgcacguuucguuggcacugacccagccucugaugagguggucuugaugaagauccuccaagugcugagaacacugcucuuaacccccguaggugcucaucugacgaaugaaucgguuugcgagauuaugcagucauguuuuaggaucugcuucgaaaugcggcuuagcgaguugcugcgcaaaagugcagaacacacucugguggacaugguccagcuccuguuuaccagacuuccucaguucaaggaggagccaaagaacuacguggggacaaauaugaaaaagcugaaaaugagggccggaggcauguccgauucuagcaaguggaaaaagcaaaagcgguccccacgcccuccacgacacaugacuaaagugaccccgggcucagaauugcccacaccuaacgggaccacgcucaguagcaaucugacuggagguaugccauuuauagacguccccacaccuauuucuuccgcuucaagcgaggccgcgagugcaguugugucuccauccaccgauagcggcuuagaguucucgucucagacuacauccaaggaggaccugaccgaucucgaacagcccgggucaccgggauauaguacggccaccgagccuggcagcuccgagcuugguguacccgaacagccagaccugcaagaggggacacauguggaaaaaucucagagcgcuucagucgagaguaucccugaaguguuggaggaguguacuucccccgccgaccacagcgauucugcaucaguucaugacauggauuacgugaacccaagaggagucagguuuacccagaguagccagaaggaaggcacagcucuagugcccuauggccugccuugcauucgggaacucuuccguuuucugaucucccuuacuaauccacacgaccgccacaacucugaaguaaugauccauauggggcugcacuugcucaccguugcccuggagucggcgccgguggcccaaugucagacauuacugggacuaauuaaagaugagaugugcagacaucucuuccagcugcuuagcauagaaagguugaaucuguacgcagcuucccuccgggucuguuuccugcuuuuugagucaaugcgagaacaccugaaguuccaaauggagauguauaucaaaaaguugauggaaauuaucaccguggagaaccccaagaugccuuacgagaugaaagaaauggcccucgaggcuauaguccagcuguggcgcauuccaaguuuugugacugaauuauacaucaacuaugacugcgauuacuauuguucuaaucuguucgaggaacuaacgaagcuccugagcaaaaacgccuuucccguuuccggucagcuuuacacaacccauuugcugucacucgacgcacuguuaacugugaucgauagcaccgaggcccacugccaggcuaagguacuaaauucucuuacacaacaggagaaaaaggaaaccgcgagaccuuccugugagauugucgacggcacuagggaagcaaguaacacagagcggacggccagcgaugggaaggcugugggaauggccucugacaucccaggcuugcaccuccccggugggggccgccugccgccugaacauggaaaauccggcugcucagaccuagaggaggcaguugauaguggggccgacaagaaauucgcuagaaagccacccagguuuagcugccugcucccugauccccgugaacugauugagaucaaaaauaagaagaaacuuuugauaaccggaacugaacaguucaaccagaagcccaaaaaggguauucaauuucugcaggagaaaggcuuacucacaaucccuauggacaauaccgagguggcccaguggcugcgggaaaacccccgacuugauaagaagaugaucggggaguucgucucggacaggaaaaauauugaucuguuggaauccuuugugucuacauucagcuuucagggacucaggcuggacgaggcacuacgccuguaucucgaagcguuccggcugccaggcgaggcuccgguaauacaaagacuuuuggaggccuucacugaaagguggaugaacuguaaugguucaccuuuugcaaacagugaugccugcuucucccuggcuuacgccgugaucauguuaaauaccgaccagcacaaccauaauguucgcaagcagaacgcacccaugacgcucgaggaauuucggaaaaaccugaagggggucaauggcggaaaagauuucgagcaggacauucuugaagauauguaucacgcuaucaagaacgaggagauugugaugccagaggaacagaccggccuggugagagaaaauuacgucuggaacguucuacuccaccguggggccacacccgagggaaucuuucugagagugccuacugcgucuuacgacuuggaccuguucaccaugacaugggguccaacuauagccgcuuuaagcuauguguuugauaaaucccucgaagagaccaucauucagaaggcaaucucaggcuucaggaagugugccaugauuagcgcucauuacgggcugagugacguauuugauaaucuuaucauaucucugugcaaauucacggccuuguccagcgagucgauugaaaaccuccccucagucuuuggaucuaauccuaaggcacacaucgcggccaaaacaguguuccaucuggcucaccgccauggcgacauucuacgggaggguuggaagaacaucauggaagccaugcugcagcuuuuuagagcacaacuccugccgaaagcuaugauagagguugaggauuucguggacccaaaugggaagaucaguuugcagagggaagagacccccuccaaccgaggcgaaagcacuguccugucuuucgugagcugguuaacacucuccggaccugagcagucaaguguucgcggcccaagcaccgaaaaucaggaggccaagcggguggcacuggaguguauuaaacaaugcgaucccgaaaagaugaucacugagucuaaauuucuucagcuggaauccuugcaggagcucaugaaggcccugguaucagucaccccugacgaagagacauaugaugaggaagacgcugcguucugucuagagaugcugcuuagaauugugcucgaaaacagggaucguguggggugcgucuggcagacgguucgcgaccaccuguaccacuugugugugcaagcccaggauuuuugcuucuuaguagagcgggcaguggucggacugcucagacuggcuaucaggcuucugcgacgggaagagauaagugcccagguguugcuaagccugcgcauucuccugcuuaugaaaccguccguuuuaucuagagugucgcaucaggucgccuauggccugcacgagcucuugaagaccaaugcugcaaacauccauagcggugacgacugggccacucuguuuacacuccuggaauguaucgggucaggagugaagcccccagcggcacuucaagccaccgcaagggccgaugcuccugacgcaggcgcccaguccgauagugagcugcccucuuaccaccagaaugacguuagcuuggaucgggguuauacauccgacucagaaguguacacugaucauggccgaccagggaaaauucacagaucugcgaccgacgcugaugucguaaacagcggauggcuagugguuggcaaggacgauguggacaacaguaaaccugggcccucccgcccaggaccgagcccucugaucaaucaauacucucucacggucggcuuagaccuggguccccacgauacaaagucacuucugaaaugcguggagucccucaguuucauuguaagggacgccgcacauauaaccccagauaacuuugaguugugcgugaagacucugcguaucuucgucgaagccagccucaaugggggauguaagucgcaggagaaacggggcaagucucacaaauaugacuccaaggguaacagauuuaaaaagaaaagcaaggaaggcucaaugcugaggcgcccccgaaccaguucucagcaugcuuccagagggggacagagcgaugacgaugaggacgaaggcguuccugccucauaccacacagugagucuucaagugagccaggaucuacuggacuugaugcacacuuuacauacccgggcagcuuccauuuauucuagcugggccgaggagcagaggcaccuggaaacagggggacagaagaucgaggcggauucccgcacgcucugggcccauugcugguguccacugcuucaaggcauugcaugccuguguugcgacgcucguagacagguccggaugcaggcccucaccuacuugcagagggcucugcuagugcacgaucugcaaaaacucgacgcacuugaaugggagucauguuucaauaagguucuguuucccuuauugacuaaacugcucgaaaacaucucuccugccgacguaggugggauggaggagacacgcaugcgagccaguacccugcuuucgaagguguuccugcagcaucucagcccguugcuguccuuaucuacuuucgcugcgcuauggcugacaauacucgauuuuauggacaaauauaugcacgcaggaucaagcgaucuucuguccgaagccaucccagagaguuugaagaauaugcugcucgucauggacaccgcugaaauuuuccacucugccgaugcaagaggcgguggccccagcgcccugugggagaucacgugggaacggauugacugcuuucuuccucaucucagggaugagcuguucaagcagacugugauccaggaccccaugccaauggagccucaagggcagaaacccuuggcuucagcgcaccugaccuccgccgcaggagauacacgcaccccaggccauccuccgcccccagaaauaccuagugaguuaggggcuugugacuuugaaaagcccgagagcccaagagccgcaucuuccucaagcccuggaucgcccguugccucuaguccguccaggcuaagcccaacuccugauggacccccaccccuggcucagccuccgcucauucuucaaccccuggccucaccauugcaagugggugucccucccaugacacugccuaucauccucaacccagcgcugauugaggcaaccucccccgugccucuuuuagccacaccacggcccacugacccgauaccuaccucugaaguaaauuga

SEQ ID NO: 56594 - RNA, 885 nt, Artificial Sequence
  derived and/or modified sequence opt3 from GBGT1__Homo_sapiens__NP_001269558
augcacagaaggcggcuggcccucggccuuggguucugccuguuggcuggaaccagcuuauccgugcugugggucuaccuagagaacuggcuccccguuucuuaugugccuuacuaucugccauguccggaaaucuuuaauaugaaacuucauuacaagcgcgagaagccccugcagccuguaguguggucacaauauccacagcccaaauugcucgaacaccgaccuacacagcugcugacucucacgccaugguuagcacccauugucagugaggguaccuucaacccugaacugcuucagcauauauaccaaccauugaaucugacaaucggcgugacuguuuuugccguggggaacccgagcuggucccagccccguucuucgucaugcgucggaaccggcuguacaaccacuagcagucuaacaacccuccagccuuucccagguuccagaugggugcccacgggguuuucugcgccuagcccauccaggguaacucccaccggacggcgccacccgugcgcuggcuggagaccuucagccaguacacugcuuaggggccugacugggcgguggaccacaagcucugcauugauguggaccugguguuucggaacgcgcggugcccuccgacccugggagacuugguggcugccauuuacacaggcuaccacuccuuuccccgcauccucaagcccaaugagugccggcguuuuucccuuaccucuguggcaaacagcuaaggggaccucuauuauggugggacaguccagcggcgguagauggccaggguauaugucgcuccuuggagccgcgacguggccgucuuggaggacccggcccauggcauccuggcugccuggcggccguaaagccacauga

SEQ ID NO: 56595 - RNA, 1092 nt, Artificial Sequence
  derived and/or modified sequence opt3 from GBX1__Homo_sapiens__NP_001092304
augcagagagccggcgggggaagcgcucccgguggcaacgggggaggcggugggggaggcccuggcaccgcauucuccaucgacucucugauugggccaccgcccccuaggucaggacaccuccuuuacacagguuauccaauguuuaugcccuaccggccucugguguugccacaagccuuagcgcccgcuccucugccagccggccuaccgccccucgcaccucuggccaguuucgcugggcgccuuacuaauacguuuugcgcaggacugggccaggccgucccaagcaugguugcuuugaccacagcccuccccuccuucgcggagccuccagaugcauuuuaugguccccaggaacuggccgcugccgcagcugccgcggccgcaacugcugcccgaaacaauccggagccugggggacguagacccgaaggcggccuggaggcugacgaacucuuaccagccagggagaagguggcagagccucccccacccccuccaccgcauuucucugaaaccuuucccucgcugccugccgaggggaaaguauacucaagcgaugaagagaaacuugaggcuagugcgggagacccagcagguuccgaacaggaggaagagggcucugggggagauagcgaagacgauggcuucuuggacuccucagccggugggcccggcgcucugcuaggaccuaagccaaagcucaaaggcagucuggggacaggagccgaggagggugcacccgugaccgccggcgucacugcuccugggggaaagagccggcgcagaaggacagccuuuaccucugaacaacuucuggaguuggaaaaggaguuccacuguaaaaaguaucucucccugacggaacggucacagauagcacaugcguuaaaacugagcgaggugcagguuaagaucugguuucagaaccgccgagcuaaauggaagagaauuaaggccggcaaugugaguucuagguccggugagccgguccggaacccaaaaaucgugguacccauuccuguucacgugaaucguuucgcaguccgcagccaacaucagcagauggaacagggggccagacccuga

SEQ ID NO: 56596 - RNA, 1047 nt, Artificial Sequence
  derived and/or modified sequence opt3 from GBX2__Homo_sapiens__NP_001476
augagcgccgcuuuucccccuucccugaugaugaugcagagaccacucggcagcucaaccgcauucaguaucgacagccuuauuggguccccgccccaaccuucuccaggacacuucguguacacagguuaucccauguuuaugccuuacaggccagucguucugcccccuccaccgcccccuccacccgccuugccucaggcggcuuuacagccagcccugcccccggcacauccucaccaucagauacccucgcuaccaacuggcuucugcucaagccucgcccaagggauggcucugacgaguacccuuauggcaacacugccuggaggcuuuuccgccucuccccagcaccaggaggcugccgcggcacggaaguucgccccacagcccuugccuggugggggaaacuuugauaaagcugaagcccuccaagcagacgcugaggauggcaagggcuuccuggccaaagaagggagccugcucgcguuuuccgccgcagagacugugcaggcuucauuaguaggagccgugcgcggucagggcaaggacgaaaguaaagucgaggaugacccaaaggggaaggaggaaucuuucucucuggaguccgauguggacuauucaagcgaugacaaucuuaccggacaggcugcccauaaagaagaggauccgggccacgcauuggaggaaacacccccuaguucuggugccgcuggguccaccacuagcacaggaaagaaccgacguagaaggaccgcguuuacgucggagcaacugcuagaacucgagaaagaguuccacuguaagaaauaccugucucuuacugaacggucccagaucgcacaugcccugaaguugucagagguucaggugaagauuugguuucaaaaucgcagagcuaaauggaagagggucaaagccggcaacgcaaauaguaagaccggcgaaccaagccggaaccccaaaaucgugguaccuauuccaguucacgugucccgcuucgccauccgaucucagcaucagcagcucgagcaagcuagacccuga

SEQ ID NO: 56597 - RNA, 654 nt, Artificial Sequence
  derived and/or modified sequence opt3 from GCA__Homo_sapiens__NP_036330
auggccuaccccggcuaugggggagguuucggcaacuuuagcauccaggugccugggaugcaaaugggacagccagucccggagaccggccccgcuauucugcucgacgguuacuccgggccugcauauucugauacauacucaagugccggagacagcguuuauacuuacuucuccgcgguggcuggccaggauggcgaaguagacgccgaggaacuucagagaugccugacgcaaucugggauaaauggaaccuauucgccauuuucauuggagacauguaggaucaugauugcaauguuagaucgggaccacacugguaagaugggcuucaacgccuuuaaagaacugugggcugcacuaaaugccuggaaggagaacuucaugaccguggaucaggacgggagcggaacagucgagcaucacgaacuccgccaggcuaucggccugauggguuaccgacuuaguccccagacccugacuacaauugugaaacguuacuccaagaaugggagaaucuuuuucgaugacuauguugccugcugugugaaauugagggcgcucaccgacuuuuuccggaagcgcgaucaucugcaacagggaucugcaaacuuuauauacgaugacuuccugcagggcacgauggccaucuga

SEQ ID NO: 56598 - RNA, 2328 nt, Artificial Sequence
  derived and/or modified sequence opt3 from GCC1__Homo_sapiens__NP_078799
auggagaaguucggcaugaacuuugggggaggucccagcaaaaaggaccugcucgaaaccaucgagacacagaaaaagcaacuucugcaguaccaggccagauugaaagauguggucagggcuuauaaguccuuacugaaggaaaaagaggcacuagaagccucuauuaagguucucucagugagucacgaggcggacguaggccuggcuggggugcagcuuccuggacugacuuucccagauagcgucgacgaucggugcuccacgcauucugaggacucgaccggcacagccacuucauuggauaccgcagccagccucacaaguaccaaaggugaauuugggguggaggacgaucgcccggcucgaggacccccuccacccaaguccgaagaggcaucuuggagcgaguccggcguuucaaguagcucuggcgacgggccuuucgccggaggugaaguggauaaacgucugcaccaacugaagacucagcucgcuacauuaaccuccucacuggccacggucacucaggaaaagagcagaauggaagcgaguuaccuugcagacaaaaagaaaaugaagcaggauuuggaggacgccucuaauaaagcugaagaggagagggcccggcuggaaggcgagcuaaaggggcuccaagaacagauagcagagaccaaagcucgccugaucacacagcagcaugacagagcccaagaacaguccgaucacgcgcuuaugcugagggaguugcagaagcuccugcaagaggaacggacucagcgccaggacuuagagcugcgacucgaagagaccagagaagcccuugcaggaagggcuuaugccgcugagcagauggagggcuuugaacugcaaacaaagcaguugacccgggagguggaggagcuaaaaagcgagcugcaggccauucgugaugaaaagaaccagccagacccccgccuccaagagcugcaggaagaggcagccagacuuaaaucgcauuuccaggcucagcugcaacaggaaaugaggaagacggcguuggcagaggaucagcuccggcagcaaucucagguagaggaacagcgaguugccgcucuggagaaucaaaucuccgaagugucagaguuacuggguacuuacgaaaaagccaagcagaaggaccagcuagcaauucagaaacucaaggagcgcauccugcaacuugauuuggagaacaaaacacuggcccucgcugccaguagcagauccccucuggacucucacggggaagagagcucacuugaugucaaugugcugaaggacaaaauggaaaaguugaagaggcucuuacagguggcagcgcggaaaagucaggucacccuggauguugagaagcugugugaccuagaaauaaugccauccagcgaggcugccgacggagagaaagcaacugcccucuauuaccagcaagaacugaagcagcuuaaagaggaauuugagcgcuauaagaugagagcucaggugguauugaagucuaaaaacacaaaggauggcaaucugggcaaagagcucgaagccgcacaggagcaacuggcugaauuaaaggagaaauacaucucacugaggcuuaguugcgaagaguuggagcaccagcaucagcaagaagccgacgauuggaagcaggagcucgcgcgucugcagcagcuacaccggcaagaacuggagcgaugucagcucgacuucagagauaggacccugaaacuugaagaggaguugcauaagcagcgcgaccgggcccuggcuguguuaacggaaaaggaucucgagcuggaacagcuuagaagcgucgcacuggccuccggguugccgggaaggcgcucucccguggguggcgggggaccuggcgacccagcugauaccucgagcuccgacucacucacacaagcccugcagcuagcagcggccaacgagcccacuuucuuucuguacgcugaacagcucgcccgaaaagagguugagauuaccagucugcggaagcagaaacaccgucuugaaguggagguccaccaauugcaggauagacuguuagaagagggugagaggcaucgcgaagagguggcagcucuccagucucacaucgaaaagaauauucgggaccagagcagagagggggccaaccuggaauaucuuaaaaauaucauauacagguuucugacacuaccugauucccucggccgacaacagacucugaccgcaauuuugacaauccugcauuucucaccagaggagaagcagguaauuaugcgcuuacccaccagcgccucuugguggccguccggaaagcgguga

SEQ ID NO: 56599 - RNA, 1317 nt, Artificial Sequence
  derived and/or modified sequence opt3 from GCDH__Homo_sapiens__NP_000150
auggcccugagaggcgugagcgucaggcuccuuucccgggggcccggacugcacguuuugcgcaccugggugucuucagcugcacagacagagaaggguggccgaacucaaagucaguuagccaaaagcucccguccugaguucgacuggcaggauccacugguacuagaagaacagcucacgaccgacgagauccugauuagagauacauuuaggacuuacugccaagaacggcuuaugccgcgcauacuguuggcgaacagaaaugagguguuccauagggagaucauuucugaaaugggggagcucggaguccugggccccaccaucaaggguuaugggugugcuggagugucgucaguugccuacggccugcucgcacgggaauuagagcgcguggacagcggcuaucgaagugccauguccguccagucuagccuggugaugcacccuauuuacgcuuauggguccgaggaacagagacagaaauaccuuccacaauuggcaaagggagagcugcuagguugcuuuggccucacagaacccaacucagggagugauccuagcucuauggagaccagggcccauuauaauuccucaaacaaaagcuacacucugaauggaacaaagaccuggaucacgaacaguccaauggcugaccuuuucguaguuugggcccggugugaagauggcugcauacgugguuuucuguuggagaaggggaugcgcggacucucugcgcccagaauccagggcaaauucucccugagggcaagcgccacuggcaugauuaucauggacgggguggaggucccugaagagaauguguuaccaggagcuucgucucuggguggcccguuugggugucucaacaaugcccgguacggaauugcauggggcgugcuuggugcuuccgaguucugccugcacaccgcccgacaguaugcguuggaucgcaugcaguuuggggucccccuagccagaaaccaacugauccagaagaaacucgcagacaugcugacagaaauaacucuuggccugcaugcuuguuugcagcucggaaggcugaaggaucaagacaaagccgcuccugaaaugguuucauuacugaagcggaauaacugcggcaaggcccuagauauugcacgccaggccagagacaugcucgggggaaaugguaucagugacgaguaccacgugauuaggcacgcuaugaaccuggaggcgguaaauaccuaugaaggcacacaugauauccacgcacuuaucuuggggcgugccauuaccggaauacaggcuuucacggccagcaaauga

SEQ ID NO: 56600 - RNA, 2346 nt, Artificial Sequence
  derived and/or modified sequence opt3 from GCFC2__Homo_sapiens__NP_003194
auggcccacagacccaagaggaccuuccggcagcgcgcugcagacagcuccgauucugacggcgccgaggaaaguccugcggagccaggggcuccgcgagaacugcccgugccuggaagugccgaggaggaaccacccagcgguggcgggcgugcacaagucgccggacucccucauagaguuaggggcccacggggucgcgggagagugugggcuuccucuaggcgggcaacaaaagccgcuccccgcgccgaugagggaucggaaucacgaacucuugacguaagcacggaugaggaagacaagauccaccauaguuccgagucuaaagaugaccagggccugagcuccgauucaaguagcucuuugggcgagaaggaauuauccucaaccgugaaaauuccugacgcggcauuuauacaggccgcuagaaggaagcgggagcuggcccgugcacaggaugacuacaucagccuagauguccaacacacaaguucuauuuccgggaugaagcgcgaaagcgaggacgacccagaaucggagccggaugaccaugagaaaagaauccccuucacucucaggccucagacccugcggcagcgaauggcugaagagucuauuucccgcaacgaagagacaucagaagagagucaggaggaugaaaagcaagacaccugggagcagcagcagaugagaaaagccgugaagaucauagaagagagggauaucgaccuuagcugcggaaaugguuccucuaaaguuaagaaguuugauacuagcauuucauucccacccgugaaccuggaaaucauuaaaaagcaauugaauacacggcucacccugcugcaggagacgcaccgcagucaccucagagaguaugaaaaauacguccaggacgugaaguccagcaaaucuacuauccaaaacuuagagucaaguagcaaucaggcgcugaacuguaaguuuuauaaauccaugaagauauacguagaaaaucuuauugauugcuugaacgagaagaucauuaauauccaggagaucgaaucuucgaugcaugcccugcuacucaaacaggcaaugaccuucaugaagaggcgucaagacgagcugaaacacgaaagcacauaucuucagcagcugucccggaaggaugagacuucaaccaguggcaacuuuucuguugacgagaaaacacaguggauuuuggaagagauagaaagccgaagaaccaagaggcgccaagcucgggugcucuccgggaauuguaaccaucaggagggaacgucaagcgacgaugaacugccuucugccgagaugaucgacuuccagaagucccagggcgauauuuuacaaaaacagaagaaagucuuugaagaggugcaggacgauuucugcaauauccagaacauacugcucaaguuucaacaguggagagagaaauucccagacaguuacuaugaggcuuuuauuagccuuuguauccccaagcuguugaauccgcuaaucagggugcagcugauugauuggaacccucucaagcuggaaucuacuggucuuaaagaaaugcccugguucaaguccgucgaggaguucauggacucaaguguugaagauagcaaaaaggagucguccucugacaaaaaggugcugagcgccaucauuaacaagacaauaaucccacgcuugaccgauuuuguagaguuccucugggacccucugucaacuucacaaacaaccuccuuaauuacgcacugccgagugauccuggaagaacacucuaccugugagaaugaggucagcaaaucccggcaggaucuacucaagucaaucgugagccguaugaaaaaggcaguugaagacgacguguuuauuccccuguacccaaaaagugccgucgagaacaagacaucuccccauuccaaauuccaggaaagacaguuuuggagcgggcuuaaguuguucaggaauauacugcucuggaacggacugcuuacugaugacacccugcaagaguugggccucggcaagcuguuaaaucgcuaccugaucauugcucuacucaacgcgacaccugggccagaugugguuaaaaagugcaaucagguagcagccugucugccggaaaaaugguuugagaacucggcuaugcggacuucaaucccccagcuugagaauuucauucaguuuuugcugcaaucugcccacaagcucaguagauccgaguucagggacgaaguggaagagaucauacugaucuuagucaaaauuaaggcacugaaccaggccgagagcuuuaucggagaacaucaccuugaucauuugaagucucucauuaaagaggacuga

SEQ ID NO: 56601 - RNA, 543 nt, Artificial Sequence
  derived and/or modified sequence opt3 from GCG__Homo_sapiens__NP_002045
augaaaagcaucuacuucguggccggccuguuugucaugcucguucagggguccuggcaaagaucucuucaggacaccgaggaaaagucaaggaguuucagcgcuucccaggcagauccccugucugacccugaucagaugaacgaggacaagcggcacucgcaaggaacauuuacuucagauuauagcaaauacuuggacagucgccgagcccaggauuucgugcagugguuaaugaauacgaagcguaacagaaauaacauugcgaaaaggcaugacgaauuugagcggcacgcugaagguaccuucacauccgauguaucuagcuaucuggagggccaggccgcaaaggaguuuauagccuggcuagugaaggggcgcggaagaagggacuucccagaagaggucgcuaucguggaggaacucggccggcgccaugcagaugguuccuuuucagacgagaugaauacuauucuggauaaccuugccgcucgagacuucaucaauuggcugauucaaaccaaaaucacagacagaaaguga

SEQ ID NO: 56602 - RNA, 1434 nt, Artificial Sequence
  derived and/or modified sequence opt3 from GCGR__Homo_sapiens__XP_006722340
augcccccuugccagccacaaagaccgcugcuccuucuguuguuacugcuagccugucagccccaggugccuagcgcucaggucauggacuuccucuuugagaaguggaaacuguacggcgaucaaugccaccauaaccuuucccuguugccacccccuaccgaacucguuuguaauaggacauucgacaaguauucuugcuggccagauacucccgcaaacacgaccgccaauaucucauguccuugguaccugccauggcaccauaaagugcagcaccgguuuguauucaagcgcugcgggccggacggacagugggugcgagguccccguggccagccuuggagagaugcgagucaaugucagauggacggggaggaaauugagguccagaaagaaguggcuaagauguauagcuccuuucagguuauguacacagugggauauucucugucgcucggcgccuuacugcuugcauuggccauacugggugggcuaucaaagcuccauugcacuaggaacgcuauccacgcaaaucuguucgccagcuuuguccuuaaagcuaguuccgugcugguaauugauggauugcuccggacccgcuacucucaaaagaucggcgacgaucugagcguuuccacaugguuaucagacggcgccguggcgggguguagagucgcagccguguucaugcaguauggaauuguggcuaacuacugcuggcugcucgucgagggucuuuaccugcacaauuugcuaggccuggccacccucccagagaggagcuuuuucagucuguaucuugggaucggauggggcgcacccaugcuguuuguugugccuugggcuguagugaaauguuuguucgaaaacguccagugcuggacuucuaaugauaacauggguuuuugguggauacuccgguucccaguguuccuggccaucuuaauuaacuuuuucaucuuuguucgcauugugcaacugcuagucgcgaagcuccgagccagacagaugcaucacacagacuacaaauucaggcuggcaaaguccacccuuacguugaucccccugcucggggugcaugagguaguuuuugcuuucgugacugaugaacacgcccagggaacccugcggucagcuaaacuuuucuuugaccuguuuuugagcaguuuccagggccuccuggucgccguguuauauugcuuucugaauaaggagguccaaucugagcuacgucgcagauggcacagguggcggcucggcaaggugcugugggaggaacgaaauacauccaaccaucgcgcaagcucgucuccggggcacggaccucccuccaaagaacuucaguucgguagaggcgggggaucacaggacaguagcgccgagacuccauuggcuggcggucugccuaggcucgcggaaucccccuuuuga

SEQ ID NO: 56603 - RNA, 753 nt, Artificial Sequence
  derived and/or modified sequence opt3 from GCH1__Homo_sapiens__NP_001019195
auggagaagggccccgugagagccccugcugaaaaaccaaggggagcacggugcagcaauggguucccggagcgcgaucccccucgaccaggucccucccguccugccgaaaagccacccagaccugaggcgaaaucugcucaaccagccgacggcuggaagggggaaaggccgcggucagaggaggacaaugaacugaaccuccccaaucuugcagccgcuuacaguagcauccuguccucuuugggagagaacccucaacgccagggcuuacugaaaaccccauggagagcagccucggcuaugcaguuuuucacaaaggguuaucaggaaacuauuucagauguccuaaaugacgccauauuugaugaggaccacgaugagaugguuaucgugaaggacauugauauguucagcaugugugaacaucaccucguacccuuuguggggaaaguccauaucggauaccugccuaacaagcaagugcuuggccugaguaaauuggcgaggauuguugagaucuauucccggcgccuccaggugcaggaacgacugacgaagcagauagcagucgccaucaccgaggcucugagaccagccggcguggggguaguuguggaagcaacacacaugugcauggucaugaggggagugcagaaaaugaacucuaagacugugaccagcacaaugcucggugucuuccgggaggaccccaagacccgugaggaauuuuuaacucugauucgcuccuga

SEQ ID NO: 56604 - RNA, 255 nt, Artificial Sequence
  derived and/or modified sequence opt3 from GCHFR__Homo_sapiens__NP_005249
augcccuaccugcucaucagcacccagauuagaauggaggugggcccuacaauggucggggacgaacaauccgauccagagcuuaugcagcaccugggagccucuaagaggcgggcuuuggguaacaauuucuaugaauacuauguugacgauccgccccgcauaguguuagacaaacuggagcgacguggcuuuagaguacuaucaaugacuggggugggacagacgcucgucuggugccugcauaaggaauga

SEQ ID NO: 56605 - RNA, 1425 nt, Artificial Sequence
  derived and/or modified sequence opt3 from GC__Homo_sapiens__NP_000574
augaagagagugcugguccuccuucuggccguugcuuucggccacgcauuggagagggggcgggacuacgagaaaaacaaggugugcaaagaguuuagccauuuaggaaaggaagauuucaccucccugucucuaguacucuauucacgcaaauuucccagugguacauucgaacaggugagccaacuggucaaggaagugguuucccuuacugaggccuguugcgcggagggcgcugacccugauuguuacgacacgcgaaccucugcccugucggcaaagucaugcgaaagcaauaguccauuuccggugcaccccgggacagccgaguguugcacuaaagaaggauuggagcguaagcucuguauggcugcacugaaacaucagccucaggaguucccaaccuaugucgaacccacaaacgaugagaucugcgaagccuuuagaaaggacccuaaagaguacgcuaaucaguucaugugggaauauuccaccaacuacggccaagccccacugucucucuuagugagcuauacuaaguccuaccugucaaugguagguaguuguugcacaagcgcgucucccaccguuuguuuucuuaaggagagguugcagcugaaacaccuaucccuccugacgacucuuucaaaucgggugugcagccaguacgcagccuauggggagaagaaaagucgccugucuaacuugauuaagcucgcucagaaagucccuaccgccgaucuggaagacguguuaccacuggcagaggauauaacaaauauccucuccaagugcugugaaagcgcuucggaggacugcauggccaaagaacuuccggagcauacugugaagcugugugauaacuugucuaccaaaaauuccaaguucgaggacugcugucaagaaaagacagcgauggaugucuuuguuugcaccuacuucaugcccgccgcacagcuaccugagcugccagacguggaacuccccacgaacaaagacguaugugauccuggaaauacuaaggugauggacaaauauacauuugagcugucaagaaggacccaccuuccagaagucuuccugaguaagguguuggagcccacucucaagagccugggcgagugcugugauguugaagacuccacaaccugcuucaacgcuaaaggcccguuacugaagaaagagcuaucuagcuuuauugauaaggggcaggaacucugugccgacuacucagagaauacguucaccgaguauaaaaagaagcuggcugaacggcuuaaagccaaguugccugaugcaacacccacugagcuggccaaacucgugaacaagcacagugacuuugcuuccaauugcugcagcaucaacucuccaccucuguacugugauucagaaauugacgcggagcuuaaaaacauccuguga

SEQ ID NO: 56606 - RNA, 1398 nt, Artificial Sequence
  derived and/or modified sequence opt3 from GCK__Homo_sapiens__NP_000153
augcuggacgauagagccaggauggaggcugcaaagaaagaaaagguggagcagauccucgccgaguuccaacuucaggaagaagaccugaaaaaggucaugcggcgcaugcagaaagagauggaucgaggcuugcguuuagagacccacgaagaggcgagcguuaagaugcugcccacauacgugagauccacuccugaagggucugagguaggagacuuucuaucacucgaucuggguggcacgaacuucagggugaugcuugucaaggugggggagggagaagagggccaguggaguguuaaaaccaagcaucaaauguauagcauuccagaagacgcuaugacagguacugccgagaugcuguuugauuacauauccgaaugcaucucugacuucuuggauaaacaccagaugaagcauaaaaagcucccgcugggguuuaccuucucguuucccgugcggcacgaggacauugauaagggaauccugcucaauuggacaaaaggcuucaaggcaucaggcgccgaggggaacaaugucgugggauuacugcgcgacgcuauuaaaagaaggggugauuuugaaauggacguaguugcaauggugaacgacaccgucgccacuaugaucagcuguuauuacgaggaucaucagugcgaagugggcaugauaguggggacaggauguaaugcuugcuauauggaggaaaugcagaacgucgagcuuguugagggcgacgaaggucggaugugugugaauaccgaguggggagccuucggggauaguggcgaauuggacgaguuucugcuagaauacgaucgccucguagacgaguccucugcgaacccuggccaacagcuguaugagaaacuuaucgggggaaaauacaugggugaacuggugcgauugguccuccugagauuaguggaugagaaucuccuguuccacggcgaagcaagcgagcagcuuaggacgcguggggccuuugagacucgguucguuucccagguggaaucagacaccggagaucgcaagcaaauuuacaacauccugaguacauugggccuaagaccaagcacuaccgacugcgauauugucaggcgggcuugugagucuguguccacacgagccgcacacaugugcucagcuggucuggccgggguaaucaaucgcaugagagaaagcaggagugaggacguuaugcggauaaccgugggcgucgacggaucuguguauaaacuccaucccuccuucaaggaacgcuuucacgcgagcgucagaaggcugacgccuucgugugagauuacuuucaucgagucugaagagggcuccgggcguggagccgcacuugugucagcuguugccugcaagaaggcuuguaugcugggucaguga

SEQ ID NO: 56607 - RNA, 1878 nt, Artificial Sequence
  derived and/or modified sequence opt3 from GCKR__Homo_sapiens__NP_001477
augcccggcaccaagagauuccagcacgugaucgagacaccugaaccagggaaaugggagcugagcggauacgaagccgcugucccgauuacugagaaguccaacccccucacgcaagaccuugauaaagcagacgccgaaaauauaguuaggcuguugggucagugcgaugcggagaucuuucaggaggaaggccaggcuuuaucuaccuaucaacggcuguacucagagaguauucuaacaacuauggugcagguagccgggaaggugcaggaaguccucaaagagccugacggaggccuggugguucuuagcggugggggaaccuccggccgcauggcauuccugaugucugugucguuuaaccaguugaugaagggccucgggcaaaagccacuguauacauaccugaucgccggaggugaucgaucagucguggcuagccgugagggcaccgaagacagugcacuccaugggauugaggaacugaaaaagguagccgcuggcaaaaagagaguuaucgugauaggaaucuccgucgguuuaucugcccccuucguggcggggcagauggauuguugcaugaauaacacugcaguguuucuuccugucuugguuggauucaauccagugagcauggccaggaacgaccccauugaggauugguccucaacauuucggcagguagcugaacgcaugcagaaaaugcaagagaagcagaaggccuucgugcugaauccugcaaucggcccagagggccuaagugggagcucuagaaugaaaggagguuccgcuaccaagauucuccuggaaacgcuucuguuggccgcgcacaaaacugucgaccagggcaucgccgcaucacaaaggugucuccuggagauauuacggaccuuugaacgcgcucaucaggugacauauagccagaguccgaagauugccacucugaugaaaucuguuuccaccagccucgagaagaaagggcacguguaccuugucggauggcagacacugggcaucauugcuaucauggaugguguggaaugcauccauaccuucggggccgacuuucgagauguaagaggcuucuugauuggagaccacucggacauguuuaaccaaaaggcagagcuaacgaaucagggcccccaguucacuuucucucaggaggauuuucugacauccauacucccuucacugaccgaaaucgacacuguuguguucauuuuuacacuugaugacaaccugaccgagguccaaacgaucguggaacaggucaaggagaaaaccaaucacauacaggccuuggcucauaguacaguggggcagacucuccugauuccauuaaagaaacuguuccccagcaucaucuccauuaccuggccucuacucuuuuucgaauaugagggaaacuuuauccaaaaguuccagagggagcugucuacaaaauggguucuuaauacugugagcaccggugcgcacguauugcugggcaagauucuccagaaccauaugcuggaucuucggauaucaaauaguaagcuguuuuggcgugcauuggccaugcuccagcgcuucuccgggcaaagcaaagcuagauguaucgaaucucuguuaagggccauucacuuuccacagccccugucagacgauauccgggcagccccgaucaguugccacguccagguggcucaugagaaggaacaaguuauuccuauagcccuacucagccugcuuuuccgauguuccaucacagaggcacaggcgcacuuggcugccgcacccucugugugcgaggccguccgcucggcucuggccggaccaggccagaaaagaaccgcagacccucucgaaauucuggagcccgaugugcaguga

SEQ ID NO: 56608 - RNA, 1914 nt, Artificial Sequence
  derived and/or modified sequence opt3 from GCLC__Homo_sapiens__NP_001489
augggccugcucagccaggggucuccccuuuccugggaggaaaccaagagacacgccgaccaugugaggcggcacggaauccugcaauucuugcauauuuaccacgcugucaaagaucgccauaaggacguuuuaaaauggggugaugagguggaauauaugcugguaucauuugaccacgagaacaagaaagugcgucuaguccucaguggcgaaaaggugcuggagacacuucaggagaagggggaacgaacuaauccuaaccacccaacgcuguggagaccggaguacggaagcuauaugauagaaggcacccccggucagccuuacgggggaacaauguccgaguucaauacuguugaggcaaacaugaggaaacggcgcaaggaagccaccucuaucuuggaggaaaaucaggcgcucugcacaauuaccucguuuccaagacugggcugucccggcuucacucugccugaggugaaaccaaaccccgucgaagggggagcuucaaagagccucuuuuucccugaugaggccaucaauaaacauccaagguuuaguacauuaacccggaacauucgccaccgaagaggugagaaggugguaaucaauguuccgauauucaaggacaaaaacacgcccuccccuuuuaucgaaacuuucaccgaggaugacgaagcaucuagggccagcaagccagaucauauuuauauggacgcuaugggcuuugggaugggaaauugcugucugcaagugacauuccaggcaugcuccaucucagaggcccgguaccuuuaugaucaguuggcuacuauuugucccaucgucauggcccugagugcggcaagcccuuuuuaccguggcuacgugucugacauagauugccgcuggggugugauuuccgccucagucgacgacagaaccagggaggagcgggggcuagagccacucaaaaacaauaacuaucgaaucagcaagagucgcuacgauucuauugacuccuaucugagcaaauguggagaaaaguacaaugauaucgaccuuacaaucgauaaagagauuuaugaacagcuguugcaagagggcauagaccaccuccuggcucagcacguugcccauuuauucaucagagauccccugacccucuucgaagagaagauucaccuugacgaugcaaacgagucggaccauuuugaaaacauccagucuacgaauuggcagacuaugagguucaagccgccucccccaaacuccgauauaggcuggcggguggaguuucgcccuauggaaguacaacugacagacuucgaaaauucagcuuacguggucuuugugguuuugcuaaccagagugauucugaguuauaaacucgacuuccugaucccccuuagcaaggucgaugagaacaugaaaguggcccagaagagggacgcgguacugcaggggauguuuuacuuccguaaagauaucugcaagggagguaaugccguuguggacggcugugggaaggcacaaaacuccacugaauuggcugccgaggaauacacacucaugucuauugauaccaucauuaauggaaaagagggcgucuuuccaggucugauacccaucuuaaacagcuaucuggaaaauauggagguggacgucgauacgcggugcucaauucuaaacuaccucaagcugaucaaaaagcgagcuaguggggagcuuaugaccguggccagauggaugagggaguucaucgcaaaucacccugacuauaaacaggauuccguuauuacagacgaaaugaacuacagcuugauacugaaguguaaucagaucgccaacgaacucugcgagugcccagaacugcuuggcucugcuuuucgcaaggugaaauauucaggaaguaagacugauagcuccaauuga

SEQ ID NO: 56609 - RNA, 1311 nt, Artificial Sequence
  derived and/or modified sequence opt3 from GCM1__Homo_sapiens__NP_003634
auggagcccgacgauuucgacagcgaagauaaggagauccuguccugggacauuaacgaugugaaacucccucagaaugucaagaaaaccgacugguuucaagaauggccagauucuuacgccaagcacauauauucaagugaggacaaaaacgcucagagacaucuuagcuccugggcaaugaggaauacaaacaaucacaacucucggauccugaagaagucgugcuugggcguugugguaugugggcgcgauugcuuagccgaagagggacgaaaaauuuaccugcguccggcgaucugugacaaggcuagacagaaacagcaaaggaagcggugccccaauugugaugguccucuaaaacucauuccaugccgcggccaugggggauuccccgugacuaacuuuuggagacacgacggcagguucaucuuuuuccagucaaagggugagcaugaucacccuaagccagaaacgaaacuggaggccgaagcacggcgcgccaugaagaaagucaauaccgcucccagcagugugucccuuucucugaaggggagcacagagacucgauccuugccuggagagacccagucacagggcagucucccacugacauggagcuuucaagaaggcguucagcugccggggucuuauuccggacaccucauagcaaacaccccacagcaaaauucauuaaacgacuguuucagcuuuaguaaaucuuacggucugggcgggaucacugaccuuacagaucagaccuccacgguggacccuaugaaguuguaugagaaaagaaagcugagcucgucuaggacuuacuccucaggagaucuacucccacccagugccagcggcgucuauuccgaccauggugaucugcaggcuuggucuaagaaugccgcgcuugggcggaaccaccuggcagacaauugcuacagcaacuacccuuucccauugaccucauggcccuguaguuuuuccccgagccagaacucuucagaaccuuucuaucaacagcucccccuggagcccccugccgcuaaaacaggaugucccccauuauggcccaauccugccggcaaccuguacgaagagaaggugcauguagauuuuaauaguuauguucagagcccagcauaccacuccccgcaggaggaccccuuccucuucacuuaugcuucucacccucaucaacaguacucgcuuccaagcaaauccucaaagugggauuuugaagaggaaaugaccuaucugggcuuggaccacugcaacaaugauaugcuacugaaccucugcccccugcguuga

SEQ ID NO: 56610 - RNA, 1521 nt, Artificial Sequence
  derived and/or modified sequence opt3 from GCM2__Homo_sapiens__XP_011513293
augcccgccgcugcagugcaggaggccgucggcguuugcagcuacgggaugcaacuguccugggacaucaacgauccucagaugccacaggaacucgcgcuuuucgaccaguuuagagaguggccggauggauaugugagguucauuuacucuucagacgaaaagaaagcucaacggcaccugagugguugggccaugcgcaauaccaacaaucauaacggccacauauugaagaaaagcuguuuagggguaguggucugcacacaggcauguacucugcccgauggaucccgacuacagcuccguccugccaucugcgacaaggcuagacugaaacagcaaaagaaggcauguccaaauugccauucugcccuugagcugauucccuguaggggccacucggguuauccugugacgaacuuuuggcgguuggaugggaaugcuaucuucuuucaggccaaaggaguucaugaccacccacgccccgaaucaaagagcgagaccgaggcgagaaggagugcaauuaaacggcagauggccuccuucuaccagccucaaaagaaacgcauccgagaaucugaggcugaagagaaccaggauagcuccggccacuuuucaaauauaccaccgcucgagaaccccgaagacuucgauaucgugacagagaccaguuuuccuauuccaggccagcccugcccuagcuucccaaagucugacgucuauaaggccaccugugaucuggcaacauuucaaggggacaaaaugcccccguuccagaaguacuccucaccuagaaucuaucugcccaggccaccuugcagcuacgaacucgcuaaucccggauacaccaacaguucuccauaucccacuuuauacaaagacuccacaagcauuccuaaugauaccgacugggugcaucugaacacgcuucaguguaauguaaacucguauucuuccuacgagcggucauuugauuucacuaacaagcagcacgguuggaaaccagccuugggcaagccgagucugguugaacguaccaaucaugggcaauuccaggcgauggccacacgccccuauuacaacccugagcuaccaugcagauaucucacuacucccccuccaggagcacccgcucugcagacagugaucaccacgacuacaaaagucagcuaccaggccuaccaaccgccugcuaugaaguauuccgacucugugagggaggucaagagccuuucaaguugcaauuacgccccagaagauaccggcauguccguguaucccgagccuuggggucccccaguuacugugacacgggcagccagcccuucugggcccccaccgaugaaaauagcuggagacugucgagcgauucgcccuaccguagcaaucccccacgaaccagugucaaguagaacggaugaggccgaaaccugggacgucugccugagcggcuugggcuccgcugugucuuacucggauaggguugggcccuuuuucacauauaacaaugaggacuuuuga

SEQ ID NO: 56611 - RNA, 8016 nt, Artificial Sequence
  derived and/or modified sequence opt3 from GCN1L1__Homo_sapiens__NP_006827
auggccgcugacacccaggugagcgagacacugaagagauucgcaggcaaagucacuacggccuccguuaaggaaaggcgggagauccucucugaacuugggaaaugcguggcgggaaaggaucugcccgagggugcuguaaaaggcuuguguaaguuauuuugccugacccuacaccgcuaccgagacgccgcaucacguagagcccuccaagcugcaauucagcagcuggccgaagcucagccugaggccacagcgaagaaccuucugcauaguuugcaaagcuccgggauaggaucuaaagcaggcgugccaucgaagucaagcgguagugccgcucuccuggcccugacuuggaccugucucuuagucaggaucguguucccgucccgggcaaaacgccagggggauauuuggaauaagcugguugaggugcagugccuuuugcugcuagaaguccucggaggcucucacaaacaugcuguggacggcgccguaaagaagcugacaaaacuuuggaaggagaaccccgggcugguugaacaguauuugagcgcgauccucucccuggagccuaaucaaaacuacgccggaauguuaggucugcucgugcaguuuuguaccucacacaaagagauggaugucgugagucagcauaagagcgcacuucuggacuucuauaugaaaaauauuuugaugucuaaggugaaaccacccaaguaccuacuggauuccugcgcuccucuccugagauaucuuucacacagcgaauuuaaggaccugaucuugccaacuauacagaaaagucuccugaggucucccgagaacgucaucgaaacaauuuccagcuuacuggccucgguuacccuagaucucucucaauacgcuauggacaucgugaagggccuggccgggcaccuuaaauccaauucaccucgguugauggaugaggcaguacuggcccuccgcaaccuggcucgacaguguagugacagcuccgcgauggaaucucuuacgaagcaucuguucgcaauuuugggaggcagcgaggguaaacucacuguggucgcccagaagaugucagugcugagugggaucggauccguuagccaccauguggucucuggcccaucaagucaaguguuaaauggcauaguagcugagcuguuuauuccguuccuacagcaggaaguucacgaggggacccucgugcacgccgucagcgugcuggcacuuuggugcaacagauuuacaauggaaguccccaagaaauugacugagugguucaagaaagccuuuucccugaagaccucuacaucggcugugaggcaugccuaucuccaguguaugcuggcaagcuaccggggagauaccuuacugcaagcgcuugacuugcucccucugcuaauccagacgguugaaaaagcugccucccagucaacucaggugccaacaauuaccgaggguguagcagccgcucugcuccugcuuaaguugagugucgccgacucucaagcagaggcuaagcugagcuccuucuggcaguuaaucguggaugaaaaaaagcagguuuuuacuucagagaaauuccucgugauggccagcgaagacgcgcugugcacaguccuucaccugaccgagcguuuguuccucgaucauccccaccgccugacgggcaauaaggugcagcaauaccauagagcccuaguagcugugcugcucucuaggaccuggcacguucggcgacaggcacagcagacaguccgcaaacugcuuuccaguuuggggggauuuaagcuggcccacggcuuacucgaagagcugaagacugugcuuagcucucauaaagugcugccucuagaggcucucgucaccgacgccggugaaguuacagaggcagggaaggcguaugugccacccagagugcugcaagaagccuuguguguaaucuccggcgucccgggacugaaaggcgaugugacugacaccgagcaguuagcucaggagaugcucauuauaucacaccauccuagucugguugccgugcaaagcgggcuuuggcccgcacuguuggcuaggaugaagaucgauccagaagccuucauuacacggcaccucgaccagaucauaccucgcaugaccacucagucgccccugaaccaguccucuaugaaugcaaugggaagccuaucaguccugaguccagauagagugcuuccccaacucauuuccacgaucacagccucuguucagaacccugcucugagguuggugacccgugaggaauuugcgaucaugcagacuccagccggugagcuguacgacaaaagcauuauccaguccgcacaacaggauucaauuaagaaagcuaauaugaagcgggaaaacaaggccuauagcuucaaagagcagauaaucgaguuagaacucaaggaggaaauuaaaaagaaaaagggcaucaaggaggaaguacagcugaccaguaaacaaaaggagaugcuucaggcccagcuggaccgagaggcucaagucagaaggcgcuugcaggaacucgacggggagcuggaagcagcccuaggacugcuugauaucauucucgcgaaaaacccgucuggccugacacaguacauacccguguugguggacuccuuuuuaccucugcucaagagcccacuggcugccccccggaucaaaaauccuuuccuuucgcuggcagccugcgucaugccaucaagauugaaggcucuagguacccugguuucucacgugacucucaggcugcuuaagcccgagugcguauuagauaaaaguuggugucaggaagagcuguccguggcagucaagcgcgccgugaugcucuugcauacacacacgauuaccagccgaguugggaaaggcgagccgggagcggcuccucugucugccccagcauuuagccucguguuccccuuucugaagaugguccuuacugaaaugccucaucacuccgaggaagaggaggaauggauggcccaaauccugcagauuuugacagugcaggcucagcuacgggccucacccaacaccccaccuggccguguugacgagaaugggcccgaacugcucccaagaguggcaauguuaaggcugcuuacaugggucaucggaacugguaguccgcgccugcaaguacucgcuagcgauaccuugacgacccugugcgccucuuccucaggcgacgaugggugugcguucgccgagcaggaagagguggacguucuccugugcgcacuucagaguccuugugcuagcgugcgggagacaguccuaagaggacugauggaauugcauaugguguuacccgccccagauacugacgagaaaaacggccugaaucuccugaggcgacuuuggguagugaaguuugauaaggaagaggaaauacgcaaacuggcugagcggcucugguccaugauggguuuggaccugcagcccgaucuaugcucucugcucaucgacgacgucauuuaucacgaggcagccguuagacaagccggggcugaagcgcuuucgcaggcaguggccagguaccagcgucaggcugccgaggugaugggccgccugauggaaaucuaucaagagaaguuauaccggccuccacccgucuuggaugcacugggaagagugauuagcgaaucaccuccggaccagugggaggccagguguggccucgcucuggcgcuuaacaaacugucccaguaccucgauaguucucaaguuaagccauuguuccaguuuuucguacccgacgcccugaaugaucgacacccugacgugcggaaaugcauguuagaugcagcucuagccacccugaacacacaugggaaggagaaugucaacagccuccuuccaguguucgaagaguuucugaaaaaugcacccaacgacgccuccuaugaugcuguucgccagucaguggucguguugaugggaucucuggccaagcaccucgacaagagcgauccuaaaguaaagccgaucgucgcgaaacugauagcagcccuuaguacucccucccagcaagugcaggaaagcguugcuucuugucucccaccucuggugcccgccauuaaggaggacgcuggcgguaugauccagagauugaugcagcaacuguuagagucagauaaauacgcagaaaggaagggggccgcuuauggacuagccggccuggucaagggucucggcauucuuucccugaaacagcaggagaugauggcagcguugaccgacgccauccaggacaagaaaaauuuccggcgaagagaaggggcucuguuugccuucgagaugcucugcacgaugcugggaaagcuuuuugaaccauacgugguucauguguuaccucaccugcucuuguguuucggcgaugggaaccaauauguccgcgaggcagcugacgauugcgccaaagcagugaugaguaaucugagcgcccauggaguaaagcuagugcugcccucgcuccuugcugcgcuggaggaagagucuuggaggacaaaggccggcuccguugaauugcugggugcaauggcuuacugcgccccaaaacagcucagcucaugucugccgaacauagucccuaaguuaaccgaggugcuuacugacagucacgugaaaguccagaaggccgggcaacaggcacugcgucagaucggaucuguaauucggaaccccgaaauccucgcuauugccccagugcuacuggaugcguugacagaccccuccagaaaaacccagaagugccugcaaacucuccuugauaccaaguuuguucacuucaucgacgcuccuagccuggccuugauaaugccaauugugcagagggcauuucaggaucgcucaacagacacgcgaaaaauggccgcucagaucaucggcaauauguauagucugaccgaucaaaaggaccucgcacccuacuuaccuagcgucacuccgggucugaaagccucccuucuggacccagugcccgagguuagaacagugucugcgaaggcucuaggcgccauggucaaagggaugggagagagcuguuucgaagaucuccugccuugguugauggagacccugacauacgaacaguccucaguggaccggucuggcgcagcccaggggcucgcugagguaauggccggacuuggcguggaaaagcuggagaaguuaaugcccgagauuguugcaacugcuaguaaagucgauaucgccccacaugugagggacgguuauauuaugauguuuaacuaccugccuauaaccuucggggauaaguuuacgcccuaugugggaccaaucauuccuugcaucuugaaagcgcucgccgacgaaaaugaguucguccgcgauacagcacugcgugcuggccagagaguuauuucgauguacgccgaaaccgcaaucgcucuacuucugccgcaacucgagcagggucuguucgacgauuuguggcggauaagguuuagcuccgugcagcugcucggcgaccuucuguuccacaucucugggguaacuggaaagaugaccacagagacugccucagaagaugacaacuuuggcaccgcccagagcaauaaagcgauuaucacagcuuuagggguggagcgccgaaacagaguccuggcaggauuguauaugggccgguccgauacgcaacucgugguuaggcaggccagucugcauguguggaagauugucguaucuaauaccccccgcacucuaagagaaauccuuccaacacuguucggucuccuguugggguuuuuagcuagcaccugugccgacaaaaggacuauagcagcccggacacugggagaccucgugcguaagcuuggcgagaagauucugccugaaaucauccccauucuagaggagggccugcgcucacagaaauccgaugaacgacaagggguuugcauaggacucagugagaucaugaagagcaccucuagagacgcuguguuguacuucuccgaaucacuggucccaacggcgaggaaagcccuuugugauccucuggaggaagugcgggaggcagcugccaagacuuuugagcagcuccacagcaccauuggucaccaggcauuagaagacauccugcccuucuugcugaaacagcucgaugacgaggaagucucggaguuugcccuugauggccugaagcaagugauggcuauuaagucucgcguugugcuaccguaucugguaccaaaacucacaaccccucccgugaacacuagagucuuggccuuccugaguuccguugcgggggacgcacuuacaaggcaucugggagugaucuuaccagccgucaugcucgcucugaaggaaaaauugggcacccccgaugagcagcuggagauggccaauugccaggcagugauacucagcguagaagacgauacaggucaccggaucauuaucgaggaccuucuggaagcuacucgaucaccugagguggggaugagacaggccgcugccauuauccuaaacauauacuguucccgcucuaaggcagauuacaccagccaucugaggagucucguuuccggauugauucggcuguuuaaugacagcucuccgguggucuuagaggaaucaugggacgcgcuuaacgccaucacgaaaaagcuggaugcuggcaaucaacucgcccugaucgaggaauugcacaaggagauucgucugaucggcaacgaaaguaaaggggagcaugugcccggauucugccucccaaagaaaggugucacauccauacuuccugugcugagagagggcguucuaaccgggagccccgaacagaaggaggaagcagcuaaagcccugggauuaguaauuaggcucacuucugcagacgcccugcgcccuucgguggucucaaucaccggcccauugauucggauccuuggugaucgauucagcuggaaugugaaggcggcucugcucgagacacuguccuugcugcuagccaagguugggauagcacucaaacccuuucuuccucagcugcagacuaccuucacgaaggccuuacaagacaguaacagaggagugaggcugaaagcugccgaugcacucggcaagcugauuucuauccacaucaaagucgacccauuguuuacagaacuucugaacggcauucgcgcuauggaggaucccggggugcgggacaccaugcuccaggcccugagauucguaauccagggagcgggugcuaagguggaugccguuauucguaaaaauauagucagccuauugcuguccaugcucggccacgacgaggauaacacuaggaucucaagugcagggugucuuggagaacugugcgccuuuuuaacagaggaagagcugucugcugugcuccaacagugccuguuggcagacgugagcggcauugacuggaugguccggcauggucgcucccuugcccugucaguugcggugaauguagccccggggcgacucugugcuggaagauauagcucugaugugcaggaaaugauccuguccagugcaaccgccgacaggaucccuauugcugucagcggcgugcggggcaugggguuccuaaugcgccaccauauagagacuggagguggccaguuaccagccaagcugucguccuuguuuguuaagugccuccaaaaccccucuucagauaucagacugguggcagagaaaaugauuuggugggcuaauaaggacccucuuccaccccuggauccgcaggccaucaaaccuauucucaaggcgcuguuggacaacacaaaagauaagaauaccgucgugagggccuacagcgaccaggcaaucguaaaccuucugaagaugcgacagggggaagagguuuuccaaagucuauccaaaauacucgauguggcuucucuggaagucuuaaaugaggugaaccggcguagccugaagaaauuggccucacaggcagacuccacggagcagguggaugacacuauccucaccuga

SEQ ID NO: 56612 - RNA, 1287 nt, Artificial Sequence
  derived and/or modified sequence opt3 from GCNT1__Homo_sapiens__XP_006717115
augcugagaacccuccuuaggcggcgccuguucagcuaccccacaaaguauuacuuuaugguguuggucuuaucccugaucacuuucucuguucuacguauucaccagaaaccugaguuugugucaguacgacaucucgaacuggccggcgagaacccaaguagcgacauaaauugcacgaaggugcuucaaggggaugucaacgaaauccagaaagugaagcuggagauuuugaccguuaaauucaagaagagaccgagguggacacccgacgauuauaucaauaugacuuccgacuguucuucguuuauuaaacggcgcaaguacaucguggaaccucucucaaaagaggaggcugaguucccaauagcauauagcaucgucgugcaccauaagauugaaaugcuggauagacugcucagggccaucuacaugccccagaacuuuuauugcauucacguagacaccaaaagugaagauuccuacuuagcggcuguuaugggaaucgccucuuguuucagcaauguguuugucgcaucccggcuggagucagugguguacgccaguuggagccgcguccaggcugaccuuaacugcaugaaggauuuguaugcaaugucugccaauuggaaguaccugauaaaccuaugugguauggacuucccuauuaaaacaaaucucgagaucguucgaaagcugaaacuucugaugggcgaaaacaauuuggagaccgaaagaaugccaucccauaaggaggaaagguggaaaaagcgguaugaggugguaaacgggaaacucacuaauacaggaaccgugaagaugcugcccccuuuagagacgccacuguuuucaggcagcgcuuacuucgucgugagucgugaauauguugguuacgugcuccaaaacgagaagauucagaaacuuauggaaugggcccaggauacuuauucuccggacgaguaccugugggcgaccauccagcgcauccccgaagucccuggguccuugccagcaagccacaaguacgaucuaucggacaugcaagccguggcuagauuuguaaaauggcaguauuucgagggagacguuucuaagggcgcccccuacccuccaugcgauggcgugcacgucagguccguguguauuuucggggcaggagaccugaauuggaugcuccggaaacaucaccuguuugcuaacaaguucgaugucgacguggaucuuuuugccauacagugccuggacgagcauuugcgacacaaggcgcucgaaacacugaaacacuga

SEQ ID NO: 56613 - RNA, 1203 nt, Artificial Sequence
  derived and/or modified sequence opt3 from GCNT2__Homo_sapiens__NP_001482
augccccugagcaugagauaccucuucaucauuuccgugucuucagucauaaucuuuauuguuuucaguguguuuaacuucggcggggacccuagcuuucagaggcuuaauaucuccgauccacugcgguugacccaaguaugcacaucuuucauuaacggaaagacucgcuuuuuauggaaaaauaagcugaugauccacgagaaaucgucauguaaggaauaucuaacgcagagccauuacauaaccgccccgcucaguaaagaggaagcugacuucccccuggcauauaucauggugauucaccaucacuuugauacauucgcccgacuuuuucgugcgaucuacaugccucagaacauuuauugcguccauguggacgagaaggcuacuaccgaguucaaggaugccguugaacagcuguuguccuguuuuccaaaugcauuccucgccucuaaaauggagcccguggucuacgguggcaucagcagacugcaagcugaccugaacugcauaagggaucucuccgcauucgaagugucauggaaguauguaauuaauacaugugggcaggacuuuccuuuaaaaaccaacaaggagaucguucaguaccugaaaggauucaagggcaagaauauuacuccaggugugcuucccccugcccacgcuaucgggcggacaaaauacguccaccaggaacauuugggaaaggagcugaguuaugugauccgcaccacggcccuaaaaccaccgcccccucacaaccucacuauuuacuuuggcagcgcguauguggcacugucuagagaguucgccaauuuuguccuucaugauccaagggcuguugaccuguugcaaugguccaaggauaccuucucacccgacgaacacuuuugggugacacucaaccggauaccuggcguaccagggagcaugcccaaugccaguuggacuggaaaccugcgcgcaaucaaauggucugauauggaggaccgacacgguggcugccaugggcacuacgugcauggaauuuguaucuauggcaauggugacuuaaaguggcuggucaacuccccgagccucuucgcuaacaaauuugaacuuaauaccuacccucugacaguggagugcuuggaacuaagacacagggagcggacccugaaccagucggagacggccauacagcccucuugguauuucuga

SEQ ID NO: 56614 - RNA, 1317 nt, Artificial Sequence
  derived and/or modified sequence opt3 from GCNT3__Homo_sapiens__NP_004742
auggugcaguggaagagacugugccaacuccacuaccuuugggcccugggcuguuauauguuguuagcuaccgucgcacugaaauugagcuucaggcucaagugcgacuccgaucaucuggggcuugagucucgggaaucacagagucaguacugucgcaacauccuguauaauuuucuaaaacuccccgccaagcgaagcauuaacugcuccggaguuacacguggugaccaggaggcggugcugcaagcuauacugaauaaccucgaagugaaaaagaagagagagccuuucacugauacgcacuacuuaucucugaccagggacugugaacauuuuaaagccgagcggaaguucauccaguuuccacuuucgaaagaggaaguagaguucccgauugcauauucaauggucauccacgaaaagauugagaauuuugagcgcuugcugagagccguguacgcuccccagaacaucuauugcguucauguggaugagaaaagcccugaaacauucaaggaagcagucaaggccauaaucaguuguuuuccaaauguguucauugcuuccaagcuaguaaggguuguguacgccucuuggagccggguccaggcggaccucaacugcauggaggaucugcuucaauccucagugcccuggaaauacuuucugaauacuuguggcaccgacuucccuaucaaaaguaacgcagaaauggugcaggccuugaagaugcucaaugggcgcaacagcauggagucugaggucccacccaaacacaaggaaacacgauggaaauaucacuuugagguugugagagauacccugcauuuaacuaauaagaagaaagacccuccaccguacaaccugacaauguucaccggaaaugcuuauauuguagccuccagggauuucgugcagcacguccucaagaaccccaaaucacagcaacuuaucgaaugggugaaggacacguacagcccugaugagcaucugugggcaacuuugcagcgggcucguuggaugccaggcaguguucccaaccacccuaaauaugacauaucugacaugaccuccauugcccgccuagugaaguggcagggucacgaaggggauaucgacaagggagcgccauacgcccccugcagcggcauucaucaaagagcaaucugugucuauggcgcuggggaucugaauuggaugcuccagaaccaccaucugcuugccaauaaauuugacccgaagguggaugacaacgcucugcagugcuuggaggaguaccucagguacaaagccaucuauggaacagaacuguga

SEQ ID NO: 56615 - RNA, 1293 nt, Artificial Sequence
  derived and/or modified sequence opt3 from GCNT7__Homo_sapiens__NP_542182
augagccagcugagagccaccaaguccggccucguggucagggcuguuaucugcauuuucauauuucuuuaccugcggaaccccacuccugcagagucugaagaggaaccagcccaaccggaggugguagaauguggguucuaucccgacgaguugugcucagcguuauuugagggaaaaggugcugccccucagaucgcaaaguucuguaaaacaccacacaagagugaaauucaugcccaucugcacacgcccggcaauugcagccgcaucucccgagggcuacacuuuauuacccguccucucucugcugaggaaggagauuucucgcuggcauacaucauaacaauccauaaagagcuugccauguuugugcagcuguugagagcuauuuaugucccacagaacguguacuguauccacguugacgagaaggcccccaugaaguauaaaacugcggugcaaacccucgucaauugcuucgaaaacguguuuauuucaagcaagacagagaaaguagcauacgccggcuucaccaggcugcaggcugauaucaauuguaugaagguucuggugcacaguaaauuucaguggaacuaugucauaaaucucugcggucaggacuucccuauuaagacuaaccgggaaaucauucauuacauccgcuccaaguggucugauaaaaauaucacaccaggggugauucaaccguuacacauaaagagcaaaaccucccagucacaucuggaguuugugcccaagggaaguaucuacgccccuccaaacaauagauucaaagacaagcccccucacaaccuuacgauuuauuucggcagcgcauacuaugucuugacuaggaaauuuguugaguucauccugaccgauauacacgcuaaggacaugcuacaguggucuaaggauauucgguccccagaacagcauuacugggugacacucaaucgccugaaagacgcccccggcgcgacuccgaacgccgggugggagggaaauguacgagcaaucaagagaaaaucagaagaggguaacgugcacgauggcuguaaggggagguaugucgaagacaucugcguguacggaccuggcgaucuucccuggcugauucaaagcccaaguuuguuugcuaacaaauucgagccuucuaccgacccccucguugugacaugucuggaacggcgucaucgcuuacagguccugagacaggccgaggugccaaucgagccccacuggcauuuucaacagcagucccacuucaauaugaggcucaaccgguga

SEQ ID NO: 56616 - RNA, 1653 nt, Artificial Sequence
  derived and/or modified sequence opt3 from GCOM1__Homo_sapiens__NP_001018100
augcugagaagcaccuccacagugacucuccuuucuggcggggccgcuaggacgcccggagcaccuucacggcgcgccaacgucugccgacugcguuugaccguuccaccggagagucccgugccugaacagugugagaagaaaaucgaaagaaaggagcaauuacuggaccuaagcaauggugaaccaacaaggaaacucccccagggcguaguguacggggucgugcggcgcuccgaucagaaccagcaaaaggagaugguuguguauggauggucuacuucgcagcugaaagaggaaaugaauuacauuaaggacgucagagcgacccuugagaaggugaggaaacggauguauggcgauuacgacgaaaugcgccagaagauacgacagcugacacaagaguugucaguaagccacgcucagcaggaguaucucgaaaaccauauccagacccaaaguuccgcccuggauagauucaaugcaaugaacucugcccuggcuagcgacuccauuggucuccagaaaacuuuaguugaugugacacuggaaaauucaaacaucaaggaccagauuaggaaucuucaacagaccuacgaagcaaguauggauaaauugcgggagaagcagcgucagcuggaagucgcccaaguggagaaccagcuacucaagaugaaaguggagagcucucaggaagcuaaugccgaggucaugcgcgaaaugacgaagaaacuguauucccaguacgaggaaaaacuucaagaggagcagagaaagcacucagcggaaaaggaggcacuguuggaagagacuaacagcuuucucaaagccaucgaagaggcuaauaagaagaugcaggccgcagagauaagucuggaagagaaagaccagaggaucggggaauuagaucggcugauugagcgaauggagaaggaacgccaucaacuccagcuucagcuguuggagcacgaaaccgagaugucuggagaacuaacagacuccgauaaagagagauaccagcaacuggaggaagcuagcgccucgcucagggagcggauccgccaucuggacgacaugguucacugccagcagaagaaagugaagcaaaugguagaagagauugaaucucuuaagaaaaagcugcagcagaaacaguugcucauccugcaauuacuggagaagauauccuuccuagagggcgaaaacaaugagcuccagucaagacuggauuaucuuacugaaacccaggcgaaaacagagguggaaaccagggagauuggcgucgggugugacuugcugccucgucucccauuucggcagaacgauaguagcucccacugccaaaagucuggaagccccaucucaagugaggaacgaagaaggcgcgacaagcagcaucuggaugacauuacggccgcacggcuucugccuuugcaccauaugccaacucagcuccuguccaucgaggagagcuuagcucugcagaaacaacagaagcagaacuacgaggagaugcaagccaaacuagcugcccagaagcucgcagaaagacugaauaucaaaaugaggucuuauaacccggagggugaaucaaguggccgcuaccgagaggugcgggaugaagacgaugacuggagcuccgaugaguucuga

SEQ ID NO: 56617 - RNA, 543 nt, Artificial Sequence
  derived and/or modified sequence opt3 from GCSAM__Homo_sapiens__NP_001177188
augggcaacagccugcucagagaaaauuccuucaggcggcagcaaaacacccaggaaaugcccuggaaugugcgcaugcagucuccuaagcagcgaacaucacguugcugggaccaccauaucgccgagggguguuuuugccuuccauggaaaaagauucugauauucgagaaaagacaagauagucagaacgagaaugaaaggaugagcuccacuccgauccaggacaacgucgaucagacguacucugaggaguuguguuauaccuuaauuaaucaccggguucugugcacacgccccucgggaaacucagcugaagaguacuaugaaaaugugccuuguaaggcagagagaccaagggagagccuagguggcacugaaaccgaguacagucuccugcauaugcccuccacagacccucggcacgcccgcucuccagaagaugaguaugaacuucugaugccccaucgaaucagcucccacuuuuugcaacagccuagaccacucauggcgccgucagagacccaguucagucaccuguga

SEQ ID NO: 56618 - RNA, 348 nt, Artificial Sequence
  derived and/or modified sequence opt3 from GCSAML__Homo_sapiens__NP_001268764
augggcaacuaccugcucagaaaacuuaggcaggagaugaccacauucgaacggaagcugcaagaccaggauaagaaaagccaggagguguccucuacuucaaaucaggaaaacgagaaugggaguggaagcgaagaggucugcuauacgguuaucaaccacauuccccaucaacgcuccucuuugucgucaaaugacgaugguuacgagaacauagacagcuuaacccgaaaggugcgucaguuuagagaaaggagugagacagaauaugcccugcuacggacuuccguaucucgcccuuguagcugcacccacgagcaugauuacgagguggucuucccacacuga

SEQ ID NO: 56619 - RNA, 522 nt, Artificial Sequence
  derived and/or modified sequence opt3 from GCSH__Homo_sapiens__NP_004474
auggcccugagaguggucaggagcguucgggcucuccuuugcacccugcgcgcagugcccuccccugccgcgccauguccgccccgaccuuggcaguugggcguaggggcugugcguacauuaagaacuggaccagcccugcuaucugucaggaaguucacggagaaacacgaaugggugaccacagagaacgguaucggcacuguugggauuucaaauuuugcacaagaagcccucggagacguggucuacugcagucugcccgaggugggcaccaaacuuaacaagcaggaugaguucggugcucuggaaagcguaaaggcagccuccgaguuguauucuccucucucgggggaaguuacagagauaaaugaagcucuggccgagaacccaggacuggugaauaaaucauguuacgaggacggcuggcucaucaagaugaccuuaagcaaccccagugaacuggaugagcuuauguccgaagaggcguaugaaaaguacauuaaaucuaucgaggaguga

SEQ ID NO: 56620 - RNA, 1416 nt, Artificial Sequence
  derived and/or modified sequence opt3 from GDA__Homo_sapiens__NP_001229434
augugcgccgcucagaugcccccucuggcacacaucuucagaggcaccuuugugcacagcacauggacuuguccaauggagguccucagggaccaccuucuggggguuuccgauucuggaaagauuguguucuuggaagaggccucacaacaggaaaaauuagcgaaggaguggugcuuuaaaccgugugaaauacgggagcugagucaucacgaguucuuuaugcccggucuaguagacacgcauauccacgcuagccaguacuccuucgccgggucuucgauugaucucccucugcuugaauggcugaccaaguauacauuuccagcagagcaccgcuuccagaacaucgacuuugccgaagagguguacacucgagucgugcguagaaccuugaaaaaugggacaaccacugcuugcuauuucgcaacaauucauaccgauucaagccuccugcuggccgacaucacggauaaguuuggacaaagggcuuucguuggcaagguguguauggaccucaacgauacuuuucccgaguacaaagaaaccacagaggaaaguauaaaggagacugaacgguucgucuccgagauguuacagaaaaauuauucucgcgugaagccuaucguaaccccaagauucagccuguccugcucagagacacuuaugggugaauuggggaacauugccaaaaccagggaccugcacauccagagucauauuagcgagaaucgggaugaaguugaggcggugaagaaccuauaccccucuuauaagaauuacacguccgucuacgacaaaaacaaucuccugacuaacaagacagugauggcacacggauguuaucuuucagccgaggaacugaauguguuucacgagcgcggcgcuagcaucgcccauugcccuaacaguaauuugucucucuccagcggcuuccugaacgucuuagaaguucugaaacacgaggugaagauagggcucggaaccgauguagcugguggcuacucguauucuaugcuugacgcaauuagacgagccgugauggucuccaauauccuguugauuaacaaagugaacgaaaagucacuaacucugaaagagguuuuuaggcucgcgacacugggcggaagucaggcccuuggccuggacggugaaaucgggaauuucgaggugggaaaggaguuugaugcaaucuugauuaacccaaaggcuagcgacuccccgauagaucucuucuacggcgacuuuuucggcgauaucucugaagccgucauucaaaaauuucuguauuuaggggacgaucggaauaucgaggaaguguacguaggagguaagcagguugugcccuucagcucaagugucaaagagaccauacaucugccugcuuccagcccacaucccccuccauuucccuga

SEQ ID NO: 56621 - RNA, 873 nt, Artificial Sequence
  derived and/or modified sequence opt3 from GDAP1__Homo_sapiens__NP_001035808
augagacugaacagcaccggcgaggugcccguccucauccacggggaaaauauuauaugcgaggccacacagaucauugacuaccuugaacaaacuuuccuggaugagaggacgccucgguugaugccagacaaggaauccauguauuacccgcgcguucagcauuaucgagaguuacuggauucucuacccauggacgcuuacacccacggauguauccuccauccugagcugacaguggauucaaugauuccagcauaugccacuacccguaucagaagucagauagguaacacagaaagcgagcuuaaaaagcuggcggaagagaaucccgacuugcaggaggcuuacaucgccaaacaaaagaggcucaaauccaagcugcuggaucacgacaacguaaaguaucucaaaaagauuuuagaugaacuggagaaagugcuugaccaggucgaaaccgaguugcagcggcgcaaugaagagacuccugaggaaggccagcaaccauggcugugcggggagucuuuuacacuagcagaugugucgcucgccguuacccugcauagacuuaaguuccugggauuugcuaggcggaacuggggcaaugguaaacgccccaacuuggaaacguacuacgagcgagugcucaagagaaagacuuucaauaaaguccuggggcacgugaacaauaucuuaauuucagcaguacugccuaccgccuuuaggguugcuaagaaacgggccccaaaggugcucggaacaacucuugucgugggccuguuggcgggcgugggguauuucgcauuuaugcuauuccguaaacgccugggaagcaugauccucgccuuuagaccgaggcccaacuacuucuga

SEQ ID NO: 56622 - RNA, 996 nt, Artificial Sequence
  derived and/or modified sequence opt3 from GDE1__Homo_sapiens__NP_057725
auguggcugugggaggaccagggcgggcuccuuggacccuucagcuuucuguuguuagugcugcuacucgucaccagauccccuguuaacgccugccugcuuacagguucucuguucguguugcucaggguauuuucauucgaaccagugccgaguugucgggcucugcaaguccugaagccccgcgaucgaaucagcgcaauugcccaccguggcgggucccaugacgcgccugagaauacucucgcugccauaagacaggcagccaaaaacggagcuacgggcguggaauuagauaucgaguuuaccucugacgguauuccaguucugaugcacgauaauacaguggacaggacuaccgaugggacaggacggcuuugcgacuugaccuucgaacagauccgcaagcugaaccccgcagccaaucauagacuaaggaacgauuuuccugacgagaaaauuccaacucuccgggaggcugucgccgaaugucugaaucacaaccuuacaaucuucuuugaugugaagggccaugcgcacaaagcaaccgaggcccugaagaagauguacauggaguucccccaguuguauaauaacucgguaguuugcucauuucucccugaagugauauacaaaaugcgccaaacggaccgagaugucaucacugcucugacccacagaccauggagcuuaagucauacaggcgacgggaagccgagguaugacacuuucuggaaacacuuuauuuucgugaugauggauauccugcucgacugguccaugcauaauauucuuugguaccuguguggaaucucugccuucuugaugcagaaggauuuugugagccccgcauaucugaaaaagugguccgcuaaggguauacaggucguuggcuggaccgugaacacauucgacgagaaaucauacuaugaaagucaccuagggagcucuuacauuaccgauuccaugguagaggacugcgaaccucacuuuuga

SEQ ID NO: 56623 - RNA, 1437 nt, Artificial Sequence
  derived and/or modified sequence opt3 from GDF10__Homo_sapiens__NP_004953
auggcccacgugcccgcuagaaccagcccuggcccagggccgcagcugcuccuucuguuguuaccccuguuccuacuccugcuuagggacgucgcaggaucccaucgggccccugcguggucugcucugccagccgcagccgaugguuugcaaggcgaccgcgaucuccagcgacaccccggggacgcugcagccacacugggaccuucagcucaggauaugguugccgugcauaugcaccgucuguacgagaaguauaguagacagggcgcgaggccaggugggggaaacacuguacggagcuuucgcgcaagacucgaaguggucgaccaaaaagccguguacuucuuuaauuuaacguccaugcaggauucugagaugauccugaccgcuacauuccauuuuuauucggaacccccuagguggccacgggcccuugagguuuugugcaagccgcgcgcuaaaaacgcaucaggccgaccccugccucuaggcccacccacuagacagcaccuccuguucaggagccuuagucagaauaccgccacacaagggcuguugcggggagcgauggcccucgcaccuccaccccguggucuguggcaggcuaaggacauuuccccgauagugaaagccgcucgcagagauggcgaauuacugcucucugcccagcuugacagcgaggagagggauccuggggucccccggccauccccuuacgcacccuauauccugguguacgccaacgacuuggcuauuucagaaccaaauaguguagcgguuacccuacagcgauaugaucccuuuccugcaggagacccagagccgcgcgccgcucccaacaauagcgccgacccuagagugaggcgggcagcccaagcuacuggcccacugcaggauaacgaacuccccggucuggacgagcgcccuccaagagcccacgcacagcauuuccacaagcaucaacuuuggcccucuccguuuagggcgcugaagccucguccagggcggaaagaucgaagaaagaaaggacaggaggucuucauggcugccucccagguguuggacuuugaugaaaagacaaugcagaaagcaaggcgcaagcaaugggacgagccccggguguguucaagaagguaccucaaggucgauuucgccgacaucggcuggaaugaauggauuaucagcccuaaaaguuuugaugcuuacuauugcgccggcgcaugugaguuccccaugccaaagauaguucgcccuucuaaccacgcuaccauccaguccauugugcgagccguagggaucauucccggaaucccagaaccgugcugugugccugacaaaaugaauagccugggugucuuauuccuggaugagaaccggaaugugguucuaaagguguaccccaacaugucggucgacacgugcgcgugucguuga

SEQ ID NO: 56624 - RNA, 1224 nt, Artificial Sequence
  derived and/or modified sequence opt3 from GDF11__Homo_sapiens__XP_006719257
auggugcuggccgcuccccuccuucugggcuucuuguuacuggcacuagagcucagaccuaggggagaagccgcggaggggccagcugccgcagccgcugcagccgcugccgcggcagccgcuggugucggcggggaacggagcucccgcccggcccccucuguugcaccugagccagacggaugccccguguguguauggcgacagcacucacgugaacugagacuugagaguaucaagagccaaauucuguccaaauugaggcucaaggaggcuccuaacauaucucgggaaguggucaaacagcugcugccaaaggcgcccccucuccagcagaucuuagaucugcaugacuuucaaggcgaugcccuucagccagaggacuucuuggaagaggaugaguaccacgccaccacagaaacugugauuucgauggcacaggagacggacccggcuguucagaccgaugguucaccccugugcugucauuuucacuucagcccuaaagugauguuuacaaagguccuaaaggcccaacucuggguguaucugcgcccaguacccagaccugcuacuguuuaccuucagauccugagguugaaaccacucaccggggaaggaacagccggcggcgggggagguggccggcgccauauucgaaucagaagucugaagauagaguuacacuccaggucugggcacuggcagagcaucgacuucaaacaggugcugcauuccugguuucggcaaccccagucaaauuggggaauugaaaucaacgcauucgauccgaguggcaccgaccucgccgucacuagccuugguccuggggcugagggacugcaccccuuuauggaguugcgugugcuagaaaauacaaagcgcucuagaaggaaccugggccucgauugcgacgagcauuccucagaaagccgguguugccgauauccacugaccguggauuucgaggcguuuggcugggacuggauuaucgcaccuaaacgcuacaaggccaauuauuguagugggcagugcgaauacauguucaugcaaaaguauccccacacgcaccuuguccagcaggcuaacccaagaggaucugccggucccuguugcacuccuaccaaaauguccccaauaaauaugcuguacuuuaacgacaagcagcaaauuaucuacggcaaaauuccggggaugguuguggauagguguggaugcagcuga

SEQ ID NO: 56625 - RNA, 927 nt, Artificial Sequence
  derived and/or modified sequence opt3 from GDF15__Homo_sapiens__NP_004855
augcccggccaggagcugagaaccgugaacgggagccaaaugcuccuuguccuguugguuuuauccuggcugccucacggaggugcccuaucucucgcugaagcaucaagggccaguuucccaggcccgagcgagcugcauuccgaagacucucgguuucgcgagcuucgaaagcguuacgaagaucuguugacaagacucagggcgaaucagucgugggaggacucaaacacugaucuggugcccgcuccugccguacggauccugacgccagaggugcgccucgggagcggaggccacuuacaucugagaauuaguagggcagcccuucccgaagguuugccugaggcuucccggcugcaccgcgcacuauuccgacucucuccaaccgccagcagauccugggacgucacaaggccccugcggcgucagcuuucacuggcucgcccucaggccccagcguugcaucucagacugaguccgcccccuagccaaucugaucaguuacuggcagaauccucaagcgccaggccacagcucgagcuucaucugcggccccaggcugcccgagggcgcagaagggcacgggcucgcaauggagaccacugcccuuugggcccaggcagauguugcaggcuacacacugugcgugccagucuggaggaucucgggugggcggacuggguucugucuccccgggaagugcaagucaccauguguauaggagccugcccgucccaguuucgagcagcuaacaugcacgcccagaucaaaacaagccuucauagacugaagccugauaccgugcccgcuccauguugcguaccugccucguauaaucccaugguuuugauucagaaaacugacacaggugugucucuccaaaccuacgaugaccuguuagcaaaggauugucacugcaucuga

SEQ ID NO: 56626 - RNA, 1119 nt, Artificial Sequence
  derived and/or modified sequence opt3 from GDF1__Homo_sapiens__NP_001483
augcccccuccacagcaaggcccgugcgggcaccaucugcuccuucuguuggccuuacugcuacccagccucccucugaccagagcuccagugcccccuggaccagcagccgcgcuucugcaggcuuugggucucagggacgagccccagggcgccccucggcugcgcccagucccgcccguuauguggcgacuguuccguagaagggauccucaggaaacacgguccgggucucgcagaacuucaccaggagugacgcuccaacccugucacguagaggaauuaggcguggcagguaacaucgucaggcauauuccugaccgcggggccccaacccgggcuagugagcccgcaagcgccgcuggacacugcccggaauggacagugguuuuugaucuguccgccguggagccugcggagcgacccucuagagcaaggcuugaauugcgguucgccgcugccgcagcugccgcgccagagggcggcugggaacugucggucgcccaggcagggcagggagcuggugccgacccuggccccgugcuacuccgucagcugguaccagcucuugggcccccuguucgcgccgagcuguugggagcagccugggcuagaaaugcgucauggccaaggagccuccggcuggcauuagcccugcgaccgcgcgcucccgccgcaugugccagacucgcugaggccagucuucuguuggugacucuagauccuaggcugugccauccacucgcacggccccgcagagacgcggaaccuguccugggcggugggccaggaggcgcuuguagggcccgucggcuuuacguguccuuucgagaggugggcuggcacagaugggucauagcacccaggggguuccuggccaacuauugccaaggacagugugcuuugccgguugcccucucugguagcggcgggccuccagcacugaaucacgcuguguuacgcgcccugaugcaugcggccgcucccggagcagccgaucuaccuugcuguguacccgcucggcucuccccaaucucagugcuguuuuucgacaacagugauaaugucgugcuuagacaguacgaagacaugguuguggaugagugcggcuguagguga

SEQ ID NO: 56627 - RNA, 1290 nt, Artificial Sequence
  derived and/or modified sequence opt3 from GDF2__Homo_sapiens__NP_057288
augugccccggcgcccuguggguggcucucccucuucugagcuuguuagcagggucccugcagggaaagccacuacaaucuugggguagaggcucagccgggggaaacgcgcacaguccgcucggcguccccggugggggacugccugagcauaccuucaaucuuaaaauguuucuggaaaacguuaagguggacuucuugaggagccucaaucuguccggcguaccaucucaggauaaaacacggguggagcccccucaguacaugaucgaccuguauaaccgcuacacuucggauaagucaacgaccccagcuagcaauauuguccgaaguuuuuccauggaagacgccauaucuaucacagcaacugaggauuuccccuuucagaaacacauucucuuauucaacaucagcauuccucgucaugaacaaaucaccagagccgagcugaggcuuuauguguccugucagaaucacguugacccaucacaugauuugaagggcaguguggucauauacgacgugcuggaugggacagacgcuugggauagcgcaaccgagacuaagacauuucuaguaucucaggacauccaggaugaaggaugggagacccucgaaguuuccucagccgugaaacgguggguccgcagcgacaguacgaagucuaaaaacaagcuggaggugacuguggagucccacagaaaagguugcgacacccuugauauuagcgucccgcccggcucgaggaaucugccuuucuuuguuguguucucuaacgaccacuccucagggacaaaggaaacucgguuggagcuccgcgaaaugaucagucaugagcaagaaagcguacugaagaaauuauccaaggauggaucuaccgaggcuggcgagagcucacacgaagaggacacagauggucauguggccgcggggaguacccuggcacgaagaaaaagguccgccggagcuggcagccacugucagaagacgucucuccgggucaauuuugaagacauuggcugggauucauggaucauagccccaaaagaguaugaagcauacgagugcaaagggggauguuucuuuccccuugcugacgaugugacuccuacaaagcacgccauuguucagacccuggugcauuugaaguucccaacuaaggucgguaaagcgugcugugugcccacaaagcuaaguccgaucagcguacuguauaaagacgauaugggcguuccuacccucaaguaccacuacgaggggauguccguggccgaaugcggaugucguuga

SEQ ID NO: 56628 - RNA, 1095 nt, Artificial Sequence
  derived and/or modified sequence opt3 from GDF3__Homo_sapiens__NP_065685
augcugagauuccuccccgaccuugccuuuagcuuccuguugaucuuagcucugggccaggcagugcaauuucaggaguacgucuuccuacaguuucucgggcuggauaaggccccuuccccacagaaauuccaaccgguucccuauauucuuaagaaaauauuucaggacagggaagcggcugccaccacaggagugucucgggaucugugcuacguaaaggaguugggugugcgcggcaacguccuccgauuccugccugaccagggguuuuuccuguaucccaaaaagaucucacaggcaaguagcugucuccaaaaguuacuguacuuuaaucuuuccgccauuaaagaacgugagcaguugacucuggcucagcuaggacucgaucugggcccaaacucuuauuacaaucuugguccugaacuggaguuggcacucuuccuggugcaggagccacacguuugggggcaaacgacccccaagccuggaaaaauguuuguguuaagaucggucccauggccgcagggcgccgugcauuucaaccugcucgacguagcuaaggauuggaaugacaaccccaggaaaaauuucggccuuuuucuggaaaucuugguuaaggaggaucgggacucaggggugaacuuccagccugaagauacaugcgcccgccuaagauguagccugcacgcgagucuccuggucgugacucuuaauccagaccaaugccaucccuccaggaagcggcgcgcagccauuccugugccaaaacugucuuguaagaacuugugccaccgacaucagcucuuuaucaauuucagagaucugggauggcacaaauggauaaucgcucccaaggguuuuauggccaacuauugucacggcgagugcccguucagcuuaaccauuucccuaaauucaaguaacuacgcauuuaugcaggcucugaugcaugccgucgacccugagaucccccaggcgguuuguauuccaacaaaacucagcccuaucucuaugcuguaccaagacaauaacgauaacgugauacuuaggcacuaugaagacaugguaguggaugagugcggguguggauga

SEQ ID NO: 56629 - RNA, 1506 nt, Artificial Sequence
  derived and/or modified sequence opt3 from GDF5__Homo_sapiens__NP_001306067
augagacugcccaagcuccuuaccuuccuguugugguacuuagccuggcuggaccuagaguuuaucugcacagugcucggcgcuccugaucuggggcagaggccacaaggaacucggccgggucuugcaaaagccgaagcgaaggagcgacccccucuggcucgcaacgucuuccguccaggcgggcacagcuauggaggcggugccacgaaugcaaacgccagagcuaaagggggaaccggccagacaggcggguugacucagcccaagaaagacgaaccuaagaagcucccacccaggccuggagguccagagccgaaacccggccauccuccacagacccggcaagcaacagcccgcaccguuacucccaaggggcagcugccuggaggcaaagcuccacccaaggccgguuccgugccgucuucauuucugcucaaaaaggcgagagaaccugggcccccaagggagccuaaggagcccuuccggccacccccuauuacaccacacgaauacauguuaagucuguaucgcacccuuagcgaugcagaccgaaaaggaggcaauuccucuguaaaguuggaggccggccuggcuaacacgauaacuucguuuaucgauaaagggcaggacgauagaggaccgguggucaggaagcagcgguacguguucgacauuucagcccuagaaaaagauggucuccugggcgcagagcuucguauccugcgcaagaaacccagcgacaccgcuaagccugccgcgccagggggaggcagagccgcacaauugaagcucaguuccugucccucugguaggcagccugcugcccuguuagauguucggagcgugccagggcuggacggcuccggaugggaggucuuugauauuuggaaacucuuccgaaauuuuaagaacucagcucagcuuugccuggaauuggaggccugggaacgcggcagagcaguggaccuaagggggcugggauucgaccgggccgcucgccagguacaugagaaagcgcucuuucugguuuucgguagaacaaagaaaagggaucuguuuuucaaugaaaucaaggcacguaguggccaagacgauaagacuguguaugaguaccuuuucagccagcggcgaaaaagaagggcccccuuggcuacccgccaggggaagcggccgucuaaaaaccucaaggccagauguuccaggaaagcacugcacgucaauuuuaaggacaugggaugggaugacuggauaaucgccccuuuagaguaugaggcuuuccauugcgaaggccugugugaauuuccacuacgcucacaccucgagcccacaaaccacgccgugauucaaacccugaugaauagcauggauccugaaaguacgcccccaacuugcugugugccuacacgacuuucucccaucuccauuuuguucaucgacagcgcaaacaaugucguuuacaagcaguacgaggauauggugguagagucgugcgguugucgguga

SEQ ID NO: 56630 - RNA, 1368 nt, Artificial Sequence
  derived and/or modified sequence opt3 from GDF6__Homo_sapiens__NP_001001557
auggacacccccagagugcugcucagcgccgucuuccuuaucuccuuucugugggauuugccuggcuuccagcaggcuucuauuucaaguagcuccucuucggcagaguuagggucaacaaagggaaugaggagccggaaagaagguaagaugcaacgcgccccacgagacagugaugcgggccgugaggggcaggaaccgcagcccagaccucaagacgagccaagggcucagcagccccgggcccaggaaccuccaggacgcggccccagaguugugccucacgaguacaugcuguccauauauaggacuuacucuaucgcagagaaacuagguauuaacgccagcuuuuuccaauccucaaagagugcuaauacgaucaccagcuuuguagaucgggggcucgacgaucugucucauacaccacuucgccgacagaaauaucuguucgacguguccauguugucagauaaggaggaacucgucggagcagaacugagacuguuuaggcaggccccgagcgcucccuggggcccuccagccggcccccuccacgugcaguuauucccuugccugaguccacuuuugcuggacgcgcggacucuagauccccaaggggcaccgccugccggaugggagguuuuugacguguggcagggucuccgucaucagcccuggaagcaacugugucuugagcugcgcgcugccuggggcgaauuggaugcaggggaggcugaagccagagcgaggggaccacagcagccucccccacccgaccuccggucucugggcuucggucgacgcgucagaccuccacaggagagggccuuacuggugguauuuacccggucccaacgcaaaaaccucuucgcagaaaugagagagcagcuugggagcgcugaggccgcuggaccgggcgccggcgcagaagggucguggcccccuccaucuggagcccccgacgcuaggccuuggcugccaucccccggucgucggcgaagaaggacagcguuugcaucacgccacggcaagcggcaugggaaaaagaguagauugaggugcagcaaaaagccgcuacacguuaauuucaaggagcugggaugggaugacuggauuaucgccccucucgaauacgaggcuuaucacugugaaggcgugugcgauuucccacugcgcucccaucuugagcccaccaaccacgccauaauccagacucugaugaacucuauggacccugguagcacacccccaucauguugcgucccuaccaaauugacgcccauuaguauccucuacauugaugcagggaauaaugugguguauaagcaguacgaggacauggucguugaauccuguggcugccgauga

SEQ ID NO: 56631 - RNA, 1353 nt, Artificial Sequence
  derived and/or modified sequence opt3 from GDF7__Homo_sapiens__NP_878248
auggaccugagcgccgcugcagcccucugccuuuggcuguuguccgcguguagacccagggauggcuuagaggcugccgcagugcugcgggccgcuggggcaggaccuguccgcucuccagguggcgggggaggcggugggggaggcggccgaacccuagcccaggcugccggggcggcagccguuccggcugccgcagugccccgugcuagagccgcgaggcgggccgcaggaucagguuuccgcaacggcaguguagugccucaccauuuuaugaugagccucuacagaucccuggcugggagggccccagcuggagccgcagccgucucugcuucgggccacggucgggcggacacaaucacuggguucacggaucaagcaacccaggacgaaucagccgcugagacaggacagagcuuucuuuucgaugugaguucccugaaugacgccgaugaaguugugggcgcagaguugcgcguccuccgaagaggcucucccgaaagcgggccuggauccuggacuucaccaccccugcugcucuuaaguaccugcccuggugccgcuagggccccacggcugcuuuauagccgugcagcggagccguuggugggccagcgcugggaggcuuuugacguagccgaugcaaugagaaggcaucggcgagaaccccgcccuccaagagccuucugucugcuacucagggcuguugccgggcccgugccuucuccacuggcacuucggcgccugggauuuggcuggcccggugggggcggauccgcugccgaggaaagagcggucuugguggugucaagcaggacacaacguaaggagagucucuuccgggagauucgagcccaggcuagagcacugggcgccgcuuuagccucugaaccgcugccugaccccgggaccggaacugcauccccaagggcggucauagguggccgccggagaaggcgcacagcccucgcugggacccgaacggcccagggaagcggcgguggggcaggccggggacacggccguagagggaggucgcgcugcucucggaaaccucuucauguugauuuuaaggagcugggaugggacgauuggaucauugcucccuuggacuacgaagccuaucacugugagggucuaugcgacuucccacugagaucccaccucgaacccacuaaccaugcaaucauucagacccugcuuaauucaauggccccugaugcugcgccagccaguuguugcgugccggcaaggcugagccccaucuccauauuguacaucgacgcugccaacaauguaguguauaaacaauacgaggauauggucguggaggccuguggcugccgauga

SEQ ID NO: 56632 - RNA, 1365 nt, Artificial Sequence
  derived and/or modified sequence opt3 from GDF9__Homo_sapiens__XP_011541610
auggccagacccaacaaguuccugcucugguuuugcuguuucgcuuggcuuugcuuuccuaucagccugggcucccaggcaucugggggagaggcccaaauugcggcuucagccgaauuggagaguggugcaaugccauggagcuuacugcagcacauagacgaaagggaucgggccggccuacucccggcucuguucaaagugcuuuccgucgggcgcggaggcucuccccgacugcagccugacucgcgugcauugcauuacaugaagaaacucuauaagaccuacgccacaaaagaggguaucccaaagucaaauagaagccaccuguauaacacuguuaggcuguuuacgcccuguacccggcauaagcaggcuccuggggaucaagugacaggcauucucccaaguguagaauuacuguucaaucuugaccgcaucacuaccguggagcacuugcugaaauccguccuacucuacaacauuaauaacucugugagcuuuuccucagccguuaagugcguguguaaucugaugaucaaagagcccaagaguagcucuagaacacuuggaagggcgccuuauuccuucaccuuuaacucacaguucgaauuuggcaaaaagcauaaguggauacagaucgaugucacuagccuguugcagccacucguggcaaguaauaaacggucuauucacauguccaucaacuucacaugcaugaaggaccaacuggagcacccgagcgcccagaauggguuauuuaacaugacccugguaucgcccucucucauucuuuaccugaaugauacguccgcucaggccuaucauucaugguacaguuugcacuacaaacgccgaccuagccagggaccagaccaagaaagaucccuaucugcauaucccguuggugaggaggcugccgaagauggcaggagcucacaucaccggcaccgucgcgggcaggagacugugaguuccgaacugaagaaaccucucggaccagcgagcuucaaccugucugaguacuucagacaguuucuucugccccaaaaugaaugugaguugcaugacuucaggcucucauuuagucagcugaagugggauaacuggaucgucgccccgcaccgguauaacccucgauacugcaaaggcgacuguccccgcgcagugggucauagauaugggagcccagugcacaccaugguccagaauauaauuuacgagaaguuagauuccucuguuccuaggcccucgugcgugccagcuaaguauagcccccuguccguacuaacaaucgaaccugacggaucaauugccuacaaagaguacgaagacaugaucgcuacuaaguguaccugccgguga

SEQ ID NO: 56633 - RNA, 1344 nt, Artificial Sequence
  derived and/or modified sequence opt3 from GDI1__Homo_sapiens__NP_001484
auggacgaggaauacgaugugaucguccugggcaccgggcucacagagugcauucuuagcggaauaauguccguuaacgguaagaaagugcugcacauggacagaaaucccuauuacggcggggaaucuucaaguaucacuccuuuggaggaauuauauaagagguuccagcugcuagagggaccaccggagagcaugggccggggucgcgauuggaacguagaccucauucccaaauuucugauggccaaugggcaacuugugaagaugcuguuguacacggaagucacccgauaucucgauuucaaagugguugagggauccuuuguguacaagggcggcaagaucuauaaagucccuucuacagaaacugaggcucuggcaucgaaccugauggggauguucgagaagcguagauuuaggaaauuccucguguuuguagccaauuucgacgaaaacgauccaaagaccuuugagggaguugacccccagacaaccucaaugcgggauguguaccgcaaauucgacuuaggucaggaugucauugacuuuacuggccaugcgcuggcucuuuacagaacagaugacuauuuggaccagccuugucuggaaaccgugaauaggaucaagcuauacagcgagagucucgcccgguaugggaaguccccauaccuguauccccuuuacggacugggcgaauugccucaagguuucgcacgccucucugccauauaugggggaacguacaugcugaacaaaccaguggaugacaucauuauggagaauggcaaggucguuggcgugaaaagcgagggggaaguagcucgaugcaagcaguuaaucugugauccguccuacauucccgacagagugaggaaagcaggacaggucauccggauaauuugcauccugucacacccuauuaagaacacuaaugaugccaacaguugucagaucaucauuccacaaaaucaggugaaccguaaaagcgacauauauguuugcaugaucucuuacgcucauaauguggccgcgcaggguaaguauauugcaaucgccuccaccacagucgagacuaccgaucccgaaaaggagguggaaccugcucucgagcuucuggagccaauagaccagaaauuuguagccauuucagauuuguacgaacccaucgacgauggcugugagagccaaguuuucugcaguuguucuuaugacgcaacaacccacuucgaaacgacuugcaacgacaucaaggauauuuacaaacgcauggcugggacagccuuugacuucgagaacaugaagagaaaacagaaugauguguuuggagaagcggagcaguga

SEQ ID NO: 56634 - RNA, 1203 nt, Artificial Sequence
  derived and/or modified sequence opt3 from GDI2__Homo_sapiens__NP_001108628
augaacgaggaauacgacgugaucguccugggcaccgggcucacagagugcauucuuagcggaauaauguccguuaaugguaagaaagugcugcacauggauagaaaccccuauuacggcggggaaucugccucaaucacuccuuuggaggacuuauauaagagguucaaaauuccaggaaguccgcccgaaagcaugggccggggucgcgauuggaauguagaccugaucccuaaguuucuaauggcuaacgggcucaugggacuguucgagaaacgacguuuuagaaaguuccuuguguacgucgcaaauuuugaugagaaggacccaaggacguucgaaggcauugaucccaaaaagaccacaaugcgggacguguauaaaaaguuugaucugggccaggacguuaucgauuucacugggcaugccuuggcgcucuaccgcaccgacgauuaucuggaccaaccuuguuacgagacaauaaacagaaucaaacuguacuccgaaucucucgcuagguauggaaagucgccauacuuauauccccuguacggucuuggcgaguugccucagggguuugcccggcugucagcaauuuauggaggcaccuacaugcuaaauaagccaaucgaggaaauuaucgugcagaacgguaaagucauagggguaaagagcgagggagaaauugcccgcugcaaacagcucaucugugacccgaguuaugugaaggaucgaguugagaaagugggccaagucauuagagugaucugcauccugucccaccccauuaagaauacuaacgacgcuaauucuugucagauaaucauuccucagaaccaggugaauaggaaaagcgauaucuacgucugcaugauauccuucgcacauaacguugccgcucaaggcaaguacauugccaucgugucaacaaccguagaaacgaaggagccagagaaagaaauccggcccgcgcuugagcuguuggaaccuauugagcagaaguuugugaguaucagcgaccuccuggucccaaaagauuuagggacugaaucucagauuuucauaucccguaccuaugacgcaacaacucacuuugagaccacaugugaugacaucaagaauauuuacaaacgcaugaccggaucagaguucgauuucgaagagaugaagagaaagaaaaacgacaucuauggugaagauuga

SEQ ID NO: 56635 - RNA, 687 nt, Artificial Sequence
  derived and/or modified sequence opt3 from GDNF__Homo_sapiens__NP_001177397
augcagagccugcccaacuccaauggcgccgcugcagggagagacuucaagaugaaacucugggauguggucgccguuugccuugugcuguugcacaccgcgucugcuuuuccuuuaccagccggaaagaggccgcccgaggccccugcagaagaccggucacugggucgccgacgugcuccauucgcacuaaguagcgauuccaacaugcccgaggacuacccugaucaauuugacgauguaauggacuucauccaggccacaauuaaaagacucaagaggucuccagauaaacagauggcugugcugccccggcgcgaaagaaauaggcaggccgcggcagccaacccugaaaauucgcggggcaaggggcgccgaggacaaagaggcaagaacagggguuguguccuuacugcuauacaucugaaugugacggacuuggggcucggauaugagaccaaagaggagcugaucuuucgguacugcucaggcagcugugaugccgcagaaacaacuuaugacaagauucugaaaaaccucagucguaaucgcagauuaguuuccgauaaggugggccaggcuugcuguaggccaaucgccuucgacgacgaucugucuuuucuugacgauaacuuggucuaccacauucugcggaaacauagcgcgaagcgaugcggguguaucuga

SEQ ID NO: 56636 - RNA, 957 nt, Artificial Sequence
  derived and/or modified sequence opt3 from GDPD3__Homo_sapiens__NP_077283
augagccugcuccuuuacuaugcccugcccgcuuugggcuccuacgcaauguuaucuaucuucuuucugagaaggccucaccuacuccauaccccacgggccccgacauuccgcauucgacugggggcgcaccguggagguucaggcgagcuucuggaaaacacuauggaggcuauggaaaauaguauggcccagagaagcgacuugcucgagcuggauugccaacugacgagggaccggguggucguugugucccaugaugaaaaccucugucgccagucuggguuaaauagagacguaggaucgcuggauuuugaggaccuucccuuguauaaggagaaacuggaaguguacuucucaccuggccacuuugcacaugguagcgauaggcggaugguccgccuagaggaccucuuccagcgauuuccaagaacccccaugaguguggaaauaaaggggaaaaacgaggagcugaucagggaaauugccggacuuguucggcguuaugaucgcaaugagaucacaauuugggcuuccgaaaagucuagcgugaugaaaaagugcaaggcagccaacccugagaugccacuguccuucacuaucucaagaggcuuuugggucuugcucaguuacuaucugggcuuacugcccuucauaccuaucccagaaaaauuuuucuuuuguuuccucccgaauauuaucaacaggaccuacuuccccuuuagcugcucuugucuuaaucagcuguuggcugugguauccaaguggcuaauuaugcggaaaucacugauccgacaccucgaggagcgcgggguucaaguggucuucuggugccugaacgaagagagcgacuuugaagccgcguucagugugggagcaacaggugugauaaccgauuacccuacugcccuuagacacuaucuggacaaucauggcccagcugccaggacaucuuga

SEQ ID NO: 56637 - RNA, 1818 nt, Artificial Sequence
  derived and/or modified sequence opt3 from GDPD5__Homo_sapiens__NP_110419
auggugagacaccagccccugcaauacuaugagccucagcucugccuuagcugucugaccggcaucuacggguguagguggaagcgguaucagcgcucccaugacgauacaacuccaugggaacgauugugguucuuacugcuaacguuuaccuucggacucacacugacuuggcuuuacuuuuggugggagguccacaacgacuaugaugaauuuaauugguaccuguauaaccguauggguuacuggucugacuggccgguucccauuuuggugaccacagccgcugcauuugccuacauagcgggccuccugguacuggcucucugccauaucgccguggggcagcaaaugaauuuacacuggcugcauaaaauuggacuugucgugaucuuggcaucaaccguuguggccaugagugcugucgcacagcugugggaggaugaaugggaggugcuacucauuagccugcagggcacugccccuuuccuucacguaggugcuguugccgcggugacaaugcuguccuggaucgucgcagggcaguuugccagagcugagaggaccucuucgcaagugacgauauugugcacuuucuuuaccguggucuucgcccucuaucuggcaccauuaacaaucucaagccccuguauuauggaaaagaaagaccugggaccuaagccagcucucaucggccaccggggcgcccccaugcuugcgccugagcauacucugaugaguuuucgcaaagccuuggaacagaagcuauacgggcugcaggcagauauuaccaucucccucgacggaguuccauuccugaugcacgauacaacccuuagaaggacgacuaacguggaggaggaauuuccggagcuggcucggcgccccgccucuauguugaauuggacaacccuccagcgacugaacgcuggucaaugguucuuaaagacugacccuuucuggacagccagcucccugucaccaagugaucauagagaagcacagaaucagagcauaugcucucuagccgagcuccuggaacuugcuaaaggcaacgcgaccuugcugcucaaucugagggaucccccucgggagcacccauaucguuccucauuuauuaacguaacgcuugaggcagugcugcacagcggguucccccaacaucaggucaugugguugccgagucgccagagaccucucgugaggaagguugcccccggauuucagcaaaccucuggcuccaaagaagcuguggccagccugcggcgaggucacauccagcgcuuaaaucugagauacacacaggucucgaggcaggagcuacgggacuaugcaucuuggaaccucuccgugaaucuguacacuguaaacgccccauggcuuuucucauugcuguggugugcugggguuccuagugugaccagcgacaauucccaugcccucucucaaguccccagcccacuguggauuaugcccccugacgaauauugcuuaaugugggugacagcagaucuggucucauuuacucuuaucgugggaaucuucguuuugcagaaguggcgccucggcggcauuagaaguuacaacccagagcagauaaugcuguccgcggcugugaggcguaccagccgggacguaucuaucaugaaagaaaagcuaauuuucucagagaucagugauggggucgaggugagcgacguucuguccguguguucugauaacucguacgacacauaugccaauagcaccgcaacuccggucggaccccgagguggcgggucccacacgaagacacucauagaaagaucaggaagguga

SEQ ID NO: 56638 - RNA, 891 nt, Artificial Sequence
  derived and/or modified sequence opt3 from GEM__Homo_sapiens__NP_859053
augacccugaacaaugugacaaugagacagggcacugucgggaugcaaccccagcagcagagguggagcaucccugccgacggacggcaccucaugguucaaaaggagccacaucaguacucccaccgcaaccgacauucugcuacgccggaagaucacugccguagaucauggaguagcgacuccaccgauucugugauuucgucagagagcgguaauacauauuacaggguagugcuuauaggcgaacagggggucggaaaaaguacucuggcaaacaucuucgccggcgugcaugacuccauggauucugacugugagguuuugggugaagauaccuaugagcggacauuaaugguggacggggagagcgcgaccauuauccugcuagauaugugggaaaauaagggagagaacgaauggcuccacgaccacugcaugcaggucggcgaugcuuaccugauuguguauuccaucacugaccgcgccucauuugagaaagcaagugagcuuagaauacaacugaggcgggcccgccagacagaagauauccccauuaucuugguaggcaauaagagcgaccucguucgauguagagaggugucugucuccgaagggagggcuugcgcagugguguucgacuguaaauuuauugagaccucagccgcuguccagcauaacguuaaggaacuguucgagggaaucgugcggcagguacgucugcgcagagauagcaaggagaaaaaugaaaggcggcucgccuaccaaaagcgaaaagagaguaugccucgcaaggcgagaagguuuugggguaaaauaguggcaaagaacaauaagaacauggccuucaaauuaaagucuaaauccugccacgaccugagcguccuuuga

SEQ ID NO: 56639 - RNA, 798 nt, Artificial Sequence
  derived and/or modified sequence opt3 from GEMIN2__Homo_sapiens__NP_001009182
augagaagggccgagcuggcuggccucaagaccauggcaugggugcccgccgaaagcgcggucgaggaacuuaugccucggcuguugccaguugagccgugcgacuuaacagaaggguucgaucccuccgugccuccacgcacuccccaggaguaccugcgacguguacaaaucgaggcugcccaguguccugacguggucguggcacagauugauccgaaaaagcuaaaaagaaagcagucuguuaacauaucacucaguggaugccaacccgccccugaagguuauagcccaacgcugcaguggcagcagcaacagguggcucaguuuuccaccgucaggcagaaugugaacaaacaccggucucauuggaagucgcaacagcuugacucaaauguaacaaugccaaagagcgaggaugaagagggcuggaaaaaguucugucugggggagaaauugugcgcagacggagccguuggccccgcuacuaacgaaaguccugguaucgauuacgugcaggccaccgucacauccgugcucgaguaucugucuaauugguuuggggaacgcgacuucaccccagagcugggaagauggcucuacgcguuacuggcaugucuugaaaagcccuugcugccugaggcccacagccuaauuaggcaacucgcucggcgcugcuccgaggugcgacugcuugucgauucaaaagacgaugaaagaguuccagcccugaacuugcucaucugucuggugaguagguauuuugaccagcgggauuuagcagacgagcccagcuga

SEQ ID NO: 56640 - RNA, 3177 nt, Artificial Sequence
  derived and/or modified sequence opt3 from GEMIN4__Homo_sapiens__NP_056536
auggaccugggcccccucaacaucugcgaggaaaugaccauucuucacgggggauuccuguuggccgagcaguuauuucauccuaaggcucuggcagaacuaacaaaaagcgauugggagagaguggguaggccaauagucgaagcccuccgggagaucuccucugcggcugcccacucacaaccguucgcauggaagaaaaaggcccugauuaucauuugggcuaaaguucuucagccccauccugugacuccaagugacacggagacccgcuggcaggaagaucuguuuuucagcguaggcaauaugauccccacaauaaaccacacuaucuuguuugagcuccugaagucccuggaagcaucuggacucuucauucaguuacugauggcccuuccuaccacaaucugucaugcugaguuggagcgauuucuggaacacgugaccgucgacacuucggccgaggauguggcguucuuucuagacguuuggugggaagugaugaagcacaaagggcauccacaagauccccuccugucacaguucagcgcaauggcccacaaguaccuuccugcucuggacgaguuuccacauccgcccaaacguuugagaagugauccugacgccugcccaacaaugccccuccuggcaauguuacugaggggccucacccagauucagucccggauccuugguccugggcgcaaguguugcgcucuggccaauuuggcggauaugcuaacggucuucgcccugacugaagacgauccacaagaggugucugcaaccguauaucucgacaaacuggcuacaguuauaagcguguggaacuccgacacucagaaucccuaccaccagcaggcccuugcugagaaggucaaggaagccgagagagaugugucacugaccaguuuggcaaaacucccgagcgaaacaauuuuugugggaugugaguuccugcaccauuuacugagggaauggggcgaggagcuacaagccguccuccggucuucccagggcaccucauaugacagcuaccgccugugcgauagucuuacgucuuucucccagaacgcuacuuuguaucugaaucgaacaagccucucgaaggaagacagacaaguugugucugagcuggcggaauguguaagggauuuucuucggaaaaccuccacugugcugaagaaccgugcauuggaggacaucacagccucaauugcuauggccgucauccagcagaaaauggaucgccacauggaagugugcuacaucuucgcaagugagaagaaaugggccuuuagcgacgaguggguugcuugucucggguccaauagagcccuguucaggcagccugauuuagugcugcggcuacucgaaaccgucauugacgugucuacggcagaucgagcgauacccgagagccaaauccgccagguaauucaucugauccuugaaugcuaugcugacuugucacugccaggaaagaacaagguucucgccgguauacugagaaguuggggcaggaaaggguuauccgagaagcugcuugcauacguggagggauuucaggaagacuugaauaccacauucaaccagcucacucaaagcgccucugagcagggccuggcuaaagccgucgcaucaguggcucggcuagucauugugcacccugaaguuaccgugaagaaaauguguagucuggccguagucaaucucgguacacauaaguuucuggcgcagauccuuacugccuuccccgcuuugcgcuuuguggaggaacaggggccaaacagcuccgcaaccuucaugguuucuugccugaaggagacaguguggaugaaauuuucgacccccaaggaggaaaaacaauucuuagagcuccugaauugccuuaugagcccugucaagccacagggaaucccgguggccgcucuguuggaacccgaugagguacucaaagaauuugugcugccuuuccuaagacuggacguugaggaggucgaucucucccugaggauuuucauccagacucuugaagccaacgcaugucgugaggaauacugguugcagacgugcucaccauuuccccuguuauucagucucugucaacugcuugaccgguuuucuaaguauuggcagcugccuaaggagaaacgaugccuaagccucgauagaaaggaccuggcgauucacauauuggaacuguuaugugagaucguguccgccaacgcugagacauucucaccagauguguggauuaaaagccucucuuggcugcacaggaaguuggaacagcuggacuggaccgucggcuugcgccucaaauccuuuuucgagggccauuuuaagugcgaaguucccgccacucuguucgagaucuguaagcuaagugaggaugaauggaccagccaagcacacccgggguacggagcugguacaggccugcuugccuggauggagugcuguugcgugucuuccgggaucucagaacggaugcucagucuguuggugguagacgucggaaauccugaggaagugagacuguuuagcaaaggcuucuuaguugcacucgugcaggucaugccaugguguucgccccaggaguggcagaggcugcaucaacuuacccgccgacuguuggagaagcagcuccugcacgugccuuauucccuagaauacauucaguuuguuccccugcuuaaccucaaaccauucgcccaggagcugcaauugucuguguuauuucugcggacuuuccaguuccucugcagccacucaugccgugauuggcugccucuugaagguuggaaucauguagucaagcuguugugugggagucuaacaagacugcucgacuccgugagggcuauacaggcggccggccccugggugcagggaccagagcaagaucugacgcaggaagcacuuuuugucuauacccagguuuucugccacgcuuuacauaucauggccaugcugcacccggaggugugugagccucucuacguauuggcccuggaaacucucacaugcuaugagacccugucuaaaacaaaccccagcguguccucacuucugcaacgcgcucaugaacagcgguuucuuaagagcauugcagagggcaucgggccagaagagagaaggcagacucuacugcagaaaaugaguucuuucuga

SEQ ID NO: 56641 - RNA, 504 nt, Artificial Sequence
  derived and/or modified sequence opt3 from GEMIN6__Homo_sapiens__NP_079051
augagcgaguggaugaagaaaggcccccuggaauggcaggacuacaucuauaaggaggugagagucaccgccuccgagaaaaacgaguacaagggguggguucucacaacugauccugugucugcuaauauuguacuugugaacuuccuggaagacggaucaaugagugucacggguauaaugggccacgcagugcaaaccguugagacaaugaaugagggggaucauagggugcgggaaaaauugaugcacuuauuuacuagcggagacugcaaggccuauuccccagaggaucuggaagaacgcaagaacucucucaaaaaguggcuagagaaaaaucauaucccgauuaccgaacagggcgacgcgccccgaacacugugugucgcuggugugcuuaccaucgauccuccauacgggcccgagaacugcucgucaagcaaugaaauuauccugagucguguacaggacuugauagagggacaccucacugccucccaguga

SEQ ID NO: 56642 - RNA, 2727 nt, Artificial Sequence
  derived and/or modified sequence opt3 from GEN1__Homo_sapiens__NP_872431
augggcgugaacgaccuguggcagauccucgagcccgucaagcaacacauuccucuuagaaaucugggaggaaaaaccauagccguugauuugagcuuaugggugugcgaagcucagacaguaaagaaaaugauggguuccgugaugaagccacaucugaggaaccuauucuuucggaucucuuaccucacucagauggacgucaaacugguguucguuauggagggcgaaccgcccaagcugaaggcagaugugauuucaaaacgcaaucagagucgauaugggagcuccggaaagucuuggucgcagaaaacgggccguucacacuuuaagagcguccugagagaguguuugcauaugcucgaaugccuggguaucccuugggugcaagccgcgggggaggcugaggccaugugugcauaccugaacgccggaggccacguagacggcugccucaccaaugauggggacacauucuuauauggagcucagacuguuuacaggaacuuuaccaugaauacaaaagauccacauguggacuguuauaccaugaguuccauuaagucuaagcugggucuugaucgggacgcauuggucggccuggccauccuacucgggugcgauuaccugcccaaaggagugccuggcguggguaaggaacaggcucuuaaacugauacaaaucuugaaggggcagagccuccugcagcgcuucaacagauggaaugagacuuccuguaacucaaguccacaguuacuggucaccaaaaagcucgcccacugcagcguuuguucucaccccggauccccuaaagaccaugaaaggaauggcugccggcuuuguaagucagauaaguauugcgagccacacgacuacgaguacugcuguccgugcgaauggcaucgcacagagcacgaccgacaacugaacgaaguggagaauaacauuaaaaagaaagcguguugcugugaaggcuuucccuuccacgagguaauccaggaguuuuugcuaaauaaggauaaacuggugaaggucauuagauaucagaggccugaccuccugcuuuuccaacgguuuacgcuggaaaagauggaguggccaaaccauuacgcaugcgaaaaauugcucgugcuguuaacucacuaugauaugaucgagcguaagcuggggagccgcaacaguaaucagcuacagcccauaagaauuguuaaaaccaggauccggaacggagugcauuguuucgaaauugagugggagaagccugaacacuacgccauggaggacaaacagcauggugaauuugcucuccugacaaucgaggaagagucucuuuucgaggccgcauauccagaaaucgucgcuguguaccaaaagcagaaguuggagauuaaaggcaagaaacagaagcgaauaaaacccaaggaaaauaaccugccggagccugaugagguaauguccuuccagagccacaugacucucaagccaaccugcgaaaucuuucacaaacaaaauucgaagcugaacucugggauuuccccagacccuacacuuccccaggagucaaucagugccagccuuaauuccuugcuccugcccaaaaacacccccuguuuaaaugcgcaggaacaguucaugucuagccugcgcccucuagccauacaacagauuaaggcaguuucaaaaagucucaucuccgagagcucucagccaaacacgucaagucauaauaucagcgugauugcugaucugcaccuuuccacuaucgacugggaaggaacaucuuuuucgaacagcccggccauucagagaaauaccuucucccaugauuugaagucagaggucgagagugaacugucugcuauacccgacggcuuugagaacaucccugaacaacucagcugcgaguccgaaagguauacugccaauauuaaaaaggugcuggaugaggacucagacgguaucagcccagaggaacacuuacugucugggaucacagaucuuuguuugcaggaccucccccugaaggagcggauuuucaccaaacuauccuacccucaggauaaccugcaaccagacgucaaccucaagacgcugaguauacuuagcgugaaagaaucuugcaucgcaaauuccggcucagauugcaccagucacuugagcaaggaccugcccgggauuccguuacagaacgagucgcgcgauuccaaaauccucaagggcgaccagcugcuucaggaagauuacaagguuaauacaucugugccuuauagcguaucaaacacugucgugaaaaccuguaauguuagaccacccaacacagcccuggaccauaguaggaagguggauaugcaaacuacccguaaaauuuugaugaagaaauccgucugccucgaccggcacucuagcgaugagcaguccgcuccuguguuugggaaggcgaaguacacaacccagcgaaugaaacauucaagccagaagcacaauaguucucauuucaaagaguccggacacaacaagcugagcucgcccaaaauccacauaaaggaaacugagcaauguguaagaucauaugaaacggcagagaaugaggaaucuugcuuuccagacaguacaaaguccagccuaucuagccugcagugucauaaaaaggagaacaauuccgguaccugccucgacucaccucugccccuuaggcagcgcuugaaacugcgguuccagaguacuuga

SEQ ID NO: 56643 - RNA, 984 nt, Artificial Sequence
  derived and/or modified sequence opt3 from GET4__Homo_sapiens__NP_057033
auggccgcugcagccgcgauggcugagcaggaaagcgccagaaacggcgggaggaaucggggaggugugcaacgcgucgagggcaagcugcgagcauccguugaaaaaggggacuacuaugaggcccaccagauguaccguacccucuucuuuagauauaugucucagucaaagcauacagaagcuagggagcuuauguacaguggagcacuguuguucuuuagccacggccagcaaaacuccgccgcugauuuaucuaugcuggugcuagagucgcucgaaaaagccgagguagaaguggcggacgagcugcuugagaaucuggcaaaggucuucucauugauggaucccaacagcccugaacgggugacuuuuguuagucgcgcccucaaaugguccucuggugggagcggaaagcugggccauccaagacugcaccagcucuuagcucugacgcuuuggaaggagcagaauuauugcgaauccagguaccauuucuugcacucagccgacggcgaggggugugcaaacaugcugguggaauauaguaccagccggggauuucgcucugaggucgauauguucguggcucaggccguacuacaauuucucugccugaaaaauaaguccucagcgagcguuguguucacaacuuacacccagaaacacccgaguaucgaggacggucccccuuuugucgaaccacuucugaacuucauuugguuuuugcuccuggccguggauggcgggaaguuaacaguguucaccguccugugugagcaguaccagcccucucuccgaagagacccuauguauaaugaauaccuugauaggauaggacaacuguucuuuggcguuccacccaaacagacuuccagcuaugguggguugcuaggaaaccugcucacaucgcugauggggucuuccgagcaggaagacggcgaggagucaccuagugauggcagcccaaucgaacuugacuga

SEQ ID NO: 56644 - RNA, 1296 nt, Artificial Sequence
  derived and/or modified sequence opt3 from GFAP__Homo_sapiens__NP_001124491
auggagagaaggcggaucaccagcgccgcucgccgauccuacgugucuucaggcgaaaugauggucgggggacuggcacccggucguagacucggcccugggaccaggcuuagucuggcccggaugccaccgcccuugccuacucgcguugacuucagcuuagcgggagcucugaacgccggcuuuaaggagacgagagcauccgaaagggccgagaugauggaacuaaaugaucgguucgcuucuuauauugagaaagugcgcuuucucgagcagcaaaacaaggcacuggccgcugaacuuaaucagcugcgagccaaagagccaaccaaguuggcggacguauaccaggcagaacucagagagcugaggcugcggcucgaucaguuaacagccaacucggcucgucuggagguggaacgcgacaaucuugcccaagauuuggcaacugucagacagaaacugcaggacgagaccaaccuaaggcucgaagcugagaauaaccuggccgcguaucggcaggaagccgaugaggcaacacuugcucgacuggacuuggagcgcaagauagaaucacucgaggaagagaucagauuccugaggaagauucacgaagaggaggugcgggaauuacaagagcagcuggcccgccagcagguucauguggaacucgaugucgcuaaacccgaccuuaccgccgcacugaaggagaucagaacucaauacgaagccauggcuagcaguaauaugcacgaggcggaggaaugguauagguccaaauuugcagauuugacagacgccgcugcccguaacgcagagcuacugcggcaggccaagcaugaagcuaaugauuaccgaagacagcuccaaucucugaccugcgaccuugagagccugagggguacgaacgaguccuuggaacgccagaugcgggagcaggaagagagacacgugagggaagccgcaucauaucaggaggcgcucgcucgccuggaggaagaggggcaaaguuuaaaagacgaaauggcccgacaucugcaggaguaccaggaucuacucaauguaaagcuggcacuugacauugaaaucgccacuuaccggaaguugcuggagggagaggaaaaccguauaaccaucccuguucagacauucagcaaucuccaaauuagaggcggcaaaucuacuaaggauggggagaaccacaaagugaccagguaucugaagucccuuacaauccgcgucauuccaauccaggcucaccagauagugaacggaacacccccugcccgggguuga

SEQ ID NO: 56645 - RNA, 618 nt, Artificial Sequence
  derived and/or modified sequence opt3 from GFER__Homo_sapiens__NP_005253
auggccgcucccggcgagagagggagguuccacggagguaaccuguuuuuccucccuggcggggcacggagcgaaaugauggacgaucuugccaccgacgcgcgcggacgaggcgcuggucguagagaugccgcagccuccgcuucuacaccagcacaggccccgacuucagacagucccguggcugaggaugccagcaggcggcgcccuugcagagcgugugucgacuuuaagacguggaugaggacccaacagaaacgggauacaaaguuccgcgaagacugcccacccgaucgagaggaacuggggagacauuccugggcaguuuugcacacuuuagccgcuuacuauccugaccugccaacccccgagcagcagcaagauauggcccaguuuauccaucuauucucuaaauuuuacccuugugaggaaugcgcagaggaccucaggaagcggcugugucguaaucacccagauacacgcaccagagcuugcuucacucaguggcuuugucaucugcacaacgaagugaauaggaaauugggaaagccggacuuugacugcucgaagguagaugagcgguggcgagacggcuggaaagauggcucaugugacuga

SEQ ID NO: 56646 - RNA, 855 nt, Artificial Sequence
  derived and/or modified sequence opt3 from GFI1B__Homo_sapiens__NP_001128503
augcccaggagcuuccuggugaaguccaaaaaggcccacaccuaccaucagccuagaguccaagaggacgaaccacucuggccgcccgcucuuacaccuguuccacgggaucaggcacccucuaacucaccugugcugaguacuuuguuuccaaaucagugcuuagacuggacgaaccugaaacgcgagcccgaacuagagcaggaucaaaaucucgcccgaauggcgccugcuccagaaggcccgaucguacugagccguccccaggacggggauuccccucuuucugacucgccacccuucuauaagccuucauuuagcugggauacccuggccacaacuuacggacacaguuauagacaggcaccauccaccaugcagucugccuucuuggagcauagcgugucccucuacgguucaccccuggucccgaguacagagccugcucuggacuuuagccucagguauucucccggcauggaugcauaccacugugugaaaugcaacaaggaacgguccuucgagugucgcaugugcgggaaggccuuuaaaagaucaagcaccuuaaguacucaucugcuuauucacucugacacaaggccauauccuugucaauucugcggaaagcgguuucaccagaaauccgauaugaagaaacauaccuacauacacacgggcgaaaagccccauaagugucagguuugcgguaaggcuuucagccagucgucuaauuugaucacucacucccgcaaacacaccggguuuaaaccauucucaugugagcugugcacaaagggauuucaacgaaaaguggaccuaagaaggcaucgggagagucagcacaaccucaaguga

SEQ ID NO: 56647 - RNA, 1269 nt, Artificial Sequence
  derived and/or modified sequence opt3 from GFI1__Homo_sapiens__XP_011539548
augcccaggagcuuccuggugaaguccaaaaaggcccacucuuaccaucagccuagaucaccaggcccggacuauagucuccggcuugagaacguccccgcuccuagccgcgcagauuccaccucuaaugccgggggagcgaaagcugaaccacgagaccgucugucgcccgagucacaauugacagaagccccugauagagcaagcgccaguccagacuccugcgaggguucuguuugugaaaggagcuccgaguuugaggauuucuggcggcccccuucaccaagugcuagcccggcaucugaaaaguccaugugccccucauuagacgaggcccagccuuuuccacugcccuucaaaccuuacagcuggaguggccuagcugggucugaucuccgccaccuggugcaguccuauagaccauguggagcccuugaaaggggcgcgggucugggguuguuuugcgagcccgcaccggagccuggacaucccgccgcucucuacggcccaaagcgggccgcaggcggggcuggagccggugcgccuggcagcuguucggccggggcaggagcuacugccggccccggucuggggcuguauggagacuucggcucugcugccgcaggccucuacgaacgcccaacggccgcugcgggguuacuguaucccgagcgaggacacggucuucaugcagauaagggcgccgggguaaaaguggaauccgaguugcugugcaccagacuacuccugggaggcgguucauacaaguguaucaaaugcaguaaggucuuuagcacaccucacgggcuugaagugcacguuaggcggucccauucuggcacucguccauucgcuugugagaugugcggaaaaaccuuuggccacgccgugagccuggagcagcauaaggcaguccacucacaagaacgcaguuucgacuguaagauuugcgggaaauccuuuaagagaagcucuacauugucaacccaccuccugauacauagugauacuaggccguaccccugccaguauuguggaaaacgguuccaccaaaagagcgacaugaaaaagcauacauuuauccacaccggugagaaaccucauaagugccagguguguggcaaggccuucucccagucuucgaacuuaauuacgcacagccgaaaacacacuggguucaagccauuuggaugcgaucuguguggcaaagguuuccagcgcaagguagaccucagaaggcaucgggaaacccagcacgggcuuaaauga

SEQ ID NO: 56648 - RNA, 2256 nt, Artificial Sequence
  derived and/or modified sequence opt3 from GFM1__Homo_sapiens__NP_079272
augagacugcucggcgccgcugcaguggccgcgcuugggaggggacgggcucccgccagccuggguuggcagcgcaagcaagucaacuggaaagcaugccgaugguccucuucaggcguuaucccuaaugagaagauucguaacauagggaucagugcccacauugacagcggaaaaaccacauugacugaaagaguguuauacuauacgggcaggaucgcuaagaugcaugagguaaaagguaaggauggggugggagcagucauggacuccauggaacuggagcggcagcgcggcauuaccauccagucugccgcuacauacacuauguggaaggaugugaauauaaacaucauugacaccccaggccacguugauuucacaaucgaaguggagagagcccuaaggguccucgacggggcggugcugguacuuugugcaguuggaggugugcagugccaaaccaugacugucaaucggcagaugaaacgcuauaacgugccguuucugacauucauuaauaaguuggaucgaaugggcucgaaccccgccagagcucuccagcagaugaggucaaaacugaaucauaacgccgcauuuaugcaaaucccuauggggcuggagggaaauuucaagggcauaguggaccucauugaagaacgggcuaucuacuuugauggugacuucgggcagauuguccguuauggagaaaucccagccgaguuacgcgcggccgcaaccgaucacagacaggagcugaucgaauguguugcuaacagcgacgagcagcuuggcgaaauguuuuuggaggagaaaauucccaguauauccgaucugaagcuagccaucaggcgggcuacgcucaagcgaucuuucacuccuguguuucugggcagcgcccuuaaaaauaaggggguacaaccacuguuggacgcagugcucgaguaccugcccaacccuuccgagguccagaauuaugccauuuuaaacaaagaagacgauucaaaggagaaaaccaagauccugaugaacaguagccgcgacaauucucauccauucgugggacucgcuuuuaaacuugaaguugguagauucggccagcugacauacgugagguccuaccaaggggaguugaagaagggagauacuauauauaacacccggacacgcaaaaaggucagacuacagaggcuggcgcguaugcacgcagacaugauggaagauguggaggagguauacgccggcgacauuugcgcucucuuugguaucgauugugccucaggggacaccuucacggauaaagcaaauagcggccugaguauggaaucuauccacguuccggaccccgugauuuccaucgccaugaagccuagcaacaaaaaugaucuugagaaguucucgaagggaauuggccgguuuacucgagaagacccaacauucaaagucuauuuugacaccgagaacaaggaaacugugauaucugggaugggagagcugcauuuggagaucuacgcucagagacucgaaagggaguaugguugccccuguauuacaggcaaaccuaaggucgccuuccgcgaaaccaucacggcaccagugcccuuugauuucacccacaaaaagcaguccgggggagcgggccaauacgguaagguuaucggggugcuggagccguuagacccugaggauuauacaaaacuggaauuuucagacgagacuuucggcaguaauauucccaagcaguuuguaccagcugucgaaaaaggauuccuagaugccugcgagaagggcccucucagcgggcauaaacuguccggacuucgguuuguguugcaggacggugcacaccacaugguugauucuaacgaaaucagcuucauaagagccggcgagggggcucugaagcaggcccucgcaaaugcuacccuguguauucuugagcccaucauggccguggaagucguggcgccaaacgaguuucaaggacagguaauugccggcaucaauaggcgccauggugugauaacagggcaggacggcguugaagauuacuucacucuguacgcugacguccccuugaacgauauguucggauauucaaccgagcuccgaaguugcacagaaggcaagggggaguacaccauggaguauucccgguaccagccuugucugccaagcacucaagaagacgugaucaauaaauauuuagaggcaacgggacagcugccggugaagaaaggcaaggccaaaaacuga

SEQ ID NO: 56649 - RNA, 2100 nt, Artificial Sequence
  derived and/or modified sequence opt3 from GFPT1__Homo_sapiens__NP_001231639
augugcggcaucuucgccuaccugaacuaucacgugcccagaaccaggcgggagauucucgaaacacuuauaaaggggcugcagcgcuuggaguaccgaggauaugacagcgcuggugucggcuuugaugggggaaaugacaaagauugggaagcaaacgccuguaagauccaauuaauuaaaaagaaaggcaagguuaaggcgcuggacgaggaagugcauaaacagcaggauauggaccuagauaucgaguucgacguacaccucgguauugcucauacucguugggccacgcacggggagccuuccccagugaauagucauccgcagagaucagauaagaacaaugaauuuaucgucauacacaacggaaucauuaccaauuacaaagaccugaagaaauuccuugagaguaagggcuaugauuuugaaagcgagacagacacugagaccaucgcaaagcuggugaaauacauguaugauaacagggaaucccaagacacaucuuucaccacuuugguugagcgggugauucagcagcucgaaggcgccuuugcucuggucuucaagucggugcacuuucccgggcaggcaguaggaacacgcagagguucaccucugcucaucggcguuaggagcgagcauaaauuaaguaccgaccacauaccaauucuguaccggacggcccgcacucaaaucggguccaaguucacccgauggggaucucagggcgaaagagguaaagauaagaaagggagcugcaaucuuuccaggguggacucaacaacuuguuuguuucccgucgaggagaaggcuguggaauacuauuucgccagugaugcgagcgcagugauugagcauaccaaccgggucaucuuucuggaagacgaugacguugccgcugugguagauggacgucuaucuauccaccgcauuaagagaacagccggcgaccacccuggcagggcagugcagacccuccagauggagcugcaacagauaaugaaagggaauuucuccucauucaugcagaaggaaaucuuugagcaaccagagagcgucgugaacacgaugcggggacgaguuaauuucgaugacuacacugugaaccuugguggccugaaagaucauauuaaggaaauccagcgcugcagaagguugauacucauugcuugugggacaaguuaucacgccggagucgcgacccgccaggugcuggaggaauuaacugagcugcccguaaugguugaacucgccucugacuuucuugaccggaauacaccuguguucagagaugacgucugcuuuuuccugucccagagcggcgagaccgcagauacguugaugggucuaagguacuguaaagagcguggggcucugaccgugggcaucacaaacacugucggaucgucuaucucccgggaaaccgacugcggcgugcauauuaacgccgggccagagaucggaguugcuucaacaaaggccuauacuucucaauuugugagccucguaauguucgcacugaugaugugugaugaccgaauuuccaugcaggaaagaaggaaggagauaaugcuuggucugaaacgcuugccggaucucaucaaggagguccugucuauggacgaugaaauucagaaauuagccaccgagcuguaccaccaaaagagcgugcuaaucaugggccggggguaucauuacgcuacaugccucgaaggagcgcugaaaaucaaggagauuaccuacaugcacucagaaggcauacuugccggugaguugaagcacgggccccuggcacucguugacaaacugaugccugugaucaugauuaucaugagagaucauacuuaugcuaagugucagaaugcccuucagcaggucguggcaaggcagggccgcccaguagugauuugcgacaaagaggauacggaaacaaucaagaacaccaaacgaacuauaaagguuccccacagugucgacugccugcaaggaaucuuguccgugauuccucuccagcuguuagccuuucaucuggcugugcuacggggcuacgacgucgauuucccacguaaucucgccaagagcguuaccguggaguga

SEQ ID NO: 56650 - RNA, 2049 nt, Artificial Sequence
  derived and/or modified sequence opt3 from GFPT2__Homo_sapiens__NP_005101
augugcggcaucuucgccuacaugaacuauagagugcccaggacccggaaggagauuuuugaaacacugauaaaagggcuccagcgccuugaguaccgaggauaugacagcgcuggugucgcaaucgauggcaauaaccacgaaguuaaggagcgucauauucaacuggugaaaaagagagggaaaguaaaggccuuggacgaagaguuauacaagcaggauuccauggaccugaaaguggaguucgaaacucacuuuggaaucgcgcauacgaggugggcuacccacggcgucccuucugccguuaauucacauccacagcggagugauaaggguaacgaguucguggugauucacaaugggaucauaacaaacuauaaagaccuacgcaaguuucucgaaagcaaaggauacgaguucgaguccgaaacugauaccgagacaaucgcaaagcugauuaaguaugucuuugacaauagagaaaccgaggauaucacuuucucuacacuuguggaaaggguaauucagcaacuggagggcgccuuugcuuugguuuucaaaucggugcacuacccgggcgaggcagucgccacccggcgcgggucaccccuccugaucggagugcgaagcaaguacaaacugaguacggaacagauaccuauucucuauagaacuuguaccuuagagaacgugaagaauaucugcaaaacaaggaugaagcggcuggacuccucugcuugucuucaugccgucggugauaaagcgguugaauuuuucuuugcaagcgacgccuccgcuauuaucgagcacacuaaccgugugaucuucuuggaagaugacgacauugccgcaguagcugauggcaagcugucaauacaucgcgugaagagaagugccagcgacgauccaucuagggcgauccagacccuacagauggagcuccaacagauuaugaaagggaauuucuccgccuuuaugcagaaggagaucuucgaacagcccgagucagucuuuaacacaaugcggggacgagugaauuucgaaaccaacacgguucugcuuggcggucugaaagaccacuugaaggagauacgcagaugcaggcggcucauugugaucggguguggaacuagcuaccacgcagcugucgccacacgccaagugcuggaagaguuaaccgagcugccuguaaugguugaacucgcuagugauuuucuugacagaaauacuccaguguucagggaugacgucugcuuuuucaucucucaguccggcgagacagccgauacccuguuggcacuacguuauuguaaagaccggggcgcccugacggugggggucaccaacacagugggaagcucgauuucucgagaaacugauugcgguguucauaucaacgcuggccccgagauugggguggcguccaccaaggcauacacaucacaguuuauaagucucguaauguucggacugaugaugagcgaggacagaaucucccuucaaaauaggcgccaggaaauuauccggggccugagaucuuugccugagcucaucaaggaaguccugagcuuagaggagaaaauucacgaccuggcccuagaacucuauacucagaggucacugcuugugaugggucgcggguacaacuaugcuaccuguuuggagggcgcccugaagauaaaagaaaucacauacaugcauagugagggcauucucgcaggagaacugaagcacgggccacuugcccugaucgauaaacagaugccgguuauuauggugaucaugaaggaccccugcuuugcuaagugucaaaaugccuugcagcaggucaccgcacgacagggacggccuauaauccucugcuccaaagaugacacugagagcucuaaguucgcguacaaaacgauugaacugccacauacaguggauugcuuacaagguauccugucaguaauuccccuacagcuccugaguuuucaccuugcuguguugcguggcuaugacguugauuucccuagaaaccuggccaagagcgucaccguggaguga

SEQ ID NO: 56651 - RNA, 1383 nt, Artificial Sequence
  derived and/or modified sequence opt3 from GFRA1__Homo_sapiens__NP_001138925
auguuccuggccacccucuacuuugcacuuccccuguuggacuuacugcuaagcgcugagguguccggcggggauagacucgacugcgucaaggccucugaucagugucugaaagaacaaucaugcaguacaaaguauaggacucuucggcaguguguugcgggaaaagagacgaacuucagccuggcuuccgguuuggaagccaaggacgagugccgcucugcaauggaagcccucaaacagaagucgcuguacaauugucgaugcaagcguggcaugaaaaaggagaaaaacugucugagaaucuauuggucaauguaccagagccuccaagggaaugauuuacuggaggacaguccuuaugaaccagugaacuccaggcuuucugauauuuuucggguagugccguucauaagcgucgagcacauccccaagggaaauaacugcuuggacgcugcaaaagccuguaaucuggaugacauuugcaagaaguaccgcuccgcuuauaucaccccuuguacaacuucagugaguaacgauguuugcaauagaaggaaaugccauaaggcccuacggcaguuuuucgacaaagugccagcgaagcacagcuacggcaugcucuuuuguucuugccgcgauauugcauguaccgaacgaagaaggcagacaaucguccccgugugcuccuacgaggagcgggaaaaaccuaacugucugaaucuucaggacucaugcaagaccaacuauauaugucguagccgccuggccgacuucuuuacuaauugccaaccagagaguagaucuguauccagcuguuugaaagaaaacuacgcugauugccuccuggccuauucggguuuaaucgggacaguuaugacccccaauuacauugacucuuccucacugaguguggcaccuuggugugauugcagcaacuccggaaacgaccucgaggaaugccuuaaguuccugaacuuuuucaaggauaauacguguuugaaaaaugcuauccaggccuuuggcaacggcucugacgucacuguguggcagccagcguucccggugcagaccacaacugccaccacaaccacggcacuaagggucaagaauaaaccccuggggccugcuggaagcgagaacgagauuccaacucauguucuucccccuugcgccaaucugcaagcucagaagcucaaaucaaacgugagugguaauacacaccuguguaucuccaacggcaauuaugaaaaggagggguugggagccagcucucauauaaccacuaagucaauggcagccccacccaguugcggccucagcccgcuguuaguacugguggucacagcucuauccacccuccugucucuuacggaaaccucguga

SEQ ID NO: 56652 - RNA, 996 nt, Artificial Sequence
  derived and/or modified sequence opt3 from GFRA2__Homo_sapiens__NP_001158511
augauccuggccaacguguucugccucuuuuucuuucuuggcaccggggcugaccccgucguuagcgcaaaguccaaucacugucuggaugccgcgaaagccugcaacuugaaugacaacuguaagaaauuaagaucuucauacauuaguauaugcaauagggagaucagcccuacagaacgguguaaccgccgaaagugccauaaagcucugcgucaguucuuugauagagugccauccgaguauacuuacaggaugcuauucuguucuugccaagaccaggcaugugccgaacggcgcagacagacgauucucccgucgugcucauaugaggauaaggaaaagcccaauugucuggaccuuaggggaguaugccggaccgaucaccugugccgcagccgauuggcugacuuucaugcaaacuguagagccaguuaccagacagugacuuccugcccugcugauaauuaucaagccugucucgguucuuacgcgggcaugaucggguucgacaugaccccaaacuaugucgauagcucccccacaggaauugugguuucaccuuggugcaguuguaggggcagcgguaauauggaggaggaaugcgagaaauuucugcgggacuucaccgaaaacccaugucugcguaaugcaauccaggccuuugggaacggaacugaugugaaugucucucccaagggcccuuccuuccaggcuacacaggccccacgcguggagaaaaccccgucacuccccgacgacuuaagcgauaguacgucucugggcacuuccguaauaaccacaugcacuagcguucaagagcaggggcuuaaggcaaacaacucgaaagaauugucuauguguuuuaccgagcugacaaccaauaucauuccuggauccaacaaggugaucaagccaaauucaggucccaguagagcuaggccuagcgccgcgcuaacgguccucuccgugcugaugcuuaaacuggccuuguga

SEQ ID NO: 56653 - RNA, 1203 nt, Artificial Sequence
  derived and/or modified sequence opt3 from GFRA3__Homo_sapiens__NP_001487
auggugagaccccugaacccuaggccacucccgcccgucguucuuaugcuguuguuacugcuaccuccaagcccccucccucuggccgcuggcgacccacuucccaccgagucccggcugaugaacucuugcuugcaggcacgccgaaagugucaagccgauccuacaugcucagcggcuuaccaccaucucgacaguuguacuagcuccaucucuacgccacugccgucggaggaacccucagugccugccgauugccuggaagcagcccagcagcuccguaauagcaguuuaauuggguguaugugccacagaaggaugaaaaaucagguagcuugucuggacauauauuggaccgugcaucgggcacgcucccuuggaaacuacgaguuggaugucucuccauaugaagacacagugacuagcaagcccuggaaaaugaaucuguccaagcuaaacaugcucaaaccugauucagaccugugccuuaaguucgccaugcuguguaccuugaaugauaagugcgacagacucaggaaggcuuacggugaggccuguaguggcccacacugccaacggcauguuugccugcgccaguuacugacauuuuucgagaaagcggcagaaccccacgcccaggggcuccuucuguguccgugcgcuccuaacgaucgaggauguggcgagagaaggcggaauaccaucgcccccaacugcgcauugccaccuguggcucccaauugucuagaacugcgucgccucugcuuuagcgacccacuguguagaucuaggcuugucgauuuccagacucacugccaucccauggacauucuggguacaugugccaccgagcaaucccggugcuugcgagcguaucucgggcugaucggaacggccaugacuccuaacuuugugucaaauguaaacaccagcguugcauuaaguuguacaugccgcggcucuggcaaucugcaggaggaaugcgagaugcuagaaggguucuuuucccacaacccaugucucacugaggcuauugccgcuaaaaugagauuccauagccagcuguuuucgcaggacuggccgcaccccaccuucgccgugauggcacaccaaaacgaaaauccugccgucaggccacagcccugggugccuucuuuguuuuccugcacacuuccacugauccuccugcuuucacugugguga

SEQ ID NO: 56654 - RNA, 810 nt, Artificial Sequence
  derived and/or modified sequence opt3 from GFRA4__Homo_sapiens__NP_071422
auggugagaugccugggccccgcccuccuucuguuguuacugcuagggagcgcuuccucugucggagguaacagguguguugacgcagccgaggcgugcaccgcugaugcccggugucagcgccuccgaucagaauacguggcacaaugccugggccgugccgcucaagggggauguccuagagcaaggugccggcgcgcccuuagaagguucuuugcucggggcccaccggcccugacacacgcgcucuuguucugucccugcgcagguccugccugugcugagcgccgaagacagacuuuuguaccaaguugcgccuucagcgggcccggaccugcaccacccuccugucuggaaccucugaauuuuugcgagaggucucgggugugccguccacgccucuuagcuuuccaggucucguguacgccggcccccucagcgccugacggcugccugcuugaucagggcgccagauguuugagggcauaugcugggcuggugggaaccgccguuacaccaaacuacguggacaaugucagcgcucggguggcccccuggugcgauuguggugcaaguggcaaccgacgcgaagacugcgaggccuuuagagggcuauucacuaggaaucggugucucgauggagcuauccaggcguuugcauccggcuggccuccaguacugcuugaccagcugaacccccagggugauccggagcauucuuugcuccaaguuagcuccaccgggcgcgcccuggaaagaaggucauuacugaguauucucccugugcuugcucugcccgccuugcuauga

SEQ ID NO: 56655 - RNA, 1659 nt, Artificial Sequence
  derived and/or modified sequence opt3 from GGA1__Homo_sapiens__NP_001001560
auggagcccgccauggaaccugagacccuggaagcuagaaucaacagggcaacaaauccacucaacaaggagcuugacugggccagcauuaauggcuucugcgaacagcugaacgaggauuuugaggggccgcccuuggcgacucgguuacuggcucacaaaauacaauccccucaggaaugggaggccauccaggcacuaacggugcucgaaaccuguaugaagucuugcggaaaacgcuuccaugacgaggucgguaaguuucgauuccugaaugagcuuauuaaaguugugucaccaaaguaccugggcagucguacaagcgaaaagguaaagaacaagaucuuggagcuccuguauuccuggacuguggggcugcccgaagaggucaaaauugccgaggcuuaccagaugcucaagaaacaaggaaucgugaagucugauccuaaguuaccagacgauaccacauuuccccugccuccaccgagacccaaaaauguuauauucgaagacgaggaaaagucgaaaaugcuugcaagguugcugaagucaagccacccugaggaucuacgggccgcuaacaaacucaucaaggaaauggugcaggaggaccagaaacgcauggaaaagauuaguaagagagucaaugccaucgaggaggugaacaauaacguaaaacugcuuaccgaaaugguuaugucccauucucagggcggugcggcagccgggagcuccgaggaucugaugaaggaauuguaucaaaggugugagcggaugcgcccaacucucuuucgacuggcuucagacacagaagauaaugacgaggccuuaggacugagugaucccaccccuccaagcggccccucucucgacggcacgggguggaacuccuuccagucaagcgacgcaacugagccgccugcucccgcccuugcgcaggccccaaguauggaaucuagaccucccgcacagaccucccugccagcuagcucgggauuggaugaccuagaucugcucgguaaaacacugcuucaacagucucugcccccugagucccagcaagugaggugggaaaagcagcagccaacuccgcgguugacccuccgugaccugcagaauaaaucaaguagcugcuccucucccagcucaagugccacauccuuacugcacaccgucagcccugagccaccccgcccuccacaacagcccgugccgacggagcuaucucucgcuucaauuacugugccucuggaaaguaucaagccaagcaacauacuucccgucacaguuuacgaucagcauggcuuuagaauuuuguuccacuuugccagggacccucugcccgggcgguccgaugugcucguaguggucgugucuaugcugucgaccgcaccacagccuauccgaaacauuguuuuccaaagcgccgugcccaaggucaugaaagugaaacuucagccaccguccggaacugagcugccugcuuuuaaucccaucguacacccaucagcgaucacacagguuuugcuccuggcaaacccccagaaagaaaaggugcgcuuaagauauaaacugaccuucacgaugggcgaccaaaccuacaaugagaugggugaugucgaccaguucccuccacccgaaacaugggggagucuauga

SEQ ID NO: 56656 - RNA, 1779 nt, Artificial Sequence
  derived and/or modified sequence opt3 from GGA3__Homo_sapiens__NP_001166175
auggcccugcccgaggaagcuaagaucaaagacgcauaccacaugcucaagagacagggcauugugcaaagcgauccuccaauaccggucgacaggacccuuauccccuccccuccaccccggccuaaaaacccaguuuucgaugacgaggaaaagucuaaacuguuggccaaguuacugaagucuaaaaaucccgaugaccuacaggaggcgaacaagcucauuaaaaguauggugaaggaagaugaggcucgcauccagaaaguaacaaagcgacugcauacucuugaggaagugaauaacaauguccgucuguugagcgagaugcuccugcacuauucccaggaagacucuucggauggggacagagagcugaugaaggagcucuuugaucaaugcgaaaacaaaaggcggacguuauucaagcuggccucagagaccgaagacaaugauaacagccuuggagacauuuugcaggcaagugacaaucugucccgcgugaucaacucuuacaaaacaauaaucgagggucagguuauuaauggcgaaguggccacucuaacccucccugauagcgaggggaacucccaguguucaaaucaaggaacacugaucgaccuugcugagcuggauaccacuaacaguuugagcucuguccucgcaccagccccgacacccccuuccucaggcauuccaauccugcccccuccaccccaggcuagcgguccgccuagaaguaggucuuccagccaggccgaagcgaccuuagggcccucgucuacguccaaugcacugucauggcucgacgaggaacuucugugcuugggacuagccgauccagcuccuaacgugcccccaaaggagagugccggcaacagccaguggcaucugcuccaacgggaacaguccgaccuggacuuuuucucuccccgcccuggcacugcagcuuguggggccagcgaugcgccacuucugcagccgucagcccccaguuccagcucaucacaagcaccuuugccacccccuuuuccagcucccguaguuccggccagugugccugcuccaagcgccggauccucucucuucucgaccggugucgcacccgcccuggcuccuaaaguggagcccgcggugccaggccaccauggguuagcacugggaaauagcgcccuacaccaccucgaugcucuggaccagcuuuuggaggaagccaaggucacauccggccugguuaaaccuacuaccucaccccucauaccaacaaccacgccggcacgaccucugcuucccuuuaguacugguccagggucuccccuguuccagccuuugagcuuucagucccaaggaucaccacccaagggcccugagcucagccuggccucuauucaugugccguuagaauccaucaagccaaguagcgcucugcccguaacagccuaugauaaaaacggcuucaggauucuauuucacuucgcaaaggagugcccuccagggagacccgacgugcucgucgugguugugucuaugcugaauaccgcgccucuuccggucaaauccaucguguugcaggcugccguacccaagucaaugaaaguuaagcugcagccaccuaguggaacugaacucagccccuuuucgccaauccagccucccgcagccauuacacaagugaugcuguuagcuaacccacugaagaaacagguccuuuccuucuuggguaaggccugucuccagccguggggccaggcaauacugcuaaccacgucuugccuggcuuga

SEQ ID NO: 56657 - RNA, 462 nt, Artificial Sequence
  derived and/or modified sequence opt3 from GGACT__Homo_sapiens__NP_149101
auggcccugguguucgucuacggcacccucaagagagggcagcccaaccacaggguucuucgggacggagcucaugguagcgcagccuuucgcgcgcgaggccguacacuggagccuuauccauuggugaucgcuggggaacacaauauuccgugguuacugcaucuacccggauccggcagacucguagagggugaaguguacgccgucgaugagaggaugcugcgguuccuugacgauuuugaaucuugcccugcacuguaucaacgcacuguguugagaguucagcuccuggaggacagggccccaggggcugaggaacccccugcaccaacggccgugcaguguuucgucuacucacgggcuaccuuucccccugagugggcccagcugccacaccaugauaguuaugacagcgaaggaccgcacggccuccgcuacaacccccgagagaauagauga

SEQ ID NO: 56658 - RNA, 501 nt, Artificial Sequence
  derived and/or modified sequence opt3 from GGCT__Homo_sapiens__NP_001186744
auggccaacagcggcugcaaggacgugaccggccccgaugaggaauccuuccuguacuuugcuuauggaucuaaucuccuuacagagagaauccaccugaggaacccuucagcagccuucuuuugugucgcgcgguugcaagacuucaaauuagauuuugguaauagucaaggcaagacuagccagacguggcaugggggaauugcuaccauauuccaguccccaggcgacgaaguuuggggugugguauggaaaaugaacaagucuaaucugaacucgcuagaugaguggcgcaaaaagcgacacacagccuuucagaaucaagggaaccauccgugcaagcacaaaacucguaugugggacagagaucccaagaucccugugcagaaucucucacuggcacuuuguuggcaggcccagagcggacaugggaccugcaacaggcuguucgcuuggguccagaaaaagauggugugucgguggaguauuaaacgcuccuga

SEQ ID NO: 56659 - RNA, 2277 nt, Artificial Sequence
  derived and/or modified sequence opt3 from GGCX__Homo_sapiens__NP_000812
auggccgugagcgcuggcuccgcaagaaccucucccucaagugacaagguccagaaagauaaggccgagcugaucagcgggccuaggcaagacucccggauuggaaaacuccuugguuucgaauggacagaucugucuucguggcgccgauugguuacuuuacugaaccguccaacggacccggcgucacuagcuguguuuagauuccucuuuggcuuccugaugguacuugauauaccccaggagagggggcugagcaguuuggaccggaaguaccucgauggacuggacgugugccgcuuuccucugcucgaugccuuaagaccacugccccuugacuggauguauuuggucuacaccaucauguuccugggcgcacuagguaugaugcucgggcuguguuauaggauuuccugcgugcuuuuucuguugccuuacugguauguuuuccuccuggauaaaacaucuuggaauaaccacagcuacuuauauggacugcucgccuuucagcuuacuuucauggacgcuaaucauuacugguccguggauggccuguugaacgcacaccggcgcaaugcccaugucccacuauggaacuacgcugugcugcgaggccagaucuuuauuguauauuucaucgccgggguuaagaagcucgacgcggacuggguggaaggauacucaauggaguaucugaguagacacuggcuuuuuagccccuucaaacuguugcucucugaggaacugaccuccuuacuggucgugcauugggguggccuacuccuggaucuuucagcaggguucuugcuguuuuucgacgugagcaggaguauaggacucuuuuucgucucuuacuuucacuguaugaacucccaacuguucagcaucggcauguuuucguauguuaugcuugccucuuccccucuguucugcucaccagaguggccgcggaaguuggugaguuacuguccccgucgccuccagcagcuguuaccucugaaagcugccccacagcccagcguauccugcguguauaagagaucuagggguaaaagcgggcaaaagccuggacuacggcaccagcucggcgcagcuuuuacacugcuuuacuugcuggaacaguuauuccugccauacucacauuuucucacccagggcuauaacaauuggacuaacgggcuguacggauauaguugggauaugaugguccacucccgaagccaucaacacgugaagauuacauaccgcgacgguagaaccggcgagcuuggguauuugaaucccggaguuuucacgcagucuaggcgguggaaagaucacgccgacaugcucaagcaguacgcgacuugucugucacgccuacugccgaaauauaacgugaccgaaccucaaaucuacuuugauauuugggucaguaucaaugacagauuccagcagaggauauucgauccccguguggacauuguacaggccgcauggagcccauuucaacggacauccuggguucagccucuccugauggaucuuucucccuggcgagcuaaguugcaggagaucaaaucgagccuggacaaccauacugagguggucuucauugccgacuuuccaggcuuacaccucgaaaauuucguguccgaggaucuggguaacaccucaauccagcuucugcaaggggaagucacaguggaguugguugcugaacagaagaaccagacccucagagagggcgagaaaaugcagcugcccgccggagaauaccauaagguguauacgacaaguccuucuccaagcugcuacauguauguauacgucaauacuaccgagcuagcacuggaacaagaccucgccuaucugcaggagcuuaaggaaaaaguggagaacggcuccgagacugggccguugcccccugaacugcagccauuacucgagggagaaguuaaggguggccccgagccuacaccacuggugcagaccuuucuuaggcgccaacagcggcugcaggaaaucgagagaaggcgcaauacgcccuuccacgagcgauuuuuccgguuucuacuccguaaacuguacgucuucagaaggucauuuuugaugaccuguauuagccugcgcaacuuaauacucgggcggccgucucuggaacaacuugcucaggaggugacauaugcgaaucugagaccuuucgaagcaguaggagaguugaacccauccaauacugauaguagccauucuaaucccccugaguccaaucccgacccagugcacucagaauuuuga

SEQ ID NO: 56660 - RNA, 957 nt, Artificial Sequence
  derived and/or modified sequence opt3 from GGH__Homo_sapiens__NP_003869
auggccagccccggcugccugcucugugugcuugggcuguuguuaugcggagcugcaucccuggagcuaucuagaccucacggugacaccgccaagaaaccaaucauuggcauacucaugcagaaguguaggaacaaagucaugaagaauuacgggcgguauuacaucgcggcuucauauguuaaauaccuggaaagugccggagcacgcgugguaccggugcgacuugaucugacagagaaggacuaugaaauuuuguucaagagcaucaacggcauucucuuucccgguggguccgucgaucugcguagaucugacuacgccaaaguggcuaagaucuucuauaaucugucgauacaaucauuugaugacggagauuacuucccuguuuggggcacuugccucggcuuugaggaauuaagccugcuuaucaguggggaguguuugcugacggcaaccgacacaguggaugucgccaugccacuaaacuucacuggaggucagcuccauuccaggauguuucagaauuuccccaccgagcugcuucugucuuuggcuguggaaccucucacagccaacuuucacaaauggagccuguccguaaagaauuucaccaugaacgagaaauuaaagaaguuuuucaauguucugacuacaaacaccgacggcaaaauugaauuuaucucaacgauggagggguacaaguauccaguguacggaguccaguggcaucccgagaaagcgccuuaugaauggaagaaucucgauggcauuagucacgcaccaaacgccgugaaaacugcuuucuaccuugccgaguucuuugugaaugaagcacggaagaacaaucaucacuucaaaagcgagucugaagaggagaaggcucugaucuaucaauuuuccccgauauacaccgguaacauuagcucauuccagcagugcuauaucuuugacuga

SEQ ID NO: 56661 - RNA, 2094 nt, Artificial Sequence
  derived and/or modified sequence opt3 from GGNBP2__Homo_sapiens__NP_079111
auggccagacugguggcugucugcagggacggcgaggaagaguuccccuuugaacggcgccagaucccucucuacauugaugacacccuuacaaugguuauggaguucccagauaacgugcugaauuuggacgggcaccaaaacaauggagcacaguuaaagcaguuuauacagcgacaugguaugcugaaacaacaggaucuaagcaucgccaugguagugacuucccgugaaguccucucugcgcugucacagcuugugccguguguuggcugcagaaggaguguggagcggcuguucagccaguuggucgaguccgggaaccccgcucucgaaccucugacggugggaccaaagggcguacugucuguuacccgcucguguaugacagacgccaaaaagcucuauacuuuauuuuacgugcacgguucaaaacugaaugauaugauugacgcaauccccaagagcaagaaaaacaagagaugccaacuucauaguuuggauacccacaaaccuaagccacuugggggauguuggauggacgucugggagcuaaugucccaggaaugcagggaugagguggugcucauugacucuagcugucugcuugagacacuggaaaccuauuugcggaaacaucgcuucugcacugauuguaagaauaagguccuccgagccuacaacauccugauaggcgaguuagacugcuccaaagaaaagggcuauugugcugcacuguacgaggggcucagaugcugcccccacgaaaggcacauccauguuuguugcgagacagacuuuauugcccaccuucugggacgggcugagccugaguucgccgguggccgucgcgaaagacaugcgaaaaccaucgauauugcacaggaagagguguugacgugucuagggauccaccuguaugaaaggcuccaccggauauggcagaagcugcgagccgaggagcaaacuuggcagaugcuguuuuaccugggaguagacgcuuugcgcaaaucauucgaaaugaccguggagaagguccagggcauuaguagacucgaacaacugugcgaggaauuuagcgaggaggaaagggugcgggaguuaaaacaggaaaagaagcgccagaaaagaaagaauaggcguaaaaacaaguguguuugcgauaucccaacaccgcugcagacugccgacgagaaagaggugucucaagaaaaggagaccgauuucauugaaaauuccucauguaaggcaugcgguagcacagaggacgggaacaccugugucgaagugaucguaacgaaugagaacacaaguugcacuugucccucuuccggaaaucuacucggcagcccuaaaaucaagaaaggccugucgccacauugcaacgggucugauugcggauacuccucaaguauggaggguagcgaaaccggcucccgggaggggucugacguugcuuguacugaaggaauuugcaaccacgaugagcauggcgacgauagcugugugcaccauugcgaagacaaggaggacgauggugacucaugugucgagugcugggccaauagugaagagaacgauacaaaagggaagaauaagaaaaagaaaaagaaauccaagauacuuaagugugacgaacacauccagaaauugggcagcugcauuaccgaucccggaaaccgagagacgucuggcaauaccaugcacacaguguuucauagagacaagacuaaagauacccacccugaaucauguugcaguagcgagaaagggggacagccacugcccugguucgagcauaggaagaacgucccgcaguucgcggaaccuacagagacucucuuuggucccgacuccggcaagggggccaaaucucugguggaacuucuggaugagucggaguguaccagcgacgaagagaucuucauaucccaagaugaaauucagucauuuauggcaaauaaccagaguuucuauucuaaucgcgagcaguaccggcaacacuugaaggaaaaguuuaacaaauauugcagacucaaugaccacaagaggccaaucugcagcggauggcugacaaccgcuggcgccaacuga

SEQ ID NO: 56662 - RNA, 1959 nt, Artificial Sequence
  derived and/or modified sequence opt3 from GGN__Homo_sapiens__NP_689870
augggcaaccugcagagcgagcccuccgccgggggagguucuagaaaggugcaaccuucagacagggcuccagauagucggcgcaccagccucgucgaaccggagaugacaucccaggcaaugcgacuuacucguggccuggggguuugguuccccggaucugccacgccuccaggcuugauggugcccagagaaccucaggcgucgccaucaaccuuaccccugacacuagagaggccuagcccaguaaugccgcccccugaagaggcugccgcagugagugccccacccccugcuccagcagguacucuccugcccgggccguccaaauggcagaagccugccggaacccccgucccacggauccgcagacuucuggaggcuucucacaggggccaaggcgacccucccagcuugcggccacucaaacccccuccaccgccccgccagcuguccgugaaggauacaguuccucgagccccaucacaguuucccccuccacuggaaaccuggaaacccccgccuccacuccccagugagagacagccugcggacaggcggauuacucccgcauuagccacaccagcuagcccucccaccgaaucucaagccgggccacguaaucagggacagacggcaggucgcgcuagaggcggggccccgccucaugcgggagagggcgagauggcccagcccgcagauuccgaaucaggucugagccuuuugugcaagauaacuuucaagaguaggccaucucuggcucccccugccgcuuccagcucgcuagccgcaaaagccucucucgggggaggcggcgggggaggucuguuugcugcguccggcgcaaucucauacgccgaggugcuuaagcaagggccacugcccccuggagcugcccggccguugggcgaagucagucgaggugcacaggaggccgaagggggcgacggagauggcgagggguguagcggaccacccuccgcuccugccucucaggcacgcgcgcucccacccccuccguauaccacauuccccgguagcaaaccaaaguuugacugggugucagcuccugauggccccgagagacacuucagguuuaacggggccggaggcgguauuggggcaccacggcgcagagccgcugcccugaguggcccuuggggaucacccccaccgccucccgaacaaauccauagcgcaccaggccccaggcguccugcuccagccuuacuggcgcccccuacuuucauuuuuccggccccaaccaauggggagcccaugcggccuggacccccaggucuccaggaacuuccuccccugccaccuccgacacccccaccuaccuugcagcccccagcucuacagccuacgccccugccgguagcaccaccucucacucccggccuggggcacaaagagucugcccuugcuccaacagccgcacccgcgcugccuccggccuuggcugccgaccaagcacccgcuccauccccugcccccgcaccuaccguugccgaaccaagucccccugugagcgcuccagcgcccgccgcagcuccgaucaagacucgaacaagaaggaacaagggaucccgcgccgcccggggcgcuaccagaaaagauggucuccauggggacggcccuagggagcgcgcaacggccaccgucccagauucuucgggaggcgggggaggcgguagcggggcgucccagacaggagcugccaauacucgagcagcccggcacuggcugcccuuccagguguuaaacucaugcccuuguaagugcuacugucaccaucagccacgucacagaaggcugccccgcaaugugagugcuuggcuaucuaccagcacaaaccaucucggcgagccgccuugggucgcaacuauaaaacuguccgguucacuuguugccaaguuggaacacuaugaccugcaagcgacccacagcaauuga

SEQ ID NO: 56663 - RNA, 903 nt, Artificial Sequence
  derived and/or modified sequence opt3 from GGPS1__Homo_sapiens__NP_001032354
auggagaagacccaggaaacagugcaaaggauccugcucgagcccuacaaauaucuucugcaguugccuggcaagcaggucaggacuaaauuaagccaggccuucaaccacuggcugaagguuccagaagacaaacuacaaauuauaaucgaggugacggaaaugcuccauaaugcuucccugcuuauugaugacaucgaggauaacucuaagcugcggcgcggguuuccgguagcacacucaauuuacggaauccccagugugauaaauagcgccaacuaugucuacuucuugggucucgagaaggugcugacccuggaccauccugaugcgguuaaacucuuuacacgacaguuacuggaacuucaccagggccagggguuggacaucuauuggcgugauaauuacacuugcccaaccgaggaagaguauaaggcuauggugcugcagaaaacaggaggccuauucggucucgccgucgggcugaugcaacuguuuuccgacuacaaggaggaucuuaaacccuugcucaacacccugggauuauucuuucagauuagagacgauuacgcaaaucugcauucuaaggaauauucggagaacaagucauucugugaagaccucacugagggcaaauuuagcuucccuacaauccacgccauuuggaguaggccagaauccacccaggugcaaaauauccuucggcagcgcacggagaacauagauauuaagaaauacugcguacacuaucuggaggacguuggcucuuuugaauacacuagaaauaccuugaaggagcuagaagcuaaagcauauaagcagaucgacgccagagggggaaaccccgagcugguggcucucgucaaacaucugagcaagauguucaaggaagagaaugaguga

SEQ ID NO: 56664 - RNA, 1710 nt, Artificial Sequence
  derived and/or modified sequence opt3 from GGT1__Homo_sapiens__NP_038347
augaagaaaaagcuggugguccucggccuucuggccguuguguugguauuagugaucgucgggcugugccuauggcuccccagcgcuuccaaagagccugacaaccacguguacaccagagcagccguugcggcugaugccaagcaguguucuaaaauuggaagggacgcacugcgggaugguggcucagccguggacgcugcaauagccgcgcuucugugcgucggguugaugaaugcccauaguaugggaaucggcggugggcuguuccucacaauuuauaacagcacuacgcgcaaggcggaagugaucaaugcacgagagguagccccacgucuggcuuuugccaccauguucaacuccucugaacaaucgcagaagggaggccucucaguugcagugccgggcgagauuagaggguacgaauuagcucaccagaggcauggacggcugcccugggcccgccuuuuucagccuagcauccaauuggcgagacaggguuucccagucggcaaagggcuggccgcagcucuagagaauaagaggacagugauagagcagcagcccgugcucugugaagucuuuugccgggaucgcaaaguucugcgagagggagaaagacuuacucugccucaauuggccgacaccuaugagacacucgcuaucgagggcgcccaggcauucuacaacgguagucugaccgcccagauugugaaggauauccaggcugcugggggaauuguaacugcagaagacuuaaauaacuauagggccgagcugaucgaacacccacucaauauaucccuuggcgaugugguccuguacaugcccucugcuccuuugagcggcccagugcuagcccugauucucaacauccugaaaggguauaauuuuucccgggagucaguugaaaguccggagcaaaagggacuuacauaccaucguauuguggaggcauuccgcuuugccuacgcuaagagaacccuguugggugaccccaaauucgucgaugugacggaaguaguuaggaacaugacuagcgaguuuuucgccgcacagcuccgggcgcagaucucugacgauaccacacacccuaucuccuauuacaagccagaauuuuauacucccgacgacggcgggaccgcucaccugucaguggucgccgaggauggaagcgcagugagugccacaucuaccauuaauuuauacuucggcuccaaaguccgaagcccugugucggguauacuguucaacaaugaaauggacgauuuuucuuccccaucaaucacgaacgaguucgggguucccccgaguccugcuaacuuuauucaacccggcaagcagccacuaagcuccauguguccuacuaucauggugggacaggacggccagguacgcauggucgugggggccgcaggagguacacaaauaaccacugcuacagcccucgcgauuaucuauaaucugugguucggcuacgauguuaaaagagccguggaggaacccaggcuucauaaccaguugcugccaaaugucaccacgguggagcggaacaucgaccaggcuguaaccgcagcccucgaaacacgccaccaucacacucagauugcuucuaccuuuaucgccgugguucaagcaauugucagaacagccgggggaugggcggcugccagcgauucaaggaagggcggugagcccgcaggguauuga

SEQ ID NO: 56665 - RNA, 678 nt, Artificial Sequence
  derived and/or modified sequence opt3 from GGT2__Homo_sapiens__XP_011528923
augaccagcgaguucuuugccgcucagcugagaucccaaaucucugaccacacaacucaucccauuucauacuauaagccugaguucuacacgccagaugacggcgggaccgcacaccucaguguggucgccgaggauggaagcgcgguuuccgcuacaucuacuauaaaccuuuauuuugguucgaaagugugcucaccgguaagcggcauccuguucaauaacgaauggaccacaagugccuugcccgcauuuaccaaugaguucggggccccuccaucccccgcuaacuuuauucagccuggaaagcagccauuacugucuaugugucuaacuaucauggugggccaggacggucaagucaggauggugguuggggcagccggaggcacacagauuaccacggauacugcucucgccaucauauacaaucugugguucggcuaugacgugaaacgggcggucgaagaaccccgccuucauaacaagcuguugccuaaugugaccacaguagagcgaaacaucgaucaggcaguuacugccgcucucgaaacccgucaccaucacacacagauugccagcaccuuuaucgcagugguccaagcuauugugagaacggccgggggaugggcggccgcauccgacucaaggaaagguggcgagccagcuggguacuga

SEQ ID NO: 56666 - RNA, 1764 nt, Artificial Sequence
  derived and/or modified sequence opt3 from GGT5__Homo_sapiens__NP_001093251
auggccagaggcuacggggcuaccgugagccugguccuccuuggacuggguuuggcauuagccguuaucgugcuggcgguagugcuauccaggcaccaggcucccugcggcccucaagccuucgcacaugccgcugucgcagccgacucuaagguguguucagauauugggcgggcuauacuccagcagcagggaaguccaguugacgccacaaucgcggcacuggugugcacuagcgucgugaacccgcaauccaugggccuuggugggggaguaauuuuuacgaucuauaauguuaccacaggcaaaguggaggucauuaacgcccgcgaaacugugcccgcuucucacgccccuucgcuguuggaucagugugcacaggcucucccacugggcaccggggcccaguggaucggagugcccggugagcugcgaggcuacgcggaagcccaucguagacacgggaggcucccuugggcacaauuauuccagccaacaauagcucugcuucggggaggccaugucguugcccccguguugucacgcuuucugcacaauagcauccuaagaccuagucuccaggcuuccacccugaggcagcuuuucuuuaacgguacugagccacugcggccgcaagaccccuugccuuggccagcccucgcaacaacccuggaaacgguagccacugaggggguggaggucuucuauaccggacgcuuaggccagaugcugguggaagauauugcuaaggagggcucucagcucacacuucaagaccuggcgaaauuucagcccgaaguuguggaugcauuggaggucccucuaggggacuacacucuguauagcccacccccgccugccggaggugcuauccucuccuucauucugaaugugcuucgaggcuuuaacuucucaaccgagaguauggccagacccgaagggaggguaaauguuuaccaccaucugguggagacauugaaguuugcaaaaggacagcgguggcgucucggcgauccacgcagccacccuaagcugcagaacgccucuagagacuuacugggugaaacccuagcucaacucaucaggcagcagauagaugggcggggcgaccaucagcugucccacuauucacuugccgaggcauggggacacggcacggggacuagccaugucaguguguugggagaagaugguucugcggucgcugccacauccaccauuaauacucccuucggcgcaaugguguacagcccacgaacagggaucauucugaacaaugagcuccuggaccuuugcgagcgcugucccagaggaucgggcaccacgccuucuccagccguuuccggugacaggguagggggcgcuccgggacggugcuggcccccugugccaggcgaacgcucacccaguagcauggucccuuccauccugaucaacaaggcccaagggucuaaauuggugauuggaggugcaggcggggagcucauaaucagcgcuguugcccaggcgauuaugucaaagcugugguuaggauuugaucugagagccgcuaucgcagccccaauacuacacgugaauaguaaaggcugugucgaauacgagcccaacuucucccaggaagugcagaggggucuccaagaccgugggcagaaucagacccagcggccguucuuucugaacguagugcaagcuguuagccaggagggcgccugcgucuaugcagugucugaucuucgaaagucaggagaggcggccggcuacuga

SEQ ID NO: 56667 - RNA, 678 nt, Artificial Sequence
  derived and/or modified sequence opt3 from GGTLC1__Homo_sapiens__XP_005260922
augaccagcgaguucuuuuccgcccagcugagagcucaaaucucugacgauacaacucaccccauuucauacuauaagccugaguucuacaugccagacgauggcgggacggcacaucucaguguggucgccgaggacggaagcgcgguuuccgcuaccucuacaauaaaccuuuauuuugguucgaaagugaggucaccgguaagcggcauccuguugaauaacgaaauggaugacuucaguuccacuucuauuaccaaugaguuuggggugcccccuagcccagccaacuucauccagcccggaaagcagccuuuauccucaaugugcccaacaauuauggucggccaggauggucaagugcggaugguugugggggcagccggaggcacccagaucacuauggcuacagcacuggccauaaucuacaaucuaugguuuggcuaugacgucaaaugggcuguggaagaaccccgccuccacaaccagcugcuuccuaauguaaccacgguugagcgaaacauugaucaggaagugacugccgcgcuggagacccgucaucaccauacacaaaucaccaguacuuucauugcagucgugcaggccaucgugagaauggcugggggaugggccgcagcuagcgacucuaggaaggguggcgaaccagccggguacuga

SEQ ID NO: 56668 - RNA, 654 nt, Artificial Sequence
  derived and/or modified sequence opt3 from GH1__Homo_sapiens__NP_000506
auggccaccggcagcagaacaucccugcuccuugcuuucgggcuguugugcuuacccuggcugcaggagggaucugcauuuccuacuaucccacuaucaagguuguucgacaacgccaugcugcgggcgcaccgccuucaucaacuggcuuuugauacguaccaggaguucgaagaagccuauauuccgaaggagcagaaauacaguuuucuccagaauccccaaaccagccucuguuucuccgaaucuauaccuacaccaucgaaccgagaggagacucagcagaagucaaaucuggaacugcuccguaucagcuuacugcuuauucagaguugguuggagcccgugcaauuucugagauccgucuucgcaaacucucuaguuuauggugccagcgacuccaauguguacgaucuccugaaagaccuugaagagggcauccagacccugauggggagguuggaggauggaucaccucggacaggccagauuuuuaagcagaccuauaguaaauucgacacuaacagccacaaugaugacgcucuccugaagaacuacgguuuacuguauugcuuucgcaaggauauggacaaaguagaaacauuccucagaaucgugcaauguaggucugucgagggguccugcggauuuuga

SEQ ID NO: 56669 - RNA, 654 nt, Artificial Sequence
  derived and/or modified sequence opt3 from GH2__Homo_sapiens__NP_002050
auggccgcuggcagcagaaccucccugcuccuugcauucgggcuguugugcuuaucuuggcugcaggagggaucagccuuucccacaaucccucuaaguaggcuguucgacaacgcgaugcuccgggcucgccgacuuuaccaacuggccuaugauacuuaccaggaauuugaggaagcauauauuuugaaggagcagaaauacagcuuccuccagaauccacaaacgucccuguguuuuucugaaucgauaccgacccccucaaaccgugugaagacacagcagaaaagcaaucuggagcucuuaagaaucagucugcuuuugauucaguccuggcuggagccuguccaacuacucaggucuguuuucgccaacagccugguguauggugcuuccgacucaaauguauaccggcaccuuaaggaucuggaagagggcauccagacuuugauguggcgccucgaagacgggaguccaagaaccggacagauuuuuaaccagagcuauucuaaauucgauacaaagucccauaaugacgaugcacuguuaaagaacuacggccugcucuacugcuuuaggaaagacauggauaagguggagaccuuccuucggaucguccaaugucgcucaguggaggguagcugcggguuuuga

SEQ ID NO: 56670 - RNA, 1038 nt, Artificial Sequence
  derived and/or modified sequence opt3 from GHITM__Homo_sapiens__NP_055209
augcuggccgcuagacucgugugccuuaggacccugcccagccgggucuuccacccugcauuuacaaaggccuccccaguugugaaaaacucuaucacuaagaaucagugguuguuaacgccgucacgcgaguacgcgaccaaaacacgaauuggcauacguagagggaggacuggacaagaacugaaggaggcugcccuagaacccaguauggagaaaaucuucaagauugaccagaugggucggugguuuguagcaggcggggccgcugugggacucggcgcacuguguuauuacggucuugggcugagcaacgaaaucggagccauugagaaggcugucaucuggccucaguaugugaaagaucgcauacauuccaccuacauguauuuggccggcucuaucggccucacagcgcugucggcaauugccaucucaagaaccccaguucugaugaauuucaugaugagggggagcugggugacuauuggagucacauuugcugccauggugggugcaggcaugcucguacggaguauccccuacgaccaguccccugggccaaagcacuuagcuuggcugcuucauucuggaguuaugggcgccguggucgcgcccuugaccauacugggugggccucuacucauucgcgccgcaugguauacggcuggaaucgugggcggccugagcacuguggccaugugcgcuccauccgagaaauuccuuaacaugggggccccgcugggagucgguuugggccucguuuuugugucaagucuggggagcauguucuuacccccuaccacaguagcaggagccacucuguacucuguggcuauguacggcggucucguccuguuuuccauguuccuuuuguaugauacccaaaaggugauuaaacgagcggaaguuucaccaauguacggggugcagaaguaugaccccaucaauagcaugcuaaguaucuacauggauacacugaacauuuuuaugagagucgcaaccaugcucgccacgggcggaaauaggaagaaauga

SEQ ID NO: 56671 - RNA, 327 nt, Artificial Sequence
  derived and/or modified sequence opt3 from GHRH__Homo_sapiens__XP_011527089
augccccuguggguguucuuuuucgucauccucacccuuagcaacuccucucacugcucaccuccaccgccccugacauugagaaugaggcgguacgccgacgcuauuuuuacuaauaguuaucgcaagguuuuaggccagcugagcgcacgaaaacuacuccaagauauaaugucccgucagcagggggagucuaaccaggaaagaggagccagggcgcggcugggucgccaaguggacucgaugugggcugagcagaagcagauggaacuugagucaauccugguagccuugcuccagaaacauagcagaaauagucaaggcuga

SEQ ID NO: 56672 - RNA, 1938 nt, Artificial Sequence
  derived and/or modified sequence opt3 from GHR__Homo_sapiens__NP_001229328
augaacuggggccccaccgggauggaccuguggcagcuccuucugacauuggccuuagcuggaagcuccgaugcauucucugguucagaggccacugcggcuauccugaguagagccccuuggagccuacaauccgugaauccaggccucaagacgaacucuucgaaagaaccgaaguuuaccaaaugcaggucacccgagcgggaaacauucagcugucacuggacugacgagguccaucacgggaccaagaaucugggaccuauucagcuuuucuacacacgccgaaacacccaggaauggacucaggaguggaaagagugcccagauuauguuagugcaggcgaaaauuccuguuacuucaacucuagcuuuacauccauauggauccccuauugcauuaagcugaccucaaauggugggacgguggacgagaaguguuucaguguagaugaaaucgugcaaccugacccacccauugccuugaacuggacucuccugaaugucagccugaccggaauccaugcugauauacaggugcguugggaggcaccuagaaacgccgacauccagaaaggcuggaugguucucgaguacgaauuacaguauaaggaggugaaugaaacaaaauggaagaugauggauccaauucugacuaccucugucccgguguacucccuuaaaguagacaaggaguaugaaguuagggugcggucaaagcaacgcaacagcggcaauuacggggaguuuagugaggucuuguacgugacacugccccagaugucucaguuuaccugcgaagaggauuuuuauuucccuuggcuacucaucauuaucuuuggaauauucggucugacggugaugcuuuuugucuuccuguucuccaaacagcaaagaauuaagauguugauccucccacccguuccugugccaaaaauuaagggcaucgaccccgaucuguuaaaagaagggaagcuggaggaaguaaacacuauccucgcuauucacgacagcuacaaaccggaguuucauucggacgauucuuggguggaguucauagaacuugacaucgaugagccugacgaaaagacagaggaauccgauaccgacaggcuguugucaagugaucacgagaaaagccacuccaaucuaggagucaaagacggcgauucuggucggacuagcuguugcgagcccgacauucuggaaacagauuuuaacgccaacgacauccaugaggggaccucagaaguggcgcagccacagcgccucaagggagaggcagaccugcuuugucuggaucaaaagaaucagaacaauaguccuuaucacgacgccugccccgcuacgcagcagccauccguuauacaagccgagaagaacaaaccccagccuuugccaaccgaaggcgcagagagcacacaucaggcugcccacauucagcucucuaauccgucaagucugagcaacaucgauuucuacgcgcaaguguccgacaucacucccgccggcucugucguguuaucgccugggcagaagaauaaggcaggaaugagccagugugauaugcacccagaaaugguaucccugugccaggagaacuuucuaauggacaaugcuuauuucugcgaagccgaugcuaaaaaguguauucccguugccccucauaucaaaguggagucacacauucaaccaagucucaaccaggaggacauauacaucaccacagaaucucugacuaccgcagccggucgacccggcacaggggagcaugucccgggaagcgaaaugccugugccagauuauaccuccauucacaucguccagucaccccagggccuuaucuugaaugcuacugcgcugccucuccccgacaaggaguuucugagcucuugcgguuacguguccacggaucaacuuaacaaaauuaugccauga

SEQ ID NO: 56673 - RNA, 1272 nt, Artificial Sequence
  derived and/or modified sequence opt3 from GHRHR__Homo_sapiens__NP_000814
auggacagaaggauguggggcgcccacguguucugcguccugagcccccucccuaccguucuugggcauaugcacccagagugugauuuuaucacacagcugcgggaagacgaguccgcuugcuugcaagcagccgaagagaugccgaacacuacguuaggaugucccgcgaccugggauggucugcuaugcuggccuacagcuggcucuggggaaugggugacucucccaugucccgacuucuuuucacauuucaguagcgaguccggagccguaaagcgcgauugcaccauuacaggcuggucugagccuuuuccacccuacccuguggcauguccagucccgcuggaacuucuggccgaggaagagucguauuucucaaccgugaaaauaaucuacacuguuggucacagcauuaguaucguggcuuuguuugucgcaauuacaauccucguggcccugcgacgucugcauugccccagaaauuauguacacacccaacucuucacgacuuuuauauuaaaggcuggggccguuuuccugaaagacgcggcacuuuuucacuccgaugacaccgaucauuguucuuucagcacaguguugugcaaggucuccguggccgcuucacacuuugccacuaugaccaacuucaguuggcugcuagcagaggcuguguaccucaauugucugcuugccagcacaucuccuuccucaaggcgggcguucugguggcuggucuuggccggauggggccucccaguucuguuuaccggcacgugggugagcugcaaauuagcauucgaagacaucgcuugcugggaucuggacgauacaagucccuauugguggauuaucaaggggccuauuguacucucugugggagucaacuuuggucuuuuccugaauaucauacgcauuuuggugagaaagcuagagccagcccagggcucccugcauacucagagccaguacuggaggcucucgaaaucuacccuguuucuuaucccccuguucgggauucacuauaucaucuuuaacuucuugccggacaaugcuggacucggcauucggcugccuuuagaacugggucuaggguccuuucagggauucauaguugccauccucuacuguuuucugaaccaggaggugcgcacugaaauuucacgaaaguggcacggccaugaccccgagcuuuugccagcauggagaacaagggccaaauggaccacgccuagucggagcgcugcgaagguccugaccuccaugugcuga

SEQ ID NO: 56674 - RNA, 318 nt, Artificial Sequence
  derived and/or modified sequence opt3 from GHRL__Homo_sapiens__NP_001128416
auguuuaccugcugguggagcuaccugagauccacacucgccgcugugcccggcgaggcaucuaggguccagcaacggaaggaaaguaaaaagccuccagccaaacuucagccgcgcgcgcuggcugggugguugcgacccgaggacggaggucaggccgaaggcgcagaggaugaauuagagguucguuucaacgccccuuucgacguggggaucaagcugucaggaguacaguaucaacagcacagccaggcucuaggcaaauuucuccaggauauucugugggaggaagcaaaggaggccccagcugacaaguga

SEQ ID NO: 56675 - RNA, 870 nt, Artificial Sequence
  derived and/or modified sequence opt3 from GHSR__Homo_sapiens__NP_004113
auguggaacgccacccccagcgaggaaccuggcuucaaucugacacucgcugaccuugauugggacgcauccccagggaacgauucucugggagacgaguuguuacagcuguuuccggcgccccuacucgccggugugacugcuacgugcgucgcccuguucguugugggcaucgcagggaaucuucugaccauguugguagugucaagauuuagggaacuccggacaacuaccaaccuguaccugaguagcauggccuucuccgaucucuuaauuuuucuguguaugccucuugacuugguccgccuguggcaauaucgaccauggaauuucggagaucuacucugcaagcuguuucaguucgugucugagucguguacauacgcuaccguucuuacuauaacagcacugucaguggaacguuauuuugccaucugcuuccccuugagagcuaaagucgugguaaccaagggcaggguuaaacucgugauuuuugucaucugggccguggcguucuguagcgcagguccuauuuuugugcuggucgggguugagcacgagaacggaacggacccaugggauacuaaugaaugccggcccaccgaguucgccgugcgcaguggcuuacugacaguaauggugugggucuccucuaucuucuuuuuccucccuguguuuugucuuacuguucuguacagcuugauaggcagaaagcuauggaggcggcgccgaggggacgcuguggucggagccucccugagagaucagaaccauaaacagaccgugaagaugcucgguggcucacaaagggcacugcggcuuagucuggcugggccaaucuugagccucugccuguuaccgucucuguga

SEQ ID NO: 56676 - RNA, 687 nt, Artificial Sequence
  derived and/or modified sequence opt3 from GID8__Homo_sapiens__NP_060366
augagcuacgccgagaagcccgacgaaaucaccaaagaugaguggauggaaaagcugaacaaucuccacgugcagagagcugacaugaacaggcuuauuaugaauuaucuggucacagagggcuucaaagaagcagccgagaaguuucggauggaguccgggauagaaccuucuguugauuuggagacuuuagacgaacgcaucaaaauucgagagaugauccugaagggacaaauucaggaggcgaucgcucuaauaaacucacuccauccagaacugcuugauacgaaucguuaccuguauuuccacuugcagcagcaacaucucaucgagcugauuagacagagggaaaccgaggccgcacuggaauuugcccagacacagcucgcugagcaaggugaggaaagucgggagugcuuaacugaaauggagcgcacccuggcacuuuuggccuucgacagcccggaagagucccccuuuggcgaucugcuacacacaaugcagagacagaagguguggucugagguaaaccaggcugugcucgacuacgaaaauagggagucgaccccuaaacuggccaaacuucugaaguugcuccugugggcgcaaaacgaauuagaucagaagaaagucaaguauccaaagaugacugaccugucaaaaggggugaucgaggaacccaaguga

SEQ ID NO: 56677 - RNA, 1254 nt, Artificial Sequence
  derived and/or modified sequence opt3 from GIF__Homo_sapiens__NP_005133
auggccugguucgcucuguaccuccuuagccuguugugggcaaccgccggcacauccacucagacgcaaucuucaugcagugugcccagcgcgcaggagccuuuagucaacgggauccagguucugauggaaaauuccgugaccucuucggcuuauccaaacccgucaauucuaauagccaugaaucucgcaggagccuacaaccugaaggcucagaaacuucugacauaucaauugaugagcagugacaauaacgaucucacuaucggucagcugggccugaccauuauggcacucacauccucuuguagagaccccggggauaagguaagcaucuuacagaggcagauggagaauugggccccuuccucaccaaacgcugaagccagugcguuuuacggacccagccuggcaauucuugccuugugccagaaaaauucugaggcuacccugccuaucgccgugcgguucgcaaagacucuacucgcuaacuccucaccauuuaaugucgacacaggcgccauggcgacccuggcccuuacguguauguauaacaaaauacccguggguagcgaagagggguaccgcagucuguucggacaaguuuugaaggauaucguggagaagauuucuaugaaaaucaaggacaauggcauuaucggcgauauauauuccacugggcucgcaaugcaggcucugagcgucaccccugaaccaucgaaaaaggaguggaacugcaaaaagacaacugacaugauuuuaaaugaaaucaagcagggaaaauuucacaacccgaugucuauugcccaaauccugcccucccucaaggguaaaaccuaccuugaugugccucagguaacauguucaccagaccaugagguucagcccacccugccuaguaacccaggccccgggccgacgagcgcuuccaauaucacugugauuuacacaauaaacaaucaauugcgaggagucgagcuacuguucaacgaaaccaucaaugugucugucaagagcggcucagugcuccugguugugcuugaggaagcccagcguaaaaacccuauguuuaaguucgagacuacaaugaccaguuggggucugguaguguccagcauuaauaacaucgcagaaaaugucaaccacaaaacguauuggcaguuuuugucuggggugacaccccucaaugagggaguugccgauuacauaccauucaaccaugagcacauuaccgcuaauuuuacucaguauuga

SEQ ID NO: 56678 - RNA, 3108 nt, Artificial Sequence
  derived and/or modified sequence opt3 from GIGYF1__Homo_sapiens__XP_005250589
auggccgcugagacccugaacuucggccccgaauggcucagagcacuuagcgggggagguuccguggccucuccuccaccgucacccgcgaugccuaaguacaaacuggcugacuauagguacggccgggaggaaauguuggccuuauaugucaaggagaauaaaguuccagaagaacugcaggauaaggaguuugcagccgugcuacaagacgaaccccuccagccucuggcucuugagccacugacagaagaggagcagcgcaacuucaguuugagcguaaauuccguggcaguccuccgacugauggggaaaggagccggacccccucuggcugguacuucucgugggagaggaucgacgaggucacggggccgcggcagaggggauagcugcuuuuaccagaggaguaucgaagagggagacggugccuucggccgguccccacgcgaaauucaacgaucucagagcugggaugacagaggggagaggcgguuugaaaaguccgcgcgucgcgauggagcaagauguggcuucgaggaggguggggccggaccgaggaaggaacacgcucggucagacagugagaacuggcgaagccuccgcgaggagcaggaagaggaggaagagggcucuuggagauuaggcgccgggcccaggcgggauggagaccgcuggagauccgcaucaccugaugguggcccaaggagcgcuggguggcgugaacauggagagcggcgaagaaaauuugaguucgaccugaggggcgaucgcggugggugcggcgaagaggaaggacggggcgggggagguaguucucaccuuagaaggugucgcgcccccgagggcuuugaagaggacaaggacggguugccugaguggugccuggaugacgaagaugaggaaaugggaaccuucgacgcguccggcgccuuucuaccacucaaaaagggucccaaagagccgauaccugaggaacaggagcuggauuuccaagggcuugaagaggaagaggaacccagcgagggccuggaggaagagggaccagaagcaggcgggaaggaguugacaccucugcccccacaggaagagaagucgucuucccccucaccucucccaacuuuaggaccgcugugggguaccaauggcgacggggaugagacagcugaaaaagagcccccugccgcugaagacgauauccgaggcauucagcucaguccaggcguggguagcuccgccgggcccccuggcgaccuugaggaugacgagggacugaagcauuugcagcaagaagcagagaagcuaguugccucucugcaggacagcucacucgaagaggaacaguuuaccgcugcgaugcaaacucagggccugcggcacagugcagccgcuacagcccuuccacugucccauggggcagcccguaagugguucuauaaagauccccagggagagauccagggcccguucaccacgcaagagauggcugaaugguuucaggccgguuacuucagcaugucuuugcucgugaagagagggugugacgagggauuucagccucugggcgaagucauuaaaaugugggguagggugccauucgcacccggcccuucacccccaccuuuacuggggaacauggaucaggagcgccuaaagaagcaacaggaacucgcggcugccgcacuguaucagcagcuucaacaccagcaguuuuugcagcugguaaguagccggcaacucccccagugcgcccugagagagaaagcugcccuuggagaccugacuccaccgccucccccacccccucagcaacagcagcagcaauugaccgcauuccuccagcagcugcaggcuuuaaagccacccaggggcggggaucaaaaucugcuaccuacaaugucccgaucucucucgguuccggacagcggacgccugugggaugugcacacuuccgccucaagucagucuggcggugaggcgagccuuugggacaucccaauaaacuccucaacccaggggcccaucuuggaacagcugcaacuccagcauaaauuucaggagcggagagaagucgagcugagggccaagcgugaagaggaggaacgcaaacggagagaggaaaagaggcgacaacagcagcaggaggagcaaaagcggcgccaggaagaggaagaguuauucagaaggaaacacgugcggcagcaggaacugcuuuugaagcuccugcaacagcagcaggcugugccugucccacccgcaccuagcucuccgcccccacuaugggccggacuggcuaaacaaggccucuccaugaagacacugcuugaguugcagcuggagggugaacgacaguuacauaaacagccucccccaagagagccugcccgcgcacaagcgcccaaucacaggguucagcucggcgggcugggaaccgccccacuuaaccagugggugagugaagcuggcccgcuguggggagggccugauaagagcggcggugggucuuccggauugggccucugggaggacacgcccaagucagguggcagucugguacgugggcuaggacugaaaaauagccggucguccccaucucucagcgauucauacagucaccuguccggcagacccauuaggaagaaaacugaagaggaggaaaaacuuuugaaacuguuacaagggaucccucgcccacaggacggauuuacacaguggugugagcagaugcuccauacccugucugccacuggcagccuugaugugcccauggcagucgcuauucugaaggaaguggaguccccuuacgacguucacgacuauauccgaucaugccuaggugauacacucgaagccaaggaguucgcaaaacaauuucuggagagacgggccaagcagaaagcuagccagcagaggcaacagcagcaggaagcgugguugaguucugccucccugcaaaccgcauuccaggcuaaccauagcacgaaguuagggccgggagagggcucgaaagccaagcgccgugcccucaugcugcacucagacccaucuauacuuggcuacagucugcauggguccagcggagaaauugagucuguggaugacuauuga

SEQ ID NO: 56679 - RNA, 3900 nt, Artificial Sequence
  derived and/or modified sequence opt3 from GIGYF2__Homo_sapiens__NP_001096616
auggccgcugagacccagacacugaacuucggccccgaauggcucagagcacuuagcuccgggggaucuaucacuucaccuccacugaguccggccuugcccaaguacaaauuagcggacuauagguacggucgggaggaaaugcuggcucuauuucucaaggauaauaaaauuccuagcgaccugcuugauaaggaguuccugccaauauugcaagaagaaccccucccuccacuggcccuggugcccuuuacggaggaagaacagcgcaacuucuccaugucugucaauucggcagccguucuccgauuaaccggccgugggggaggcgguacagugguaggggcuccuagaggaaggucaagcagucggggccgcggcagagggaggggagaaugcgguuuuuaucagcgguccuucgacgagguggagggcgucuuugggcgcggaggcggucgagaaaugcacagaucucagagcugggaggaaaggggagaucggcguuucgagaaaccagggcgcaaggacgugggcagaccgaacuuugaagagggcgggcccacuuccguuggaaggaagcaugaguucauccggucagaaagugagaauuggcgaauuuuucgcgaagaacaaaacggugaagaugaggacggcggguggagacuggcaggaagcaggcgggauggcgagcgcuggagaccucacucuccagacggucccagguccgccggguggcgugaacauauggagcggcgaagaagguucgaauuugauuuccgcgaccgggaugacgagagaggcuacaggcgcgugcgaucaggaagcggcaguaucgacgaugaccgggauucucuuccugaaugguguuuggaggacgcugaggaagagauggggaccuucgauuccagcggagccuuucugucgcucaaaaagguccagaaagaaccaauucccgaggagcaggaaauggacuuccguccgguggaugagggugaagagugcucugacuccgaaggcucacacaaugaggaggcgaaggaaccugauaaaacaaacaagaaggagggggagaaaaccgacagaguaggaguugaggcaagugaagagacuccccagacaagcuccucuagcgccaggccaggcaccccuucagaucaucaaagucaggaggcuucccaguuugaacgcaaggacgagcccaaaacggaacagacugagaaggccgaagaggagacccggauggaaaauagccuaccagcaaaagugcccucuagaggugacgagauggucgcugaugugcaacagccucugucacagaucccaagugacacagccagcccgcuucugauauugcccccuccagugcccaacccuuccccaacucucaggcccgucgaaaccccgguugugggggcgccuggcaugggaucuguaucgacagagccagaugacgaggaaggccugaagcacuuagagcaacaggccgagaaaaugguggcauaucugcaggauagcgcucucgacgaugagcgacuugccuccaagcugcaggaacaccgcgcuaagggggucucaauccccuugaugcaugaggccaugcaaaaaugguacuauaaggacccucagggagagauucagggucccuucaauaaccaggaaauggcagagugguuucaagccggcuacuucaccaugagucuacuggugaaacgggcuugugaugaaucuuuucagccacucggggacaucaugaagauguggggaagaguuccuuucagccccggcccagcgccgccuccccacaugggugagcuggaucaggaaaggcuuacgcgucagcaagagcugacugcauuguaccagaugcagcaucuccaguaucaacaguuucugauucagcaacaguacgcccagguguuagcucagcaacagaaagccgcacuguccucacagcagcaacagcagcuagcccuccugcuucagcaauuccagacauugaagaugcgcaucagcgaccagaauauaauuccaucugucacccgguccgugaguguacccgauacugggagcaucugggagcugcaaccuacagcuucucagccaaccguuugggaaggcggauccgugugggaccucccccuggacacgaccacaccuggcccggcccuugagcagcugcagcaauuggaaaaggcaaaagcggcuaagcucgagcaggaaagaagggaggccgagaugcgagcaaaacgggaagaggaagaacgcaagagacaggaggaacugaggcggcagcaagaggaaauuuuacgaagacagcaggaggaggagcgcaaaaggcgugaggaagaggaacuggcccggagaaagcaggaggaagcucuaaggcgccaacgagagcaggagaucgcccucagacggcagagggaagaggaggagcgccagcaacaggaagaggcacugcguagacuugaggaacggaggcgcgaggaagaggagcgaagaaagcaggaagaguugcugcggaaacaagaagaggaagcugccaagugggcgagggaggaggaagaggcccagcgcagacucgaagagaacaggcugcggauggaagaggaggcugcacguuuacgccacgaagaggaggaacgaaaaagaaaggaacuggagguccagaggcagaaagagcuuaugcggcaacgccagcagcagcaagaagccuugagaaggcuccagcagcagcaacagcagcaacagcuggcucagaugaagcuaccaucaaguagcacuugggggcagcaaucgaauaccacagccugccagucccaggcaacucugucucucgcggagauccagaagcuggaagaggagcgggaacgacaacuuagagaggaacagcgcaggcagcagcgggaguugaugaaagcccugcaacagcagcagcaacagcagcaacagaaguuaagcggauggggcaacgugucaaaacccagugguaccacaaagucccuccuggaaauucagcaggaggaggcucgucaaaugcagaaacagcagcaacagcagcagcaacaccagcagccuaacagagccaggaauaacacccauucuaaucuucacacuagcauagggaacuccgucuggggaucaaucaauacgggcccacccaaccaaugggcaagcgaucuggugaguucuauuugguccaaugcugacacaaagaacagcaauauggguuuuugggaugacgccguuaaagaagugggcccucgcaacucgaccaauaagaacaagaauaacgcaucauugucuaaaaguguaggggucuccaaucggcagaacaagaaaguggaggaagaggaaaagcuccugaaacuauuccagggaguuaacaaggcccaggauggcuuuacucaauggugugagcagaugcugcaugcucucaauaccgcgaacaaucuggacgugccgacauucgucagcuuccuuaaggagguggaaucucccuaugagguacacgauuacauccgagccuauuugggggacaccagcgaagcaaaagaguuugcuaagcaguuccuggaaagaagggccaaacagaaggccaaccaacagcgccagcagcaacaguuaccacagcaacagcagcagcaaccuccccagcagccaccucagcaaccccagcagcaggauuccguguggggaaugaaucauucaacucuccacaguguuuuucaaacaaaccagagcaauaaccagcagucuaauuucgaggcuguccaauccggcaaaaagaagaaaaagcagaaaauggugcgggcagacccaucacugcuugguuuuagugugaacgccagcuccgagagacugaauaugggggaaauagagacgcuagaugacuacuga

SEQ ID NO: 56680 - RNA, 924 nt, Artificial Sequence
  derived and/or modified sequence opt3 from GIMAP5__Homo_sapiens__NP_060854
augggcggguuccagagaggaaaguacgguaccauggccgagggcaggagcgaagacaaccuguccgcuacacccccugcacuccggaucauucuuguggggaaaacuggaugcggcaagucugccacggguaauucaauacuggggcaaccagucuuugagaguaaauugcgcgcgcagagcguuacccgaacaugucaggugaagacuggaaccuggaacggccguaaaguauuaguggucgauacaccguccaucuucgaaucucaggcugacacccaagagcuguauaagaauauuggcgauugcuaccuacucucggcccccgggccucacgugcugcuucugguuauccaguugggaagauuuacugcacaggacacaguggccauuaggaaggucaaagaaguguucgguaccggcgcuaugcggcauguaguuauccucuuuacgcacaaggaggaucucgggggacaggcacuggacgauuauguggccaacacugacaauuguucacugaaagauuuaguccgcgagugcgaaagaagguacugugcuuucaacaauuggggcagcguggaggaacaacggcagcagcaggccgagcugcuugcggugauagagcgcuugggucgagaaagagaggggaguuuucauuccaacgaccuguuccuagaugcacaacuccugcagaggaccggagccggcgcuugccaggaagacuaucggcaauaccaggccaaggucgaguggcagguugaaaaacacaagcaggagcuucgugagaaugaaucuaacugggcauauaaggcucuguugcgcgugaaacaucucaugcuguuacacuacgagaucuuuguauuccugcuccuuuguagcauucuguuuuucaucaucuuuuuguucauuuuccacuacauauga

SEQ ID NO: 56681 - RNA, 903 nt, Artificial Sequence
  derived and/or modified sequence opt3 from GIMAP7__Homo_sapiens__NP_694968
auggccgagagcgaagacagaucccugaggaucgugcucgucggcaagaccgggucuggaaaaucagcuacagcaaacacuauucuuggugaggaaauauucgauagucggaucgccgcgcaggcuguuacgaagaauugccaaaaagccagccgcgaguggcagggccgagaccuguuggugguagauacccccggguuauuugacacaaaggaaucccuggauacuaccuguaaagagauuucucguugcaucauuucgucauguccuggaccacacgcaaucgugcuaguccuccugcuuggcagauacacagaggaagaacagaagaccguggcccugauaaaggcuguuuucgguaaaagcgcaaugaagcauauggugaucuuguuuacuaggaaagaggagcucgaggggcagaguuuccacgacuuuauugccgaugcugacgucggacugaaguccaucgugaaagaaugcggcaaccgguguugcgccuucucuaauagcaagaagacauccaaagcggagaaggaaucacaaguacaggagcugguugaacucauugagaaaauggugcaguguaacgagggcgcauauuuuagugaugacaucuacaaggauaccgaggaacgcuuaaaacagagagaagagguccugaggaagauauauacggaccaacuuaaugaagagauuaaauugguggaggaagauaagcauaagagcgaggaagagaaagaaaaggagaucaaacugcuaaagcucaaauacgacgagaagauuaagaacauccgggaagaggccgaacgcaauaucuucaaagacguguuuaaccgaauuuggaagaugcugucugagauauggcacagauuccuuuccaaaugcaaguuuuauucaagcuga

SEQ ID NO: 56682 - RNA, 1998 nt, Artificial Sequence
  derived and/or modified sequence opt3 from GIMAP8__Homo_sapiens__XP_005250007
augagcgagcaguccugccaaaugucugaacugagacuccuucuguugggcaaguguaggucagggaaaagugccaccggaaacgcuaucuuagguaagcacguguucaaaagcaaguuuuccgaccagacagucauuaaaaugugccagcgggagucuuggguucugcgcgaacgaaaggugguagugauagauacucccgaccuauucucgucaaucgcaugugccgaggauaagcagcguaauauucaacauugccucgaacugagcgcgccuagucuucacgcucuguugcucgucaucgccauuggccauuuuacgagagaggacgaggaaaccgcaaaagggauccaacagguguucggagccgaggcuaggcggcacauaaucauuguuuuuacacgcaaggaugaccugggcgaugaccugcuccaggauuucaucgaaaagaacaagccauuaaaacagcuggugcaggacuacgaggguagauauuguauuuuuaauaacaagacuaauuccaaggaugagcagaucacccagguccuugaauugcugaggaaaguggagucucuaguaaacacaaaugggggaccguaccauguuaacuucaagaccgaaggcagccgguuucaagacugcgugaaugaggcagccucccaggaaggcgauaaaccccaggggccucgcgagcgacaacuccagucaacuggaccagagcagaaccccgguacaagugaacugaccguccuucuggugggcaagagaggggcuggaaaaagcgccgcgggcaauucuauauuggguaggcaggcauuccaaacgggguuuuccgagcagucagugacucagagcuuccucagugaaucucgguccuggcguaagaaaaaggucagcauuaucgacgccccugacauuucgucucugaagaacaucgauuccgagguucgcaaacacaucuguaccggaccacacgccuuuuuacuggugacaccccucggcuucuauacuaagaaugacgaagcuguacuuucaaccauucagaacaauuucggcgagaaauuuuucgaguacaugauaauccuguugacaagaaaggaagaucuaggggaccaagaucuggacaccuuucucaggaacaguaacaaagcacuguauggacuuauucagaagugcaagaaucgguacagcgcuuucaacuaucgagccacgggugaggaggaacagcgccaggcggaugaacuguuggagaaaaucgaguccauggugcaucaaaauggcaacaagcacugugucuuuagagaaaaagagacucucaauauagugcugguugggaggucuggaacaggcaagagcgccaccgguaacucaauuuuagggagucugguguucacuucccggcuacgcgcacagccugucacaaaaaccagccagucuggcagaaggacgugggacggacaggaagugguaguuguggauaccccaucauuuaaucaaaugcucgacgucgagaaggauccgagucgucuggaggaagaggugaagcggugccuuagcuguugcgaaaaaggcgacacauucuuugucuugguguuccagcuggggcgauuuacugaggaagacaagaccgcuguugccaaacucgaggcuaucuucggagccgauuuuacaaaguacgcaaucaugcuguucacuagaaaagaggaccuuggugccggcaaccuggaagauuucaugaaaaauuccgacaacaaggcuuugaggcgcauuuuuaaaaagugcgggcggagagugugugcguucaauaacaaagagaccggacaggcacaagaaacacagguaaaggcccuccugaccaaagucaaugauuuaaggaaggagucuggcuggucggguuacccccauacucaggaaaacgugagcaaacugaucaagaauguucaggagaugucccaagcugagaagcuacucaaaaaccugauugggauacuucaguga

SEQ ID NO: 56683 - RNA, 1569 nt, Artificial Sequence
  derived and/or modified sequence opt3 from GIN1__Homo_sapiens__NP_060146
auggugagaagcggcaagaacggggaccugcaccucaaacagaucgccuacuauaagaggaccggagaguaccauuccacaacucuucccucugaacggucagguauucgccgagcugccaaaaaguucgucuuuaaagagaagaagcuguucuauguuggcaaagaucguaagcaaaauagauuggugauaguaagugaagaggagaaaaagaaaguguuaagggaaugccacgagaacgacagcggggcacaucacggaaucucccggacgcugacccuagucgaaucuaauuacuauuggacaucggugacuaacgauguuaagcaguggguguacgcgugucagcauugccaggucgcuaagaauaccgugauuguagccccuaaacaacaccuccugaagguugagaacccauggucacuugugacagucgaccugaugggcccguuucacaccagcaaucgcagucauguguaugcaaucauuaugacugauuuguucacaaaauggaucgugauacucccccugugugacgucuccgccucugaaguuagcaaggcuaucauuaacaucuuuuuccuguacgguccuccacagaaaauuaucauggaucagagagacgaguuuauacagcaaauuaauaucgagcucuacagguuauucgggauuaagcagaucgugaucucccacaccucaggaacgguaaaccccacugaaaguaccccuaauacaauuaaagcauuucugagcaagcauugcgccgaucacccaaacaauugggacgaucaccuuucugcuguguccuucgccuuuaacgucacucauuuggagcccaccaagaauacaccuuauuuccagauguuuucacggaacccauacaugccggaaaccagcgacagucugcacgagguggauggcgacaacacgucuauguucgcgaaaauacuagacgcaaucaaggaagccgauaaaauuauggagaauaagacuacaucccucggccagauggagaacaauaaccuggacgaacuuaauaaaagcaagaucauaguuaagaaaaagcccaaacaacugaacccuuuccauuugaagguggggcacgagguccuccgccagcgaaagaauugguggaaagauggaagauuucagucggaauggguggguccauguguaauugacuauaucaccgagucuggcugcgcuguucugagggauaacacuggggugcgguuaaagcgucccaucaaaaugucccaucugaagccuuacauucgcgaaucaagugagcaagagagccucuaucuucugcagggauccgucguggccgaccacgauuacaucggcuugccagaaauucccauaggugcauaucaggcuaauauccuagucgaggacgccacaauugggaucguggauaacgaacugcucaccucuagcaaagacagagagcugcuugaauacaggaauacgaagaucucaccgcugauugaugaccacaguuccuuggagaaacagaccuucagccuccuggacucuucaaaccaaguuuuagaguaccugaguuga

SEQ ID NO: 56684 - RNA, 591 nt, Artificial Sequence
  derived and/or modified sequence opt3 from GINS1__Homo_sapiens__NP_066545
auguucugcgagaaggccauggaacugaucagagagcuccacagggcucccgaaggccagcuuccugcauuuaaugaggacgggcugcggcaaguguuggaagagaugaaagccuuauacgagcagaaucagagcgaugucaacgaagcgaaguccggaggucgcucugaccugauuccaaccauaaaauuccgacauuguucacuacuccguaauagaaggugcacaguugcuuaucuguacgaucggcuucugcgcaucagagccuugaggugggaguauggcagugugcucccgaacgcacugcgguuucacauggccgcugaagagauggagugguucaauaacuacaagcgcagccuggcaacuuauaugcgaucccucgggggagacgaaggcuuagauauuacgcaggacaugaaacccccuaagucucuguacaucgagguaagaugucuuaaggauuauggugaauuugagguggacgaugggaccucggucuugcugaaaaagaacucacaacauuuccuaccaagguggaaaugcgaacagcucauucggcagggagugcuggagcacauccuuagcuga

SEQ ID NO: 56685 - RNA, 558 nt, Artificial Sequence
  derived and/or modified sequence opt3 from GINS2__Homo_sapiens__NP_057179
auggacgccgcugagguggaguuccuggcagaaaaggaacucgucaccaucauucccaacuuuagccuugauaaaauauaccugaucggcggggacuugggaccuuucaauccagguuuaccgguugaggugccccuguggcuagccauuaaccucaagcagagacaaaaaugcaggcugcuuccuccagaauggauggauguagagaagcuggagaaaaugcgggaccacgaacgcaaggaggaaacauuuacucccaugccuuccccauauuacauggaguugacgaagcuccugcugaaucaugcgucugauaacauccccaaagcugacgagauucgaacccucgugaaggauaugugggacacacguaucgccaaauuaagagucucagcagauaguuucgugaggcagcaggaagcccacgcuaagcuggacaaucuuacuuugauggagauaaacaccagcggcacauuucugacccaggcacuaaaucauauguauaaacuccggacuaaccugcaaccucuugaauccacacagucucaggauuucuga

SEQ ID NO: 56686 - RNA, 1002 nt, Artificial Sequence
  derived and/or modified sequence opt3 from GIPC1__Homo_sapiens__NP_005707
augccccugggccucgggagaaggaagaaagccccuccacuuguggagaacgaagaggcugaaccgggacgggguggccugggggucggagagcccggcccuuugggugggggaggcagcggcgggccacagaugggauuacccccuccacccccugcacugcgcccacgucuaguuuuccacacccaacucgcccaugguuccccgacaggccgaaucgaaggguuuacuaaugugaaggagcuguacggaaaaauugcggaggcuuucagacuucccacggccgaaguaauguuuugcacccugaacacacacaagguggacauggauaaauugcucggcggucagauagggcuggaggacuucaucuuugcacaugucaagggacagaggaaggaaguggagguuuucaaaucugaggaugcccugggccucacuauuaccgacaauggcgcuggguaugcauuuaucaagcggauuaaagaaggaucagugaucgaucacauacauuuaaucagugucggugacaugauugaggccaucaacggccagagccugcuugggugucgccacuacgaaguggcuagauugcugaaggagcuaccuaggggacggacauucacccucaaacugacugaaccacgcaaggccuuugauaugauuucccaacgaucugcgggcgguagacccgggucgggcccucagcuuggaacaggcagggggacccugcgguugcguucacgcggaccagcaacgguagaggaccuccccagcgccuucgaggaaaaggcuaucgagaaaguugaugaccuguuagaaaguuauauggguauaagagauacugagcuggccgcaaccaugguggaacucggcaaggacaaaaggaauccggaugagcuugcugaggcccuggacgaacgguugggggacuuugcguucccugaugaguuugucuucgacguguggggagccauuggcgaugcaaaggugggucgauacuga

SEQ ID NO: 56687 - RNA, 939 nt, Artificial Sequence
  derived and/or modified sequence opt3 from GIPC3__Homo_sapiens__NP_573568
auggagggcgccgcugcaagagaagccagggggaccgagacaccccgggcgagcgcuccuccaccggcccccuccgaaccuccagcagcuccccgcgcccgaccucgucugguguucagaacucagcucgcacacggaucuccaacggguaagaucgagggcuuuaccaacgucagggaacuuuacgccaaaauugcugaggccuucgggauagcgcccacagagauccuguuuugcacuuugaauagucauaagguugacaugcaaaaauuacugggaggccagauuggucuagaagauuucaucuuugcacacgugcgcggggagaccaaggaaguagaggugacaaaaaccgaggacgcccucggacugacuauuacagauaacggcgcuggcuaugccuucaucaagcggauaaaggaagggaguaucauuaauagaaucgaggcagucugugugggagacagcauugaagcuaucaacgaucauuccauaguugguugcaggcacuacgagguggccaaaaugcuucgggaacugccuaagucucagccauuuaccuugcgccucguccagccgaaacgagcguucgacaugauuggccaaagaucgaggucaagcaagugucccguggaggccaaaguaacgagugggcgggagacucugcgucugcgcuccggaggcgcagcuaccguugaagaggccccuucugaauuugaggaagaggcuagcagaaagguggaugaccucuuagaguccuauauggguaucagggauccagaacuggccucaacaauggucgagacuucaaagaaaaccgcaagcgcccaggaguucgcucggugccuugacucuguguugggggaauuugcguuccccgaugaauuuguggucgagguuugggcagccauuggagaggcucgagaagccuguggcuga

SEQ ID NO: 56688 - RNA, 462 nt, Artificial Sequence
  derived and/or modified sequence opt3 from GIP__Homo_sapiens__NP_004114
augguggccaccaagacauucgcucugcuccuucugagcuuguuuuuagcagucggccugggggagaaaaaggaaggacacuucuccgcccuacccucucucccuguugguucacaugcgaaagugaguagcccacagccgagaggccccagguacgcugaggggacuuuuaucuccgacuauucuauugccauggauaagauacaccaacaggacuucguaaacuggcugcuugcacagaaaggaaagaagaaugauuggaaacauaacaucacgcagcgggaagcccgcgcucuggaguuggcaucgcaagccaaucgaaaggaagaggaggcuguggaaccucagucaagcccagccaaaaaccccagugacgaggaucuccugcgugaccugcucauucaggaauuacuggcgugccuuuuggaucagaccaaucuguguagacuaaggucccgguga

SEQ ID NO: 56689 - RNA, 1401 nt, Artificial Sequence
  derived and/or modified sequence opt3 from GIPR__Homo_sapiens__NP_000155
augaccacaagccccauccugcagcuccuucugagauuguccuuaugcggccugcuacuccaaagggccgagacugggucuaagggacagacggcuggugaacuguaccagcggugggagcgcuaucgacgugaaugucaggagacccuugcagccgcggaaccuccaucaggccuggcuugcaacgggaguuucgacauguacguguguugggauuaugccgcaccgaaugccacagcuagagcaagcugccccugguacuugccuuggcaccaucacgucgccgcuggauuuguucucaggcaauguggcuccgacggucagugggggcuguggcgggaucauacucagugcgagaacccagagaaaaaugaagccuuccuggaccagcgccucauuuuagagagacugcaagugauguauaccguaggauacucucuuucguuggcgacacugcuacucgcacugcuuauacugucauuguuuaggcggcuccacuguacccgcaacuauauccauauuaaucuguucacuagcuuuauguuacgagccgcugccauccugaguagagauaggcuccuuccccggccuggcccauaccugggcgaccaggcauuggcucuauggaaccaggcccuggcggccugccguacagcacagauugugacccaauacugugucggggcuaauuauacguggcuccugguggaaggaguuuaccuucacucccuguuggugcucgucgguggcucugaggaggggcacuuccgcuauuaccuguuacugggauggggcgcccccgcucuauuugugaucccuuggguaauaguuagauaucucuacgaaaacacucagugcugggagaggaaugaagugaaggccaucugguggauuauccggaccccaauucugaugacaauccuuauaaacuucuugauuuuuauccgcauucuggguauccuccugagcaaacuucgaacuagacagaugaggugucgggauuaucgccugagauuggcaagguccacccucacacuggucccguuacugggggugcaugagguggucuucgcccccguuaccgaagaacaagcucguggagcgcuacgguuugcaaagcucggcuucgagaucuuucugucaaguuuccagggcuuccuugugagcguauuguacugcuuuauuaauaaagaagugcagucugagauacgaagaggguggcaccauugcaggcugcgccggucccucggagaggagcagagacaacugccugaaagggccuuccgcgcuuuaccaucagguagcggccccggggaggucccuacgagucgaggacugucuuccggcacucuuccaggucccgggaacgaggccagccgggaauuggagucguacuguuga

SEQ ID NO: 56690 - RNA, 2313 nt, Artificial Sequence
  derived and/or modified sequence opt3 from GIT1__Homo_sapiens__NP_001078923
augagcagaaagggccccagggccgaggugugcgcugacuguuccgcaccugauccagggugggccucuaucucacggggaguccugguuugcgacgaauguugcagugugcaccgcagccucggucgacauauuuccauaguaaaacaccuucgucauucugcguggccgcccacccuguugcagauggugcacacauuagcuucgaacggcgccaauucaaucugggagcauagccugcuagauccugcacaaguccagagugggagaaggaaggccaacccacaggacaaagugcaccccauuaaguccgaguucauccgggcuaaauaccagaugcucgcauuuguucacaagcugccuugucgcgaugacgauggagugacugccaaggaccuuucuaaacaacugcauagcuccgucagaacgggcaauuuggaaaccugccucaggcugcugucacucggugcucaggccaacuucuuucacccagaaaaggggacaacucccuuacauguggcggcaaaagccggacagacccugcaggcugagcuuuugguaguuuauggcgccgauccuggcaguccagacgugaaugggcggacaccgauugauuacgcacgccaagcuggacaccacgagcuggccgaacgacucgucgagugucaguaugaacuaaccgacagacuggcguucuaccuuugcgguaggaagcccgaucauaaaaacggccacuauaucauaccucagauggccgaccggagccgucagaaguguaugucucaaucccuggacuugucagagcucgcaaaggcugccaaaaagaaacugcaggcuuuaagcaaucgccuguuugaggaacucgccauggauguguacgacgagguggauagaagggaaaacgacgcagucuggcuugccacucagaaucauaguacacugguuaccgagcggucugcugugccauucuugcccguaaacccugaauauuccgcgacgcgaaaucaagggcgccagaagcuagcaagauuuaacgccagggaguucgcuacucugaucauugauauccucagcgaggccaaacggcgccagcagggaaagucgcugucuuccccaaccgacaaucuugaacugucauugagaagucaaagcgaucucgacgaucagcacgacuacgauuccguggcaucugacgaggacacagaucaggaaccccugaggagcacuggcgccacccguucaaaccgggcucgaaguauggacuccagcgauuuaucugacggugccgucacacugcaggaguaccuagaacucaaaaaggcacuggcgaccucagaggcuaaggugcaacagcuuaugaaaguuaauaguagcuuguccgaugagcugagaaggcuccagcgcgaaauucauaagcugcaggccgagaaccuucaacugcggcagccgccugggcccgugccaacgccucccuugccaucugaaagagcagagcacacucccauggccccuggaggcucgacacacaggcgcgaccgacaggcuuuuagcauguaugaaccaggcuccgcccucaaaccguucgggggacccccuggugaugagcugaccacucgguuacagccauuucauucaacagagcuggaagacgaugcaaucuacaguguccacgugcccgcuggccuauaucguauaagaaaggggguaucugccagcgcgguuccuuucaccccauccucaccccuccugagcugcucucaagagggauccaggcauacgaguaaacuuagccgccacggcucuggugccgacuccgauuacgaaaacacccagucaggggacccguugcugggccucgagggaaagcgguuucuggaguuaggcaaggaagaggauuuccacccugaacuggagagucuugacggggacuuggauccaggacuccccagcacagaagacgugauucugaaaacugagcaggucaccaagaauauccaagagcuacugagagcugcacaggaguucaaacaugauucguuugugccuuguuccgaaaagauucaccucgccgucacagaaauggcuucucuguuccccaaaaggccagcccuugagccugugcgaagcucauugcgccuguuaaacgcaagugcguaucggcuccaguccgaaugcagaaagacuguucccccagagccgggugccccuguggacuuucagcugcuuacccaacagguaauccagugcgcuuacgauaucgccaaggcagcuaaacagcuggucacaauuaccacuagggagaagaaacaauga

SEQ ID NO: 56691 - RNA, 2046 nt, Artificial Sequence
  derived and/or modified sequence opt3 from GIT2__Homo_sapiens__NP_001128685
augagcaagagacugagguccucugaggugugcgccgacuguucaggccccgauccuaguugggcuagcgucaaccgggggaccuuccucugcgacgaauguugcuccguucaccgcucucuuggacgacauaucucacaggugcgucaccugaaacauacaccauggccgcccacuuuguuacaaaugguagagacgcuguacaauaacggugcaaauucgauuugggaacacagccuacucgauccugccaguauaauguccggcagaaggaaggcgaacccacaggacaaagugcaucccaauaaggcugaguuuauccgggccaaauaucagaugcuggcauucguccaccgccuuccuuguagagaugacgauucugugaccgccaaggaccugagcaagcaguugcacuccucaguuaggacagggaaccucgaaacuugccugcggcugcucaguuuaggagcucaagcaaacuuuuuccauccagagaaaggcaauacaccccugcacguggccagcaaggcuggucagauucuucaggccgaguugcuggcggucuacggggcagauccuggaacccaggacucuuccggcaaaaccccaguggauuaugcccgccaaggcgggcaucacgaacuagcugagcgacucguagaaauccaguacgagcugacugacagacuugccuuuuaucuguguggaaggaagccggaucacaaaaauggucagcauuucauuaucccccagauggcagaccggcguuugucacucgaccugagcgaguuagcuaaggccgcgaagaaaaagcugcaaagucucucuaaccaccuuuuugaagaacuggccauggauguuuacgacgaaguggaucgcagagagacagacgcagucugguuggcuacccagaaucauuccgcccuagugacggaaacuaccguggucccuuuccugccaguuaaccccgaguauagcucgacaaggaaucagggccggcaaaaacucgcucgauuuaacgcccacgaguucgcaacucuggugauagauauccuuucugacgccaagcgcagacagcagggguccucacugaguggaagcaaagauaauguagaauugauucucaagaccaucaacaaccagcauuccguggagucucaagacaaugaucagccugacuacgauagcgucgcuucagacgaagacacagaucuggagaccacggcgaguaaaacuaacaggcagaaguuacagacacugcaauccgaaaauagcaaccuacggaagcaggcaaccacuaauguguaccagguucagacaggcucugaguauaccgacacgucaaaccacaguagccucaaacgcagaccauccgccagggguucucgucccaugucgauguacgagaccgggagcggacaaaagccguaucugccuaugggcgaggcuucccggcccgaggaaucacgaaugagacuucagccauuuccugcccacgcaaguagguuggagaaacaaaauucuacacccgaaagcgauuacgacaacacuccaaaugauauggagcccgacggcaugggguccucacgcaagggacggcagagaagcaugguguggccuggugauggccuggucccagacaccgccgagccgcauguggcucccucuccuacacucccauccacugaagauguaauuaggaaaaccgagcagaucacaaagaacauacaggaacugcuucgcgccgcacaggagaauaagcacgacaguuauauucccugcagcgagcgaauccauguugcggugaccgaaauggcugcccuguucccuaaaaagccaaaaucugauaugguccggacuuccuugcgucuccugacgucaagugcauacagauuacaaagcgaguguaagaaaacacugcccggggacccgggaucgccuaccgaugugcagcuagucacucaacaggugauucagugcgccuaugacaucgcuaaggccgcaaagcagcucguuaccaucacaaccaaagaaaacaauaacuga

SEQ ID NO: 56692 - RNA, 1149 nt, Artificial Sequence
  derived and/or modified sequence opt3 from GJA1__Homo_sapiens__NP_000156
augggcgacuggagcgcccuggggaagcuccuugauaaagugcaggcuuacuccaccgcaggagguaaggucuggcugucuguuuuguucaucuuuagaauuuuacugcuaggcacagccguggagucagcguggggagacgaacaaagugcuuucaggugcaacacucagcagcccgggugugagaauguaugcuaugauaaaucauuuccuauaucccacgugcgguucuggguccuccagaucauuuuugugucuguuccaacgcugcuuuaccuggcccauguguucuaugucaugcgcaaggaagagaaauugaacaagaaggaagaggagcucaaaguggcacaaaccgacggcguaaauguugauaugcaccugaagcagaucgaaauuaaaaaguuuaaauacgguaucgaggaacaugggaaggugaagaugcgaggaggccugcuccguacauauauaaucucgauuuuauucaaaucaaucuuugaggucgccuuccugcuuauucagugguacaucuauggcuuuagcuugagugcuguguacacuuguaagagagacccgugcccccaccagguggauuguuuccuguccaggccuaccgagaaaacaauauuuauuaucuucaugcuagucguuucucucgugagccuggcacuuaacauuaucgaacuguucuacguauuuuucaagggggugaaagaccgggucaagggaaaauccgauccauaucaugccaccucaggugcuuugagucccgccaaggacugcggcagccaaaaguacgcguauuuuaauggguguucuuccccuacugcaccacucucacccaugagcccuccaggauacaaacuggugacaggcgaucgcaacaauaguucuugcagaaacuauaauaagcaggccuccgagcagaacugggcuaauuacagcgccgaacagaacaggaugggucaagcagggucgaccaucucuaauucccacgcucagccguucgacuuucccgaugacaaccagaauagcaaaaaguuagccgcgggacacgagcugcaaccucucgccauuguugaccagcggccaaguagccgcgcauccucucgagcuagcucaagacccaggccugaugaccuugaaauauga

SEQ ID NO: 56693 - RNA, 1308 nt, Artificial Sequence
  derived and/or modified sequence opt3 from GJA3__Homo_sapiens__NP_068773
augggcgacuggagcuuccuggggagacuccuugagaacgcccaggaacacuccaccgugaucggaaaggucuggcugacaguuuuguuuauuuucaggauauuagugcugggugcugcagccgaggauguauggggcgacgaacaaucugauuuuacuugcaauacgcagcagcccgggugugagaacgugugcuacgaccgggcguucccuaucucacauauucgcuuuugggcucuacagaucauuuucgucaguaccccaacacucaucuaucugggacacgugcuucauauaguucgaauggaagagaaaaagaaagagcgugaagaggaagaacaacugaagagagagagcccgucccccaaagaaccuccacaggauaaucccucuucgagggacgaucggggccgcgugagaauggccggugcauugcucaggacuuacgucuuuaacaucauuuucaagacccuguuugaggugggguucaucgccggacaguauuuucuguacggcuucgaacucaagccuuuauaucggugugaccgcuggccaugccccaauacaguagauuguuuuauuucacgaccuaccgagaaaacuaucuucauaauuuucaugcuggcuguugcaugcgccagccuuuugcugaacaugcuagaaaucuaccaccucggcuggaagaaacugaagcagggggugacaaguagacuuggaccagacgcuuccgaggccccgcuggguaccgcggaucccccuccauugcccccuucuagcaggccacccgcagucgccauuggcuuuccgccuuauuacgcucauacggccgcaccccucgggcaagcucgggccgugggauacccaggcgcgccucccccagccgcagacuucaaacuguuagcucugacugaggcccgugguaaggggcaguccgcuaagcucuauaauggacaccaccaucuucugaugaccgaacagaacugggccaaucaggcagccgagcgccaacccccugcuuugaaagcguacccagcagccucaacaccggcugcccccaguccugugggcucuagcuccccaccccuagcacacgaagccgaggcuggcgccgcaccucugcuccuggaugggucaggaagcagucuugaagguucugcgcuggcuggcacuccagaggaggaggagcaggccgucaccacagcagcccagaugcaucaacccccguugccucucggggacccaggcagagcuuccaaggccagcagggcaucgucuggacgggcucgacccgaagaccuggccaucuga

SEQ ID NO: 56694 - RNA, 1284 nt, Artificial Sequence
  derived and/or modified sequence opt3 from GJA8__Homo_sapiens__XP_011507719
augggcgacuggagcuuccuggggaacauccucgaggaagugaaugagcacuccaccgucauuggaagaguuuggcuuacagugcuguuuauauucaggaucuugauuuuagguacugccgcugaauuuguauggggcgaugagcagucugacuucgugugcaacacgcaacagcccgggugugaaaaugucugcuacgaugaggcauuuccuaucucacauauucggcugugggugcuacagaucauauucguuaguaccccaagccucauguaugugggacacgccguccauuacgugcgcauggaggaaaagcgaaaaucccgugaggcggaagaguugggccagcaagcugguacaaacgggggaccggaccagggcucuguaaagaaaucgucaggcagcaaggggacuaaaaaguuuagacuugagggaacccuguugaggacauauaucugucacauuaucuucaagacccucuuugaaguugguuucauugugggccauuacuuucuguauggguuccggauccugccccucuaccgcugcaguagauggccuuguccaaaugucguggauugcuuuguguccaggcccacugagaaaacaauauucauuuuauucaugcugucugucgccagcguuucccuuuuucugaacgugauggaacugggacaccuaggccucaaggguauccggucagcacugaaacgcccuguagagcagccacuuggggaaauucccgagaagagucugcacagcaucgccgugucuuccauccagaaagcuaagggauaucaauugcucgaggaagagaagauugucucacauuacuucccucugaccgaagugggcaugguugagacgagcccauuaccggcaaaacccuuuaaucaguucgaagagaagauaaguacuggcccucugggggaccucucucgaggauaccaggagacccuuccauccuaugcccaggugggugcucaagaagucgagggcgaagggcccccugccgaggaaggagcggagccagaggugggcgagaaaaaggaggaagcagagagacugacaacugaggaacaggagaaaguagccguucccgaaggugagaagguggaaaccccgggggucgauaaagagggcgagaaggaagaaccucagagcgaaaaggugucgaaacaaggauugcccgcugagaagacaccaucucuauguccugaacugaccacggacgaugccaggccccucucccggcugucaaaagcaaguagccgugcucgcuga

SEQ ID NO: 56695 - RNA, 852 nt, Artificial Sequence
  derived and/or modified sequence opt3 from GJB1__Homo_sapiens__NP_000157
augaacuggaccggccuguacacacuccuuagcggggugaauagacacuccacugccaucggaagggucuggcugucuguuauuuucauauuucggaucaugguguugguaguggcugcagagucagucuggggugacgaaaagaguagcuucauuugcaacacguuacagcccggcuguaauuccgugugcuaugaucaauuuuucccuaucucucauguucgccuguggucgcuacagcucauucuggugucaaccccagcccuucuggucgcgaugcacguggcucaucagcagcacaucgagaaaaagauguugcgacucgaagggcauggagacccgcugcaccuggaggaaguaaaacgucacaagguucauauaagcggcacacucugguggacuuacgugaucagugucguguuuagauuacuguucgaggccguguuuauguaugucuucuaccuuuuguaucccgguuacgcaaugguuaggcuggugaaaugugauguauauccuugcccaaacaccguggacuguuuugucucccggcccacagagaagaccguguucacuguuuuuaugcuagccgcuucugggauuugcaucauucucaauguggcagaagucguguaccugaucauacgcgccugugcuagaagggcccaacggcgcagcaacccuccaucccgaaagggaucaggcuucggccacagacuuagucccgaguacaaacagaaugaaauuaacaagcuguugagcgagcaggaugggucucucaaagacauccugaggcgguccccuggaacaggugcgggcuuagcagagaagucagaucguugcagcgccuguuga

SEQ ID NO: 56696 - RNA, 681 nt, Artificial Sequence
  derived and/or modified sequence opt3 from GJB2__Homo_sapiens__NP_003995
auggacuggggcacccugcagacaauccucgggggagugaacaagcacagcacuuccauugguaaaauauggcuuacgguccuguucaucuuuagaauuaugaucuugguuguggccgcuaaggagguauggggcgaugaacaagcagacuucgugugcaauaccuuacagcccggguguaaaaacgucugcuacgaucauuauuuuccuauuucucacaucaggcugugggcccuacagcucauauucgugucaacaccagcgcugcuuguugcuaugcauguggccuaccggcgccacgagaagaaacgaaaguuuaucaagggagaaauuaaaagugaguucaaggacaucgaagagauuaaaacucagaagguccguaucgagggcagccugugguggaccuauacauccucuauauuuuucagagugauuuuugaagcagccuucauguacguauuuuauguuauguacgaugguuucucgaugcaaagguuggugaaauguaaugcuuggccgugccccaacaccgucgacuguuuugugucacggccuacugagaagacaguguucaccgucuucaugaucgcaguuagcgggauuugcauccuccugaaugugacggaacuguguuaucucuuaauccgcuacugcaguggaaaguccaaaaagccaguauga

SEQ ID NO: 56697 - RNA, 786 nt, Artificial Sequence
  derived and/or modified sequence opt3 from GJB6__Homo_sapiens__NP_001103691
auggacuggggcacccugcacacauucaucgggggagugaacaagcauagcacuuccauugguaaagucuggauaacgguuaucuuuauuuucagagugaugauccucguaguggccgcucaggaggucuggggcgaugaacaagaggacuuugugugcaauacccuucagcccggguguaagaacguuugcuacgaucacuucuuuccugugucucauauuaggcugugggcauugcaguuaaucuucgucucaacaccagcccugcuaguggcgaugcacguagcuuauuaccggcaugaaacuacccgcaaauuucgacguggagagaagagaaaugacuucaaagauauagaagacaucaagaagcagaaaguuaggauugagggcagucucugguggacauauaccagcuccaucuuuuuccggauuaucuuugaggccgcauucauguacguguuuuauuuccuguacaacgguuaucaccuuccguggguccugaagugugggauagaucccugcccuaauuugguggacuguuucauuucucgcccaacugagaaaacaguguuuaccaucuucaugauuucggccucagucaucugcaugcuccugaacguugcugaacuguguuaccucuuacugaaggugugcuuuagaaggagcaaacgggcacaaacgcagaagaaucaccccaaccaugcccuuaaggaaaguaaacagaaugagaugaacgaguugaucuccgauucuggacagaaugcuauuacuggcuucccuagcuga

SEQ ID NO: 56698 - RNA, 1191 nt, Artificial Sequence
  derived and/or modified sequence opt3 from GJC1__Homo_sapiens__NP_001073852
augagcugguccuuccugaccagacuccuugaggaaauccacaaccauucuacauuugugggcaagauuuggcugacugucuugauaguuuucaggaucguguuaacggccguagggggagagucaauuuacuaugacgaacagaguaaauuugugugcaauaccgagcaacccgguugugaaaacgucugcuacgaugcuuucgcaccucugagccacgugcgguuuuggguuuuccagaucauucuaguggccacaccauccgucauguaucucggcuacgcgauccauaagauagcuaaaauggagcacggggaggccgacaagaaagcagcccgcucuaagccguaugcuaugcgauggaagcagcaucgugcacuggaagagacugaagaggauaaugaggaagaccccaugauguacccugagauggaacuugagucggauaaagaaaacaaggagcagucacaaccaaaacccaagcacgacggaagaaggcggauccgcgaggauggccugaugaaaauuuauguguugcagcuccuggccagaaccguauuugaaguugguuuccugaucgggcaguacuuucucuacggauuccaggugcacccuuuuuaugucuguagcagguuaccaugcccccauaagauugacuguuucaucagucggccuacagagaagaccauauuucugcuuauuauguacggcgugacuggcuugugccugcuacucaauaucugggaaaugcugcaccuuggguucggaacaauucgcgauucccugaacucuaaacgaagagaguuggaagacccaggugcuuauaauuacccguucaccuggaacacgcccagcgccccuccaggcuauaauaucgcggugaagcccgaucaaauccaguacacugagcucuccaacgcaaaaauugccuauaagcagaauaaagcuaacaccgcccaggagcaacaguacgggucacaugaagagaaucugccugcagacuuagaagcucugcagagggagauacggauggcccaagaacgucucgaucuugcgguccaggccuacagucaccagaacaauccacacggaccccgcgagaagaaagcaaagguuggcagcaaggcugguucuaacaaauccacagccucaagcaagaguggggacggaaaaacuucuguguggaucuga

SEQ ID NO: 56699 - RNA, 1320 nt, Artificial Sequence
  derived and/or modified sequence opt3 from GJC2__Homo_sapiens__NP_065168
augaccaacaugagcugguccuuccugacaagacuccuugaggaaauccacaaucauucuacuuuugugggcaaggucuggcugacgguuuuggugguauucaggauuguguuaaccgccgucgggggagaggcuauauacucagacgaacaggcaaaauuuacaugcaacacucggcaacccgguugugauaaugugugcuaugacgccuucgcgccucugagucacguucgcuuuuggguguuccagaucgucgugauuagcaccccauccguaauguaccuaggcuaugcuguucaucgacucgcccgugcaucugagcaggaaagaaggcgggcccugcgcagaaggccggggccccggcgcgcuccucgagcacaccuuccacccccucaugccggauggccagagcccgcugaucugggcgaggaggaaccuauguugggucucggggaagaggaggaagaggaagagacaggagccgcggaaggcgcaggcgaggaggccgaagaggcuggggccgaagaggcauguaccaaggcugugggagccgacgguaaagcggccggcacuccagggccgacaggacagcacgauggcagaaggcggauccaacgugaaggucugaugcgcgucuacguggcacagcugguggcuagagccgcuuuugaggucgccuuccucguugggcaguauuuacuguacggauuugaggugaggcccuucuuuccuugcucgcggcagccauguccccacguaguggacugcuucgucucacgaccuaccgaaaagacgguguuucuuuugguuauguauguggucagcugucugugccuacuccugaaccuuugugagauggcacaucugggcuugggcagugcccaagaugcugugcgcgggagaaggggaccacccgcguccgcaccggccccugcuccccggccaccucccugcgccuucccagcagccgcugccggucucgcaugucccccugacuacucucugguaguucgcgcggcugaaagagccagggcacacgaucagaauuuagccaaccuggcucuccaggcccuucgugacggcgcagcugccggggaucgggaccgagauagcuccccaugcgugggacugccggcggccucaagaggucccccuagggcuggcgcaccagccagucgcacugggagcgcuaccucugccggcacagucggagagcagggccggcccgggacucaugaaagaccuggagcaaaaccaagggcggguuccgagaagggcucagccagcagucgcgacgggaagaccacaguguggauuuga

SEQ ID NO: 56700 - RNA, 840 nt, Artificial Sequence
  derived and/or modified sequence opt3 from GJC3__Homo_sapiens__NP_853516
augugcggcagauuccugaggcggcuccuugccgaggaaagccgccgauccacccccguggggcgucuguuguuaccuguccugcuaggauuuagacucguucugcuugcugcaucugguccaggcguguacggggacgagcagucagaguucguaugucacacacaacagccgggaugcaaggccgcguguuuugaugcuuuccauccccugaguccuuugagguuuuggguguuccaggucauccucguggccguuccaagcgcacuguauaugggcuuuacucuguaccacgugauuuggcauugggaacucuccgguaaagggaaggaagaggagacguuaauacagggacgggaaggcaacaccgacguccccggcgccgggucucugcgccuuuugugggcuuauguggcacaacugggagccaggcuaguacucgagggugcugcccugggccuucaguaccaccuguauggguuccagaugccuucgucauuugcgugcagacgggaaccauguuugggaagcaucacaugcaaucucagucgccccuccgagaaaacuauuuuccugaagaccauguuuggcguuucugguuucuguuuacuguuuacauuccucgagcuugugcuguuggggcuaggacgaugguggagaaccuggaaacauaagagcuccucaaguaaguacuuccugacuagcgaaucuacaaggcggcacaaaaaggcaaccgauucccucccugucguggagacgaaagaacaguuucaagaggccgugccaggccguucacuggcucaggaaaagcagcgcccggucggccccagagacgccuga

SEQ ID NO: 56701 - RNA, 966 nt, Artificial Sequence
  derived and/or modified sequence opt3 from GJD2__Homo_sapiens__NP_065711
augggcgaguggaccauccuggaaagacuccuugaggccgcugugcagcaacacagcacaaugauugggaggauacuguugacugucguugugaucuuccggauuuuaaucguagcaauugugggagaaacggucuacgacgaugagcagaccauguuugugugcaacacacugcagcccgguuguaaucaggccugcuaugaccgcgcguucccuaucucccauauacgauacuggguuuuucaaaucauuaugguguguacuccaucucuaugcuucaucaccuauucaguccaccagagugcuaagcagcgugaaagaagguacagcacaguguuucucgcccuggaucgggacccgcccgaguccauuggcgggccuggaggcaccggugggggaggcucuggcgggggaaaacgcgaggauaagaaacuucagaacgcaaucguaaaugguguucugcaaaacacugaaaauacaucgaaggagaccgaaccagacuguuuggaggugaaagagcucacgccccauccuucaggccugagaacugccagcaagaguaagcugaggcggcaggaagggauaucccgcuucuauauuauccaggucguguuucgaaacgcucucgagauuggauucuuagugggccaguacuuucuguaugguuucucugucccagggcuuuacgaaugcaauagauaccccuguaucaaagagguugaaugcuaugugagcaggccuaccgagaagacaguauuuuugguguucauguuugcagucuccggaaucugugugguucugaaccuagccgagcucaaucaccugggcuggcggaaaauuaaacuugcugugcguggcgcccaagcgaagcgcaagucaauauacgaaaucagaaacaaggaucugccaagggucagugugccgaauuucgggcggacucagagcucugacuccgcauauguauga

SEQ ID NO: 56702 - RNA, 885 nt, Artificial Sequence
  derived and/or modified sequence opt3 from GJD3__Homo_sapiens__NP_689343
augggcgagugggccuuccuggggagccuccuugacgcugugcagcugcaaucccccuuggucggaagauuauggcugguugugaugcuaaucuuuaggauucucguacuggcaaccguggguggcgccgucuucgaagaugagcaggaagaguuugugugcaacacacuucagccugggugucggcagacuugcuacgaccgcgcguucccaguuucucacuaucgauuuuggcuguuccauauauugcuccugucagcuccgcccgugcuguuugucguguacaguaugcaccgugccggaaaggaagcaggcggugccgaggcugcagcccaaugugcuccugggcucccagaggcccagugcgcgcccugugcauuaagagccaggcgggcucgcagaugcuaucugcuuagcguagccuugaggcugcuagcagaacucacguuccugggaggccaggcccuucuguacggcuuucggguugcuccucauuucgcgugugccgggccacccugcccucacaccguggauuguuuugucucccgcccaacagagaaaacuguguucguguuguuuuauuucgcagucggacuccugucugcuuuacugucgguugccgaacucggucaucuucuguggaagggccgaccgagagcuggggagagggacaaucggugcaaccgugcccacgaggaagcacagaaauugcuacccccuccacccccuccacccccgccucccgcccugccaucacgcagaccuggacccgagccaugugcucccccugcguacgcacacccagccccggcuagccucagggaaugcggcaguggucgggggaaggccucccccgcaaccggacgacgcgaucuggccaucuga

SEQ ID NO: 56703 - RNA, 1575 nt, Artificial Sequence
  derived and/or modified sequence opt3 from GK__Homo_sapiens__NP_000158
auggccgcuagcaagaaagcagugcugggcccccucgucggggccguugaccagggaaccuccucuacaagauuccuuguguuuaacucaaagacugcggagcuguugagucaccaucaaguagaaaucaaacaggaguucccuagggaagguuggguggagcaggauccaaaggaaauuuuacacagcgucuacgagugcauagagaaaacgugugaaaagcugggccagcuaaauaucgacauuuccaacaucaaggcuauuggggugucuaaucaacgggagaccacaguugugugggauaaaaucacuggagaaccgcucuauaacgccgucguguggcuggaccuucgcacccagucgacaguagagucacugagcaagcgaauacccggcaauaacaauuuuguuaaaaguaagaccgguuugccucucuccacuuacuucucugcagugaaacugcguuggcugcucgauaacgucagaaaggugcagaaggccguggaggagaaaagggcuuuauuugggacaaucgacagcuggcugauuuggucccuuaccggaggcgucaauggcgggguucauugcacggaugugacuaacgcaucacggaccauguuguucaauauccacagucuggaaugggacaagcagcuaugugaauuuuucgguauuccaauggagauccuccccaacguacgcucuagcuccgaaauauauggacugaugaaagccggcgcucuugagggggugccuauuucaggaugccugggcgaucaaagcgccgcguuggucggucagauguguuuucagaucgggcaggcaaagaauacauacggaacuggcugcuuccuccuguguaacaccggccauaaaugcguguuuagugaccacggguuacugacaaccguugccuauaagcucggaagagauaaaccaguguacuaugcucuugaggguucugucgccauugcaggcgcugugaucagguggcugcgggacaauuuggggaucauuaagacguccgaagagauagaaaagcuagccaaagagguaggaacuagcuacggcuguuacuucguucccgcguuuucgggucuguaugccccuuacugggaaccaucugcacgcgggaucauuugcggccucacacaauucaccaacaagugucacaucgcuuucgccgcucuggaggccgugugcuuucagacucgagagauacuugaugcaaugaacagagacugcggcauuccgcugucccauuugcaggucgacggagggaugacaucaaauaaaauccucaugcaacugcaggccgauaucuuauauauucccguggucaagccuaguaugccagaaaccacggcucugggagcggcaauggccgcuggugccgcagagggcguggggguuuggagccuagaacccgaggaccucuccgccgugaccauggaaagguucgagccucagaucaacgcugaggaaucugagauucgguacagcacauggaaaaaggccguaaugaagucaaugggaugggucacuacccagaguccagaauccggcauacccuga

SEQ ID NO: 56704 - RNA, 600 nt, Artificial Sequence
  derived and/or modified sequence opt3 from GKN1__Homo_sapiens__NP_062563
augcuggccuacagcuccgugcacugcuucagagaggacaagaugaaauuuaccauagucuucgcuggccuccuugggguuuuucuggcacccgccuuggcgaacuauaauauuaacgugaaugaugacaacaauaacgcuggaucuggucagcaaucaguaagugugaauaacgaacauaaugucgccaacguggauaauaacaauggcugggacagcuggaacuccauaugggauuacgggaauggauucgcagccacaagguuauuucagaagaaaacuuguaucguucacaagaugaacaaagaggugaugccuucuauucagucgcuggacgcucuagucaaggaaaagaaacuccagggcaaggguccagggggaccgcccccuaaaggccugauguauucagugaacccaaauaagguagaugaccuuagcaaauucggcaagaacaucgcaaauaugugccgggggauucccacguacauggccgaggaaaugcaagaggcuagucuguuuuucuauuccggaaccuguuacacaacuucuguuuuguggaucguggauaucagcuuuugcggugacaccgucgagaacuga

SEQ ID NO: 56705 - RNA, 555 nt, Artificial Sequence
  derived and/or modified sequence opt3 from GKN2__Homo_sapiens__NP_872342
augaagauccugguggccuuccucgucguucuuaccauuuuuggcauacagagccacggguacgagguguucaacaucauuucccccucuaauaacggagguaauguacaagaaacagugacuaucgacaacgagaaaaauacggcuauuaucaacauacaugcaggcucaugcaguagcaccacaaucuuugauuauaagcacggguacauugccuccagaguccugucuaggcgggcguguuucaucuugaaaauggaccaucagaauauuccuccauuaaacaaucugcagugguauaucuacgaaaagcaggcucuagauaacauguuuucgucaaaauauacuugggugaaguacaauccgcucgagagccugauaaaggacguugauugguuccuucugggaagucccauugaaaaauugugcaagcacaucccucucuauaaaggcgagguggucgagaacacccauaaugugggugccgggggaugugcaaaggccggccugcugggcauucucgggaucuccaucugcgcugacauucacguauga

SEQ ID NO: 56706 - RNA, 1290 nt, Artificial Sequence
  derived and/or modified sequence opt3 from GLA__Homo_sapiens__NP_000160
augcagcugagaaaccccgagcuccaccuuggcugcgcccuggcuuugagguucuuagcacuggugagcugggacaucccuggggcccgggcgcuagauaauggacucgcucgcaccccaacaauggguuggcugcauugggaacgauuuauguguaaccuugacugccaagaggaaccggauuccuguauuucugagaagcuguucauggaaauggccgaguugauggucucagagggcuggaaagacgcaggguacgaauaucucugcauagaugacuguuggauggcuccccagcgugauagugagggaagacugcaggccgacccucagagguuuccacacggcauccggcaacuggcaaauuacguucauagcaagggucucaaauuagggauuuaugccgaugugggaaacaagacuugcgcuggcuuccccggcuccuuuggguacuaugacaucgaugcccagacguucgcggacuggggaguagaucugcuuaaauuugacgguuguuacugcgacucuuuggaaaaucuggcagauggcuauaagcacaugucgcuagcccucaaccgcaccgggagaucaauuguguacagcugugaguggccucuguacauguggccauuccagaagcccaauuauacagagaucaggcaguacugcaaccauuggcggaauuuugcugacauagaugacaguuggaaauccaucaagucuauucuugauuggacuagcuucaaccaagaacgcaucgucgacguggccggaccuggcgguuggaaugauccagacaugcugguuauugggaacuuuggauuguccuggaaucaacaggugacccagauggcacucugggcuaucauggccgcgccgcuguucaugucaaacgauuuacgacacauaaguccccaggccaaagcacugcuccaggacaaggaugucauugcuaucaaucaggacccucuuggcaaacaaggcuaucagcugagacagggggacaacuuugaggugugggaaaggccauugagcggacuagccugggcuguagccaugauuaaccggcaggagaucgguggcccccguucuuacacaaucgcaguugccucccuggggaagggaguggcuuguaauccugcgugcuucauuacccaacuccugccagucaagcgcaaacuuggcuucuaugaauggacuucaagacugaggagccacauaaaccccacagguaccguguugcuccagcuggagaauacgaugcagaugaguuuaaaggaucugcuauga

SEQ ID NO: 56707 - RNA, 2034 nt, Artificial Sequence
  derived and/or modified sequence opt3 from GLB1__Homo_sapiens__NP_000395
augcccggcuuccuggugagaauccucccucuucuguuggucuuacugcuacucgggccaaccaggggacugcggaacgccacacagcgcauguuugagauugacuacagccgagauuccuuccuuaaggacggucaaccguuucguuauauaucuggcucaauccacuacaguagaguucccagguucuauuggaaagaucggcuguugaagaugaaaauggcugggcucaaugcaauucagacuuacgugccuuggaacuuucaugaaccauggcccggacaguaucaguucagcgaggaccacgauguagaauacuuucugcgccuggcccaugagcucggcuuacuggugauccuuagaccugguccauauauuugcgcggaaugggagaugggaggauugcccgcuuggcugcuagagaaggaauccauccuccugaggucuucggacccugauuaccuugccgcagucgacaaauggcugggcguguugcucccaaagaugaagccgcuguuauaccaaaauggcgggcccguuauaacggugcaggucgagaacgaauauggaucauacuucgccugugauuuugacuaucugcgguuccuccagaaacgcuuucgacaccaucuuggugaugacgugguacuguucaccacagauggcgcucacaagacuuuucugaaaugcggggcacuacagggacuguacaccacaguugacuucggcaccgguagcaauaucacugacgccuuccucagucaaagaaagugugagccuaaagggccacugauuaacuccgaguuuuauacaggauggcuugaucacuggggccagccccauucuaccaucaagacggaagcuguggccagcucccuguacgacauuuuggcgaggggcgcaucagucaaucucuauauguucaucgggggaacuaacuuugccuacuggaauggugcuaacaguccuuacgccgcacagccaaccagcuaugauuacgacgcuccccugucugaggccggcgauuuaacagaaaaguauuucgcgcugcggaauauaauucagaaauuugagaaggugccggaagggccuauucccccauccacuccuaaauucgccuacggaaaggugacccuagagaaacucaagacagucggcgcagcucuggacauccuuugccccucagguccaaucaagagcuuguauccccugaccuuuauccaaguuaaacagcacuacggguucgugcucuaucguacgacucugccucaggauuguaguaacccagccccgcuuucuucccccuugaauggcguacaugaccgcgcuuacguggccgucgaugggauuccucaaggcguguuggagagaaacaauguuauaacacucaacaucaccgggaaggcaggagccacucuggacuuacugguggaaaacauggguagggucaauuacggcgcuuauauuaacgauuuuaaagggcuagugagcaaucucacacugucgucuaacauccuuaccgacuggacgauauucccauuggacaccgaggaugcgguacggucccaccugggaggcuggggucaccgagacucagggcaucacgaugaagcaugggcccauaauaguagcaacuacacacuccccgcuuuuuauaugggcaauuucuccauuccuucuggaaucccagaccugccccaggauacuuuuauccaguucccgggcuggaccaaggggcagguuuggauuaacggauucaauuuaggucgcuacuggccugccagaggcccacaacugacacuuuuugugccccagcacaucuugaugacuagcgcaccuaacaccauuacaguccucgagcuggaaugggcccccugcucaagugacgauccagagcuaugugcugugaccuucgucgacaggccugugauaggguccagcguuacuuaugaucaucccucuaaaccaguggagaagcggcugaugccgccucccccacagaaaaauaaggacucauggcucgaucacguauga

SEQ ID NO: 56708 - RNA, 1644 nt, Artificial Sequence
  derived and/or modified sequence opt3 from GLCCI1__Homo_sapiens__NP_612435
augagcaccgccuccucuucaaguagcuccucuucgucacagacaccccacccuccaagccaaagaaugaggcggagugcugcaggcuccccgcccgccguggcggcugccgggucuggaaacggugcaggcgggggaggcggugucgggugcgccccugcugcaggagccggccgccugcuccagccaauccgagcuacuguucccuaccagcuucugcguggcagccagcauuccccuacgagaccacccguggccgcggcagccgcuucauuggggaguuuaccuggaccaggugccgcaaggggcccgagccccucuuccccuaccccacccgcugccgcggccccugcagagcaagcuccacgggccaaggggcgccccagaaggucaccggaaagccaccggcgcaguucuuccccugagcgaagaagccccggaucgccaguauguagggcugacaaagccaagucucaacaggugcggacauccucaacuauucgucgcaccaguagccuggauacaauaaccggcccuuaucuaacuggucaguggcccagagacccacauguccacuaccccuccugcaugaaagauaaggcaacacagaccccuucuuguugggccgaagagggggcugagaaaaggagccaucagcggucagcgaguuggggauccgcagaccagcucaaggaacagaucgccaagcugcgacaacagcuucagcgcagcaaacaaucuucaagacacaguaaggagaaagauaggcagagcccacugcacggcaaucauauuacgaucucccacacucaggcuaccggcucucggucggugccgaugcccuugagcaacauuuccguuccuaagucaagugugucucgcgucccaugcaauguggaagggaucagccccgagcucgaaaaaguauucauaaaggagaacaauggaaaggaggaaguuuccaaaccucuggacaucccagaugguagaagggcaccccugccggcccauuaucguucaagcucuacacgguccauugacacucagaccccuagugugcaagagcgaucuagcuccuguucaagucacagcccaugcgucucgcccuuuuguccucccgaaucccaggauggcucuccaugcagcacagaggaccucuuauacgauagagacaaggauucagggaguuccucuccucugcccaaauaugccagcuccccaaagccgaacaauucauacauguucaaaagggaaccucccgagggaugugagcgcgugaagguguuugaagagauggcuagccggcagccaaucagugcaccccuuuucucuugcccugacaaaaacaaggucaauuuuauuccaaccggcuccgccuucugucccguuaaguugcuggguccucuacucccggcgagcgaccugaugcuuaaaaacucgccaaauucagggcagucuagugcucuggccacguugacuguggaacaacucuccagcagaguaucuuuuacaagccuguccgaugacaccucaacugcaggcaguauggaggccagcgugcagcagcccucucagcaacagcaguuacugcaggaacuccaaggagaggaucacaucuccgcucagaacuaugucauaauuuga

SEQ ID NO: 56709 - RNA, 1854 nt, Artificial Sequence
  derived and/or modified sequence opt3 from GLCE__Homo_sapiens__XP_005254355
augagaugccuggccgcuagggugaacuacaagacccucaucauuauaugugcacuuuucacacuggucacuguuuuguuauggaauaaaugcagcuccgacaaggccauccaguuuccccggcgaucuucaaguggcuuccgcguggauggguuugagaaacgugcggcugccagcgaauccaacaauuauaugaaccacguagcaaagcaacagucugaggaagccuucccucaggagcagcaaaaagcuccaccgguggucggagguuuuaauucgaacgugggcucaaagguucuggggcuaaaguacgaagagauugacugucucaucaaugaugagcauacgauuaaaggaagaagggaaggcaacgagguguuccugcccuuuaccugggucgaaaaguauuucgacguguacgguaaaguaguucaguaugauggguacgaccgguuugaguucagccacaguuauuccaagguguacgcacagcgcgccccuuaccauccagauggagucuuuaugucuuucgagggcuauaauguggaagugagagacagggucaaaugcaucagcggcguugagggggugccccuuuccacacaguggggaccucaagguuacuuuuauccaauacagaucgcucaguacggccugucacacuauaguaagaacuugacugaaaagcccccucauauugagguauacgaaaccgccgaggaucgggacaaaaauaagccaaacgauuggacagugccgaaaggguguuucauggcgaaugucgcagacaagagccgcuucaccaacgugaaacaguuuaucgcccccgagacuucugaaggaguuucccuccaacugggcaauacaaaggauuucauuaucucauuugaccugaaauuccucaccaacgguagcgugagugucguguuagagacgacugaaaagaaccagcuguuuaccauacacuauguaucuaaugcucagcuuauugccuucaaggagcgagacaucuacuacgggauuggaccuagaacauccuggagcacuguuaccagggauuuggugacagaccugcggaaaggcgucggccuaucgaacaccaaggcagugaaaccaacgaagaucaugcccaaaaaggucgugcgucucaucgcuaaggggaaaggauuucuggauaauauuacuauaucuacaaccgcccacauggcggccuucuuugcagcuuccgacuggcuuguucgcaaccaagaugaaaaggguggcuggccuaucauggugacuagaaaacugggggagggauucaagucauuggagccaggcugguauagugccauggcucagggucaggccauuagcacacucguaagggcauaccuguuaaccaaagaccauaucuuucucaauuccgcccugcgggcuacggcgcccuauaaguuccuuucugaacagcacggggucaaggcaguguuuaugaacaaacaugauugguacgaggaauauccgaccacaccuagcucauucguucugaauggcuucauguacaguuugauaggacuauaugaccugaaggagacugccggcgaaaaacucgggaaggaggcucgaucccuguacgagcgcggaauggaaagccuuaaagccaugcugcccuuguacgauaccgguucuggcacaauuuaugaccucagacacuuuaugcuggggaucgcaccaaacuuagccaggugggauuaccacacuacccauaucaaucaacugcagcuacucucaacaauugacgagaguccuguguucaaggaauuugucaagcgguggaaaagcuaucugaagggaucccgcgcuaaacacaacuga

SEQ ID NO: 56710 - RNA, 3063 nt, Artificial Sequence
  derived and/or modified sequence opt3 from GLDC__Homo_sapiens__NP_000161
augcagagcugcgccagagcuuggggccugaggcucgggcggggaguggguggcgggcgccgacuugcaggaggcuccggucccuguugggccccucguucuagagacucaaguagcgggggaggcgauuccgcggcugccggcgcaucuaggcuguuggagcgguuacugccacgccacgacgauuucgccagaaggcauaucgggccgggagacaaggaucaacgggaaaugcuacagacccucggucuggcuucgauugacgagcuuauagagaaaacaguccccgcaaacauccgccugaagcgaccuuugaaaauggaggauccaguuugcgaaaaugagauucucgccacucugcacgcuaucucaagcaagaaccagauuuggagaaguuacaucggcaugggguauuacaauuguuccgugccccagacgauacugaggaaccucuuagaaaauucuggauggaucacccaauauacaccuuaccagccagaaguaagccagggccggcuggagucccuuuugaacuaucagacuauggugugcgacauuaccggucuggauauggccaaugcgucacuacucgacgaagggacagcagccgcugaggcccugcaacuuuguuaccgucauaacaaacgcagaaaguuucuggucgaucccaggugccacccucagaccaucgcagugguucagacucgggcuaaguauacaggaguguugaccgagcucaaacugccaugugaaauggacuucaguggcaaggaugucagcggcguguuauuucaguacccggacacggaggggaaaguagaagacuucacugagcugguugaacgagcccaucaaucuggaucccucgcgugcugugccaccgaucuucuggcauugugcauucuaagacccccuggugaguuuggcguggacaucgcucuggggucaagccagcgcuucggagucccacucggcuacggugggccccacgccgccuuuuucgcugugagggagagucuggugcggaugaugccuggccgcauggucggaguuacaagagaugcaacuggcaaggaaguguauaggcuugcccugcagacccgugagcaacacauacggcgagacaaagcuacaucuaauauuuguaccgcgcaggcauugcucgccaacauggcugccauguuugcaaucuaccaugggucccacggacuggaacauauugccagaaggguacacaaugcuacguuaauccugagcgagggucuaaagcgcgccggccaccagcuccagcaugaucuguucuuugacacucuuaagauccaaugcgggugcucggugaaagaagucuugggacgggcagcgcagagacagauuaacuucaggcuguuugaggauggcacacucgguauaucucuggacgagaccgugaaugaaaaggaucuugacgaucuguuguggaucuucgggugugaguccucagcugaacucguugccgagaguaugggcgaagagugccgcggcauuccaggaagcguguucaaacgaacuucccccuuucugacacaccaggucuucaacucuuaucauagcgagaccaauaucgugcgguacaugaagaaauuagaaaacaaggacauaucacugguacacaguaugauuccgcuaggguccuguacgaugaaacucaacucuagcucagagcuggcaccuaucaccuggaaggaauuugccaauauccaucccuucguuccacuugaccaagcucagggauaucagcaguuguuucgugagcuggagaaggaucucugcgaacugacagguuacgaccaaguguguuuccagccuaacaguggcgcccagggggaguaugcaggauuagcuacuauuagagccuaccugaaucagaaaggcgaaggucacaggaccgucugccuuauccccaagagcgcgcacgggacaaacccagccuccgcucauauggcaggcaugaaaauucaacccguggaggucgauaaguacggaaauauagacgccgugcacuugaaagcuaugguugauaagcauaaggaaaaccucgccgcaaucaugauuacuuauccuucuaccaauggcguguuugaggagaacaucucggacguaugugaucugauccaccagcacgggggacaggucuaccuagacggcgcgaauaugaacgcccaaguggguauuugccgcccaggggauuucggaagcgacguuucccaucugaaucuccacaaaacauuuuguauaccgcauggcgguggcgggcccggaaugggcccuaucggggugaagaaacaccuggcuccauuccuucccaaccauccugucauuucauugaagcggaaugaagaugccugcccagugggaaccguaagugcagcucccuggggcucuagcuccauccugccgauuucaugggccuauaucaaaaugaugggugggaagggauuaaagcaggcaacugagacggccauacucaacgcuaauuacauggcgaaaagacuggaaacacacuauaggauccuuuuucgaggcgcccgcgguuacgugggccacgaguucauucuggacacccggccuuuuaagaaaagcgcaaacaucgaagcuguugaugucgccaagagauugcaggacuauggguuccaugccccaacuaugucuuggcccguggcuggaacccucaugguggagccuacagaguccgaagacaaagcagagcuggauagguucugugacgccaugauuaguauccgucaggaaauagcggauauugaggaaggccgcaucgacccccgggucaacccacuaaagaugagcccucacucucugaccugcguuacuuccucacauugggauagacccuacaguagggagguggcugccuuuccacucccguucgugaagccugagaauaaauuuuggcccacaauugcacgaaucgacgauauauacggggaccaacaccugguaugcacguguccacccauggaagucuaugagagcccuuucucggaacagaagcgggccuccucuuga

SEQ ID NO: 56711 - RNA, 1656 nt, Artificial Sequence
  derived and/or modified sequence opt3 from GLDN__Homo_sapiens__NP_861454
auggccagaggcgcugagggcggaaggggugacgcaggcugggggcugcggggagcccucgcggcuguggcccuucugagcgcauugaacgccgcuggcaccgucuucgcauuaugccaguggcgcggucuguccucugcccuacgagcucucgaagcccaacgugggagagagcagagggaagauucagcgcugcggaguuuucuugcagagcugagccgcgcccccagaggagcuuccgccccuccacaggacccggcaucuucggcuaggaauaagcggucacacagcggcgaacccgccccucauauccgcgcggagagucacgauauguugaugaugaugacauacuccaugguuccaauucgagugaugguagaccucuguaacucuacuaaaggcauaugccugacggggcccagcggaccuccaggucccccuggcgccgggggacugccaggccauaauggucucgaugggcagccgggaccccaaggcccuaagggcgagaaaggggcaaacggaaagagagguaaaaugggcaucccaggggcugccggaaaucccggcgaaaggggugagaagggggaccacggcgaauuaggacugcagggcaacgaggggccuccaggacagaagggugagaaaggcgauaagggggacguguccaaugauguccuuuuggcuggagccaaaggcgaccagggucccccggggccucccggcccaccuggacccccagggcccccugggccaccgggaucacggcgugcaaaggguccccgccaaccuaguauguucaacggccaguguccaggggaaaccugcgccauucccaaugaugacacacuggugggaaaagcugaugagaaggcgagcgaacaucacucuccucaggcagaguccaugaucacuucaauuggcaacccaguucaggugcuaaaggucaccgaaacauuugguaccuggaucagagagagcgccaauaaaagugacgacaggauaugggugacugagcacuucucugggaucaugguaaaggaauuuaaagaucaacccucccuccugaacggcagcuauacauucauucaucuuccguacuauuuucacggauguggccauguuguguacaauaacucgcuguauuaccacaaagggggaucuaauaccuugguccgguucgaguuuggccaggaaacgucccagacucucaagcuggagaacgcuuuauauuucgaccgaaaguaccuguuugccaacucaaaaaccuacuucaaucucgcaguggaugaaaagggucuuuggaucauuuaugccaguagcguggacggguccucuauccuggucgcucaauuggaugagcgcacauuuagcguugugcagcacguaaacacuaccuacccuaagucaaaagccggaaaugcauucauagcgagaggcauucuauaugugacagacaccaaggauaugagggucacguucgcuuuugaccugcucgguggcaaacagaucaacgccaauuucgaucugcggacaagucaguccgugcuugcaaugcuggccuacaacaugcgcgaccaacauuuguauagcugggaggaugggcaccucaugcuguacccaguucaguuuuuaucuacuacccugaaucaguga

SEQ ID NO: 56712 - RNA, 2097 nt, Artificial Sequence
  derived and/or modified sequence opt3 from GLE1__Homo_sapiens__NP_001003722
augcccagcgagggcagaugcugggaaacccugaaggcccucagguccucugacaaagggcggcuuuguuacuaucgcgauuggcuguugcgacgugaggacguguuagaagagugcaugucacugccuaagcuaaguagcuacuccggaugggucguugaacacgugcucccacauaugcaggagaaccaaccgcugucugagacaucgcccucaagcacgagugcuuccgcacuugaucagccuucuuucguaccaaaaagccccgacgccuccucagcguuuaguccugcuagcccagccacucccaaugguaccaagggcaaagaugaaucucagcacacagaguccauggugcugcagucaagcagagggaucaaggucgaaggaugugugaggauguaugaguugguucaucggaugaagggcacugagggucuccgccuguggcaagaggaacaggaaagaaaagugcaggcacugagugagauggccucugaacagcucaagagguucgacgaguggaaagaguuaaagcaacacaaagaauuucaggaucugcgggaggucauggaaaaguccagccgcgaggcucuugggcaucaggaaaaguugaaagcagagcaccgacacagagccaagauucugaaccuaaaacucagggaggcugaacagcaacgggugaagcaggccgagcaggaacgucugcgcaaagaggaaggacaaauaagacuuagggcgcuguacgcauugcaggaggagaugcuccagcugucgcagcaauuagacgccucugaacagcauaaggcucugcucaaaguagaucuugccgcauuccagacccggggcaaucagcugugcuccuugaucucaggcauuauccgagcuaguagcgaguccucuuauccuacagccgaaagccaagcggaggccgagcgcgcacuaagagaaaugagggaccugcucaugaaccuggggcaggagauuacccgggcuugugaagauaagcgcagacaggacgaggaagaggcccagguuaagcugcaagaggcucagaugcagcagggaccagaagcccacaaagagccgcccgcaccuucacaagguccaggcgggaagcagaaugaagaucuucaggugaaaguccaagacaucacuaugcagugguaccagcaguugcaagacgccaguaugcagugcgugcucacauuugagggacugaccaacuccaaggauagccaggcuaaaaagauaaagauggacuuacagaaagcggcaacgauccccgugucucaaauuucaacuaucgccggcaguaagcugaaagaaauuuucgauaagauccauagccuacucuccgguaaaccuguccagucugggggaaggucgguuagcgugacccugaauccacagggccuugacuuuguacaguauaaguuggcugagaaguucgugaaacaaggcgaggaagaggucgccucccaccacgaagcagccuuucccauagcugugguugccucagggauuugggagcugcauccgcgugugggagaucucauccuggcacaccuucauaagaaauguccuuacaguguccccuucuacccaacauuuaaggaagguauggcgcuggaggacuaucagcggauguugggcuaccaggugaaagauucuaagguagagcaacaggacaacuuccucaagcgaaugagcgggaugauuagacuguaugcugccaucauccaguuaagguggccuuacggaaaucgccaggaaauucacccccauggccugaaccacgguuggcgguggcuagcacaaauacucaauauggagccacuguccgauguuacugccacccuuuuguuugacuuccuggaagugugcgggaacgcucucaugaaacaguaucagguccaguucuggaagaugcugaucuuaauuaaagaggauuacuuucccagaaucgaggccauaacaucaagcggccaaaugggaucuuucauuaggcugaagcaguuucuugaaaaauguuugcagcacaaggacaucccugugccaaaaggcuuccucaccuccaguuuuuggcgcagcuga

SEQ ID NO: 56713 - RNA, 3579 nt, Artificial Sequence
  derived and/or modified sequence opt3 from GLG1__Homo_sapiens__NP_001139138
auggccgcuugcggcagagugaggcggauguuccgccugagcgcagcccuccaccuucuguuguuauuugcggcuggggccgagaagcugcccggacaggguguccauucccaaggccaggggccuggagcaaacuucguuucuuuugugggccaggccggugggggaggcccagcuggccagcaacuaccgcagcucccccagucaagucagcugcaacagcagcagcaacagcagcaacagcagcagcaaccucagccaccccagccuccauuccccgcagggggaccuccagcccgacgugguggcgcuggggccggaggcgguuggaaacuugcggaagaggaaagcuguagagaggacguaaccagggugugcccgaagcacacaugguccaauaaccuggcagucuuggaaugucuccaggaugugcgggagcugcuguggaauuacaaacucaacuuaacuacggaccccaaguuugagucuguugcccgcgaagugugcaaaucgaccaucacagagauuaaggaaugugcugaugagccugucgggaagggauauauggugucaugccugguagaccauagaggcaauauaacugaguaccaaugucaccaguauaucaccaaaaugacagccauuaucuucagcgauuacaggcuuauuugcggcuuuauggacgauuguaagaacgacaucaauauauugaaaugcgggaguauccggcugggagaaaaggaugcacauucccagggugagguugugucuugucuagaaaaaggccucgucaaggaggcugaagaacgcgagccaaagauucaggugagcgaacugugcaaaaaggccauccuucgaguggcggagcuguccucagacgauuuccacuuggacagacaccucuauuuugccugcagggaugaccgggaacguuucugugagaacacccaagcaggggaaggacgcgucuacaaaugccuguuuaaucauaaguucgaggagaguaugagcgaaaaauguagagaggcuuuaacuacaaggcagaagcugauugcccaggacuauaaaguuucuuacucccucgcuaagucaugcaagagcgaucuuaaaaaguaccgguguaacguggaaaaucugccccgaagucgcgaggccagauugucuuaucuacugaugugccucgaauccgcaguacacaggggccgccaggugagcucggagugucaaggugagaugcuggacuaccggagaaugcuuauggaagauuuuucucuguccccugagaucauauugucaugcaggggcgaaauugagcaucacuguagugggcuccaccguaaaggacggacccugcauugcuuaaugaaggucgugcgaggcgagaaagggaaccugggaaugaauugucagcaggcccuacaaacgcucauccaggaaacugacccaggugcugauuauagaauugacagggcgcugaacgaggcaugcgaaagcguuauccagaccgccugcaagcacauccgcuccggcgaucccaugauucuuucuuguuugauggagcaucuguacacagaaaagaugguggaggacugcgagcaccggcuccuggaacuucaguauuucauaagcagagauuggaaacuggacccggucuuguacaggaagugucaaggggaugcuucacgccucugccauacucacggauggaaugagaccagugaguucaugccucagggcgccguguuuuccugucuguaucgacacgcauaccggacagaggaacagggucguagauuaagcagggagugccgcgccgagguacagcggauccugcaucaaagagcuauggacguuaaacuagaccccgcccuccaggauaagugucugauugaccuugggaaauggugcucugaaaagaccgagacgggccaggaauuggagugucugcaggaucaccucgacgaucugguggucgaaugcagggacaucgugggaaacuuaacugagcuggagucagaagauauacaaauugaggcacuuuugaugcgagcgugugaaccaaucauccagaacuucugccaugacgucgcugauaaucagauugacaguggcgaucucauggagugccugauccaaaacaagcaccagaaagacaugaaugagaagugugccauuggggugacacacuuucagcuaguucagaugaaagauuuccgcuuuagcuacaaguucaaaauggcaugcaaggaagacgugcugaagcucuguccuaacaucaaaaagaaaguagacgucgugauaugccuguccaccacuguucggaaugauacacuucaagaggccaaggaacauagagugucuuugaaauguaggcgucagcugcgcgucgaggaauuagagaugaccgaggacauucggcucgaacccgaucuguaugaggcuugcaagucggacaucaaaaacuuuuguagcgccgugcaguacggaaaugcacagaucauugaaugccuuaaggagaacaagaaacaacuguccacgagaugucaccagaagguauucaaauugcaggaaaccgagaugauggauccagagcucgacuauacacugaugagggugugcaagcagaugauaaaacgauuuugucccgaagcugauucaaagacuaugcuacaaugccugaagcagaauaaaaacagugagcucauggacccuaagugcaaacagaugaucaccaagcggcagauuacacaaaauacugauuaccgccugaacccaaugcuuagaaaagccuguaaggcggacaucccgaaguucugccaugguauuuugaccaaagccaaggaugacucugaacuggagggccagguuaucagcuguuuaaaacucagguaugcugaucagcggcuguccucagacugcgaagaccaaauacgaaucauuauccaggagagcgcacuugauuacagacuggacccccagcuacagcuccacuguucugaugagauuuccagucugugcgccgaagaggcugccgcacaagaacagacagggcaggucgaggaguguuugaaggugaaucuguuaaaaaucaagaccgaacucugcaagaaagaggugcugaacaugcuuaaggaaagcaaagcggacauauuugucgauccuguucugcauacugccugugcuuuggacauuaagcaccacugcgccgcaaucacgccaggacgcggcaggcagaugucuugucucauggaggcucuggaagauaaacgugugcggcuacaacccgagugcaagaaaagacugaaugacaggauugagaugugguccuaugccgcaaagguggccccugcugaugguuucucagaccuugcgaugcagguaaugacaaguccaagcaagaacuacauccucucggucauauccgggucuaucugcauucuguuuuugaucggccugauguguggacgcauuaccaaacgagugacuagagaauuaaaggaucggcuccaguacaggagcgagaccauggccuauaaaggccugguuuggucacaggacgugacagggagucccgcauga

SEQ ID NO: 56714 - RNA, 3198 nt, Artificial Sequence
  derived and/or modified sequence opt3 from GLI1__Homo_sapiens__NP_001161081
auguucaacagcaugaccccgccuccaaucuccucuuacggcgaaccgugcugucugagaccccucccuucacagggggccccaagugugggaacagaagucaagcugacuaaaaagagggcucugagcauuucccccuugucugacgcaucguuagaucugcaaacgguuauacggaccucaccuagcagucuaguggccuuuaucaauucccgcugcacaucuccagguggcagcuaugggcaccucuccauuggaacuaugucacccagucugggcuucccugcgcagaugaaccaucagaaagguccaagcccgucuuuugggguacagcccuguggaccucacgacuccgcucgaggcggcaugaucccacauccccaaucacgugggccuuucccaaccugccagcuuaagagcgagcuggauauguuggugggaaaauguagagaggaaccccucgaaggugacaugaguucucccaauuccacaggcauucaggauccucugcuggggaugcucgacggaagggaggauuuagagcgggaagagaagcgcgaacccgagagcgucuacgagaccgacugcagaugggauggcuguucgcaggaauuugacucucaagagcagcuggugcaccauaucaacuccgaacacauacacggugagaggaaggaguucguuugccauuggggcggauguucacgggaacuucgcccauuuaaagcccaguauauguuggugguccacaugcgaagacauacuggcgagaagccucacaaaugcacauucgaaggcuguaggaagaguuacagccggcuggagaaucuaaaaacccaccuccguucccauacgggggaaaagcccuauaugugcgagcacgaaggaugcucuaaggcauuuagcaacgccucagaucgcgcuaaacaucagaauagaacucacaguaacgagaagccauacguguguaaacugcccgguugcaccaagagguauacagacccuuccagccuucggaaacauguaaagacuguucacggcccagaugcacacgugaccaaacgacaucgcggggacggaccgcugcccagagccccuucuaucucaacagucgagccaaagagggaacgggagggcggucccauucgcgaagagaguagauugaccgugccugaaggggcuaugaagccacaacccagcccgggcgcccaguccucuuguucgagcgaccacuccccugcgggaucagcagccaauacggauaguggcguggagaugacugggaacgcuggagguucuacagaggaccucagcucccuggaugaaggcccaugcaucgccgggaccggauuaucaacucugaggcgucucgagaaucuucggcuggaccaguugcaucaacuacgacccauuggcacaagaggucugaaacucccuagccugucucacaccgggacgaccgucuccaggcgcguugggcccccagugagucuugaacggagaaguucuuccucaaguagcaucucguccgcauacacaguaucuaggcgcagcucacuggcuaguccuuuucccccaggauccccgccugagaacggcgccucuagcuugcccgggcucaugccagcgcagcacuaccuguuacgagcccgguaugcauccgcucguggagguggcacuucacccaccgccgcuagcagucuggauagaauagggggacuaccuaugccacccuggaggucucgcgccgaguacccuggcuauaauccgaacgccggugugacacggagagcauccgacccagcucaggcggcagauaggcccgccccugcucgaguccagcgcuucaagagccucgggugugugcauacuccacccaccguugccggcggaggccaaaauuucgacccuuaccugccgacaucgguguauucaccccagccaccuucuauuaccgaaaacgcagccauggaugcucgggggcuucaggaggaacccgaggucggaacuagcauggugggcuccgguuugaacccauacauggacuuuccucccacggauacacugggguauggaggcccagaaggugccgcagcggagccguacggcgcuagagggccuggaagccucccccugggcccagggcccccuaccaauuacggaccaaaccccugcccucagcaagccucuuauccggacccaacucaggagaccuggggcgaguuccccagccacuccggucuuuacccugggcccaaagcacugggaggcacauauucacaguguccaagguuggaacauuacggucagguacaaguuaagccugaacagggcugccccguggggagugacagcaccggacucgccccaugucugaaugcucacccuucugagggcccgccccauccacagccuuuauucucccacuauccccagccaucaccuccccaauaccugcagagugggccguauacucagccaccucccgauuaccuaccaagcgaaccccguccuugccucgacuuugauuccccgacacacucuacgggacaacugaaagcccagcuugucuguaacuacgugcagucgcagcaagaguugcugugggagggcggugggcgcgaagacgcacccgcucaggagccaagcuaucagucaccuaaguuccucggaggcucccaggucagucccucucgggccaaggcgccugugaauaccuacgguccaggcuuugggcccaaccugccuaaucauaaaagcggauccuauccaacucccucaccgugccacgaaaacuucguugugggcgccaauagagcuucucauagggcagccgcuccuccacgauuacugcccccucuuccaacaugcuacgggcccuugaagguaggaggcaccaacccgagcuguggucacccugaggucgggcggcucggaggcggccccgcccuguauccaccucccgaagggcaagugugcaauccacuagauagucuggaccucgauaacacacagcuggacuuuguugcaauccuugaugagccccagggauuguccccuccaccgagccaugaccagcgcgguucuucaggccacacucccccuccauccgggcccccuaauauggcggugggaaacaugaguguccuguuaagaagccucccaggcgagaccgaguuccuuaauucgucugccuga

SEQ ID NO: 56715 - RNA, 4761 nt, Artificial Sequence
  derived and/or modified sequence opt3 from GLI2__Homo_sapiens__NP_005261
auggagaccagcgccuccgcuacagcaucugaaaagcaggaggccaaaucaggcauccuggaagcggcuggguuccccgacccuggaaagaaagccaguccacucguggucgcagccgcugcagccgcugccguugcggcacaaggugugccgcagcaccuucugcccccuuuucaugccccauugcccauugauaugagacaccaggagggcagguaccauuaugaaccucacagcguacauggggugcacggaccacccgcuuuauccggcucuccugucauaucggacaucucacugauucggcuaagcccacacccggccggucccggggagaguccuuucaacgcaccacaucccuacgugaauccucacauggagcauuaucuccgcuccguucacucuagcccaacucuguccaugaucucagcugcccgaggacuuagucccgcggauguggcccaggaacaccugaaggagcguggcuuguuuggccucccggcaccugggacgacccccagcgacuacuaucaucaaaugacacuggucgcuggacacccagccccuuacggugaucugcucaugcagucuggcggggcugccuccgcaccccauuuacacgacuaucugaacccaguggauguaucaagauucagcagucccaggguuacuccucggcuuucucgcaaaagagccuuguccauuagcccacugucggacgcuucucuagaucuccagaggaugauccggaccuccccgaauagucugguggcguacauaaacaauagucgcagcuccucugcagccagcggaucauacggccaucuuagugcuggugcccugucccccgcauuuacauucccucacccaaucaaccccgucgccuaucagcaaauuuugagccagcagcgagggcucggaucugcuuuuggccacaccccuccacugauccagcccucaccgacuuucuuagcccaacagccuauggcacugacaaguauuaaugcgaccccaacgcagcucagcuccucuucgaacugccuuagcgacacuaaucaaaacaagcaguccucagaaagugcugugucuagcaccgugaaucccgucgccauccauaagagauccaaaguuaagacagagccugagggccugaggcccgcaucaccauuggcccuaacucagggacaggugagcgggcacgguucuuguggcugcgcucugccucucucccaagaacagcuggccgaucuuaaagaggaccuggaucgggacgacuguaagcaggaagcagagguagugauauacgaaaccaacugccauugggaggauuguacaaaagaguaugacacccaggaacaauugguccaccacauuaauaacgagcauauccacggggaaaagaaggaguuugugugccguuggcaggcuuguacgcgcgaacagaaacccuucaaggcccaguacaugcucguugugcauaugagaaggcacacuggagagaaaccacauaagugcacauuugagggcuguaguaaagcguauagccggcuggaaaauuuaaagacccaucugcgaucucacacuggugagaaaccguacgucugcgaacacgagggguguaacaaggccuucuccaacgcuucagaucgcgcaaagcaccaaaauagaacacauaguaacgaaaaaccuuauauuugcaagauccccggcugcaccaaaagguacacggacccaagcucgcuacggaagcacgugaaaaccguacauggacccgaugcccacguuacaaagaagcagcgcaaugacgugcaccucagaacuccucugcuuaaagagaacggcgauuccgaggcugggaccgaaccaggaggucccgagucuacagaagccagcucaacuucacaggcagucgaggacuguuugcaugugagggcgaucaagaccgaguccucuggccugugccagagcuccccuggggcccaaucaagcuguaguucugaaccguccccacucggaagcgcucccaauaacgauucgggcgucgagaugccugguacagggccaggcucacugggagaccuuaccgcccuggaugacacucccccuggcgcagacacgucugcuuuggccgcaccgagugccgggggacuccagcugcguaaacacaugacaaccaugcaucgguuugaacaguuaaagaaagagaagcugaagucccuaaaagauagcugcucuugggcuggucccacuccacacacccgaaauacaaagcucccuccccugccaggcagcggguccauucuugaaaacuucucaggaaguggcggugggggcccugcgggauugcugcccaauccaagacucagcgagcugucugccuccgaggugaccauguuaucacaacugcaggaaaggcgcgacaguagcacuuccacaguuucuucggcauacacggugagccggagaucauccggcauaaguccguauuucucuagcaggcgcuccucagaggcuucuccucuuggggccggacgaccccacaacgccagcagugcugauuccuacgacccaaucagcaccgaugcaucucggcguucauccgaagccagucaguguagcggcgguucgggguugcucaaucugacucccgcgcagcaauauucucuaagagcuaaauacgccgcagccacaggaggcccuccacccaccccucugccgggucucgagaggaugucccugcgcacacggcuugcuuugcuggacgcaccagaaagaacuuuacccgccggcugcccuaggccccucgggccacgacgcggaagcgauggcccuaccuaugggcauggacacgcgggcgcugcccccgcauuuccacaugaggccccuggugggggagcucggagagccucagacccgguaaggcgucccgaugcacugagucuuccacgcguccagcgguuccacucuacgcauaacgugaauccuggcccccugccaccuugugcugacagaagggguuugcgacuccagucccaccccagcaccgauggcgggcuggcccggggagcguacucaccgcgcccaccuaguauuagcgagaacguugccauggaagcaguggcugccggcgucgacggggcuggacccgaggcagaucuaggccugccagaagacgaccucgugcugcccgaugacguagugcaguauaucaaggcccacgccuccggugcucuugaugaggggacaggacaaguuuacccuacugaaucuaccggcuuuagcgacaauccgagauugcccuccccaggucugcauggccagaggcggauggucgcggcagauucaaacguggggccuucugcccccauguuaggaggcugccagcucggguucggagcuccuaguucgcugaacaaaaauaacaugccagugcaguggaaugaggucagcuccggcacaguugacgcccuugcaucucaagugaagcccccuccauuuccccaggguaaccuggccgugguacagcaaaagccggcuuucgggcaguacccuggauauucaccacagggccuacaggcgagccccggcgggcucgauuccacucaaccucaucugcagccacgaaguggagcccccucucaggguauaccgagagucaauuacaugcagcaauugcgccagccuguggcaggcagccagugucccgggaugaccacgacaaugucaccacacgcuugcuauggacagguucacccucaacugucccccaguaccauuagcggcgccuuaaaccaguuuccacagucuuguuccaauaugcccgcaaaaccuggucaccucgggcauccacagcaaacugagguggccccggaccccacaaccaugggaaacaggcaccgugaacugggcgucccugauucagcucuugccggcgugccacccccucauccaguucagagcuacccccagcaaucgcaccaucuggcggcaucuaugagucaggagggguaucaccaggugccuuccuugcucccggcccggcagccaggauucauggaaccccaaacugguccuaugggcguagcuaccgccggguuuggacugguccagcccagaccaccucuagagcccagcccaacaggcaggcaccgcggugugcgagcugugcagcagcaacuggcauacgccagagcuacggggcaugccauggcagcgaugccgucaucccaggagaccgccgaagcugucccuaagggagccaugggcaauaugggcucuguucccccacagcccccuccacaggacgcagggggagcucccgaucacagcaugcuuuauuacuacggucaaauccauauguaugagcaggacggcgggcucgaaaaccugggaaguugccaggugaugcggucccaaccuccgcagccacaggccugccaggauagcauccaaccccagccuuugccaucucccggcguaaaucaggugucaaguacugucgacucccagcuguuagaggcaccucaaauugacuucgaugccaucauggacgauggugaccacagcucucucuuuucgggggcucugucacccagccuucugcacuccuugagucagaacucuagcaggcucacaaccccacgcaauucccugacacuaccgucaauuccugcgggaauaaguaacauggccgugggcgauaugucuagcaugcugacuucccuugcagaagagucaaaauuccucaauaugaugaccuga

SEQ ID NO: 56716 - RNA, 4743 nt, Artificial Sequence
  derived and/or modified sequence opt3 from GLI3__Homo_sapiens__XP_011513575
auggaggcccagagccacuccucuaccacaacugaaaagaaaaagguggagaacucaaucgucaaaugcaguacgagaaccgacguuagcgaaaaggcuguggcauccucuacaacuucgaaugaggaugaaucacccggccaaaccuaccauagggagcggcgcaacgccauuacaaugcagccucagaauguacaggggcugagcaaagugagugaggaaccauccaccucuagcgacgagcgagcgucccucauaaagaaggaaauccacggaucacuuccgcaugucgcugagcccagugugccuuaucgugguacuguuuucgccauggauccaagaaacggcuacauggagccccacuaucauccuccacaccuguuucccgcauuccacccuccagugccgauugacgccaggcaucacgaagggcgguaccauuaugaucccagcccuaucccacccuugcacaugacaucugcuuuauccucaagcccuaccuacccagaccugcccuuuauucgcaucaguccgcacagaaauccuacggcagccucugagucccccuucagcccaccucaucccuauauaaacccauacauggauuacaucaggucgcuacacucuucccccucacucaguaugauuagcgcuacucggggacuguccccuaccgacgccccacaugcgggcgucucuccggcagaauauuaccaccaaauggcccuucugacaggucagcgcagccccuaugcugauaucauuccuucagccgcaacugcugggaccggagccauccauauggaguacuugcacgcgauggacaguacacgauuuuccagcccaagacucucugccaggcccucacggaaacguacccugaguauaagcccucuguccgaucacucuuucgaccuccagacgaugauucgcacuucgccaaauagcuuagugacaauccugaacaauuccagaucaaguucuagcgcauccggcucauauggccaucuuagcgcuucugccauuucccccgcuuugaguuuuaccuacagcucugccccgguaucccugcacaugcaucagcaaauccuaucaaggcagcagagucucgggagcgcauucggacacucgccuccacugauccaccccgccccuacuuuucccacacagcggccaauuccugguauacccaccguucuuaacccagugcaagucuccucuggcccgagcgaaucaagucagaauaagccuacguccgagucugcugugagcuccaccggggaucccaugcauaacaaacgaucaaagaucaaaccagacgaggaccugcccagcccuggagcgcgcggccagcaagaacagccagaggguacaacuuuggugaaggaagagggggauaaggacgaaaguaaacaggagcccgaggucauuuaugaaaccaauugucacugggagggaugcgcaagagaguucgauacacaggaacaacucguucaucacaucaacaaugaccauauacacggcgaaaagaaagaguuuguguguagguggcuggauugcucucgggagcagaagccuuucaaagcccaguacauguuaguagugcacaugcgcagacauacuggcgaaaagccgcacaaauguaccuuugaggggugcacaaaggcuuacuccaggcuggaaaaccucaagacccaucuucguagccacacuggagagaaaccauaugucugugagcaugaagguugcaacaaggccuucucgaaugcaucagaccgggccaaacaccagaaccgaacgcacucuaaugagaagcccuacguguguaaaauuccuggcugcacaaagagauauaccgauccaaguucccugaggaagcauguuaaaacugugcacgggcccgaagcucaugucaccaagaaacaacgcggagacauccacccucggccgcccccaccuagagauagcggcucucacagccaguccaggucacccggucgcccaacacagggggccuugggcgagcagcaagaccuaaguaacaccacuagcaagcgagaagagugucuccaggugaaaacaguaaaggcagagaagccuaugacgucucagcccuccccaggaggccagucaaguugcagcucccaacagucuccgaucucgaauuacagcaacucagggcuggaacugccucuuaccgauggagguuccauuggcgaccugagugcgaucgacgagacucccauuauggauucuacaauaagcaccgcuacaacugccuuggcacuccaggcccggcguaauccagcugggaccaaauggauggaacauguuaagcuggagagauuaaaacaagugaacggaauguuccccaggcugaauccuauccuaccacccaaggccccugcagucuccccgcucauuggcaacgguacgcagucaaauaauaccugcucucuugggggcccaaugacacuguugcccggacgcagcgaccugaguggcguggaugucacuaugcucaacaugcugaaccggagagacuccagcgcuucuaccaucucauccgccuaucuuaguagcaggcgaucgucugggaucuccccuuguuuuagcucacgccggaguucugaagcgucccaggccgagggaagaccccagaaugugagcguugcugauucauacgacccaauuaguacagaugcaagcaggcguuccucugaggccagccaauccgacggucugccuucauugcucucucugacucccgcucagcaguaucgcuuaaaagccaaguacgcagcggccaccggcgggccaccuccgacgccccugccaaacauggaacggaugagucuaaagacaagacucgcucugcuuggagaugccuuggagccuggcguggcacugcccccaguacacgcuccuaggcgaugcucggacgguggggcccauggcuacggacggcgccaccuccagccccaugaugcaccgggccacggggucagaagggccagcgacccagugcggaccggauccgaaggccuggcuuuaccucgaguucccagauucucuucacugagcuccuguaacccacccgcgauggccacuagcgcagagaaacgcucucuuguguugcaaaauuauacaaggccugaaggugggcagagccguaacuuucacucauccccgugucccccaaguauaaccgagaaugucacucucgagagccugaccauggaugcugacgccaaccuaaaugacgaagauuuccugccugacgaugugguacaguaccucaacucucagaaucaagccggauaugagcagcauuuucccuccgcucugccugacgauucaaaggugccacacggccccggugacuucgaugcaccuggccuuccagacagccaugccgggcagcaauuucacgcguuggaacagcccugcccggagggaucgaaaacagaucugccuauccaguggaacgagguuucuaguggcuccgcugacuuaagcucauccaagcucaaaugcgggccacggcccgccgucccucagacgagagcauucggauuuuguaauggcaugguggugcacccacaaaacccccugaggucugguccggccgggggauaccagacccuuggcgaaaauagcaacccuuaugguggccccgagcaucugauguugcacaauaguccaggguccggaacuagcggcaacgcuuuccaugaacagccuugcaaggcaccccaguacgggaauugucucaaccgccaaccagucgcccccggagcgcuggauggcgcuugcggugccgggauucaggcaucuaaacuaaagucaacaccuaugcagggaaguggcggucagcugaacuuuggccucccaguugccccgaaugaguccgcugggagcauggugaacggaaugcaaaaucaggaccccgugggccagggguaucuggcccaccagcuuuugggagauucuaugcaacauccuggcgcaggucgaccagggcagcagaugcugggacaaaucucggcuaccucacacauuaacaucuaccagggccccgaaagcuguuuaccuggcgcccacgggaugggaucccagccaaguucucucgcgguagucagagguuaccagcccugcgccagcuucggcgggucccggaggcaagcaaugccucgcgacucacuggcacuucagaguggacagcugucugacacaagccagacuugccgugugaauggcauaaagauggagaugaaaggucaaccgcauccacuauguuccaaccuccagaauuauucagggcaguuuuacgaucagaccguuggauucagccaacaggacacgaaggccggcucuuucuccaucagugaugcuagcugccuguugcagggcacaucggcuaaaaacuccgagcuguuaucucccggggccaaucaagugaccucaacugucgacagccucgauagucacgaccuggaaggagugcagauugauuuugacgccaucauugaugacggugaucauuccucucuuaugagcggcgcucugucaccuuccaucauacagaacuugagucacaguucuucaagacucaccacaccccgggcgucccugccauucccugcacuaagcaugucuacuaccaauauggccauuggggacaugaguucgcugcuuacaucccucgcugaggaaagcaaguuucuggccguuaugcaguga

SEQ ID NO: 56717 - RNA, 801 nt, Artificial Sequence
  derived and/or modified sequence opt3 from GLIPR1__Homo_sapiens__NP_006842
augagagugacccuggccacaaucgcuuggauggucagcuucguuuccaacuacucucacacugcaaauauucuccccgacauagagaacgaagauuuuaucaaggacugcgugaggauucauaauaaauuccggucagagguaaagccuacggccagugauaugcuuuauaugaccugggacccagcgcuggcucagaucgccaaagcaugggccagcaacugucaauuuucccacaauacacgcuugaagccgccccauaaauuacacccuaacuucacuucucugggcgaaaauauuuggaccgggucggugccaaucuuuucagucagcagugcuauaacaaacugguacgaugagauccaggacuaugauuucaagacccgaauuugcaagaaaguguguggacauuacacucagguugugugggcagacuccuauaaggucgguugcgccgugcaguuuugucccaaaguaucuggcuucgaugcucuaagcaauggggcccacuuuaucugcaacuacggaccuggcgguaauuauccaacauggcccuacaagcguggggcgaccuguuccgcaugcccuaacaaugacaaaugucucgauaaccugugcguuaauagacaaagggaccaggugaagcgguacuauucagucguguacccaggauggccgauuuauccccgcaacagauacacgagucuuuuccugaucgugaacagcgucauauugauucucucuguuaucauuacuauccuggugcagcacaaguauccuaaucugguacucuuagauuga

SEQ ID NO: 56718 - RNA, 387 nt, Artificial Sequence
  derived and/or modified sequence opt3 from GLIPR2__Homo_sapiens__NP_001273939
augggcaagagcgccuccaaacaguuccacaacgaggugcugaaggcucauaaugaauacagacaaaaacacgggguucccccucucaaacuuugcaagaaccugaauagggaggcacagcaguauucugaagccuuggcgucaacccggaucuuaaagcauaguccagagagcucccgcggacaguguggugaaaaccuggcuugggccucuuacgaccaaacaggccacuuuacugcaauggucuggaagaauacgaaaaagaugggggugggaaaagccucggcuucagauggcagcaguuucguaguggcacgauauuuuccggccgguaacgucgugaaugagggguucuuugaggaaaacguucuacccccuaagaaauga

SEQ ID NO: 56719 - RNA, 1575 nt, Artificial Sequence
  derived and/or modified sequence opt3 from GLIS2__Homo_sapiens__NP_001305847
augcacagccuggacgagccccucgaucuuaagcuguccaucaccaaauugagagccgcuagggaaaagcgggagcgcacauuaggcgugguccgaccucgugcacugcauagagaacuagggcucguugacgauucuccaacuccgggaucacccgguaguccuccaagcggcuuccugcuuaacuccaaauuucccgagaagguggaagggagguucucugccgcgccucugguagacuugucgcucucaccacccagcggacuggauaguccuaauggcuccucuagccuguccccagagcggcaggguaacggggaccucccgcccgugccuucagcuagugauuuucaaccauuacgcuaccuggacggaguccccagcucuuuccaguuuuuccuuccuuugggcuccggcggggcccugcaccuaccagcaucaucuuuucucacgcccccgaaagauaagugccugaguccugaccuuccccugccaaagcaguugguguguagaugggccaaaugcaaucaacucuucgagcuguuacaggaucugguugaccaugugaacgauuaucacgucaagccugaaaaagacgcuggauacuguugccauugggaggguugugcaaggcacggccggggguuuaaugcccgcuauaagaugcucauucacauacgaacccauacaaacgaaaaaccccacagaugcccaacuuguucuaaguccuucagcaggcuugagaaucugaagauccauaaccggucgcacaccggagagaaacccuacgugugcccuuaugaaggcuguaauaagcguuacucuaacuccucagaccgcuuuaaacacacaagaacccauuauguagauaagccauacuacugcaaaaugccggguugucacaagagguauacugaccccaguagcuugcggaaacauauuaaggcucacgggcauuucguuucccacgagcagcaggaacuacugcagcuccgaccuccacccaagccuccacugcccgccccggauggaggcccuuacgugucuggcgcgcaaaucauuaucccaaaucccgcagcccuuuuugggggaccuggucugcccggcuugccacucccucuggcucccgggccauuagaccugagcgcccuagcaugcggaaacggcggugggucaggcggaggcgggggaauggguccgggccucccugggcccguccugccacuuaauuuggcuaaaaacccccugcucccuaguccauucggagccggcggucuggggcuucccguggugucccuguuggcgggcgccgcaggaggcaaggcugagggggaaaaaggacgcgguagcgucccuacaagagcccucggcauggaggggcacaagaccccgcuggagaggacggaaucuucaugcagucggccaagccccgauggauuaccucugcuaccaggcacuguucucgaccuguccaccggugugaauagcgcugccucgagccccgaggcacuugccccuggguggguagugauaccgcccggcuccgucuugcugaaaccagcugugguuaacuga

SEQ ID NO: 56720 - RNA, 1719 nt, Artificial Sequence
  derived and/or modified sequence opt3 from GLIS3__Homo_sapiens__XP_006716794
augaacggcagaagcugcuccaugucucugcacaggaccucagggacaccccagggaccucggauggugaguggucaucacaucccagccauucgcgcucauagcggcacuccggggcccuccccuuguggaucuacgucgucaccaaccauggcaagccucgccaauaaccuucaccugaagaugcccaguggcggugggauggcgccucaaaauaacgucgcugagucccgaauacauuugccagccuuaucuccccguagacagaugcugacaaauggaaaaccuagguuccagguuacucaggcaggcggcaugagcgggucccacacccuaaagccaaaacaacaggaauuuggaucaccguuucccccuaacccagguaagggcgcccucggguucggaccccagugcaaaaguaucggcaaggguagcuguaauaaccuggugguaacaucuuccccuaugauggugcagcggcuugggcugauuucaccacccgcuagccaagucaguaccgcaugcaaucagaucucuccguccuugcagcgcgccaugaacgcugccaaucucaacauuccucccagcgacacuagaucgcugaucucuagggagucccuggcgucaacaacccucaguuuaacggaaagccaguccgcaucuagcaugaagcaagaguggucacagggauaccgggcccugccaagucuuuccaaucacggcagccagaacggcuuggaucugggggaccuacucucucugccucccggaacuucaaugaguagcaauuccgugucuaacucgcuuccaagcuaucuguucgguaccgaauccucacauagucccuacccuucuccacgccacagcuccacacgaucacauagcgcuagaucuaaaaagagggccuugucccucaguccgcugagcgauggcauagggaucgacuuuaacacuauuauccggaccucucccacauccuuaguugcauauauuaauggaucacgugcuaguccugccaaccugagcccacaacccgagguguacggccacuuccucgguguccgcgggucguguaucccucagccaagacccgugccgggcucccagaaaggaguacuuguugcgccuggcgggcuggccuugccagcauauggagaggauggugcucuagaacacgagaggaugcagcaacuggaacauggcgggcuccagcccggacuggugaaucacauggucgugcagcauggccuuccuggucccgacucucagagcgccgggcuguuuaagaccgagcgguuggaggaguucccaggcucaacgguggaucucccucccgcuccaccgcugccucccuuaccacccccuccaggacccccuccgccauaccacgcccaugcacaucugcaccaccccgaacuaggcccucacgcccaacagcucgcucugccacaggcgacucuugacgaugacggggaaauggauggaauagguggcaaacauugcugucgauggauugacugcagugcauuguaugaucagcaagaggaacugguccgccacaucgagaagguucacauugaccagagaaagggggaggacuuuacauguuucugggccggaugccccaggcgguacaaaccuuuuaacgcucgcuacaagcuccugauccauaugagagugcacuccggcgaaaaaccgaauaaguguaccgccgcauga

SEQ ID NO: 56721 - RNA, 1785 nt, Artificial Sequence
  derived and/or modified sequence opt3 from GLMN__Homo_sapiens__XP_011538848
auggccguggaggaacugcagagcaucauuaagagaugccaaauacucgaggaacaggacuucaaagaggaagauuuuggccuuuuccagcuggcugggcagagguguaucgaggagggacacaccgaccaauuguuagaaauuauccagaacgagaagaauaaagucauuaucaagaacauggguuggaaucugguuggccccgugguacggugccuacucuguaaagauaaggaagacuccaagcgcaaaguguacuuucugauauucgaucuucuggucaaguugugcaacccuaaagagcuccugcuggggcucuuagagcugaucgaggagccaucuggaaagcagauuucacagaguauccuuuugcugcuacaaccgcuccagacagugauucagaaacugcauaauaaggcauauagcaucggccuugcccuguccacuuuguggaaccagcucucucuguuacccguuccuuacucgaaggaacaaauacagauggacgauuauggucugugucagugcuguaaagcgcucauugaguuuacgaagccauucguggaagaggucaucgacaauaaagagaacucacuugaaaaugagaagcugaaagaugaauugcuaaaguuuugcuucaaaagccugaaguguccccuccugaccgcucaauuuuucgagcagagugaagaagggggaaacgacccuuuucgauacuucgccuccgagauuaucggcuuucuuucugcaaucggccacccauuccccaagaugauuuucaaucaugggcguaaaaagagaacauggaacuaucuggaauuugaggaagaggaaaauaaacaguuggccgauagcauggcuucccucgcauaccugguguucguacagggaauacacaucgaccaauuaccuaugguucugucaccacuauaucuccugcaguuuaacaugggucauauugagguguuccuucagaggacugaggaaagugucaucagcaagggcuuggagcugcucgaaaauucucugcuucggauagaggauaacucccuguuguaccaguaccucgagauuaaaucauuucugaccgugccgcaaggguuagugaaggucaugacacugugccccaucgaaacccuacgcaagaaaagccucgccaugcugcagcuuuauaucaacaaguuggacagucagggaaaauacacucuguucagaugucuccugaauacaucuaaccacuccggcguugaggcuuuuauuauccagaauauuaagaaccaaauagacaugagcuuaaaaaggacccggaauaacaagugguucacggguccucagcugaucucgcuuuuggaucucgugcuguuucuaccagaaggggccgagacugaccugcuccaaaauucugaucgcauuauggcgucccugaaccuuuugcgauaucugguaaucaaggacaaugaaaacgauaaucagaccggauuauggacagagcucggcaacaucgagaauaacuuccugaaaccccuucacauuggccugaauaugucaaaggcacauuacgaagccgagauaaagaacagucaggaagcucagaaaagcaaagacuugugcuccaucacugugucuggggaggaaauuccuaacaugccacccgagaugcagcucaagguccugcacagcgcccuauuuaccuucgaucugaucgagucagugcucgcaagaguugaggaacugauugaaaucaagacaaaaaguaccuccgaggaaaauauaggaaucaaguga

SEQ ID NO: 56722 - RNA, 555 nt, Artificial Sequence
  derived and/or modified sequence opt3 from GLO1__Homo_sapiens__NP_006699
auggccgagccccagccuccaagcggcgggcugaccgacgaagcugcacucuccugcuguucugaugccgacccgucaacaaaggauuuccuucugcaacagacuauguugagagugaaagaccccaagaaaaguuuagauuuuuacacgaggguccugggaaugacccuaauccagaagugcgacuucccuauuaugaaauuuagccucuauuuccuggcguacgaggauaagaacgacauaccaaaggaaaaagaugagaagaucgcuugggcccuuucccggaaagcaacacuggaauugacucacaauugggguaccgaggacgaugagacacagucuuaucauaacggcaauucggacccccgcggguuuggacacauuggcaucgccguuccugauguguacucagcuuguaagcgauucgaggaacucgguguaaaauuugugaagaagccagacgacgggaaaaugaagggacuggcauucauucaagaucccgacggcuauuggaucgaaauacugaacccuaauaaaauggccacccucauguga

SEQ ID NO: 56723 - RNA, 897 nt, Artificial Sequence
  derived and/or modified sequence opt3 from GLOD4__Homo_sapiens__NP_057164
auggccgcuagaagggcacugcacuucguguuuaaggucggcaaccgguuccagaccgcccgcuuuuaccgagacguucucgggaugaaagugcuucgucaugaggaguucgaagaaggaugcaaggcggcuuguaauggucccuaugauggcaaauggagcaagacaaugguaggguuuggaccugaggacgaucacuucguggccgaacugacuuacaacuauggcgucggugacuacaaauuggggaaugauuuuaugggaaucacguuagcauccucucaagccgugucaaacgcuagaaagcuggaguggccacuaaccgagguugcagaaggcguguucgagacagaagccccgggcggguauaaguuuuaccuccagaauaggagucugccccagagcgacccuguccuuaaagugacucuggcuguauccgauuugcagaagucucucaacuauuggugcaaucugcugggaaugaaaauuuacgagaaggacgaggaaaaacaacgggcccucuuagguuacgcggauaaccaguguaagcuggagcuucagggcguuaaagggggaguggaccaugcagccgcuuucggccgcauagccuuuucgugcccacagaaagaauugcccgaucuggaggaccuaaugaagagagaaaaucaaaagauccucaccccucuggucucacuugauacaccagguaaggcaaccguccagguggugauucuggcugaccccgacgggcacgagaucuguuucguuggagaugaggccuuuagggaauugagcaaaauggacccugagggcaguaagcuccuggaugacgcgauggccgcagauaaauccgacgaaugguucgcuaagcauaacaagccaaaagccucuggcuga

SEQ ID NO: 56724 - RNA, 1392 nt, Artificial Sequence
  derived and/or modified sequence opt3 from GLP1R__Homo_sapiens__NP_002053
auggccggcgcucccgggccucugagacucgcacuucuguuguuaggaaugguggguagggccggcccacggccgcaaggggcgaccgucagccugugggagacaguucaaaaguggcgcgaauaccgacgucagugccagagaucccuaacugaggaucccccuccagcuacggaccucuucuguaacaggaccuuugacgaauaugccugcuggcccgauggagagccuggcucuuucgugaauguaucauguccaugguaccugcccugggcaaguagcgugccucagggucacgucuaucgguuuugcacagccgaagggcuuuggcugcaaaaagacaacuccucuuugccauggcgcgaucucucggagugugaggaaucaaagagaggagagaggagcaguccggaggaacagcugcuguuccucuacaucauuuauacugugggcuacgcuuuauccuuuucugcacugguuauagccagcgcuauccuuuugggcuuccggcaucugcacugcacccgcaauuauauucaucuaaaccucuuugccuccuucauccugcgagcgcuuucaguguuuauuaaagacgcagcccugaaguggauguacaguacagcugcccagcagcaccaaugggauggguugcucagcuaccaggacucucuguccuguagauuagucuuccugcucaugcaguauugcguggcagcuaauuacuauuggcuucugguagagggaguuuacuuguauacccuacuggccuuuucagugcucagcgaacaguggaucuucaggcuguacgucaguauagguuggggcgugccccuucuguuuguggucccuugggggaucguuaaauauuuguacgaggaugaaggauguuggacucggaacucuaauaugaacuacuggcucauuauccgucugccaauuuuauucgcgaucggcgugaauuuccugauauuuguacgcgugauuugcaucgucguguccaagcuaaaggccaaccucauguguaaaacagacauuaagugcagacuggcaaaaagcacccuuacguugaucccccugcucgguacucaugagguuaucuucgcuuuugugauggaugaacacgccagggggacccugcgguucauuaagcuguuuacagagcugucguucacuucuuuucaaggauugauggucgcuauacucuauugcuucgugaauaacgagguacagcuggaauuucgaaaauccugggagcgcuggagauuagaacaccuucauauccagagggacucaaguaugaagccucuaaaguguccaaccagcucccucucuagcggcgccacagcaggcucaaguauguacaccgccacgugccaggcuuccuguagcuga

SEQ ID NO: 56725 - RNA, 1662 nt, Artificial Sequence
  derived and/or modified sequence opt3 from GLP2R__Homo_sapiens__NP_004237
augaagcugggcagcuccagagccgggcccggaagggguucugcuggccuccuuccuggggugcacgagcugccaaugggaaucccggcacccuggggcaccucaccuuugaguuuccaucggaaaugcagcuuaugggccccaggucgccccuuucugacucuaguccuccugguuuccauuaaacaggugacagggucucuucuggaagagacgacccgaaagugggcgcaauacaagcaggcuuguuugcgugaccuccugaaagaaccuucgggaauauucugcaacggcacauuugaucaguauguauguuggccacacucaagccccggcaaugugagugucccuugcccauccuaccugccgugguggucugaggaaagcuccgggagagccuauaggcauugucucgcacagggaacuuggcaaaccaucgagaacgccacagacauuuggcaggaugacucagagugcagugaaaaucacagcuucaagcagaacguggaucgguacgcuuuacugucuacccuucaguugauguauacuguugguuacuccuuuucacugaucagccuauuccucgcacugacacuucuguuguuucuccgcaagcugcauuguaccagaaauuauauucacaugaacuuauucgccaguuuuauccugaggacgcucgcugugcuugucaaagacgugguauucuacaauucuuacuccaagcggcccgauaacgagaauggcuggaugagcuaucugucggaaaugucuacuuccugccgcucaguucaaguguugcuacacuacuuugucggggccaacuaucuguggcuccugguggagggacuuuaccugcauaccuugcucgagccuacagugcugccagaacgaagauuauggcccagguaucugcuacucggcugggcguucccuguccuguuuguugugccaugggguuucgcacgggcccaccuugagaauacuggguguuggaccacaaacggaaauaaaaagauaugguggaucauucguggccccaugauguugugcguaaccgugaacuucuuuaucuuccugaaaauucucaagcugcuuaucaguaagcugaaagcucaucagauguguuuucgcgacuacaaguauagauuggccaaaagcacgcucguccugauaccguuacugggcgugcacgaaauucuauucuccuuuaucacugaugaccagguugagggguucgcaaagcucauuaggcuguuuauccagcuuacauugucuagcuuccacggauuucugguggcucuccaauacgguuucgccaauggcgaagucaaagcggagcugcggaaguacugggugcgauuuuuacuggcccgccauucagggugcagagcaugcguacuuggaaaagauuucagguuuuugggcaaguguccuaagaaacucagugagggugacggggcugaaaagcugcggaaacuacagcccucccugaacagcggccgccuccugcaccuugccaugagaggauugggcgagcugggggcucagccacaacaggaucaugccagguggccucguggaucuucauuaagugaaugcagcgagggugacguuaccauggcaaacacuauggaagagauccucgaggaauccgagauuuga

SEQ ID NO: 56726 - RNA, 1350 nt, Artificial Sequence
  derived and/or modified sequence opt3 from GLRA1__Homo_sapiens__NP_000162
auguacagcuucaacacccugagacucuaucuuugggagacaaucguguuuuucucccuggccgcuucuaaggaagcagaggccgcgaggucagcucccaaaccuaugaguccaagcgacuuuuuggauaaguuaaugggccggacuuccggguacgacgcccgcauucgaccgaauuucaaaggacccccugucaacguuucuugcaauauauuuaucaacucguucgguucaauugcagaaacgaccauggauuaucgugugaauaucuuucugagacagcaauggaacgacccaaggcuagccuacaaugaguaucccgaugacagccucgaucuggacccuaguaugcuugauuccauuuggaagccagaccuguucuuugcuaacgaaaaaggcgcacacuuccaugagaucacaacugauaauaaguugcuccggauaucucgcaacgggaauguacuguacagcaucagaauuacccugacacucgccugucccauggacuuaaagaacuuuccuauggaugugcagaccugcaucaugcagcuggaguccuucggauauacuaugaaugaccuuauuuuugaauggcaggagcaaggcgcuguccagguggccgacgguuugacacugccacaguucauccuaaaagaagagaaggaucucagguacuguaccaaacacuacaacacggggaaguucacuugcauagaggcgcgguuucaucuggaacgccagaugggauauuaccuuauucaaauguauaucccgucacuguugauuguuauccucaguuggaucagcuucuggauuaauauggacgcagcccccgcucgagugggccugggcauaaccacagucuuaacuaugaccacacagucuuccgggucaagagccagccugccuaaagugaguuacguaaaggcaaucgauauuuggauggcuguuugucuccuuuuuguguucucugcccuguuggaguaugcggccgucaacuuuguguccaggcagcacaaggaacuacugcgguuccgucgcaaaagaaggcaucacaaggaggacgaagcaggagagggucgguuuaacuucagcgcuuacggcauggggccagccugccuccaggcuaaagauggaaucucggugaagggcgccaauaacucuaauaccacgaaucccccuccagcacccuccaaaucaccggaggaaaugcgaaagcuguuuauacaacgcgccaaaaagauugacaagaucaguagaaucgguuucccuauggcuuuucuuauuuucaacauguuuuauuggaucauuuacaaaauagucaggcgggaggauguucacaaccaguga

SEQ ID NO: 56727 - RNA, 1359 nt, Artificial Sequence
  derived and/or modified sequence opt3 from GLRA2__Homo_sapiens__NP_001112357
augaacagacagcuggugaauauccucaccgcccuuuucgcuuucuuccuggagacaaaccacuuuaggacugcauucugcaaggaccaugauagccgguccggcaaacaacccucucagacguugucaccuagugacuuuuuagauaagcugauggggcgcaccagcggauacgacgcccguauucgaccaaauuucaaagguccgcccgucaacguuacauguaauauauuuaucaacuccuucggcucugugacugaaaccacaauggauuauagaguaaauauuuuucuaaggcagcaguggaacgacucgcggcucgcguacucagaguauccugaugacagccuggaucuugacccaaguaugcuggauuccaucuggaagcccgacuuguucuuugcuaaugaaaaaggggccaacuuccacgaugugaccacugacaauaagcuccugcgcauuucuaagaacggaaaaguccuguacagcaucagacucacauuaacccuguccugcccuauggaccuuaagaauuuuccaauggaugugcaaacguguacuaugcaguuggagucauucggcuauaccaugaacgaccugauauucgaauggcuaagugauggucccguucagguggcagaggggcucacacugccucaguuuauccuuaaagaggaaaaggagcugggauacugcacuaaacauuauaauaccggcaaguucacauguauugaagucaaguuucacuuggagaggcaaaugggcuacuaccucauccagauguauauuccaagccuguuaaucgugauacugucuuggguauccuucuggauuaacauggacgccgcuccggcacggguugcccucgggaucaccacggugcuuacuaugacaacccagucaagcggaagucgcgcuucucugcccaaagucuccuacgugaaggccauugauaucuggauggcggugugcuugcuauuugucuucgcagcccugcucgaguaugcugccguuaacuuugugagccgacagcauaaagaauuucugagacuuaggcggcgucaaaagcgccagaauaaagaggaagacguaacuagagagucgagguuuaacuucucugguuacggcauggggcacugucugcaagugaaggauggaacagcagucaaagcuaccccugccaauccauugccccagccuccaaaggacggcgaugcgaucaagaaaaaguuuguggaccgggccaaacgaauugauacgauaucccgcgcagcuuucccccucgccuuucugaucuucaacauuuucuauuggaucaccuacaagauaauuagacacgaagacguucauaaaaaguga

SEQ ID NO: 56728 - RNA, 1350 nt, Artificial Sequence
  derived and/or modified sequence opt3 from GLRA3__Homo_sapiens__NP_001036008
auggcccacgugagacauuucaggacccuggucagcggcuuuuacuucugggaggcugcacuccuucuguccuugguugccacaaaggaaacugacucugcgcggucacgcagugcucccaugagcccuuccgacuuuuuagauaaacugauggggcgaacgucuggauaugaugcccguaucagaccaaacuucaaggguccgcccgugaauguaaccugcaacauuuuuauaaauucguucggcucaaucgcagagacaacuauggacuacagggugaacauuuuucuacggcagaaauggaaugauccucgccucgccuauagcgaauacccagacgauagucuggaccuugaucccuccaugcuggacucuaucuggaagccugauuuguucuuugcuaacgagaaaggggcaaauuuccacgaagucaccacagacaacaagcuccugagaauuuuuaagaauggaaacgugcuguauagcaucaggcucaccuuaacucuguccuguccaauggaucuuaaaaauuuccccauggacguucaaacaugcauaaugcaguuggagucauuuggcuacaccaugaacgaccugaucuucgaguggcaggaugaagccccugugcaggucgcugagggucuaacgcucccacaauuccugcuuaaggaagagaaagaccugcgguauuguacuaagcauuacaauaccgggaaauuuacaugcauugaggugcgcuuccacuuggaacgacagaugggauacuaucucauccagauguacauuccgagucuguuaaucguaauacugagcuggguuucuuuuuggauuaacauggaugccgcgcccgcaagaguggcccucggcaucacuaccguccuuacaaugaccacgcaguccucaggcagcagggcuagucugccuaaggugucuuaugugaaggccauugacaucuggauggcagucuguuugcuauucguguuuuccgcucugcucgaguacgccgcgguuaauuucguaagccggcaacauaaagaacugcuucguuuucgcagaaagaggaaaaacaaggaugacgaggugcgggaaucgcgauucucuuuuacugccuaugggaugggaccaugccugcaggcaaaagaugguaugacacccaagggcccuaaccacccaguccaggugaugcccaaauccccggacgagaugcgcaagguuuucaucgauagagcuaagaaaauugacaccauaucaagggccuguuuuccuuuggcuuuccucaucuuuaauauuuucuacugggugaucuauaagauacugcggcacgaggauauucaucagcaacaggacuga

SEQ ID NO: 56729 - RNA, 1494 nt, Artificial Sequence
  derived and/or modified sequence opt3 from GLRB__Homo_sapiens__NP_001159532
augaaguuccugcucaccacagccuuucuuauccugauuagcuuguggguggaggaggcuuacuccaaagaaaagucuaguaaaaagggcaaagggaagaagaaacaguauuuaugucccucacaacagagcgcagaagaccuggccagagucccugcgaacuccacuucuaauauacuaaacaggcuccugguuucguacgauccacggauccgcccgaauuucaagggaauacccguggacguaguggucaacaucuuuauuaauucauucgguagcauccaggagacgaccauggauuaucgagugaacauauuucuucgucagaaauggaaugacccuagacugaaguugccaagugauuucaggggcuccgacgcucucacaguugaucccacuauguacaaaugucuguggaagccugaccuguuuuucgccaacgaaaagucugcaaauuuucacgaugugacccaagagaacauccucuuauucauuuuucgggacggggauguccuggugagcaugcgccuuuccaucacauugucaugcccacuggaccuaacccucuuccccauggauacucagagauguaaaaugcagcuggagaguuuuggauauacaaccgacgaccuuagguucauuuggcagagcggcgauccuguacaacuggaaaagaucgccuugccacaguucgacauuaaaaaggaggauauugaauacgguaauugcacgaaauauuacaaggggacuggauacuauaccuguguugaggugaucuuuacacuccggcgccaggucggcuucuacaugaugggcguguaugcuccgacucuguuaauugugguccugucuuggcucuccuuuuggaucaaccccgacgcaucagccgcucgaguuccucuugggaucuucagcgugcugaguuuggccucugagugcaccacacuagcggcagaacugccaaaaguauccuacgugaaggcccucgaugucuggcugauugcuugucuucuguuuggauucgccagcuugguggaguaugcaguugugcaggucaugcucaauaaccccaagagaguggaagcugagaaagccaggauagcgaaggccgaacaagcagacgguaaaggcgggaauguagcuaagaaaaacaccguuaacggaacgggcacuccugugcauaucucgacacugcaggucggugagacccggugcaagaagguguguacuucuaaauccgauuuacguucaaaugacuuuaguauugucgggagccugccacgcgauuucgagcuauccaacuacgacugcuauggaaagcccaucgaagugaauaacggccucggcaaaucucaggccaagaauaacaaaaagccgccucccgcuaagccaguuauaccuacagccgcaaaaagaauugaucuguacgccagggcucuuuuucccuucugcuuuuuguucuuuaaugugaucuacuggagcaucuaucuguga

SEQ ID NO: 56730 - RNA, 498 nt, Artificial Sequence
  derived and/or modified sequence opt3 from GLRX2__Homo_sapiens__NP_057150
augaaccccagagacaaacaggugagcagguucuccccucugaaggaugucuacaccuggguugcccucgcuggcauccaacggucugggucaccaggacgcacacgaagugcagcccguagaauggagagcaauacuuccucuucgcuugaaaaccuggcgacggcuccggugaaucagauucaggagaccauaucagacaacugcguagugaucuuuagcaagacaaguuguuccuauugcacuauggccaaaaaguuguuccacgauaugaaugucaacuacaaagugguugaauuagaccugcuagaguaugguaaucaguuucaagaugcacucuacaagaugaccggcgaaaggacagugccccggauuuucgucaacgggaccuuuaucggaggcgccacugacacacaucgccugcacaaggaggguaaacuucugccuuuggugcaucaguguuaucucaagaaaucuaagagaaaagaguuccaguga

SEQ ID NO: 56731 - RNA, 1008 nt, Artificial Sequence
  derived and/or modified sequence opt3 from GLRX3__Homo_sapiens__NP_006532
auggccgcuggcgcagccgaggcggcuguggccgcagucgaagagguugggagcgccggacaguucgaggaacugcucagacuuaaggcuaaaucccuguuggugguacacuuuugggcacccugggccccucaaugcgcucagaugaacgaagugauggccgaguuagcgaaggagcugccacaggucucuuucgugaaacuagaagcagaggguguuccggaagugucagagaaguacgagaucaguagcguccccaccuuucucuucuuuaaaaauucccagaagauugacaggcuggauggcgcccaugcuccugaacuuacaaagaaagugcaacggcacgccucuucggggucauuccugccaagcgcaaacgagcauuugaaggaagaccucaaucugcgccugaaaaagcucacucacgcugcccccuguauguuauuuaugaaaggaacgccucaggagccacgaugcggcuucaguaagcagaugguagaaauacugcauaagcacaacauccaguuuuccucuuucgauauuuuuagcgacgaggagguucgucaaggucuuaaagcguauuccucauggcccaccuacccucaguuguaugugaguggggaacugaucggaggccuagauauuaucaaggagcucgaagccagcgaggaacuggacacaauauguccaaaagcaccgaagcucgaggagagacugaaagucuugacuaauaaggcuucugugaugcuuuucaugaaaggcaacaagcaggaagccaagugcggguuuuccaaacagauccuggagauuuuaaauucaaccggaguggaauacgagacauucgauauccuggaagacgaggaggucaggcaaggucucaaggcuuauagcaacuggcccaccuacccucagcuuuauguuaaaggcgaacugguagggggauuggauauugugaaggagcuaaaagaaaauggcgagcugcucccaauccugcggggugagaacuga

SEQ ID NO: 56732 - RNA, 474 nt, Artificial Sequence
  derived and/or modified sequence opt3 from GLRX5__Homo_sapiens__NP_057501
augagcggcucccuggggagagccgcugcagcccuccuuagguggggacggggugcgggcgggggaggccuguggggucccggggugcgcgcugccggaucuggcgcaggcgggggagguucagccgagcaguuggacgcuuuagucaagaaagauaagguugugguauuccugaaaggcaccccugaacaaccacagugcggguuuaguaacgcagugguccagauccuacgacuccacggagugcgugacuacgccgcuuauaauguucuggaugacccggagcuuagacagggcauuaaggauuacagcaacuggcccacaauaccucaaguguaucugaauggugaguucgucgggggaugugacaucuugcuccagaugcaucagaacggcgaucugguggaagaacugaaaaagcucggcauucacuccgccuuacuggacgagaagaaagaucaggacucuaaguga

SEQ ID NO: 56733 - RNA, 321 nt, Artificial Sequence
  derived and/or modified sequence opt3 from GLRX__Homo_sapiens__NP_001230588
auggcccaggaguucgugaacugcaagauccaacccggcaaagucguuguguuuauuaagccuaccuguccauacugcagaagggcucaggaaauacugagccagcucccgaucaaacaggggcuucuggaguucguagacauuacagcaacuaaucacacgaacgaaauccaagauuauuugcagcaguuaaccggagcccggacagugccccgcgucuuuauugguaaggacuguaucggcgggugcuccgaucuggugucucuacagcaaucaggagagcuccugacucgacuuaaacagauaggcgcgcugcaguga

SEQ ID NO: 56734 - RNA, 1809 nt, Artificial Sequence
  derived and/or modified sequence opt3 from GLS2__Homo_sapiens__NP_037399
augagaagcaugaaggcccugcagaaagcucucuccagggcaggcucucacugcgggcggggagguuggggccaucccucacgcaguccucuucuugggggaggcgugcgacaccauuugagcgaggccgcggcucaaggucgugaaaccccacacucccaucagccgcagcaccaggaccacgauucuucggagucagggauguuaagcagacugggagaccuacucuucuacacaaucgccgaaggccaagagaggauucccauacauaaguuuacuacggcacugaaagccaccggccuucagacaagugauccucggcugcgcgacuguauguccgaaaugcacagagucguucaggagucuagcuccgggggauugcucgauagggaccuguuccggaagugcgugucaaguaacaucguacugcucacucaggcuuuucgcaaaaaguucgugauuccagauuuugaggaguucaccggucaugucgaccgaaucuuugaagaugugaaggaauuaacaggcgggaaaguugcagccuauauuccccaacuggcuaagagcaauccugaccuuuggggagugucuuuguguaccgucgauggccagagacacuccgugggucacacuaaaaucccauucugccugcagucauguguaaagccccuaacauacgccauaagcaucaguacccucgggacggacuauguucauaaauuugugggaaaggagccuucuggccugagguacaacaagcugucccugaaugaggaaggcauuccacacaacccgauggucaaugcgggggcaaucguggugagcucguugauuaaaauggauugcaacaaggccgagaaauucgacuuuguccuccaguaucugaauaagauggcuggaaacgaauacauggguuucucuaaugccacuuuucaauccgagaaagaaaccggcgaccggaacuaugcaaucggguacuacuuaaaggagaaaaaguguuuccccaagggaguugauaugauggcugcccuggaccucuauuuccagcuuugcucaguggagguaacaugugaaaguggcagcgugauggcggccacucuggcaaauggugggauaugcccuauuaccggcgaguccgucuugucugcugaagccgugcguaacacacuaagccugaugcauucauguggaauguacgauuuuaguggccaguucgcuuuucacguugggcucccagccaaauccgcagugagcggagccauccugcuugucgugcccaauguaauggguaugaugugccugucuccuccauuggacaagcucggcaacucacaucgcgggaccaguuucugccaaaaacugguuagcuuauuuaauuuccacaacuaugauaaccugagacacugugcuaggaagcuagacccccggcgagagggagcggaaauucgcaauaaaacgguggucaaccuccuguuugcagccuacuccggcgaugugucugcucuuagaagguucgccuugucggcaauggacauggagcagaaggauuaugacagccggacugcccugcaugucgcugccgcagagggucacaucgaagugguuaaguuucucaucgaggcgugcaaagugaauccguucgcuaaggaucgcugggggaacauuccucuggacgacgccguacaguuuaaucaucuugaagucgugaaacuguugcaggauuaccaagacuccuauacacucucagagacccaggcagaagccgcugccgaggcacugaguaaggagaacuuagaaucuaugguuuga

SEQ ID NO: 56735 - RNA, 1797 nt, Artificial Sequence
  derived and/or modified sequence opt3 from GLS__Homo_sapiens__NP_001243239
augaugagacugaggggcagcgggaugcuccgggaccuucuguugcgcucccccgccggagugucugcuaccuuacgacgugcacagccucuggucacacuaugcagaaggccacgggguggcgggcgcccggccgcgggacccgcugccgcagccagacuccacccuugguggggcggugggggauggccagcugagccccuggcaaggggccuuucaaguagcccuuccgaaauccugcaagaguugggcaaggggucuacucauccacagcccggaguuucgccuccagccgcuccggccgcgcccgguccuaaagauggcccaggggaaacggacgcauucggaaacucagagggcaaggaacucguggccagcggugagaauaaaauuaagcaggggcugcugcccagucucgaggauuuacuguuuuacaccauagcugaaggacaggagaaaaucccuguacacaaguucauuacagcccuuaaguccacuggcuugcggaccucugacccacgccugaaagaauguauggauaugcuacgacucacacugcaaaccacuagcgacggcgugaugcuugauaaggaccuguuuaaaaagugcguccaguccaacaucguguugcucacacaggcauucagaaggaaauuuguuauucccgauuucaugucauuuaccagucauaucgacgagcuguaugagagcgcuaagaagcagucugggggaaaaguggccgauuacauaccgcaauuagcgaaguucuccccugaccuguggggugucucaguguguacgguagauggccagcggcacagcacuggggacaccaaaguucccuuuugccuccagaguugugugaagccacuuaaauaugccaucgcagucaaugaccugggaacagaauacgugcaucguuaugugggcaaggagccuucugguuugcgcuucaacaaacuauuucugaaugaagaugacaagccccacaacccaauggucaaugcuggggccauuguugugacuucccucaucaagcagggcguaaacaaugcugagaaauucgauuacgugaugcaauuucugaacaagauggccggaaaugaauaugucggcuucagcaacgcaaccuuccagucggagagagagucuggggacaggaauuuugccauuggauacuaccuuaaagaaaagaaaugcuuccccgaggguacagauauggugggcauccuggacuuuuauuuccaguuguguuccauagaaguuaccugcgagucagcuagugugauggcggcaacgcucgccaacgggggauuuuguccuauuacuggcgaacggguccugagcccagaggcugugcgaaauacauuaucccugaugcacucuugcgguauguacgauuucagcgggcaauuugccuuccauguaggccuaccggcaaagucaggaguugccggcgggauccuccuggugguccccaacgugaugggaaugauguguuggaguccuccacuugacaagauggguaacuccgucaaaggcauucacuuuugccaugauuuggugagccugugcaauuuccacaacuaugacaaucuccgccacuuugcuaagaaacuggaucccagaagggaagggggagaccagcggcauucuuucggcccucuugacuacgagucacugcagcaggaguuggcccucaaggaaaccguuuggaaaaaggugaguccagagagcaacgaagauaucuccacuacaguagucuaucgcauggagucucugggugagaagucguga

SEQ ID NO: 56736 - RNA, 801 nt, Artificial Sequence
  derived and/or modified sequence opt3 from GLT1D1__Homo_sapiens__NP_653270
augagacuacucuuccuugccgugcugaggccccacaccggcaacgcugucacagcacagcggguucgcgcccauuuggaggcggcugggcacgugugcguauuaaaggacgccuuugauuucgaaagccgauccgagaucgcaaaucugauucuagccgaaaacugugaggcugcacucgcccugcaucuuuaccguggagguagacuguugcaaggccacaggauaccuuuuggggugaucuucggaggcacugacgucaaugaagaugcuaaccaggccgagaaaaauacggugaugggucggguucucgaggaagcgcgcuuugcaguggccuucaccgagucuaugaaggaaauggcucaggcccagugggucgacccaguguuuacaagagagguaaaagcaaagguuaaaagggcugccggggugcggcugauuggagagaugccgcaagaagaucugcaugcggucgugaagaacugcuucgccguggucaauucaaguguuagcgagggcauguccgcagcuauccucgaagccauggacuuagaggugcccguacuggcucgcaacauuccuggcaaugccgcaguggucaagcacgaagugacugggcuuuuguuuucuaacccacaggaguucguucaccuggccaaacgacuggugucggaucccgcucucgagaaggaaaucgucgugaauggaagagaguauguaaggauguaccauucauggcagguugaacgggacaccuaucagcaacugauacguaaacuugaggguagcacagaagauuga

SEQ ID NO: 56737 - RNA, 831 nt, Artificial Sequence
  derived and/or modified sequence opt3 from GLT6D1__Homo_sapiens__XP_011516939
augaacagcaagagaaugcugcuccuugugcuguucgccuuuuccuugauguuagucgagagguacuuccggaaucaccagguugaggaacugcgccuaucugacugguuucauccccgaaaacguccugaugugaucaccaagacagacuggcucgcuccaguacugugggaaggcacuuucgauagaagggugcuugagaaacacuaucggcgcagaaacauuacggucgggcuggcaguguuugccaccggaagguucgcggaagaguacuugcggccguuucuccauucagcuaauaagcacuucaugacagguuaucgcguuauauuuuacaucaugguggacgccuucuuuaaacugcccgauauugagccuaguccacugcgaacuuucaaggcauuuaaggucggcaccgaaagaugguggcucgacgggcccuuagugcauguaaaaagccugggagagcacaucgccucccacauucaagaugaaguugacuuccuuuucucuauggcugcaaaccagguguuucagaaugaguucggcgucgagacauuggguccucugguggcccagcuacaugcuuggugguauuuuaggaacaccaagaauuucccauacgaacggcgucccacuucggccgcgugcaucccuuuugggcaaggagauuucuauuacggcaaccucauggugggcgggacaccacacaauauacuggacuuuaucaaagaguaccuuaacggagucauucaugauaucaagaauggucugaacucaaccuaugaaaaacacuugaauaaguacuucuaucucaacaagccgacguga

SEQ ID NO: 56738 - RNA, 1116 nt, Artificial Sequence
  derived and/or modified sequence opt3 from GLT8D1__Homo_sapiens__NP_001010983
augagcuucagaaaggugaacaucauuauacugguccucgccguugcucuuuuucuguugguguuacaccauaauuuccugucccuaucuucacuccugaggaacgagguaaccgacaguggcaucguggggccccagccuauugauuuugucccaaaugcacuucggcacgccguggacggacgccaagaagagaucccgguugugauugcggcuagcgaagaucgacuggguggcgccaucgcagccauaaacuccauccagcauaauacacguucuaacgucauuuucuacaucgugacuuugaauaacacggcugaccaccucagaucguggcuuaauucagauagccugaaaaguauuagguauaagaucguaaacuuugaccccaaacucuuagaggggaagguuaaagaagauccugaccagggagaguccaugaagccacugaccuucgcacgguuuuaccuucccauauuggugccuucugccaagaaagcuauuuauauggaugacgaugucaucgugcagggcgacauucuggcccuauacaauacagcgcucaagccaggucaugcagccgcuuucagcgaggauugcgacuccgccucaacuaaaguggucauccgcggggcaggaaaccaauauaauuacaucggcuaucuggacuacaagaaagaaagaauuaggaagcugaguaugaaggcuagcaccuguucuuuuaaccccggcguuuucguggccaaucugacagaguggaaacggcagaacauaaccaaccaguuggaaaaguggaugaaacucaauguagaggaggggcuguacucccgcacuuuagcgggaucaaucacaaccccuccacugcucauuguguuuuaucagcaacacagcacgaucgauccgauguggaacguccgacaccuugguaguucugccggcaagagauacagcccccaguucgugaaagcagcuaagcuguugcauuggaaugggcaccuaaaaccuuggggaaggacugccuccuauaccgacguuugggaaaagugguacauaccagaucccacaggcaaguuuaaccugauucggcguuauacugagaucucgaauaucaaauga

SEQ ID NO: 56739 - RNA, 4683 nt, Artificial Sequence
  derived and/or modified sequence opt3 from GLTSCR1__Homo_sapiens__XP_005258890
auggacgaugaggacggcagaugccugcucgaugugaucugugacccccaggcccuuaacgauuuccugcacgggagcgaaaaguuggacuccgaugacuuacuggauaauccuggagaggcucaaucugcauuuuacgaagguccaggccuacauguccaggaggccucagggaaccaccucaauccggaacccaaccagccugcgccaaguguugaccuggauuuccuugaggacgauauucugggaagccccgcuaccggcggugggggaggcggcuccgggggagccgaccagccuugcgacauauugcaacagucucuccaggaggcaaauaucacagaacagacucuggaggccgaagcugagcuggaucucgguccauuucaauuacccacgcugcagccugcagacggcggggccggaccaaccggcgcugguggggccgcggcaguggccgcuggaccgcaggcccuuuuccccggcucgacagauuugcugggccuacaggggccuccaacuguacucacccaucaagcacuggugcccccucaggacgucgugaacaaagcucuuucaguucagccauuucugcaacccgugggauuggguaaugucacacuccagccgauuccuggccugcagggguuacccaacggaagcccaggcggugccaccgcggccacucuggggcucgcaccuauccaggugguaggccaacccguuauggcucuuaauacaccaaccagucagcuguuggccaaacaggugcccgucuccggauaucuagcuucugccgcaggcccuagcgagccagugacgcuggccuccgcuggggugucaccgcagggagcgggucucgucauucaaaagaaccugagugcagccguugcuacuacccuuaauggcaacagcguguucgggggagccggcgcagccucugcucccacagguacuccuuccgggcagccacuggccguagcacccggcuugggaucaagcccucucgugccagcgcccaaugucauccugcacaggaccccgacaccuauacagccaaagcccgcuggcguguuaccucccaaacuguaccagcuaaccccaaagccuuuugcccccgcaggggccacgcucacuauccaaggagaaccaggugcucugccgcagcagccuaaggcaccccagaaccuuacauucauggcagcuggcaaagccgggcaaaauguuguguugaguggauuuccagcgcccgcccugcaggcuaacgucuucaagcagccuccagcaaccacuacaggcgccgcucccccucaaccgccaggugcccucucuaaacccauguccgugcaucugcuuaaccaggggagcucgauuguaaucccugcacagcacaugcugccaggccagaaucaauuuuugcuccccggagcgccugccguucagcugccgcagcaguuaucugcucugcccgccaacgugggcgggcaaauucuagcagcugccgcaccacacaccggaggccagcucaucgccaauccuauacugacgaaccagaaucuugcuggucccuugucccuggggccaguccucgcgccucauucaggagcccacagugcacauauucugagcgcugcccccauccaggugggccaaccagccuuauuccagaugccggucucccuggcugcagguucucuuccuacccagagccaacccgccccagcgggccccgcugccacaacuguguugcaggggguuacccucccuccaucagcaguggccaugcugaacacacccgauggccuaguacagccugcuacuccggcagccgcgaccggagaggcugccccaguccugacagugcagcccgcaccucaagcucccccagcuguuaguaccccucucccccuggggcuucagcagccacaggcccaacagccuccgcaggcacccacuccacaggcugccgcgccuccccaagccacgacaccacagccuucccccggauuggcaagcucuccggaaaagauugugcugggccagccaccuucagcuacccccacugccaucuuaacccaggacagucuccaaauguuucugccacaggagcggagccagcaaccccuuuccgcugaagguccucaccugucugucccggcaucggugaucguaagcgccccacccccugcccaggaucccgcuccugcgacaccaguggcaaaaggggccggauugggcccccaggcuccugacucccaggccucaccagcacccgccccgcaaauuccugcugcggccccacucaagggucccggcccuaguucuagcccaucccugccccaccaggcaccgcuaggggauucaccucaucugcccagcccacacccuacccgcccacccucucgacccccuucccguccacagaguguuagcagaccgcccucugagccuccacuccaucccuguccuccaccccaggcuccuccgacucugccaggaauauucgucauccaaaaucagcuuggcgugcccccucccgccuccaacccagcaccuacagcccccgggccaccgcagccucccuugaggccacagucacaacccccugagggaccacugcccccugcuccgcacuuaccacccaguagcacgucguccgccguggcgucuagcucagaaaccaguucccggcucccugcaccaacucccucugacuuccagcugcaguuuccucccagccaaggcccacauaaguccccgacaccucccccaacccuucaccuggucccugagcccgccgcuccaccucccccgccaccucgcacauuccagaugguuacuacccccuuuccagcccuaccccagccuaaagcucuccuggaaagauuccaccaggugccgucagguauuaucuugcaaaauaaggcagggggagccccagcugcaccccagacgagcaccagucugggcccuuuaacaucucccgccgcguccgugcucguaagcggucaggccccaucgggcacuccuaccgcucccucacaugccccagccccugcuccgauggccgcaacagggcugcccccacuucugccugccgagaacaaagccuuugcgucuaauuugcccacucucaacgucgccaaggcagcuaguuccggaccaggcaaaccuagcgggcugcaguaugaaucuaagcuaagcggacugaaaaagcccccgacccuucaaccauccaaggaggccugcuuccucgagcaucugcacaaacaccagggcucaguguugcacccugauuacaagacggccuuucccaguuucgaagacgcacugcauagguuacucccauaucacguuuaccagggugcucugcccagcccuucugacuaucauaaaguggaugaggaauuugagacagucuccacccagcuucugaagcggacucaagccauguugaauaaauaccgccuccugcuacuggaagagucacgaagagugagucccagcgcggagaugguuaugauagacaggauguucauucaggaagagaagacaacccuugcucucgauaagcagcuggccaaagaaaagccagacgaguacguguccucuucgcggagcuugggguuaccuaucgcagccucauccgagggacaccgucugccgggccauggcccccucaguucuagcgcuccaggggcauccacucagccucccccacaucugccuaccaaacuuguaauccgccacggaggugccggcgggucacccucugucacaugggcgagagcuagcaguucccugucuagcucauccaguagcucgucugccgcauccagcuuggaugccgacgaagauggaccgaugccuucaaggaaccggccacccauuaagacguaugaggcucgaagucgcaucggccuaaaacugaagauuaagcaagaagccggucucucuaaaguggugcacaauaccgcacuggacccuguccaccagccacccccuccacccgcuacucuuaagguugccgagccgccucccagaccacccccuccacccccuccaacagggcagaugaacggaaccguggaucauccgcccccugcggccccagaaaggaaacccuuaggcacagcaccucacuguccacggcugccccuccgcaagacuuacagagagaacguaggcgggccgggagcuccugaggguaccccagccggcagggcacgugggggaucccccgcuccuuugcccgccaaaguggacgaagccacgagcggccugauacgggagcucgcggcugucgaagaugagcuguaucaacgaaugcuuaaggguccaccgccugaacccgcagccucagcugcccaggggacaggagacccagauugggaggcacccggccugccuccagccaagagaaggaaaagugagagccccgacguggaccaggcuuccuuuucuagcgauuccccucaggacgauaccuugacugaacaucuacaaucagcgaucgacucuauucugaaucuccagcaggccccaggccgcaccccggcacccaguuacccucacgcugccucggcagggacaccagccagcccucccccauuacaccggcccgaggcuuauccuccguccucucauaacggaggucugggcgccagaacucuuaccagguga

SEQ ID NO: 56740 - RNA, 1437 nt, Artificial Sequence
  derived and/or modified sequence opt3 from GLTSCR2__Homo_sapiens__NP_056525
auggccgcuggcgggagcggaguggguggcaagagauccucuaaaucagacgcagauaguggguuccugggacucaggcccaccagcgucgacccugcccuucggcgccgacguagaggcccaaggaacaagaaacgggguuggcgcagacuggcgcaggagccguugggguuagaaguugaucaauuucuggaggacgugaggcuacaggaacggacauccggaggccuccugucugaggcucccaaugaaaaacuuuucuuuguagauacuggcucgaaggagaaggggcugacgaagaaacgcaccaaggugcagaaaaagucauugcuccugaaaaagccucugcgagucgaccucaucuuagagaacacaagcaaggugccagcccccaaagauguucuggcacaccaggugccuaaugccaagaaacuuagaaggaaggaacaauugugggagaaacuggcuaagcagggagaacuaccacgggagguccgucgcgcacaggccagacuccugaaccccagugcuacuagggccaaaccugguccacaggacaccguggagcggccguucuacgaucuuugggcguccgacaauccccuggaucgaccuuugguaggccaagacgaauuuuuccucgagcagacaaagaagaaagggguuaagcgcccagcaagacugcauaccaaacccucucaggccccugcuguggaagucgccccagcaggagcuagcuauaaccccuccuuugaggaucaccagacuuuacugucagccgcgcaugaaguggagcuccaaaggcagaaggaggccgaaaaacuugagcggcagcuggcauugccggcuacagaacaagccgcuacccaggagaguacguuccaggaacuaugcgagggccugcucgaggaaagcgacggugagggggaaccuggacagggcgagggccccgaagccggggacgcagagguguguccaacuccugcccgccuggcuaccacagagaagaagacugaacaacagagaaggcgugagaaagcgguccaccggcuucgaguucagcaggcagcccugagagcugccagguugcgccaucaagaacucuuucggcugagaggaauuaaggcacagguggccuuaaggcuggcugagcuagcccgccgacagcggcguagacaggcaaggcgcgaggcggaagcugauaaaccccggagacucgguaggcugaaguaccaagccccagacauagauguacagcuuucuuccgaguugaccgacucacugcgaacacucaaacccgaaggcaauauccugcgcgaucgguucaagagcuuucagagaaggaacaugauugagccucgugaacgcgcaaaguucaaacggaaguauaaagugaaacuugucgagaagagagccuuuagggagauccagcuguga

SEQ ID NO: 56741 - RNA, 1677 nt, Artificial Sequence
  derived and/or modified sequence opt3 from GLUD1__Homo_sapiens__NP_005262
auguacagauaucugggcgaggcccuccuucugagcagggcugggcccgcagccuugggauccgcgucugcugacucagccgcauuacuggguugggcccggggccagccugcugcagccccacaaccggggcuagcucucgccgcgcgccgacacuacagugaagcaguggccgaucgugaggacgaucccaacuucuuuaagauggucgaaggauucuuugacagaggcgcuagcaucguugaggauaaacugguggaagaccuuaggacccgggaguccgaggaacagaagcgcaauagaguaagggguauucugcggauaaucaaaccuugcaaccauguguugucucucucguucccaauucgccgagaugacgggucaugggaggucaucgaaggauauagagcccagcacagccagcauaggacacccuguaagggcggcauucgguacaguacugauguguccguugacgaggugaaagcacuggcuucucugaugacguauaagugcgccgucguggauguaccuuuugggggagcgaaggccgguguuaaaaucaauccaaagaacuacaccgacaaugagcucgagaaaauaacacgucgcuucacuauggaauuagcaaagaaaggcuuuaucgggcccggaauugaugugccugcuccagacaugagcaccggcgaaagagagauguccuggaucgccgacacauaugcuucaaccauuggucacuacgauaucaacgcccaugcaugugucacugggaagccgauaagucaaggaggcauucacggcaggaucagcgccacagggcggggaguguuccacgguauugaaaauuuuaucaacgaggcuucuuacauguccauccugggcaugacccccggguucggagacaagacguuugugguccagggcuucgguaauguugggcuucauucaaugcgauauuugcaccgcuuuggcgcgaaaugcauugcagugggagagagcgauggcaguauauggaacccugacgggaucgauccaaaggaacuggaggacuucaaacuacagcauggaucuauucucgguuuccccaaggccaaaccuuacgaaggcuccauccuggaggcugauugugacauacuuauuccagccgcaagcgaaaagcagcugacuaaaucgaaugcccccagaguaaaggcuaagaucaucgccgagggggcaaacggaccgaccacaccugaggcggauaaaaucuuuuuggaaaggaauauuauggugauucccgaccucuaucugaacgcuggcggugucacugugucuuacuucgagugguuaaagaaucugaaccacguuuccuaugggcggcucaccuuuaaauacgaacgcgauucaaacuaucaccuucugaugagugugcaagagagcuuggaaagaaaguucggcaaacauggaggcacaauaccaaucgucccuaccgccgaguuucaggacaggauuuccggggcaucugagaaggacaucgugcacagcggacuagccuacacgauggaacguucagcucggcagaucaugcgaacugccaugaaguacaaucugggucucgaucugagaacagcagcuuauguaaacgccauugagaaaguuuucaagguguacaaugaagcgggcgucaccuuuacuuga

SEQ ID NO: 56742 - RNA, 1677 nt, Artificial Sequence
  derived and/or modified sequence opt3 from GLUD2__Homo_sapiens__NP_036216
auguacagauaucuggccaaggcucuccuucccagcagggcaggcccugccgcgcugggguccgcugccaaccacucugcagccuuguuaggacggggucgcggccagccagcugcagccucacaaccggggcuggcucuagccgcgcgacgucauuacagugagcucguggcagacagagaagaugaccccaauuucuuuaaaauggucgagggauucuuugauaggggcgccagcaucguugaagacaagcuggugaaagaucuucggacccaggaguccgaggaacagaagcgcaacagaguaagggguauucugcggauaaucaaaccuugcaaucacguguugucucucucguucccaauucgccgagacgaugggucaugggaggucaucgaaggauauagagcucagcauagccaacacaggacacccuguaagggcggcauucgguacaguacugacguguccguugaugaggugaaggcccuggcaucucugaugacguauaaaugcgcugucguggacguaccuuuugggggagccaaggcggguguuaaaaucaacccaaagaauuacaccgaaaacgagcucgagaaaauaacacgucgcuucacuauggaauuagccaagaagggcuuuaucgggcccggaguggaugucccugcaccagacaugaauaccggcgagagagaaaugagcuggauugcugauacauaugccuccaccaucggucauuacgacauuaacgcucacgccugugugacugggaaaccgaucucacagggaggcauacacggcaggauuagugcaacagggcggggaguguuccaugguaucgagaauuuuauuaacgaagccagcuacaugucuauccugggcaugacccccggguuccgagacaagacguuugucguucagggauucggcaaugugggucuucacuccaugcgcuauuugcauagauuuggggcuaaaugcaucgcgguaggcgagucagauggaagcauuuggaacccugacggcauagauccaaaggagcuggaagacuucaaacuacagcacgggaguauccucggauuccccaaggcaaaaccuuacgaggguucuauucuggaaguggauugugacauccuuauaccagccgcuacugagaagcaacugaccaaguccaaugcccccagggucaaagcaaagauuaucgccgaaggcgcuaacgggccgacaacuccugaggccgauaaaaucuuuuuggagcggaauauucucgugauccccgaccuguauuuaaacgcaggaggcguuaccgugagcuacuucgaauggcugaagaaccucaaucacgucucguauggucgccuuacauuuaaauacgagagagauucuaacuaucaucuguugcuauccgugcaggaaucacuggagaggaaguucgggaagcacggcggaaccauuccaauaguaccuacggcggaauuucaggacaguaucagcggcgcuuccgagaaagauauuguucauucugcccucgcauacacuauggagcguagcgcccggcagaucaugcacacagcuaugaaguacaaucuggggcuugaccugcgaaccgccgcauaugugaacgcuaucgaaaaagucuucaagguguacucagaggccggagucacuuuuacauga

SEQ ID NO: 56743 - RNA, 1122 nt, Artificial Sequence
  derived and/or modified sequence opt3 from GLUL__Homo_sapiens__XP_006711341
augaccacaagcgccuccucucaccugaacaagggcaucaaacagguguacaugucacucccccaaggggagaagguccaggcuauguauauuuggauagacggaacuggugaaggccuuagaugcaaaacgaggacccuggauagugagccuaaguguguugaagaguugccagaauggaauuucgacgggagcuccacauuacagucugagggaucgaacucagauauguaccuggugccggcagccauguuucgggaccccuuccgcaaagauccuaauaagcuaguacucugcgagguguuuaaguauaaccgacguccagcggaaacuaaucugagacauaccuguaaaaggaucauggacauggucagcaaccagcaccccugguucggcauggagcaagaauacacacuuauggguaccgaugggcauccuuuuggauggccaaguaauggcuuccccggcccucaggggccauauuacugcggagugggugcugaccgggccuauggccgcgauauuguugaggcacacuacagagccugucuguacgcuggggugaagaucgcaggaacuaacgccgaggucaugccggcucagugggaauuucagauuggccccugcgaggguaucuccaugggggaccauuuguggguggccagguucauacuccaccggguaugugaagauuuuggaguuaucgcgacauucgacccuaaaccaauucccggcaauuggaacggcgcagggugccacaccaauuuuucuacgaaggccaugcgcgaggaaaacggacugaaauauaucgaggaggcuauugaaaagcugagcaagcgacaucaauaccacaucagagccuaugauccuaaagguggccucgacaaugcaaggcgguuaacuggguuccaugagaccuccaacauaaaugacuuuucagcuggaguggccaaccguagugcgagcauucgcaucccaagaacagucggccaggaaaagaaagguuacuucgaggauaggcggcccucugccaacugugacccguucuccgugacugaagcacugauucgaaccugccuuuugaaugagacaggggaugagccuuuucaguauaagaacuga

SEQ ID NO: 56744 - RNA, 492 nt, Artificial Sequence
  derived and/or modified sequence opt3 from GLYAT__Homo_sapiens__NP_005829
augaugcugccccuccagggcgcccaaaugcuucagaugcuggaaaagagcuugagaaaauccuuaccugcuucucugaagguguacgggaccgucuuccacaucaaccauggaaauccauuuaaccuaaaagcaguuguggacaaguggccggauuucaauacaguaguggucugcccccaggagcaggacaugacugaugaccucgaucacuauacgaacaccuaccaaauuuauucaaaagacccucagaauugucaggaguuucuggguaguccagaacuuauaaacuggaagcagcaucugcaaauccagagcucccagcccucuuugaaugaggccauucagaaccucgcggcuaucaagucguucaaagugaagcaaacacagaggauucuguacauggccgcagaaacugccaaagagcugaccccuuuucucuuaaagucaaaaauccugagcccaaauggcgggaagcccaaggcuauguga

SEQ ID NO: 56745 - RNA, 867 nt, Artificial Sequence
  derived and/or modified sequence opt3 from GLYATL3__Homo_sapiens__NP_001010904
augcuggugcucaacugcagcaccaaacuucugaucuuggagaagauguuaaaguccuguuuccccgaaucucugaaagucuacggcgccguuaugaauauuaacagagggaauccuuuucagaaggaggugguacuagacucauggccagauuucaaagcugugauaacaaggcggcaacgcgaagcagagacugacaaccucgaucacuauacgaaugccuacgcggucuuuuauaaggacgugcgagcuuaccgucagcugcuugaagagugcgauguuuucaacugggaccagguguuucagauccaaggacugcagagugaguuguaugaugucagcaaggccguggcaaauuccaaacagcucaacauuaagcugaccucuuucaaagccguacauuuuucgccgguuucaagccugcccgacacaaguuuccucaaggguccuuccccaagauuaacuuaccugucuguggcuaaugcagaucuuuugaacaggaccuggagccggggcgggaaugaacagugucugcgcuauaucgccaaccuaauuuccugcuuucccucagucugugugagagacgagaaaggaaauccugugaguuggagcaucacagaucaauucgcuaccaugugccacggcuacacucucccagaacauaggcggaaggguuacucucgccuggucgcccuuacacuggcgcgaaaguugcaguccagaggguuucccucacagggaaacguucucgacgauaauaccgcaagcauaagucuguuaaaaucucugcacgccgaguuccucccuuguagguuucaucggcuuauccugacgccagcuacuuucuccggcuugccgcaccuauga

SEQ ID NO: 56746 - RNA, 705 nt, Artificial Sequence
  derived and/or modified sequence opt3 from GLYCTK__Homo_sapiens__NP_001138423
auggccgcugcacuccaggugcuccccagacuugccagggcgccucugcacccauuguuauggcggggcagcgucgcucgccuggccuccucuauggcacuagccgagcaagcucgacagcuguucgaaucagcaguuggggccgugcugccgggacccaugcuucaucgugcucugaguuuggacccugguggcagacagcucaagguaagggaucggaacuuucagcugcgccaaaaucuguaccucgugggguucggaaaagccgucuuaggcauggcggcagccgcugaggaacugcuuggucagcacuuggugcaggggguuaucagcgugccaaagggaauuagagccgcaauggagagggcuggcaaacaggaaaugcugcuaaagccccauucccggguccaaguguuugagggcgccgaggacaaccucccugaucgcgacgcgcugcgagccgcacuugcuauacagcagcuggccgaaggguugaccgcugaugaccuccuguuaguacugaucucuggaggugagccacaccccguuagaugcggcgggggaccuuguggcggugauugccaguggccacauagggggcaauucccgcagugugcccggcuccccgcauauccucagucgcuucguccacccugcagcccugccacauuuugugaagacugcgcugugucaggacgccuguga

SEQ ID NO: 56747 - RNA, 582 nt, Artificial Sequence
  derived and/or modified sequence opt3 from GM2A__Homo_sapiens__NP_000396
augcagagccugaugcaagcuccccuccuuaucgcccugggcuuguuacuggcagccccugcgcaggcucaccuaaagaaaccaucccagcucucuucauucaguugggacaacugcgaugaggggaaggacccggccgugauuagaagccugacccuugaacccgauccuauaaucgucccaggaaauguuacacuguccgugauggguucuacuucgguacccuugucaagcccucucaaaguggaccugguccuggagaaggaaguggcaggccucuggauuaaaaucccauguacggauuacauugggaguugcaccuuugagcauuucugugacguuuuagauaugcugauccccacaggagaaccuugcccagagccgcuuaggacuuauggcuugcccugucacugcccuuuuaaggaggguaccuacucccugccaaagucugaguucgugguccccgaccuagaacucccuagcuggcugacaaccgggaacuaucggauagaauccgugcuuucaaguagcggaaaacgccugggcuguaucaagauugccgcuucuuugaaaggcaucuga

SEQ ID NO: 56748 - RNA, 1548 nt, Artificial Sequence
  derived and/or modified sequence opt3 from GMCL1__Homo_sapiens__NP_848526
augggcagccuguccucuagagugcucaggcagccccggccugcccuugcucaacaggcacagggggcccgcgcgggagguucagcucgacguccagacaccggcgaugacgccgcagggcacggauucugcuacugugccggcagucauaagagaaaaaggagcuccgguucuuuuugcuauugucacccggauucggagacagacgaagaugaggaagagggggacgaacagcaacggcuguugaacacuccccgcagaaagaaauuaaagucaacgagcaaauacaucuaucagacccuguuccuaaauggagagaacagugauauuaagauaugcgcucucggcgaggaauggucccugcauaagaucuaccuuugucagucuggcuauuuuagcuccauguucucagggaguuggaaagagagcucuaugaauauuaucgaacuggagauuccugaccagaacaucgaugucgaggcauugcaaguugccuuuggaucccucuacagggacgaugugcugauaaagccaucacggguaguggcuauccuggccgcggcaugccucuuacagcuggacggucuuauucagcaguguggcgaaacaaugaaagagacugucaaugugaagaccguuugcggguauuacacaagcgccggaaccuacggcuuggauagugugaaaaagaagugucuggaauggcuacucaacaaucugaugacucaccaaaacgucgagcuuuucaaagaacugucuaucaaugugaugaagcaguugauugguuccagcaaccucuuuguaaugcagguugagauggacaucuauacagcucugaaaaaguggauguucuuacaacuggugcccucguggaaugggucucucaaacagcuucugaccgagacggacgucugguuuuccaagcagcgcaaagauuucgaaggaauggccuuuuuggagacugaacagggcaagccuuucgugucaguguuucgacaucuaagacugcaauacauaauuagugaccucgcaagcgcuaggaucauugagcaggaugccgucguuccauccgaauggcugucuagcguguauaagcagcagugguucgcgaugcuucgggccgagcaagacucagagguaggcccccaggaaaucaacaaagaggaacuggaggggaauaguaugcguugcggacgcaaguuggcaaaagauggugaauacuguuggagauggaccggcuucaacuuuggguucgaccuccuggugacauauacuaauagguacaucauuuuuaagcggaacaccuuaaaccagccuugcuccggaagcgucucucugcagccacgacgcucaauagcuuucagacuaaggcucgccaguuuugauagcuccggcaaacugaucugcucucggacaaccgguuaucaaauucuuacguuggagaaggaccaggaacaggugguuaugaaucuggauucgcgccuccugaucuucccgcuuuacauauguugcaacuuucuguacauuagccccgagaagaaaaauuga

SEQ ID NO: 56749 - RNA, 1029 nt, Artificial Sequence
  derived and/or modified sequence opt3 from GMDS__Homo_sapiens__NP_001240775
augugcaagauggacggcagcuaccuggccgaguuccuccuugaaaaaggguaugaggugcacggaaucgucagaagguccucuucauuuaacaccggucggauugaacaucuguacaagaauccccaggcucacauagagggcaacaugaaauugcauuauggggauuuaacagacaguacuugucugguuaagaucauuaaugaagugaaaccuacggagaucuacaaccuaggagcacaaagccacguaaagauuuccuucgaucucgccgaguauaccgcggacguggauggcgucgguacacugcgccuucuggacgcugugaagacuugcggguugaucaauucuguuaaauuuuaccaggccucgaccucagaacucuauggaaaggugcaggagauaccacagaaagaaacaaccccguucuacccccgaagcccuuacggcgcagccaagcuguaugcuuacuggaucgucgugaacuuucgugaggcauauaaucuguucgccguaaacggcauucucuuuaaucaugagaguccaagaaggggagcuaacuucguuacucggaaaaucucccgcucuguggccaagauuuacuuagggcaacuggaauguuuuagccuugguaauuuggaugcgaagagagacuggggccacgcaaaagauuaugucgaggccauguggcugaugcuacagaacgacgaacccgaggauuucgugaucgcuacaggggaagugcacuccgucagggaguuuguugagaagucauuccuccauauaggaaaaaccauugugugggaaggcaagaaugagaacgaaguaggucggugcaaagagacggggaaggugcacgucacuguggaccugaaauacuaucgcccuaccgaaguugauuuucuucagggagacuguacaaaggccaagcagaaacugaauuggaagccacgaguggcauucgacgaguuggucagagagauggugcaugcugauguagaacucaugaggacuaaccccaacgccuga

SEQ ID NO: 56750 - RNA, 429 nt, Artificial Sequence
  derived and/or modified sequence opt3 from GMFB__Homo_sapiens__NP_004115
augagcgagucccugguggucugcgacguugccgaagaucucguggagaaacuuagaaaguucagguuucggaaggaaaccaacaaugcugcaaucauuaugaaaauagacaaggauaaacgccugguaguguuggacgaggaauuagagggcaucucucccgaugagcugaaggacgaacuaccugagcgacagccacguuucauugucuacucauauaaguaccaacacgaugacgggagagugaguuauccgcucuguuuuaucuucagcucccccguuggaugcaaaccugaacagcagaugauguacgccgguucuaagaacaaacuggugcagacagcggagcuuacuaaggucuuugagauuaggaauacggaagaucugaccgaggaaugguugcgggagaaacucggcuucuuucauuga

SEQ ID NO: 56751 - RNA, 429 nt, Artificial Sequence
  derived and/or modified sequence opt3 from GMFG__Homo_sapiens__NP_004868
augagcgacucccugguggucugcgagguugaucccgaacucaccgagaaacuuagaaaguucagguuucggaaggaaacagacaacgccgcuaucauuaugaaaguggauaaggaccgccagaugguagugcuggaggaagaguuccaaaauauaucuccugaggaauugaaaauggaguuaccagaacgacagccgcguuuugucguguacucauauaaguacguucacgaugacggcagagugaguuauccccuguguuucaucuuuagcuccccugucgggugcaagccagagcagcagaugauguacgcaggaucuaaaaacaggcuagugcaaacugccgagcucacgaagguauucgaaauucggaccacagaugaccugacugaggcguggcuucaggaaaaacugucguuuuuccgcuga

SEQ ID NO: 56752 - RNA, 2826 nt, Artificial Sequence
  derived and/or modified sequence opt3 from GMIP__Homo_sapiens__NP_001275927
auggacgccgcugagcccggccugccuccagggccggaaggaagaaagagguacagcgauaucuuccggucccucgacaaccuugagauuucucuggguaaugugaccuuggaaauguuagcaggcgauccccugcuaucagaggacccugaaccagauaaaacacccacugccacggucaccaacgaggcgaguugcuggagcgggccuuccccagagggacccguuccucucacaggcgaagaacuggaccuucgccugauacgaacuaagggugggguggaugcugccuuggaauaugcaaaaaccuggucucguuacgccaaggagcuccuggcuuggacagagaaaagagcaucguaugaacuggaguuugccaagucaaccaugaagaucgcugaagccggaaaaguaagcauucagcaacagagucacaugccacuccaguacaucuauacuuuauuccuggagcaugaccuuuccuugggcacacuggcgauggaaaccguggcacagcaaaagagggauuacuaucagccgcuagccgcuaaacggacggagauugagaaguggcgcaaagaauuuaaggagcaguggaugaaggaacagaaaagaaugaaugaggccguccaagcacucaggcgggcucagcugcaguacgugcagcgcucugaagaccuucgagccagaagccaaggcucccccgaggauucagcgccucaggccaguccagggcccagcaagcagcaagagaggcggcgucgcucuagagaagaggcacaggcuaaagcccaggaagcugaggcccuguaccaggcauguguuagggaagccaacgcucggcaacaggacuuggagaucgcgaagcagcgaauagugucccacguccgcaaacucguguuccagggagaugagguacugagaaggguuacuuuaucacuguuuggucuccggggcgcacaagccgaacgcgggccuagagcuuucgccgcacuugccgagugcugugcuccauuugaacccggacagagguaucaggaguucgugcgugcccugcggccggaggcaccucccccaccucccccagcguuuagcuuccaggaauuuuugcccagucuaaauucuuccccucuggacauccgaaagaaacucagcggcccacugccgcccagacuugacgagaacucggcugaaccugguccaugggaggaucccgggaccggauggagguggcaaggcccuacaccaggcucugacgucgauuccgucgggggagguucagaaagucgcagccuggacucccccacuucuagcccggauuugggcgacgggcucgagaauggacugggcucaccuuucgguaaguggaccuuaaguuccgccgcacagacacaucagcugcggagacuaagggggccagccaagugccgcgagugugaggcuuuuauggugagcggcaccgagugcgaagaguguuuccucacgugccacaaacgaugucuggaaacucuuuugauucugugcggacaucggcgucuccccgccagaacaccucuguucggcguggauuuucuucagcugcccagggacuucccagaggagguuccuuuugugguaaccaaguguacugcagaaaucgagcaccgcgcuuuggaugugcaagggauuuaccgggucucuggaucaagagugaggguugaacgacucugccaggccuucgagaacggucgcgcgcugguggaauuaaguggcaauagcccccacgacgucuccucugugcugaaacgguuucuacaggagcucacagagccaguaaucccguuccaucuguaugaugccuuuauaucgcuugcuaagaccuugcacgcagacccuggggacgaucccggaacgccaagccccuccccugaaguuauuagaucacugaaaacccuccuggugcaauuaccagacaguaacuacaauacacugaggcaucuugucgcccacuuguuccguguggcugcccgcuuuauggagaacaagaugucugcaaauaaccucggcaucgucuucggucccacucugcuacggccuccggaugggccaagagcggccagcgcuauucccgugaccugccugcucgacuccggccaccaggcccagcugguugaauuucuuaucgugcauuaugagcagaucuucggaauggaugaguugccucaagcaacagaaccacccccucaggacucaagcccggcucccggcccacugacuaccucuucccagccucccccaccucacuuagaucccgacagucagccaccgguacucgccagcgauccugggcccgacccacaacaucacucuacacuggagcagcaucccaccgcaacuccuacggaaauuccaacaccccaguccgaucagagggaggacgucgccgaagauaccaaggacggagguggcgaggugucaagucaagggccugaggacagccuucugggaacucagucgcgaggccacuuuucccggcagccgguuaaauacccacgcgguggggugagacccgucacccaccaauugucuagccucgcucugguggcgucaaagcuaugugaagagacaccuauaaccaguguacccaggggcucccugcggggacgaggcccaucuccugccgcagcuagccccgaaggguccccacucagacgcacuccucugccgaaacauuucgagaucacacaggaaacggccaggcuuuugucaaagcuggauagcgaggccgugccccgugcuaccugcuguccagacguucagccugaggaagcagaggaucacuuauga

SEQ ID NO: 56753 - RNA, 510 nt, Artificial Sequence
  derived and/or modified sequence opt3 from GML__Homo_sapiens__XP_011515271
auggagcccggcagcagacugcucagggaagugaugcuucuguucgccuuguuacuggcuauggagcuaccucucgucgcagccuccgcgaccaugcgggcucaguggacauacucucugcgcugccacgacugugccguuaucaacgauuuuaauugcccaaacauucgaguguguccguaucauauacguagaugcaugacuaucucaauuaggaucaauagucgggaacuucugguauacaagaacuguacgaauaacugcaccuucguguaugcagccgagcaacccccugaagcuccagggaaaauuuuuaagacaaauagcuucuacugggucuguugcuguaacuccauggugugcaaugcaggaggucccacuaacuuggagcgcgacaugcucccugaugagguuaccgaagaggaacugccagagggcacagugagacugggggucucuaaacucuuacugucguuugccucaaucauagugagcaauauccuucccuga

SEQ ID NO: 56754 - RNA, 630 nt, Artificial Sequence
  derived and/or modified sequence opt3 from GMNN__Homo_sapiens__XP_005249216
augaaccccagcaugaagcagaaacaagaggaaaucaaggagaauauuaaaaacuccucugugccuagaaggacccugaagaugauacagccaucagccaguggcagccucgucgggcgggaaaaugagcuuuccgcuggacugucuaaacgcaagcaccgaaacgaccauuugacaucgacuacgucaagcccggguguuaucgugcccgaaaguuccgagaauaagaacuuaggcgggguaacccaggagucuuucgaucugaugauuaaagaaaauccuagcucccaguacuggaaggagguggcagaaaaacguagaaaggcccuauaugaggcgcucaaagagaacgaaaagcugcacaaggagaucgaacaaaaagacaaugagauugcuaggcuuaagaaagaaaacaaggagcuggccgaggucgcagaacaugugcaguacauggccgaguugaucgaacggcucaauggagagccacuggauaacuuugaaucacuggacaaucaggaguucgauagugaggaagagacaguugaagacagccucguggaggauucugaaauaggcacuugcgcugaggguaccgucuccucaagcacagacgcaaaacccuguaucuga

SEQ ID NO: 56755 - RNA, 1263 nt, Artificial Sequence
  derived and/or modified sequence opt3 from GMPPA__Homo_sapiens__NP_995319
augcugaaggccgugauccucauuggcgggccccagaaaggaaccagauucaggccucuuagcuuugaggucccaaagccgcuguuccccguugcuggugugccuaugauacaacaccauaucgaagcaugcgcccagguaccaggcaugcaggagauuuuguuaaucggguuuuaccagcccgacgaaccucugacacaauuccuagaggcggcucagcaggaauuuaaccucccagugcgguaucugcaggaguucgcaccccuuggaacuggcggugggcuguaccacuuucgcgaucaaauuuuggccggauccccugaggccuucuuuguccucaaugcugacguguguucugauuucccacugucagcaaugcuggaagcccaucgacgucagagacacccguuucucuuacugggcacgaccgcuaacaggacacagagucuuaauuauggcugcaucguugagaacccccagacucaugaaguguugcacuacgucgagaaaccuagcaccuucauauccgacaucauuaauugugggaucuaucuguuuucuccagaggcccuaaagccccuccgggauguguuccaacgcaaccagcaggacggacaacuggaagauucgccuggucuuuggccaggcgcggggacaauuagacuggagcaggacguauucucagcauuggccggacagggccagaucuacguucaccucaccgaugguauauggagccaaauuaaaagugcuggguccgcccuguaugcaucuagguuauaccugagccgguaccaggacacucaucccgaacgccucgcuaagcacacaccgggaggcccuuggauccgaggcaauguguauauucaucccaccgccaaggucgcgccauccgccgugcuugggccuaacgugucaaucggaaaaggugucacgguuggcgagggggugagacugagggaaaguaucguauugcacggagcaacucuacaggagcauaccugcgugcugcacagcauugucggcugggguucuacaguggggcggugggcucguguugagggcacucccuccgauccaaaucccaacgacccucgcgccagaauggauucagaaagccucuuuaaggacggaaaacugcuuccagcuauaaccauccugggcuguagggugcggauuccggccgaggucuugauccucaauaguauagugcugccccacaaggaauuaucucgauccuucacaaaccagauuauccuguga

SEQ ID NO: 56756 - RNA, 1164 nt, Artificial Sequence
  derived and/or modified sequence opt3 from GMPPB__Homo_sapiens__NP_037466
augaaggcccugauccucgugggcggguacggaaccagacuuaggccccugacauugagcacuccuaaaccauuagucgacuucugcaacaagccgauucugcuacaccagguugaggcucucgcagccgcggguguggaucauguaauacuggcuguguccuauaugucucaaguccuugaaaaagagaugaaggcccaggaacagcggcugggcauccgcauuucaaugagucacgaggaggaacccuuggggacggcaggaccucucgcccuggcucgagaccugcucagcgagaccgcagauccauuuuucguguuaaauuccgacguuaucugugauuuucccuuccaggccauggugcaauuucaucgucaccauggccaggaagguucuauucuggucacaaaaguggaggaaccuucgaaguacgggguaguugugugcgaggcugacacuggaagaauccacagguucgucgagaagccacagguguuugugucaaacaaaauaaaugccggcauguauauccuuagccccgcggucuugcggcgcauucagcugcaaccuaccaguaucgaaaaggagguuuucccaauuauggcaaaagaaggccagcuauacgccauggagcuccagggguuuuggauggauaucggacagccgaaggacuuccugacagguaugugucuuuuucugcaauccuugagacagaaacagcccgaaaggcucugcucuggcccugggauagugggaaacguacugguggauccaagcgcucggauuggccaaaauuguuccaucggucccaacgucucauuagggccuggagugguuguggaggacggcgucugcauucgccgauguaccgugcugagagaugccaggauccggagucacagcuggcucgagucuugcaucguaggcuggcguugucgcguugggcagugggugucccuuugggcaggacuggguggcgaaagagggggagagugcgcuuguuugccagacaaggccuauccccuacuggaagucaggauggagaaugugacuguccucggcgaagaugugauuguuaacgacgagcuguaccuuaauggugcgucagugcugccgcauaagagcauaggggagaguguaccugaaccccggaucauuauguga

SEQ ID NO: 56757 - RNA, 1047 nt, Artificial Sequence
  derived and/or modified sequence opt3 from GMPR2__Homo_sapiens__NP_001002000
augccccacaucgacaacgaugugaagcuggacuucaaagauguccuccuuagaccuaagaggagcacccugaaaucccggucugagguugacuugacacgcucauuuaguuuccgaaauagcaagcagacuuacuccggcgugccaauuauagccgcuaacauggauacgguagggaccuuugaaauggcaaaaguguuaugcaaguucucucuguuuacagccguccauaagcacuauucgcuagugcaauggcaggaguucgcgggacagaauccggacugucucgaacaucuggcugccucaagcgguacuggcaguuccgauuuugagcagcuugaacaaauccuggaggcaauuccccagguuaaauacaucugcuuggacguggccaacggguauucugagcacuucgucgaauuugugaaggauguacguaaaagauucccucagcauaccauuauggcuggaaauguugugacaggcgagauggucgaggaacucauccugagcggugcagacauaaucaagguggggauuggaccaggcuccguguguaccacuaggaaaaagacaggcgucggguacccccagcugucagccguuauggagugcgcugaugccgcgcacggacucaagggucacaucauuagugacggcggguguagcugcccuggagauguggcaaaagccuuuggcgcuggugccgacuucguaauguuagggggaaugcuggcaggccauucugaauccggcggggagcuuaucgaacgggacggaaagaaauauaaguuguuuuacgguaugucaagcgagauggcuaugaaaaaguaugccggcgggguggcggaauaccgcgccagugagggaaaaaccgucgaggugccauucaagggcgauguugaacacacgauaagagacauucugggugggaucaggucuacuuguaccuacgugggcgcagcuaagcuaaaagagcucucccggcgcacaacuuucauucgagucacccaacaggugaaccccaucuuuagcgaagccugcuga

SEQ ID NO: 56758 - RNA, 1038 nt, Artificial Sequence
  derived and/or modified sequence opt3 from GMPR__Homo_sapiens__NP_006868
augcccagaaucgacgccgaucugaagcucgacuucaaagauguucuucugaggccuaagcggagcuccuugaaaucucgcgcugaggucgacuuagaacgaaccuuuacauuccguaacucaaagcagacuuacaguggcauuccaauaaucguugcaaauauggauacgguggggaccuuugagauggccgcgguaaugagccaacacuccauguucacagcuauucauaaacacuauucucuggacgauuggaagcuauuugccacuaaccauccggaaugccuccagaauguggcagucucgucaggaagcggucagaacgaccuggagaagaugaccaguauccuugaagccgugccccagguuaaauucauuugucuggauguggcuaauggcuacuccgagcacuuugucgaguucgugaaguugguaagagcaaaauuuccugaacauacaaucauggccgggaacguugugaccggagagauggucgaggaacucauacugucuggcgcugacaucauuaagguggguguggggccaggaagcgucugcacuacaaggaccaaaacgggcguuggcuauccccaacuguccgccgugaucgagugugcggauucagcacacgggcucaagggacacauuaucagugacgguggcugcacuuguccuggggauguagccaaggcuuucggagccggcgcagacuuugugauguuaggugggauguucagcggacauaccgaaugcgcuggcgaggucuuugaacggaauggccgcaaacugaaacuuuucuacgggaugucuuccgacacagccaugaacaagcacgcgggagguguggccgaguauagagcaucagaaggcaagacuguugaggugccauacaaaggggaugucgagaauaccauauuggacauucugggaggccuaaggagcacauguaccuaugugggugcugccaagcucaaagaacugagucggcgcgcuacguucauccgaguaacucagcagcauaacacaguguuuucuuga

SEQ ID NO: 56759 - RNA, 2082 nt, Artificial Sequence
  derived and/or modified sequence opt3 from GMPS__Homo_sapiens__NP_003866
auggcccugugcaacggcgacagcaagcucgagaaugcugggggagaucuuaaagacggucaccaucacuacgaaggcgcaguggucauccuggaugccggggcgcaguauggaaagguuauugacagaagggugcgggaguuguucguacaauccgaaauauuucccuuagagaccccugcuuucgccaucaaagaacagggcuuucgcgcaauuaucauuucuggugggccaaacucaguguacgccgaggaugcuccgugguucgaccccgcaaucuuuacaauaggaaagccuguccugggcaucuguuauggcaugcagaugaugaauaaaguguucgggggaacuguucauaagaagagugugcgagaggauggugucuuuaacauuagcguggacaauacgugcucccuauuccguggccuccagaaagaagagguaguucugcuuacccacggggauucuguggacaaggucgccgauggauuuaaagugguggcuagaucgggcaacaucgucgccgguauugcgaaugaaucaaagaaacuguacggggcacaauuccauccagagguuggauugacagagaacggcaaggugauccucaagaauuuucuguaugacauagccggcuguagcgggacuuucaccguacagaacagggaacuggagugcauucgggaaaucaaagagcgcgugggaacaaguaagguccucguguuacuguccgguggcguugauucuaccguguguacugcucuuuugaauagagcccugaaccaggaacaggucauugcagugcacaucgacaauggguuuaugaggaaacgggagagccaauccguagaggaagcucuaaagaaacucggaauccagguuaaggugauuaacgccgcgcacucauucuacaauggcacaaccacgcugcccauaagugacgaggaucgcacuccucgaaaaagaaucagcaagacccuuaacaugacaacuucuccagaagagaagaggaaaauuaucggugacaccuucgucaagauagccaacgaagugauuggggagaugaaucugaaacccgaggaagucuuuuuggcacagggcacacuccggccugaucugaucgaguccgcuucauuaguggccagcggaaaggcugaacugaucaaaacccaucacaacgacacggagcucauucguaaacuucgcgaagagggcaagguuaucgagccacugaaagauuuccauaaggacgaagugagaauuuuggggagggagcuaggacugccggaggaacucguaagucggcaccccuuuccugguccaggccuggccauacgagucaucugcgcagaggaacccuauauuuguaaagauuucccugagacuaauaacauccuuaagaucguggccgacuuuucugcuuccguuaaaaagccacacacacuguugcagcgcgugaaggcgugcaccacugaagaggaucaagaaaaacucaugcagauuacaagccugcauucguuaaaugcauuccugcuacccauaaagaccgucggggugcagggagacuguagaucuuacuccuacguaugcggcaucucaaguaaagaugagccggacugggagagccucauuuuucuggccaggcuuaucccucggaugugucacaacgugaaucgcguugucuauauuuucggucccccagugaaggaaccucccacggacgugaccccaacauuuuugacuaccgggguccuguccacacucagacaagcugauuucgaggcccauaacauccugagggaaucuggcuacgcaggaaaaauaagccagaugcccguuauccuuacuccucugcacuuugaccgugauccauugcagaagcagccgucaugccaacggaguguggugauucgaaccuucaucacauccgacuuuaugaccggcauucccgccacuccugggaaugagaucccaguagaagucgugcucaagaugguuacggagauaaagaagauucccggaaucagcagaauuauguaugaucugacaucuaaaccuccagguaccacugagugggaauga

SEQ ID NO: 56760 - RNA, 1080 nt, Artificial Sequence
  derived and/or modified sequence opt3 from GNA11__Homo_sapiens__NP_002058
augacccuggagagcaugauggccugcugucucuccgacgaagugaaggagucuaaaagaaucaacgcugaaauugagaagcagcuuaggcgggauaaacgcgacgcacgacgugaacugaaguuguuacugcuaggcacaggggagucaggaaaaaguacuuucauaaagcaaaugagaaucauucacggugccggcuacagcgaggaagauaagaggggguuuacgaaacucgucuaucagaauaucuucaccgcgaugcaggcuaugauucgggccauggagacacugaagauccuuuacaaauaugaacagaacaaggcaaaugcccuguugauacgcgagguugacguggagaaaguaacuaccuuugaacaucaauacguguccgcuaucaagacacucugggaggaucccgggauucaggaaugcuaugacagaaggcgggaguaccagcugucugauucggcaaaguauuaccugaccgacgucgaucgcaucgccacucucggcuacuuaccuacacagcaagacgugcugcgaguuagagugccaaccacggguauuaucgaauauccguucgaucuugagaacauaauuuuuaggauggucgacgugggaggacagcggucagagcgucgcaaauggauccacuguuucgaaaauguaacuagcauuauguuuuugguugcucugagugaguacgaucaggugcuagucgaauccgacaacgagaauagaauggaagagucuaaggcccucuucaggaccaucaucacauaucccugguuucagaacagcuccgugauucuguuccuuaauaaaaaggaccuguuggaggauaaaauacucuacucacaucugguggacuauuuuccugaguucgauggcccacaacgggacgcgcaggcagcccgagaauuuaucuuaaagauguucgucgaucugaaccccgacagugauaaaauuaucuacagccacuucacuugcgcuaccgacacagaaaauauacgcuuuguuuucgccgcagugaaggauaccauucuccagcuuaaccugaaggaguauaauuugguauga

SEQ ID NO: 56761 - RNA, 918 nt, Artificial Sequence
  derived and/or modified sequence opt3 from GNA12__Homo_sapiens__NP_001269369
auggcccccagagcuggccugggggcaggaccucuccuucugaggagccgggccgacugggugugcgguggcugggaggcggcuuuguccgccccaccgcccuucuguaccgcaugggucgaacgcacaggguuaguucacuuucugcgagagggaggccauggugccugcuucccucuagcucuccugcacccagggucugugguaucauuucagaugaucuacccccuuauugugcugccuuugugugcaaguuggcauuggggacucauacguaagggcaucguccuguucuggggcgaaagcgugaaauauuuucuggauaaccucgacagaauugggcaauuaaauuacuucccauccaagcaggauauccugcuugccaggaaagcuacuaagggaauuguugagcacgacuuugugaucaaaaagauacccuucaagauggucgauguggguggccagcggucucagcgccaaaaaugguuucagugcuucgacgggaucacgucgauuuuguuuaugguaucaagcagugaauaugaucagguucugauggaggacagaaggaccaaccggcuaguggaguccaugaauaucuucgaaacaauugucaacaauaagcucuuuuucaacgugucuaucauacuguuccuuaauaaaauggaucuguugguggagaaggucaaaacuguuagcauuaagaagcauuuuccugacuuccgcggagauccacaccgacucgaagacgugcagagauaccugguacaauguuuugauaggaaacggcguaaccgcuccaagccguuauuccaccauuuuaccacagccaucgacaccgagaaugugagauucgucuuucacgcggugaaagacacuauucugcaggagaaccucaaggauaucaugcuucaguga

SEQ ID NO: 56762 - RNA, 849 nt, Artificial Sequence
  derived and/or modified sequence opt3 from GNA13__Homo_sapiens__NP_001269354
augagagugcuggucgacgccagggagaagcuccacauccccuggggcgauaacagcaaucagcaacauggggacaaaaugauguccuucgauacccgggcuccuauggcagcccagggaaugguugaaacacgcguguuucuucaguaccugccagcgauucgagcuuugugggccgacucugguauacagaacgcauaugaucguagaagggaguuccaauuaggcgaaucaguaaaguacuuucuggacaaucuagauaaacucggggagccggacuauauccccagucagcaggauauucugcuugcccggcgcccuacuaagggaauccacgaauacgacuucgagauuaaaaacgugccauuuaagauggucgaugugggcggucagagaagcgagaggaagcggugguucgaaugcuuugacuccguuacgucuauccuguucuuggugucgucaagcgaguuugaucaaguccucauggaagaccgccugaccaaucgacugacagagagucucaacauauucgagacuaucgugaauaacagaguauuuuccaauguuucuauuaucuuauuccugaacaaaaccgaccuuuuggaagagaaggugcagauugucagcaucaaagauuauuuucuggaguucgaaggggacccccauugucuaagggaugugcagaaguuccucguggaaugcuuucggaauaaacgucgcgaccagcaacagaagccucuguaccaccauuucacaaccgcuauaaacacugagaauauuagacuugucuuuagggauguuaaggacacaauccugcacgauaacuugaaacagcucaugcugcaauga

SEQ ID NO: 56763 - RNA, 1068 nt, Artificial Sequence
  derived and/or modified sequence opt3 from GNA14__Homo_sapiens__NP_004288
auggccggcugcuguugccugagcgcugaggaaaaggagucccagagaaucucugcagaaauugagaggcaacuccggcgcgacaaaaaggaugcccgacgugaacuuaaacuguuguuacuggggaccggagagucagguaagaguacauucauaaaacagaugagaaucauucacggcagcggguacuccgacgaggauaggaagggauuuacuaagcuaguguaucagaacaucuucacggcgaugcaggcuaugauucgggccauggacacccuccgcauccaauacgucugugaacagaauaaagagaacgcacagauaaucagagaaguugagguggauaagguaucuaugcugucgagggaacagguggaggccauuaaacaacuuuggcaggaccccggcauccaggagugcuaugaucggcgccgagaauaccagcugucagacagcgcuaaguauuacuugacagauauugacagaaucgcaacuccuaguuuugucccaacccaacaggaugugcucaggguucgggugccgacaaccgguauaauugaguaucccuucgaccuggaaaauaucauuuuucguauggucgauguagggggacagcgcuccgagagaaggaaauggauccauuguuucgagucugugacuagcaucauuuuucugguugcccucuccgaauacgaccaaguguuagcugagugcgacaacgaaaaucggauggaggaaucaaaggcccuguucaagacaauaaucaccuacccuugguuucuuaacaguagcgucauuuuguuccugaauaaaaaggaucuacucgaggagaaaaucauguauucucaccugauauccuacuuuccagaauauacgggccccaagcaggacgugcgagcggcacgcgauuucauucuuaaacuguaccaggaccagaacccugauaaggagaaagugaucuauucacauuuuacuugugccaccgacacagauaauaucagauucgucuucgcugccguuaaggacacuauuuugcaacucaaccugagggaauuuaauuuaguguga

SEQ ID NO: 56764 - RNA, 1125 nt, Artificial Sequence
  derived and/or modified sequence opt3 from GNA15__Homo_sapiens__NP_002059
auggccagaagccugaccuggaggugcugucccuggugccucacagaggacgaaaaggcugcagcccggguggaucaggagaucaaccgcauucuucuggaacagaaaaagcaagaccgaggcgaguugaaauuacugcuacucgggccuggagaauccgguaagucuacuuucauaaaacagaugcguaucauucacggcgcgggguacucagaggaggaaagaaagggauuuaggccacuggucuaucagaauaucuucguuaguaugcgggcuaugauugaggccauggaacgccuucaaaucccguuuagcagacccgaguccaagcaucacgcaucucuggugaugucgcaggauccuuacaaaguaacgaccuucgagaagagguaugccgcugcaaugcagugguuguggcgggacgccggcauacgcgcuuguuacgaacgaagaagggaguuucaucuccuggauucagccguguauuaccugagccaccucgaacggaucacagaggaagguuaugucccaacugcgcaggacguguuacguagucgcaugcccaccacagggauuaacgaguacugcuucuccguucagaaaaccaaucugagaaucguggaugucggaggccaaaagucugagaggaaaaaguggauucauuguuuugaaaacgugaucgcacuuauauacuuggccagccuguccgaguaugaccagugccuagaagagaauaaccaggaaaaucggaugaaggagucacucgcucuguucggcacuauucuugagcugccuugguuuaaaaguacaagcguaaucuuguuccucaacaagaccgauauucuggaagagaaaaucccaacgucucacuuagccacuuacuuucccuccuuccaagggccuaagcaggacgcagaagcugccaaacgauuuauccuggauauguauacccgcauguacacaggauguguugacgguccagagggcucaaagaaaggggcgagaagcaggcgccucuucagucacuauacuugcgccaccgauacacagaauauucggaagguguucaaggacgucagagacucugugcuugcaagguaccuggaugaaauaaacuugcuauga

SEQ ID NO: 56765 - RNA, 909 nt, Artificial Sequence
  derived and/or modified sequence opt3 from GNAI1__Homo_sapiens__NP_001243343
augaagaucauucacgaggccggcuacagcgaagaggaaugcaaacaguauaaggcuguggucuacuccaacaccauacaaucuaucauugcaaucauuagagccauggggaggcugaaaaucgacuucggagauucagcgcgggcugacgaugcccgccagcucuuuguucuugccggugcagcugaggaaggcuucaugacagcagagcuggccggggugauaaagcgauuguggaaagacaguggaguacaggcuuguuuuaaucguagcagagaguaucaguuaaacgauuccgccgcguacuaucugaaugaccuagauaggaucgcacaacccaacuacauuccuacucagcaggacgugcuccggacgcgcgucaagaccacaggcaucguggaaacucauuucaccuuuaaggaucugcacuucaaaauguuugacguuggugggcagagaucugagaggaagaaauggauucauugcuucgaaggagugacagccaucauauuuugugucgcucuuucggauuaugaccugguguuggccgaggaugaggaaaugaaucggaugcacgagucaaugaaacucuucgacagcauuugcaacaauaagugguuuaccgacacaaguaucauucuguuccugaacaagaaggaucucuuugaagagaaaaucaagaaauccccauuaacuaucuguuacccggaauacgcaggcucuaauaccuaugaggaggcugccgcguacauucaaugccaguucgaagaccugaacaagcgcaaagauacgaaggagauauauacucauuucaccugugccacagacacuaaaaauguacaguuuguuuucgaugcagugaccgacgucaucauuaagaacaaucuuaaggauugcggcuuguuuuga

SEQ ID NO: 56766 - RNA, 957 nt, Artificial Sequence
  derived and/or modified sequence opt3 from GNAI2__Homo_sapiens__NP_001159897
augagaggcgccggggagagcggaaaguccaccaucgugaaacagaugaagauuauacacgaagacgguuacucugaggaagagugcaggcaauaucgggcugucguuuacucaaacacaauccagaguauuauggcaaucgugaaagccaugggcaaucugcagauugauuucgcggaccccagccgcgcugaugacgcccgacagcucuuugcacuuuccuguacugccgaggaacaagggguacugccugaugacuugucuggagugauccguagauuaugggcugaucauggcguccaggcaugcuucgguaggucgcgggaguaucagcugaacgacucagccgcuuacuaucuaaaugaucucgaacgcauagcccagagcgacuacaucccaacgcaacaggaugugcugagaaccaggguuaagacaacugggauuguggagacccacuuuacauucaaagaccuucauuuuaagauguucgaugucggaggccagcggagugaacgcaagaaauggauccacuguuuugagggcgugaccgcgauuaucuucugcguagcacuguccgccuaugacuugguucucgcugaggacgaagagaugaaccgaaugcaugaaucuaugaagcuguuugauagcauauguaauaacaaaugguucacugacacauccauuauccuguuucucaauaagaaagauuuauucgaggaaaagauuacccacucaccgcugacgaucugcuuucccgaguacacuggggccaacaaguacgacgaggcagcuaguuauauccagagcaaauucgaagaucuuaauaagagaaaagacaccaaggagauuuacacacacuucacuugugccaccgauaccaaaaacgugcaauuugucuucgacgcggugacagaugugauaaucaagaauaacuugaaagacugcggacuguuuuga

SEQ ID NO: 56767 - RNA, 525 nt, Artificial Sequence
  derived and/or modified sequence opt3 from GNAL__Homo_sapiens__NP_001248373
auguucgacgugggcgggcagagagaugagaggcggaaguggauccaaugcuuuaacgacgucaccgccauuauauacguugcugcauguagcuccuauaauauggugauccgcgaagauaacaauacaaaccgacugcgugagucucucgaccuuuucgaaucaauuuggaauaacagauggcugaggacuaucaguauuaucuuguuuuuaaauaaacaggauaugcuggccgagaagguacuagcgggaaaaagcaagauagaagacuacuuccccgaguaugcuaacuacacggugccugaggaugccaccccagacgccggugaagauccgaaagucacacgggcaaaguuuuucauccgcgaccucuuucugagaauuuccacugcuaccggcgaugggaagcacuauugcuacccccauuucacaugugcaguggacaccgagaauaucaggcggguuuuuaacgauugccgcgacauuauccagcgaaugcaccuuaaacaguaugaacuguuguga

SEQ ID NO: 56768 - RNA, 1065 nt, Artificial Sequence
  derived and/or modified sequence opt3 from GNAO1__Homo_sapiens__NP_066268
augggcugcacccugagcgccgaggaaagagcugcacucgagagguccaaggccaucgagaaaaaccuuaaggaagacgggauuucugcggcuaaagaugugaagcuguuguuacugggagccggugaaucaggcaaaaguacaauagucaagcagaugaagaucauucacgaggacggguucagcggagaggauguuaaacaauacaagcccgugguauauuccaauacuauccagucucuagcagccauugugcgggcuauggacacgcucggcaucgaauacggugauaaagagcgcaaggcagacgccaaaauggucugugaugugguuucgcgaauggaagacaccgagccuuuuucagcugagcugcuuagcgccaugaugcgucuguggggagauagugggauacaggaaugcuucaacagauccagggaguaucaguugaaugacucugcgaaguacuaucucgauagccuggaccggaucggcgcagccgauuaccaaccaacagaacaggacauucugcgcacuagagugaagaccacaggcaucgucgagacccauuuuacuuucaaaaaccuccacuuuagguuauucgacguagggggacagcgguccgaacgcaagaaauggauucauuguuuugaggaugugacagcuaucauauucugcguugcccugucagguuaugaccaggugcuucacgaggaugaaaccacgaaucgaaugcaugagaguuugaugcuguuugacagcauuuguaacaauaaguucuuuaucgauacuucuauuauccuauuccucaacaaaaaggaccuguuuggcgagaaaaucaagaaguccccgcuuaccauuugcuuccccgaauacacagggccuaauacuuacgaagaugcagcugccuauauacaagcgcaguucgagagcaaaaacagaucaccaaauaaggagaucuacugucacaugaccugcgccacagacaccaacaauauucaggucguguuugaugcagugacggacaucauaauugcuaacaaucugaggggauguggcuuguauuga

SEQ ID NO: 56769 - RNA, 1080 nt, Artificial Sequence
  derived and/or modified sequence opt3 from GNAQ__Homo_sapiens__NP_002063
augacccuggagagcaucauggccugcugucucuccgaagaggcuaaggaagcaagaaggauuaacgacgagauagaacggcagcuucgccgagauaaacgugacgccagaagggagcugaaguuguuacugcuaggcacaggggagucuggaaaaucaacuuucaucaagcaaaugcggauuauccacgguaguggcuacagcgaugaagacaaacgcggguuuacgaagcucguguaucagaauauuuucaccgcgaugcaggcuaugaucagagccauggauacacugaagauacccuacaaauaugagcauaacaaggcacacgcccagcuugucagggaaguugacguggagaaaguauccgcuuuugagaauccuuacguggaugcaaucaagucucuguggaacgacccaggcauucaagaaugcuaugaucggcgccgagaguaccaguugucggacucaacuaaauauuaccucaaugaucuggacagagucgccgauccggcuuaccugcccacccagcaggacgugcucaggguucgggugccuacaaccggaaucauugaauauccauucgacuuacaaagcgucaucuuucguaugguggauguaggugggcagcgcagugagagaaggaaguggauacauuguuucgaaaacguuacuuccauuauguuucugguggcccuuucugaguacgaccaggucuugguggagagcgauaaugaaaaccggauggaggaauccaaggcgcuguuccgaacaaucauuaccuaucccugguuucaaaauucaagugugauccuauuccucaacaaaaaggaccugcuugaggagaaaaucauguacagccaccuggucgauuauuuuccugaauacgacggaccacagcgcgaugcacaggccgcuagagaguucauuuugaagauguuuguugaccucaaucccgauucugacaaaauaaucuauucccauuucacgugcgccacugauaccgaaaacauuagguucguguuugcagcuguaaaggacacaauccugcaguuaaaucugaaagaguacaaccucguguga

SEQ ID NO: 56770 - RNA, 1185 nt, Artificial Sequence
  derived and/or modified sequence opt3 from GNAS__Homo_sapiens__NP_000507
augggcugccuggggaacagcaagaccgaggaccagagaaaugaagagaaagcccaaagggaagcuaacaagaaaaucgagaagcagcuccagaaagauaaacagguguaccgggcaacacaccgccuucuguuguuaggagccggugaauccggcaagucuacuauugucaagcaaaugcgaauacugcauguuaauggguucaacggagagggcggugaggaagacccccaggcggcucguucaaauagugauggggagaaggccacgaaagugcaggacaucaagaacaaucuaaaagaagcaauugagaccaucguagccgcuaugagcaaccucgugccuccagucgagcuggcaaauccggaaaaccaguuuagaguggauuauauucuuuccguuaugaaugugcccgacuucgauuuuccuccagaguucuacgaacacgccaaggcucugugggaggacgaaggagucagggccuguuaugagcggucuaacgaguaccaauugaucgauugcgcgcaguauuuucucgacaagauagaugugaucaaacaggcagacuacguacccucggaucaggaccugcugcgcuguagaguucucacaucaggcauuuucgaaacuaaguuucaaguggacaaagucaauuuccauauguuugaugugggcgggcagagggacgagcggcgcaaguggauccagugcuucaacgaugugaccgccauuaucuuugucguugcuagcaguuccuauaauauggugauacgagaagacaaccaaacaaacagauuacaggaggcccugaaucuuuucaaaucuauuuggaacaauaggugguugcggaccaucagcguaauucuguuucuaaacaagcaggaucuccuggcagaaaaagugcuugcuggaaaguccaagaucgaggacuacuucccugaguucgcccguuacacuacaccagaagaugcgacccccgagccuggugaagacccacgcgucacgagagccaaauauuuuaucagggaugaguuccugcggauuucaacugcaaguggcgacgggcgacacuacuguuauccgcauuuuaccugcgcuguggauacagaaaauauacgcagaguuuucaacgacuguagggacaucauucagcggaugcacuugcgccaauacgagcuccuguga

SEQ ID NO: 56771 - RNA, 1053 nt, Artificial Sequence
  derived and/or modified sequence opt3 from GNAT1__Homo_sapiens__NP_653082
augggcgccggggcuagcgcagaggaaaagcacuccagagagcuggagaaaaagcucaaagaagacgccgaaaaggaugcgaggaccgugaaacuucuguuguuaggagcuggugagucuggcaagucaacaaucgucaagcagaugaaaauuauacaucaagacggguacagucuggaggaaugccuagaguucaucgccauuaucuauggaaacacucuccagagcauucuggcaaucguucgggccaugacgacccuuaauauacaguacggcgauuccgcucgccaggacgaugcacgaaagcugaugcacauggccgacacaaucgaagaggguacuaugcccaaagagaugucugauauuauccaacguuuguggaaggacucggggauucaggcuuguuuugaaagagccucagaguaucagcucaacgauagcgcgggauacuaucugagugaccuggaaaggcucgugaccccuggcuacguaccaacagagcaggauguguuacggucccgcgucaaaaccacuggcaucauagaaacacaauucucuuuuaaggaccugaauuucagaauguuugauguugggggacagaggagcgagcggaagaaauggauucauugcuucgaggguguuaccuguaucauuuuuaucgcagcccuuuccgcuuaugacaugguguuggucgaagacgaugaggugaaccgcaugcacgaaucacugcaucuauucaauaguaucugcaaccaccgauacuuugccacgacuagcauuguacucuuccugaauaagaaagacguguuuuucgagaagaucaaaaaggcacaccuuucuauauguuuuccggauuacgacggccccaacaccuaugaagaugcugggaauuacauuaaagugcaguuccuggaguugaacaugagaagggacgucaaggagaucuauucccauaugacaugcgccacugauacccagaaugugaaguucguguuugacgcggucacagauauaauuaucaaagaaaaccucaaggacuguggacuguucuga

SEQ ID NO: 56772 - RNA, 1065 nt, Artificial Sequence
  derived and/or modified sequence opt3 from GNAT3__Homo_sapiens__NP_001095856
augggcagcgggaucuccucugagucaaaggaaagugccaaaagaagcaaggagcuggagaaaaagcuccaggaagacgcugaaagggaugcacggaccgugaaacuucuguuguuaggagccggugaguccggcaagucuacaauugucaagcaaaugaaaauaauccacaagaacggguacucggagcaggaaugcauggaguucaaagcgguuauuuauucaaauacucugcagagcauccuagcuauugugaaggccaugacgacccucggaaucgacuacguaaacccccgcagugcagaagaucagcgacaacuguaugccauggcuaauacacuugaggacggcgguaugacuccucagcuggcagaggugauaaaacguuuguggagagauccagggauccaggccuguuuugaaagggcuuccgaguaccagcucaacgacucugccgcguauuaccugaaugaucuggaccggauuaccgcaagcggauaugucccgaacgaacaagaugugcuccauucccgcguuaagacaaccggcaucauugagacucaguucucauuuaaggacuuacacuucagaauguuugaugugggcgggcagaggagugaacggaaaaaguggauccauugcuucgagggagucacauguauaaucuuuugcgccgcucugagcgccuacgacauggugcuuguagaggaugaagagguuaaucgcaugcacgaaucuuugcaucuguucaacuccauuuguaaucacaaauacuuuucaaccacgagcauugugcuauuccucaacaagaaagacaucuuucaggagaaggucacuaaagugcaccugaguaucugcuuccccgaauauaccgguccuaauacauuugaggacgcaggcaacuacauuaagaaucaauuccuugaucugaacuugaagaaagaggacaaggaaauauauucucauaugacuugugcuaccgauacacagaaugugaaauucgucuuugacgccguuaccgauaucauuaucaaggagaaccucaaagacugcgggcuguucuga

SEQ ID NO: 56773 - RNA, 1068 nt, Artificial Sequence
  derived and/or modified sequence opt3 from GNAZ__Homo_sapiens__NP_002064
augggcugcagacagagcuccgaggaaaaggaggccgcuaggcggucucgccgaaucgaccgucaccugagaucagaaagucaaaggcagcggcgcgagauuaaacuccuucuguuggggaccagcaacuccggaaagucuacaauagugaaacagaugaagaucauucauucggguggcuucaauuuagaagcauguaaagaguacaagccccugaucauuuauaacgccaucgauucacuaacuagaauaaucagggcgcucgcugcccugcggauugacuuucacaauccugaucgcgcauacgacgccguccagcuuuucgcucugacggggccagcagagagcaagggagaaaucaccccggaguugcucggcguuaugcgaagacugugggccgaucccggugcucaagccugcuuuaguagguccucugaauaucaucuggaggacaacgcggcauacuaucucaaugauuuagagcggauugccgcugccgacuacaucccuacaguggaagauauacugcguagccgcgacaugacuaccgggauuguagagaacaaauucacauuuaaggaacuuaccuucaaaaugguggaugucggaggccagagauccgagaggaagaaauggauccacuguuuugaaggcgugacugcaauuaucuucugcguugaguugucaggguaugaccugaagcuauacgaggauaaucagacaagucggauggcugaaagccuccgacuguuugacucuaucuguaacaauaacugguucauuaauaccucccuuauacuguuuuugaacaagaaagaccuccuggccgagaagauccgcaggauuccauuaacgaucugcuuccccgaauacaaaggacagaauacuuaugaggaagcggccguguacauacaaagacaguuugaggaucugaaccggaauaaggagaccaaagaaauuuauucacauuucacaugugcaacugacaccagcaacauccaguucgucuuugaugcugugacagacguaaucauucagaacaaucucaaguacaucggucuuugcuga

SEQ ID NO: 56774 - RNA, 984 nt, Artificial Sequence
  derived and/or modified sequence opt3 from GNB1L__Homo_sapiens__NP_443730
augaccgcccccugcccuccaccgcccccugacccacaguucgugcugagaggcacacaaagccccguccacgcucuccauuuuugugagggggcacaggcccagggaaggccucuucuguucuccgguucucagucaggcuugguucacaucuggaguuuacaaacucggcgcgcggugacgacccuggaugggcauggaggccagugcguaacauggcuacagacucucccacagggucgacaacugcuuagccaggggcgugaccugaaguugugucucugggaucuggcugaaggaagauccgccguggucgacucugugugccuggagucgguuggcuuuuguaggucaagcauucucgcaggcgggcagccccgguggaccuuagccgugccuggacgcgguagugaugaaguccagauacuggagaugccauccaaaacaucugugugcgcucuuaagccgaaagcagacgccaaguugggcaugcccaugugucugagacuauggcaagcugauugcagcuccaggccucuccugcuugccggguacgaagacggaucaguaguucugugggaugugagugagcagaaagucuguagccggaucgcgugccacgaggaaccagugauggacuuggauuucgacucucagaaggcacgcggcauuuccgguucagccgggaaggcucucgccguguggagccuggauuggcaacaggcauuacagguccgaggaacccaugagcugacuaaccccggcaucgcugaaguuacaauuagaccugacaggaaaauccucgccaccgcgggcugggaccaccggauacguguguuucacuggcgcacgaugcagccacuugccguacuggcauuccauagugcugccgugcaaugugucgcuuuuacugccgauggguugcuagcagccggaucuaaggaccagagaaucucccuguggagccucuaucccagggcuuga

SEQ ID NO: 56775 - RNA, 954 nt, Artificial Sequence
  derived and/or modified sequence opt3 from GNB2L1__Homo_sapiens__NP_006089
augaccgagcagaugacacugagaggcacucucaaggggcacaacggaugggugacgcaaaucgccaccacaccccaguucccugacaugauucuuagcgcuuccagggauaaaacuauaaucauguggaagcugacccgggacgaaacaaauuacgguauuccacagcgcgcauugcgaggccauucucacuuugucucagauguugugaucaguagcgacgggcaguucgccuuauccggaucuugggauggcacccugcgucuaugggaccucacuacagguaccacgacuagaagguuuguagggcauaccaaagaugugcugucggucgcguucucaagcgacaaccggcaaauugugaguggaucccgcgauaagacaaucaaacuuuggaauacucugggcguuugcaaguauaccgugcaggacgagucucacagcgaaugggucuccugugugagauuuucaccgaacaguagcaaucccauaaucguaucuugcggcugggauaaguugguuaaaguguggaaccucgcuaauuguaagcugaaaacaaaccauauugggcacaccggauaccugaauacggucacuguguccccugacgguucacucugcgccagcggcgggaaggauggacaggcaauguuaugggaccugaacgagggcaaacaccuuuauacauuggacgguggggauaucauuaaugcccuguguuucaguccaaacagguacuggcuaugcgcugcaaccggacccucuaucaagauaugggaccucgaaggcaagauuaucguggaugagcugaaacaggaggucauuuccacuagcucgaaggccgaaccuccacaauguacaucucuugcuugguccgccgacggccagacccuguuugcgggguauacggauaauuugguucggguguggcagguaaccaucggaacacgcuga

SEQ ID NO: 56776 - RNA, 1023 nt, Artificial Sequence
  derived and/or modified sequence opt3 from GNB3__Homo_sapiens__NP_002066
augggcgagauggaacagcugagacaagaggccgaacagcucaagaaacagaucgcugacgcaaggaaggccugcgcggaugugacccuugcugagcuggucagcggguuggaaguugugggacggguacagaugcgcacacgacguacuuuaagaggucaccuggccaaaauuuacgcaaugcauugggccacggacuccaagcuacucgugucugcuucacaagauggcaaacugauagucugggacaguuauaccacaaacaaggugcacgcaaucccccuuaggagcuccuggguuaugacuugugccuacgcuccuucugggaauuucguggccugcggaggccuggauaacauguguucgauuuauaauuugaagucacgggaggguaacgucaaagugagccgcgagcucagugcgcauaccggguaccuguccugcuguagauuucuggacgauaauaacaucguaacaucuagcggagacaccacuugcgcacucugggauauugaaacaggccagcagaagaccguuuucgugggccacacgggggacuguauguccuuagccgucucaccagauuuuaaucuguucaucaguggagcuugcgacgccagcgcaaaacuuugggaugugagggaggguacuugucggcagaccuuuacaggccaugaaucugacauaaacgcuaucugcuucuuuccgaauggggaggccauuuguacuggauccgacgaugcgucaugccgcuuguucgaccugcgagccgaucaagagcuaaucugcuuuagccacgaaaguauuaucuguggcauaaccucuguggcauucucccucagcgguagacugcuuuuugcuggguaugacgauuucaacugcaaugucugggacucgaugaagucugagaggguuggcauucuguccggacacgauaaccgggugucauguuugggcguaacagccgacgggauggcuguggccaccggaaguugggauagcuuucucaaaaucuggaauuga

SEQ ID NO: 56777 - RNA, 1023 nt, Artificial Sequence
  derived and/or modified sequence opt3 from GNB4__Homo_sapiens__XP_006713784
augagcgagcuggaacagcucagacaagaggccgaacagcuuaggaaccagauccaggacgcucggaaggcaugcaaugaugccacccuggugcaaauuacauccaacauggacucugucggccgcauacagaugcgaacucguagaacguugagggggcacuuagcgaaaaucuacgcuaugcauuggggauaugauucacggcugcuaguuagugccagccaggacgguaagcucauuaucugggauuccuacaccacaaauaaaaugcacgcaauuccccugagaucuucgugggugaugacuugugccuaugcuccuucaggcaacuacguagcaugcgggggacuugacaauaucuguagcauauauaaccugaagacccgcgagggcaaugugagggucagucgggaauugccaggucauacaggguaccucuccugcugucgcuuccuggaugacucucagaucgugaccagcuccggagauacuacaugcgcccugugggacauugagaccgcucaacagacgacuaccuuuacaggccacucaggcgauguuaugagucucagcuuaucuccggacaugcgaacuuucguguccggggccugugaugcgucaagcaaacugugggacaucagagacggaaugugcaggcagaguuuuaccggucaugucucugauauuaacgcaguguccuucuuucccaauggcuaugccuucgcuacagggagcgacgaugccaccugucggcuuuuugacuugcgugcagaucaggagcugcuacucuacucgcacgacaacaucauaugcggaauuacgucuguagcuuucuccaagucaggccgccugcuucuggccgguuacgaugacuuuaauuguaacguuugggauacuuugaagggggacagagcgggagugcucgccggccacgauaauagggucaguugccugggcgugacagacgacgggauggcaguggcuaccggaagcugggauuccuucuuacggaucuggaacuga

SEQ ID NO: 56778 - RNA, 1062 nt, Artificial Sequence
  derived and/or modified sequence opt3 from GNB5__Homo_sapiens__NP_006569
auggccaccgagggccugcacgaaaacgagacacucgcuagccuuaaguccgaagcagagucucugaaagggaaguuggaagaggagagagccaaauuacaugacguggaacugcaccaggucgcggagaggguugaagcucuaggacaauucgugaugaagacucggcgcacgcucaaaggucauggcaauaagguacugugcauggauugguguaaggacaaacgacguaucgugucaaguagccaggaugggaaggucauugugugggacuccuuuaccacaaacaaagagcacgccguuacuaugcccugcaccugggugauggcaugugccuacgcuccuucuggaugcgcaauagccuguggcggucuugauaauaagugcucggucuauccacugacauucgacaaaaacgagaauauggcugccaagaagaaaucaguggcgaugcauaccaacuacuugagcgcauguaguuuuacuaauuccgauaugcagauccucacagccucuggggacggaaccugcgcucugugggauguagaaagcggccagcugcuccaauccuuccacggccacggggccgacguuuuaugucuggaucuugcaccgucagagacgggaaacacuuuugugagugguggcugcgacaagaaagcuauggucugggauaugagaagcgggcagugugugcaggccuucgaaacccaugagucugacauuaauuccgugagguauuaccccucaggagacgcguuugccagcggcagugaugacgcaacaugccgguuguaugaucugcgcgcugacagagaagucgccaucuacucuaaggaguccauuaucuucggugcuagcucgguugauuuuucucuauccgggaggcuccuguucgccggauauaacgacuacacuauaaaugugugggauguacuuaaaggcucacgggugaguauccuguuuggccacgagaaccgcgucagcaccuugcgaguguccccugacgggacagcauucugcucuggaagcugggaucauacccucagaguuugggccuga

SEQ ID NO: 56779 - RNA, 2262 nt, Artificial Sequence
  derived and/or modified sequence opt3 from GNE__Homo_sapiens__NP_001121699
auggagaccuacggcuaucugcagagagaaagcugcuuccaagggccccacgagcucuacuuuaagaaccuuuccaaaaggaauaagcagaucauggagaaaaacggaaauaaccggaagcugcgcgugugugucgccacaugcaaucgagcugacuauucuaaauuggcaccuauuauguucgguauaaagacugagccagaauuuuucgaguuagauguugugguacugggcucacaucuaaucgacgauuacgggaacacguaucguaugauugagcaggacgauuuugacaucaauaccagacuccacacaauugugaggggagaagaugaggccgcgauggucgaaagugugggccuggcucuuguuaagcugccggacguguugaaccggcucaaacccgauaucaugauaguccauggugaccgcuucgaugcccuggcacuggccacuagcgcugcacucaugaauaucagaauuuuacacaucgaagggggagagguguccggcaccauugacgauucuaucaggcaugccauaacaaagcuggcucacuaccacguauguugcacccggucggccgaacagcaucuuauuucaaugugugaggaccacgaccgcaucuugcuggcgggcugcccuagcuaugauaaacuacucagugcaaagaacaaagacuacauguccauuauccgaauguggcugggggaugacguuaagucuaaggauuacaucguggcccuucaacauccagucacuacagacauuaaacacagcauaaagauguuugaacugaccuuggaugcucucaucuccuucaauaaaagaacgcugguguuauuucccaacauugacgccggaucaaaggagauggugagggucaugcggaaaaaggguaucgaacaccauccuaauuuccgugcaguuaaacacgugccauuugaucaguucauacagcugguagcucaugccggcuguaugauugggaacaguagcugcggagugcgcgaggucggcgcguuugguacucccgugaucaaucucgggaccagacagaucggaagggagacaggcgaaaacguucuucacgugcgggacgccgauacucaagacaagauucugcaggcauugcaucuacaguucggcaagcaguauccuuguucuaaaaucuacggggacggaaacgcugucccacgcauucugaaguuccucaaauccauagaucugcaagagccgcuucagaagaaauuuugcuuucccccugugaaggaaaauaucucacaggacauugaucacauccuggagaccuugagcgcccucgcuguagaccuggguggcacaaacuuacgaguugccaucgugaguaugaagggggaaauugucaaaaaguauacccaauucaauccaaaaacguacgaggagagaauaaaccugauccuacagauguguguggaagcagccgcugaggcggucaagcucaauugcaggauucugggagugggcaucucuacuggugggcggguuaacccccgcgaaggcauugugcuucacuccacaaaauugauccaggaguggaauagcguagaucugagaaccccucucucggacacucugcaucuuccagucuggguggauaacgacggaaauugcgcagcccuggcugaaaggaaguucggccaggggaagggauuggagaacuuuguuacacucauaaccgguacgggcaucgggggaggcauuauccaccaacaugagcugauucacgguucuuccuucugugccgcagaauuagggcaccugguggucucacuagauggccccgacugcaguuguggaagccauggcugcaucgaggccuaugcuuccgggauggcccuccagcgugaagcgaaaaagcugcacgaugaggaccuuuugcugguggagggaaugucuguaccgaaagaugaagcagugggugcucuccaucugauacaggccgcaaaguuaggcaaugccaaagcucagagcauucugcggaccgccgggacagcacuuggauugggcguugucaacauccuccacacuaugaauccuucacuggugauucuaaguggugugcuggcuucccauuacauccacauagucaaggacguuauccgacaacaggcccucagcucugugcaggacguggauguagucgugucagaccugguugaucccgcgcuuuugggggccgcuaguauggugcuggacuauaccacaagaaggauuuacuga

SEQ ID NO: 56780 - RNA, 207 nt, Artificial Sequence
  derived and/or modified sequence opt3 from GNG10__Homo_sapiens__NP_001017998
augagcuccggcgccucugcuucagcacugcagagacucguggagcaacuuaagcuggaagccggggucgagaggaucaaaguuagucaggcggcugccgaauugcagcaguacugcaugcaaaacgcauguaaggacgccuuacuggugggaguacccgcugguagcaauccuuuccgggagccacgcuccugcgcacuacucuga

SEQ ID NO: 56781 - RNA, 222 nt, Artificial Sequence
  derived and/or modified sequence opt3 from GNG11__Homo_sapiens__NP_004117
augcccgcccugcacaucgaggaccucccugaaaaggagaaacuuaagauggaaguggagcagcugagaaaagaagucaaguugcaaaggcagcagguuagcaaaugcuccgaggagauuaagaacuacauagaggaacggucuggcgaagauccauuagugaaggggaucccggaggacaaaaaucccuucaaggagaaaggaucauguguaauuaguuga

SEQ ID NO: 56782 - RNA, 216 nt, Artificial Sequence
  derived and/or modified sequence opt3 from GNG2__Homo_sapiens__XP_011535148
auggccagcaacaauaccgcuuccaucgcacaggccagaaagcugguggaacaacucaaaauggaagcgaacauugacaggauaaaggucucuaaagcugccgcagaucuuauggccuacugcgaggcucacgcaaaggaagacccccuguugacaccuguuccagccucagagaauccguuccgggagaaaaaguuuuucugugcuaucuuauga

SEQ ID NO: 56783 - RNA, 228 nt, Artificial Sequence
  derived and/or modified sequence opt3 from GNG4__Homo_sapiens__NP_004476
augaaggagggcaugagcaacaauuccaccacaucuaucucacaggccagaaaagcuguggaacaacugaagauggaggcaugcauggacagggucaaaguuagucaggccgcggcugaucuccuugccuacugugaagcacacgugcgggaggacccccugauuauaccuguaccagccagcgaaaacccguuccgcgagaagaaauuuuucugcacuaucuuguga

SEQ ID NO: 56784 - RNA, 207 nt, Artificial Sequence
  derived and/or modified sequence opt3 from GNG7__Homo_sapiens__NP_443079
augagcgccaccaacaauaucgcucaggcaagaaagcugguggagcaacucaggauugaagccggcauagagcggaucaaagucuccaaggcggcuucugaccuuaugucauacugcgaacagcacgcccgcaacgauccccuguugguuggggugccugcaagugagaauccauucaaagacaagaaaccguguauuaucuuauga

SEQ ID NO: 56785 - RNA, 213 nt, Artificial Sequence
  derived and/or modified sequence opt3 from GNG8__Homo_sapiens__NP_150283
augagcaacaauauggccaagaucgcugaggcaagaaaaaccguggaacagcugaagcucgaggucaacauugacaggaugaaaguuucccaagccgcggcugaacuucuggccuucugcgagacacacgcaaaggaugaccccuuggugacuccuguaccagccgcugaaaauccguuucgggauaaacgcuuauucugugugcugcuauga

SEQ ID NO: 56786 - RNA, 225 nt, Artificial Sequence
  derived and/or modified sequence opt3 from GNGT1__Homo_sapiens__NP_068774
augcccgugaucaacauugaggaccugaccgaaaaggauaaacucaagauggaggucgaccagcuuaaaaaggaaguuacacuggagagaauguuggugagcaaaugcugugaagagguaagggauuacguggaggaacgguccggcgaggacccuuuagucaaggggauaccagaagauaagaauccguucaaagagcugaagggagguugcgugaucucuuga

SEQ ID NO: 56787 - RNA, 210 nt, Artificial Sequence
  derived and/or modified sequence opt3 from GNGT2__Homo_sapiens__XP_006721882
auggcccaggaccugagcgagaaggaucuccuuaaaauggaaguggagcaacugaagaaagaagucaagaacaccagaauccccauuuccaaagcuggcaaggagauaaaggaauacguugaggcacaggccgggaaugacccuuucuugaaaggaaucccagaggauaagaacccguuuaaagaaaaggguggcugcuuaauuucuuga

SEQ ID NO: 56788 - RNA, 1824 nt, Artificial Sequence
  derived and/or modified sequence opt3 from GNL1__Homo_sapiens__NP_005266
augcccagaaagaaaccuuucagcgugaagcagaaaaagaaacaacugcaggacaagagggagcggaagcgcggccuccaggaugggcuucgauccucuucaaacagucguagcggauccagagaaaggcgggaggaacagaccgacacaucugauggugagucggucacucaccauauccgcagacugaaucaacagccaucacagggcuuggggccgaggggauacgaccccaaccgguaucgcuuacacuuugaacgagauagcagagaggagguugaaaggcggaaacgugccgcucgcgaacaggugcugcaaccuguaagugcagaacuacucgagcuggacauuagagagguguaccagccaggcuccguccuugauuuccccaggcggccuccauggucuuaugaaaugagcaaggagcagcugaugucccaggaggagcgaucauuucaagacuacuuggguaaaauacauggggccuauaguagcgaaaagcucucuuacuucgagcacaaucuggagacguggcgccagcuguggagagugcucgaaauguccgauaucguuuuacugauuaccgacaucaggcaucccguggucaacuuuccuccagcgcuuuaugaguacgugacaggagaauugggccuggcucuaguacucguucugaauaaaguggaucuugccccgcccgcacuggucguggccuggaagcacuacuuccaccagcauuauccucaauugcacgugguccucuuuacuucauucccacgggacccccgcaccccucaggauccaagcaguguucugaagaaaucuagaaggcguggccggggguggacacgagcuuuaggacccgagcagcugcucagagcaugcgaagccauuaccguggguaagguagaccuuuccagcuggagggagaaaaucgcucgcgacguggccggcgcgacuugggggaacggaucgggcgaggaagaggaagaggaagaugguccggcaguccugguggagcagcaaacagacucugccauggagccuaccgggcccacgcaggaacgguacaaggauggaguugugacuauaggcugugucggcuuuccaaauguggggaaauccucauugaucaacggucuaguaggaagaaagguugugagugucagcaggaccccuggccauacacgcuauuuccagacuuacuuucugacccccuccgugaaacucugcgacuguccagggcugauuuuccccucucuucugccucgacaguugcaaguccucgcuggaaucuauccaauugcccagauccaggagccguacacagcagugggcuaucuggcuagccggauacccguucaggccuuacugcaccuacgucacccugaagcggaggauccaucagccgagcaucccuggugcgcaugggacauuugugaggcuugggccgaaaagagagguuacaagaccgcuaaagccgcaaggaaugauguguaccgcgccgcuaacagucuccugcggcuugcgguagacgggagauugucccugugcuuucacccuccaggcuauagcgaacaaaagggaacgugggagucucaucccgaaacuacagagcucgucgugcugcagggcaggguugggccggcaggagaugaggaagaggaagaggaagaggagcuuucaaguagcugugaagaggaaggugaggaagaccgagaugccgacgaggagggcgaaggggacgaggaaaccccuacuuccgcuccaggaucuucgcuggccggccgcaaucccuacgcauugcucggugaggaugagugcuga

SEQ ID NO: 56789 - RNA, 1650 nt, Artificial Sequence
  derived and/or modified sequence opt3 from GNL3__Homo_sapiens__NP_055181
augaagagacccaaacugaagaaagccagcaagaggaugaccugccacaaacgguacaagauccagaagaaagugcgcgagcaucaccgaaagcuccguaaagaagcuaagaaaagaggccauaagaagccuaggaaagacccaggggucccgaacuccgcacccuucaaggaggcccuucugcgggaagcggaguugcgcaaacaaagauuagaagaacugaagcagcagcagaaacuagauaggcaaaaggagcucgagaaaaagcggaagcuggagacaaauccugacauuaaaccaucuaacguugaacccauggagaaggaguuuggacuuuguaaaacugaaaauaaggcuaaaucagguaagcagaacaguaagaaacuguauugccaggaguugaagaaagugauagaagccagcgauguagugcucgagguccuggacgcacgcgauccucugggcugucgaugcccacagguggaagaggccaucguucaauccgggcagaagaaacucguguuaauucugaauaagucugaccuuguccccaaggagaacuuggaaucguggcugaauuaccugaaaaaggagcucccuacggugguauucagagcuucaaccaaaccaaaggauaaaggaaagaucacaaagaggguuaaagcaaagaaaaacgccgcuccguuucggagcgaaguguguuucggcaaggagggucuguggaaacuucuagggggauuucaggaaacuugcaguaaggccauucgugucggcgugaucggcuuccccaauguggggaaauccucuauaaucaacagcuugaagcaggagcaaauguguaaugucggaguuuccaugggucucacccgcucaaugcaagugguaccucuggacaagcagauuacaaucauugauaguccaucguuuaucgugucucccuuaaacuccucaagcgcgcuggcacucagaaguccugccucuauagaggucgugaaaccaauggaagcugccuccgcaauucuuagccaggcugacgccaggcagguugugcugaaguauaccguccccggcuaccggaauagcuuggaguucuuuacugugcuagcgcagcgacgcgggaugcaccagaaaggaggcaucccgaacguagaaggugccgcaaagcugcucuggucugaguggacaggggcuucccuggccuauuacugccauccucccaccucauggacgccaccucccuauuucaaugaaaguauuguuguggauaugaaaagcggauuuaaccuugaggagcuggaaaagaacaaugcucaauccaucagagccaucaagggcccacacuuggcaaacucuauucucuuccagagcucaggccugacuaaugggauaaucgaggaaaaagacauucacgaggaguuacccaagaggaaagaacggaagcaggaggaacgcgaggaugacaaagacagugaucaggaaaccgucgacgaggagguggaugaaaacuccagcggaauguuugccgcugaggaaacaggugaggcgcugucugaagagacuaccgcaggcgagcaaucaacaagaaguuucauccuagacaagauaauugaagaggaugacgccuacgauuucagcaccgacuacgucuga

SEQ ID NO: 56790 - RNA, 1749 nt, Artificial Sequence
  derived and/or modified sequence opt3 from GNL3L__Homo_sapiens__NP_061940
augaugaagcugagacacaagaacaagaaacccggcgaggggagcaagggacauaaaaagaucuccuggccuuacccacagccggccaagcaaaaugguaaaaaggcuaccucuaaagugcccucagcaccucacuucguccauccaaacgaccacgccaauagggaagcggagcucaagaaaaaguggguugaagagaugcgggaaaagcagcaggcugcccgcgagcaggagcgacaaaaacguagaacaauugaaaguuauugccaggaugugcuuaggcggcaggaggaauuugagcauaaggaggaaguacugcaggaguugaacauguucccccaauuagacgaugaagcaacucgcaaagccuacuauaaggaguuuagaaaaguggucgaauacagcgacgugauacuggagguucuagaugcuagggacccucucggcugucggugcuuccagauggaggaagcagugcugcgcgcccaggggaauaagaaacuuguccugguguugaacaagaucgaucucguaccaaaggagguuguggaaaaauggcuggacuaucugcgaaaugagcuccccacggucgcuuuuaaggccuccacccagcaccaagugaaaaacuuaaauagauguucugugccugucgaucaggcgucggaaucacugcuuaagagcaaagcaugcuucggagccgagaacuugaugaggguucugggcaauuacugucggcuaggugaggugcguacacacauucgcguagggguggucggacucccaaacgugggcaagaguucccugaucaauucucuuaagagaagcagggcuugcuccguuggcgccgugccggggauuacuaaauuuaugcaggaagucuaucuggacaaguucauccgguugcucgaugcacccggaauagugccugguccaaacucagagguaggcaccauccugcgaaauuguguucaugugcaaaaauuagcugaccccgucacaccuguggaaaccauucugcagcgcugcaaccucgaggaaaucaguaacuacuacggggucagcggauuucagacuacagagcacuuccuuaccgccguggcgcauagacugggcaagaaaaagaaggguggguuguauucucaggagcaagccgcaaaagcuguucuagccgauuggguguccggaaagauuucauuuuacaucccacccccggcuacgcacacucugccuacccaccucagcgccgaaauaguaaaagagaugacagaagucuucgacauugaggacacugagcaggcaaaugaagauaccauggagugucuggccacaggcgaaagugacgagcuucugggcgauaccgaccccuuggaaauggagaucaagcuccugcauucuccaaugacgaaaauugcugaugcgaucgagaacaagacuacaguguauaagaucggggacuuaaccggauacugcacuaauccuaacaggcaccagauggguugggcaaaacggaauguugaucaucgccccaaguccaacagcaugguggacgucuguucgguggauagaaggucuguacugcagcguauuauggaaacagacccacuacaacagggccaggcccucgcuuccgcccugaaaaauaagaaaaagaugcagaaacgggcagauaagauagccucaaaacuuagugacagcaugauguccgcuuuggaccugucugggaacgccgaugacggagugggcgauuga

SEQ ID NO: 56791 - RNA, 519 nt, Artificial Sequence
  derived and/or modified sequence opt3 from GNLY__Homo_sapiens__NP_001289687
auggccaccugggcucugcuccuucuggcagccauguuguuaggcaaccccgggcuggaggugagcgucuccccuaaggguaaaaauacaucuggaagagaaucaggcuucgggugggcgaucuggauggagggccuaguuuuuaguaggcucagcccagaauacuaugaccuggcucgggcccaccuucgcgaugaggaaaaguccugcccgugucuggcacaggagggaccccaaggugacuugcucacuaaaacgcaggagcuggggcgagauuaccguaccugccugacaauugugcagaagcucaaaaagaugguagacaagccuacucagagaucugugucgaacgccgcuaccagggucugucggacaggacgcucaagauggagggaugugugccggaauuucaugcgccgauaucaaagcagaguuacccagggcuuaguggcaggcgaaacugcccagcagauaugugaggaccugaggcuuugcaucccaaguacagggcccuuguga

SEQ ID NO: 56792 - RNA, 888 nt, Artificial Sequence
  derived and/or modified sequence opt3 from GNMT__Homo_sapiens__NP_061833
augguggacagcgucuacagaaccaggucccugggcguugccgcugaggggcuccccgaucaguaugcagacggagaagccgcgcggguguggcaacuuuacaucggugauacacgcucucgaacugcugaguauaaggccuggcuguugggcuuacugcgucagcacgggugccagagaguacuagacguggcauguggaacgggcgucgauucaauuaugcucguggaagaggguuucaguguuaccagcguggacgccuccgauaaaaugcugaaguacgcucuuaaagaaagguggaaccggcgccaugagccugcauuugacaagugggucauagaggaagccaauuggaugacacuggauaaagacgugccacagucugcugaagggggauucgaugccguaaucugcuugggcaacucguuugcgcaccucccggacuguaagggcgaucaaucagagcauagacuggcacugaagaauauugccagcaugguuagggcugggggacucuuagugaucgaccaccggaacuaugaccauauucugaguacugguugcgcacccccuggcaaaaauaucuacuauaaguccgaucuuaccaaagacgucacaaccucuguguugauagugaacaauaaggcccacauggucacucuggauuacacaguucaggugccaggggcuggacaggacggcagccccggucuauccaaauuccgccucucauacuauccucacugucuggccaguuuuaccgagcuucugcaggcggccuucgggggaaagugccaacauagcguauugggcgauuuuaagccauacaaacccggccagacguauaucccuuguuacuucauucacgugcucaagcgaacugacuga

SEQ ID NO: 56793 - RNA, 2043 nt, Artificial Sequence
  derived and/or modified sequence opt3 from GNPAT__Homo_sapiens__NP_055051
auggagagcuccucuucaaguaacagcuacuucuccgugggccccaccucuccuucggccgucguucugcucuauucaaaggaacuuaaaaagugggacgaguuugaagauauccuggaggaaagaaggcacgugagcgacuugaaauucgcuaugaagugcuacacaccauuaguauauaaagggauuacuccguguaagcccauagauaucaagugcagugugcuaaauuccgaggagauucauuacgucaucaaacagcugucuaaggaaagccuccaauccguggacguucugcgggaggaagugucagagauucuugaugagaugagucacaaacugcgcuugggagcaauccgauuuugugccuucacgcucagcaaggucuuuaaacagauauucucuaaggugugcguaaacgaagaggguauccagaagcugcagcgugcgauucaagaacauccuguugugcugcucccaucccacagaucauauaucgacuuuuuaaugcugagcuuccuuuuguacaauuaugaucugcccgucccugugauugcugccggcauggacuuucuagggaugaaaauggugggagagcuccugaggaugaguggcgcauucuuuaugcggcgcaccuucggugggaacaaacuuuacugggccgucuuuucugaauacguuaaaacaaugcugagaaauggauaugcuccaguggaguucuucuuggagggcacuaggucccggagcgcaaagacccucacacccaaauuuggccuguuaaacaucguaauggaaccuuucuuuaagcgcgagguguucgauaccuaccuggucccaauaucgauuucuuaugacaaaauccucgaagagacucuuuacguguaugaacuguuggggguuccgaagcccaaggaguccacaaccggacuacugaaagcccgaaagauucucucagagaauuuugguaguauccauguguacuucggcgauccugucagccugagaucccuugcugccgggaggaugucucggagcucauauaaccuggugccacguuacaucccccagaaacagagugaagacaugcacgcguuuguaacggagguugcauacaagauggaauugcuccagauugagaauauggugcuguccccuuggacuuuaauagucgccgugcugcuacaaaaccgcccaagcauggauuucgacgcucucgucgaaaagacccuguggcuuaagggauugacacaggccuuuggcgguuuccugaucuggcccgacaauaagccggcagaggaggugguuccugcuucuauucuccugcacucaaacaucgccagucuugugaaagaucagguaauacugaaggucgacagcggggauuccgaagugguugacggauugaugcuccagcauauuacucuguuaauguguucugcguauagaaaucaacugcuaaacaucuuugugaggcccucgcucgucgccguggcacugcagaugaccccaggcuuccggaaagaggauguauacagcugcuuucgauuccuucgcgacguguucgcugaugaauuuaucuucuugccuggcaauacacugaaggacuuugaggagggguguuaucuccugugcaaauccgaagccauucagguuaccacgaaggauaucuuagucacugagaagggaaacacagugcuggaguuccuuguggguuuguuuaaacccuucgucgagucauaccaaauuauauguaaguaucuccugagugaagaggaggaccacuuuucugaagaacaguaccuagcugccguuagaaaauucaccagccagcugcucgaucagggcacuucccaaugcuaugacgugcugucaagcgacgugcagaagaacgcacuugccgcuuguguaagguugggggucguggagaaaaagaagaucaauaacaauugcauuuuuaacguuaaugaaccagcgacaaccaaacuggaagagauguuaggaugcaagacgcccaucggcaaaccugcaaccgccaagcucuga

SEQ ID NO: 56794 - RNA, 957 nt, Artificial Sequence
  derived and/or modified sequence opt3 from GNPDA1__Homo_sapiens__XP_005268405
augagcuccuucuggucugacuaccuguuucccuucgugcucuggggcaaacuuaagacccagagagggucacaaaguaaggauaaaaugaagcugaucauuuuggagcacuauagccaggccuccgaaugggcugcaaaauacauaaggaaccggaucauucaguuuaauccuggaccagagaaguauuucacauuaggucugccgacuggcucuacgccccuagggugcuacaagaaacucaucgaauauuacaagaacggagaccugucguuuaaauaugucaagaccuucaauauggaugaguacguuggccuuccucgcgaccauccagaaucauaccacagcuuuauguggaacaauuucuuuaaacauauugauauccaccccgagaacacacauauacuggacgguaaugccguggauuugcaggcggagugugacgcuuucgaagagaagaucaaggccgcagggggaauugaacucuuuguaggcggcaucgggccugauggacacauugccuucaacgagccagguaguucccuggugucucgaacucgugucaaaacccuggcuauggacacaauccucgcaaaugccagauuuuucgauggcgaguuaaccaaggugcccacuauggcucugacaguuggggugggaaccgucauggacgccagggaagugaugauacuuauuacgggcgcgcacaaagcauucgccuuguauaaggcuaucgaggaagguguaaaccauauguggacuguuagcgccuuucaacagcacccucggaccguguucgucugcgaugaggacgcaacacuggaacuaaaagugaagacugugaaauacuuuaaggggcucaugcugguccauaauaaacuuguugacccacuguauuccauuaaggagaaggagaccgaaaaaucacagaguagcaagaaaccguacucugauuga

SEQ ID NO: 56795 - RNA, 729 nt, Artificial Sequence
  derived and/or modified sequence opt3 from GNPDA2__Homo_sapiens__NP_001257809
augagacuggugauccucgacaacuacgaucuugccagcgagugggcugcaaaguauauuugcaauaggauaauccaguucaaacccggccaagaccgguacuuuacccugggguugccuacaggauuaccacgcaaccacccggaauccuaucauucuuacauguggaauaacuucuuuaagcacauugauaucgaccccaauaacgcccauauucuggaugguaaugcggcugaccuacaggccgagugugaugcauucgaaaacaaaaucaaggaggccggcgggauagaccucuuugucggaggcaucgguccugaugggcacauugcuuucaaugaaccaggaucaagucugguuagccgaacucgucuuaaaacgcuggcaauggacaccaucuuggccaacgcuaaguauuuugauggcgaccucuccaaggugcccacaauggcccugacuguaggcguggggaccgucauggaugcgagagaggugaugauucugaucacaggagcacauaaagccuucgcucucuacaaggccauagaggaagguguuaaucacauguggaccgugucugcauuucagcagcacccuaggacuauuuucgucugcgacgaggacgcuacauuagaacugcgggugaaaaccguaaaguauuuuaaaggccuuaugcauguucacaacaaguugguggauccacuguucucgaugaaggacgggaauuga

SEQ ID NO: 56796 - RNA, 3771 nt, Artificial Sequence
  derived and/or modified sequence opt3 from GNPTAB__Homo_sapiens__NP_077288
augcuguucaagcuccuucagagacaaaccuacacaugccugagccacagguauggcuuguacgugugcuuuuuaggggucguugugacuaucguauccgccuuccaguuuggagaggugguccuggaauggucucgggaccaguaucaugugcuauucgauucauaccgcgacaacauugcugguaaaaguuuucagaaucgacucugucugcccaugccuauagauguuguguauacgugggucaacggcaccgaccuugagcuguugaaggaacuccaacaggugcgugagcagauggaagaggagcagaaagcaaugagagaaauccuggggaagaauacaacugagccaaccaaaaagagcgaaaagcaacuggagugucucuuaacacacugcauuaaaguaccgaugcugguucuugaucccgccuugccugcgaacaucacccugaaggaccuaccaucccucuaccccucuuuccauucggcuucagauauuuuuaauguggccaaaccuaagaacccaagcacuaaugucagugugguggucuucgacuccacaaaagauguugaggacgcacacucuggacugcuuaagggcaacagcaggcagaccguguggcgggguuaucugacgacugauaaggaaguacccggguuggugcucaugcaggaccuggccuuuuuauccggauucccuccaaccuuuaaagagacaaaucagcugaagacuaaacucccggaaaaccuuucaaguaaggucaaacuguugcaacuauacagcgaggcuucuguggcacugcucaagcugaauaaccccaaagauuuccaggaacuuaauaagcagaccaagaaaaacaugacaaucgacggcaaggagcugaccauauccccugccuacuugcucugggaccugucagcuaucagccaaaguaaacaggaugaggacauuucugccucccgcuuugaagauaaugaggaauuaagauauagccugaggucgaucgagcggcaugcgccauggguucgcaacauuuucaucgugacgaacggccagauacccucuuggcuaaaucucgacaacccucgagucacuauugugacacaccaggauguauucagaaaucugucccaccuuccaaccuuuucaagucccgcaaucgaaagccauauucacaggaucgagggguugucccaaaaguucaucuaccugaacgacgauguuauguuuggaaaagacguguggccggaugacuucuauucucauagcaagggucagaaggucuaccucacuuggccugugcccaauugugccgagggcugcccagggucauggauuaaagauggauauugugacaaggcuugcaacaauagugccugugacugggauggcggugacugcuccgggaacagcggaggcucucgguacauagcaggcgggggagguacaggcucaaucggggucggacagccuuggcaguuuggcggugggauuaauagugugagcuauuguaaccaaggcugcgcuaauuccuggcuggccgauaaauucugcgaccaggcguguaacguucuuucuugcggauuugaugccggcgacugugggcaggaucacuuccacgaacuguacaaggugaucuugcuccccaaucagacccauuacauaauuccaaaaggagagugccugcccuauuuuucguucgcagaaguagcuaagcguggugucgagggcgccuacagcgacaacccuaucauccgccacgcuuccauugccaauaaguggaaaacgauccauuuaauuaugcacucagggaugaacgcaaccacaauacauuuuaaccugacuuuccaaaauaccaacgaugaagaguuuaagaugcagaucacaguggagguugacacuagagaaggaccaaaacuaaauaguaccgcccagaagggcuaugagaaccucgugucuccgauuacacugcuucccgaagcugagaucuuguucgaggauaucccuaaagaaaagagguucccaaaguuuaaacggcacgacgucaauagcacccgacgcgcgcaggaggaagugaagauuccccugguaaacauaucccuccugccuaaagaugcacaauuaucacugaauacucuugacuugcagcucgagcacggugacaucacgcugaagggguacaaccuaagcaaaucugcccugcucagauccuuccugaugaauagucagcaugcuaagauuaaaaaccaagccaucauuacagaugaaaccaaugacagccuuguggcaccacaggagaagcagguucacaagucuaucuugcccaacucccugggcgucucagagagguuacagcggcucacuuuuccggccgugagugugaaagucaauggacaugaucaaggccagaacccuccacuggaccuugaaaccacagcucgcuucagaguugagacccacacucagaagacaauagggggaaaugugacgaaagaaaagcccccuagccugaucgugcccuuggagucgcagaugaccaaagaaaagaagauuacugguaaagagaaggagaacuccaggauggaagagaacgccgaaaaucacaucggcguaacagagguccuccuggggcguaaacuacaacauuauaccgauucuuaccugggauuucucccaugggaaaagaaaaaguauuuccaggaccugcuugaugaggaggaaucauugaagacacagcuggcauacuuuacugacagcaaaaacaccggccggcaguuaaaggauacguucgcggacagucuccgauacgugaauaaaauucugaacuccaaguuugguuucaccucuagaaaaguuccugcucacaugccccauaugaucgauaggauagugaugcaagagcuucaggacauguuuccagaagaguucgauaagacuagcuuucacaagguccgccauuccgaggacaugcaguucgccuucucauauuuuuacuaucugaugagcgcagugcaaccgcuaaauauuagucagguuuucgacgaaguggauacagaccagucugggguacucuccgaucgggagaucagaacccuggccacaaggauucacgaauugccucugagcuuacaggaccucacuggccuggagcacaugcuuaucaacuguucgaaaaugcugcccgcugauauaacccaauugaauaacaucccacccacgcaggaaucauacuaugacccuaaucucccacccgucacaaagucucuggugaccaacugcaaaccugugacugauaagauucauaaagccuacaaggacaaaaauaaguaucgcuuugagaucaugggagaggaagagauugcauucaagaugauccgaacaaacgucagucacguugugggccagcuagaugacauacggaaaaauccgcguaaguuuguaugucugaacgauaauauugaccauaaccacaaagacgcucagaccgugaaggccguccuuagagauuucuacgaauccauguuuccaauccccagccaauucgagcucccuagggaauaccgcaaccgguuucugcauaugcacgaguugcaggaguggagagcguauagggacaaacugaaguucuggacucacugcguguuagccacccucaucauguuuacaauuuucucuuucuuugcugaacagcugaucgcacuuaagcgaaaaauuuucccacgccggagaauacauaaggaggccagccccaauaggauccguguuuga

SEQ ID NO: 56797 - RNA, 918 nt, Artificial Sequence
  derived and/or modified sequence opt3 from GNPTG__Homo_sapiens__NP_115909
auggccgcuggccuggcaagacuccuucuguuguuagggcugagcgccggaggucccgcgccugcuggcgccgcaaagaugaaaguggucgaggaaccaaacgccuucgggguuaauaacccguuucuaccccaggcuuccaggcuccaagcaaagcgggacccuucuccagugucaggacccguacaccuguuccgccuuaguggcaaaugcuuuagccugguggaguccaccuacaaguaugaguucuguccuuuucauaaugucacacagcacgaacagacuuuccgauggaacgccuacucugguaucuuggggauuuggcaugaaugggagauagcuaauaacacguuuaccggaauguggaugcgugauggcgacgccugcagaucgaggucacggcagagcaaaguggagcucgcguguggcaagaguaaucgccuggcacacguuuccgaaccaucuacaugcguguaugcccugacuuucgagacaccccucgucugucauccucacgcuuuacugguguacccaacccuuccggaagccuugcaaagacagugggaucagguagagcaggaccuggcagaugagcuaaucacuccccaagggcacgaaaagcuccugaggacccuuuuugaggacgcuggauaucugaaaacaccugaagagaacgaaccaacccaguuggaggguggccccgauagccucggguucgagacgcuggaaaauugccggaaggcccauaaagaguuauccaaggaaauuaaacgccugaagggacuccuuacucagcacggcaucccuuacacccgaccaacagagacuucaaaccuggaacauuugggucacgagacccccagagcgaagaguccggagcagcuaaggggagacccugggcugcggggcagccucuga

SEQ ID NO: 56798 - RNA, 291 nt, Artificial Sequence
  derived and/or modified sequence opt3 from GNRH1__Homo_sapiens__NP_000816
augugccugagaaugaagcccauccagaaacuccuugccggccugauuuuguuaaccugguguguggaggggugcagcucccaacacuggucuuacggacugaggccugguggcaagcgggacgcugaaaaccuaauagauucauuccaggagaucgucaaagaaguugggcagcucgcagagacacagcgcuuugaauguacuacgcaucaaccacgaaguccgcugcgugaccuuaagggagcccuggagagcuugauugaggaagagaccggccagaaaaagaucuga

SEQ ID NO: 56799 - RNA, 342 nt, Artificial Sequence
  derived and/or modified sequence opt3 from GNRH2__Homo_sapiens__NP_847901
auggccagcuccagaaggggccugcuccuucuguuguuacugaccgcucaccuagggcccucugaggcacagcauuggucacacggaugguacccugguggcaagcgggcccucaguagcgcgcaagacccacagaacgcucugcgcccgcccgccggguccccugugcagacagcacauggacuuccaucugaugcccuggcucccuuggacgauucgaugccuugggaaggccgaacuacggcacaguggucacuccaccguaaaagacaucuggccaggacccugcucacagcugcccgggagccacgccccgcgccuccaagcaguaauaaggucuga

SEQ ID NO: 56800 - RNA, 987 nt, Artificial Sequence
  derived and/or modified sequence opt3 from GNRHR__Homo_sapiens__NP_000397
auggccaacagcgcuucccccgagcagaaucaaaaccacugcucugcaaucaauaacucaauuccucugaugcagggcaaucucccaacccuuacacugagugggaagauaagagugacugucacguucuuuuuguucuuacugagcgccaccuuuaacgcguccuuccuacucaaacugcagaaguggacacagaaaaaggaaaaaggaaagaaacuuucuaggaugaagcuguugcucaagcaucugacucuggcuaaucucuuagagacccugaucguuaugccgcuugacgguauguggaacauuacagugcaaugguacgccggcgaauugcuguguaaaguacuaucguaucucaagcuguuuucaauguacgcacccgccuucaugaugguggucaucagccuugaucggagucuggcuauuacccgcccuuuggcacucaaauccaauucuaagguggggcagagcaugguuggacuggccuggaucuuauccucaguguuugcuggcccacagcuguauauauuccgaaugauccaccucgccgacaguagcggucagacuaaggucuuuucucaaugcgugacacauuguuccuucucacagugguggcaccaggcguuuuacaacuucuuuaccuucagcugccuuuucauuaucccccuguuuauuauguugaucuguaaugcaaaaauaauuuucacgcuaacucguguacugcaucaggauccucacgagcuccaacugaaccagaguaagaauaacaucccaagagccaggcuuaaaacccugaagaugacaguugcuuuugccacuucuuucaccgugugcuggacacccuauuacgucuuggggauuugguauugguuugacccugaaaugcucaaucggcuguccgauccagugaaccacuucuuuuucuuauuugcauuccugaacccguguuuugacccccuaaucuacggauacuucagccucuga

SEQ ID NO: 56801 - RNA, 1659 nt, Artificial Sequence
  derived and/or modified sequence opt3 from GNS__Homo_sapiens__NP_002067
augagacugcucccccuugccccuggcaggcugcggcgcgggagcccacgacacuugccguccugcucucccgcuuuacugcuacucgugcugggagguugucuuggcgucuucgggguugcagccggaacccguagaccuaacgugguacuguugcucacagacgaucaggacgaggugcugggcgguaugacuccacugaagaaaacgaaggcgcucaucggggaaaugggaaugaccuuuucaagugcuuacguccccagcgccuuaugcuguccuuccagggcaucuauucugacaggcaaauauccacauaaucaccaugugguuaacaauacucuugagggcaacugcucgucaaagagcuggcaaaagauacaggaacccaauaccuucccugccaucuugcggaguauguguggguaccagacauuuuucgcuggaaaguaucugaacgaguacggugcaccagaugccggcgggcuagaacacgugccgcucggaugguccuauugguacgcucuggagaaaaauucuaaauauuacaacuacacccuuagcauuaauggcaaggcccgcaaacauggugagaacuauuccgucgacuaccugacugauguguuggcgaauguaucacucgacuuucuggauuauaagaguaacuucgaacccuuuuucaugaugaucgcaaccccugccccacacagccccuggacagcugccccucaguaccaaaaagcauuucagaauguuuucgcuccaagaaacaagaauuuuaacauucacgggacgaacaagcauugguuaaucaggcaggccaaaacucccaugaccaauucuuccauacaguuccuggacaacgcguuucggaagcgcuggcaaacacuccuuucaguggaugaccuggucgagaaauuggugaagcgacuagaguucacuggagaacugaauaacaccuauaucuucuacacaagcgauaauggcuaucacaccggccaguuuagucucccgauugacaaaagacagcuguacgaguucgauaucaaggugccucuucuggucagggggcccggaauuaaaccaaaccagacgucuaagauguugguugccaauaucgaccucgguccuacuauacuggacauugcaggcuacgauuuaaacaagacacaaauggacgggaugucccugcuacccauccuccggggagcuagcaaucugaccuggcguucggaugugcuuguagaauaucagggcgagggucgcaacgugacugacccaacaugccccucuuuguccccuggggucucacaguguuuuccagauugcgugugugaagacgccuacaauaacaccuaugcuugcguuagaacgaugagugcccuguggaaucuccaauacugugaguucgaugaccaggaaguguuugucgagguguauaaccugaccgcagauccggaccagauuacaaauaucgccaaaacuaucgaucccgagcuucugggcaagaugaacuacagguugaugaugcuccagagcugcuccggaccuaccugccggacaccaggcguauucgaccccggguaucgauuugacccucgccugauguucucuaacagaggaagcguuaggacucggcgcuuuucaaaacauuuacuguga

SEQ ID NO: 56802 - RNA, 2304 nt, Artificial Sequence
  derived and/or modified sequence opt3 from GOLGA1__Homo_sapiens__NP_002068
auguucgccaagcugaaaaagaaaaucgcugaggaaaccgcaguggcccagagacccggcggggcgacaaggauuccucggagcgucuccaaggagucuguugcuucaaugggagccgacaguggugaugacuuugcaagcgauggcuccucuucgcgcgaagaccucucaagccaacuucugcgacguaacgagcagauaagaaaauuggaagccagguuaagugauuacgcugaacaggugcggaaucugcagaagaucaaggagaaacuagaaauugcacucgagaagcaccaagacuccucuaugcgcaaauuccaggaacagaacgagacuuuucaggccaauagagcuaagauggccgaggggcuggcgcuugcacuggccaggaaagaucaagaauggagcgagaagauggaccaguuggaaaaggagaaaaacauccucacggcucagcugcaggaaaugaagaaucaauccaugaaccuguuccagcggcgcgaugagauggacgagcucgaaggauuucagcaacaggaguuaucaaaaauuaagcauaugcugcuuaaaaaggaagagaguuugggcaaaauggaacaggagcuggaggcccgaaccagagaacuaagcaggacacaggaggaacucaugaacucuaaucaaauguccucagaucugagccagaaacuugaggaacugcagcggcacuauaguacuuuggaggagcagcgugaccauguaaucgcaucuaagaccggugcugaauccaagauaacagcccucgagcaaaaggaacaggagcugcaggcguuaauccagcaacugagcauugaucuccagaaagugaccgccgagacucaggaaaaggaggacgucaucacacaccuucaggaaaaaguggcaucgcuggagaagcgcuuggaacaaaaucuaucuggggaggagcauguucaggaacugcucaaggagaaaacccuggcugaacagaaccuugaggacacgagacaacagcuguuggccgcuagguccucacaggccaaggcaauuaauacucucgaaacccgggugcgagagcuggagcagacauuacaagccagugaggagcagcugcagcagagcaaaggaaucgucgcugcgcaagaaacucagauacaggagcuagcagccgcuaaccaggaauccucucacgugcaacagcaggcccucgcacuggagcaacaguuccuugagcgcacccaggccuuggaagcucagauuguagcccuggagagaacaagggcagcggaucaaaccacggcugaacagggcaugcggcagcucgagcaggagaaugccgcacugaaggaaugccgcaacgaguacgaaagaagccuucaaaaucaccaguuugagcugaaaaaguugaaggaagaguggucacagagggagaucguuaguguggccauggcucaggcccucgaagagguccguaaacaacgggaagaguuccagcagcaggcagcuaaccugacugccauuaucgacgaaaaggagcaaaacuuacgagagaaaacagaagugcugcuacagaaggagcaggaaauccuccaacuggagagaggccauaauuccgcgcuuuugcagauucaccagcugcaggccgaacucgaggcucugaggaccuuaaaagcagaggaagccgcuguggucgccgagcaagaagaucugcuucgcuugcgggggccacuccaggcagaggcgcugagcguuaacgagucucaugugacuucaagagccaugcaggacccgguauuucagcuacccacagcuggaaggaccccuaauggugaagugggcgccauggaucugacgcaacuccagaaggagaagcaggaccuggaacagcaacuuuuggagaaaaacaagaccauaaaacagaugcagcaacgcaugcuggaauuacgaaagacacuccagaaagagcugaagauccggccagauaaugagcuuuucgaaguccgugagaaacccgggccugaaauggcaaacauggcuccaagugugacuaauaacaccgaccugacagaugccagagagauuaauuuugaauauuugaagcacguugugcucaaguucaugagcuguagggaguccgaggcauuucaccugaucaaagccgucucugugcuacugaacuucucgcaggaagaggaaaauaugcucaaggagacucuggaauacaaaaugagcugguucggauccaagcccgcuccuaaaggcucaauacgcccaaguauuucuaacccgcggauccccuggagcuga

SEQ ID NO: 56803 - RNA, 3009 nt, Artificial Sequence
  derived and/or modified sequence opt3 from GOLGA2__Homo_sapiens__NP_004477
auguggccccagccuagacugccaccgaggcccgccaugagcgaggaaacccggcaauccaagcucgcugcagccaaaaagaaacuucgcgaguaccagcagcgaaacucuccuggcgugccaacaggggcgaagaaaaagaagaaaaucaagaauggaucaaaccccgaaacuacgaccagugguggcugccacagcccugaggacacaccaaaagauaaugcugccacucugcagcccuccgacgauaccgucuugccugggggaguuccaucuccgggcgcaucguuaacaucaauggccgcuagccaaaaccaugacgcagauaaugugcccaaccugauggacgaaaccaagacuuucaguuccacagagucucuacgucagcucagccagcagcugaauggucuuguaugugaguccgcuaccugcgugaacggggaaggaccugccucaagugccaaucugaaagauuuggagagcagauaucaacagcucgcggucgcacuggacucuuccuacgugacgaacaagcagcugaauauuacuauagaaaagcucaaacagcaaaaccaggagaucaccgaucaguuagaggaagagaagaaagaaugucaccaaaagcagggcgcccugagggagcagcuucagguucauauucaaacaaucggcauuuuggugucagaaaaagcugagcugcagacugcccuagcacacacccagcaugcugcccggcagaaggagggggaaagcgaggaccucgcgagucgccugcaauauucuagaaggcgggucggagaacuugagcgcgcccuguccgcagugagcacacagcagaaaaaggcugaucgauacaauaaggaauugaccaaagagagagacgcccucaggcuggaguuauauaagaacacgcagucgaaugaagaucugaaacaagagaagucugaacucgaggaaaaacuucggguacugguuacugagaaggcugguaugcaguugaaccuagaggaacugcagaagaaacucgagaugacagaacugcuucugcagcaauuuuccucacguugcgaggccccagacgcaaaccagcaguugcaacaggccauggaggaacgcgcucagcucgaggcgcaccugggccaggugauggaaagugucagacaauuacagauggagagggacaaguacgcagaaaaucugaaaggggagagcgccauguggcggcagcgaaugcagcaaauguccgaacaggugcacacccuacgcgaagagaaggaauguucuaugagcagagugcaggagcucgaaacuucacuggcugagcuuaggaaccagauggccgagcccccuccacccgaaccgccugcaggacccagugaggucgaacaacaguugcaggccgaggcugaacaucugcggaaagagcucgagggccuggccggucaacuucaggcacagguucaggauaaugaagggcugucccgcuugaacagagagcaagaagagaggcuccuggaguuagaacgugcggcugagcuguggggagaacaggccgaggcacggcgacagauccuagaaacaaugcagaaugacagaaccacgauaagcagggcccucucucaaaaccgcgagcugaaggagcagcuugcugaauugcagucaggcuucgugaagcugaccaaugagaacauggaaaucacaagugcccuccagagcgagcaacacguaaaacgggaacugggcaagaaauuaggggagcugcaggagaaacuuuccgaauugaaggagacuguggaacucaagucucaggaggcacagucgcugcaacagcagagagaucaauaucuaggacaucugcagcaguacgucgcugccuaccagcaacucaccagcgaaaaggaggugcugcacaaucagcuuuugcugcagacacaguuaguugaccaacuccagcagcaggaggcgcaagguaaagccguggcugaaauggcaaggcaggagcugcaggaaacucaagagcgccuugaggccgcuacccagcagaaccagcaacugcgagcccaguugucccucauggcacacccaggcgaaggggauggacuggaccgggaggaagaggaagaugaggaggaagaggaagaggaagcggucgccgugccucagcccaugccaucaauucccgaggaccuagagagucgugaagcuaugguagccuuuuucaauucugcaguugcuagcgccgaggaggagcaggcaagacugaggggccaacucaaggaacagcgcgugcggugcagaaggcuggcccaucuuuuggcuuccgcgcagaaagagccugaggccgcagcuccagccccggguacagggggcgauucagucuguggagaaacccaccgagcccugcagggcgcuauggagaaguuacaaagccgcuuuauggaacucaugcaggagaaagcagaccugaaggagcggguggaggaacuugaacauagaugcauccagcugucuggggagacugauacgauuggagaauauaucgcccuauaccagucccaaagggcgguccucaaagagcgucaccgcgagaaggaagaguauauaagucggcuggcucaggacaaggaagagaugaaagugaaguugcuggaauuacaggagcucguucugagacuugugggugacaggaacgaguggcauggccgauuccuggccgcagcccaaaaucccgcugaugaaccuacaagcggggcaccagcgccccaggaguugggagccgcuaaccagcagggcgaccucugugaaguaucucuggccgguuccgucgagccugcacaaggggaagcccgggagggcucaccacgcgauaaucccaccgcucagcagauuaugcagcuacugagagagaugcaaaacccgagggaacggccuggacuuggcaguaacccaugcauccccuuuuucuaccgagccgacgagaaugaugaagugaaaauuacuguuaucuga

SEQ ID NO: 56804 - RNA, 3405 nt, Artificial Sequence
  derived and/or modified sequence opt3 from GOLGA3__Homo_sapiens__NP_001166028
auggacggcgccagcgcugagcaggaugggcugcaagaagacagaucccacucuggacccucaagucucccugaggcaccacuuaagccgcccgguccucuggugccacccgaucagcaggacaaaguccagugcgccgaaguuaacagggcgagcaccgagggcgaauccccugaugggccaggacaaggcgguuugugucagaaugggcccacaccuccauucccggaucccccuucuucguuagacccaacuacgucacccgugggaccugacgcuagcccaggcguagccggcuuucaugauaaccugcggaagagucaggggaccuccgcagagggaucugugcgcaaagaggcccuacagagccuccgacugucccuucccaugcaagaaacacagcugugcucaacugacaguccguugccucucgagaaggaagaacagguccgucugcaggcuagaaaauggcuggaggaacaacucaagcaguacagggugaagcggcagcaagagcgcagcucucagcccgcaaccaaaacaagauuauucuccacccuggauccagaacuuauguugaauccugagaaccugcccagggccucaacucuagcuaugacaaaggaauauagcuuucuccggaccaguguuccacgcggucccaaagugggcucucuggggcuuccugcccacccacgagagaagaaaacguccaagagcucgaagaucagaucucuggcggacuacaggacugaggauuccaaugcaggaaacucaggcgguaaugucccggcccccgacaguaccaaagggagcuugaagcagaaccgguccucugcugccagcgugguaucagaaauuagucucuccccugacacagaugaccgucuggagaauacuagcuuagcaggagauucuguuucagaaguggacggcaacgauagugacagcuccucuuauucgagcgcuuccacccgcggcacauacgggauacugucaaaaaccgucggaacgcaggauacuccauauauggugaauggucaagagauccccgccgacacacucggccaguucccuaguauuaaggaugugcuucaggcggccgcagcugaacaucaggaccaagggcaggaggucaacggagagguuagaucuaggcgggauagcaucuguuccucagugagccuggaaucuuccgccgcugagacccaggaagagauguugcagguacuaaaagaaaagaugcgacuggagggccaacucgaggcccugagucuugaagcaagccaggcccugaaagagaaggcugaauugcaggcgcagcucgcagcccugucuacuaaguuacaagcucagguggagugcucccacucaagucagcaacgccaggacagccugucguccgaggucgacacacuaaaacagucuuguugggaucucgaaagagccaugaccgaccugcagaauaugcuugaggcaaagaacgccagcuuggcuucaaguaauaacgaucugcaaguggccgaggagcaguaccagaggcucauggcaaaaguugaagacaugcagcgguccaugcugucuaaggauaacacggugcaugaccuucgccaacagaugaccgcgcugcagagccaguugcaacagguccagcucgagagaacaacucugaccuccaaauuaaaggcuucacaagccgagauuagcagucugcagucugugaggcagugguaucagcaacagcuagcacucgcccaggaagcucguguacggcugcagggugagauggcccacauccaaguugggcagaugacacaggcaggccuuuuggaacaccugaagcucgagaaugugucccugagccagcaauuaacugaaacccagcaucgaucgaugaaagagaagggaagaauagcugcccagcugcagggcaucgaggcggauaugcuugaccaagaagccgcuuuuaugcagauucaggaggcaaaaacaauggucgaagaggauuugcaaaggcgccucgaagaguucgagggggaacgggagagacugcagaggauggccgacucagcugccucucuagaacagcagcuggagcaagugaagcucacccugcuucagcgcgaucagcaguuggaggcacugcaacaggaacacuuagaccucaugaaacagcugacucuuacgcaggaggcgcugcaaagucgagaacaguccuuggaugcccuccagacacauuacgacgagcugcaagcucggcuaggagaacugcagggugaggccgcaagccgugaggacaccaucugccuccugcagaacgaaaagauuauccuugaggcugccuugcaggcagccaagucuggcaaagaggaacuggauagaggggcuaggcgcuuagaagagggaacugaggaaaccagcgagacacucgaaaagcugcgggaggaacuugcgauaaaauccggccaagucgagcaucugcagcaggagaccgccgcacuaaagaaacagaugcaaaagauuaaggaacaguuucuccagcagaaagugaugguugaggcuuacagaagggacgccacuucaaaggaucaacugaucagugaauugaaagccacacgaaagcgccuggacagcgaguuaaaagagcuccggcaggaacugaugcaagugcacggugagaagagaacggcugaagcagagcuuucuaggcugcaccgugaaguagcccagguccgccagcacauggcggauuuggaggggcaucuccaguccgcucagaaagagcgggacgaaauggagacccaucugcaaucacuacaguucgauaaggaacagaugguggccguuacugaggcaaaugaagcccugaagaaacagauugaggagcuucaacaggaagcuagaaaggcaaucacagagcagaaacagaagaugaggcgacucggcagugaccugaccagcgcccaaaaagaaaugaagacaaagcacaaagcguaugagaacgcugugggaaucuugucccggcgccugcaggaagccuuagcagccaaggaggcugccgaugcagagcucggccagcugagagcucaagggggaucuucggacagcucacuugcccugcacgaaaggauucaggcguuggaggccgaacuccaggcagucucccacaguaaaacucugcuagagaaggagcugcaggaagugauagcucuuaccucucaagagcucgaagagagccgggaaaaaguacuggaguuggaggaugaagugcgaccaggucauuuacuguggagacagcgcggcgccgggcacguuucccccggacaugcugcaacgagggagacccgucggacaaagcuccacagagucccgucaguggccacuuuuggcguggccaccuucuga

SEQ ID NO: 56805 - RNA, 6732 nt, Artificial Sequence
  derived and/or modified sequence opt3 from GOLGA4__Homo_sapiens__NP_001166184
auguucaagaaacugaagcagaaaaucagcgaagaacagcagcagcuccagcaagcccuugcucccgcacaggccuccucuaacucaaguaccccuacaagaaugaggagccggacuuccucuuuuacggaacagcuggacgaaggaaccccaaaucgcgaaaacgcgucgacacacgcuucaaagagcccggauagugugaauggguccgaacccucuauuccucagagcggagacacucaauccuucgcccagaaauugcaguuacgagucccaucaguugaaagucuguuucguagccccauaaaggaaucucuauucagauccucaagcaaggaaagucucgugaggaccucuucccgggaaagccugaaccgccuugaucuggacucgucuacagcauccuuugauccuccaucagacauggauagugaagccgaagacuugguagguaauagcgauucccucaacaaagagcagcugauccaaagacugaggcggauggaacgcucucucagcucauaccgaggcaaguauagugaguuagugaccgcuuaccagaugcugcagagagagaagaagaaacuucaagggauuuugucccagagccaggacaaaucucugaggcggaucgcagagcuacgugaagaacuccagauggaucaacaggccaagaaacaucugcaggaggaguucgacgcuucacuugaggaaaaggaucaguauauuaguguccugcaaacucaggugagcuugcucaaacagcgccugagaaauggacccaugaacguugacguguuaaagccucugccacagcucgagccgcaagccgaagucuuuacaaaagaggagaaucccgaauccgacggcgagccugugguagaagaugguaccucuguuaagacgcuugagacucugcagcagagggugaaacggcaggaaaacuugcuaaagcgaugcaaggagaccauccaaucgcacaaagagcaguguacacugcucacuagcgaaaaggaggcgcugcaggaacaacuugacgagcgccugcaggaguuggagaagauaaaggaucuccauauggcagagaaaaccaagcugaucacacaguuaagagacgccaagaaucugauugaacagcuagagcaagauaaagggauggucaucgcugaaaccaagaggcagaugcacgagacgcucgagaugaaagaagaggaaauugcccagcugcggucccgcaucaagcagaugacuacacaaggagaggaacuuagagagcagaaagagaagucagaaagggcagcuuucgaggaauuggagaaggcccugaguaccgcgcagaaaacugaagaggcccgucggaagcucaaagcagagauggacgaacagauaaagacaauugagaaaaccucugaagaggagcgaaucagccugcaacaggaacuuuccagagugaagcaggagguggucgauguuaugaagaaaucaagcgaagaacagauugcuaagcugcagaaauugcaugaaaaggagcucgccaggaaagagcaggaacugacgaagaaauuacagacccgcgagcgggaauuucaagagcagaugaagguggcucuggaaaagucucaguccgaguaccuaaaaaucagucaggagaaggaacaacaggagagccucgcccuggaagaacuugaauugcagaaaaaggcaauccugacagagucugagaacaaacucagagaccugcagcaagaagccgagacuuauaggacccgcauuuuagaacuggaguccucacuugagaagaguuugcaggaaaauaagaaccagagcaaagaucucgcuguacaccuggaggcggaaaagaauaaacacaacaaggagauaacagugauggucgaaaaacauaagacugagcuagagucgcugaagcaccagcaagacgcacucuggaccgaaaaacugcaagugcuuaagcagcaauaccagacagagauggaaaaauugcgagagaagugcgaacaggagaaagagacccuguuaaaggauaaggaaaucauuuuccaggcccauaucgaggaaaugaacgagaaaacucucgaaaagcuggacguuaaacaaacggagcuugagucccugucuagcgaauugucagaggugcucaaggcucggcacaaacuggaagaggagcuaaguguccugaaggaccagacagauaaaaugaagcaggaacucgaggccaagauggacgaacagaaaaaucaccaucaacaacagguggauuccauaauuaaggagcacgaaguaucuauccagcguaccgagaaagcacugaaggaccaaaucaaccagcuugaguugcuguuaaaagaaagagauaagcaucucaaggagcaccaggcccauguugaaaaucuggaggcugacauuaaaaggagcgaaggcgagcuucaacaggccuccgcaaagcuggauguguuucagucauaucagagcgcgacucacgagcaaaccaaggcuuacgaagaacagcuagcccagcuccagcaaaagcuguuggaccuggaaacagagcgcaucuuacucaccaaacaggucgcagaaguggaggcccagaagaaggaugucuguacugagcuggacgcucacaaaauucaggugcaagaucuuaugcagcagcuggaaaagcagaacagugagauggaacaaaaaguuaagucuuugacacagguguacgaguccaaacucgaggacggcaauaaggaacaggagcaaacgaagcagauacugguagaaaaagagaacaugauccuacagaugcgggaagggcagaagaaagagauugagauccugacccaaaaacuuagcgccaaagaagauucgauccauauucucaaugaggaauaugagacuaaguucaagaaccaggagaaaaagauggagaaagucaagcagaaagcaaaggagaugcaggaaacacugaaaaagaaguugcuggaccaagaggcuaaauuaaagaaagaacucgagaauaccgcccuggaacuuucacagaaggagaaacaguuuaacgcgaagaugcuggagauggcccaggcuaauucugcaggaauaagugacgccguguccagauuggaaacaaaccaaaaggagcagaucgaaagccucacugagguucacaggcgagagcugaaugaugugauuucuaucugggagaaaaagcuaaaccagcaagcugaggaacugcaggagauucaugaaauccagcuucaggagaaagagcaagaagucgccgagcucaagcagaaaauacuguuguucgguugcgaaaaggaggaaaugaauaaggagaucaccugguuaaaagaggaaggcgugaagcaggacacgacccugaacgagcuccaggaacaacugaaacaaaagagcgcacacguaaacucccuugcgcaggaugagacaaaacugaaggcccacuuggaaaagcuagagguggaccugaauaaaucacucaaggagaacacuuuccugcaggaacaacuuguugaguuaaaaaugcuggcugaagaggauaagcgcaaagucagugagcucaccagcaaguugaaaacaacugacgaagaguuucagucucugaaguccucacaugaaaagaguaauaaaagccucgaggauaagucccuggaguucaagaaacuuucugaggagcuggccauucaguuggacaucuguugcaagaaaaccgaagcacuacuggaggcuaaaacgaacgaacucauuaauaucucgagcucaaaaacaaacgccauauuaucccggauuagucacugucaacauagaaccacuaaggugaaagaggcacugcuuaucaagacaugcaccgugucugaacuggaggcccagcucaggcaguugacugaggaacagaauacccugaacauuagcuuucaacaggcuacacaccagcucgaggaaaaagagaaucagaucaaguccaugaaggcggauauagaaucacuggucacggagaaagaggcccuucaaaaggaagggggaaaccagcagcaggcagcuucugagaaagaaagcuguaucacccaacuaaagaaagagcugagugagaauauuaacgccguuacuuugaugaaggaagaguuaaaggagaaaaagguggagaucuccagccugucuaaacagcucacagaccugaaugugcagcuucagaacucaauuucccugagugaaaaggaggccgcuaucagcucgcuccguaaacaauacgaugaggaaaagugcgaguugcuggaccagguacaggaucuaucuuucaaagucgacacccuguccaaggaaaagauaagcgcacucgagcaaguggacgauuggucaaauaaauuuagugaauggaagaaaaaggcccagucucgcuucacacagcaucagaacacuguuaaagagcuucaaauucagcuggaguuaaaguccaaggaagcguaugagaaagacgaacagaucaacuugcugaaggaggaacucgaucagcaaaauaaacgguuugacugucugaagggcgagauggaggaugacaaaagcaagauggaaaagaaagagucaaaccuugaaaccgagcugaagagucagacggcuagaaucauggagcucgaagaucacauuacacagaaaaccaucgagauugagagcuugaaugaggugcugaagaacuacaaucagcaaaaagacauagaacacaaggaguuaguccagaagcuacagcauuuccaagagcugggugaagagaaagauaacagggugaaggaagccgaggagaaaauccucacucuugagaaucagguuuauuccaugaaggcagagcuggaaaccaaaaagaaggaguuggaacacgugaaccugucuguaaaaagcaaggaggaagaacucaaagcccuggaggaccgacuugaauccgagucagcugcaaagcucgccgaacugaaacggaaggcggagcagaaaauugcugccaucaagaagcaguugcugucucaaauggaggaaaaagaggaacaguacaagaaagggacagagagucauuuaucggaacuaaauacuaagcugcaggagcgcgagagagaaguccacauucucgaggaaaaacuuaagagcguggaguccucucagucagaaacccugaucgugccaaggagcgcaaagaacgucgccgcuuauacagagcaagaggaagccgauucccagggaugcguucagaaaacguacgaggaaaagauaaguguguugcagcggaaucugaccgagaaagaaaagcuccugcaacgaguaggccaggagaaagaggaaacugugucuagccauuuugagaugagaugccaguaccaggaacgccuuaucaaguuagagcacgcagaggcuaagcaacacgaagaccagucaaugauuggccaucugcaggaggaacucgaggagaaaaacaagaaauauuccuugaucgucgcccaacacguggagaaggaagggggcaaaaauaacauucaggcgaagcagaaucuggaaaacguuuucgacgaugugcagaagacacuacaagagaaagaacugaccugucagauccucgagcagaagauaaaagaacuugacaguugccuggucaggcagaaggaggugcaucguguugagauggaagaguugacuagcaaauacgaaaagcugcaagcccuccagcagauggauggucggaacaaacccacagagcuguuagaagagaauaccgaggaaaagucuaagucccaccuugugcagccuaaacugcucucaaacauggaggcacaacacaaugaccuagaauuuaagcuggcuggcgccgagagagagaaacagaaguuggggaaagaaauugucaggcugcagaaggaucuccgcaugcuucgaaaggagcaucaacaggaacuggagaucuugaaaaaggaauaugaccaggagagagaggagaaaaucaagcaggagcaagaagaucuggagcucaaacacaacagcacguuaaagcagcugaugcgggaguucaauacucagcuugcucagaaggagcaagagcuggaaaugaccauuaaagagacaauaaacaaggcacaggaaguagaggccgaacuacucgagucgcaucaggaggaaaccaaucagcuguugaaaaagaucgccgagaaagacgaugaccugaagaggacugcuaagcgcuacgaagagauucucgaugcgcgugaggaagagaugacagcaaaagugagagaccuucaaacccagcuggaagaguuacagaagaaauaucaacagaagcuggaacaggaggagaacccaggaaaugauaacacacaguuggcccagaaaacuacccucaucucugacaguaagcugaaagaacaggaguuucgggaacagauucacaaucuagaggacaggcuuaagaaguacgagaaaaacguuuaugcuacgacagugggcacccccuacaagggugggaaucuguaccauacugaugucucccucuucggcgagccgaccgaguucgaauaucugcgcaaaguguuguuugaguacaugaugggacgagaaacaaagacuauggccaaaguaaucaccacggugcugaaguucccugacgaucagacacaaaagauacucgagagagaagacgcacggcuuaugagcuggcugaggucauccucuuga

SEQ ID NO: 56806 - RNA, 2196 nt, Artificial Sequence
  derived and/or modified sequence opt3 from GOLGA5__Homo_sapiens__NP_005104
augagcugguucguggaccuggccggcaaggcugaggaucuccuuaacagagucgaccagggggcagccaccgcgcuguccaggaaagauaaugcuucuaacaucuacucaaagaauacagacuauacugaauugcaccaacagaacacggauuuaauuuaccagaccggacccaaaaguacauauauaagcuccgccgcagacaauauccggaaccagaaggccacuauucuggcugguaccgcaaauguuaaagugggcucucgcacaccuguagaggccucgcauccaguggaaaacgcuucagucccgcgacccagcagucacuuugugcguagaaagaaguccgagccugaugacgaacuacucuucgauuuucuuaauucuagccaaaaagagccaaccgggaggguugagauccggaaggaaaaaggaaagacucccguguuccaguccucacagacaaguagcgucucuuccgugaacccuucaguaaccacgauuaaaacuaucgaggaaaauagcuuuggcagucagacccaugaggccgcgucuaacuccgacagcucgcacgagggucaagaagagucuuccaaggaaaauguuucaaguaacgcagccugcccagaucauacacccacuccuaaugacgaugggaaaagccacgagcuguccaaccugcgcuuggaaaaccagcuccugagaaaugaggugcagucucugaaccaggagauggcuagccucuuacaaaggucaaaagaaacccaggaggaacugaauaaggcccgggcacgcgucgagaaauggaacgcugaccacaguaaguccgaccgaaugacaagaggacuuagggcccagguggaugacuugaccgaagcgguggccgcaaaagauagccaacuggcuguccuaaagguucggcuccaggaggccgaccagcugcuuucuacgcguacugaggcucuggaagccuugcagucagagaaaagucgcauaaugcaagaucagagcgaaggcaauucccuccagaaccaggcacugcaaacauuacaggagagacugcaugaagccgacgcuacccucaagagggagcaggagucuuacaagcagaugcaaucggaguucgcggcacggcuuaauaaaguggaaauggaacgacagaaccuggccgaggcuaucacuuuggccgagcgcaaguauagcgaugaaaagaagagaguagacgagcuacagcagcaagugaaacuguacaagcucaaucuggaauccucaaagcaggagcuuauugauuauaaacagaaggcaacaaggauccugcaaaguaaagaaaaguugauuaacucucucaaagagggcagcggguuugagggacuggacuccucaaccgccagcucuauggaauuagaggaacugcggcacgagaaggaaaugcagcgcgaggagauccagaagcuaaugggucagauacaucaacucagauccgaacugcaggauauggaggcucagcaggucaaugaagccgagagugcaagggaacaacuucaggacuugcacgaccagauugcgggccagaaagcuagcaagcaagagcuggagacggaacucgagcgucugaaacaggaguuccacuacaucgaagaggaucuuuaccggaccaagaacacacugcagucucgaauuaaagacagagaugaagagauccaaaaguugaggaaucagcucacuaacaagacccuguccaauucaagucagagcgaauuagagaaccgccugcaucagcuaacagaaacucucauccaaaaacagaccaugcuggagucgcuuuccacagagaagaacucuuugguguuucagcuggaacggcucgagcagcaaaugaauagcgccucagggaguuccucuaacggaagcuccauuaauaugucaggcauagacaacggugaagggaccagacugaggaauguuccaguguuauucaacgauacugagacgaaucuggcaggaauguauggcaaaguccgcaaggccgcuagcaguaucgaccaguuuucuauucgacuuggcaucuucuugcggcguuacccgauagccagaguguuuguaauuaucuauauggcacuccugcaccuauggguuaugaucgugcugcucacauacacccccgaaaugcaucacgaucagccuuaugggaaauga

SEQ ID NO: 56807 - RNA, 1812 nt, Artificial Sequence
  derived and/or modified sequence opt3 from GOLGA8B__Homo_sapiens__NP_001018861
auggccgaggaaaccggccagagcaagcuggcugcagccaaaaagaaauucaaggaguacuggcaaagaaacaggcccggggugccugcggcugccaaacggaauacaaaggcaaacggauccucuccagaaacugccgcuucagguggcugccacaguagcgaggcauccucuucggccucaagcagucuccaugcucgccaguccccgugucaggaacaggccgcgguccuuaauucucgaagcaucaagauuucccgucugaacgacacgauaaaaucauugaagcaacagaaaaagcagguugagcaccaguuagaggaagagaaaaaggcaaauaacgaaaagcaaaaagccgagagagagcuggaagggcagauccagaggcuaaauaccgagaagaaaaagcucaacacagaucuguaucauaugaaacacagucuucgguacuuugaagaggaaagcaaggaccuggcuggacgcuugcagagaucuucccaaaggauuggcgagcucgaguggucacugugcgccguggcagcuacucagaaaaagaagcccgaugguuucagcagucggucuaaagcccugcucaagcgccaguuagaacaauccauccgagagcagauucugcuuaaagggcauguaacccaguugaaggaaagccugaaagaggugcagcuagaaagagaccaauaugcggagcagaucaagggagagagggcccaguggcagcaacggaugcguaagaugucgcaggaagucuguacacucaaagaggaaaagaaacacgauacccaccgcguggaggaacuggagagaucucuuuccaggcugaagaaucagauggcagagccuuugccacccgacgcuccugccguuucaagugaaguggagcuccaggaucugcggaaagaauuagagcgagucgcuggcgagcugcaagcccagguggaaaacaaucagugcauaagccuccuuaaccgcggccagaaggagagacugagggaacaagaggaacgguugcaggagcagcaagagcgccuaagagaaagggagaagcgucugcagcagcucgcagaaccacaguccgaccuggaggaacuuaaacaugagaauaagucugcccugcaauuggagcagcagguaaaagaacuccaggagaagcuggggcaaguuauggaaacuuuaacaagcgcugagaaagaacccgaggcggcagugccugccucaggaaccgguggcgagaguuccgggcugauggaucuacucgaagagaaggcugaccugcgggaacacgucgagaaacuugaguugggauuuauccaguaccgaagagaaaggugucaucagaaggugcaccgccugcucacggagccaggcgauagcgccaaggacgcaucuccgggugggggacaccaucaggccggccccggccaagggggagaagagggugaagcugccggcgcagcgggggauggaguggcugccugcggcucauauagugagggucacgggaaauuccuggcagccgcucggaacccugccgcagagccaagccccggcgcuccugccccacaggaacuuggagcggccgacaagcauggcgaccugugugaggcuuccuugacuaauucugucgaacccgcacagggggaggccagagaaggaucgagccaagauaacccgaccgcucagccuguucuccagcuguuaggugagaugcaggaccaccaagagcaucccggccugggguccaacugcugugugccaugcuuuuguugggccuggcuaccuaggcgccgacgguga

SEQ ID NO: 56808 - RNA, 9810 nt, Artificial Sequence
  derived and/or modified sequence opt3 from GOLGB1__Homo_sapiens__NP_001243415
augcugagcagacucuccggccuugccaacgugguccugcacgaauugucuggggacgaugacaccgaucagaauaugagggcucccuuagacccugaacugcaucaagagucagauauggaguucaacaauacaacucaggaggacguucaggaacggcuagcauacgccgagcagcucgugguagagcugaaggauaucauucgccaaaaagacgugcagcuucagcagaaggaugaagcgcugcaagaggaacgaaaagcugccgacaacaagaucaagaaguugaagcuccacgcaaaagccaagcugacgagucugaauaaauauaucgaggagaugaaggcucagggagguaccguccucccaacagaaccgcagagcgaggaacaguuauccaaacaugauaagucuucgacugaggaagagauggagauugaaaagaucaaacacaagcugcaagagaaagaagaacuuauuucaaccuugcaggcacagcugacacaagcccaggcugaacagcccgcccagagcaguaccgagauggaggaauuugugaugaugaagcaacagcuacaggagaaagaagaguucaucuccacucuccaggcgcaacugucucagacacaggcagaacaggccgcucaacuuagcuccaugcagcagguugugcgugagaaggacgccagauuugagacccaggucaggcugcaugaagaugaguugcuccaacuggugacgcaggcagacguagaaacugagaugcagcaaaaauuacggguucugcagcgcaagcucgaggaacacgaggaaucacuugugggcagagcucaggucguggaccuguugcagcaagagcuaaccgccgcggaacagaggaaccagauacugagucagcaacuccagcagauggaggccgagcacaauacacugcggaacacuguggaaaccgagcgcgaagagagcaagauccuucuggagaaaauggaguuggaggucgcagaacgaaagcucucuuuccauaaucugcaggaggaaaugcaccauuuacuggagcaauuugaacaggcugggcaggcccaagcugagcuagaguccagauacucagcccucgaacagaaacacaaggcagagauggaagagaaaacaagccacauucugagucuucagaagaccggacaggaguugcaaucugccugcgaugcucugaaggaccagaacuccaaacuccugcaggauaagaaugaacaggcgguucaaagcgcacagacgauccagcagcuugaggaccaacugcagcagaaaucgaaggaaauuucucaguucuugaacaggcucccucugcaacagcaugagacugccucccagacaucauuuccagauguguauaaugaaggcacccaagcuguaacugaggagaacaucgccaguuuacagaaacggguggucgaacuggagaaugaaaagggugcacuacuccugagcuccauagagcuugaagaguugaaggccgagaacgaaaaacugucuagccagauuacacuccuggaggcucagaaccguaccggggaagccgaccgcgaggugucagaaaucaguauuguugauaucgcaaauaagagauccagcucugcggaggagucaggacaagacguguuagaaaacacguucagucagaaacacaaggagcugagcguccuuuugcucgaaaugaaagaggcucaggaggaaaucgccuuucugaagcuacagcugcaaggcaagagggcagaggaagccgaucaugaggugcucgaccagaaagaaaugaagcagauggagggcgaggggauugcucccauaaaaaugaagguauuccuggaagauaccggacaggacuuuccucuuaugccaaaugaggaauccucuuugcccgccguugagaaagaacaagcaucgacagagcaccagagccggacuuccgaggaaaucucacugaacgacgcugguguggaguuaaagaguaccaaacaggauggcgacaagucucucagcgccgucccugauauugggcaaugucaucaggacgaacuggagcgacuuaagucccagauccuggaauuggagcucaauuuccacaaagcgcaggagauauacgaaaagaaccuggaugagaaagccaaggaaauuucaaaucuaaaccaacugaucgaggaguuuaaaaagaaugcugacaacaauagcucugcauucacagcccucuccgaagaacgcgaucagcugcuuagucaggugaaggaauugagcauggucacugagcugagagcucaggugaaacaauuagaaaugaaccucgccgaggcagagaggcagcggcgccuggacuaugaaucucagaccgcgcacgauaaucuucugacagagcagauccauucccuaucaauugaagccaagaguaaagacguuaagaucgaggugcuccaaaacgaacuggaugacguacaguugcaguucagcgagcagucgacccugauuagauccuuacaaucucagcuccagaauaaagagagcgaaguccuggagggagcugaaagggugcgucacauaucaaguaagguugaggaacuuucccaagcccugucucagaaggaguuggagaucacuaaaauggaucagcuccugcuagaaaagaaacgggacguggagacgcugcagcaaacaauugaagagaaggaccagcaggucaccgagaucagcuuuuccaugacugagaaaauggugcagcuuaacgaggaaaaguucucacucggcguagagaucaagacccugaaagaacaauugaaccuguuaagccgagcagaggaggcuaagaaagaacagguggaggaagauaaugagguuaguucuggucucaagcagaacuacgacgaaauguccccagccgggcagauuagcaaagaggagcugcaacaugaauuugaucuucugaagaaagagaaugaacagagaaagaggaaguugcaggcagcccucauaaaccgcaaagagcugcuacaacgggucucgagacuggaagaggagcuugcuaaucucaaggacgaaagcaaaaaggagaucccgcugucugaaacagagaggggagagguggaagaggauaaagaaaacaaggaguauagugaaaagugcgugaccuccaaaugucaggagauugagaucuacuugaagcagacuauuagcgaaaaagaggucgaauuacagcacauccgcaaggaccuggaggaaaaacucgcggccgaggagcaauuccaggcacugguuaagcagaugaaucagacacuucaagauaagacgaaccagauagaccuguugcaggcugaaaucucugagaaucaggccauuauccaaaaacuaauuaccagcaacacugaugccuccgacggcgauucaguggcucuggugaaggaaacaguagucaucagucccccuugcaccggcagcucugagcacuggaaaccagaacucgaggagaagauacuggcacuugaaaaagagaaggaacaguuacagaagaaacugcaagaggcccucacaucccgaaaggcgauuuugaaaaaggcucaggagaaagaacggcaucugcgugaggaacucaagcagcagaaggacgauuacaauagacugcaagagcaguuugacgaacagucaaaagagaacgagaauaucggggaccagcuuaggcaacugcagauucaggugcgcgaaaguaucgauggaaaguugcccagcacugaccagcaagaguccuguucuucgaccccuggucuagaagaaccacuguucaaagccacggaacagcaccauacccagcccguucucgagagcaacuuaugcccggauuggccuucacacuccgaggacgcaagugcccugcagggcgggacaucuguggcucaaauaaaggcacagcuuaaagaaaucgaggccgaaaaggucgagcuggaacucaaagugagcuccacuaccucagaguugacaaagaagucugaggaaguuuuucagcugcaagagcagauuaauaaacagggacucgaaaucgagagccugaagacugugagucaugaggcggaaguacacgcugagucccuucagcaaaaacuagaaagcucucagcugcagauugccggcuuggagcacuuacgggaacugcagcccaagcucgaugagcugcaaaaacuuaucucaaagaaggaggaagacgucuccuaucugaguggucagcucagcgagaaagaagcagccuugaccaagauacagacggagauuaucgaacaggaggaucugaucaaagcucuacauacacaacuggagaugcaggccaaggaacacgacgagagaauuaaacagcuccaaguggaacuuugugagaugaagcagaagccagaagagaucggggaggaaucgagggcaaaacagcagauucaacgaaagcugcaggcugccuuaauaucucgcaaagaggcguugaaggaaaacaaaucccugcaggaggagcucagccuggcccggggcaccaucgaaagacuuacuaagucacuggcagauguggagagucaggucucugcucaaaacaaggaaaaagacacaguucucggaagguuggcccuguuacaggaggaacgugauaagcuaauuaccgagauggaccgcucccugcucgagaaucagagccuuucaaguagcugcgaaucccugaaauuggcucuggagggccucacugaagacaaggagaaacuggugaaggaaaucgagucucuuaaaagcuccaagauugcagagucaaccgaauggcaggagaagcauaaagaacuccaaaaggaguacgaaauccuguugcagucuuaugagaacguaaguaaugaggccgaacggauacagcacguggucgaggccgugagacaggaaaaacaagagcuguacgggaaguuaaggucgacagaggcuaacaaaaaggaaacggagaagcagcuacaggaagcggagcaagaaauggaggagaugaaagaaaagaugcgaaaauucgcaaagagcaaacagcagaagauccuggagcucgaagaggaaaaugaucggcuucgcgccgagguucauccugcuggagacaccgccaaggaguguauggaaacucuguuguccucuaacgcaucaaugaaagaggaacuggagagagugaagauggaauaugagacacucagcaaaaaguuucagucccugaugagugagaaagauucucuuagcgaagagguccaagacuuaaagcaccagauugaagguaaugugucaaagcaggccaaccuggaggcuaccgagaaacacgauaaucagacaaacguuacugaagagggcacccaauccauccccggggaaacggaggaacaggacagucucagcaugucuacaaggccaaccugcuccgagucagugcccagcgcgaagucggccaauccugcagucucuaaagauuucaguucccaugacgagauuaacaauuacuugcagcagaucgaucaacugaaggaacggauagcuggacuagaggaagagaaacagaagaacaaagaauuuagccagacucuggagaaugagaagaacacccuccuuucacaaauuuccacaaaggacggcgaacugaaaauguugcaggaggaaguaacuaagaugaaccugcucaaucagcagauccaagaggaacugucucgagugaccaaauuaaaggagacagccgaggaagagaaagaugaccuugaagagagacugaugaaccagcucgcagagcuaaaugguagcaucgggaacuauugucaggauguuacggacgcccagauuaagaaugaacuguuggagagugaaaugaagaaccugaaaaagugcguguccgagcucgaagaggagaaacaacagcuugucaaggagaaaaccaagguggagagcgaaauacgcaaggaguaccuggagaaaauacagggcgcucagaaggaaccaggaaauaaaucucacgccaaggaguugcaagaacugcucaaagagaagcagcaggaaguaaagcaauuacagaaagacugcauuagguaccaggagaagaucucagcgcuggaacguacugugaaagcacuugaguucguccagacagagagucaaaaggaucuggaaauuaccaaagagaaccuagcccaggcuguugaacaucggaagaaggcccaggcugagcucgcauccuuuaaagugcuguuggacgauacucagagcgaggccgcuagagugcuggccgacaaucucaaacuuaaaaaggaacugcaaucuaacaaagagucggucaagucacagaugaaacagaaggaugaagacuuagagaggcgccuggaacaggcagaggagaagcacuugaaagaaaagaaaaauaugcaagagaagcucgaugcgcugcgaagagaaaaagugcaccuagaggaaacaaucggcgagauacagguuacccuuaacaagaaggacaaagagguacagcagcugcaagaaaaucucgauagcacggugacucagcuggccgcuuucaccaaguccaugaguucuuugcaggacgaucgggacagggucaucgaugaggccaaaaagugggaacgcaaauucagcgacgcaauucaauccaaggaggaagagauccgucugaaggaggacaacuguucagugcucaaagaucagcuuagacagaugaguauucauauggaagaacugaagaucaauauaucucgguuagaacacgacaaacagauuugggagagcaaggcucaaacagagguucagcugcagcagaaagugugcgauaccuugcaaggggaaaacaaggagcuccugucccagcuagaagagacuaggcaucuuuaucacucaagccagaaugaacuggccaagcucgagucugagcugaaauccuugaaggaccaguuaacagaucugaguaacagccucgaaaaauguaaggagcaaaaaggaaaccuugaagguaucauccgccagcaggaggcagacauucaaaauucgaaguuuuccuacgaacagcuggagaccgaucuacaggccucucgagagcugacaucaagacuccaugaagagaucaacaugaaagaacagaagauaauuagcuugcugaguggcaaggaggaagcuauccaagucgcgauugccgagcuucggcagcagcacgacaaagagaucaaggaacuggagaaucucuuaucccaggaagaggaggaaaacauagugcuggaggaagagaauaaaaaggcaguagauaaaacuaaccaauugauggaaacccugaagacgauuaagaaagagaauauccagcagaaggcucagcucgacucuuucgucaaaagcaugucaucccuucaaaacgauagggaccgcaucgugggggacuaucagcagcuggaggaaagacaccuaaguauuauccuggagaaggaucagcucauucaagaagccgccgcagagaauaacaaauugaaggaagagauaaggggacugcggagccauauggacgaucuuaauucugagaacgcuaagcuggacgccgaauuaauccaguaccgugaggaucucaaucagguuauuacaaucaaagacucacaacagaagcagcuguuggaagugcagcugcaacagaacaaagagcucgaaaauaaguaugcgaaacuugaggagaagcugaaggaauccgaggaagcuaacgaggaucuacgccgaucauuuaacgcccugcaggaggaaaaacaggaccucucuaaggagaucgaaaguuugaaagucucgauuucccaacugaccagacaggugacugcauuacaggaggaaggcacccuuggucuguaccacgcccagcucaagguuaaagaggaggaagugcauaggcugagcgcuuuguucucaucuagccaaaagcggauagcagagcuggaagaggaacucgucugcgugcagaaagaggccgcgaagaagguaggggagaucgaagauaaacuuaagaaagagcugaagcaccuacaccaugacgcuggcauuaugcgcaaugaaacagagacugccgaagagagaguggcagagcuggccagggauuuaguugaaauggagcagaaacuccugauggucaccaaggaaaacaagggauugacggcucaaauccaguccuuuggccggaguaugucaucucuucagaauagccgagaccacgccaacgaggagcuggaugaacucaaaagaaaguaugacgcaucccugaaagaguuggcucagcugaaggaacaagggcuacucaaucgcgagagggacgcccuucugagugaaacagcguucagcaugaacuccaccgaggaaaauucuuuaucacaucuggaaaaacucaaccagcagcuguugagcaaggaugagcagcuucugcaccucucgucccaacuggaagacaguuacaaucaggugcagucuuuuagcaaggccauggcaucacuacagaacgagcgggaucauuuguggaaugaacuggagaaauuccguaaguccgaggaaggaaaacaaagaucugcugcccagccgaguacuagccccgcagaggugcagucccucaagaaagcuaugucaagccuucagaacgacagggaucgccuguuaaaggaacugaagaaucuccaacagcaguaccugcaaauuaaccaggagaucacagaauugcacccucuuaaagcccagcugcaggaguaucaagacaagaccaaagccuuucagauaaugcaggaggaacuccggcaggagaaucugucuuggcaacacgaacuacaucaguuacgaauggagaagaguuccugggagauccacgaaagaaggaugaaagagcaguaccugauggcgauuagcgauaaggaccagcaauugucacaucuccagaaccugauccgcgaacuucggucuuccucgagccagacucaaccacugaagguccaguaucagagacaggcuagucccgagacaucugcauccccugauggcagccaaaaccucguauacgaaaccgagcuguugcguacgcagcuuaaugacucacugaaagagauucaccagaaggaacuaaggauccagcaacucaacaguaauuucucccagcuguuagaggagaaaaacacucugagcauacaguugugugauaccucucagucacuccgggagaaucaacagcacuauggugaccugcuuaaccauugcgccgugcuggaaaagcagguucaagagcuccaggcugugagcaaagagaaggggccauugaauauugacgucgcccccggagcaccgcaggagaaaaacggcgugcaccgcaaguccgauccugaggaacugcgagagccacagcaaucuuuuagugaggcccagcagcagcuuuguaauacaagacaagaaguuaacgagcugaggaaguuacuagaagaggaacgggaccagcgcguggcugcggagaaugcccucucggucgcagaggaacagaucagaaggcuggagcauagcgaaugggauuccucacgaacccccauuaucgguucuugcggcacacaggagcaagcucuguugauagaccucacuagcaacaguugucggcguaccagauccggggugggauggaaacgcguacugaggucacuuugccacucucggacgagagugccucuguuagccgcaaucuacuuccucaugauucauguucuguugauccuuuguuuuacaggccaccuguga

SEQ ID NO: 56809 - RNA, 1206 nt, Artificial Sequence
  derived and/or modified sequence opt3 from GOLM1__Homo_sapiens__NP_808800
augaugggccuggggaacggaagaaggagcaugaagucucccccucucgugcuugccgcucuggucgcaugcaucauuguuuuggguuucaauuacuggauagccuccucacggaguguggacuuacagacccgcaucauggaacuggaaggccgaguacguagagcggcugccgagaggggagcaguggaacucaaaaagaacgaguuucaaggggaacuagagaaacagcgggagcagcuggauaagauucagagcucccacaauuuccaacuugaaucugucaacaaacuguaucaggacgagaaggccguguugguuaauaacaucacaacuggcgaacgccucauuagagugcugcaggaucagcugaagacgcuccaaaggaauuacggucgguuacagcaggacguccugcaguuucagaaaaaccaaaccaaucuugagcgcaaguucucguaugauuugucacaguguaucaaccaaaugaaagaggugaaggaacagugcgaggaacgaauagaggaaguaacuaaaaaggggaaugaggcuguugcaagcagagaccugagugagaacaaugaucagaggcagcaacuacaggcccucuccgaaccacagccgcggcugcaggcugccggacuuccccauacagaggugccucaaggcaagggcaacguccugggaaauucuaaaagccagaccccagcgcccuccucagaagugguguuggacaguaagcgucaggucgagaaagaagagacaaacgagauccagguugugaacgaggaaccucaacgcgauagacucccacaggaacccgggagggagcagguaguggaagaccggccugucgguggccgaggguuuggaggcgccggugagcuggggcagaccccacaagugcaggcagcuuuaagcguuucucaggagaauccggaaauggagggacccgaacgcgaucaacuggugauuccugacggccaggaggaggaacaggaggccgcaggcgaagggagaaaccagcaaaagcucaggggagaggaugacuacaauauggacgaaaacgaggcugaguccgaaacugauaaacaggccgcgcuugccgguaaugaccggaacaucgaugucuucaauguggaggaccagaagcgcgauacaauuaaccuguuggaccagagagagaaaaggaaucacacccuauga

SEQ ID NO: 56810 - RNA, 897 nt, Artificial Sequence
  derived and/or modified sequence opt3 from GOLPH3__Homo_sapiens__NP_071413
augaccagccugacacagagauccucuggccucgugcaaaggcggacugaggccucacgcaacgcugcagacaaggaacgagccgcugggggaggugcgggcaguagcgaggaugacgcccagucccguagagaugaacaggacgaugacgauaaaggggacucuaaggagacgaggcuuacccugauggaagaggucuuguuacugggacuaaaagaucgggagggcuacacaucguucuggaaugacugcaucucaagcggucuccgcggguguaugcugauugaacuugcacugagaggaagguugcagcucgaggccugcggcaugcggcgcaagagucugcugacucgaaaaguuauauguaaguccgaugcucccaccggcgacgugcucuuagaugaagcacugaagcacguaaaagagacacaaccuccagagaccgugcagaacuggaucgaacuuuugucuggggagacuuggaauccgcugaagcuacauuaucagcucagaaacgucagggaacggcuggccaaaaaucuuguggagaagggaguucugacaaccgaaaaacagaacuuucucuuguucgacaugacgacucacccccugaccaauaacaauauuaagcaacguuuaaucaagaaagugcaggaggcuguccuggacaagugggugaacgauccucaucgcauggacagaaggcuccuugcccugauuuacuuggcgcacgcaagcgauguacuagagaaugccuuugcuccacugcucgacgaacaguaugaucuggccacaaaacggguucgacagcuucuggacuuggaucccgagguggaaugccucaaggcaaacacuaaugagguccugugggcugugguggccgcguucaccaaauga

SEQ ID NO: 56811 - RNA, 399 nt, Artificial Sequence
  derived and/or modified sequence opt3 from GOLT1A__Homo_sapiens__NP_940849
augaucagcauuaccgaguggcagaagauaggcguggggaucacaggauucgguaucuuuuucauucuguuuggcacucuccuuuacuucgacuccguccuguuggccuuugggaacuuacuguuccuaacgggacucucucugauuaucggccuuagaaaaaccuuuugguucuuuuuccaaaggcacaagcugaaagguacaucauuuuugcucgggggaguugugauaguacugcugcgguggccccucuuaggcauguuccuggaaacuuauggcuuuuucagucuuuucaagggguuuuucccuguggcuuuuggauucuuggguaaugucugcaacaucccauuucugggcgcacuauuccgccgacuccaggggaccagcuccaugguguga

SEQ ID NO: 56812 - RNA, 417 nt, Artificial Sequence
  derived and/or modified sequence opt3 from GOLT1B__Homo_sapiens__NP_057156
augaucagccugaccgacacacagaagauuggcauggggcucacuggauucgguguguuuuucuuguuuuucggcaugauacuguuuuucgauaaagccuuguuagcuaucgggaacguccuguuuguugcaggacuagccuucgugauuggccucgagagaacguuuagguucuuuuuccaaaagcacaaaaugaaggcgaccggguuuuuccuggguggaguauucgugguccuuaucggcuggccccugauuggcaugaucuuugaaauauacggguucuuucuucucuuccggggauuuuucccugugguuguggguuuuauccgccgagucccagugcugggcucccugcucaauuuaccggggauucguucuuucguagacaaaguuggagagucaaacaauaugguguga

SEQ ID NO: 56813 - RNA, 6723 nt, Artificial Sequence
  derived and/or modified sequence opt3 from GON4L__Homo_sapiens__NP_001269787
augcugcccugcaagaaaagaagaaccacagugacugagagccuccagcacaaaggcaaccaagaagagaauaacgucgaccuugaauccgcaguuaaaccugagucugaucaggugaaggaccugucaagugucuccuuguccugggauccaucucaugggcggguggcuggcuucgaaguccagucguuacaggacgcagguaaucaacugggcauggaggauacgucacuaagcagugggaugcucacccagaacacaaaugugccgauccuggagggaguugacguggccauuucccagggcauaacucuucccucucuggaguccuuucacccuuugaacauccauauugguaaagggaagcuccacgcgaccggauccaagcgcggcaaaaagaugacacugcgaccaggccccgucacccaggaggaucguugugaccaucugacucucaaagaaccuuucucaggggagccaagugaggaagugaaggaggaaggagguaaaccccaaaugaauagcgagggcgaaaucccuucuuuaccauccgggucacagagcgcuaagccgguaagucagcccagaaagucuacacagccugauguuugcgccuccccacaagagaaaccccugaggacccuuuuucaccagccugaggaagagauugaagacggaggcuuguucaucccaauggaggaacaggauaacgaggagagcgaaaagcggcgcaaaaagaaaaaggguacgaaaagaaagagggacgggcggggacaagagggcacucuggcauacgaucuaaagcucgacgacaugcuggaucgcacccuugaagacggcgccaaacagcacaaucugacagcugugaacguccgaaauauauugcaugaggugaucacuaacgaacacguggucgcaaugaugaaggccgcuauuucggagaccgaggauaugcccauguuugaaccgaaaaugacaagaucuaagcucaaagagguuguggaaaaggggguagugaucccuaccuggaauauuucccccaucaagaaagccaacgagauaaagccaccucaguucgucgacauucaucuggaggaagaugacucaagugaugaggaauaucagcccgacgaugaggaagaggacgagacggcggaagagagcuuacuggaauccgauguggagucuacugcaagcucaccaaggggagccaaaaagagucggcuccgucaauccagcgaaaugacagagaccgacgaggaaucugguauccuuucagaggcugaaaaaguuacuacacccgccauucgccacaucagugcagagguggucccuaugggcccaccgcccccuccaaagcccaagcagaccagagacagcacguuuauggaaaaacugcacgcuguggaugaggaguuggccuccucuccuguauguauggacucguuccagccaauggaugacagccuaaucgcguuuaggacccgguccaagaugccccugaaagauguuccgcucgggcagcuggaagccgagcuucaagcaccugacauuacaccagauauguacgaccccaauacugcugaugacgaagauuggaagauguggcugggaggcuugaugaacgacgauguggguaacgaggacgaggccgacgaugacgaugacccugaauauaauuuccucgaggaucuggacgaacccgauaccgaggacuuucgaacagaucgcgcugucagaauaacuaaaaaggaagugaacgaguuaauggaggaacuguucgagaccuuucaggacgaaaugggguucucaaauauggaggaugacggcccagaagaggaggaaugcgucgccgagccuaggcccaacuucaauacaccacaggcacuacgguuugaagaaccgcucgccaaccugcuuaaugaacagcaucgcaccgugaaggaguuguucgagcaacugaaaaugaagaaaaguucugcuaagcagcuccaggaaguugagaaagugaagccucagagcgaaaaaguacaccaaacucugauccuugaucccgcgcagagaaagaggcugcagcaacagaugcagcagcauguccaauugcucacgcagauucaccuguuagcaacauguaacccaaaucugaaccccgaggccaccacuacccguaucuuucuaaaggagcucggaacauucgcucaguccucaauagcccugcaucaccaguacaauccuaaauuucaaacccuuuuccagccaugcaacuugaugggcgcaaugcagcugauugaagacuuuagcacucacgugucuaucgacuguagcccccauaagacaguuaaaaagacggccaaugaguucccuugccucccgaaacagguggcuuggauccuggccaccaguaaggucuuuauguauccagaauuacugcccguguguagccuuaaggccaaaaacccucaagauaagauuguauucacuaaagcggaggacaauuugcucgcucuggggcuaaagcacuuugaaggaacagaguucccaaacccccugaucucuaaauaccuccugaccugcaagacagcccaucagcuuacugugcggauuaagaacuugaauaugaaccgagcaccugauaauauaaucaaauuuuauaagaaaaccaagcagcugccgguuuuagguaaauguugcgaggaaauucaaccccaccaguggaagccaccuaucgagagagaggaacacaggcuccccuucuggcugaaggccucccuuccaucaauccaggaggaacugcgccauauggcugacggcgcccgggaggucgggaacaugacgggaaccacagaaauuaauagugauaggagcuuggagaaagacaaccucgaacugggcucggaguccagguacccucuacugcuccccaaggguguggugcugaaacuuaagccagucgcaacucgcuucccgcgaaaggcuuggcggcagaagcguucuagcguuuugaaaccucuguuaauacaacccucaccaagucuccagcccuccuuuaauccugggaagaccccagccagaucuacacacagcgaagcgcccccuuccaagauggugcugaggaucccgcauccaauucagcccgccacugugcuucagaccguaccuggcguacccccacugggagugucaggcggggagagcuucgagaguccugcugcacuacccgccguuccaccugaagcucgcacgucuuuuccgcucuccgagagccaaacacuguugucgucagcccccgugccaaaagucaugcugccuucuuuagcacccaguaaguuccggaaaccauacgugagaaggcgaccuuccaagcgccggggaguuaaagcgagccccugcaugaagccggccccagugauccaccauccugcuucuguaauuuuuaccguccccgccacuacagugaagaucgugagccucgguggcggguguaacaugauacagccagucaaugcagcuguugcccagagcccccagaccaucccuauuacuacccugcuugugaacccgacaucauuccccugcccacugaaucaaaguuugguagcaagcucuguguccccucucaucgucucaggaaacagugugaaucugcccauuccuagcacgccagaagauaaagcccacguuaacguggacaucgcuugugcggucgccgauggcgagaaugcauuucagggucuagagcccaagcuggaaccucaggagcuuuccccacucucugcuaccguguuccccaaaguugaacacucgccggggccuccacuggccgacgccgagugccaggaaggcuugagcgagaacucagcuuguagauggacuguggucaagacagaggaaggaaggcaagcacuggagcccuuaccucagggcauacaggaaucccucaacaauccaacccccggggaucuggaggaaauuguaaaaauggagccggaggaagcccgugaggaaaucaguggaucuccugagcgcgacauuugcgacgauaucaagguggaacaugcgguugagcuugacacaggcgcucccagcgaggaacuguccucagccggugaggugacuaagcaaaccgucuugcagaaagaagaggagcggucucagccaacgaagacaccuagcaguucccaggaacccccagaugaggggaccagcggaacugacgugaacaaaggaucuucaaagaaugcacucuccaguauggaucccgaaguaagacugagcucgccuccagguaaaccggaggacucuuccagcguggauggccaaucagucgggacccccguuggaccugaaacaggcggggagaagaacggaccagaggaagaggaagaggaagacuuugaugaccuaacucaggaugaggaggacgaaaugaguucugccuccgaggaaagcgugcugucagugcccgagcuucaggaaaccauggagaagcucacauggcuggcuagugagaggcgaaugagccaggaaggcgaguccgaagaggaaaauucucaagaagagaacagcgaaccugaggaagaggaggaagaggaagcagaggguauggaauccuugcagaaagaggaugagaugacggacgaagccgucggggacucagcggagaagccacccaccuucgcuucuccugaaacugccccggagguggaaacaagucggaccccacccggagagucgauaaaagcagccggcaagggucgcaauaaccacagagcuaggaauaaacggggcagccgagccagagcauccaaggauacuucuaaguuacugcuccuguaugacgaggauauccuugaacgcgacccucugagggagcagaaagauuuggcuuuugcccaggcguaccuaacacguguucgggaagcccugcaacauauucccgggaaguaugaggacuuccuccagguaaucuacgaguuugaaucaagcacccagagaaggacggcaguggaucuguauaaaucccuucaaauuuuacugcaggacuggccacagcucuugaaggauuucgcugccuuccugcucccugagcaggcucuggcauguggacuuuuugaagaacagcaggccuucgagaaaagucgcaaguuucugcgacaguuggagaucugcuucgccgagaaccccucucaccaucagaaaauaauuaagguccuacaaggcugugcugacugccugccacaggaaaucacugagcucaagacccagauguggcaguuacugaaagggcacgaucaccuucaagacgaauuuagcaucuucuuugaucaucugagaccggcggcaucacggaugggagacuucgaggaaauuaauuggacagaggagaaggaauacgaguuugacggcuucgaagagguggcccucccugauguugaagaggaggaggagcccccaaaaauccccaccgcuuccaagaacaaaaggaagaaggaaauuggugugcagaaucacgacaaagagacugaguggccugauggggccaaggacugugcaugcaguugccaugaaggaggcccagauagcaaauugaagaaaucuaagcgccguuccuguucacacugcagcucgaaggucugugacucuaaaaguuauaaguccaaagagccccacgaacugguggguagcucaccucauagagaggccuccccgaugccaggcgcuaaggaagcggggcagggaaaagauaugauggaggaggaagcccccgaggaacgggagucuacagaagcaacccagagcaggacaguacgcacuacccgaaagggcgagaugccugucagugggcucgcugugggauccacgcugccaagccccagagagguuacagugaccgaacggcuucuacuggacggcccucccccacacucuccggagacuccucaauuucccccaaccacaggugccgucuuguacacugugaagaggaaccagguugggccugaagugcgcucaugccccaaagcaaguccaagauuacagaaggagagggaaggacaaaaagccgucuccgagagcgaggcucugaugcucgugugggaugccucugaaaccgagaagcugccuggcacgguagaacccccggcgucguuccuuucaccagugagcuccaaaacacgggacgcaggccgucgccauguuagugggaagccugauacccaggagcgauggcugcccucuagcagagccagggucaaaacucgggaccgcacauguccagugcacgagucccccucaggaauagacaccagugaaacuucuccuaaggcuccgagagguggccucgccaaggauagcgggacacaggcuaaaggaccagagggcgaacagcaacccaaggcagccgaggcuaccgugugcgccaauaacuccaaagucucaagcacgggugaaaagguaguguuguggacuagggaggcagaccggguuauccugaccaugugucaggagcagggggcgcagccucaaacauucaacauuaucucucagcagcuaggaaauaaaacccccgccgaagugucccaucgauuuagagagcugaugcaacucuuccacacagcuugcgaagccaguagcgaggaugaagacgaugcaacuucgaccuccaacgcugaccaacuuucugaucacggcgaccuguuaucagaggaggaauuggaugaguga

SEQ ID NO: 56814 - RNA, 1365 nt, Artificial Sequence
  derived and/or modified sequence opt3 from GOPC__Homo_sapiens__NP_001017408
augagcgccggcgggcccugcccugcugcagccggagguggcccagggggagcguccuguucugugggcgcuccggguggggucucaauguucagauggcuggagguucucgaaaaggaguuugacaaagccuucguggauguagaccuucuguugggagaaaucgaucccgaccaggcagauauuaccuacgagggcaggcaaaagaugacaaguuuaagcuccugcuuugcccagcugugucacaaagcucagucugugucgcagauaaaccauaagcuagaagcacaacucgucgaccugaaaucagagcuuacugagacgcaggccgaaaaggugguucuggagaaggaagugcacgaucaguugcuccagcugcauagcauccaacugcagcuccacgcuaaaaccggccagagugccgacuccgggacaauuaaggcgaaauuagagcgggagcuggaagcaaauaagaaagagaagaugaaggaagcccagcuugaggcugaagucaaauugcugcgcaaggagaacgaggcccuacgacgucauaucgcagugcuccaagcugaaguauauggagccagacuggcggccaaauaccuugauaaggagcuggcagguaggguucagcagauucaauugcucggccgggacaugaaagggccugcucacgauaagcuguggaaucaguuagaagccgagauccaucugcaccgccacaaaacugugauaagagcuugcaggggacggaacgaccucaagcgcccaaugcaggcacccccuggccaugaucaggacucucuuaagaaaagccaaggugucgggccaauccgaaaggugcuguugcuaaaagaagaccacgagggacugggcauuuccaucaccggcgggaaggagcacggagugcccauucucaucucagaaauacauccuggucagccagccgauagauguggcgggcugcacgucggagacgccauucuugcuguuaauggcgugaaccugagggauacaaaacauaaggaggcgguaaccaucuugagucagcagcggggugaaauugaguucgaaguggucuauguggcaccggagguugacagcgaugacgagaauguggaauacgaggaugaaucugggcaccguuaucgccucuaccuggacgaguuagagggcggaggcaaccccggggccuccugcaaggauacuucaggagaaaucaaaguccugcaagguuuuaauaagaaagcugugacagacacccaugagaacggcgaucuagggacggccagcgaaacuccucucgacgacggagcaaguaagcuggaugaccuucacaccuuguaucacaaaaagucuuacuga

SEQ ID NO: 56815 - RNA, 741 nt, Artificial Sequence
  derived and/or modified sequence opt3 from GORAB__Homo_sapiens__NP_001139511
augagcugggccgcugugcuggcagucgccgcggcuagauucggccacuuuuggggguguagguggcccggaccuauggcccaggguugggcaggcuucuccgaggaggagcuccggcgccuuaagcaaaccaaagacccauuugaaccgcagcgacgucugcccgccaagaaaucuagacagcaguugcaaagggagaaggcuuuaguugaacagucacagaaacuggggcuacaggauggaaguacaagccuccugccugagcaacuucuguccgcaccaaagcagcgggugaacguacagaagcccccuuucucuucgccaacuuugcccucacauuuuacgcucaccagcccugugggcgacggucagccacaagggaucgagagucagccgaaagaacugggacuggaaaauucccacgauggccauaacaaugucgaaauuuuacccccuaagccagacugcaaacucgagaagaaaaagguggagcugcaggaaaagucucgcugggagguucuucaacaggaacagagauugauggaggagaaaaacaagaggaaaaaggcccugcuagcuaaagccauagcggaacggagcaagcgcacacaggcagagacuaugaaacucaagcgaauccaaaaggaacugcaggcccuugaugacaugguguccgcugauauuggcauccugagaaauaggauugaccaggccucauuggauuacaguuaugcacgguga

SEQ ID NO: 56816 - RNA, 1323 nt, Artificial Sequence
  derived and/or modified sequence opt3 from GORASP1__Homo_sapiens__NP_114105
augggccugggggugagcgccgagcagcccgcuggaggugcagaaggcuuccaccuccaugggguccaagagaacuccccugcccagcaggcgggacuugaaccauacuuugacuucaucauuaccauaggccacucuaggcugaauaaggagaacgauacauugaaggcuuuacugaaagccaauguugaaaaaccggugaagcuagagguauuuaacaugaaaacuaugagggugcgggaggucgaagugguucccucaaauauguggggugggcagggacuccugggcgcaagugugcgcuucugcagcuuucgacgugccuccgagcaagucuggcaugugcuugacguagaaccuucuucgccagcugcacuggccggcuugagacccuauacggauuacguuguggggucagaccagauccuccaggagagcgaggauuucuuuacccugauugaaagucacgagggaaagccucugaagcucauggucuauaacuccaaaucugacagcuguagggaagugacagugacuccaaaugcugccugggguggcgagggguccuuaggaugcggcaucgguuacggguaucugcaucggauucccacccagccuccaucauaccacaagaaaccgcccggaacaccuccacccagugcgcuuccuuugggcgcaccacccccggaugcccugccucccggcccaaccccugaagacagccccucucuagagacugggucccgccaaucagauuauauggaggcucuccugcaggccccaggaagcaguauggaagacccccuuccugguccaggcucuccgucccacagcgcacccgauccugacgggcugccacauuucauggagacacccuugcagccuccacccccgguccagagaguuauggauccuggauuucucgacgugucgggcaucucucuguuagacaacuccaaugcuucaguauggccaagucugcccagcuccaccgaacucacgacuaccgccgugucuacaagcgguccugaggauauauguucaaguuccagcucucacgaaagagggggcgaggcgacuuggucaggaagugaguucgaagucagcuuucuugacucccccggcgcccaagcacaggcugaucaucugccacaguugacccuaccugacucucugacaucggccgcuagccccgaggaugggcucuccgccgaacugcuugaggcacaagccgaagaggagccagcuucaaccgaaggacuggacacggguacugaggcggaaggcuuggauagucaggcacagaucucuacaaccgaguga

SEQ ID NO: 56817 - RNA, 1359 nt, Artificial Sequence
  derived and/or modified sequence opt3 from GORASP2__Homo_sapiens__NP_056345
augggcagcucccagucuguggagauccccgggggagguaccgaaggcuaccacguccugagaguucaagagaacucaccugggcauagggccggacucgaaccauucuuugacuucauugugaguauaaauggcagccggcuuaacaaggauaaugacacacugaaagauuuguuaaaggcuaacguagagaaaccggugaagaugcugaucuauuccucuaaaacucuagaacuccgcgagacgucggucacccccucaaaucuguggggugggcagggacuucugggcgugagcauucgauuuugcaguuucgacggcgcaaacgagaauguuuggcacguguuggaagucgaguccaacucuccugccgcgcucgcugggcugcguccacauagcgauuacaucauuggagccgacacagugaugaaugaauccgaggaucuguuuucacucaucgagacucacgaagcaaagcccuuaaagcuguauguauacaacaccgacacagauaauuguagagagguuauaaucaccccuaacagugccugggguggcgaagggagccuuggaugcggcauugguuauggguacuugcauaggaucccaacucggcccuucgaggaaggcaaaaagauuucucugccuggacagauggcuggcacaccaaucaccccgcuaaaagacggguuuacggaggugcagcucuccucagucaaucccccuagccugaguccacccggaacuaccgguauagagcaaucucuuacaggccuguccauuagcucgacuccuccagcagugucuuccguguugucaaccgggguccccacaguuccgcuccugccuccccaggugaaccagaguuuaaccagcguaccaccuaugaaucccgccacgacucugccaggacucaugccccuuccugcuggccugccaaacuugccgaaccuaaaucugaaccuccccgccccucacaucaugccagguguggggcugcccgaacuugucaauccuggccugccacccuugccguccaugccuccacgcaaccuccccggaauugcgccucugcccuuaccaucugaguuccugccuagcuuuccccuagugccagaaucaaguuccgcagccagcucuggcgagcuccugucaagucuuccgccuacaagcaaugcucccuccgauccagccaccacuacagcaaaggcugacgccgcgucuucguugaccguugaugugacgcccccuaccgccaaagcaccaacaacugucgaagacagagugggggacagcacccccguauccgagaagccuguuucagcugccguggaugcuaacgccagugagucuccguga

SEQ ID NO: 56818 - RNA, 747 nt, Artificial Sequence
  derived and/or modified sequence opt3 from GOSR1__Homo_sapiens__NP_001007026
auggccgcuggcaccagcuccuacugggaggaccugagaaagcaggcaaggcaacucgaaaacgagcuugaucugaaauuggugucuuucucaaaguuaugcacaaguuauagccacuccucuacucgggacgggcgccgagauucgucagacacgacaccccugcuaaauggaagcagucaggaucguauguuugaaaccauggccaucgagauugaacagcuccuggcgagacuuacuggugucaacgacaaaauggcugaguacaccaauuccgccggcguuccuucucugaacgcagccuugaugcauacacuccagaggcaccgggauauacugcaagacuauacccaugaguuccacaagacuaaagcuaauuuuauggcaauccgcgaaagagagaaccugauggggagcgugaggaaggauauugaauccuacaagucaggaaguggcguaaauaaccggcgcacagagcuguucuuaaaagagcaugaccaccuccgaaauagcgauagacuuaucgaagagaccauuucuaucgccauggcuacgaaggaaaacaugacuucccagagggguauguugaaaucaauacacagcaagaugaauacccuggccaaccgguuuccagcggugaauagucuaauccagcguauuaaccuccgcaaaagaagggacucucugauccuugggggagucauuggcaucuguacaauacuguugcuccuguaugcauuccauuga

SEQ ID NO: 56819 - RNA, 588 nt, Artificial Sequence
  derived and/or modified sequence opt3 from GOSR2__Homo_sapiens__NP_001012529
auggacccccuguuccagcaaacccacaagcaagugcaugagauccagagcugcaugggcagacucgaaacagccgauaaacaguccguccacauuguugagaacgaaauacaggcuucuaucgaccagauuuuuagcaggcuugagcggcuggaaaucuugaguagcaaggagccuccaaauaaacgccagaacgcacgauuacguguggaucagcugaaguacgacguacaacaucuacagacugcccucagaaauuuccagcacaggcggcaugcgcgcgagcagcaagaaagacagagggaggaacugcuuucccggacguuuaccacaaacgauucugacacuaccauuccgauggaugagucgcugcaguucaauucaucauugcaaaaagugcacaacgggauggacgaucucauccuggacggacacaauauacuggauggucuccgcacacagcgauuaacccugaaggucggcagucuuuugggggacagagagaaggcuuccuguuuuucucugauccagcaguucagcaacugcguguauauucuaaucacuuguccccaaauuguuaucuuuuga

SEQ ID NO: 56820 - RNA, 1242 nt, Artificial Sequence
  derived and/or modified sequence opt3 from GOT1__Homo_sapiens__NP_002070
auggcucccccuagcguguucgcugaggucccacaggcacaaccgguucugguguuuaagcucaccgccgacuucagagaagaucccgacccuaggaaaguaaaccuuggcgugggggcguaccggacagaugacugccacccauggguccugcccgugguuaagaaaguggagcagaagaucgcuaaugauaacuccuugaaucaugaauauuuaccuauucugggacuagccgaguuucgcucuugugcaucacgacucgcccugggugacgauaguccagcucuuaaagaaaagcgugucggcggggugcagagccugggaggcacuggugcauugagaauaggggccgacuuccucgcuaggugguacaacggaacgaauaacaagaauacccccguauauguuuccucuccuacaugggagaaccacaaugccguguuuucggcggcaggcuucaaagauauccggucauaccgcuauugggacgccgagaagagaggccuggaucugcagggguuucucaacgacuuagaaaaugcuccagaguucagcauugucgugcugcaugccugcgcacacaacccgacuggaaucgaucccaccccugaacaauggaaacagauugcuagugugaugaagcauagguuucuuuucccauuuuucgacuccgccuaccaggguuuugcgucuggcaauuuggagcgggacgccugggcaauccgcuauuucgucagcgagggguucgaauuuuucugugcucaguccuuuaguaaaaacuucggacuguacaaugagcgaguuggcaaccuaacagugguagguaaggaacccgagucaauacuccaagugcugagccagauggaaaagaucgucagaauuaccuggucuaacccuccagcccagggggcuaggaucguggccuccacucuuucaaaucccgagcuguuugaggaauggacaggaaacguuaaaaccauggcagaucggauuuugacgaugcguagcgagcuccgcgccagacuggaagccuuaaagacuccgggcaccuggaaucacaucacagaccagauaggcauguucaguuuuacugggcugaacccuaaacaaguggaguaccucgucaaugaaaagcacauuuaucuucugcccucuggaaggaucaacguguccgguuugaccaccaaaaaucuagauuacguagcgacaagcauucaugaggcaguuacgaagauccaguga

SEQ ID NO: 56821 - RNA, 1164 nt, Artificial Sequence
  derived and/or modified sequence opt3 from GOT2__Homo_sapiens__NP_001273149
auggcccugcuccacagcggcagagugcuucccgggaucgcugcagccuuccauccuggacuggcggcugccgcauccgccagggcuucuucaugguggacccacgucgagauggguccaccggaccccauuuugggcguuacagaagcauuuaagcgggauacuaacaguaaaaagaugaauuuaggggugggagccuaccgcgacgauaacggcaaaccuuauguacugccaagcgugcgaaaguucgucacggugcagaccauauccgguacaggggcucuacguaucggagccucuuuucuccaaagauucuuuaaauucucgagggacguuuuucugcccaagccuacuuggggcaaucauaccccaauuuuccgggaugcgggcaugcagcuucagggguaccgcuauuacgaccccaagacaugcggauuugauuucaccggugcaguggaggacaucucaaaaauuccugaacagagcguccuguugcuccacgccugugcucauaacccaacuggcguggauccgagacccgagcaauggaaggaaaucgccacaguaguuaaaaagaggaaucuguuugcauucuuugacauggcuuaucagggguucgccaguggagauggcgacaaagaugcgugggccgugcggcacuucauagagcaggguaucaacgucugccugugucaguccuacgcaaagaauauggggcucuauggagagcgcgugggcgcuuuuaccauggugugcaaggacgccgacgaagcuaaacgagucgagucucaauuaaagauucugaucagaccuauguacagcaacccaccccuuaauggcgccaggauugcagccgcuaucuugaacacgccugaucugcggaaacaguggcuacaggaaguuaaggugauggcggaccguauaauugggaugcgcacucagcucguauccaaucugaaaaaggagggaucaacccacaacuggcaacauaucacagaucagauugguauguucuguuuuacuggccuuaaaccagaacagguggagagacugaucaaggaguucaguaucuacaugaccaaggacgggaggauuagcgucgcaggagugacaucuuccaauguuggcuauuuggcccacgcuauacaucaagugaccaaauga

SEQ ID NO: 56822 - RNA, 1959 nt, Artificial Sequence
  derived and/or modified sequence opt3 from GP1BA__Homo_sapiens__NP_000164
augccccugcuccuucuguuguuacugcuaccuagcccacuccacccgcaucccaucugcgagguguccaaggucgccucucaccuggaaguuaacugugacaaaagaaaucuuaccgcucugccuccagauuugcccaaggacacaacuauucuccaucugucagagaaccugcucuacacguucaguuuagcaacccugaugccuuauacaaggcuuacucaguugaaucuggaucggugcgaacuaaccaaacuccaaguggacggcacacugccaguacuugggacccuggauuugagccacaaccagcuccagucccugcccuuacugggacagacucucccugcccuuacagugcuggacgucucuuuuaaucgcuugaccucgcuaccacugggugcgcuccgaggccugggggagcuucaagaacuguacuugaagggaaacgagcucaaaacgcugccgcccggcuuacugacuccuaccccaaagcuagagaagcucucacuggcuaauaacaaucuuacagaauugcccgccggucugcucaacgggcuggagaaucuugauacucuguugcuccaggaaaacagccuguauaccauaccuaaaggauucuuuggcagucauuuacugccauucgcauuucuacacggcaaucccuggcucuguaacugcgagauccuguacuuccguagauggcuucaggacaaugccgagaacguguauguuuggaagcaggggguggaugucaaagcuaugacauccaacguggcaucuguacaaugugacaauagcgauaaguuuccgguuuacaaauauccuggaaaggguugccccaccuugggcgacgaaggggauacggaccuguacgacuacuauccagaggaagauacugagggagacaaggugagggccacacggaccgucgugaaauucccuacuaaggcucacacaacccccuggggccucuuuuacuccuggucaacggccagucuggauagccagaugccaucuuccuuacaucccacccaggaaucaacaaaagagcagacuaccuucccuccacgcuggacaccgaacuuuacucugcacauggagagcauuaccuucaguaagacacccaaaucuaccacugaaccuacgccaucccccacaaccagcgagccugugccagaacccgcgccgaauaugacuacccuugagccuacaccaucgcccaccacuccugaacccacaucugagccagcaccuucccccacgaccccagagccgacuucagaaccugcccccaguccaacaacccccgagccuacaagcgaaccagcucccuccccuacuaccccggagccaacgcccaucccuaccauugccacaucuccaacuaucuuggucagcgcaaccucacucauaacacccaagaguacuuuucugaccacgacaaaaccuguuucccuacuggaaagcaccaagaagacuaucccggagcucgaccaacccccaaaacugagaggugugcuucaggggcauuuggagucuucaaggaacgauccuuuccugcaccccgacuucuguugcuuacucccacugggauuuuauguacuuggccuguucugguugcucuuugcuagugugguccugauucuacugcucagcugggugggccacguuaagccucaggcccuggauuccgggcaaggagcggcccuuacaaccgcaacucagaccacacauuuggaacugcagcggggucgccaggugacggucccccgagcuugguuacucuuccugagaggcucucuuccaaccuuuaggucgagccuguuccuaugggugcggccgaaugggcguguaggaccucucguugccggccgcagacccuccgcucugucacaagguagggggcaggacuugcugaguacugugucuauccgguacagcggccacuccuuauga

SEQ ID NO: 56823 - RNA, 621 nt, Artificial Sequence
  derived and/or modified sequence opt3 from GP1BB__Homo_sapiens__NP_000398
augggcagcgggcccagaggagcccugucccuccuucuguuguuacuggcuccuccaucuaggccggcagccgguugccccgcgccuuguucaugcgcuggcacccuaguggacugugggcggcgcggacucacaugggccagucugccaacugcauuccccgucgauacgaccgagcuuguucugacaggcaacaauuugacugcccucccuccaggucugcuggacgcucuccccgcauuacgaaccgcccaccugggggcuaacccuuggcguugcgauuguagacuugugccauugagggccuggcuggcgggacggccggaacgcgcacccuacagagaccuaaggugcguagccccuccagcucuccggggccgccugcuucccuaucuggccgaggaugaauugcgagcagcuugugccccuggcccacucugcuggggagcgcuggccgcacaguuagcucugcucgggcuuggucuguugcaugcccuacugcucgugcugcuucuguguagauugaggcggcuccgugcucgcgccagagcaagggccgcugcgcggcugagcuuaacagacccccuggucgcagagcgagccggcaccgaugaauccuga

SEQ ID NO: 56824 - RNA, 1614 nt, Artificial Sequence
  derived and/or modified sequence opt3 from GP2__Homo_sapiens__NP_001007241
augccccaccugauggagagaauggugggcagcgggcuccuuuggcuggccuuggucuccugcaucuuaacccaggcuucugcaguucaaaggggauacgguaacccuauugaagccucaaguuauggccuggaccuagauuguggggcgccaggaacaccggaggcucaugugugcuucgaccccugucagaauuacacucuccuggaugaaccuuuucggagcacggagaacuccgccggcucucaggguugcgacaagaauaugucggggugguaucgcuucguaggagaaggcggcgugcgaaugucagagaccuguguccaggugcaccguugccaaacagaugcaccaauguggcuuaacgggacucaucccgcccugggagacgguauaaccaaucacacagcuugugcacauuggagcggcaacugcuguuuuuggaaaaccgagguuuuggugaaggccugcccugggggauaccacgucuauagacucgaaggcacuccaugguguaaucugagguacugcacagugccccgggauccuaguaccguagaggacaaaugcgaaaaggcuugucgcccagaggaggaaugccuggcccucaacuccacgugggguuguuucugcagacaggauuuaaauucuagcgacguucacucccugcagccgcagcuugauugugggcccagggagaucaaagugaaggucgacaagugcuugcugggaggccuaggccucggggaagaggugauugcguaucugcgggauccuaacuguucaaguauccuucaaacugaggaacgcaauugggugagcgucaccucuccaguucaggcauccgccugccgaaacauucuggagagaaaucagacacaugcuaucuacaaaaacacuuugucacucgugaaugacuuuauaaucagggacaccauucugaacaucaacuuccagugugccuaccccuuagauaugaagguaagccugcaagcagcucuccagccuauugugaguucucuuaaugucuccguggacggaaacggugaauuuaucguucggauggcccuguuccaggaucaaaauuauacaaacccauacgagggcgacgcgguggaauugagcgucgagucggugcuauauguaggggccauacuggaacagggagauaccucucguuuuaaucucguucugcgcaacugcuacgcaacgcccacugaggacaaagcugaucuugugaaguauuucauuaucagaaauuccuguucaaaccagagggacaguacaauucacgucgaggaaaauggccagagcuccgagucucgguuuagcgugcaaauguucauguuugccggucauuacgaucuggucuucuugcacugcgaaauccaccucugcgacucacugaacgagcagugucagccgaguugcucccgaagccaggugcgcucugaaguuccugcuaucgauuuagccagagugcuggaccuagggcccauuaccaggcggggcgcacaaucaccaggaguaaugaauggcacuccuaguacagccggguuccucgucgcuuggcccauggugcugcuuaccguuuugcuggcguggcucuuuuga

SEQ ID NO: 56825 - RNA, 1683 nt, Artificial Sequence
  derived and/or modified sequence opt3 from GP5__Homo_sapiens__NP_004479
augcugagaggcacccuccuuugcgccgugcugggguuguuaagggcucagcccuucccuuguccaccggcaugcaagugugucuuucgggacgccgcgcaaugcagcggaggugauguugcucgcaucuccgcccugggccuacccacaaaccucacucacauucugcuuuucgggaugggacgaggcgugcugcagucucagucauuuagugguaugacgguauugcagcgucucaugauaagcgacucccauaucucugcaguggccccugggaccuucucggaucugauuaaacugaagacacucagauuaucaaggaauaaaaucacucaucugccaggagcucuuuuggacaagaugguccugcuagagcaacucuuucuggaucacaacgcacuucggggcauugaccagaauauguuccagaaacuggugaacuugcaggaacucgcccugaaucaaaaccaguuagauuuucugcccgcuagccucuucaccaaucuugagaaccugaaguugcuagaccugaguggcaauaaccucacacaucugccuaaggggcuucugggagcccaggcgaaauuggaacgccuccuguuacacuccaauagacugguuucucuagauagcggucuccugaacucccuuggcgcauugaccgagcugcaguuucacaggaaucacauccggucaauagccccaggggcuuucgaccgccuccccaaccugaguagccuuacucugucucgaaaucauuuggccuuucucccuuccgcacuguucuuacacucacauaaccugacacuacucacccuguuugaaaacccacuugcugaguugccgggagugcuguucggcgagaugggugggcuccaagaacugugguuaaauagaacgcagcugaggacucuucccgccgcggccuuccggaacuugagccgucuccgcuaccugggagucacccuaaguccuagacugucugcacucccacagggcgcuuuucaaggccugggggagcuucagguguuggcccugcacuccaauggauuaacagcucuccccgauggucugcuuaggggccuggggaaguugcggcagguaagccuccgacgcaacagacugagggcccuaccucgggcacuguuccgcaaucucucgucucuggaauccguucagcuugaccacaaccaauuggagacucugccaggagauguguuuggcgccuuacccagacucaccgagguccugcuuggucauaauucauggaggugugacugcgggcugggcccguuccuaggauggcuccgucagcaccugggcuuggucgggggagaggaaccuccccggugugcugguccaggcgcgcaugcagggcugccuuuaugggcccuccccggaggcgacgcugaaugcccagguccccgagggccuccaccgagacccgccgcagauaguagcuccgaggccccugugcacccagcucuggcccccaacucuagcgaaccuugggugugggcacagccaguuacaaccggcaaaggacaggaccauucacccuuuuggggcuucuauuuucuucuguuggcggugcaagcuaugaucacgguaauuaucguguucgccaugauuaagaucgggcagcucuuuaggaaacugauacgcgagcgggcacuaggauga

SEQ ID NO: 56826 - RNA, 1863 nt, Artificial Sequence
  derived and/or modified sequence opt3 from GP6__Homo_sapiens__NP_001077368
augagccccuccccuaccgcccuguucugccucggccuuugucuggggagagugccagcucagucuggaccguugcccaagccuucauuacaagcacugccaaguagccuagucccccucgagaaaccuguuacacugaggugccaggguccacccggcguggaccuuuaccggcuggaaaaguuguccucuucgcgcuaucaggaucaggccguacucuuuaucccugcgaugaaacgaucacuggcugggcguuacagauguagcuaucaaaacggaagucuguggucccucccaucugaccaguuagagcugguggccacuggcgucuucgcaaagccgagccuuuccgcccagcccgguccugcugugucaagugggggagauguuacguugcagugccaaaccagguacggcuuugaccaguucgcacuguauaaagaaggcgauccagcccccuacaagaauccugagcggugguaucgcgcuagcuuuccaauuauaacagugacugccgcgcacucugggaccuacagauguuacuccuucucaagcagggaccccuaucuauggagugcaccgucugauccucucgaacuggucgugacaggaaccuccguaacucccagccggcuuccaacagagccucccucgccaguugccgaguuuucugaagcuaccgccgagcugacgguguccuucacuaacgaagucuuuaccacagagacuucacgcaguaucaccgcaagccccaaggaguccgacucuccugcuggugaaagcugcccaccgguguugcaucagggccagcccgggccugauaugccacgaggaugugaccccaauaacccuggcggugugucagggagaggacucgcccaaccagaggaagcgcccgccgcacagggccagggcugcgcugaggccgcuagugccccgccugcaccacccgccgauccugaaauuaaaaggggguccggauggcggcccacagguuguagccaaccacgugucauguucaugaccgcugagccucaggcgcgcucuuaccccagagagggcucauggcacgggaggcggcugaaggacuggcgaguuuggaguguggaagcaggaggccagcgcuuacagcuguggaaaagaggucaugccgcuagcuccuggugcucuaucagggagccauuugggcaaugucucucgguaugccuuccgcugugcuugcgggccccuagcauuugggauggccgcaaucuauggagaccccacccacccccuuguacgcuguggaugacuugguauccaggauggacaaccuacuggccccucuccucaacaagucugaucugggcaccugacggcucucuuagguucccggcccugcguguggacagcgucccauccucagugcagaaucccccuguuuugccauuugggccccucugcagcugucugguguucccucggaacucucauccgcacuccauaagucacugcggauuaacuaaccugcuaagcucucuccgaaccggucuggcuggcucccuugggaugucauucaucuuuuugagugucaagcuggccagauguccccucccauucacgcuggaaaauaaaauuagccuuugcaacauggugaagccucaucuguaucagcagaauaagaaaacccaaaaguuggcaagguguggaggcgcgucgcucuacucccagcagcugcgcgguuuacggugggagaacgggcugucucuaggcggaagaggcugcagcgaacucaggucacaccauuguacacuggcucgcguaacuaaacccgauuuuguuaguaagaauaccgggaugaacauguccaucacacuuauuuga

SEQ ID NO: 56827 - RNA, 534 nt, Artificial Sequence
  derived and/or modified sequence opt3 from GP9__Homo_sapiens__NP_000165
augcccgccuggggcgcucuguuccuccuuugggcaaccgccgaggcgacaaaggacugcccuagcccauguacuugcagagcucuggaaacgaugggguuguggguggauuguaggggacacgguuuaaccgcccugccggcacuacccgcccggacacgccaucuccugcuugcuaacaauucccugcagucugucccuccaggcgcauuugaccacuugccccaacuccagacucuggauguuacccagaacccuuggcauugcgacuguucacugacauaccuccgauuauggcuggaggaucguaccccagaagcccuuuugcaagugagaugcgcuagucccagccuggccgcgcacgggccucuaggaaggcucacuggcuaucagcuggguuccuguggguggcagcuucaggcaucuuggguacggccaggagugcugugggacgucgccuugguggcuguugccgcacucggccuggcuuuacuggccggccuccuuugcgcgacaaccgaggcccuggauuga

SEQ ID NO: 56828 - RNA, 960 nt, Artificial Sequence
  derived and/or modified sequence opt3 from GPA33__Homo_sapiens__NP_005805
auggugggcaagauguggcccguccuguggacccucugcgccguuagagugacaguagacgcuaucagcguggagacuccucaggauguccuuagggcaucccaagggaaaucugugacgcugccauguaccuaccacacaucaaccaguagccgggaaggauugauucagugggacaaguuacugcuaacucauacagagcgcguugugauauggccguucuccaacaaaaauuauauccacggugaacucuacaagaaccgagucucuauuucgaauaacgccgagcagucagaugcgagcaucaccauugaccagcugacuauggcugauaauggcacauaugaaugcagugugucccuuaugucugaccuggaggggaacaccaaaagccguguaagauugcucguucuggugcccccuuccaagccagaguguggaaucgaaggcgagacgauaaucgguaauaacauucaacugacuugccagucaaaggaagggagucccaccccucaguacagcuggaaaagguauaauauccucaaccaggagcaaccauuagcccagcccgcaucuggacagccugucucccugaagaauauuucaacagauacuagcggcuacuauaucuguaccaguucuaacgaggaaggcacacaguuuugcaauauaaccguggccgugcgguccccaagcaugaacgucgcucuuuacguugggauugcagugggaguaguggccgcuuugaucauuaucgguaucauuauauacuguugcuguugccgcggcaaagacgauaauacggaggacaaggaagaugccagaccgaacagggaggcguaugaggaacccccugagcaacugcgggaacuaucgcgcgagcgagaagaggaagacgauuacagacaggaggagcagaggucuacugggcgggaauccccagaccaucucgaccaauga

SEQ ID NO: 56829 - RNA, 1866 nt, Artificial Sequence
  derived and/or modified sequence opt3 from GPAA1__Homo_sapiens__NP_003792
augggccugcucagcgaccccgugagaaggcgggcccuugcucgccuggucuugcgauuaaacgcaccucugugcguucuauccuacguggccgggaucgcgugguuccucgcucugguauuuccaccgcuuacccagcguacauauaugucugagaaugccaugggaucaacuaugguggaggaacaauucgcugguggcgauagagccagggcuuuugcacgggacuucgccgcucaccgcaagaaaaguggggcccugcccgucgcgugguuggaaagaacgaugaggagcgugggacucgagguuuacacccaguccuuuucucggaagcugccuuucccagaugaaacacaugagcgcuauauggugucgggcacuaacgucuacgguauucugcgagcacccagagccgcuucaaccgagagccucguguuaacaguaccuugugggagugacuccaccaauucucaggccguuggacugcuuuuggcacuggcugcccacuuuaggggccagauauauugggcgaaagauaucguguuccuagucacugaacaugaccuccugggcacagaggccuggcuugaagcauaccacgaugugaacgugaccgggaugcaaagcuccccacugcagggacgggcuggugccauucaggcugccgucgcauuggagcucucaagugacguugugacgagccuggauguagccguggagggcuuaaaugggcagcugcccaaccucgaccuucugaauuuguuucaaacuuucugccagaagggaggccuacuguguacccuccaggguaaacugcagccugaagauuggacaucucuugacgggccacugcaaggauugcagacucuccuguuaaugguccugcgucaggcuuccggccgcccgcauggcucacacgggcuauuucucagauauaggguggaggcgcugacccuucggggaaucaacagcuuccgacaauacaaguacgauuugguugcaguggguaaggcccuggaaggcauguuucgcaaacucaaucaccuucuugagagacugcaucagaguuucuucuuguaucuccugcccggguuaucuagguuugucuccauuggacuguacaugccugcugugggcuuccuacuccugguacuugguuugaaggcccuggaacucuggaugcagcugcacgaggcagggaugggcuuagaggaaccaggaggcgcccccgggccuagcguuccacugcccccgucgcagggagugggucuugcuucuuuggucgccccucuccugaucucccaagcaaugggccuagcgcuguaugugcuccccguccuggggcagcauguggcuacacagcacuuuccaguugccgaggcagaagccgugguacuuaccuugcuggcuauauacgccgcaggauuagcucucccucacaacacgcaucgggucgugucaacucaggcccccgaccgcggcuggauggcgcugaaacuuguugcccugaucuauuuggcucuccaacuggguugcauugcacuaacaaauuucagucugggguuucuccuggccaccacuauggugccaacagcugcccuugcaaagccccacggcccuagaaccuuguacgcggcccuguuaguccucacgagcccagcugccacccugcuuggaucccuguuccuauggagggagcuccaggaagcaccgcugucuuuggcugagggcuggcagcuguuuuuagccgcacucgcccagggggugcuggagcaucacacauauggagcacuucuguuccccuugcucagccugggucuauacccuuguuggcugcuguuuuggaacguacucuucuggaaauga

SEQ ID NO: 56830 - RNA, 1023 nt, Artificial Sequence
  derived and/or modified sequence opt3 from GPALPP1__Homo_sapiens__NP_061029
auggccagagaccugaucggccccgcucucccuccaggguucaaggcaaggggaaccgccgaggaugaagagagagacccgagccccguggcggguccugcccuuccacccaacuacaaauccucuucaagugauagcuccgacucugaugaagacucgucaagccuguaugaggaaggcaaucaggagagugaggaagaugacuccgggccuacagcucgcaagcaaaggaaaaaccaggaugacgaugacgaugacgacgauggauuuuucggcccagcauugcccccugguuuuaagaaacaggacgauucuccaccgcgucccauuauagggccugccuuaccacccggauucaucaagagcacucagaaguccgacaaaggcagagaugacccuggccaacaggagacggauucaagugaagacgaggauauuaucgggccaaugcccgcuaagggaccggucaauuacaacguuaccacagaguuugaaaaacgagcacagcggaugaaggagaaacugacuaagggugacgaugacagcucuaagccuauugugcgcgaauccuggaugaccgagcuacccccagaaaugaaagacuucggccucgggccuagaacauuuaagaggcgggccgaugacaccucaggagaucgcagcaucuggacugacacacccgcugaucgagagagaaaagccaaggagacccaggaagcgaggaaaaguucuuccaagaaagacgaggaacacauacugagcggccgggauaagcgucuugcagagcaaguaucgucuuauaaugaauccaagcgcucagagagucugauggacauccaucacaaaaaguugaaaagcaaggccgcugaggauaaaaacaagccacaggaacggauucccuucgacagggauaaggaccucaaagugaaucgguuugaugaggcccagaagaaagcacugaucaagaaaucccgagaacugaacacgcgcuucucucaugguaaggggaauauguuucucuga

SEQ ID NO: 56831 - RNA, 2487 nt, Artificial Sequence
  derived and/or modified sequence opt3 from GPAM__Homo_sapiens__XP_005270055
auggacgagagcgcccugacccucggcacaaucgauguguccuaccuuccccacucuucagaauauagugucgggagaugcaagcauacuagcgaggaauggggagagugugguuucaggccuacgauuuuucgguccgcuacccugaaauggaaggaaucuuugaugucgcgcaaacgaccauucguuggccguugcuguuacucaugcacaccgcagagcugggacaaguuuuucaaccccaguauaccuuccuuagggcugagaaaugugaucuauauuaacgagacucacaccaggcaucggggauggcuagcacgcagacucucuuacguacuguuuauccaagagagggaugugcacaaaggcauguucgccacaaaugucaccgaaaacgugcuuaauagcucccggguucaggaggcgauugcugaaguggccgcagagcugaacccagacgguucagcccagcagcaaaguaaggcugucaauaaggugaaaaagaaagcaaagcgcaucuugcaggagaugguagccacuguuagccccgcuaugauacgacucacagggugggugcugcugaaacucuuuaacucuuucuuuuggaauauccagauucauaagggacaguuagaaauggucaaggccgcgaccgagacgaaccugccucuuuuguuccugccagugcacagaucccacaucgauuaucuacuccugacuuuuauucuuuucugucauaauaucaaagcacccuacauagccucaggcaacaaucugaacauuccuaucuuuagcaccuugauucacaagcucggcggguucuucaucaggcggcgucuggacgaaacaccagauggacgcaaagacguguuauauagagcucugcuccauggucacaucgucgagcuucugaggcaacagcaguuuuuggaaauuuuccuagagggcacucggagucgaucugggaagaccuccugcgcccgcgcaggacugcucagcguugugguagauacacugucgaccaaugugauaccggacauccuuauuauccccgucggcauaucuuacgauagaauuaucgagggucacuacaacggggaacagcugggaaaaccuaagaaaaacgaguccuuguggucaguggcuaggggcguuauccggaugcuccgcaagaauuauggcugugugagagucgacuuugcccaaccauucagucugaaggaauacuuagagagccagucccagaaacccgugucugcgcugcuaagccucgaacaagcccugcuuccugcaauuuugccaucaaggcccagugaugcugccgacgaggggcgugacacguccaucaacgagagccggaaugcuacugaugaaucucugcgaagaaggcucauugccaaccuggcagagcauauacuuuuuacagccucaaagaguugcgcuaucaugagcacccacauuguagcgugucuguugcucuaucgccaucggcagggaaucgaccuguccacuuuaguugaagauuucuuugugaugaaagaggaaguccuggcaagagacuucgaucuagguuuuucuggcaauucggaggacguggucaugcacgccauccagcuccuggggaacugcgugacaauuacccauacgagcaggaaugaugaguucuuuauaaccccguccacaacuguuccuucaguguucgaacuuaacuuuuacaguaauggaguauugcacgucuucaucauggaggcuauuaucgccuguucucuguaugcagugcucaacaagcgcggccugggugggcccaccagcacaccaccuaauuuaauuucccaggaacaacugguucgaaaagccgcuucacuuugcuacuugcucagcaacgagggcacuaucucucugcccugccagaccuucuaucaggugugucacgagacagucggaaaguuuauacaguacggcauccuaaccguggccgaacaugacgaucaagaggacauuuccccaagucuggcagaacagcagugggauaagaaacuccccgagccucugagcuggcggucugacgaagaggacgaggauuccgacuucggggaggaacagcgugauugcuaccuuaagguaucacaaaguaaagaacaccagcaguuuaucacuuucuugcagagacuguuaggaccacuccuggaggcguauagcucggcugccauuuuugugcauaauuucuccgguccgguucccgaaccugaguaccuucaaaagcugcacaaauauuugaucacgaggacagagcgcaacgucgcaguguacgccgaaucugcuaccuauugucucgugaagaaugccgucaagauguuuaaagacauaggcguuuucaaggagacuaaacagaagcgggugagcgugcuggaacuaucaaguaccuuucugccacagugcaacagacaaaaacuccuggaguacauucuuuccuucguagucuuguga

SEQ ID NO: 56832 - RNA, 1071 nt, Artificial Sequence
  derived and/or modified sequence opt3 from GPANK1__Homo_sapiens__NP_149417
augagcagaccccugcucaucaccuucacuccugccacagacccauccgaucuuuggaaggacggccagcaacagccgcagcccgagaaaccugaaucuacgcuggauggggcugcagccagggcguuuuacgaggcuuugauuggagacgaaucaagugccccagauagccagcggucccaaaccgagcccgcacgcgaacgaaagcguaaaaagagaaggauaaugaaagccccugcugcagaggccguggcugagggugccucuggccggcacgggcagggacgcucguuagaagcggaggacaagaugacacauagaauccugagggcagcccaggaaggcgaucuaccagagcuccggcgccugcuugagccccacgaagcugguggggccggaggcaacauuaaugcacgagacgcuuucugguggacuccucugaugugcgccgcgagagccggccagggggcagcugucucauauuugcucggaaggggugccgcuuggguuggcgugugugagcugagcgggcgggaugccgcacaacuggccgaagaggcuggauuuccagaaguagcgcguauggugcgcgagagucauggcgagaccagauccccggaaaacaggucucccacaccuagccuccaguacugcgagaauugugacacccacuuccaggauuccaaccaucggacuucaacagcacacuuacugagucuuagccaggguccacaacccccuaauuugccacuggggguccccaucucuuccccgggauuuaagcuacuccugcgaggcggcugggaaccugggaugggacuugguccccgcggcgaggggagagccaacccaauuccuaccgugcugaaaagggaccaggaaggauugggcuaucggucagcuccccagccacgcguuacgcacuuccccgccugggauacuagagcaguggccgguagggagcguccuccacgggucgcuacccucagcuggcgagaggaaagaaggcgcgaggaaaaggaccgggccugggagagagaccugaggacauacaugaauuuagaauuuuga

SEQ ID NO: 56833 - RNA, 2388 nt, Artificial Sequence
  derived and/or modified sequence opt3 from GPAT2__Homo_sapiens__NP_997211
auggccaccaugcuggagggcagaugccagacacaacccaggagcuccccuucugggcgggaggcuucacucuggaguagcggauucgguaugaaguuggaagcagugacuccauuucugggcaaauaccgcccguucgucgggcgauguugccagacguguacccccaaguccugggaaucuuuguuucaccguucgaucacagacuuaggauucugcaacguuauucuggugaaagaggaaaauacuagauuuaggggcuggcuaguacggcgccucuguuauuuccuguggucacuugagcagcauauaccuccaugccaggaugugccccaaaagaucauggagagcaccgguguccagaaccuguugagugggagagugccuggaggcacaggcgaagggcagguuccagaccucgugaaaaaggagguccagaggauucugggacacauccaagccccuccucggccauuucuggugcgccucuucuccugggcguuacugcgauuucuuaauuguuuguuccugaacguacagcuacauaagggucagaugaaaaugguucagaaggcugcccaagcaggccucccgcuggugcuucugucuacccacaaaacuuugcucgaugggauucuguuacccuuuaugcugcucagccagggacuuggcguccugagaguggccugggacuccagggcuugcucacccgcauugcgggcccuacugcguaagcucggugggcuguuccuuccacccgaagcuagucugagcuuggauucuuccgagggacuccuggcccgcgcggugguccaggcaguuaucgagcaauuacuggugucaggccagccucuacucauauuucuggaggaaccacccggcgcccuugggccgagauugagcgcucugggacaggccuggguagguuucgugguccaggcagugcaaguuggcaucgugccugacgcucuccugguccccguggccguaacauacgaucuuguuccagacgcgccuugugauauugaccaugccagugcaccccugggguuguggaccggagcucucgccgugcugaggucuuuauggucccgguggggcugcagccaccgaaucuguucgcgcguccaccuggcucagccauucucucuacaggaauauauuguguccgccagaucaugcuggggugggaggcagacgcucgagcaacugcuucagcccaucgucuugggccagugcacugcagugccugauaccgaaaaagagcaggaguggacaccaauaacuggaccgcugcucgcccugaaggaagaggaccaauuacugguucggcgccuuaguugucauguguugagcgcuuccguaggcucuagcgcggucaugucaaccgcaauuauggccacacuccugcuauuuaagcaccagaaacugcucggggaguucaguuggcugaccgaagaaauccuuuugagaggauuugauguggguuucuccggccagcugaggagcuuacuccagcauucucugucacuucugcgugcucacguugccuugcuccggauucgacaaggggaccugcuaguggucccccagccuggaccaggccugacgcaccucgcacagcugagugccgagcuuuugcccguguuucugagcgaggcuguaggugccugcgcagugagaggguuacucgcgggcaggguuccuccacaaggacccugggaacugcagggcauccuucugcuaucccagaaugagcucuaccgccagauccuguugcugaugcauuuacucccgcaagaccugcuucuguugaagccuugucagucuucguauugcuacugucaggaaguccucgaucggcugauucagugcgggcuacugguggcugaggaaacuccaggaagcagacccgccugugacacagguaggcaacgccuuucccgaaaacuccuguggaagccuucaggcgauuucaccgacagugauucugacgauuuuggggaggcagacggacgguauuuccguuugagccagcagucccacugccccgacuuuuuccuguuuuuauguagacuccugucaccacuucugaaagccuucgcucaggccgcagcuuuucuuaggcaaggccagcucccugauacugagcuggguuacacagaacagcuauuccaauuccugcaggccaccgcgcaggaggaagggauauuugagugcgccgaucccaaacuugcuaucagcgcaguguggacguuccgcgaccucggcguccugcagcaaaccccaucuccggccggaccucgguugcauuuaucccccacauuugcuagucuggacaaccaggagaagcucgaacaguucauuagacaguuuaucuguagcuga

SEQ ID NO: 56834 - RNA, 2796 nt, Artificial Sequence
  derived and/or modified sequence opt3 from GPATCH1__Homo_sapiens__NP_060495
auggccgcuagagacagcgauuccgaggaagaccuggugucuuacggcaccgggcucgagccccuugaagagggagaaaggccuaagaaaccaaucccgcugcaggaucaaacaguccgggacgagaagggucgcuauaaacgauuccacggcgcauuuucagggggauucagugccggcuacuuuaacacuguugguagcaaggagggguggacgcccuccaccuucgugucuucgcgucagaauagagcggauaaaucaguauugggaccugaagacuuuauggaugaggaagacuuaagcgaguucggcauugcuccaaaggccauagugacaacugaugacuuugcaaguaagaccaaagauaggauccgggagaaggcccgccagcuggcugcagccacagcucccauuccuggcgccacccuacucgacgaucugaucacuccagcgaaacuuuccgucggguucgaacuguugagaaagaugggauggaaagagggucagggcguggggcccaggguuaagcggcgcccucgaagacaaaagccagacccgggagugaaaauuuauggcugcgcacugcccccugguucuagcgaaggguccgagggagaagacgaugacuaccucccagauaacgucacauuugcccccaaggacgugaccccuguagauuucacgccaaaagacaauguucauggccuggcuuauaagggccucgauccccaccaggccuuauuugggacuucaggagagcauuucaaccuguuuagugguggcagcgagagggcaggggaccuuggagaaaucggcuugaauaaaggucggaagcuggggauaucuggccaggcuuucggagugggcgcccuagaggaagaggaugacgauaucuacgcgaccgaaacacucuccaaauaugacacuguccugaaggacgaggagccgggggauggacuuuacgguuggaccgccccucgucaguacaagaaccaaaaagaaucagagaaggaccugcgcuaugugggcaaaauuuuggauggguucagccucgcaaguaagccccugucuuccaaaaagaucuacccaccucccgaauuaccaagagacuauaggcccgugcacuacuuucggccuauggucgcugccacaagcgaaaauucgcaucugcuccagguucuuucugaauccgcuggaaaggccaccccagauccgggcacgcacucaaaacaccagcugaacgcaaguaagcgagccgaguugcuaggugagacucccauucaggggagcgcuacauccgugcuggaguuccucucucaaaaagacaaggagcgcaucaaagaaaugaagcaggcgaccgaucugaaggcagcccagcuuaaagcuagaagccuggcccaaaaugcacagucaaguagggcccaguuguccccugcugccgcagcgggccauuguagcuggaacauggcucucggaggcgggacugccacacugaaggcaucuaauuuuaaaccauucgccaaggaccccgagaaacagaagcgguaugaugaguuuuuaguacacaugaagcaaggacagaaagacgcucuggaacgcugccuagauccuucaaugaccgagugggaaagagguagggagcgugacgaguucgcccgggcagcucuccuguacgccaguagccauuccacgcuuucuucgcgauuuacccacgcgaaggaagaggaugacagcgaccagguggaagucccaagagaucaggagaacgacgugggcgauaaacaauccgccguuaagaugaaaauguucgggaaguugacaagggacacuuuugaauggcaccccgauaaacugcucuguaagcgcuucaaugugccggacccuuauccagauucaacccuggucggacuuccccgggugaagagagacaaauacaguguauuuaacuuccugacauugccugagacugcuucucuccccaccacacaggcaagcuccgaaaagguuucacagcauaggggcccagauaaaagccgcaagccuucucgaugggacaccuccaaacacgagaagaaggaggauaguauaagcgaauuucugucuuuagcccgguccaaagcugagcccccaaagcagcaaucaaguccgcuggugaauaaagaagaggaacaugccccugagcuaagcgcaaaccagacugucaacaaggacguggaugcgcaggccgagggugaagggucgcgucccuccauggaccucuucagagcuauuuucgccucuagcucagacgagaaaaguuccucuagcgaagaugagcagggcgacuccgaggaugaccaagcaggaucaggcgaagcuaauuuucagagcagucaggauacggaccugggggagacaucuuccgucgcccacgcacuugugccagcuccccaagaaccuccacccagcuucccuauccagaagaugcagauugaugagagggaagaguuuggaccgcgcuugccacccguuuucugcccuaacgcccggcagacccuggaggugccacaaaaggaaaaacauaagaaaaauaaggacaaacacaaggcgaagaaagagcacagaaggaagaaagaaaagaaaaagaaacaucgaaagcacaagcauaaaggcaagcagaaaaacaagaaacccgagaagucgucaucuagugaauccagcgauucuagcgacucccagucagaugaggagacugccgacguaaguccucaggaacuccugcgccgguuaaagagccugccgcuuagaaggcaauga

SEQ ID NO: 56835 - RNA, 1131 nt, Artificial Sequence
  derived and/or modified sequence opt3 from GPATCH2__Homo_sapiens__NP_001284683
auguucggcgccgcugggagacagcccaucggagccccugcagcggguaacagcuggcacuuuuccaggaccauggaggaacuggugcaugaccucgucucugcucuugaggaaucaagugagcaagcccggggcggguucgcagaaacaggagaucacagccgcuccauuucuugcccacugaagcgacaggcccguaaaagaaggggccggaagcgcagaucguacaauguucaucacccgugggagacuggucauuguuugucagaggggagcgacaguuccuuagaagaacccucuaaagauuauagggaaaaccacaauaacaauaagaaagaccacagcgauuccgacgaucagaugcugguggcuaagcggcgcccuucaaguaaccuaaauaacaauguacgaggaaagagaccacucuggcaugagagcgacuuugcaguggauaacgucggcaauaggacgcugcggcgucgcagaaaagugaagaggauggccguugaccuuccccaggauauaucuaacaaacggaccaugacacaaccuccagagggcugccgagaccaggauauggacuccgaccgcgcuuaccaguaucaggaguucacuaagaauaaagugaagaagagaaaacugaagaucauuaggcaagggcccaaaauccaggaugagggagucguguuggaaucagaggaaaccaaccagacaaauaaggacaaaauggagugugaggaacagaagguaagcgaugagcucaugagugaaucugacuccagcucgcugucuuccaccgaugccggucuguuuacuaacgacgagggccggcaaggggaugacgaacagucagauugguucuacgagaaagagaguggaggcgcgugcgguauuacagggguugugccuuggugggaaaaggaggacccaaccgaacucgauaagaacgucccggaccccguguuugagagcaucuuaacgggauccuucccucugaugucucacccaagccgcagaggcuuucaggcaaggcuuucacguuugcauggcaugaguuccaaaaauauaaagaaaagcgggggaacucccaccucuauggccacaaacuggacuucagaaaucccucuguga

SEQ ID NO: 56836 - RNA, 1449 nt, Artificial Sequence
  derived and/or modified sequence opt3 from GPATCH2L__Homo_sapiens__NP_060396
auggacgagcuggugcacgaucucgccagcgcucuugaacagaccuccgagcaaaacaagcugggcgaauugugggaggaaauggcauuaucucccagacagcagaggcggcagcugcgcaaacgacgugggagaaagaggcggucagacuucacacaucuagccgagcacacuugcuguuacagugaggcgagcgaauccucucucgaugaggcuacgaaagacugccgcgaagucgccccuguuaccaauuuuucggauucagacgauacaaugguggcaaagagacauccagcccugaacgcuaucguaaaaagcaagcaacacaguuggcaugaguccgacucuuucacugagaaugcaccguguaggccccuucggcgccgaagaaaggugaaaagggucaccagcgaaguggccgcuucccugcagcagaaguugaaaguuucagauuggaguuaugagcggggaugccguuuuaagagcgccaaaaagcagcgccucucuagauggaaggaaaacacaccuuggaccuccucaggucacggccugugugagagcgcggaaaauaggacuuuccugaguaaaacagggcggaaggagcgaauggagugcgaaaccgacgagcaaaaacagggaucugaugaaaacauguccgagugugaaacgagcucgguguguucuuccucagacacuggccucuuuaccaaugaugagggucgccagggggacgacgagcagagugauugguucuacgaaggagagugcgucccaggcuuuacagugcccaacuuacugccuaagugggcaccagaccacugcagcgaaguagagagaauggauuccggccuugacaaauucucugauagcaccuuuuugcugcccucaaggccugcccaacggggguaucauacucgccuaaauagacucccaggagcugccgcaaggugucugcguaagggucggcgaagacuuguuggcaaagaaacaaguauuaacacccuggggacggagaggauaucccacaucauuagcgacccgcgccagaaggagaagaauaaggcuuuggccucugauuucccccauaucucagcgugcgcccacgaauuuaacccucucaguccacuguacagcuuagacgugcuggcagaugcuucccaccggagaugcucucccgcccauuguucggcuaggcaggccaauguccacuggggaccuccaugcagccgcgacauuaaacgaaaacggaagcccguggcaacugccucccucucaaguccgucugcugugcauauggaugcggucgagccuacaacccccgcaagccaagccccaaaauccccuucaagcgaauggcuuguucguacuucugcugccgagaaggcaacagacgccaccacggcuaccuucuuuaagaugccccaggagaaauccccaggcuauaguuga

SEQ ID NO: 56837 - RNA, 4509 nt, Artificial Sequence
  derived and/or modified sequence opt3 from GPATCH8__Homo_sapiens__NP_001002909
auggccgacagauucagcagguuuaacgaggaucgggacuuccagggcaaucacuuugaucaauacgaagaggggcaucuggaaaucgagcaggcuucccucgacaagcccauugaaucugauaacauaggacaccgccuucugcagaaacaugguuggaaguugggccagggguuaggaaaaucacugcaaggccgaaccgacccuaucccaauuguggucaaguaugauguuauggguauggggcguauggagauggagcuagacuacgcagaagaugccacagagagaaggcgggugcucgaaguagagaaagaggacacugaggaacugcgccagaaguauaaggauuacguggacaaagaaaaggcgaucgcuaaagcccuugaggaucugagagcaaauuucuauugcgaauugugugacaagcaguaccagaaacaccaagaguuugacaaccauauuaauaguuaugaucacgcccacaagcagaggcucaaggaccugaaacagcgggaguucgcucgcaacgucagcucccgaucuagaaaggaugaaaagaagcaggagaaagcacugaggcggcuccaugaauuagccgagcaacguaagcaggcugaaugcgccccgggaucgggccccauguuuaaaccuacgaccguggcgguugacgaggagggcggggaagaugacaaggaugagucagcaacaaauagcggaacuggugccaccgcuaguuguggccugggguccgaguucucuacagacaagggaggcccauuuaccgccgugcagaucacuaacacaaccggucuugcacaagcucccggguuggccagccagggaauauccuucggcaucaaaaauaaccugggcacgccucuacagaagcucggggucucauuuaguuucgcgaaaaaggccccagugaaacuggaaagcauugcaucuguauuuaaggaucacgcugaagagggaacuuccgaggacgguaccaagcccgaugaaaaaucaagcgaccagggccuucaaaagguuggggacagugauggaucuuccaaucuggacggcaaaaaggaggaugaagacccucaggauggugggagcuuggccucgacacucucuaaacugaagcgcaugaagagagaggagggcgcuggagccacugaaccagaguacuaccauuauaucccgcccgcacacugcaaagugaagccuaacuucccauucuuacuguuuaugagggccuccgaacagauggacggcgauaauaccacacaccccaaaaacgcuccugagucaaagaaagggaguagcccaaagcccaaguccuguauuaaagcggcagccucucagggagcugaaaagaccgucagcgaggugucagagcaaccgaaagaaacgaguaugacugagccuuccgaacccgguagcaaggccgaggccaaaaaggcccucggcggggacgugucugaucagucacuugaaagucauagccagaaagucuccgagacacagaugugcgagucuaauucgagcaaggaaaccucccuggcuacuccagccggaaaggagucacaagaaggcccuaaacaccccacagguccauucuuucccguuuugaguaaggacgagucuaccgcacuacaguggccuagcgaacugcucaucuucacgaaagcggagccauccauaucauacagcuguaacccgcuguauuuugauuucaaacuuucucggaacaaagacgcucgaaccaaggggacagagaagcccaaagauauuggcuccaguagcaaggaccaucugcagggauuggacccuggcgaaccaaauaaaucuaaggagguagggggagagaaaaucgugcgcuccucagguggcagaauggaugcccccgcaagugggagcgccugcucgggacucaacaagcaggaaccuggcgguucccacgggucugagacugaagacaccggcaggagccugccaucaaagaaagagcggaguggaaagucccaucgccacaaaaagaaaaagaagcacaaaaagucuagcaaacauaagagaaaacacaaggcugauacagaagagaaauccucaaaggccgaaagcggcgagaagaguaaaaagaggaaaaagcguaaacggaagaagaauaaaucuuccgcacccgcugacagcgagcgagggccgaagccugaaccacccggaucgggcucuccugcacccccaagaaggcgccggagagcgcaagaugacucacagaggcgcaguuuaccugccgaggaagguuccagcgggaaaaaggaugagggaggcgguggcucuagcucccaggaccaugggggacgaaaacacaagggcgaacugcccccaucaaguugucaacggcgugcugggacuaagagaagcucuagguccucacaccgcagucagccgagcuccggagaugaggacucugaugacgcaucgagccaucggcuacaccagaaaucaccuucccaguacagugaggaagaggaagaggaagauucuggcagcgagcauuccagaucaaggucucgaagcggucgccggcacaguucccauagaagcucuaggcguucauauuccaguagcucggacgccucuuccgaccaaagcugcuacucacgccagcggaguuauucugaugacuccuacagcgauuacucagacagaaguaggcgacacagcaagcggucccacgauucugacgauagcgacuaugcuuccucaaaacaucgcucuaagagacacaaauacaguucgagcgaugacgauuauucccucucuuguucacagagcaggucccggagucgaucucauaccagagagcgcagcaggucacgugggcgguccagaaguagcucuugcuccaggucacgcagcaagcgaagaucgcggucuacaaccgcccacaguuggcagaggucccgcagcuacucacgugacagaucccggucuacuaggagccccagucaacgcuccggaagccgaaagagaucuuggggccaugaaucaccagaggaacggcacagugguaggcgcgacuuuauuagauccaaaaucuauaggagccagucuccccacuacuuccggucgggccguggggagggaccuggcaagaaagaugacgggcgcggagaugacucaaaggcaacgggcccacccagccagaacuccaauaucgguacagggcgaggaagugagggcgauugcucuccugaagacaaaaacagcgugaccgcgaagcugcuuuuggagaagauucaguccagaaaagucgaaaggaagccgucagugagugaggaaguucaagccacuccaaauaaagcuggucccaagcugaaagauccuccacagggcuauuuugggcccaagcucccuccgucucugggaaacaaacccgugcuuccacugauaggcaaguugccugccacccggaagcccaauaaaaagugugaggagagcgggcucgaacgcggagaggaacaggagcaauccgaaacagaggagggcccaccugguucaagcgacgcacuguucgggcaucaguuucccucugaagagaccacuggaccauuacuggauccgccucccgaagaguccaaaaguggcgaagcuacagccgaccacccagucgcaccccuaggcacgccugcccauagcgauugcuacccaggggaccccaccaucucgcacaacuaccucccugauccguccgacggagacacucuggagucucuugauucaagcagucagccaggucccguggaguccucuuugcugccuauugcucccgaccucgaacacuucccaagcuaugcgccucccucaggcgauccauccaucgagaguacagacggggccgaagaugcaagccuggcuccuuuagagucucagccgauaaccuuuacacccgaggaaauggagaaguacucaaaacugcaacaggccgcccagcagcauauucaacagcagcuuuuggcuaagcagguaaaggcauucccagccuccgcggcucucgccccugcaacucccgcccugcaaccaauccacauccagcagccugcuaccgcaagcgccacgucuauuaccacaguucagcaugcgauccuacaacaccaugcugccgcagccgcugccgcaauuggaauacacccccacccgcauccacagccucuggcucaggugcaccauaucccccaaccacaccucacucccauuagucugucgcaccuuacccauuccaucaucccuggccacccggccacauucuuggcgagccaucccauucacauaaucccagccucagcaauucauccuggucccuuuacuuuccacccugucccacacgcugcccuguaucccaccuuacucgcuccuagaccagcagccgccgcugcgacggcacugcaucuucacccccuguugcauccgaucuuuucugggcaggaccuccagcacccuccaagccacggaacauga

SEQ ID NO: 56838 - RNA, 993 nt, Artificial Sequence
  derived and/or modified sequence opt3 from GPBAR1__Homo_sapiens__XP_011509046
augacccccaacagcacaggcgaggugccuuccccaaucccgaagggggcccugggacucucucuugcucuggcaucauugauuauaacugccaauuuacugcuagcgcucgguaucgcuugggacagaaggcugcggagucccccugccggcugcuucuuucuuagccuguugcucgcagggcugcugacgggacucgccuuaccaacccugcccggccuuuggaaccagucccgccgagguuacuggucuuguuugcuggucuaucuagcuccuaauuucucguuucucucacugcuugcaaaccuguugcucguucacggggaacguuacauggccgugcugagaccauuacaacccccuggaagcauuaggcuggcucuccuucugacaugggccggcccauugcuauucgcgagucugccggcacucggcuggaaucauuggacucccggggccaacugcuccucucaggcuaucuuuccugccccauaucuguaccuugagguauauggacuguugcuccccgcagugggugcugccgcguuccugagcguccggguguuagccaccgcacaccgccagcugcaggauauuuguagacuagaaagggcuguuugccgggacgagccuuccgcccucgcucgcgcccugacauggcgacaagcaagagcccaggcuggcgcgaugcuuuuguuugggcuguguuggggaccauacguggcaacccuccugcuuucaguccuggccuaugaacagaggcccccguugggcccugguacucuccugaguuuacugagccuagggucugcuuccgccgcagccgugcccguagcuaugggacucggcgaucagcgguacacagccccauggcgugcagcggcucaacgcugccugcagggccuuugggggagagccucaagggacagcccuggacccaguaucgcauaccauccaucuucccagagcucgguugauuuggaccugaauuga

SEQ ID NO: 56839 - RNA, 1677 nt, Artificial Sequence
  derived and/or modified sequence opt3 from GPC1__Homo_sapiens__NP_002072
auggagcugagagccaggggcugguggcuccuuugcgcugcagccgcgcugguggcuugugccagaggggaccccgcaagcaagucccgcucuugcggagaaguccgacagaucuacggugccaaaggcuucucauugagugauguuccucaagcugagauuagcggggaacacuuacguauauguccacagggauauaccugcuguacauccgagauggaagagaaccuggcaaauagaucucaugccgagcuagaaacugcucucagggacucgucacgggugcugcaggccaugcuugcgacgcagcugcgcagcuuugaugaccacuuccaacauuugcucaacgauagugagagaacccugcaggcaacauuuccgggcgccuucggugaacuguacacucagaaugcuagggccuuucgggaccucuauuccgaguuacgccuguacuaucgaggggcaaaccuucacuuggaggaaacccuggcugaguucugggccagacuacucgaaaggcuguuuaagcagcuucauccccaacuguugcucccugaugacuaccuggauugcuuaggaaaacaggcggaggcccugcggccauucggcgaagcaccccgugagcuccgccuuagagcuacaagggccuuuguagcugcccggucuuucgugcagggccugggggucgcaagcgacgugguucgaaagguggcccaggucccuuugggaccagaguguucccgcgcugugaugaagcuaguauauugcgcgcacugucuggguguucccggcgcaagaccuugcccagauuacuguaggaaugugcucaaagggugccuggccaaccaagcugaccuugaugccgaauggcggaaucuguuggacucaaugguccucaucaccgacaaguuuuggggaacaaguggcguggagagcgugauugguucuguccacacuuggcuggcagaagccaucaacgcuuuacaggauaaucgcgacacccugacggccaaaguuauucaggggugcggaaacccgaaggugaauccccaaggcccuggcccagaggaaaaacggaggcgugggaagcuagcaccccgggagcgaccuccauccggaacucucgagaaacugguaucagaagcgaaggcucagcuuagagaugugcaggacuucuggaucagcuugcccgguacccuguguagugagaagauggcccucucuacagcauccgaugacaggugcuggaacggcauggcccgcgggcgguaccugccggaagucaugggagauggccuugcuaaucagauaaacaauccugagguggaaguugacaucacuaaacccgauaugaccauuagacaacagaucaugcagcugaagauuaugacaaacagguugcgcagcgccuauaacgguaaugacguggauuuucaggacgcaucggacgaugggucuggcuccggaucaggcgacgggugucucgaugaccugugcagucgaaaagucagccggaaguccucuagcucacguaccccauuaacgcaugcucugccuggacuaagugagcaagagggucagaaaacuuccgccgcgagcuguccccagccacccacauuccuccugccucuuuugcuguuccucgcccugaccguggcuagaccaagguggcgcuga

SEQ ID NO: 56840 - RNA, 1740 nt, Artificial Sequence
  derived and/or modified sequence opt3 from GPC2__Homo_sapiens__NP_689955
augagcgcccugagaccccuccuucuguuguuacugccucuaugcccaggcccggggcccggaccugguuccgaggcuaaggugaccaggucuugugcagaaacacggcagguccucggcgcccgcggguacucacugaaccuuaucccacccgcgcugauuaguggagagcacuugcgaguuugcccucaagaauauacuuguugcagcuccgagacggaacagcgucucauaagagagaccgaggcuacauucaggggccugguggaagacucugguucguuucugguacauacucucgccgcacggcaccgcaaauucgaugaguuuuucuuagaaaugcugucaguggcccagcauagccuuacccaguuguuuagucacuccuacgggagacuguaugcucaacaugcacuaaucuucaauggacucuuuucuaggcugcgggacuucuacggcgagagcggcgaggggcuugaugacacacuggccgauuuuugggcucaguugcucgaacgcgucuucccacuguuacacccccaguauuccuuuccuccagacuaccugcucugucuuucacgacuggccaguagcaccgauggaucuuugcagccguucggugacucccccagaaggcuacggcugcaaauuacucguacacucguggcggcacgcgccuuuguucagggccuggagaccgggagaaacguggucucagaagcucuuaaggugccuguaagcgagggaugcagucaggcccugaugagguugaucggcuguccacucugccgggguguucccucucugaugccuugucagggguucugcuuaaaugugguccgaggaugucuguccagccgcggccuagaaccagauuggggcaacuaucucgacgggcugcuuauuuuggcagauaaacugcaaggacccuucucguuugagcucacggcugagucuaucggugugaagauauccgaaggccugauguaccuucaggaaaauucagccaaagugagugcgcaggucuuccaagagugcgggccgccugaccccguuccagccagaaacaggcgggcaccucccccacgcgaggaagcuggaagacuguggagcauggugacugaggaggaaaggcccaccacagccgcuggcacuaauuugcaccgucucguaugggagcugcgggaacgauuagccagaaugagggguuuuugggcacgccugucccuaaccgugugcggggauucucggauggccgcugacgcgagccucgaggcagccccuuguuggacaggcgcuggaagaggcagguaccugccaccggucguugggggaucacccgccgaacaggugaacaauccugagcuuaagguggacgcaagugguccagauguccccacccgccgacggcguuugcagcugagagccgcuacggccaggaugaagacugcagcgcucggccaugaccuggaugggcaggacgcugaugaggacgccuccggaagcggcggugggcaacaguaugcagaugacuggauggccggcgcuguggccccuccagcacggcccccgcgcccuccauaucccccuagaagggauggaucuggcgggaaaggagguggcgggucagcucgauacaaccagggacgcagucggagcggcggugccuccaucggguuccacacacagaccauuuuaauccugucucuuucggcguuggcccuccugggccccagauga

SEQ ID NO: 56841 - RNA, 1812 nt, Artificial Sequence
  derived and/or modified sequence opt3 from GPC3__Homo_sapiens__NP_001158089
auggccggcaccgugagaacagcuugucuggucguugcaaugcuccuuagccuggacuuccccgggcaggcccaaccuccaccgcccccuccagaugcgacuugucaccaggugagguccuuuuuccagcgguugcagcccggauuaaaguggguaccugagacgccagugcccgguucugaccugcaagucugccuaccuaaaggcccaaccuguugcucacgcaagauggaagagaaauaccagcucacagcucgacugaacauggaacagcuucugcagagugccagcauggaguugaaguuucucaucauucaaaaugcagccguguuccaggaagcauuugagauaguugugcgucaugcuaaaaacuauacuaaugccauguucaagaacaauuacccgucccugacaccccaggcuuuugaguucgucggggaauuuuucaccgaugugucucuguauauccucggaucggacauuaacguagaugacaugguuaaugaguuauuugauucacuguucccugugaucuacacccagcuuaugaacccaggcuugcccgacagcgcccuggauauuaaugaaugucuaagaggugcgaggcgggaccucaaggucuuugggaacuucccuaaacugaucaugacucaagugaguaagucccuucaggugacacgcauauuccugcaggcauugaaucucggaaucgaggucauuaacaccacggaucaccugaaauuuucuaaggacugcggcagaauguuaacuaggaugugguauuguagcuacugccaaggccugaugaugguuaaaccaugugggggauauugcaaugugguaaugcaggguuguauggccggcguggucgagaucgauaaguacuggcgggaauacauucucucccuugaggaacuggugaacgggauguaucgcaucuacgacauggagaauguuuugcuaggacuguucucaaccauacaugacaguauucaguaugugcagaagaacgcuggcaaacucacaacuaccgaaacagagaagaaaaucuggcacuuuaaguaccccauuuucuuucugugcaucggucuugaucugcaaaucgggaaauugugcgcccauagccagcagcgacaguauagaucugcauacuauccggaggaccucuucauugauaagaaaguccugaagguggcucacguagaacacgaggaaaccuuauccucaaggcggcgugagcugauacaaaagcuaaagagcuuuaucaguuucuacucugcccucccuggauacauuuguucccauagccccguugcggaaaacgacacgcugugcuggaauggccaggagcuuguggagcgcuauucgcagaaagccgcaagaaacggcaugaaaaaucaguuuaacuugcacgaacugaagaugaaagggccagagccugucgugucucaaaucauagauaagcucaagcauauuaaucagcugcuuaggacuauguccaugcccaaaggacggguccuggacaagaacuuggaugaagaggguuucgaaucaggcgacuguggggaugacgaggaugagugcaucggaggcaguggugacgggaugaucaaagugaagaaucagcuccgauuucuggcugaauuagccuacgaccuggauguugacgaugcuccaggcaacagccagcaagccacacccaaagacaaugagauuuccaccuuccacaaccuaggaaaugugcacucuccucucaagcugcuuacuagcauggcaaucucaguagucugcuuuuucuucuuggugcauuga

SEQ ID NO: 56842 - RNA, 1671 nt, Artificial Sequence
  derived and/or modified sequence opt3 from GPC4__Homo_sapiens__NP_001439
auggccagauucggccugcccgcucuccuuugcacccuggcaguguugagcgccgcguuacuggcugccgagcuaaaguccaaaucuuguucagaagucaggcggcucuacguuaguaagggguuuaacaaaaaugacgcaccucugcacgagaucaacggagaucaucuuaagauuugcccacaggguagcacauguugcucccaagaaauggaggaaaaauauucucugcagucgaaggacgauuucaagucagugguaagcgagcaguguaaucacuugcaggccguguuugcuagucgcuacaaaaaguucgacgaguuuuucaaagaacuccuggagaacgcagaaaagucccugaaugauauguuugucaaaacuuauggccaucucuacaugcaaaacucugaguuauucaaggaccuguuuguggagcuuaagcgauauuacguuguggggaaugucaacuuggaagagaugcugaaugauuucugggcccgucuacucgaaagaauguuuaggcuggugaacagccaguaucacuucacggacgaguaccuugaaugcguauccaaauacaccgagcagcugaagccguuuggagauguuccccggaaauugaagcuccaggugacacgcgcuuucgucgccgcgagaacuuucgcacaaggccuggccguggcuggugacguggucucaaaaguuagugugguaaauccuaccgcccaguguacacaugcauuacugaagaugauauauugcagccacuguagggggcucgugaccgucaaaccaugcuacaacuauuguucuaauaucaugcggggaugccuugcuaaccagggcgaucuggacuuugaguggaauaacuucauugaugccauguugaugguggcggaacgccuagagggccccuuuaacaucgaauccguuauggacccuauugacgugaagaucucagaugccauaaugaauaugcaggacaacagcguccaagugagucagaagguauuccaggggugcggaccacccaaaccucugccagcaggucgaaucucuagauccauuagcgagucggcuuuuucugccagguuccggccgcaccaucccgaggaacguccuacuacagcugccggcaccucccucgaucgccugguuacggacgugaaggagaaacuuaagcaagccaaaaaguuuuggucaagucugccaagcaaugucuguaacgaugaaagaauggcagcugggaauggaaacgaggacgauugcuggaauggcaaggguaaauccagguacuuguucgcggugacugggaacggacucgcaaaucagggcaacaaucccgaaguccagguggacaccucuaagccugauauccugauuuuacggcagaucauggcccugcgaguuaugacaagcaaaaugaagaacgcuuauaauggcaacgacguggacuuuuucgauauaucagacgagaguuccggggaaggaagcgguucuggcugugaguaccaacagugcccaucagaguuugauuauaaugccacugaccacgcagggaaaagugccaacgaaaaggcugauagcgccggaguacgccccggcgcacaggcguaccuacucaccgucuucuguauucuguuucuugugaugcagagagaguggagguga

SEQ ID NO: 56843 - RNA, 1719 nt, Artificial Sequence
  derived and/or modified sequence opt3 from GPC5__Homo_sapiens__NP_004457
auggacgcccagaccuggcccgugggcuucagaugccugcuccuucuggcuuuggucgggagcgcaagguccgagggaguucaaacaugugaagaggugcggaaguuauuucaguggcgccugcuaggugccguacgaggccucccugauucuccacgugcggggccggaccuucaggugugcaucaguaaaaagcccacuuguugcacgagaaaaauggaagagagguaccagauugcugcccggcaagauaugcagcaguuccugcagaccucaagcuccacacugaaguuuuugauaucucgcaacgcagccgcuuuccaagaaacucucgagacccugaucaaacaggcagagaauuauacaucgauucuguuuuguucaaccuacagaaacauggcccucgaagcugccgcgagcguccaggaguucuuuacugacgugggauuauaucuguucggcgcagauguuaauccugaagaguuugugaacagguucuuugacagucuuuucccauuggucuacaaucaccugaucaaccccggugugacagauuccucucuagaguauagcgaaugcauucggauggcccgccgagacguauccccuuuugggaauaucccacagagaguuaugggacaaaugggcaggucacuccugcccagucggaccuuccuucaggcucugaacuugggcauagaggugaucaauacgacugauuaccuccauuucagcaaggaauguucucgugcccuguuaaagaugcaguauugcccucacugucaagggcuggcacucaccaaaccaugcaugggauacugucuuaacgucaugcgcgguugccuggcucauauggccgaguugaauccgcacuggcaugcguacauuagaucccuagaggaacugucagacgccaugcacggcacauaugauaucgggcacgugcuccugaacuuucaucuucuggugaaugacgcagucuugcaggcucaccucaacggacagaagcuguuagagcagguuaauaggauuugcggccggcccgugcgaacuccuacccaaagcccacgcuguaguuucgaucagucuaaagaaaagcaugguaugaaaacaaccacgagaaacuccgaggaaacucuggccaacaggcggaaggaguuuaucaauagccuacgccucuacagaucguucuaugggggacuggcugaccagcuuugcgccaacgaauuggcagccgcugacggccugcccuguuggaauggcgaggauauaguaaagucuuacacacagaggguggucgggaacggaauuaaagcgcaauccgguaauccugaggugaagguuaaaggcaucgacccagugauuaaccagaucaucgauaagcucaaacacgucgugcagcugcuucaggggcguucacccaagccggacaaaugggaacuguugcaacucggaaguggcggugggaugguagagcagguuagcggcgauugcgacgaugaagacggauguggcggguccggaucuggugaggugaagcggacccugaagauuacugauuggaugccugacgauaugaauuuuagcgacgucaaacagauacaccagacagacaccggcucaacguuagauaccacaggggcaggaugcgccguggcuacugaaaguaugaccuucacacugaucuccgucgugaugcuacuccccggcauuugguga

SEQ ID NO: 56844 - RNA, 1668 nt, Artificial Sequence
  derived and/or modified sequence opt3 from GPC6__Homo_sapiens__NP_005699
augcccagcuggaucggcgccgugauucugccucuccuugggcuguuguuaucccugccagcuggagcagacgucaaggccagaucuugcggugagguuaggcaggcguacggcgcuaaaggguucucacuagccgauauaccguaucaagaaaucgcaggagagcaccuccggauuuguccccaggaauauaccugcuguacaacugagauggaagacaagcugagucagcagagcaaacuugaguuugagaaccugguggaagagacgucccauuucguacgcaccacauuugugucucgacacaagaaauucgaugaauuuuuccgugaguugcucgagaaugccgaaaagucgcugaacgacauguuugucagaacuuacggcaugcuguacaugcaaaauucagagguguuccaggaucucuuuaccgaauuaaagagguauuacacaggugggaacguuaaucuggaggaaaugcuuaacgacuucugggcucgguugcuggagcgcauguuucagcuaaucaauccucaguaucauuucagcgaggauuaccucgaaugcgugaguaaauacaccgaccaacugaagccauuuggagauguccccagaaaacuuaagauucaggugacuagggcauucaucgccgcucggacauucguacagggccugaccguuggccgcgagguggccaaccgagucuccaaagugucuccuacgccaggguguauaagagcguugaugaagaugcucuauugccccuacuguaggggacugccuacugugcggccaugcaauaacuauuguuuaaaugucaugaaggguugccuggcaaaccaggccgaccucgauaccgaauggaaucuuuuuaucgacgcuaugcuguugguugccgagcgucuagaaggcccguucaacauugagagcgugauggaucccaucgacguaaaaauuuccgaggcaaucaugaauaugcaagaaaacucaaugcaagugagugcuaaggucuuucagggguguggacagccuaaaccagcccccgcgcugcgcagcgccagaucugcaccugagaacuucaauacaagguuucggccauacaaccccgaagaacgaccgacuaccgcugccggcacaucccucgaccgccuggugaccgauauaaaggaaaaacuuaagcugagcaaaaagguuuggucagcuuugccuuauacgauuugcaaggacgagagugugacugccgguacaucuaaugaggaagagugcuggaacgggcacuccaaagcaagauaccuccccgaaaucaugaaugauggacugaccaaccagauuaauaacccagaggucgacguggauaucacuaggccugacacauucauccggcagcagauuauggccuuacgcguaaugaccaauaagcugaaaaacgcuuauaauggcaacgauguuaauuuucaagacacgagcgaugagucgucuggcuccgggucaggaagugguuguauggacgaugugugccccaccgaguucgaguuugucacaacugaagcgccagcaguggaccccgacagaagggaggucgauagcuccgccgcucagcguggccauucucuacucagcuggucacugaccuguauagugcuugccuugcagcggcugugccgauga

SEQ ID NO: 56845 - RNA, 2019 nt, Artificial Sequence
  derived and/or modified sequence opt3 from GPCPD1__Homo_sapiens__NP_062539
augacccccagccagguggccuucgagaucagaggcacacugcucccuggggaagucuuugcuauuugcggauccugugacgcacuugguaacuggaauccacaaaacgccguugcgcuguugccggagaaugauacuggcgaaucuauguuauggaaggcuacgauagugcugucacgagggguaagugugcaguaccgguauuucaaaggauacuuucuagagcccaagaccaucggcgguccuugccaggucauugugcacaaaugggaaacacaucuccagccacgcagcaucacuccccuggaguccgagauuaucauagacgaugggcaauucggaauccacaacggcguugaaacccuugacucuggcuggcugacaugucagaccgagauucgauugcgucuccauuauucggaaaagccuccagugucaaucacuaaaaagaagcugaaaaagagcagauuuagggucaaacugacacucgagggguuagaggaagaugacgaugaccgggugagucccaccguacugcacaagauguccaauucucuugagauuagcuugaucuccgauaacgaguucaaaugccgccauucacagccugaauguggauacggucugcagccagacagauggacggaauauaguauacaaacuauggagccggauaaucuagagcucauuuuugacuucuuugaagaggaucugagcgaacacguugugcagggcgacgcccuucccgggcacgucggaaccgcaugccuguugucuuccacaaucgccgagucaggcaagagcgcugguauucucacucugccuaucaugaguaggaacucucggaagaccaucgggaaagugcgcguggacuacauuauaaucaagccauuacccggauauuccugugauaugaaaagcucguucucuaaguacuggaaaccuaggauuccacuggacgucggccauagaggcgcaggaaauuccacaaccacggcccagcucgcuaagguucaggaaaacacuaucgccucacuuaggaaugcggcaagucacggggccgcuuuuguggaguucgauguacaucugagcaaagacuuugugcccgucguguaccacgauuugacaugcugucuaaccaugaagaagaaauucgacgccgauccgguugagcuguucgaaauaccugugaaggagcucacuuuugaccaacugcagcuucugaaauugacacacgucaccgcacucaaguccaaagaucggaaggaaucugugguacaggaggaaaacagcuucucagagaaucaacccuuuccaagucugaagaugguuuuagagucccugccugaagacguggguuucaacauugagaucaaauggaucugccagcagcgugauggcaugugggacgggaaucuaagcacguauuuugacaugaaccucuuccuggauauuauccuuaagaccgucuuggaaaacucuggaaaacgcagaauuguguuuucaaguuucgacgcugauauauguacaauggucaggcagaagcaaaauaaauaccccauccuguuucucacucagggcaagagcgagauuuauccagagcugauggaccuucggucccgaaccacacccaucgccaugucuuucgcgcaguuugaaaaccuguuggguaucaaugugcauacugaggaucuccugcgcaacccuucguacauucaggaagccaaggcaaaaggguuaguuauauucugcuggggcgacgauaccaaugacccagagaacagaaggaagcugaaagaacuaggagugaauggccucaucuaugaucggauuuacgacuggaugccggagcaacccaacaucuuucagguagagcagcuggaacgccuuaagcaggaguugccugaacugaaaagcugccucuguccaacagucuccagauucgugcccucaagucugugcggggagucugauauucacguugacgcuaauggaaucgauaacguggaaaaugccuga

SEQ ID NO: 56846 - RNA, 981 nt, Artificial Sequence
  derived and/or modified sequence opt3 from GPD1__Homo_sapiens__NP_001244128
auggccagcaagaaagugugcaucgucggcuccgggaacuggggaucugcuauugcaaagauaguugguggcaaugccgcgcagcuggcucaauucgaccccagagugaccauguggguauuugaggaagauaucgggggcaaaaagcucacagagauuaucaacacucagcacgaaaaugugaaauaccuuccuggacauaagcugccaccgaacgucuucauugguaagaucugugaccaguugaaagggcacuuaaaggccaaugcaacgggaauaucacugaucaaaggcguggaugagggccccaacgggcuaaagcucauuagugaaguuaucggagagaggcuggguauuccuaugagcgugcuuaugggcgccaauaucgcuuccgaggucgcagacgaaaaauuuugcgagaccacaauaggguguaaggauccagcccagggacaacuguugaaggaacucaugcagacucccaacuuccggauuaccgugguacaggagguugacacaguggagaucugcggcgcucugaaaaaugucguggccgugggugcgggguuuugugauggacugggcuucggcgacaacaccaaggcagccgucauucgccucggguuaauggaaaugaucgcuuuugccaaacuguucugcucuggaccuguuucgucagcaacuuuucuugagagcugugguguggcugauuugaucacaaccugcuauggcgggcgaaaucguaagguagccgaagcguucgccagaacgggaaaaaguauugagcagcuggaaaaggagcuacucaacggccaaaaacugcaggguccagagacugcaagggaacuuuacuccauacugcagcauaagggguugguggacaaguuuccccucuucauggcugucuauaaaguguguuacgagggccagccuguuggagaauuuauccacugccugcaaaaucauccagagcacauguga

SEQ ID NO: 56847 - RNA, 1056 nt, Artificial Sequence
  derived and/or modified sequence opt3 from GPD1L__Homo_sapiens__NP_055956
auggccgcugcaccccugaaggugugcaucgucggcagcgggaacuggggauccgccguugcgaaaauuauagguaauaacgugaagaaacuccagaaguucgcuucuaccguaaaaauguggguguuugaggaaacagucaauggcagaaaacuuacugacaucauuaacaaugaucacgagaacgugaaguaccugccugggcauaaguugccagaaaauguuguggccaugucaaacuuaagugaggcaguccaagacgccgaucugcuaguguucguaaucccgcaccaguuuauucauaggaucugugacgaaauaacgggacggguucccaagaaagcucucggcaucacccugauuaaggguaucgaugaggggccugagggacuuaaacugauuagcgacaucauacgcgaaaagaugggcauugauaucuccguguugaugggcgcaaauauugccaacgaggucgcugccgaaaaguucugcgagacaacuaucgggucuaaagugauggagaauggacuccuguuuaaggaacugcuccagaccccaaacuuccgaaucacaguggucgacgaugcggacaccguugaguuauguggugcacugaaaaauauuguggccguaggcgcuggguuuugcgauggacuucguuguggcgacaacacuaaggccgcagugauaagauugggucugauggaaaugaucgcuuucgccaggaucuuuugcaaagggcaggucucgacagcgaccuuccuagagucauguggaguggccgaucucauuacgacuugcuauggcggccggaaucgcagaguugcagaagccuuugcuaggaccgggaagacaauagaggagcuggaaaaagagaugcuuaacggacaaaagcugcaggguccccagacuagcgcugaaguguaccggauuuugaagcagaaaggccuccuggacaaguucccuuuauuuaccgccgucuaucaaaucuguuacgagagucgcccagugcaggaaaugcuguccugccuccagucucaccccgagcauacauga

SEQ ID NO: 56848 - RNA, 2184 nt, Artificial Sequence
  derived and/or modified sequence opt3 from GPD2__Homo_sapiens__NP_001076581
auggccuuccagaaggcugugaaaggcaccauccuggucgggggaggugcacucgccacaguucuuggccugagccaauuugcgcacuacagaaggaagcagaugaacuuggcuuaugugaaagccgcagacugcauuuccgagcccguaaaucgggaaccuccaucucgcgaggcccaguuacugacucuacagaacacgucagaauuugauauacucgugaucgggggaggcgcuaccgguagugggugugcacuggacgccgucacacgaggacuuaagacugcucugguggagcgugaugacuuuagcuccggcaccucuucgagaucaacaaaauugauucauggcgggguuagguaccuccaaaaggccaucaugaagcuggauauugaacaguaucggauggugaaagaggcgcugcacgagcgcgcaaaucucuuagaaaucgccccgcaucugagcgcuccccuuccuauaauguugccagucuacaagugguggcagcugcccuauuacugggugggaaucaaacuauaugaccucguagccgguaguaacugccugaaguccucuuacguucuuagcaaauccagagcacuggagcacuucccuauguugcagaaggauaagcucgugggcgcuauugucuacuaugacgggcaacauaaugaugccaggaugaaccuggcgaucgccuuaaccgcagcucgguacggagccgcuacugccaauuauauggaaguggugucacugcucaaaaagacagacccacagaccggcaaaguccgcguuaguggugcacgauguaaggaugugcuuacggggcaggaguuugacguaagagccaaaugcgugauuaacgcuacuggacccuucaccgauagcgucaggaagauggacgacaaagaugcggcagccaucugucagccuucugcuggcgugcacauaguuaugccaggcuacuauuccccggagucaauggggcuguuggaccccgccacaagcgauggacgggugauuuucuuccuaccuuggcaaaagaugacuaucgcagguaccacagacaccccaacggaugucacucaccaucccauuccuagugaagaggacaucaauuuuauccugaacgaagugcguaauuaccucucuugcgauguagagguucgcagaggcgacgugcuggccgcuugguccgggauuaggccacuugucacagaucccaagagcgccgacacccagucgauaucucggaaccacguggucgauaucuccgaaucaggacugauuacuaucgcaggcgguaaauggacaaccuaucgaaguauggcggaggacacgauaaaugcugccgugaagacccauaacuugaaagcagggccgagccgcacaguuggccucuuccugcagggaggcaaggacugguccccuacuuuauacauuagacuggugcaagauuacgggcuagagucugaaguagcccagcaccucgcugccaccuauggagacaaagcauuugaggucgcuaagauggccagcgugacagguaagagguggcccaucguuggcgugcggcuggucucagaguucccauacaucgaagcggaagugaaauaugggauuaaggaguacgccuguacugcuguagauaugaucagucgcagaaccaggcuugcauuuuugaaugugcaggccgcugaggaagcccugccucguauuguugagcucaugggacgggaacugaacugggacgauuauaaaaagcaggagcaacuugaaacagcacgaaaauuccuguacuaugagaugggcuacaaguccagaagcgagcaguugaccgacaggucugaaauaucacuccugcccagugauaucgaccgcuacaagaaacgguuccacaaguuugaugcggaccagaaagguuucauuacuaucgucgaugugcagagaguguuagagagcaucaacguccaaauggacgaaaauacgcugcaugagauucuaaacgagguugaucucaauaagaacggccagguggaacugaaugaguuucuucaguugauguccgccauacagaaagggagggugucuggaucgcgccuggcuauccucaugaagacagccgaagagaaccuggaccgacggguaccaauucccgucgaccguagcugcggcggguuauga

SEQ ID NO: 56849 - RNA, 1128 nt, Artificial Sequence
  derived and/or modified sequence opt3 from GPER1__Homo_sapiens__NP_001091671
auggacgugaccagccaggccagaggcgucgggcuggagauguaccccggaacagcucaaccugcagccccaaacacuacguccccggaacucaaucuuucucacccccuguuggguaccgcguuagcuaacggcacaggggagcugucagaacaucagcaguauguuaucggacuauuccucaguugccuguacacuauuuuucuuuucccuauaggcuuuguggguaauauccugauuuugguagugaacaucagcuucagggagaagaugaccauuccagaucucuauuuuaucaaucuggccgucgcagaccugauacucguggccgauuccuuaaucgaaguuuucaaccugcacgagcgguacuaugacauugcugugcuuuguacauuuaugucuuuguuccugcaggucaauauguacucgucaguguuuuuccuaaccuggaugagcuuugaucgcuauaucgcacucgcccgagcuaugcguugcagucuguucagaacuaaacaucacgccaggcuuuccugugggcugauuuggauggcgucuguaagcgcaacauugguucccuuuaccgccgugcaucuccaacacacggacgaggcuugcuucuguuucgccgauguccgggaagugcaguggcuggaggugacuuuaggauuuaucgucccuuucgcaauaauuggccugugcuacucccucaucguucgcgugcuuguaagagcucacaggcaucggggccugcgcccacgaagacagaaggccuugaggaugauucuagcggugguccugguguuuuucguuuguuggcuccccgaaaacguguuuaucucaguccaucugcuucagcggacccaaccuggggccgcaccaugcaaacagaguuuccgucacgcucacccgcugacaggacacaucgugaauuuggccgcuuuuagcaacucuugucucaauccccugauuuacuccuucuuaggugagacuuuucgcgacaagcugagacuauauauagagcagaaaaccaaccucccugcccugaauagguucugccaugcagcccuuaaggcuguaaucccagauucaacagaacagagcgacguucgguuuaguucugcgguguga

SEQ ID NO: 56850 - RNA, 390 nt, Artificial Sequence
  derived and/or modified sequence opt3 from GPHA2__Homo_sapiens__NP_570125
augcccauggccagcccucagacccuggugcucuaccuucuggucuuggcuguuacagaggcauggggccaagaagccgugaucccagggugccacuuacauccguucaacguaacugugagauccgacaggcagggaacgugucaggguucucacgucgcgcaggcuugcgugggccauugugagucaagugccuuucccagccgguauuccguucugguggcaucuggguaccgccacaauauuaccucggucucacaaugcuguacaauaagcggacuaaagaaagugaagguacagcuccagugcguuggcagucgacgugaggaacuggaaaucuucacugccagagcuugucagugcgauauguguaggcuuucccgguauuga

SEQ ID NO: 56851 - RNA, 2211 nt, Artificial Sequence
  derived and/or modified sequence opt3 from GPHN__Homo_sapiens__NP_001019389
auggccaccgagggcaugauccugacaaaccacgaccaucagauuagaguggggguccucacuguuagcgauuccugcuucaggaaucuugcugaagaccggucuggaauaaaccugaaggauuuggugcaagaccccucauuacuggguggcacgaucagugcauacaaaauuguaccugaugagaucgaagagauuaaggaaacccuaaucgacuggugugaugagaaagagcucaaucugauacuuacaacugggggaaccggcuuugccccacgcgacgugacaccggaagcgaccaaggaggucaucgaacgagaggcucccgguauggcccuggcaauguugauggggagccucaacgugacuccucugggaaugcugucccguccaguuugcggcauuagaggcaaaacacucaucauuaauuuacccgggucuaagaagggaucgcaggaguguuuccaguuuauccugccugcccuuccacacgcuauagauuugcugagggacgcaauugugaaagucaaggaagugcaugaugagcuagaagaccuccccucaccuccaccgccccugagcccuccacccaccacgaguccucacaaacagacugaggauaaggguguacaaugcgaagaggaggaagaggagaaaaaggacuccggcguugccucuaccgaagacagcuccucaagucauaucacagcugccgcgauugcagccaagaucccagauagcaucauuucucgcggggugcagguccuuccccgggacacugcuucccugucaaccacaccgagcgaaaguccuagagcccaggcaaccucuagguuguccacggcuagcugucccacuccaaaagugcagucgcgguguucuuccaaggagaacauacuccgcgccucacacagugcgguggauaucacaaaagucgcccgaagacacaggaugagcccuuucccccugaccuccauggacaaggcauuuauuacuguuuuagagaugacaccagugcugggaaccgaaaucauaaauuaucgggauggcaugggucguguacucgcucaagacguguacgccaaagauaaccuucccccuuucccagcuucugucaaggacggguaugccgugcgcgcagccgauggaccgggcgacagauuuauuaucggcgagagccaggcuggggaacagcccacgcagaccguuaugccuggacaagugaugagggucacaacuggugcgccaauccccugcggcgcagaugccgugguacagguugaggacaccgaacugauucgggagucagacgaugggacagaggaauuggaggugcgaauccuaguccaggcucgcccuggacaagacauuagaccaauaggccaugauaucaaaaggggugaaugcgugcuggccaaggggacucacaugggccccagugagauuggacuccuggcaaccgucggcgugacagagguugaagugaauaaguucccgguagucgccgugauguccaccgggaacgagcuucugaauccugaagacgauuugcucccaggaaaaauccgggacagcaaccgcucuacucuguuagcuacgauccaggagcaugguuaccccacaauuaaucugggcauaguuggggauaacccugacgaucuacucaaugcccugaacgaaggaaucucaagagcagacgugauuaucaccaguggcggugucagcaugggggagaaggauuaucuuaaacagguguuggacauugaucugcacgcgcagauccacuuuggcaggguauucaugaagcccggacucccaacuaccuuugcuacacuggacauagacggcgugcguaaaaucauuuucgcccuuccugggaaccccguuuccgcagucgugaccuguaaucuguuuguggucccagccuugcggaagaugcaaggaauccucgauccgcgaccuacuauuaucaaggcuagacugucuugcgacguuaaauuagaucccaggccagaguaccaucgcuguauacugacauggcaccaucaggaaccccuaccuugggcccagucgacggguaaccagaugagcucccggcucaugucaaugagaagugcaaauggccugcuuauguugccacccaagaccgagcaauauguggaacugcacaaaggggaggugguagacgucauggugauuggaaggcucuga

SEQ ID NO: 56852 - RNA, 555 nt, Artificial Sequence
  derived and/or modified sequence opt3 from GPIHBP1__Homo_sapiens__NP_835466
augaaggcccugggcgcugugcuccuugcacuguuguuauucgggagacccggaaggggucagacccaacaggaggaagaggaagaggacgaagaucacggcccugacgauuacgacgaggaggaugaagacgaggucgaagaggaggaaacaaaccggcugccagggggacgcagccgaguucuacuccguugcuauacuuguaaaucccugccgagagaugagaggugcaaucuuacgcagaacuguucucauggccagaccugcacaacucugaucgcccacgguaauaccgaaucaggguugcucacaacccauaguacuugguguacagacagcugccaacccauuaccaagacgguggagggaacucagguaaccaugacauguugccaguccucucuguguaacgugccuccauggcagucgucacggguccaagaucccacuggcaaaggcgcugggggaccucgcgguagcagugaaaccgugggcgcggcccugcucuuaaaucugcuugcaggguugggagccaugggcgcuagaaggccauga

SEQ ID NO: 56853 - RNA, 1710 nt, Artificial Sequence
  derived and/or modified sequence opt3 from GPI__Homo_sapiens__NP_001171651
augguggcccugugcagccuccagcaccuuggcuccucugaccccagagcucugccuaccuugccaacagcaacuucagggcaaaggccggccaagcggcgccgaaaaagucccgcgauggcugccuuaacgcgugauccucaguuccagaagcugcagcaaugguacagagagcauaggagcgaacuaaaccuccggcgccuguuugacgcaaauaaagauagauucaaccacuuuucccuuacccugaauacaaaccauggacacaucuuggucgacuauucuaagaaucucguuacugaggaugugaugaggaugcugguagaccuggccaaaucgcgggguguggaagcugcacgcgagcgaauguucaacggcgaaaagauuaauuacaccgaggggagagccguccuccauguggcuuuaaggaaccggucaaauacaccaauacugguugauggaaaggacgugaugcccgaggucaacaaagugcuugauaagaugaaaaguuuuugucagggcccuuugaugguaaccgaagcccugaagccauauagcuccggugggccccguguuugguacgugucuaauaucgacggaacucacauugcgaaaacacuagcacagcucaacccugagagcucccuguucaucauugccucaaagaccuuuacgacucaggaaaccaucacaaaugcugagacugccaaggagugguuccuucaagcagcuaaagauccaagugccgucgcgaagcacuuuguggcccugagcaccaacacaaccaaagugaaggaauuuggcauagacccgcagaauauguucgaguucugggauugggucggcgggcgcuauucuuugugguccgcaaucggacucucaauugcucugcauguugguuuugacaacuucgaacaguuacugagcggcgcccacuggauggaccagcauuucagaacgacuccccucgagaaaaacgcuccugugcuucuggccuugcuagggaucugguacauuaauugcuuuggaugugaaacacacgcaaugcugccauaugaucaauaccuccacagguucgccgcuuacuuucagcagggcgacauggagaguaacgguaaguauaucaccaaaucugggacucggguagaucaucaaacaggacccauaguguggggcgagccuggcaccaaugggcagcacgcguucuaccagcugauucaucagggaacgaagaugaucccaugcgacuuucuuauucccguccaaacccagcacccgauccgaaagggucugcaucacaaaaucuugcucgcaaacuuccuggcccagacagaagcucuuaugcgcggcaaguccacugaggaagccagaaaagagcugcaggcagccggaaagagcccugaagaucuagagaggcuccugccccacaaaguguuugaggggaaucggccaaccaacucgauuguuuucacaaaguuaacuccuuuuauguugggcgcucugguggccauguaugaacauaagauauucguccaagguaucauuugggacaucaauucuuuugaucaguggggcguggagcucgggaaacagcuggcaaagaaaauagaacccgagcuugacggauccgcgcagguaaccucacacgaugcuaguacaaacggccugauuaauuucaucaagcaacagcgcgaagccagaguucaguga

SEQ ID NO: 56854 - RNA, 1431 nt, Artificial Sequence
  derived and/or modified sequence opt3 from GPKOW__Homo_sapiens__NP_056513
auggccgacagcaaggagggcgugcugccccucaccgcugcauccacagccccuaucucuuucggguuuacuagaacgucagcgaggcggcgccuugcugauaguggagacggugccggcccaagcccggaagagaaagauuuccugaagaccgucgaagggcgagaguugcaguccguuaaaccccaagaagcaccuaaggaguuagugauuccacugauacagaacggacaccguagacagcccccugccaggccacccggcccuucuacagacacuggugcucuagcagaugggguagugucgcaggccgucaaagagcucaucgcugaaucaaagaaaagccuggaggaacgggagaaugccggaguggacccaacccuugcgauuccgaugauccaaaagggcugcacacccaguggcgagggggcagauuccgaaccucgcgccgagaccguuccagaagaggcuaacuacgaagccgugcccgucgaggcauauggacuggcuauguugagagguaugggcuggaagccuggggagggaauuggcaggacuuuuaaucaggugguaaaaccacggguuaacucucuccgccccaagggucuggggcugggagccaaucucacagaagcgcaggccuuaaccccgacgggcccuagccgaaugcccagaccagacgaggaacaggagaaagauaaggaagaccaaccucagggccuggugcccgggggagcagucguggugcuuuccgguccacauaggggcuuguacgggaaggucgagggacuggaucccgacaacguucgggcuauggugcgucuagccguaggcucacgcguggucacugugagugaguauuaccucagaccuguuagccagcaggaguucgauaaaaauacccuggaccuuaggcaacagaacgguacagcuucuucccggaagacucuguggaaucaggaauuguauauccaacaggacaacucagaacgaaaacgcaagcaccucccagauagacaggacgggccggccgcaaaaagcgagaaggccgcucccaggagucagcauuggcugcaccgggauuuacgcgugagauuugucgacaauauguacaaaggcggacaauauuacaacaccaagaugauaaucgaagaugugcugucuccugacacauguguaugcaggaccgaugagggccguguucucgaggggcuucgggaagacaugcuggagacguuggugccaaaggcggaaggagaucgagucauggugguccuagguccccagacuggcagaguggggcaucugcucuccagggaccgcgcacggagcagagcccugguucagcuuccuagggagaaucaggugguagagcugcacuacgaugcuauuugucaauauaugggaccaucggacacagacgaugacuga

SEQ ID NO: 56855 - RNA, 2523 nt, Artificial Sequence
  derived and/or modified sequence opt3 from GPLD1__Homo_sapiens__NP_001494
augagcgccuucagacuguggcccggccuccuuaucaugcugggguccuugugccacaggggaucuccuugugguuuaucaacccauguggagauuggccaccgggcucuggaauuucuacagcuccauaacgggcgcgucaauuaccgagagcugcuucuggaacaccaagacgcauaucaggccggaauaguuuucccagauugcuuuuacccgaguaucuguaagggcgguaaauuccaugacgugagcgaguccacacacuggacucccuuuuugaacgcgucuguacacuauauucgugaaaauuacccucucccaugggagaaggauacggagaaacugguggcuuuccuguuugggaucaccucgcauauggccgcagacgucucauggcacagccucggauuagaacagggcuuccugagaacaaugggcgccauugauuuucaugggaguuauuccgaggcucacucugcaggagacuucgguggcgaugugcuuagccaguuugaguucaacuuuaauuacuuggccaggcggugguauguucccgugaaggaccugcuagggaucuacgaaaaacucuacggacgcaaggucauaacugagaacgugaucguagauugcucccacauucaauuccuggaaauguauggcgagaugcuugcuguuucaaagcuguacccuaccuauaguacaaaaagcccauucuugguggaacaguuucaggaguacuuccucggugggcuggacgauauggccuuuuggucuaccaauaucuaucauuuaacuuccuucaugcuggaaaacggaacaucagacuguaaucuccccgagaacccucuuuuuauugcgugcggcggccagcaaaaucacacccaggggagcaagaugcagaaaaacgauuuccauagaaaucugacgacuucauugaccgagucugucgacaggaacaucaauuacacagaacggggaguguuuuucuccgugaacagcuggacuccagacucgaugucuuuuauauauaaggcacuagagcgcaacauucgaaccauguucaucgguggcucccagcugucacaaaaacacgucaguagcccgcucgccuccuacuuucugucuuuccccuacgcuagacuugggugggccaugacaagcgcagaucugaaucaggacggacauggcgauuugguugugggugcuccuggguauucaaggccaggccacauucacaucggacggguauaccucaucuauggcaacgaccugggguuacccccuguggaucuggaccuagauaaggaagcccaucguauucucgagggauuucagccaaguggucgcuucggcuccgcgcuggccguccuugacuucaauguggaugggguucccgacuuggcagugggagcuccgagcgucggcucugaacaacugaccuacaagggugccguguauguauacuuugggucaaaacagggcggaaugaguagcuccccuaacauaacgaucucuugucaggauauuuauugcaaucucggcuggacucugcuugcugccgacguuaacggggacucggagcccgaucuggugaucggaagcccauucgcaccugguggcgggaagcagaaaggaauagucgccgcuuuuuacuccggccccucauugagugacaaggagaaacucaauguggaagcggcaaacuggacagucagaggugaggaagauuucucuugguuuggguacagccugcacggcgugaccguugacaauaggacuuuacugcuagugggauccccaacauggaagaacgccucacggcucggccaucugcuucacauucgagaugagaaaaagagcuuggggcgcguauauggauacuuucccccuaauggccaaucuugguucaccaucuccggugacaaggcuauggggaaacugggaacgagucucagcucuggccacguccugaugaacgguaccuuaaaacaggugcugcuuguuggcgccccaacauaugaugacguguccaaggucgcauucuugacugugacccuccaucaagggggagccacaagaauguacgcucugacuucagaugcccagccgcuacugcucaguaccuuuagcggcgacaggcgguucucgcgcuuugggggaguacugcaccuuuccgauuuggacgaugacggccuggacgaaaucauuauggcagcgcccuuaagaaucgcugaugugacaucuggucucauugggggagaggacggcaggguuuaugucuacaaugguaaggagaccacucugggcgauaugacggggaaauguaagagcuggauaacaccuugcccagaagagaaggcccaguaugugcuuaucucacccgaagcaaguucccguuucggaucuagccugauuaccgugcgguccaaagccaagaaccaggucguuaucgcugccggccgaaguagcuugggggcaagacucaguggagcucugcauguguacucucuaggcuccgacuga

SEQ ID NO: 56856 - RNA, 816 nt, Artificial Sequence
  derived and/or modified sequence opt3 from GPM6A__Homo_sapiens__NP_001248377
augaccgaccuggagggcugcuucgaauguugcaucaagugucucggggguauucccuacgccagccuuauagcuacaauccuguuguaugcuggaguggccuuauuuugcggcugugggcacgaggcgcuguccggaacugucaacauucuacagacguacuucgaaauggcuagaaccgccggcgauacacucgacguuuuuacuaugaucgauauuuucaaauaugugaucuacgguauagcagccgcauuuuucguauaugggauccugcuuaugguggagggauuuuucaccacaggcgcaauuaaggaccuguacggcgauuuuaaaaucaccacuugcgggaggugugucucugccugguucauuauguugacauaucucuuuaugcuggcuuggcugggagugaccgccuucacgucacucccuguuuacauguacuuuaauuuauggacuaucugccggaacaccacacugguggaaggugcgaaucuuuguuuggaccugcgccaauucggcauagucacuauuggggaggagaagaaaaucugcaccgugagugaaaacuuccuacgaaugugugagagcacagaacucaauaugaccuuucaucuguucauuguagcacuugccggagcuggcgccgcaguuaucgcuauggugcacuaucugauggucuuguccgccaacugggcguacgugaaggaugccugccguaugcagaaguaugaggacaucaaaucuaaggaggaacaggagcuccaugauauucacucgacgagaucaaaagaaaggcugaaugcauacacuuga

SEQ ID NO: 56857 - RNA, 741 nt, Artificial Sequence
  derived and/or modified sequence opt3 from GPM6B__Homo_sapiens__NP_001001994
augggcugcuucgaguguugcaucaagugucucgggggagugcccuacgccagccuggucgcuaccauucuuugcuuuuccgguguugcacuguucuguggcugcgggcacguggccuuggcgggaacaguagcuauauuagaacagcauuuuucuacuaacgccucagaccacgcacugcuaagugaggugauccaacucaugcaguaugucauuuacggcaucgccagcuucuuuuuccuguaugguauuauccuucuggcugaaggguuuuacacgaccuccgcagugaaagaguugcauggagaguucaagacaacugccuguggcagaugcauaucuggcauguuuguuuuccucaccuaugugcugggggucgcuuggcugggaguguuugguuucucggccguaccuguuuuuauguucuacaauaucuggucaacaugugaagugauuaaaagcccacagaccaacggcacuacaggggucgagcagaucugcguggauauuaggcaauauggaaucauaccguggaaugcguuccccggcaagauuugugguagugcacucgaaaacaucugcaauaccaacgaguuuuacauguccuaccacuuauucauuguggccugcgcuggggccggagcaacggucaucgcucugcuuaucuauaugauggccacuaccuacaauuaugcgguuuugaaauuuaagucucgggaagacuguugcacaaaguucuga

SEQ ID NO: 56858 - RNA, 1089 nt, Artificial Sequence
  derived and/or modified sequence opt3 from GPN1__Homo_sapiens__NP_001138519
augaccggccacacaagaagcucccugcccaggugcacugggaucgugcuccuuauuaagcugcgguucucugagcgcuugacgggacauuuacacgcccaggguaccccuccauacgucauaaaccuggacccggcuguucaugaagugcccuuuccugcaaauaucgauauucgagacacaguaaaauauaaggaggugaugaaacaauacggccuagggccaaacggaggcaucgucacuucacucaaucuguucgccacccguuuugaucaggugaugaaguucauugaaaaagcgcagaacaugaguaaguauguucuuaucgacacacccggucagauagagguguuuaccuggagcgcuuccgggacuaucauuacagaagcccuggcaucuucguucccuaccgucgugaucuacguaauggauacgucaagaagcacuaauccaguuaccuuuaugaguaacauguuguaugccuguuccauucucuacaagacaaaacugcccuucaucguggucaugaauaagacugacauaauugaucacucuuuugcuguggaguggaugcaagacuucgaggcauuucaggaugcccugaaccaggaaaccacauaugugagcaaucucaccagguccaugucauuaguccuggacgaguucuacaguagccuucggguugugggaguaucugcuguguugggcacgggccuggaugaacuauuuguccaggugacuuccgccgcggaggaguacgaacgcgaguauagaccugaauacgagaggcucaaaaagucacuggcaaacgccgaaagccaacagcagcgggagcagcuugagcgccugcgaaaagacauggggaguguugcuuuggaugccggaacagcaaaggacucucucuccccagugcugcauccgagcgacuuaauccugaccagagguacucucgaugaagaggacgaagaggcugauucggacacagaugacauugaucacagggucaccgaagagucucacgaggaacccgccuuccaaaauuucaugcaggaguccauggcgcaguauuggaagcggaacaauaaauga

SEQ ID NO: 56859 - RNA, 1719 nt, Artificial Sequence
  derived and/or modified sequence opt3 from GPNMB__Homo_sapiens__NP_001005340
auggagugccuguacuauuuccucggcuuucuucuguuggccgcuagauuaccccuggacgcagccaagagguuccacgaugugcuagggaacgaacggccuagcgcguacaugcgcgagcauaaucagcucaacggaugguccucugacgaaaaugauuggaacgagaaacuguauccagucuggaagcgaggugacaugcguuggaaaaauucauggaagggcgggagaguucaagcugugcuuaccagugauagcccggcccugguaggauccaacaucacauuugcagugaauuugauuuuccccaggugucagaaagaagacgccaacggcaauauagucuacgagaagaacugccggaaugaggcuggucucucugcagauccuuauguguacaacuggacugccuggucggaagacucagauggggagaauggaacgggccagagccaccauaacguuuuuccagacggcaagcccuucccucaccauccaggguggcgcagauggaauuuuaucuauguguuccacacccugggacaguacuuucaaaaacuggguagguguaguguccggguguccguaaacacagcuaacguuacucucggcccccaguuaauggaagugaccgucuaccgccgacacgggagagccuaugugccuauugcgcaagugaaggaugucuacguugugacagaccagaucccaguauucgugaccauguuucagaaaaaugauaggaacucuagcgacgagacuuuccugaaggaccuuccgauuauguuugaugucuugauccaugaccccucccacuuccugaauuauucaacaauaaacuacaaauggaguuucggagauaauaccggccuauuugugagcacgaaccauacuguuaaucacaccuaugugcucaacgguacauucucucugaaucuuacugucaaggcagccgcuccugggccaugucccccuccacccccgccuccccggccauccaagccuacccccucacuggccacaaccuugaaaagcuacgacaguaacacgccaggacccgcaggcgauaauccucucgagcugucucguaucccagacgaaaacugccagauuaaucgcuauggccacuuucaggcuacuaucacaauuguggaggggaucuuagaaguaaacauaauucagaugaccgauguucugaugccggugcccuggccugaguccagccucaucgacuucgucgugacuugccaaggaucgauuccaacagaagucuguaccaucaucucugaucccacgugcgagauuacccagaauacaguguguuccccuguugacguggaugagaugugccuucugacuguaagaaggaccuuuaacgguucaggcacauacugugucaacuugacucuaggggacgacaccagucuggcccucacaagcacccugauauccgugccagaucgggaccccgcgucuccgcuucgaauggccaauagcgcacugaucucaguuggaugcuuggcuauuuucgugacugucaucagucuccugguguacaagaaacauaaggaauauaacccuauagaaaauuccccaggcaacguagugcgcagcaaagguuuaucuguuuuucugaauagagccaaggcugucuucuuucccgggaaccaggagaaagauccucuacucaagaaucaagaguucaagggcgugucauga

SEQ ID NO: 56860 - RNA, 1527 nt, Artificial Sequence
  derived and/or modified sequence opt3 from GPR101__Homo_sapiens__NP_473362
augaccagcacaugcacuaacuccacgagagagucuaauucaagucacaccuguaugccccugagcaagaugccuaucucccucgcccauggcauuauaaggucuacagugcuugucaucuuccuggcugcaucguuuguugggaacauuguguuggccuuaguacugcagcggaaaccacaacuacuccaggugacuaaucgcuucaucuuuaaccugcuugucaccgaccuguugcagauuucacucguggcgccguggguuguggcuacaagcgucccccuguucuggccucugaauagucacuuuugcaccgcccucguguccuuaacucaucuguucgcauuugccucuguaaacacaaucguuguggucagcguggaucgauaccuuuccauaauccacccauugucauaucccaguaagaugacccagcguagaggauaccugcuacucuaugguacguggauuguggcuauccugcaaagcacuccuccacuuuacggcugggggcaggcagccuucgacgaaaggaaugcucuguguucuaugauuuggggagccucccccucauauaccaucuugagcgucguuaguuuuauagugauuccucucaucguaaugauugcgugcuacucuguggucuucugugcagcccggcgccagcaugcucuguuauauaacgugaaaagacacucccuggagguuagggugaaggauugcgucgaaaaugaggacgaagagggcgccgagaaaaaggaagaguuucaggaugaaagcgaguuccggcgccaacacgagggugaagugaaggcaaaagaggggcgaauggaagcuaaggacggaucgcucaaagccaaggagggcucuacaggcacuuccgaaucaaguguagaggcgagagggagcgaggaaguuagggaguccucuaccguggccagcgauggaucaauggaagguaaagagggcaguacaaaggucgaagagaacuccaugaaggcagacaaagggcggaccgaggugaaucaguguagcaucgaucuuggagaagacgauauggaguuuggcgaagacgauaucaacuucucugaggacgacgucgaagcugugaauauuccagagucacugccgcccagucgucgcaacagcaauuccaacccuccauugcccagaugcuaccaguguaaggccgcuaaaguuauauucaucauuaucuuuucuuacgugcuaucgcuggguccuuauugcuuccucgccguacuggcagucuggguggauguugagacucaggugccacaaugggucauaacgauuaucaucuggcuguuuuuccuucaguguugcauucaucccuacguguauggguacaugcacaagacaaucaaaaaggaaauucaggacauguugaaaaaguuuuucugcaaggagaaaccgccuaaggaagauagccaucccgaccucccaggaaccgagggcggcacugaggggaaaauaguaccuuccuaugauucagccacauuucccuga

SEQ ID NO: 56861 - RNA, 1008 nt, Artificial Sequence
  derived and/or modified sequence opt3 from GPR119__Homo_sapiens__NP_848566
auggagagcuccuucucuuuuggcgugauccuggccguccucgcuucacuuauuauagcaaccaacacacugguugccguggcgguauuguuacugauccacaagaaugacggggugagucuaugcuucacucucaaccuggcugucgccgauacgcuuauuggaguggcaaucagcggucuguugaccgaccagcucuccucucccucgagaccuacacagaaaacucuguguucacugaggauggccuuuguuaccagcagugcugcagccuccgugcucacagucauguuaauuaccuucgaucgguaccuggcuaucaagcaaccauuucgcuaucuuaaaauaaugucuggcuucguggccggggcgugcaucgcaggauuguggcugguaagcuaccuaauuggcuuucucccgcuggguauccccauguuccagcagacugccuauaaggggcaauguuccuuuuucgcuguuuuucauccucacuucgugcuuacacugucaugcgucggauuuuucccagccaugcucuuguucguguuuuucuacugugacaugcugaaaauugcaaguaugcauagccagcagauccgaaagauggaacacgcuggcgccauggcgggcggguaucguucucccagaaccccuuccgauuuuaaggccuuaaggacggugucaguccugauagggagcuucgcacucaguuggacuccauuucuuauuaccgguaucguucagguggcuugccaagagugucaucuguacuugguacuagaacgguaucuguggcuccugggcgugggaaauucucuucugaaccccuugauuuacgccuacuggcagaaagagguccgccuccagcuguaucacauggcuuuaggagugaagaaaguucugacauccuuccuacucuuucugagcgccagaaauugcggcccugaaaggccacgggagucgucuugucacaucgugacuaucuccucaagugaguucgacgguuga

SEQ ID NO: 56862 - RNA, 1005 nt, Artificial Sequence
  derived and/or modified sequence opt3 from GPR12__Homo_sapiens__NP_005279
augaacgaggaccugaaagugaaucucagcggccuucccagagauuaccuggacgccgcugcagccgaaaacaucuccgcggcugucucuucaaggguuccugccguggagccagaaccggaguugguagugaaucccugggauauugucuuaugcaccagugggacacugauaagcugugaaaacgcaaucgugguucuaauuaucuuccacaauccuucccuccgggccccaauguuucugcuuauuggaucucuggcuuuggcagaccuccuggccgguaucggccugauaacuaacuucguguuugcuuaucucuuacagucggaggccacgaaacuggucaccaucgggcuuauuguggcgucauucagcgcaaguguaugcuccuugcuggccaucacaguugaucgcuaccuaucucucuauuacgcucugacuuaucauagcgagcgaaccgugacauuuaccuacgucaugcuugugaugcuguggggaacuuccauuuguuugggccuccugcccgugauggguuggaauugcuuacgugacgaaucaacauguagugucguuagaccucugaccaagaacaaugccgcaauccucagcgugucuuuccuuuuuauguucgcucugauguugcaacuauauauacagauuugcaaaaucguaaugaggcacgcccaucagauugcgcugcagcaccauuuucucgccacgucccacuacgugacuacccggaagggggucucaacacuggcaaucauccuuggaacuuucgcugccuguuggaugccauuuacccuguacagcuugauugcugauuauacauaccccaguauauauaccuacgccacgcuccugccugcaacuuauaacucuaucauuaauccagugaucuacgccuuccgcaaccaagagauacagaaggcuuuaugccugauuuguugcggcuguaucccguccagccuagcgcagagagcaaggucgcccucugacguuuga

SEQ ID NO: 56863 - RNA, 1143 nt, Artificial Sequence
  derived and/or modified sequence opt3 from GPR132__Homo_sapiens__NP_001265623
augugccccaugcugcucaagaacggcuacaaugggaacgccaccccugugacaacuacggcuccaugggcaagccuuggacuguccgccaaaaccuguaauaacgucucuuucgaggaaucaagaaucguuuuggugguaguguauagugcggucugcacauuaggugugccggcuaauugucugacugccuggcuagcacuccugcagguucuucaaggcaacgugcuggccgucuacuugcucugccuggcucugugugagcucuuauauaccgggacacugccccuuugggugauuuacauaaggaaucagcaccgguggaccuugggacugcuagcaugcaagguaacugccuauaucuuuuucuguaacauuuacguuagcauccucuuucugugcuguauuuccugcgaccgcuucguggcugucguguaugcccuugaaucucgaggccguagaaggcggcgcacagcgauccugauaucggcauguaucuuuauuuugguggguaucguccauuacccuguuuuccagaccgaggauaaagaaacgugcuuugacaugcuccagauggauucaagaauugccggguacuauuacgcuagguucacugugggauuugccaucccacugagcauaauugcauucaccaaucaccggaucuuucgcaguauuaagcaauccaugggcuuaucugcugcccagaaagcgaagguaaagcauagcgccaucgcaguggucgugaucuuccugguuugcuuugcucccuaucaccucgugcuucuggucaaagccgcugccuucuccuacuaucgaggcgacagaaacgcaauguguggguuggaggagaggcuauacacagccucagugguauuccugugccucaguacuguuaauggaguggcugauccuauuauauauguccuggcgaccgaccauagccggcaggaagugucucguauccacaaggguuggaaagagugguccaugaagacagaugucacccgccuuacgcacucaagagacacugaggaacugcagagcccaguggcauuggccgaucauuacacauuuaguaggcccguucacccuccaggcucuccgugucccgcuaaacggcucauugaggaauccugcuga

SEQ ID NO: 56864 - RNA, 1485 nt, Artificial Sequence
  derived and/or modified sequence opt3 from GPR135__Homo_sapiens__NP_072093
auggaggaaccccagccuccaagaccgcccgccagcauggcucugcucggcucccaacacucuggggcaccuucagccgcgggaccacccgguggcaccaguagcgcugccacagcagccgugcuuuccuucucuacugucgcuacggcagcccuggggaacuugucggacgcuucaggaggcgguaccgccgcggcaccugggggaggcggcuuagggggaagcggugccgcuagggaggccggcgcagcuguucggcgcccacuggggcccgaagccgcgccucuacucagucauggagccgcaguggcugcccaggcucugguacuucuguugaucuuucuccuguccucucugggcaauugcgccgugaugggugucauugugaagcaccgacagcuccguacaguuacuaacgcauucauauuaagccugucccuuucagauuugcugaccgcccuacucugucugccagcugcguuucuugaccuguucacaccgcccgggggaagugcacccgccgcugccgcaggcccauggagaggcuuuugcgccgcuagcagguucuuuucuuccuguuucgggaucgugucaaccuugagcgucgcccucauuagucuggaucgguacugcgcaaucgugcgcccuccuagagagaaaauuggaaggcggcgcgcguuacagcugcucgcuggugccuggcuuacugcacugggcuuuucuuugccaugggaacuacugggggcuccccgagagcucgcugccgcacaauccuuccauggaugucuguauagaacaagcccggacccugcucagcuuggcgccgcguuuucgguaggucugguuguggccugcuacuugcuccccuuccuguuaauguguuuuugccacuaucauaucuguaagaccgucaggcugucugaugugcgggugcguccagucaauacguacgcucgcguucuaagauucuucuccgaggugaggacugcaaccacaguacucauaaugaucguguuugucauuugcuguugggggccuuauugcuuccuggugcuuuuggccgcugcccggcaggcacagacuaugcaagcgcccucacugcucaguguuguggccgucuggcugaccugggcuaacggcgccaucaauccagugauuuacgcaauccgaaaccccaauauaagcaugcuucugggacgcaacagagaagagggcuauaggacacggaauguagacgccuuuuugccuucccaggggccaggacuccaggcccgcucuagaagcaggcugcguaaccgguacgcaaaucgauuaggugccugcaacagaaugucaaguuccaauccggcuagcggcguugcgggggauguggccaugugggcaaggaaaaaccccgucgugcuguucugucgcgaaggaccuccagagcccgucaccgcugugacgaagcagccuaaaucugaggccggcgacacuucacuauga

SEQ ID NO: 56865 - RNA, 1290 nt, Artificial Sequence
  derived and/or modified sequence opt3 from GPR137C__Homo_sapiens__NP_001093122
augagagugagcguccccggcccugccgccgcagccgcgccagcugccgggagggagccguccacccccggagguggcucugggggaggcggugcaguugccgcugcaucaggggccgcugugccuggaaguguacagcuggcccucagcgugcuucacgcgcuguuguacgcagccuuauucgcuuuugccuaucugcaacuauggcggcuccugcuuuaccgcgaacgacgucuguccuaucagucuuugugccucuuccugugucugcucugggcagcuuuaagaacaacucuguuuucggccgcguucucacuuagcggcaguuugccacugcuaaggcccccugcccaucuccacuuuuucccacauuggcugcuuuacugcuuucccuccugucugcaguucucuacguugugccuccugaacuuauaucuggcagaggucaucuguaaggugcggugcgcuaccgaacucgaccgccacaaaauucuucugcauuugggcuuuauaauggccagccuacuguuccucguugugaaucugacaugugcuaugcuuguccacggggaugugccugagaaccagcugaaguggacuguauuuguuagagccuugaucaaugacucccucuucauucugugcgcaaucucauuaguguguuacauuugcaaaaucaccaagaugaguagcgccaacgucuaucuggaaucuaaaggaaugucccuaugucaaacagugguggucgguucaguugugauacuccuguacagcaguagggcuugcuacaaucuuguaguggucaccaucucucaggauacuuuggaguccccauuuaacuauggcugggacaaucugagcgauaaggcgcacguggaggacauuucgggggaagaguacaucguuuucggaauggugcuuuuccugugggaacaugucccggcauggucugugguacucuuuuuccgggcccagcgccugaaccagaauuuggcucccgccggcaugauuaacucccacucauauaguagccgagcauacuuuuucgauaauccuagaagguaugacuccgaugacgaucucccacggcuggguucuagccgugaggggucauuacccaacagucaaucccugggaugguacggcacaaugaccggcugcgggucuagcucauauacgguuacuccucaucuaaauggaccaaugaccgacacagcuccccuccuguuuacuuguaguaaccuugauuugaauaaccaccacagccuguacgugaccccgcagaacuga

SEQ ID NO: 56866 - RNA, 1062 nt, Artificial Sequence
  derived and/or modified sequence opt3 from GPR139__Homo_sapiens__NP_001002911
auggagcacacccaugcccaccuggcugcaaacagcucccucucuugguggucacccggcagugccugcgggcuuggauucgugccugucguuuacuauagccuguuguuaugucugggucuaccagcgaauauccucacagugauuauacugucccagcuuguagcuagaaggcaaaagucuucguacaacuaucuguuggcccucgcagccgcugacauccuggugcuguuuuucauugucuuuguggauuuccucuuagaagacuuuauccugaauaugcagaugccgcagguucccgauaaaauuaucgaggugcuugaauuuucaagcauacauacgaguaucuggauuacugucccuuugaccaucgaccgguacauugcagugugccacccacugaaguaucauacaguauccuaccccgcccgcacucgaaaaguuaucgugucugucuauauaaccuguuuucuaacaagcauuccuuacuacugguggccaaacaucuggaccgaggauuauauuuccacuucagugcaccacgugcucaucuggauccauugcuucacagucuaccugguucccuguaguauuuucuucauacuuaauagcaucauuguguauaagcugcguagaaaaucuaacuuuagguugcggggcuacuccaccgggaagacgacugcuauccucuucaccauaacaucaauuuuugccacucugugggcgccucgcaucaucaugauuuuauaucaccuguacggagcaccaauccagaauagauggcucguacauauuaugagcgacauagccaacaugcuugcucuguugaauaccgccaucaacuucuuccuauauugcuuuauuaguaagagguuccggacaauggcagcugccacccugaaagcguuuuucaagugucaaaaacagccggugcaguuuuacacgaaucacaacuucucuaucacuuccagccccuggaucucgccugccaauucucacugcauuaagaugcucgucuaccaguaugauaaaaacggcaagccaauaaaggugucccccuga

SEQ ID NO: 56867 - RNA, 1215 nt, Artificial Sequence
  derived and/or modified sequence opt3 from GPR143__Homo_sapiens__NP_000264
auggccagccccagacugggcaccuucugcuguccuacaagggacgcugcaacucagcucgugcuuuccuuucaaccacgggccuuccacgcgcugugcuuggggucuggagguuuacgccuggcucuaggccuccugcagcuucugccggggcgacgucccgccggaccuggcucaccagcaacgagucccccugccagcgucagaaucuugagggcugcagccgcuugugaucuccuggguugccuggggaugguuauucgguccaccguguggcucggauuuccaaacuucguagacucugugucggauaugaaucauacagagauauggcccgccgcguuuugugucggcucagcaauguggauccaguuacuguacagcgccugcuucuggugguuguuuuguuaugcuguggacgccuaccuuguuauucgcagaagugcaggccuguccacuauccuacucuaucacauuauggcuugggggcuggccacccuucugugcguggaaggagcggccauguuguacuauccuucugucuccaggugugagcggggucucgaucaugcaaucccacacuacgugacaauguaucugccguuacugcucguacuuguugcuaaccccauacuguuccagaagaccgugacugccgucgcuagcuugcuaaaaggccgccaagggaucuacacagaaaaugagcgaagaaugggagccgugauuaagaucagguuuuucaaaauuaugcuggugcucaucauaugcuggcugucaaacauuaucaaugaaagucuucuguuuuacuuggagaugcagaccgacauuaacggcgguagccucaagccuguccggacggcagccaaaacuaccugguucaucauggggauccugaauccagcucagggauuuuuacugucucuagcguucuauggcuggacaggcuguucccucggguuccagucaccccguaaggagauucaaugggaaagccugacuaccagugcagccgagggagcucauccuucuccacuuaugccccacgaaaacccggccuccgguaagguuagccaggugggcgggcagacaucggaugaggcauugucuaugcuguccgagggaucagacgccaguaccauagaaauccacacggcuagcgaguccugcaauaaaaacgaaggcgauccugcccuccccacucauggugaccuguga

SEQ ID NO: 56868 - RNA, 1044 nt, Artificial Sequence
  derived and/or modified sequence opt3 from GPR148__Homo_sapiens__NP_997247
augggcgacgagcuggcccccugcccuguggggaccacagcuuggccagcacucauccagcuuauuagcaagacuccguguaugccccaagccgcguccaacacgucucugggauugggugauuuaagagucccuucaaguaugcuguacuggcuauuccucccaagcucccugcuugcugccgcaacccuggccguuucucccuugcuccuggugacaauacugaggaaucagcggcuccgccaggaaccucacuauuuacugccagcuaacauccuuuugucggaccuggcauacauucuacuccauaugcugaucucaagcaguucccuuggcgggugggagcugggacgaauggccugcggcauuuugacugaugcuguauuugccgcguguaccucuacaauccucagcuucaccgcaauagugcugcacacuuauuuagccgucauccauccccugcguuaccucuccuuuaugucacacggugcugccuggaaagcaguggcucuuauuuggcugguugccugcuguuucccuacauuuuugaucuggcuaaguaaguggcaggacgcgcaacuggaggaacagggggccagcuauauucucccaccgucuaugggaacccagcccggcugcggccugcuugugaucgucacguacacuuccauacuguguguguuguuccucugcaccgcacugauugcuaauuguuuuuggagaaucuaugccgaagcuaaaacaucagggauuuggggacaggguuacagcagggcccggggcacuuuacugauccauaguguacuaaucacccucuacguuucuacagggguggucuucucccuggauauggugcuuacccgcuaucaccacauugacagcggaacgcauacuugguugcuggcagccaacucggaggugcucaugaugcugccuagagcuaugcuuacauaccuguauuugcucagguaccggcaacuguuaggcaugguccgcggucaucugccaucucgaagacaccaggcgauauuuaccaucuccuga

SEQ ID NO: 56869 - RNA, 2196 nt, Artificial Sequence
  derived and/or modified sequence opt3 from GPR149__Homo_sapiens__NP_001033794
augagccuguuccucuccaaccuuucuaccaaugacucaagucuguggaaggagaaccacaauagcacagauuuguuaaaucccccuggcacucugaauaucuaccuauuuugccucacgugucugaugaccuucgccgcucuugugggguccauuuauucucugauaucguugcucaaaaugcagaacagaacagucguuucaaugcugguggcaagcuggaguguagacgaucugauguccgugcucucugucacuaucuuuauguucuuacaauggccaaaugaagugccgggauacuuucaguuccugugcaccacaagcgcccuuauguauuugugucagggucuguccucaaaccuaaaggcgacccuccugguuaguuacaauuuuuauacuaugcauaggggcguggggagccagacagcuucucggcgcuccggacaaguccuuggcgugguacugaccguuugggccgcaucauugcuccugagcgccuuaccccugugcgguuggggagcuuucgugcgaacgccuugggggugucucgucgacugcaguucuuccuacgugcuuuuucugagcauuguguaugcauuggccuucggccuacuggucggccucucgguuccacugacucaccgucuucuguguucugaggaacccccuagauugcauuccaacuaccaggagaucucacgaggggcuaguauuccaggaacacccccuacagccggucgggugguaagccucuccccagaagaugcgccgggccccucucugcgcagaagcgggggaugcucaccuaguuccgacacuguguuuggcccaggugcacccgccgcugccggggcagaggcuuguaggcgggagaaucgcggaaccuuauacggcacaaggagcuucaccgucucuguggcccagaaaagauuugcgcugauccuagcccucacgaagguugugcuguggcuuccuaugaugaugcacauggucgugcagaacguaguuggcuuccaaucauugccacuggaaacuuucaguuuucuccugacacuucuggcaaccacugugacacccgucuucguguugagcaaaagguggacccaucucccgugcggguguauaaucaauugccggcagaacgcuuaugccgucgcuuccgauggaaagaagauuaaacguaaggguuuugaguucaaucugucuuuucagaaaucguacggcaucuauaagauugcccacgaagacuacuaugaugacgaugagaacagcaucuucuaccacaacuuaaugaacuccgagugcgaaacgaccaaagacccucagcgcgauaacagaaauauauuuaacgcaauuaagguggagaucucaacaacucccagucuggacucuagcacccaaagggggauuaauaaguguacaaacacugacaucaccgaagccaaacaggauuccaauaacaagaaagacgcuuucucagauaagacaggaggcgacaucaauuaugaggaaaccacuuuuagcgaggguccagagcggcgacuaucucaugaagagucccagaaaccugaucucagugacugggaauggugccgcagcaagucugagagaacgcccaggcaacgguccggguacgcgcuggcaauuccacuuugugccuuccagggcacaguuucauugcacgcucccaccggaaaaacucugagucucagcaccuacgaagugucggccgagggccagaagauaaccccugcauccaagaaaaucgagguauaucgcucuaagagcgucgggcaugaaccaaacucagaggauaguuccucuaccuuuguggacacuagcguuaaaauucaccuggaaguguuagagaucugcgauaaugaagaggcccuggacacagucuccauaauuucaaacaucagccagaguucuacgcaagugagauccccgagccuuagguacucgcguaaggagaaucgguucguaucaugugauuugggagaaaccgcuucuuauagucucuuucugcccacuuccaacccugacggugacaucaauauuagcaucccagauacaguggaggcccaccgacagaacucuaaaagacagcaucaggaaagggacggcuaccaagaggagauucagcuacugaacaaggcauaucgcaagcgggaagaggaaagcaaaggguccuga

SEQ ID NO: 56870 - RNA, 1305 nt, Artificial Sequence
  derived and/or modified sequence opt3 from GPR150__Homo_sapiens__NP_954713
auggaggaccuguucagccccuccauccucccuccagccccgaacauuucugugcccauacuucugggcuggggguugaauuuaacccugggacagggugcuccugcaucaggcccacccaguagaaggguccggcuaguuuuucucggggugauccugguaguggccgucgcgggaaacacaacugugcuuugccgccuguguggcggugggggaccuugggcuggcccaaagcgacguaaaauggauuucuugcucguucaacuggcccuggcagaccucuacgccugcggcgggacggcuuuaagccagcuggcaugggaacuuuugggagagcccagagccgcuaccggugaucuggccuguagguuucuacagcuccugcaggcguccggccgcggggcaucugcccaccuugugguccugauugcuuuggaacggagaagggccgugcggcucccucauggacgcccacugccggcacgagcuuuagccgcgcugggcuggcuccuugcccuguugcuagcacugcccccugcuuucguaguuagaggugacucgccaucaccccucccuccacccccgccucccacaagccugcaaccaggggccccucccgcugccagggcauggccaggagagcggcguugccacggcaucuuugcuccccuuccucgcuggcaucugcaaguguaugccuucuacgaagcggucgcaggcuuuguggccccagugacugucuuggggguugcuuguggacaccuccugagugugugguggagacauaggccgcaggcccccgcagccgcugccccuugguccgcaucuccaggucgggcgcccgcuccuagcgccuuaccacgagcaaagguacagucccugaaaaugucacuacuccuggcccuuuuguucgugggcugcgagcugcccuauuuugcugcccgccucgcagcugccuggaguagcgggccggcgggagauugggagggcgaaggucugucugccgcucuuagagucguggcaauggccaauuccgcucugaacccuuucguuuacuuguuuuuccaggccggggacuguaggcuccggcgccagcugagaaagagguuaggcucacugugcugugcaccacagggaggcgcggaggaugaagaggggccccguggacaccaggcccuauaucggcaacgauggccucacccccauuaccaccaugcuagaagggagccacucgacgaagguggccugcgcccucccccaccgcggccuagaccccuuccaugcagcugugagagugccuuuuga

SEQ ID NO: 56871 - RNA, 1260 nt, Artificial Sequence
  derived and/or modified sequence opt3 from GPR151__Homo_sapiens__NP_919227
augcuggccgcugcauucgccgacagcaacuccucuucaaugaaugugaguuuugcgcaccuccauuucgcuggcggguaccuucccagcgauucccaggacuggagaaccaucauuccugcccuguuggucgcaguuugcuuagugggauuuguagguaaccugugugugauaggcauccuacuccacaaugccuggaaggggaaaccaucuaugauucauucgcugauccuuaaccugucauuggcugaucucagccugcuccuguucagugcaccgauuagggccacagcuuauuccaagucugucugggacuuaggaugguuugugugcaaaagcuccgauugguucauccacacuuguauggccgcgaagucacugacgauaguuguggucgcaaaagugugcuuuauguacgccagugaccccgcuaagcaaguaagcauccauaauuauaccauuuggucuguucuuguggccaucuggacagucgcauccuugcugccucuaccagagugguucuuuucaacuauucggcaccacgaaggcguggagaugugucucguggauguccccgcuguugccgaagaguucaugagcauguuugguaagcuguacccucuucuggcguucggguugccacucuuuuucgccaguuucuauuuuuggcgcgcauacgaccagugcaaaaagcgaggaaccaaaacacagaaccugcguaaucagaucagaucuaagcaagugaccguaauguuacuguccauagcuauuaucagcgcccuccuuuggcugcccgaauggguggcuugguugugggucuggcaucuaaaagccgcaggcccugccccaccgcagggcuucauugcucugucucaggugcucauguuuucgaucuccucagcgaacccccugaucuuccuuguuaugagugaggaguuuagggaagggcugaagggaguguggaaguggaugauuacuaaaaagccuccaacagucagcgagucccaggaaacccccgcagguaauucugagggcuugccugauaaagugccaagccccgagucaccggccaguauaccugaaaaggagaaacccuccagcccaucuucagggaagggaaaaacggaaaaggcugagaucccuauucuccccgacguagaacaauucuggcacgagcgggauacuguuccaagugugcaggacaacgaucccaucccuugggagcaugaagaccaggagaccggcgaaggugucaaguga

SEQ ID NO: 56872 - RNA, 1413 nt, Artificial Sequence
  derived and/or modified sequence opt3 from GPR152__Homo_sapiens__NP_996880
auggacaccacaauggaggccgaucugggcgcuacugggcacagacccaggacggaacucgacgaugaggacagcuacccucagggagguugggauaccguguuccuugucgcacuguuguuacugggccuaccagccaacgggcucauggcguggcuggcuggaucccaagcccggcauggcgcagguacacgccuugcccuguugcuccugucucuggcucucucagacuuuuuauuccuggcagccgcugccuuucagauccuugaaauucgacacgggggacauuggccguugggcacugcggcaugccguuucuauuacuuucuguggggcguuaguuauagcuccgggcuauuccuccuggccgcucuuucucuggauagauguuugcucgcccugugcccccacugguacccuggacauaggccagugcgguuaccccuguggguaugugcugguguguggguccucgcuacccuguuuucggugccuuggcuuguuuucccagaggccgcgguguggugguaugacuuggucauaugccuagauuuuugggacucagaggaacugagccuccgcaugcuggaggugcuuggcggguuccugcccuuuuugcuccuguuaguaugucacguucugacacaggccaccgcaugcagaacuugucacaggcagcaacagccugcugccugccggggauucgcucgcguggcccgaacaauccuaagugcauacgucgugcucagacugccauaucagcuugcccaguugcuguaccucgcuuuucugugggauguguacuccggcuaucuucugugggaagcguuggucuacucugacuaucucauucuguuaaauagcugucuguccccguuccuaugccucauggcaucagccgaucugaggacccuuuugcggaguguucugagcucuuucgcugccgcacucugugaggaacgucccgguuccuuuacgccuacugagccacaaacccagcuggacucagaggggcccacauuaccugaaccaauggccgaggcucagagccagauggaccccguggcccaaccgcagguaaacccuacucugcagccccgcagugauccaaccgcacaaccucagcuuaaucccacagcgcagccacagucugaccccaccgcucaaccucaguugaaccucauggcccagccacaguccgauagcguggcacaaccgcaggccgacacgaauguccagacucccgcuccugccgcaucgucugugccaucccccugcgaugaagcaucaccuacaccaaguagccaucccaccccgggagcccuggaggacccugcgacuccacccgccuccgaaggcgagucuccuagcucaacacccccagaggcugcaccuggcgccgggcccaccuga

SEQ ID NO: 56873 - RNA, 1830 nt, Artificial Sequence
  derived and/or modified sequence opt3 from GPR153__Homo_sapiens__XP_011539736
augagcgacgagagaaggcugcccggcuccgccgugggguggcucgucugcggaggucuuucucuguuggcuaacgcauggggcaucuuaucaguuggggccaagcagaaaaaguggaaaccucuggaguuccuacucuguacccuggcggcuacacacaugcuuaauguggccguaccaauugcaacuuacagugugguccaacugcggcgccagcgaccggauuuugaguggaacgaaggauugugcaagguguucguuagcacguuuuauacccucacacuggccacuuguuucuccgugaccucucugucguaccaucguauguggauggucugcuggcccgugaauuauagacucucaaacgcuaaaaagcaggcaguacacacaguuaugggcauauggauggugagcuuuaucuuaagugcccugccugcugucgguuggcaugacaccuccgagagguucuacacucacgggugucgguuuauuguggccgaaaucggacuuggcuucggcgugugcuuuuugcugcuagucgggggaucuguugcgaugggugugauuuguacagcaaucgcccucuuccagacccuggcuguacaagugggccgccaggccgauagaagggcauuuacggucccaacuauagugguugaggacgcucaggggaagcggcgcagcuccaucgauggaucagagcccgccaaaaccagucuucagacaacuggccuggugaccacaauugucuucaucuaugacugcuugauggguuuuccugugcucguaguuagcuucucuucccugcgagcggaugccucagcaccauggauggcuuuaugugugcuguggugcagcgucgcccaagcucuccuucugcccguguucuugugggccugugacagauacagggcagaucuaaaggccguccgggaaaaaugcauggcucugauggcgaaugacgaggaaagugaugacgagaccucucucgaagggggaauuuccccugaucuggugcuugaacguagccuggacuauggcuacggcggggacuuuguugcauuggaucgcauggccaaguacgagaucucggcucucgaaggaggucugccacaguuauauccgcugagaccccuacaggaggacaaaaugcaguaccuccaagugccuccaacgaggcgguucucucaugaugacgccgauguaugggcagccgucccccugccugcuuuucuuccacgauggggcuccggggaagacuuggccgcacuggcgcaccucgugcugcccgcuggaccggagcgcagaagggccucacuucuggcauucgccgaggaugcuccucccagucgggcccgcagaaggagcgcagaauccuugcucucucugcguccaagcgcuuuagacucaggcccucggggugcccgagauagucccccagggucccccagaaggcgcccuggcccaggaccgcggagcgcgucugccucacugcuacccgacgcuuuugcacucacugccuucgagugcgaaccucaggcucugagaaggccacccggcccuuuuccagccgcacccgcggccccggauggggcugacccuggagaggccccaacacccccuaguagcgcacagcgcucccccgguccacgaccuucugcucacucgcaugccggcagccuucggcccggguuguccgcaucauggggagaaccaggcggucugcgugccgcugggggcggaggcaguaccucuagcuuccucuccucaccgagcgagucuuccggguaugcgacucugcacagugacagcuuaggaucugccuccuga

SEQ ID NO: 56874 - RNA, 2529 nt, Artificial Sequence
  derived and/or modified sequence opt3 from GPR155__Homo_sapiens__NP_001253980
augaacagcaaucugcccgccgagaaccucaccaucgcugugaauaugacaaagacucuuccuacggcagucacccacggcuucaacuccacaaaugacccaccgucuaugucaauuacuagacuguuucccgccuuguuagaaugcuucgggauaguucuguguggauacaucgcggguagggcuaacgugauuaccaguacacaggccaaaggccuagggaauuuuguaagccgguucgcacucccugcccugcuuuuuaagaacauggugguccugaauuucuccaacguggauuggucuuuucuuuauucgauccucauugcuaaagcaucaguuuucuuuaucgugugcguccugacccugcucguggccagcccagacagucgcuucuccaaggcuggauuauuucccauauucgccacucaaucuaaugauuuugcgcugggcuacccuaucguagaggcacuuuaucagacaaccuacccagaauauuugcaguacauuuaucugguugcccccaucagccuaaugaugcucaacccuauugguuucaucuucugugagauacagaaauggaaggacacgcaaaaugcuucccagaacaagauuaaaaucguggggcugggacuucugcgagucuugcagaauccaauuguguuuaugguguucaucggcaucgccuuuaacuucauucucgaucguaaggucccgguuuacguggaaaacuuucuggacggcuuaggaaauucauucaguggaagcgcacuguuuuaccucggucuuacuaugguaggcaaaauaaagagacugaaaaagucugcuuucguggucuugauccuacugauuaccgccaagcuccuggugcuuccccuguugugcagggagaugguugagcuccuggauaaaggggacuccguggucaaccauacaucauuaagcaauuaugcguuucuguacggaguguucccuguagccccaggcguugcaaucuuugcuacucaguucaacauggaaguggagauaauuaccagugguauggucaucucuacauuuguguccgcccccaucauguaugucagcgcuuggcuacucaccuucccuacgauggauccaaagccccuggccuacgcaauucaaaaugugucguucgacaucucuauuguuucccuuauaucauugaguaucgugugugccgggaugaugauuuggaacuuuguaaaagaaaagaauuucgucggacagauccugguguuuguucuccuguauagcucccuuuacucuacuuaucuguggacaggcuugcucgcuaucagccuguucuuacugaaaaagcgggagcgcgugcagauuccggucggcauaaucauuaucucagggugggggauuccugcgcuacucguggguguacugcuuaucaccggcaaacacaacggggauaguauagacuccgcauuuuucuacggaaaggagcagaugaucacuacagccgugaccuuguuuugcagcauucugaucgcuggcauuucucucauguguaugaaucaaacggcccaggcagguucauacgaaggguucgaucagagucaaagccauaagguugucgagcccggcaacaccgccuuugaagaguccccagcuccugugaaugaacccgagcuguucacaucuucgaucccagagacuagcugcuguuccugcucaaugggaaacggcgaauuacacugucccaguauagagccuauugccaauaccucuacaagcgaaccagugaucccguccuuugagaaaaacaaucauugcgucucaagaugcaacagccagucuuguauucuggcacaggaagaggagcaguaucuucaauccggggaccagcaguugacuaggcacguucuccugugccuacugcucaucauaggacuguucgcgaaccuuaguagcuguuugugguggcuguuuaaucaggaacccggucgguuauacguggagcuccaauucuucugcgcuguguuuaacuucggccagggguuuaucucuuucggaauuuuuggccuggacaagcaccuuaucauucugccuuucaaacgccgauuggaauuucucuggaauaacaaggauaccgccgagaauagagacuccccaguaucagaagagaucaaaaugacaugucagcaguucauacauuaucacagggaucugugcauucggaacaucgucaaggagcgucgcuguggugcaaagaccagugccgggacuuuuugcggcugugaccuagugagcuggcugaucgaaguuggacucgcuucggauagaggcgaggccgugauuuacggggacaggcugguccaaggaggugugauccagcauauuacgaaugaauaugaguuccgggaugaguacuuguuuuaucgauucuugcagaaaucccccgaacagucuccuccagcaauaaacgcuaauacacugcaacaggagcgcuacaaggaaaucgagcacagcucacccccgagucacuccccuaaaaccuga

SEQ ID NO: 56875 - RNA, 2433 nt, Artificial Sequence
  derived and/or modified sequence opt3 from GPR156__Homo_sapiens__NP_001161743
auggagcccgaaaucaacugcagcgagcugugugacuccuucccuggccaggaacucgauagaaggccacuucacgaccugugcaagaccacaauuacuucuucacaucacaguagcaaaacgauauccucuuugucgccgguguuacuggggaucgucuggaccuuucuaucauguggacuccugcuuauucuguucuuuuuggccuucacaauccauugccggaagaaucgcauuguuaaaaugagcagucccaaccucaauaucgugacucugcuggguuccugucucaccuacucuagcgcuuauuuauuuggcauacaagauguacuggugggguccucaauggagacacuuauccagacccgauugaguaugcugugcauuggaacuagccuagucuucggcccuauccucgguaagucuuggcgucuguacaaaguguuuacacagagaguuccagacaagagggugauuaucaaggaucuucagcuguuggggcucgucgcagcccuguuaauggcggacgugauacugcucaugaccuggguacuuacggaucccauucaaugucugcagaucuuguccguuacuggaaaagacgugucaugcaccagcacaaguacucacuucugugcuucucgguauuccgaugucuggauugcccuaaucuggggcugcaagggccugcuccugcuuuacggggcauaucuggccggauugaccggucaugugagcucgccuccagugaaccagucucucacaaucauggucggcguuaaucuguuagugcuggcugcagggcuacucuuuguagugacccgcuaccugcacuccuggcccaaccuugucuucggauugacgucaggcgguauuuuuguguguacuacaaccauaaauugcuucaucuuuauuccucagcugaaacaauggaaggccuucgaagaggagaaccagacuaucagaaggauggcuaaauauuucaguacaccaaauaagagcuuucacacccaguacggggaagaggaaaacugccauccgcggggagagaaguccucuauggagcgccuccugacggaaaaaaaugccguuauagagagccuucaggaacaagugaacaaugcgaaggagaaaauuguccgacugaugucagcagaauguaccuacgacuugcccgagggcgccgcuccuccagccaguucccccaacaaggaugugcaggcaguagcuagcguucacacacucgccgcggcccagggcccuucugggcaucugucagacuuccaaaaugauccaggaauggcagcuagagacagucagugcacuagcggucccuccucuuaugcccagucguuagagggcccggggaaagacagcuccuuuucaccuggaaaggaagagaaaaucagugauucuaaggacuucagcgaucaccuggacuccggcuguucacagaagcccuggaccgaacaaagccuagguccagagaggggggaucaggugccuaugaaccccucucagucccuccugccagaacggggcggaagugacccccagcgucaacgccaccuugagaacagcgaggaaccuccagagagaaggucucgggucuccucagugauccgagaaaaauugcaggagguccugcaggaucucggccuggggccggaagcuaguuuaagcacagcccccucgugccaucagcaaacuuggaagaauuccgcagccuuuucuccucagaaaaugccacugagcaaggagcuuggauucucacccuacauggugcgcagaaggcgggcugcgcagcgcgcaagaagucacuuuccugguuccgccccaucuagcguuggccauagggcuaaccguaccgugcccggggcccacucccgguugcauguacagaauggagacucaccgagccucgcaccucaaacaaccgauagucgagucagaaggccaucuucccgcaaacccagccugccuucggacccccaggaucggccaggcacucuagaggguucaaagcagucucaaacggaaccugagggggccagaggcaguaaggcugccuuccugaggcagcccuccggaagcggccgcgcaccaucuccggcggcuccuugucucagcaaagccucccccgaccugccagaacaguggcagcuuuggcccccugugccaucagggugcgcaaguuugagcucucaacacuccuauuuugacacagagucaaguagcuccgaugaguucuuuugucgaugccaccggcccuacugugaaauuugcuuccagucuucgagcgacucauccgauaguggaaccucugacacugauccugagccgaccgguggccuggccagcugggaaaaguuaugggcucguuccaaaccaaucguuaacuuuaaggacgaucucaaacccacacugguguga

SEQ ID NO: 56876 - RNA, 3648 nt, Artificial Sequence
  derived and/or modified sequence opt3 from GPR158__Homo_sapiens__NP_065803
augggcgccauggcuuacccccugcuccuuugccuguuguuagcacagcuggggcuaggagccgugggugcgagcagagacccucaaggcaggccagauuccccgcgggagcgcacccccaaggggaaaccucacgcucagcagccaggacgagccucugcaucagacaguagcgcccccuggucccguucuacagauggcacuauccucgcucagaagcuggcagaagaggucccuauggacguugccucguaucuuuacacgggugauucacaucaacugaaaagagcuaacuguagcgggagguaugaauuggccggacucccaggcaaguggcccgcgcuggcaagugcccacccuucccugcaucgggcucucgacaccuuaacacacgccacuaauuuccugaacgugaugcuucagucuaauaaaagccgcgagcagaacuugcaggaugaccuggauugguaccaagcccuaguauggucccuccuggaaggcgagccaucaauuaguagagcugccauaaccuuuagcacagacucucuuuccgcgccggcaccccagguguuccugcaggcaaccagggaggaaucacggaucuugcuccaggaucugagcaguucugcuccucauuuagccaaugcuacucuggagacagaaugguuucacgggcuccgccgaaaguggagaccacaccuucauaggcggggacccaaccaagguccucguggccuggggcacuccuggcgcagaaaggacggauugggcggugauaaaagccauuucaaguggucgccacccuaucuagagugcgagaaugggucuuacaaaccgggauggcuggucacccucuccucagccauuuauggccugcagccuaaccuugugcccgaauuuaggggcguuaugaagguggacaucaaucugcagaaagucgacauugaucaauguaguagcgacgggugguucuccggaacgcacaagugccacuugaacaauucugaguguaugccaaucaagggucucggcuuugugcugggggcauacgaaugcauauguaaagccggauucuaccauccuggcguauuacccguuaacaauuuucggcgacgcgguccagaucagcacaucagcgggucaacuaaggacgugagugaggaggcuuaugucugccugcccuguagagaaggcugcccuuucugugcggaugacuccccaugcuuugugcaggaggauaaauaccuaaggcucgcaauuaucagcuuccaggcccugugcaugcuuuuggacuuugugucuaugcuggucguuuaucauuuccggaaggcuaaaucaauucgcgccaguggacucauccugcuugaaaccauacuguucggcagcuugcuccuguacuuuccggugguaauuuuauauuucgagcccuccacauuuagauguauccugcuaaggugggcacgucuccugggguucgccacuguguacggaaccgucacacuuaaguugcaccgggugcugaaaguuuuucucucucgaaccgcucaaaggauuccuuauaugacggguggcagagugaugcgcaugcuggccgucaucuuacuggugguauucugguuucuuaucggguggacuucgagcguuugccagaacuuggaaaagcagauuucccucauaggacagggcaagacaucagaucaucugaucuucaauaugugucuaauugaccggugggauuacaugaccgcaguggcggaguuucuguuccuccuguggggugucuaccuuugcuaugcugugagaacugucccaagugccuuucacgaacccagguacauggcaguggccguucacaacgaguugaucauaucugcuauuuuccauacaauccgcuuugugcuggccagccgauuacaauccgacuggaugcucaugcuguauuucgcacacacccaucuuacgguaaccgucacaaucgggcuguugcucauuccuaaauucucacacagcucuaacaauccacgggacgauaucgcuacugaggccuacgaagacgagcuggauaugggccguuccggaaguuaucuaaacagcucuauuaauuccgcguggucagaacacagucuggaccccgaggauauaagagacgaacucaagaaacuguacgcccagcuugagaucuauaagaggaaaaagaugauuaccaacaauccgcauuugcagaagaaacgcuguagcaagaaaggccuggggcggucgaucaugagaaggaucacagagauuccugaaacugugucccgacagugcucuaaggaggauaaagaaggagcugaccacgguaccgcaaagggcacagccuuaauacgcaagaacccacccgagagcucagggaauaccggaaaaaguaaggaggaaacucucaaaaaccggguguuuucccugaagaaaucucauagcacguacgaucacguuagagaccaaacagaggaauccucaagccuuccuaccgagagucaggaagaggagacuaccgaaaauucuacacuggagucccuaagcggcaagaagcucacccagaaacugaaggaagauucggaggcugaaucaacugagucuguccccuugguguguaaaagugccuccgcacauaaccugagcucugagaagaaaacaggucacccaaggacgagcauguuacagaagucccucucaguaaucgcgagugccaaagaaaagacccuggggcuugcuggcaagacucaaacagccggaguggaggaacguaccaaaagccagaagccucugcccaaagacaaggagacaaaucgcaaccacucuaauuccgauaacacugaaaccaaagacccagcaccgcaaaauucaaacccugcugaggagccccggaagccacagaagaguggcauuaugaaacagcagagaguuaaccccacgaccgccaauagcgacuugaacccugggacaacucagaugaaggauaauuucgacaucggagaagucugcccaugggagguguacgaucucacccccggcccugugccguccgaaucuaaaguccaaaagcauguuucgauuguggcaagcgagauggagaaaaacccaacauuuucacugaaggaaaagucccaccauaaacccaaggccgcugaggugugucagcagaguaaucagaaaaggaucgacaaggcggaaguaugccuaugggagucucaaggucagagcauacuggaagaugagaaacuucucaucuccaagacuccuguccugccagagcgagccaaggaagagaacgggggacagccccgggcagcuaaugugugugccggccagucagaagaguugccuccgaaagccguugcuucuaagaccgaaaacgagaaucugaaccaaauuggucaccaggagaaaaagacgagcaguuccgaagagaaugugcgcggcagcuauaacucuucaaauaacuuccagcaacccuuaacauccagagcagaagucugcccaugggaguuugaaaccccugcccagcccaaugcggggaggaguguggcucucccagccagcucggcacugucugccaacaaaaucgcuggaccucggaaggaggagauuugggacuccuucaaaguuuga

SEQ ID NO: 56877 - RNA, 1083 nt, Artificial Sequence
  derived and/or modified sequence opt3 from GPR15__Homo_sapiens__NP_005281
auggaccccgaggaaaccagcguguaccuggauuauuacuaugccacauccccuaacucugacaucagagagacucacucacaugucccauacacgaguguuuuccucccgguguuuuauaccgcuguauuccuuacaggcgugcugggcaauuuggucuuaaugggagcacugcacuuuaagcccgguagcaggcggcuaauugauauauucaucauuaaccucgccgcguccgacuuuaucuuccuggugacucuuccucuguggguugauaaagaggcuucuuugggccucuggcgcaccgggucguuucugugcaagggaucaagcuacaugauuagugugaauaugcauuguuccguccugcucuuaacaugcaugucuguggaccgauaucuggccaucguauggccaguugugagccguaaauucagaaggaccgauugugcauacgucgugugcgccuccauaugguuuaucucaugucuuuugggccugcccacucuacucagucgggaacugacacuuauugacgauaagccuuacugcgcugagaaaaaggcaaccccaaucaagcugauuuggagcuugguggcccucaucuucacguuuuucgucccccuguuaucuauaguuacuuguuauugcuguauugcucgcaaacugugcgcccacuaccagcaauccgguaagcauaacaaaaagcucaaaaagucaaucaagauuaucuuuaucgugguagcggcauuccuugugagcuggcugccuuucaauaccuuuaaauucuuggccauugucagugggcuaagacaggaacacuaucugccaucugcuauacuccagcugggaauggagguguccggcccgcuugccuuugcaaacagcuguguuaaucccuucaucuacuauauuuuugacucguacaucaggcgggcuauagugcacugccugugcccuuguuugaagaacuaugauuucgggucuuccacagaaacuucagacagucaucucaccaaagcccugagcacauuuauucacgcggaggauuucgcccgccgaagaaagagguccgucucuuuauga

SEQ ID NO: 56878 - RNA, 1017 nt, Artificial Sequence
  derived and/or modified sequence opt3 from GPR160__Homo_sapiens__NP_055188
augaccgcccugagcuccgagaacugcucuuuccaguaccaacucagacagacaaaucagccccuugacgugaacuaucuguuguuuuuaaucauucugggcaagauacuacucaauauccugacucuugggaugaggcggaaaaacacgugucagaauuucauggaauacuuuugcauuucacuggcuuucgucgauuugcuccugcugguuaacaucaguauuauccucuauuuucgcgacuucguguuacugagcauacgauuuaccaaguaccacaucugucuuuucacacaaauuaucuccuuuacuuauggauucuugcauuacccuguauuucugaccgcaugcauugauuauugucuaaauuucucuaaaacaaccaagcucucguuuaaaugccagaagcuguucuacuucuuuacugugauccuuauauggauuucaguccuggccuacguguugggugacccagcgaucuaucagagccucaaggcucagaacgccuacagucgucacuguccguucuauguuuccauucaaucuuacuggcugagcuuuuucauggugaugaucuuauuugucgcauucaucacaugcugggaggaagugaccacgcugguacaggccauuagaauaacuuccuauaugaaugagaccauccucuacuuucccuucucaagucauagcucuuauacaguuagguccaaaaagauuuuucuuucaaaacugaucguguguuucuugagcacuuggcuaccuuuuguccugcuccaggugauaauugugcugcuuaagguccagaucccagcuuacaucgaaaugaacauucccuggcuguacuucguuaauaguuucuugaucgcaaccguguauugguuuaacugccacaaacucaaucugaaggauauuggcuuaccucuggacccauucguaaacuggaaguguugcuuuauaccccuaacaaucccuaaucucgagcaaauugagaaaccaaucucuaucaugauuugcuga

SEQ ID NO: 56879 - RNA, 1641 nt, Artificial Sequence
  derived and/or modified sequence opt3 from GPR161__Homo_sapiens__NP_001254540
augaaggugguccagcacgcccugcccaccccuagaaggggcgcucucacaaugagccuuaacuccucucugucaugccggaaagaguugaguaauuuaacugaagaggaagggggagaggguggcguuaucauuacgcaauucauagcaaucauugugaucaccauuuuuguaugccuggggaaccuagugaucgucgugacacucuacaagaaaagcuaucugcuuacucuguccaauaaguucguguuuucuuugacccucucgaacuuccugcugucaguucucgucuuaccauuugugguaacaagcaguauacgccgagaauggaucuucggaguuguguggugcaauuuuuccgcccugcuuuacuugcugauuucuagcgcguccaugcuaacccucggcgucaucgcuauugaccguuauuacgccgugcuguauccgaugguguaccccaugaaaaucacugguaacagagcagucauggcccuuguuuauauauggcugcauucauugauugggugucucccuccacuguucggauggaguagcguggaguuugaugaguucaaguggaugugcguagcugcauggcacagggaacccggcuacacagccuuuuggcagaucuggugugcuuuauucccuuuucuggugaugcucgucugcuacggcuucauuuuccggguggcccgcguuaaggcgagaaaagugcauugugggaccgucgugaucguagaggaagacgcacagaggacgggacggaaaaauucuuccacuucaaccagcaguucugguucccgccgaaacgccuuucagggcguuguguauagcgcuaaucaaugcaaggcccuuaucacaauucuggucguguugggggcauucauggucacuuggggaccauacauggugguuauagcuucggaggcccuauggggcaagucuuccgugucacccagucuggagaccugggcgacauggcucagcuuugccuccgcaguaugucacccucugaucuauggucuuuggaacaaaaccgucagaaaggaacuguuggggaugugcuucggagauagguacuaucgggagccauuugugcagcgucagcgcacgucuagacucuucagcauuucaaauaggaucacugaccugggcuuaaguccgcaucugacagcucuaauggccggcgggcagccccucggacacuccagcucuaccggugauacuggcuuuucauguagucaagacagcgggacagauaugaugcugcuugaagacuacaccuccgaugacaacccuccaucucacugcacgugucccccuaagcggcgaucgagcguuaccuucgaggaugaaguggagcagauaaaagaggcugccaaaaauuccauuuugcaugucaaggcagaagugcacaagucacuggacaguuaugccgcuucucucgcgaaagcaaucgaggccgaagcuaagaucaaccuguuuggagaggaagcccuuccaggcguacuggugacagcacgcacuguucccggugggggcuucggaggcagaagggggagccggaccuuggucucccagcgccuccagcugcaaucaauugaggagggagauguguuagccgcugaacagagauga

SEQ ID NO: 56880 - RNA, 915 nt, Artificial Sequence
  derived and/or modified sequence opt3 from GPR162__Homo_sapiens__NP_055264
augcugagcaccggcguggucuccuucuuuucucucaagucagacagugcucccccuuggaugguucuugccgugcuguggugcagcauggcacagacauuguuacugccauccuucaucuggucuugugagagauacagggccgauguacggacugugugggaacaaugcgucgcgauuaugucggaggaagacggggaugacgauggagguugugacgauuaugcugagggccgcgugugcaaaguucgauuugacgccaacggggcaacgggaccgggcucacgugaucccgcccaggugaagcuacucccugguagacacaugcuguucccaccccuugaaaggguccauuaccugcaagugccuuugagccggcgccucagucacgacgagaccaauauauuuuccacaccaagagagcccgggucuuuccugcauaaauggagcuccucagaugacaucaggguacugccugcucagagucgggcacucggaggcccaccggaauauuuaggccagcgccaccgacuggaggaugaagaggacgaggaagaggccgaagggggaggucuugcuagcuugagacaguuucuggagucuggcguucuaggguccggaggcggucccccuagggggccaggauucuuucgggaagagauuacuaccuucaucgacgagacaccccucccuucaccaaccgccagccccggccauaguccgcgucgcccuagaccccugggccuuucuccaaggcggcuguccuuggggagcccugaaucgcgagcggugggacucccccuggguuuaucugcaggccgcagauguucccugacugggggagaggaaucagccagggcuuggggcgguaguugggggccaggcaaccccauuuuuccucagcucacacuuuga

SEQ ID NO: 56881 - RNA, 960 nt, Artificial Sequence
  derived and/or modified sequence opt3 from GPR171__Homo_sapiens__NP_037440
augaccaacagcuccuucuuuugccccguguacaaggaccuggagccuuucacauacuuuuucuaucucgucuuucuuguuggcaucauugggucuuguuucgccacuugggcuuuuauacagaaaaauacgaaccacagaugcgugucaaucuaucugauuaauuuguuaaccgcagauuuccugcuaacacucgcccugccaguaaagaucguggucgaccuuggaguggcgccguggaaacugaagauuuuucauugucaaguuacugcuugcuugaucuacauaaacauguaucucaguaucauuuuccuggccuuugugagcaucgauaggugucugcagcucacccacuccugcaaaauuuaccggauccaggaacccgguuucgcaaagaugauaucuacagucgugugguuaaugguacugcuuauuaugguuccuaauaugaugaucccaauuaaggacaucaaagagaagucgaacgugggcuguauggaauuuaaaaaggaguucgggcgcaauuggcauuugcugaccaacuucaucugcgucgccauuuuucuaaauuucucagcuauaauccucauuagcaacugucuggugauccgacagcuuuaucguaauaaagauaacgaaaauuaccccaacgugaagaaggcacugauaaauauuuugcucgucacuacaggauacaucaucugcuuuguuccuuaucacauugugagaaucccauacacccugagucaaacggagguaauuacugacuguuccaccaggauaucuuuauucaaagccaaggaggcuacacugcuccuugccgugagcaaccugugcuuugaucccaucuuguauuaccaucuauccaaagcguuccggucaaaggucacugaaaccuuugcaaguccuaaagagacaaaggcccagaaagaaaagcugcgcugcgagaacaaugcuuga

SEQ ID NO: 56882 - RNA, 1002 nt, Artificial Sequence
  derived and/or modified sequence opt3 from GPR174__Homo_sapiens__NP_115942
augcccgccaacuacacuugcacaagaccugacggcgauaauacugacuucagguauuuuaucuacgcugugacguauaccgucauucugguuccagggcucauaggaaacauccuugcacuguggguguucuacgguuauaugaaggagacaaaacgggccguaauuuuuaugaucaauuuggcgauugcugauuuacuacaggugcugagccucccgcugcgcaucuucuacuaucuuaaccacgacuggcccuuuggcccugggcuguguauguucugcuuuuacuugaaguacgucaauauguaugccuccauauacuuccucguguguaucucuguucgacguuuuugguuccugauguauccauuuagauuccaugauugcaaacaaaaguacgaccuguauauuucaaucgcaggauggcucauuaucuguuuagccugcgugcuguuuccccuuuugaggaccagugaugacaccagcggcaaccggacaaaauguuucgucgaucugccuacccgcaaugugaaccuagcucaguccguaguuaugaugacuauaggugaacucauuggguucgugacaccacugcuuaucguccuguacugcaccuggaagacgguguugucucuccaggacaaguaucccauggcacaggaucugggagagaaacaaaaggccuuaaaaaugauucugacuugugcuggcguguuucucaucugcuucgccccuuaccacuuuucguucccacuugacuuucuggucaagucaaaugaaaucaaaagcuguuuggcgagaaggguuauucuaauauuccauaguguggcacugugccucgccucccugaacucuugccuugauccgguaaucuacuauuuuagcaccaaugaguuccggcgccgacuguccagacaggacuugcacgacucaauucagcuccaugcuaagaguuuugugagcaaccacacagccucuacuaugacccccgaacuguguuga

SEQ ID NO: 56883 - RNA, 1413 nt, Artificial Sequence
  derived and/or modified sequence opt3 from GPR176__Homo_sapiens__NP_001258784
augcccgccccucugcuccuuaucagcagaacccugggcaacuucaugguguugugguccacaugcaggacuacggucuuuaagucuguuaccaaucgguucauuaaaaacuuagcuuguucagggauaugcgcaagucugguguguguaccauuugacaucauucuaagcacauccccgcacugcuguugguggaucuacacuaugcuguucugcaagguggucaaauuucuccauaagguguucuguucuguuaccauucuuucguuucccgccaucgcgcuggaucgcuauuacucaguguuguauccucucgagcgaaaaauaagcgacgcuaagagucgugaacuggucauguacaucugggcccacgcagugguagccuccguuccaguguucgcugucacaaauguggcagauauuuaugccaccucuacuugcacagagguguggagcaacucccugggacaucucgucuacguuuuaguguauaauaucaccacgguaauugugcccgucgugguuguguuucuguuccuuaucuugauaagaagggcucugucagccagucagaagaaaaaggucauuaucgcggcacuacggacuccucaaaacaccauuagcaucccauacgccucucagcgcgaagcugagcuccacgccacacugcuuuccauggugaugguauuuauccuguguucaguucccuacgcaacuuugguggucuaucagaccgugcucaaugucccugacacaagcguguuccuguuacugaccgcuguuuggcucccaaaagugagucuucuggccaacccgguauuguuucuaacggucaauaagucugugagaaaaugccugauugguacucucguucagcugcaucacagguacucccggcgcaacguggucagcacaggcucggggauggcggaagccucucuugagcccuccauacgaucaggaagucaacuguuggagauguuccacaucggccagcagcagauuuucaagccuaccgaagaugaggaagagagcgaggcaaaguauaucgguuccgcugacuuucaagccaaagaaauauucucuacuugucucgagggggaacagggaccacaguuugcucccagcgccccuccacugucaacaguggauaguguaucccagguggcacccgccgcuccgguugagccugaaaccuuccccgacaaguacagcuuacaauuuggcuucggcccauuugagcugccuccccaguggcuaucugagacgagaaauaguaaaaagaggcuccugccaccccuugggaacaccccugaagaguugauucagacaaaagucccaaaggugggacggguggaacguaaaaugucacgcaauaacaaggucagcaucuucccgaagguugauuccuga

SEQ ID NO: 56884 - RNA, 7104 nt, Artificial Sequence
  derived and/or modified sequence opt3 from GPR179__Homo_sapiens__NP_001004334
augggcaccagaggggccgugaugcccccuccaauguggggccugcucgguugcuguuucgucugcgcuugggcccuuggcgggccgaggcccauccggagccugccuccauuguccucucagguuaaacccgggucagugccuaugcaaguaccauuagagggcgccgaagcggcucuggccuaccuguauaguggugacgcccagcagcucagccaggugaacuguuccgagcgcuacgaagcccgaggggcuggagcaaugcccggccugccuccaucucuucaaggcgccgcugggacacuggcccaggcggcaaacuuuuugaacaugcuccugcaggccaacgauauucgugagucgucagucgaagaggacguggagugguaucaggcucugguuagaagcguggccgaaggagauccgagggucuaccgggcacucuuaacuuucaaucccccuccaggugcuagucaucugcagcuugccuugcaggcgacgcgcaccggcgaggaaacaauacugcaggaccuauccgggaauugggugcaggaggagaaucccccuggagaucucgacacuccagcccugaaaaagagaguacuuaccaaugaucugggcucuuuggguagccccaaauggccgcaagcagacggguauguuggagauacacaacaggugaggcucuccccucccuuucuggaaugccaagagggccgguuacgcccaggcuggcugaucacccucucagcuacuuucuacgggcuuaagccugaccugagucccgaaguccgaggacaggugcagauggauguggacuugcagagcgucgauauuaaccaaugugccucugguccaggcugguauuccaauacacaccuaugcgaccugaacucaacccaguguguuccccucgagagccagggguuugugcugggaagauaccuuuguaggugccggccuggcuucuacggugcuaguccaucugggggccuggaagaguccgacuuucagacgacuggacaauucggcuuuccggaggggcguagcggacgcuugcuccagugccugcccuguccugaagguugcaccucgugcauggaugccacaccauguuuaguagaggaagcagccgugcugagagcugcgguccuagcaugccaggccuguugcaugcucgcuaucuuccugucuaugcuuguguccuauaggugucggcgaaauaaacgcauuugggccucaggcguuguguugcuggagacuguccucuuuggguuccugcuucuguacuuucccguguucaucuuguauuucaagccuaguguauuuagaugcauagcacucagguggguucggcuguuaggauucgccaucguguacggcaccauuauccugaagcuauaucgcguccuccagcuguuucuuagcagaacagcucaaagguccgccuugcugucuagcggucgucuccugcggcacuuagggcugcuuuugcucccagugcugggcuuccuagcagucuggaccgugggagcgcuggaacgaggcauucagcaugcuccccucguuaucagagggcacacgccgucaggaaggcauuuuuaccugugucaccacgaccgcugggauuauauaauggugguagccgagcuuuugcuguuaugcugggguaguuuccucuguuacgcaacucgggccguccuguccgcuuuucaugagccuagauacaugggcauugcccuucacaacgaacuguugcucagcgcagcuuuccauacagccagguuugugcugguuccaucucuacaccccgacuggacccugcuccuguucuuuuuccacacucauucaacagugaccacgacccuugcguugaucuuuauuccuaaauucuggaagcugggggcacccccacgcgaggaaauggucgaugaggugugcgaagacgaguuagaucuccagcacaguggaagcuaucugggcuccucuaucgcuucggcauggagcgagcauucccuugacccuggugauauccgagacgaacugaaaaagcuauacgcccagcucgagguacacaaaacaaaggaaauggcugccaauaacccccaucugccaaagaaacgggggucaaguugucaaggcuugggacguucuuucaugagauaucuggcagaguuuccggaggcguuagccaggcagcacagccgcgauuccggcucaccugggcacggaagccuccccggaucuucccggagaaggcugcuuaguagcucucugcaggaaccagaggguacucccgcuuugcauaagucccgaucaaccuacgaccaacgccgggaacaggacccuccacuccuggauagucuacugagaaggaaacuugccaagaaagcaagccguacagagucgcgcgaauccguggaggggcccccugcucucggauuccggucugccagcgcacacaaucugacuguuggcgagagauugccgagggcccgaccagcuucacugcagaagaguuuauccgucgcgucuagccgggaaaaagcccuccugauggcaucccaggcuuaucuugaggaaaccuaccgccaagccaaggagagagaagagaggaagaaagccaaggcugcaauggccucacuggugcggcgacccagcgcgagacgcuuggagaggccucguggugcuccacucagugcacccccuucuccggcaaaauccagcucgguggacucaucucauacaaguggccggcugcacgaagaggccagaaggcgccuaccccacccaccuauucgacaucaggucuccacccccauacuggcucuuagcgggggacucggcgaaccaagaaugcugucuccuacuagcacguuggcacccgccuuacugccagcgcucgcuccgacuccugcccccgcacuggccccaguucccguguccccucagucaccaaaccuucugaccuauaucugccccugggagaacgcugaauugccugccaagcaggagaaugugccgcaagaggggccaaguggacccgaacggggccaccauagcccugcacccgcuagggcccgccuauggcgugcgcugucuguagccgucgagaaauccagagcuggugaaaacgagauggaugcagaggacgcccaccaucagcgggaagcuaaugauguggacgaggauaggccaaagauuuuuccuaagucacacagucucaaagcacccguucagcaggggagcaugcgcucccugggacuugccaucaaggccuuaacucgaucuagaucgaccuaccgggaaaaagagagcguggaagagucaccagagggccaaaacuccgguacagcuggcgaaaguaugggggcgccuucuaggagcccgcgccugggaagacccaaggcagucuccaaacaggccgcucucauaccaucagacgauaaggagucuuugcagaaucaacagaacgcccacaccagcaggaugcuacaggugugccagcgggaaggcagucgugagcaagaagaccgcgggcgaagaaugacucagggacucggcgagaggaaggcagagcgggccgguaaaacagggcuggcuaugcuucgccagguuuccagagauaagaauauuaaacagagcaaggaaacgccugugggauggcaagagcugcccaaagcgggcuugcagucucuagguucagccgaccauaggguagcagaagucuguccaugggaggugaccgaauccgagacucggcagccugauaguggcaacaaggcugagaucugccccugggaaacaagcgagggggccccggaaucgcgagcacugagacaggacccaggagacucucaaaagaaacgcggcgaggccagggggaaguccgagccuaucgaugugguccccaugaugcggaaaaagccagaacgucucguuagagagcaggaagcugugugucccugggagagcgccgacaggggaggcuuaucaccugguagugcgccgcaggaucccgggcgcauucgggacaaaucugaagcaggagauuccguagaggcccgaaagguggagaaaccaggcugggaagcugccggcccugaggcucacacccccgacaucacaaaggcagaaccuugcccaugggaggccagcgaagggggagaggaugguaagcccgcucaggaggccgucaaagaccugccucaagaaaagcagaaaacuagaaaggcaaccuucuggaaagagcagaagccaggcggggaucuugaaucacugugucccugggagaguacggacuuuaggggaccgagcgcgguguccauucaagccccuggcucuagcgaaugcuccgguucacucgggucuggaauagcugagguuuguuugugggaggccggcgaugcaccagcuauccagaaggccgaaauuugccccugggagcuggacgauaaugugaugggccaggaaaugcucagucuggggaccggacgcgagucgcuucaggagaaagaaaaggcaagccggaaagguuccuucggcgagaugggggaacaaacagucaaggccgugcagaaacuaucucagcagcaagagucaguuuguccuagagaaagcacugugccaggacauuccagucccugccuggacaacucuagcucaaaggcuggcucccaguuuuuguguaauggugggagucgugcgacccaggucugcccgcaggaggacuuaaggccugaggcccaagaagcaacacccgcuaagacugagaucugcccaugggaaguaaacgagcggacccgcgaagaguggacgagcgcccaggugccucgaggaggcgagucucagaaagauaaggagaaaaugcccggcaaguccgagaucgaagacguuacagccugggagaaaccagaagggcaaauucagaagcaggaggcagugggacccugggagucagucgauccugguagcuucucgccacagccgagaccccaagacaccgaaaggccucagacucugcuccagaugucuggcagugugggguccaaggcugccgauauauguccacuggacguagaggaaaaucuuacagcgggaaaagcugagaucugccccugggaggugggcgccggugcaggggaagaacgggcccugggagcugaagcaauucgcaagagcccuaacgauaccggcaaagucucagccgaccucggcccaagagagagggcgguuacugcucccgaaaagccucagaaaccgaccccagagugggagguggccugucccuggggguccgugggaccuggugcaugcucucaacaccccggcacauuggaugccgacgggccaaaggcuggauuucaggaacuggaucauaugggcugucgaccuggugaggucugccccugggaagcccaggaggcagcuacgagcgaaaaagccaagaucuguccaugggaggugagugaggggaccacuggaaagggccuagaccagaaagcgggcuccgaaagcgccgagcaacgggaaaaggcacuggagaaagggcgucucacaucucuuggagaagacguuucaaaggguauggcuaaacugugccagcagcaggagaccauuuguaucugggagaauaaggauuuaagagaaaguccggcccaagcaccuaagauauccgacuugcccagcucuaugucgucagagguagcugaaggccacagccuggaggccacagagaaaggggaucuccgccaggacccaaagacuggauccuuccccgaacacaucacccaggagaaagccccugcggcugauacggaagaguuuacaaccgaagacggcgagaagacaagucaugagcugcaaucugugugcccaugggaaaccacagcacccgccgauagcgucucccaccuugacaggcagcggccugaucagccgaaggcuucaagucagagacuggugucuacuggugggcgcgccgcagacguuuguccaugggaugugcccgacgccggcgucuacaagagcgauuccucagcuaaggcggagaccugcccuugggaagugacagagaggauuccaguaaaaggagucagccgacaagacggcaagggggacucucaggaagagaaaggacgggcccccgagaaguccgaaccuaaaggugugcccguucagaagaagccagagauggcagauuucagacagcaagaagcugugugcccgugggagagucaggacggcaaagggcucagcccucagcccgccccagaugcaucggacaggucccgcggaucuucagaagccgcuggcagcgucgagacgcguguggccgagguuuguuugugggaaguggucgaggcgccuagugcaaagaaagccgaaaucugccccugggaggcuggugggggcgccgcagaggaaggagagcaggaacgggagucccaaggccagggggaaauguuucugcagaaggcuggaccagguggcaccgaggagcauuucucuaaagccgcugccaagccuagagaacaagaggcagugugucccggggaaggaacuggcagcgguggguuacuaccgcagucaggcgcgcuggauccagagcucaagguauccccuaaagaagccggaaguaugggcagcaggauggcugagcuuugccagugggagauuacagaccccgaagggaacaagaucaaaggaaccauggccgauauauguccaggcgaggaaacuggugugcccucugaggaaucagggcuguuggcacugacagcuacccgccgagaguucuuuccuacggccccggagaagccacucugccugcuuguucacggaccccucgaccacuucuuuccugaauccaaaauucccuguccaaaggucagccggccugcaucuacuuucacccuggagggcgugagagaauugcagggucccaguggccuggagccaaggacaucguuagccccugagccgucccuacaagaagcggagagccagucaucuagccugaccgaagauuccggacagguggcuuuugaggcccaguaugaagaguucacucccccaacagucuacccuugggacugggaguga

SEQ ID NO: 56885 - RNA, 1020 nt, Artificial Sequence
  derived and/or modified sequence opt3 from GPR17__Homo_sapiens__NP_001154889
augaacggccuggagguggcucccccugggcucaucaccaauuucagccuugccacagcagaacagugcggacaagagacuccacuggaaaacauguuguuugccuccuucuacuuacuggacuuuauucuagcgcucgucgguaauacgcuggcucuuuggcuguucauaagagaucacaagucuggcaccccggccaacguuuuucuuaugcaucucgcaguggccgaccugucauguguacuggugcuccccacaagguuagucuaucacuucagugggaaucauuggccuuuuggagagaucgcuugccggcugacuggcuucuuguuuuacuugaacauguaugcaagcauuuacuuccugaccuguaucuccgccgaucgcuuucuagcuauugugcacccaguuaaaucucucaagcugcgacguccccuuuaugcccaucuggcgugcgcauucuuguggguggucguggccguagcuauggccccucuccugguuucgccacagacagugcagaccaaucacacugucguguguuuacagcuguacagagaaaaagcaucacaccaugcucucgugagccuugccgucgcguuuacauuccccuucaucaccacgguuacuugcuaucuguugauaaucaggagucuacggcaaggucugcgcguggagaagagacucaaaaccaaggccguaaggaugauugcaaucgugcuggcuauuuuucuugucuguuucgugccuuaccacguuaaccgguccguguacguccugcauuaucgcucucacggggccagcugcgcuacacagcgaaucuuggcccucgcaaauagaauaacuuccugucugaccucauuaaacggagcccuggacccaauuauguacuuuuucguggcugagaaguuuaggcacgcgcuaugcaaucuccuguguggcaaacggcuuaagggcccgcccccuaguuucgaagggaaaacaaacgagagcucuuuguccgcaaagucagaacuguga

SEQ ID NO: 56886 - RNA, 1323 nt, Artificial Sequence
  derived and/or modified sequence opt3 from GPR180__Homo_sapiens__NP_851320
augggcgggcugagacuccuugccguggcucugaccugcuguugguggccccagggaagccaagguaagacauugaggggcuccuucucuucaacugcagcccaggacgcgcaggggcagcggaucggacacuuugaguuccauggcgaucacgcuuuacugugcguccgcauuaacaauauagccguugcaguggguaaagaagccaagcuauaccucuuucaagcucaggaguggcugaaacuucagcagaguagccauggguauuccuguucugaaaagcugucgaaagcacaauugacgaugaccaugaaccagacagagcacaaucucacuguaucacagaucccuagcccacagaccuggcauguguucuacgccgacaaguauacaugccaagaugacaaggaaaacagucaggucgaggauauuccguuugagauggugcugcugaaucccgacgcugaaggaaacccuuucgaucacuuuuccgccggcgagucuggccuccacgaauuuuucuucuuacugguucuuguguacuuugucaucgcguguauuuaugcacagagcuuguggcaagccaucaaaaagggagggccaaugcauaugauacugaaagugcuaaccacugcucuccugcuucaggccgguuccgcacuggcuaauuacauccacuucucaaguuauagcaaggacggcauugggguacccuuuaugggaucuuuggccgaguucuucgauaucgcgucccagauucagaugcucuaccuguuacugucacucugcaugggcuggacaaucguucgaaugaaaaagagccaaagucguccucuucagugggacucuaccccagccuccacggguauagcaguguuuauugucaugacucagagcgugcuguugcuaugggagcaguucgaagauaucucgcaucacucuuaccacucccaucacaaccuggcugggauucuccugaucgugcuuagaaucugucuggccuugucacucggaugcggccuguaucaaauuauaaccgucgagaggaguacauuaaagcgggaauuuuacaucacuuucgcuaaaggcuguauucugugguuucuaugccaucccguucucgccuguaucagcgugauauucuccgacuaucagcgcgauaagguaauuaccaucggggugauccugugccagucugucagcauggugauucuuuacagauuguuucugucacacagucucuauugggagguuuccagccugucuucagugacacuuccucugaccaucaguagcggacauaaauccaggccacacuucuga

SEQ ID NO: 56887 - RNA, 1215 nt, Artificial Sequence
  derived and/or modified sequence opt3 from GPR182__Homo_sapiens__XP_011536129
augagcgugaagcccuccuggggcccugggccaucugagggagucaccgccguuccgacaucagaccugggugaaauccacaacuggacugagcuccuugaucuguucaaucauacguugagugaaugccacguggaguuaagccaguccaccaaaagaguagugcuguuugcucuauaccucgcaauguucgucgugggccugguugaaaaccuucuggugauuugugucaauuggagggggucuggacgggccggcuugaugaaccucuauauacugaauauggcgaucgcugaccuggguauugugcucucguuacccguauggaugcuggagguuacacuugauuacacuugguugugggggucauuuagcugccgcuucacccauuauuuuuacuucgugaacauguauaguuccaucuuuuuccuggucugucuaucuguggaccgauacgugacacucaccagcgccuccccuucauggcaacguuaucagcacagagucaggcgggcaaugugcgccggaauuuggguucugagugcuaucauaccacuucccgaggugguacauauccagcugguggaaggcccugagccaauguguuuguuuauggcacccuucgaaacuuacagcacaugggcccucgcugucgcccugucuaccacgauuuuaggcuuucugcucccuuucccacuuaucacuguguuuaauguucugaccgcgugccgcuugagacagccggggcaacccaaguccaggcggcacugucuacugcucugcgcauacguggccgucuucgugauguguuggcugccuuaucacguaacacuucuguugcucacucugcauggaacccacauuucauuacauugccaccugguucaccuacucuacuucuuuuaugaugugaucgacuguuucagcaugcugcauugcgucauaaacccaauucuuuacaacuuuuugaguccccacuuccgcggucgacugcucaaugcugugguccauuaucugccuaaagaucagacaaaggccgggaccugcgcaucuuccagcucguguucuacgcagcacuccaucauuaucacuaaaggcgacucacagccagcugccgcggcaccccauccggagccuagucuuagcuuucaagcccaccaccuguugcccaauacauccccaaucucuccuacccagccccucacuccaagcuga

SEQ ID NO: 56888 - RNA, 1086 nt, Artificial Sequence
  derived and/or modified sequence opt3 from GPR183__Homo_sapiens__NP_004942
auggacauccagauggccaacaauuucacacccccuagcgcuaccccacaaggcaacgauugcgaccuguacgcacaccauuccacugccagaauugugaugccgcuccacuauucucuugucuuuauaaucgggcugguuggaaauuuguuagcgcuggugguaauugugcagaacaggaagaaaaucaauucaacgacccuauacaguacaaaccucgucauuagcgauauccuguucacuaccgcccuucccacacggauagcuuauuacgcaauggguuuugacuggcgcaucggcgaugcccugugucgaauuaccgcuuugguguucuauaucaauacuuacgcagggguuaacuuuaugacaugccucuccauugaccguuucaucgccgugguccauccucugagauauaauaagauaaaaaggauugagcacgcuaagggaguguguaucuuuguauggauucugguuuucgcccagacccucccauuacugaucaaccccaugucuaaacaggaagcggagcggaucacgugcauggaauacccuaauuuugaggaaacuaagucgcuuccauggauuuugcugggcgcauguuucauagguuacgugcuaccccucaucauuauccugauaugcuauucacaaauuuguugcaaacuuuuucgcaccgccaagcagaacccucugacagaaaagagcggggucaauaaaaaggcuuugaacacuaucauccucauuaucgugguguucguccuguguuuuaccccauaccauguugccauuauacagcacaugaucaaaaaguuaagauucaguaauuuccuggagugcucccagaggcacucuuuucaaauuagccuccauuucacagugugucuuaugaacuuuaacugcugcauggauccguucaucuacuuuuucgcauguaagggauauaaacggaagguaaugcgcaugcugaaacgacagguguccgucucaaucaguagcgcugugaagucugcccccgaggaaaauuccagagagaugaccgagacgcagaugaugauucacucaaaaagcaguaacggcaaguga

SEQ ID NO: 56889 - RNA, 1305 nt, Artificial Sequence
  derived and/or modified sequence opt3 from GPR19__Homo_sapiens__XP_011518926
augaaggaggccagcuucuuuuucucccccaccagaaucaaaaggaagaaagugaacauggucuuugcucaccggauggacaauucuaagccucaucugauuauaccaacacuccuuguuccgcugcagaaccgcucaugcacugaaacggcaacccccuugccuagucaauacuuaauggagcugagcgaggaacacuccuggaugucuaaucagacagaucuacauuaugugcucaaaccaggcgaaguagccacugcgucgaucuucuuugggauucuguggcuuuucucaaucuuuggaaacagccugguguguuuggucauucaccgaagucguagaacccaguccacaaccaauuacuucgugguuucuauggcuugcgccgaccuccugaucagcguggcauccacucccuuuguccugcuccaguucacaaccgguagguggacguuaggcucagccacuuguaaggugguacgguauuuucaauaccugaccccugggguucagauauaugugcuuuugaguaucugcauugaucgcuucuacacaaucgucuauccacugagcuuuaaggugucuagagagaaagcuaagaaaaugauugcagccuccuggguguucgacgcuggauucgucacucccguucuauuuuucuacggcucaaacugggauagccauuguaauuacuuucucccuaguucuugggaggguaccgccuauacagugauccacuuccugguaggguuugugauaccauccguccuuauuauccuguucuaccagaaggugauuaaauauaucuggaggaucggaaccgacggccggacgguucgccgaacuaugaacauugugccgagaacaaaggucaagaccauaaaaauguuuuugauccucaaucuguuauuccugcucagcuggcuucccuuucacguggcgcagcuguggcauccucacgaacaagauuacaagaaaucgucuuugguauucacugcaauuacauggaucuccuuuucaaguagcgccuccaagccaacccuauauucuauauacaacgcuaauuucaggcggggcaugaaagagacguuuugcaugagcucaaugaaguguuaucguaguaacgccuacaccauuacaacuuccagccgcauggcuaaaaagaauuacguugggaucucugaaauccccucaauggcaaagaccauuacaaaagacaguaucuaugauagcuucgacagagaggccaaggagaaaaagcuggcguggccuauuaacuccaauccacccaacacuuucguguga

SEQ ID NO: 56890 - RNA, 1068 nt, Artificial Sequence
  derived and/or modified sequence opt3 from GPR1__Homo_sapiens__NP_001091669
auggaggaccuggaagagacccucuucgaagaguuugaaaacuacagcuaugaucuugacuacuauucccuggagucugauuuggaggaaaaggugcaguuaggcgucguucacugggugucacugguacuauacugccucgccuucgugcuggggauccccggaaaugcuauugucauaugguuuacagguuucaaauggaagaaaacugugacgacccuuugguuucugaacuuggcaaucgccgacuucauuuuucuccuguuccugccucucuauaucaguuacguugcgaugaauuuucauuggccauucggcauuugguuauguaaggcuaacagcuuuacagcccaacugaauauguucgcauccguguuuuuccuuacugucaucucuuuggaucacuauauacaucugauccacccggugcuaucgcauagacacaggacccucaaaaacucacugauuguaaucauuuucaucuggcuucuggccagcuugauagggggacccgcucucuacuuucgggacacaguugaguucaauaaccacacccugugcuacaauaacuuucagaagcaugauccugacuuaacucugauucgccaccaugugcucacaugggucaaguucaucauuggcuaucuuuuuccacuguugaccaugaguaucuguuaccuaugccugaucuucaaagugaagaaacgauccauucucauaucuagccgucacuuuuggacgauccugguggucguuguggcauucguaguguguuggacucccuaucaccuguuuuccauuugggaacuuaccauccaucacaauucauacagucaucacgucaugcaggccgguauaccuuugagcacagggcucgcuuuccugaacucuugcuuaaauccaauucuguaugugcuaaucuccaagaaauuucaggccagauucaggucaagcguugcggagauccucaaguacacucugugggaggugaguuguucuggaaccgucuccgaacaacuucggaacagcgagacaaagaauuugugccugcucgaaaccgcacaguga

SEQ ID NO: 56891 - RNA, 1077 nt, Artificial Sequence
  derived and/or modified sequence opt3 from GPR20__Homo_sapiens__NP_005284
augcccagcguguccccugccggcccaucugcuggggcagucccgaacgccaccgcgguuacaacugugagaacgaaugcuucaggacuggagguaccccucuuccaccuuuuugccaggcuggacgaagaguugcaugguaccuucccuggcuuauggcuggcacuaauggccgugcacggggcuaucuuucucgcaggacugguccuuaacggccuggccuuguacguguucugcugucggacacgcgcuaagacuccaaguguuauuuauaccauaaaucucguggucacagaucugcuggugggucucagcuuacccacccgauuugccguauacuauggggcgcguggaugccugagaugugcauucccucauguucuuggcuacuuuuugaacaugcacugcuccauccuguuccuaacuuguauuugcguggacagguaucucgccaucguccggccagaaggcucucgcagauguaggcagcccgcuugcgcccgggcagugugugcuuuuguguggcuggccgcgggggccgucacacuuucgguucugggagugaccgguucacgcccuugcugucgaguauucgcauugacggugcucgaguuucuguuaccacugcucgucauuagcguguucacuggcagaaucaugugcgcucuuaguaggccggggcuguugcaucaaggacggcagcgucgcguuagagccaugcagcuacugcucaccgugcugauaaucuuucuugucugcuucacacccuuccacgcuaggcaaguggccguagcacuguggccugauaugccacaccauacuuccuugguuguguaccacgucgccgugacccucucuagcuuaaauuccuguauggaccccauugucuauugcuuugugacaucaggcuuccaggcuaccguucggggucuguuugggcagcauggagaacgagagccuaguagcggcgaugugguaucuaugcaccgcuccucaaaaggcagcgggagacaccauauccugagugcgggaccacacgcacuaacgcaggcccucgcuaacggucccgaggccuga

SEQ ID NO: 56892 - RNA, 1302 nt, Artificial Sequence
  derived and/or modified sequence opt3 from GPR22__Homo_sapiens__XP_011514358
augugcuucagcccgauccuggagauuaacaugcaguccgaaucuaauauaaccgugagagacgauaucgacgauauuaacacaaauauguaccaaccucucucauauccacuuaguuuucaggucagccugacuggcuucuugauguuagagaucguucuggggcuaggauccaaccucacggugcugguacuuuacuguaugaagucuaaucugauuaacucggugucaaauaucauaaccaugaacuugcacguccucgacgugaucauuugcguugguuguaucccgcugacaauugugauccugcucuuaagccuggaaaguaauacugcccuuauaugcuguuuucaugaggcuugcgucuccuucgcaucugugagcaccgccauuaacguauuugcgaucacauuggauagguaugacauuuccguuaaacccgcuaaucggauccugaccaugggccgcgccgugaugcuaaugaucucaauuuggauauucagcuuuuucaguuuucucaucccuuucauugaagucaacuuuuucucucugcaguccgggaauacuugggagaacaagacacuucugugugugucaaccaaugaguacuauacggaauugggaauguacuaucaccuccuggugcagaucccaauauuuuucuucacugucguugugauguuaauuaccuacacaaaaauccugcaagcacucaacauccgaauuggcacucguuuuagcaccggucagaagaaaaaggccagaaagaaaaagacaaucagucuuaccacgcagcaugaggcuacugauaugucucaguccagcgggggaaggaacguaguguucggcguccggacaucggugucuguuauuauagcacugcgcagagccgugaaaaggcaccgggaacgccgagagagacaaaagagggucuuucggauguccuugcuaaucauuucaaccuuccugcucugcuggacucccaucagugugcugaauacaaccauccuuugucugggcccuagcgacuugcucguaaaacugcguuuaugcuuucugguuauggcuuacgggacgaccauuuuccauccacuacucuaugccuuuacacgccagaaguuccagaaggugcugaaauccaagaugaaaaagagagucgugucuauagucgaggcggauccccuuccuaacaaugcagugauccacaacagcuggauugacccaaaaaggaauaagaaaaucacuuuugaagauucagagauucgggaaaaguguuugguuccccaggugguaaccgacuga

SEQ ID NO: 56893 - RNA, 1014 nt, Artificial Sequence
  derived and/or modified sequence opt3 from GPR26__Homo_sapiens__NP_703143
augaacagcugggacgccggccuggcugggcuccuugugggaaccaugggugucucccuguugucuaaugcauuaguucugcuaugccuccugcacucagccgauaucagaaggcaggcgcccgcucuuuucacacugaacuugacuuguggcaaucuccugugcacggugguaaacaugccucugacccucgccgggguggucgcacaacggcagccagccggagaccgcuuaugucgacuggcugcauuucuugauacauucuuggccgcuaauaguaugcugagcauggccgcgcuauccauugaccguuggguggcaguuguguuuccgcucucuuacagagccaagaugaggcugcgggaugcugcccuuauggucgcauauacuuggcugcaugcuuugaccuuccccgccgcggcccucgcacugucgugguuaggcuuucaccagcuguacgcuucaugcacacucuguagccgcagaccugacgagaggcuucgguucgccguguuuaccggugcuuuccaugcccuguccuuuuugcuaaguuucguaguucugugcuguacuuaucucaaagugcugaaggucgcacgcuuucacugcaaacgaauagaugugaucacaaugcagacccuugugcuguuggucgaccuccauccaucuguuagagaaaggugucuggaggaacaaaagcggcgucgccagagagccacgaaaaagauuagcacuuucaucgggaccuuuuuagugugcuucgcucccuacguaauuacaaggcugguggagcuauucuccacugucccuaucggaucacacuggggcgugcucaguaagugucuggcguauagcaaagcagccucugauccauuuguuuacucccuuuugcggcaccaguaucgaaagucaugcaaagaaauacugaaccgccuccugcauagaaggagcauccacaguucuggccuuaccggggacucccauagccagaauauucugcccgugucggaguga

SEQ ID NO: 56894 - RNA, 1146 nt, Artificial Sequence
  derived and/or modified sequence opt3 from GPR34__Homo_sapiens__NP_001091048
augagaagccacaccaucacaaugacuacgaccuccgugucuucauggcccuacaguagccauaggaugcgguucauuacaaaccacuccgaccagccuccacaaaauuuuucugccacuccgaacgucaccacaugccccauggaugagaagcugcucucgaccguucuuacuacaucauauagcgugauauucaucguaggccugguggggaauauuaucgcuuuguacgucuuuuuagguauucaucgcaaacgaaacaguauccagauauaucugcuaaauguggcaaucgccgaccuccugcuuauuuucugucugccuuuucguaucauguaccacauuaaccagaauaaguggaccuugggaguuauccucugcaaaguggucggcacgcuguucuauaugaacauguacauauccauuauccugcucggguuuauuucuuuagauagauauaucaagaucaauaggagcauucagcaacggaaagcgauaacuaccaagcaguccaucuacguguguugcauuguauggaugcuggcucuuggaggcuucuugacaaugaucauacugacucuaaagaaaggugggcauaacucaaccauguguuuucacuaccgcgacaagcacaaugccaaaggagaagcaauuuucaacuuuauccucguugugauguucuggcugaucuuucuucugauuaucuugaguuauauuaagauaggcaaaaaucuccugagaaucagcaagaggcggucuaaguucccaaacuccggcaaauacgccacaaccgcucgcaauucauucauugucuuaaucaucuuuacgauuugcuucgugcccuaucaugcauuucgauucauauacaucagcagucagcugaacgugucuuccuguuauuggaaggagauuguccacaaaacuaacgaaaucaugcucguucuuagcucguuuaauucuugccuggauccugugauguacuucuugauguccucaaacauuagaaagaucaugugucagcuacuguuuaggcgguuccaaggggagccaagucguagcgaauccacaucugaguuuaaacccggauauagccuccaugacaccucaguagccgugaagauacagaguuccagcaaaucuacuuga

SEQ ID NO: 56895 - RNA, 1023 nt, Artificial Sequence
  derived and/or modified sequence opt3 from GPR35__Homo_sapiens__NP_001182311
augcugagcggcuccagagccgugcccaccccucacagggggucugaggaacuccuuaaguacaugcugcauucaccaugcgucaguuugacaaugaacggaacuuauaauacgugugguagcuccgacuuaaccuggccgcccgcuaucaaacugggcuucuacgcauaucuagggguucuccuggugcuuggacuguugcucaacucucuggcccuguggguauuuugcugucggaugcagcaauggacagagacucgcauuuacaugaccaaucucgcgguggcugauuuaugccugcuuuguacauugccuuucguccugcacucgcuacgagacaccucagauacuccacucugccagcugagccagggcauauaucuuacaaaccguuacaugaguaucucccuggugaccgccauugcaguugacagauauguggccgucaggcaucccuugcgggcucgcggucucagaucuccuaggcaggcagccgcugugugugccguacuguggguuuuagugaucgggagccuggucgcgcgguggcuccuuggcauucaagaaggaggcuuuugcuuccgcuccacgcgacacaauuuuaacucaauggcauucccacuguugggguuuuaccuaccccuggccgugguggucuucuguagucucaagguugugacugcucuggcccagagaccuccaaccgauguaggacaggcagaggcuacaaggaaagccgcgcggauggugugggccaaucuucuggucuuugugguuugcuucuugccgcuccaugugggucugacuguccguuuagcagugggcuggaacgcuugugcccugcuagaaaccauccgcagagcucucuacauaacaagcaagcugucugacgccaauugcugccuugaugcaaucuguuauuacuauauggccaaagaguuucaggaggcuuccgcguuggcaguagcccccucagcuaaggcccacaagagccaagacagucugugcguuacccucgcauga

SEQ ID NO: 56896 - RNA, 1842 nt, Artificial Sequence
  derived and/or modified sequence opt3 from GPR37__Homo_sapiens__NP_005293
augagagcccccggcgcucugcucgcaaggaugagccggcuucuguuguuacugcuacucaagguguccgccucuucagcgcugggggucgcuccugccagucgcaacgagaccugccuuggagaaagcugugcaccaacaguuauccagcgacgugguagagacgccuggggcccgggaaauuccgcuagggaugugcugcgggcacgcgcccccagagaggaacaaggggcugccuucuuggcgggcccuucuugggaccucccagcagcccccgguagggauccugcugccgggcggggagcagaggcuucggccgcgggcccacccggcccuccaacucgcccgcccgggccuuggcgauggaaaggagccagaggucaggaaccaucagagacgcugggcagggggaaccccaccgcacugcagcucuuuuuacagauuagcgaggaagaggaaaagggaccucggggcgcugguauaagugggcguucccaagagcagucuguaaaaacagugccaggagccagcgaccuguucuacuggccccgcagagcuggcaaacuucagggcucccaccauaaaccguugucaaagacugccaaugggcuggcaggacacgaggguuggaccaucgcccuaccuggcagggcucucgcgcagaacgggagucugggagaaggcauucaugagcccggugggccacggcgaggcaauagcacaaaccgcagagucaggcuuaagaauccuuuuuauccccugacccaagaaucuuacggagcauaugccgugaugugcuuguccguugugaucuucggcacugggauuaucggaaaccucgcugucauguguauagugugccacaauuacuauaugcggucaaucagcaacagucuguuagccaaucuggcauuuugggauuuccucauuaucuuuuucugucuuccacugguaauuuuucaugaguugacaaagaaguggcuacuggaagacuucucuugcaaaaucguucccuacauagagguggccucccucggugucaccacguuuacucugugugcucuuugcauugaucgcuucagagccgcaaccaacgugcagauguauuacgagaugaucgaaaauuguagcucgacaacugcgaagcuggcugugauuugggucggcgccuugcuccuggcauuaccugagguugugcugaggcagcuaucuaaagaagaccucggguuuuccggacgugccccagcugagcggugcaucaucaagauuucaccggaucugcccgacaccauauacguacuugccuugacauaugauagugcacgacuguggugguacuucggcuguuauuucugccucccuacccuguuuacgaucacuugcagccuugugacagcuagaaagauuaggaaagccgaaaaggcguguacccgcgguaacaaacggcagauccaacuggagucccagaugaauugcacugucguggccuugacaauacucuacggguucuguauuaucccagagaacaucugcaacauuguuaccgcuuauauggcaacgggcgugucucagcaaaccauggaccuguuaaauaucauuagccaguuucugcuauucuuuaagucaugugucacacccgugcuccuguucugccuuuguaaaccuuuuaguagagccuucauggaaugcuguugcuguugcugcgaggaauguauacagaaguccagcacuguaaccucugaugacaacgacaaugaguacacaacugaauuggagcugucaccauuuaguaccaucaggcgcgagaugagcacauucgcuuccguuggaacccacugcuga

SEQ ID NO: 56897 - RNA, 1446 nt, Artificial Sequence
  derived and/or modified sequence opt3 from GPR37L1__Homo_sapiens__NP_004758
augagauggcuguggccccucgccgugagccuugcugucauccuggcaguuggcuuguccagggugucugggggagccccuuuacaccugggucggcaucgcgcggagacccaagaacaacagucacgaaguaagcguggcacagaggacgaagaggcuaaagggguacagcaguacgugccagaagagugggccgaguauccgagacccauucacccugcaggacuacaaccaacuaagccccucgucgccacgagcccuaacccaggcaaagauggugggacccccgacuccggacaggaacugaggggcaaucuuacaggcgcuccugggcagcggcugcagauacaaaacccauuguacccggugacugagucuucguauucagcauacgccaucaugcuccuggcucugguuguguucgccgucggaauuguggguaaucucagcguaaugugcaucguuuggcauaguuauuacuuaaaguccgcguggaacucuauucuggcaagccuugccuugugggauuuucuggugcuauucuuuugucuccccaucgucauauucaaugaaaucaccaaacagcgccugcuuggcgacguguccugcagagcugugccuuuuauggaggucucaagucuggggguuacaaccuucagcuugugugcccucggaauugauagguuucacguggcaacuucuacacugccaaagguacggcccaucgagcgcugccaguccauuuuagcuaagcuggccgugaucugggucggcucaaugacccucgcggugccugaacuucuguuguggcagcuagcccaagagccagcacccacgauggguacucuggacagcuguauaaugaaaccgagugcuucucucccugaaucccuguauagccuuguuaugaccuaccagaacgcccgaauguggugguacuucgggugcuauuuuugucugcccauuuuguucacagugacuugccagcucgucaccuggagagugaggggaccaccuggccggaagucggagugucgugcuucuaaacaugaacaaugcgagucccaguuaaauucaacaguaguuggccugaccguggucuacgccuuuuguacgcugcccgagaacgugugcaauaucgucguggcauaucuaaguacugaacucacacgccagacccuggaucuuuuggggcugauuaaccaguucagcacauuuuucaagggagccaucacuccaguucuccugcuuugcaucuguagaccccugggucaggcuuucuuggacugcuguugcuguugcuguugcgaggaauguggcggggcguccgaggcaucugccgcuaauggaagcgauaacaaacucaagaccgaagugucaaguuccauuuacuuucacaagccuagggagagcccaccgcuguuaccccugggcacgccuugcuga

SEQ ID NO: 56898 - RNA, 1362 nt, Artificial Sequence
  derived and/or modified sequence opt3 from GPR39__Homo_sapiens__NP_001499
auggccagccccucccugccuggcucugacugcucacagaucauugaucacagucaugugccagaguucgaagucgcuaccuggauaaagaucacacucauucuuguuuaccugaucauuuuugugaugggguuguuaggaaacagcgcaacuaucagaguaacgcaagugcugcagaaaaaggguuaucuacagaaagaggucaccgaccacauggugucccucgccuguucugauauacugguuuuccuuaucggcaugccgauggaauuuuacucgauuaucuggaauccccugacaacuucaagcuauaccuugaguugcaagcuccauacauuccuguuugaggcguguuccuacgcuacccugcuccacguguuaacucugucuuucgaaagguauauugccaucugccauccuuuucgguacaaagcagucagcgggccaugucaggugaaacuuuugauaggauucguauggguuacauccgcccugguggcucuaccccuccuguuugcaaugggcaccgaguauccucuugucaacgugccaucacaccgcggucugacgugcaaucgaaguagcacucgucaccaugagcaacccgaaaccucuaacauguccauuuguacaaauuugucaagcagauggacuguguuccagaguucuaucuuuggggccuucgucguuuaccucgugguacuguuauccguggcuuuuaugugcuggaacaugaugcagguccugaugaaaagccagaagggaucgcucgccggcggcaccaggccuccacaacuucggaagucugaguccgaagagucacgcacagcgagaaggcagaccauuaucuuccugcgguugaucgugguuacgcuagcaguguguuggaugccgaaucagauucgccgaauaauggccgcugccaaacccaagcacgacuggacuagaaguuacuucagggcauauaugauccugcucccuuuuagcgagacauucuuuuaccuguccucugucauuaacccacuucuguauaccgugagcucacagcaauuccggcguguauuuguucagguguugugcugucgccucagucugcagcaugcuaaucacgaaaagagauuaaggguccacgcccauuccacuacagauagcgcgcgguucgugcaacgaccccugcuauuugccucucgcagacagucaagugcaaggcggaccgagaagaucuuccucagcacguuucaguccgaagcugagccucagucuaagucgcaaagccugucccuugaaucauuggagccaaacaguggggccaaacccgcuaauucugccgcagagaacggauuccaggaacacgaggucuga

SEQ ID NO: 56899 - RNA, 1089 nt, Artificial Sequence
  derived and/or modified sequence opt3 from GPR4__Homo_sapiens__NP_005273
augggcaaccacaccugggaggggugccauguggacagcagagucgaucaccuguuucccccuucccucuacaucuucguuauuggagugggucuuccaacaaauugucuggccuugugggcugcauauaggcagguacaacagcggaacgaauuaggcguguaccugaugaaucuaucuauagccgaccuccuguauaucugcacucuuccgcugugggucgauuacuucuugcaucacgacaacuggauucaugggcccggaucauguaagcucuuuggcuucaucuuuuauacgaauauuuacaucaguauagcguuccugugcuguaucagcguggaucgcuaucuggcuguugcccacccucuccgauuugcacguuuaagaagggugaaaaccgccgucgcuguguccucuguaguuugggcaacagagcugggugccaacucggcuccacuuuuccacgacgaauuguuucgggaucgcuacaaucauacuuucugcuuugagaaguuccccauggaaggguggguggccuggaugaaccuguacagagucuuugugggauuccuauucccuugggcgcucaugcugcuuucauauaggggcauucugcgggcagugcgcggcagcgucaguaccgagcgacaggagaaagccaagaucaaaagauuggcucucucccugauugccaucguuuuaguguguuuugcaccauaccacguacugcuccuuucuaggagcgcuauauaucuggggcggcccugggacugcggauucgaggaacguguguuuuccgccuaccauucaaguuuggcguucacaagccuaaauugugucgccgauccuauucuguauugccucgugaacgaaggugcacgcucugacguugcuaaggcccugcacaaucuucugagauuuuuggcuuccgauaagccacaggagauggccaacgcaucacucacccuggagacuccguuaacaagcaaaaggaauaguaccgccaaggcuaugacgggcucuugggcggcaacucccccuucccaaggggaccaggugcagcugaaaaugcuaccacccgcccaguga

SEQ ID NO: 56900 - RNA, 1854 nt, Artificial Sequence
  derived and/or modified sequence opt3 from GPR50__Homo_sapiens__NP_004215
augggccccacccuggccgugccuacaccauacgggugcaucggauguaagcucccgcagcccgaguauccuccagcucuuauuauauucauguuuugcgcaauggucaucacuauuguuguggaccugaucgguaacagcaugguaauuuuggccgugacgaaaaauaagaaauuaagaaacuccggcaauaucuucgucgugucucugucaguugcggauaugcuaguggcuauauaccccuauccucucaugcugcacgccaugaguaucgggggaugggaccuuagccaacugcagugucagauggucggcuuuauuaccgguuuguccgugguagggucuaucuucaacauuguugcaaucgccauaaauagguacugcuauauuugucauucgcuccaguacgaacggaucuuuucagugcgcaacacaugcauuuaucuggucaucacuuggaucaugaccgugcuggcugugcucccaaauauguacauuggaacaauagaguacgauccccgaaccuauacuuguaucuucaacuacuuaaauaacccugucuuuacaguuaccauugugugcauccacuucguacugccacuuuugauagugggcuuuuguuauguccguauuuggacgaaggugcuggcagccagagacccggcuggccaaaaucccgauaaccagcuagccgaaguuaggaauuuccucacuauguuugugaucuuccugcuuuuugcggucugcugguguccuaucaacgugcugaccguauugguugcagugagcccaaaagagauggccgggaagauucccaauuggcucuaccuggcugccuauuucaucgcauacuucaacaguugcuuaaacgcugucauuuauggacugcucaaugaaaacuuucggcgcgaguacuggacaauauuccaugccaugagacacccuaucaucuuuuucuccggucuuauuucugacaucagggagaugcaggaagcgcggacucuggcccgcgcacgagcucaugccagagaucaggcuagggagcaagaccgggcccacgcaugcccagccguggaagagacccccaugaauguccguaacgugccguugccuggcgaugcugcggcagggcaccccgaccgcgccagcggacauccaaagccucacuccagaucaaguagcgcuuacaggaaaucugccuccacacaucacaagucaguuuuuagccacaguaaagcagccucuggccaucuaaagcccguguccggucacagcaaaccagcuucggggcaucccaagucugccaccguauauccuaagccagcauccguccacuucaaagcggauucagugcauuuuaagggagacaguguucacuucaaaccggauagcgugcacuuuaagcccgcuuccucuaauccuaaaccaauuacgggccaucacgucagcgccggcucacauaguaaguccgcauucagcgccgcuacuucucaccccaaaccuacaaccgggcacauaaagccagccacuucacaugcagagcccacaaccgcugacuacccgaagccugccacgaccagucacccaaaacccacagcggccgacaacccugaacugagcgcuucccauugucccgagaucccagcaauugcccacccugugucugaugacucggaucuccccgaaagcgcuuccucaccagccgcaggaccgacuaagccugcggccagucagcuggagucugacaccaucgcugaucuucccgacccaacaguagugacuaccagcacaaaugauuaucaugacguugucgugauugauguggaagacgaucccgacgagauggccgucuga

SEQ ID NO: 56901 - RNA, 1086 nt, Artificial Sequence
  derived and/or modified sequence opt3 from GPR52__Homo_sapiens__NP_005675
augaacgagagcagauggaccgaauggaggauccugaauauguccucuggcauugugaacgucucagagcggcacaguugcccccucggguucggacauuacagcguuguggacguauguauauuugaaacaguggucaucgugcuucugacuuucuugauuaucgccgguaauuuaacgguuauuuuuguguuccacugcgcuccucugcuacaucacuauaccacauccuacuuuauccagacuauggcauaugccgaucucuucgucggcgugucuugucugguaccaacccuuucgcuguugcauuacucaacagggguucacgagagccugaccugccaaguguuuggauauauaaucaguguccucaaguccgugucuauggcgugucuggcuugcauuagcguggaccgcuaccucgccaucacuaaaccguuauccuauaaccagcuggucacacccugucgacuucguauuugcaucauauugauuuggaucuacucaugucugauuuuccuaccuagcuuuuucggcugggguaagccaggguaccacggagauaucuuugaauggugcgcaaccaguuggcucacgucugccuauuucacuggcuuuaucguuugucugcuuuacgcucccgcagccuucgugguaugcuucaccuauuuucauauuuucaaaauaugcagacagcacacaaaggagaucaaugacaggcgggcucgcuuuccuucccaugagguggauucaagcagagaaacuggccacaguccagacaggcgguacgccaugguccuguuccgcauuaccucuguguuuuauauguuguggcuccccuacaucauauauuuccuguuagaguccagccgaguucuggauaacccuacacucucguuucuuaccacguggcuggcgauuucuaauuccuucuguaacugcgugaucuacucauugaguaauagcgucuuuagacuagggcugaggcggcucuccgaaacuauguguacaucuugcaugugugugaaagaccaggaggcacaagagccaaagccgcguaagcgcgccaacagcugcucaaucuga

SEQ ID NO: 56902 - RNA, 960 nt, Artificial Sequence
  derived and/or modified sequence opt3 from GPR55__Homo_sapiens__XP_011510479
augagccagcaaaacaccuccggcgacugccuguucgauggggugaaugagcucaugaagacacuucaguuugccguccacauccccacuuucguucugggauuguuacugaaccuacucgcuauucaugguuuuucuacguuccugaaaaauagauggccugacuacgcagccaccucaauauauaugaucaaccuugcgguguuugaucuguugcucguacugagucugccauucaagauggugcucagccagguccaguccccguuucccucuuuauguacacugguggaaugccuuuacuucguuucgauguauggcucaguguuuacuauuuguuucaucagcauggacagguuuuuggcuauucgguacccucugcuagucagucaccuccgcuccccacgaaaaaucuucgggauaugcuguaccaucugggugcugguauggacaggaucuauucccaucuauagcuuucauggcaagguugagaaauacaugugcuuccacaauauguccgaugacaccuggucagccaagguguucuuuccucuugaagucuucgguuuucuguugccaauggggauuaugggauucuguugcagucguagcauccauauacuccugggcagaagggaucacacucaagacugggugcagcagaaggcauguauuuauucuaucgccgcuuccuuagcaguguuugucguuucauuccugcccgugcaccucggcuuuuuccuucaguuucugguacggaacagcuucauuguggagugccgcgccaaacaaaguaucuccuuuuucuugcagcuaucuauguguuuuagcaaugucaacugcugccuggauguguucuguuacuacuucguuaucaaggaauuuagaaugaauauuagggcucaucggccuucgcgcgugcagcucguccugcaggacacaaccauaucucgaggguga

SEQ ID NO: 56903 - RNA, 1014 nt, Artificial Sequence
  derived and/or modified sequence opt3 from GPR65__Homo_sapiens__NP_003599
augaacagcacaugcaucgaggaacagcacgaccuggaucauuaccucuuccccauuguguauauauuugucaucauuguuuccaucccugccaauauuggcucucuuugugugucauuccugcaagcuaagaaagagagugaauuggggaucuacuuauuuagccugucccuaucugaccuccuguaugcacuuacccugccauuguggauagauuacacuuggaacaaggacaauuggacguucucgccggcccucugcaaaggaucagcguuucugauguauaugaacuucuacagcaguaccgcuuuucugacauguaucgccguagauagauaucucgcaguggucuaccccuuaaaguucuuuuuccugaggacucggcgcuuugcccuuaugguguccuugucuauuuggauccuggagaccauuuucaaugcuguuaugcuaugggaagacgagacaguggucgaguacugcgaugcagagaaaagcaacuuuacccucuguuaugacaaguacccucuggaaaaguggcagaucaaucuuaaccuguuccgaacuugcacagguuaugccauaccauuggugaccauucucaucuguaaucguaaaguauaccaggcuguuagacacaacaaggccacggaaaauaaagagaagaaaaggauuaucaagcuguuaguguccaucacugucaccuucgugcugugcuuuacacccuuccaugugaugcuccuuauucgguguauacuggagcacgcggucaacuuugaagaucauucaaauaguggcaagcgcacuuauaccauguacagaaucacaguugcauugaccagccuaaacugcguggccgacccuauucuguauuguuucguaacggagacugggagguacgauauguggaauauccucaaauuuugcacaggacggugcaacaccucucagcgccaacgaaagagaauacuguccgugucaacuaaagacacaauggaacuugagguccuggaauga

SEQ ID NO: 56904 - RNA, 1098 nt, Artificial Sequence
  derived and/or modified sequence opt3 from GPR68__Homo_sapiens__NP_001171147
augggcaacaucaccgccgacaauagcuccaugucuugcacaauugaucacacuauacaucagacgcuggcucccguggucuacguuaccgugcucguagugggguucccugcaaacugucuuucacuguauuuuggauacuugcaaaucaaggccagaaaugaguuaggugucuaucugugcaaccuaacaguggcggaccucuucuacauuuguagucugccauuuuggcuucaguauguucugcagcacgauaauuggagccauggcgacuuguccugccaggugugugggauccuccuguacgaaaacauuuauaucucugucggauuccugugcuguauaucgguggauagguaccucgcuguagcccacccguuucgguuccaucaauuucgcacuuuaaaagcagccguuggcgugucagucgugaucugggcuaaggagcugcuuaccagcauuuacuucuugaugcacgaagaggugaucgaagacgagaaucagcaccgagucugcuuugagcauuaucccauucaggcauggcagcgugccaucaacuacuauagauuccugguugguuuucuauucccuauaugucuccugcuugcuaguuaccaagggauucugagggccgugcggcgcucccacggaacacagaaaucuagaaaggaucagauccagagguugguacucagcaccguggucauuuuucuggcgugcuucuuaccauaucaugugcugcuccuuguucgguccgugugggaagcaucaugugacuucgccaaaggcgucuuuaaugcuuaccacuucagucuguugcuaacuagcuuuaacugcguggccgaucccguacuguauugcuucguuucugagacaacccaccgcgaccucgcacgacugagaggcgcuugucuugccuuucugacgugcuccaggacugggcgggcgcgugaagccuacccuuugggagcaccagaggcuucagguaagagcggcgcccaaggggaggaacccgagcuccugaccaaguuacauccugcuuuccagacaccaaauaguccgggaucuggcgguuuucccacugggcgccuggccuga

SEQ ID NO: 56905 - RNA, 1134 nt, Artificial Sequence
  derived and/or modified sequence opt3 from GPR6__Homo_sapiens__NP_001273028
augacccugcucgccuggugcacaagaggcgcuaaccccgcagccaugaaugcgagcgcugccucccuuaacgacucucagguggucguuguggcagccgagggggcugcagccgcugccacugcggcaggagguccugauacgggcgaaugggggccaccggccgcugccgcacugggagcuggcgguggggccaauggaucauuggaguuaaguagccaacuguccgcgggcccuccuggccuacuccugccagccguaaaccccugggacgugcuucugugugucucugggaccgugaucgcaggagaaaaugcuuugguuguggcccucauugcuucgacacccgcccugaggacuccaauguucguccugguggguucacucgcaaccgccgauuuacuggcuggcugcgggcuuauauugcacuuuguauuccaguaccugguucccagcgagacagugagucuacucaccgucggauuucugguggcguccuucgcagccucugugagcucccuucuggcuaucacugucgaccgguauuugucacucuacaacgcccugacauauuacagucgccgaaccuuacugggcguucaucuccuucuggcagccacguggacugugagcuugggucuagggcugcucccuguacugggauggaauugucuugcugaacgugccgcaugcucuguggucagaccacuggcgaggucccacguggcuuugcucucagccgcauuuuucaugguuuuuggcauuaugcugcauuuauaugugcggaucugucaggucguguggcgccacgcccaucagauugcucugcaacagcacugccuagccccgccccaccucgcagcuaccagaaagggcguagggacacuggccguugugcuuggaacuuucggugcgagcugguugccuuuugccaucuacugugucgugggcagucaugaggauccagcugucuauaccuacgcaacacugcuccccgccaccuacaacucuaugauaaauccuaucauuuaugcuuucaggaaccaggagauccagcgggcccuguggcuucuguugugcggguguuuucaauccaaagugccauuccgcagccgaucgcccucugaaguuuga

SEQ ID NO: 56906 - RNA, 1623 nt, Artificial Sequence
  derived and/or modified sequence opt3 from GPR75__Homo_sapiens__NP_006785
augaacagcaccggccaucugcaggacgcccccaaugcuacaucccuccacgugccucacucucaagaggggaacucaacuucccuucaggaaggacugcaggauuugauccauacggcaaccuuagucacaugcacuuuccugcuagccguuauuuucugucucgguagcuacggcaauuucauaguguuucuguccuucuuugacccagcguucagaaaguuuaggaccaacuucgauuuuaugauccuuaaucugucuuucugcgacuuguuuauuugugggguaacagcuccgauguucaccuuugugcucuuuuucucgucagccagcaguauccccgaugcauuuugcuucacuuuucaccugacauccucuggauucauuaucaugagccugaaaaccgucgccgugauagcucuccaucgguuacgcaugguucugggcaagcagccuaaccgaacggcauccuuuccauguacugugcuuuugacccugcuacucugggccacaucauucacucuggcuacccuugccacacugaaaaccaguaagagccacuugugccuccccaugucuucccugaucgcggguaaagggaaggcaauuuuaucacuguaugucguggacuuuacguucuguguagccguugugagcgucaguuacaucaugauugcucaaacucuccguaagaaugcccaggugagaaaaugcccuccagugaucacagucgaugcaucuaggccccagccuuuuaugggaguuccagugcagggcggcggggacccgauacaaugugcuaugcccgcccuuuaucggaaccagaauuacaacaagcugcagcacguacagacccgcggauauacuaaauccccuaaucaauuggugacaccagcggccagcagacuacagcuggucucggcaauuaaccucucuaccgcuaaggauuccaaagccgugguuacgugcgugaucauuguccugucagugcuuguauguugccugcccuuggguaucagucucguucaggugguccugagcuccaauggcucuuucaucuuauaccaauuugagcuguucggguuuacccuaauuuucuucaagagcggacucaacccuuuuauauauucaaggaauagugcuggccugcggcgcaaggugcuuuggugcuugcaguacaucggucugggguucuuuuguugcaaacagaagacacgacucagagccaugggaaaaggcaaccuggaagucaacaggaauaaguccagccaucacgagacuaacucugcauacaugcuuucaccaaaaccccagaagaaauucguggaccaagccuguggcccgagucauagcaaggaauccaugguuucuccuaagauuucggcugggcaccagcacugcggacagagcuccucaacccccaucaauacacggauagagccauauuacaguauuuauaacucuagcccuucccaggaggaaucaagccccuguaaucugcaaccagugaacucuuuugguuucgcgaauaguuacaucgcaaugcauuaucacacuaccaacgauuugguacaggaguacgacaguacaagcgccaaacagauccccgucccuucuguguga

SEQ ID NO: 56907 - RNA, 1092 nt, Artificial Sequence
  derived and/or modified sequence opt3 from GPR78__Homo_sapiens__NP_543009
augggccccggggaggcccugcucgcuggacuucuggugauggucuuggcaguugccuuacugagcaacgcgcuagugcuccugugcugugcuuacuccgccgaacuuagaaccagggcaucugguguacuguuggugaaucucucacugggccacuugcucuuagccgcucuggacaugccuuucacacuuuugggggucaugcggggacgcacuccaagugcaccgggcgccugccaggugaucgguuuucuggauacguuccuagcuagcaacgccgcgcucuccguugcagcccugucugcugaccaauggcuugccgugggguuuccccugcgauaugcaggacguuugagaccuagguacgcuggccuccuguuaggcugugccugggggcagucgcuggcguucucaggagccgcacucgguugcagcuggcuuggcuauaguuccgcuuuugccucuuguagccugcgguugccacccgagccugaacgcccaagauucgcugccuuuaccgcaacacuacaugccgucggguucgugcugccccucgcuguacugugccuuacuucccugcagguucacaggguggcgcggcgccauugucagcgaauggauaccgucacaaugaaggcauuggcccuccuggcugacuuacacccuucagugagacaaaggugccugauucagcagaaacggcgucgccauagagccaccaggaagauaggaaucgcaauugccacuuuucuaaucuguuucgcuccauacgugaugacacggcucgccgagcuggucccguuuguuaccgugaaugcacaguggggcauucuuaguaaaugcuugacguauagcaaggcgguagcugaucccuucacuuacucucugcuccgacgcccuuuuagacaagugcuggccgguaugguccacaggcuucugaaacggaccccacgccccgcauccacacacgacucaagccuggauguggccgggaugguucaucagcuccugaagagaacuccuaggccagcuaguacccacaacggaucuguggacacagaaaaugauuccuguuuacagcagacccauuga

SEQ ID NO: 56908 - RNA, 1272 nt, Artificial Sequence
  derived and/or modified sequence opt3 from GPR83__Homo_sapiens__NP_057624
auggugccccaucugcuccuucugugcuuguuaccucuggucagagccaccgagccacacgaaggcagggcugacgagcagagcgcagaagccgcgcuagcuguuccgaacgccucccacuucuuuucuuggaauaacuacacauucucagauuggcaaaauuuuguggggcggcgccgauauggagcagagagucagaaccccacuguaaaggcccuccugaucguggcuuacagcuucauuauagucuuuucccuuuucgguaaugugcugguuugucaugugaucuuuaaaaaccagcguaugcacucugcaacgucguuguucauugucaaucucgccguggcugacaucaugauuacccugcugaacacaccuuuuacucucguaagauucguuaauucaaccuggaucuuuggcaaggggaugugccaugugagcagguucgcccaguauuguaguuuacacgucuccgcgcugacacuuaccgcaauagccguggaucggcaccaagugaucaugcauccauugaaaccccgcauuucuaucacuaagggagucauuuacaucgcuguuauauggacaauggccaccuuuuucagccugccucacgcaauuugccagaaacuauucacguuuaaguauuccgaagacaucgugagaucacucugucugccagauuuccccgagccugcugaccucuuuuggaaguaccuggauuuggccacuuucauucuccuguauaucuuaccacugcucaucauuaguguagcguacgccaggguggcaaagaaacuuuggcugugcaacaugauaggcgacgucaccacagagcaguacuuugcuuugcggcgcaaaaagaaaaagacuaucaagaugcuaaugcuggugguugugcuuuucgcccuguguugguuuccgcuuaauugcuauguccuguugcucagcucuaaagugauucgaaccaacaaugcucuguacuucgccuuucauugguucgcaauguccucaacauguuauaaccccuuuaucuacugcugguuaaaugaaaacuucagaauagagcugaaggcccuacucagcaugugucagaggccuccaaaaccccaagaagaucggccuccaagucccguaccgucuuuucguguugcuuggaccgagaagaacgacggucagcgcgcgccucuggcaaauaaccuuuugcccacgucccagcugcagagcgggaaaacugaucucucgucuguggagccaauugucacaauguccuga

SEQ ID NO: 56909 - RNA, 1077 nt, Artificial Sequence
  derived and/or modified sequence opt3 from GPR87__Homo_sapiens__NP_076404
augggcuucaaccugacccucgccaaacuucccaauaacgagcugcacgggcaggaaagccauaauuccggaaacagaucugacgguccuggcaagaauacaacuuugcacaacgaguuugauacgaucguguuaccaguccuguaccuaauuauauucguugcuucaauccuccugaaugggcuugcaguguggaucuuuuuccauauuaggaacaagaccaguuuuauuuucuaucugaaaaauaucguaguggccgacuugauaaugacacucacuuuuccguuccggaucguccacgaugcgggauuuggccccugguacuucaaguuuauucugugccgcuauaccagcgugcuguucuacgcuaacauguauacauccaucguuuuucucgguuuaauuucuaucgaccgauaccugaaaguggucaagccuuucggggauucgcguauguauucaauaaccuucacuaaggugcuuagcguauguguuugggugauuauggccgucuugagucugccaaauaucauucuaacaaacggacaacccaccgaagacaauauccaugauugcuccaaacucaagucuccucugggcgugaaauggcacacggcagugacuuacgucaacagcugucuuuuuguugccgugcugguaaucuugauuggcugcuacauagcuaucuccagauauauucacaagucaaguaggcaguucaucagccagucuucccggaaacgcaagcauaaucagucaauaagaguggucguggcaguguuuuucaccuguuuucucccauaccaccugugcaggauucccuucacauuuagccauuuagaccggcugcucgaugagagugcccaaaagauccuuuauuacuguaaagaaaucacucuguucuugucugcuugcaacguuugucuagacccuauuaucuacuuuuucaugugccgcuccuuuagccgaagacuguucaagaaaucgaacauuaggacccggucugaguccauacguucacuccagaguguccgcagaagcgaggugaggaucuauuaugauuacacagacguauga

SEQ ID NO: 56910 - RNA, 4188 nt, Artificial Sequence
  derived and/or modified sequence opt3 from GPRASP1__Homo_sapiens__NP_001092881
augaccggcgccgagaucgaaagcggggcucaggugaagcccgagaaaaagccuggagaagaggucguugguggcgcagaaauugagaacgacgugccacugguagugagaccgaaagucaggacacaagcccagauaaugcccggggcgcggccuaagaauaaauccaaggugaugccaggagcuucuacuaagguugagacgucagccgugggcggugcacgccccaaaaguaaggccaaagcuaucccugucagccgauucaaggaagaggcacagaugugggcccagccacguuuuggggcugaaagacucuccaaaaccgagaggaacucucaaacaaauauuaucgccucgccccuugugucaacugauagcguacugguugcgaagaccaaguacuugagugaggaccgggaauuagugaacacagauaccgaguccuucccucgcagaaaagcacacuaucaggccggauuucagccaucuuucaggagcaaggaagagacuaauaugggcuccuggugcuguccgcggcccacaucaaaacaggaagcuaguccuaacagcgacuuuaagugggucgauaaaucuguguccucacuguucuggagcggcgacgaggugaccgccaaguuucauccagggaaucgcgucaaagauaguaaccgaucuaugcacauggcaaaucaagaggcuaacacgauguccagaagccagacuaaucaggaacuauacauugccucgucuuccggaucagaggacgaaaguguuaagacccccugguucugggcgagggauaagacaaacacuuggagcgguccucgggaggacccaaauucccguucucgcuuuagaagcaaaaaggaaguguauguagagucaaguuccggcagcgagcaugaagaucaccucgagucuugguucggggccggaaaagaagcaaaguuuaggucaaaaaugcgggcuggcaaggaggccaacaaucgagcucgccauagagccaagagggaagcaugcaucgacuucaugcccgguaguauagaugugaucaaaaaggagagcuguuuuuggccggaggaaaacgccaacaccuucucccggccuaugauuaaaaaggaggcucgcgcgagagcaaugacaaaagaagaggccaagaccaaggcuagggcccgugcaaaacaggaggcccggucugaagaggaagcucugaucgggacgugguucugggccacugacgagucgagcauggcagacgaagcguccauugagucaagucuucaagucgaggaugaaucuaucauaggaagcugguuuuggacagaggaagaggcuuccaugggcaccggcgccucaagcaagucucgacccagaacugacggggaaaggauuggagauucccuguucggugcacgcgagaaaacaaguaugaagaccggcgccgaggcuacgagcgaaucuaucuuggccgcagacgaugaacaggugauuaucggguccugguuuugggcuggagaagagguuaaucaggaagccgaggaggaaaccaucuucggcucaugguuuugggugauugacgcggccagugucgagagcgguguggggguaucgugcgaaucccggacaagaucugaggaggaagagguuauaggcccaugguucuggagcggagaacaaguggauaucgaggcuggcauuggggaagaggcaaggccuggagccgaggaagagacuaucuuugguucaugguucugggcugaaaaccagaccuacauggacugucgcgccgagacaaguugcgauacuaugcagggcgcagaagaggaggaacccauaauuggguccugguuuuggacccgagucgaggcguguguggaaggagacgucaauucuaaaagcucccucgaggauaaggaagaggccaugaucccaugcuucggcgcuaaggaggaagugucaaugaaacacgguacagggguucggugucguuuuauggccggcgcagaggaaaccaacaauaagagcugcuucugggcugagaaagagcccuguauguauccugccggaggcgggaguuggaagucuagaccagaagaggaagaggacaucgugaacuccugguuuuggagcaggaaauacacuaagccggaagcaauuaucggaucguggcugugggccacggaggagucaaauauugacgguacaggcgaaaaagcuaagcugcucaccgaggaagagacuauaaucaacucuugguucuggaaggaagaugaggcgauuagugaggccaccgaccgcgaagagucccggcccgaagcagaggaaggggauaucaucggaagcugguucugggcuggcgaggaggacagauuagaaccugccgccgagacaagggaagaggaucgacuggcugcagagaaagaagguauuguagggucuugguuuggcgcccgcgaggaaaccauacggagagaggcgggaagcugcuccaagucaaguccaaaagcugaagaggaggaagucaucauuggcagcugguucugggaggaagaggccucucccgaagcaguggccgggguuggauuugaguccaagccuggcacugaggaagaggaaaucacaguggguucaugguucuggccagaggaagaggcuaguauucaggcagggagccaagccgucgaggaaauggaguccgaaacggaggaggaaaccaucuuuggaucuugguucugggacggcaaagaggugucggaagaggcgggucccugcuguguaagcaagccggaagaugacgaggagaugauaguggaaucaugguuuugguccagggauaaggcuaucaaagagacuggcacaguugcaaccugcgaaaguaagccugagaaugaagagggggccauugucggaucuugguucgaggccgaagacgagguggauaaccguacagacaauggcagcaacugugggucccgcacucuugcugaugaagacgaggccaucgugggaucaugguuuugggcaggcgacgaagcucacuucgagucuaauccaagccccgucuuucgggccauuugcagaaguaccuguuccguugagcaggaaccugaucccagcaggcgaccacagucuugggaggaagugacggugcaguucaaaccuggucccugggggcggguaggauuuccaucaaucuccccguuccgcuucccuaaggaggcggccaguuuguuuugcgagauguucggcgguaaacccagaaacaugguccugagcccagaaggcgaggaccaagaaucgcuacuccagcccgaucagccuucuccagaguuucccuuccaguaugacccuuccuacaggagcgugcaagaaauacgggagcaucugcgagcaaaggagucaaccgaaccggagaguucuuccuguaauugcauucagugugaacuuaagaucgggagcgaggaauuugaggagcuguugcuccugauggagaaaauuagagauccauucauccacgagauaucaaagaucgcuaugggaaugcgcagugccagccaguuuacaagggacuucauucgugauuccggcguugugucuuuaaucgaaacucugcucaacuaccccagcucccgggucagaaccucauuucuugagaacaugauuaggauggcuccuccauaucccaaucugaacaucauacagacauacauuugcaaagugugugaagagacuuuggcauauucuguugacaguccugagcaacuaucggggauccgcaugauccgacaucugaccacgacaaccgauuaccacacucucguggccaauuauaugagcggauuccugucccuucuggccacaggcaacgcuaagaccagauuucacguauugaaaaugcuccugaauuuaucugaaaaccuguucaugacuaaggagcuacucucagcggaagcagucagcgaguucauuggucuguuuaaucgggaggaaaccaacgacaauauccagauugugcuugccauauucgagaacaucgggaauaacauuaagaaagaaacaguguuuuccgaugacgauuucaauaucgagccguugauuagugcuuuucauaaggucgaaaaauucgccaaggagcugcagggaaaaacggacaaccaaaaugaccccgagggcgaucaggaaaacuga

SEQ ID NO: 56911 - RNA, 1074 nt, Artificial Sequence
  derived and/or modified sequence opt3 from GPRC5A__Homo_sapiens__NP_003970
auggccaccacagugcccgacggcugcagaaacgggcucaagagcaaauacuauaggcugugugauaaggcugaggcauggggaaucguccuugaaacuguugccacggcgggugugguaaccuccguggcuuucaugcugacauugccuauuuuagucugcaaagugcaggacucuaaucggcgcaagaugcugccaacucaauuucuauuccuccugggcguucuugggauauuuggacugaccuucgccuuuaucauuggcuuggaugguucaacagggccgacccgauucuuucucuucggaauccuguuuaguauuuguuucagcugccugcucgcacacgccguguccuuaacuaaacugguccguggcagaaagccccuuucuuugcuggugauccuaggccucgcuguaggguuuucgcugguucaggacgugauagcaaucgaguacauuguccuuacaaugaacaggaccaaugugaacguguucucagaacugagcgccccucggcgcaaugaggauuuugucuugcuccugacguauguuuuauuccugauggcucucacuuuccuuaugaguuccuuuaccuucuguggaucuuuuacagguuggaagagacauggcgcccacaucuaccugacuauguugcuaagcauugcgaucuggguggcauggauaacccugcucaugcugccagacuucgauaggcggugggacgauacaauucuuuccucagcccuggcugccaacggguggguauuuuugcucgcauaugugagucccgaguucuggcuguuaaccaaacagcgcaauccuauggacuacccagucgaagaugcuuuuugcaagccccagcuggugaaaaagagcuauggaguugagaaccgagccuacucucaagaagagaucacgcagggcuucgaagagacuggugacacacuauacgcgccuuauuccacccauuuucagcuccagaaucaaccaccgcagaaagaguucucaauucccagagcccacgcauggccuagcccauacaaggauuaugaagugaagaaagaggggaguuga

SEQ ID NO: 56912 - RNA, 1605 nt, Artificial Sequence
  derived and/or modified sequence opt3 from GPRC5B__Homo_sapiens__NP_001291700
augugcgccgugggcgucguugcuauccugagaagggacccccgggagggguguaccgauuggacaugcguguuccgcggagcaaaggaagccgguguaggcccuagcgugcgaaaacguacuacgaccuccgggucuugggcggucagaagggagaagucagugagucggcgcaaccucccaggaggcggucuugcuguuugugugagacugggggucuacaggggagugggcgacuuugaacggcaccgcgccggcagcauuuuguccgcaucuuggacauggugcugguguguaucggggaaauuacugcuaaugaauccgcccuggucaguugccuggggacaggaggguuuccgagcuggcacuccugggagcagauaucucccaaggauguuuguggcaagugaacggaagaugcgugcccaucaaguccugaccuuccuucuguuguuugugauaacauccguggcuucugagaacgccagcaccucccgcggaugcggccucgaucugcugccccaguacgucucacucugugacuuagaugcgaucugggguauuguuguggaggcaguagccggggcuggagcccugaucacucuuuugcugaugcuaauucuccuggugagacuuccuuucaucaaagaaaaggagaagaaaaguccagucggccugcacuuuuuguuccuccugggcacauuagggcuguuuggacucaccuucgcauuuauaauccaggaagacgagacgauuugcagcgugaggcgguuccuuugggguguucuguuugcuuuguguuucucuugccuacugucccaggccuggcgagugcgcagacucgucaggcauggcacugggcccgcgggauggcaacuggugggccuugcccuguguuugaugcucguacagguuaucauugcaguggaguggcuggucuuaaccgugcugcgggauacacgcccugcuugcgccuaugaaccaauggacuucgucauggcucuaaucuacgauauggugcuccugguugugacucuugguuuggcccuguuuacccucugcgggaaguucaaaagauggaagcugaauggcgcauuucuucugauaacagccuucuugucaguacucauuugggucgcuuggaugaccauguaucuguuuggaaacgugaaauuacagcagggcgacgcguggaaugauccgacgcuggcaaucacucuagccgcuagcggguggguuuucgugauuuuucacgccauccccgagauccauuguacacuccugccugcacuucaagaaaacaccccaaauuacuucgacacaagucagcccaggaugcgugagacugccuuugaagaggauguccaguugccucgggcuuauauggagaacaaggccuucucuauggacgaacacaaugcagcgcugcgaaccgcuggauuuccaaacgguucccucggcaagagacccagcgggucgcugggaaaaaggccgucugccccuuuccgcuccaauguguaccagcccacggagauggcaguaguguuaaacggcgguaccauuccaacagccccucccucacacacugggcggcaucugugguga

SEQ ID NO: 56913 - RNA, 1362 nt, Artificial Sequence
  derived and/or modified sequence opt3 from GPRC5C__Homo_sapiens__NP_061123
augggcacccagcccgagccugggcugggagccagaauggcuauccacaaggcacucgugaugugccuuggucugccauuguucuuauuuccgggcgccugggcgcaagggcauguucccccuggauguagccagggccugaacccacuauacuauaaucucugcgacagguccggugcuugggggauuguccuggaagccguggcaggagccggcauaguaacaacuuucgugcuuacgaucauucuggucgcuucuuugcccuuugugcaggauaccaaaaagcggucacuccugggcacacagguuuucuuucugcucgggacuuuaggacuguucugucuuguguuugcaugcgucgugaaaccugacuucaguaccugugccagccgccgauuuuuguucgguguacuguuugcuaucugcuucuccugucuagccgcgcacguuuuugcacucaacuuccuggcccguaagaaucauggcccaagagggugggugauuuucacagucgcgcuucuguugacccucguggaggugaucauaaacacugaauggcugaucauuacauuagucaggggaucuggcgagggugggccccaaggaaauucgucagccggcugggcaguugcuagcccuugcgccaucgcgaacauggauuuugugauggcccugauuuacguaaugcuccuucuguugggcgcauuccuaggggcuuggccagcccuguguggacgguauaaacgcuggagaaagcacgguguguuuguccuccugaccacggcuaccaguguggccaucuggguuguguggauagucauguacacuuauggcaauaagcagcauaacuccccgacaugggacgaucccacucuugcaauugcccuggcugcgaaugcaugggccuucguguuguuuuacguaaucccugaaguuucucaggugaccaaaagcuccccagagcagucauaucaaggggacauguaccccacaaggggagucggcuacgagaccauucucaaggaacagaaaggucagaguauguucguggagaacaaggcuuuuagcauggaugaaccugucgccgcaaaacggccagugucucccuauuccggguacaauggccagcuguuaacgucaguuuaucaaccgacugagauggcccugaugcacaaggugccuagcgagggagcuuacgacaucauccuaccccgcgccacagcaaacagucagguaaugggcucugcuaauuccacccuccgagcugaagauauguauagcgcccagucgcaccaagcagccacuccaccuaaggacgggaaaaacucucaggucuucagaaaucccuacgugugggauuga

SEQ ID NO: 56914 - RNA, 1038 nt, Artificial Sequence
  derived and/or modified sequence opt3 from GPRC5D__Homo_sapiens__NP_061124
auguacaaggacugcaucgagagcaccggcgauuauuuccugcucugugacgccgaagggcccuggggaauuauacuugagucccuggcuaucuuggguauuguggucacaaucuuacugcuacucgcauuucuguuccuuaugagaaaaauucaggauugcucucaauggaacguucugccuacucaguugcucuuucugcugucagugcucggcuuauucgggcuggccuuugcguucaucauagaacuuaaucagcagacggcuccaguaagguacuuuuuguucggagugcuguuugcccuauguuucaguugccuccuggcacacgccagcaaccuugucaagcuggugcggggcuguguuuccuuuucuuggaccacaaucuugugcauugcuaucgguuguucgcuccugcaaauuaucauagcaacugaguaugugaccuuaauuaugacacgcgggaugauguucgucaauaugaccccgugccagcugaacguggacuuuguaguucuccuuguguacguccuguucuugauggcccuaacuuucuuugugucaaaagcuacauucuguggacccugcgaaaauuggaagcagcauggccgacugaucuuuauuaccguccucuucagcaucaucauuugggugguuuggauaaguaugcugcuucguggcaacccucaguuucaaagacagccacagugggaugaccccgugguauguaucgcccuggugacgaaugcgugggucuucuugcuccuguauauugugccugaguuaugcauccuguacagguccugccggcaggaguguccacuacaagggaacgcaugccccguuacugccuaucagcacucuuuucagguggaaaaucaagagcucagccgcgcuagagauuccgacggagccgaagaggaugucgcacugaccucauacgguacaccuauacagccacagacuguggacccgacccaggaguguuucauuccccaagcuaaacuuaguccucagcaggaugccggcgggguauga

SEQ ID NO: 56915 - RNA, 2256 nt, Artificial Sequence
  derived and/or modified sequence opt3 from GPRC6A__Homo_sapiens__NP_001273283
auggccuuccugaucauucucauaaccugcuuugugaucauucuugcuacaagccagcccugucaaacuccugacgauuucgucgcagccacguccccaggccacaucauuaucgggggacuguuugcgauacaugagaagauguugucuucagaagacaguccgagaaggccccagauccaggagugcguugguuucgaaauuagcguguuuuuacagacccuggcuaugauccacuccauugagaugaucaacaauucuacacuacucccuggcguaaaacugggguacgaaauauaugauacuuguaccgaggugacagucgccauggcagccacccuucgguuccugucgaaguuuaacugcucacgcgagacuguggaguucaaaugugacuacagcaguuauaugccacgaguuaaggcugugauuggauccggcuacucugaaaucacaauggcagucagccguauguugaaucuccaacugaugccccagguggguuaugaauccaccgccgagauucugucagauaaaaucagauuuccuaguuuccucaggacgguaccaagcgacuuucaucagaucaaggcuauggcccacuuaauucagaagucuggguggaacuggauaggaaucauuacuaccgaugacgauuacggccggcuggcgcuuaauacauucaucauacaagcagaggccaacaauguuugcauugcuuuuaaagaaguguugcccgccuuccuguccgacaacacuaucgagguccgcaucaauagaacccuaaagaaaauuauccucgaagcacagcugcuuggcgugcugaagaacgugacauucaccgauggguggaauagcuuucauuucgacgcucacggagauuugaacacggguuaugacgucguucucuggaaagagauuaauggccacaugacugugacaaagauggccgaauacgaccugcagaacgauguauuuauaaucccugaccaggagaccaagaaugaguucaggaacuuaaaacaaauucagagcaaguguaguaaagaaugcucuccagggcagaugaagaaaacuacacggucccaacauaucuguugcuacgagugucagaacugcccggaaaaucacuauaccaaccagacggauaugccccauugccugcucuguaauaacaagacccacugggcgccugugcgcagcacaaugugcuuugagaaagaagucgaguaccuuaauuggaacgacucgcuggccaucuugcuacugauucucucucugcuuggaauaaucuucgugcugguugugggcauuaucuuuacucgaaauuugaacaccccagucgugaaguccucaggugggcucagaguauguuauguuauucuguuaugccacuuccugaauuuugcaaguacuagcuucuuuaucggagagccccaggauuucacauguaagaccaggcaaacaauguuuggcguguccuucacccuaugcauaucuuguauccucacuaaaagccugaagauucuuuuggcuuucucauuugacccuaaacugcagaaguuccucaaaugccuguaccggccaauccuuauuaucuuuacguguacaggcauacaggucgugauuugcacccugugguugaucuucgccgcucccacugucgaagugaacguuagucucccgcgugugauuauccuggagugugaagagggguccauauuagccuuuggaaccaugcuggguuauaucgcaauucuagccuucaucugcuuuauuuucgcuuuuaagggcaaguacgaaaauuauaacgaggcgaaauucaucacauuugggaugcucauauacuucauugcauggaucaccuuuaucccuauuuacgccacuacauucggaaaguauguacccgcugucgagaucauugugauacugaucagcaauuacggcauucuuuauugcacguucaucccaaaauguuacguuauuaucugcaagcaggaaauaaacaccaaaucugccuuuuugaagaugaucuauucauacaguagccauuccgugucuucgauugcacugagcccugccucccucgauucaaugagugguaaugucacuaugacaaaccccucuagcuccgggaagucagcuaccuggcaaaaaucaaaggaccugcaggcccaggcauucgcgcacaucugucgcgagaacgcuacaucuguguccaaaacuuuaccaagaaagaggaugaguagcauuuga

SEQ ID NO: 56916 - RNA, 3027 nt, Artificial Sequence
  derived and/or modified sequence opt3 from GPRIN1__Homo_sapiens__XP_005265863
auggacaccgccgaggaucccgcuuggcugcagcuccuucaaaaggacagcuccccuccaggcccgagacccacagcauucuuuugcccucaggaugggucucugggagccgguucaagugcgaugagggacuacuguccaagccagcagaaagcuagucccgccccuccacggcacacucccgaucaaucuccuggcauggaaucgcgccaucgaucaccaagcggggcaggagagggcgccaguugcuccgacgguccgcgugggucuuuggcuugucccagcccuacgugcuucuccccacaggaaucacccaguaaggagaccuuagaagcacacggagccagcaucucuggcacaccugaggcuacuaccuccggcaaaccagagcccgugucaagcgucaagacagaaccgaaaaguucugaugacagaaacccuauguuucuggagaagauggauuucaaguccagcaaacaggccgacucgaccucuauugggaaggaagaucccggauccucaaggaaagcggacccaauguuuacugguaaggcagagccugagauacuaggcaaaggggaucccguugccccaggacggauggaccccaugacagugcgcaaggaagaccucggcagucuggguaagguagauccucuuuguagcuccaaaaccuauacggugucuccaagaaaggaggacccggggagccugaggaaagucgaucccgugucaagugacaagguugauccuguguucccacggaaagaggaaccccgcuacuccggaaaggaacauccugucagcucugagaaaguggcuccaacuucagccgagaagguagacuugguucucaguggcaagcgagaucccggcccgagcgggaaagcagacccuaugccacuggaauccauggauucugcuucgaccggaaagacagagcccggucugcucggcaaauuaaucccugggagcuccggaaagaauggccccgugucaagugguacuggggccccaggcucucugggaagacuugacccuaccugcuugggcauggcggaucccgccagcgucgggaacguggaaacagugccagcaaccaaagaggacuccagguuucugggaaagauggacccggcuucaagcggugaaggccggccugucucugggcacacggauacuacagccuccgcuaagaccgaccuaacuucccucaaaaauguugaucccaugagcucuggaaagguggacccaguaucccugggcaaaauggaucccauguguucagguaagccugagcuucugaguccagggcaggccgagcgugugagcgucggcaaagcaggaacagugucgcccggcaaggaagacccuguuuccucucgcagagaggauccgauuagcgccgggucaaggaagaccaguuccgaaaaagugaacccagagucuagcggaaagacgaaucccgucuccucagguccuggcgacccacggagcuuggggaccgcuggacccccuagugcggugaaagcagaaccggccacaggcgguaagggggauccccucucuuccgagaaagcuggccugguagccagcggaaaggcagccccaacugcuucgggcaaggccgagccuuuagcaguugggaaagaagaccccgugucaaagggaaaagcggaugcuggcccaucuggucaaggggacagugucuccaucggaaagguggucagcaccccuggcaaaacagugcccguuccaucugguaagguggauccgguaagccugggcaaagccgaggcaauuccugaagggaaggucggaucccucccccuugagaagggcucaccagugacuaccacaaaagccgacccccgagcuagugggaaggcccagccucagagcggaggcaaagcagagaccaagcugccaggucaggaaggggcugccgcgcccggagaggccggcgcuguuugcuugaaaaaggaaacuccucaagcaucugagaagguggacccggguuccugucgcaaagccgaaccacuagcuucaggcaagggggagcccgucagucugggaaaagccgauagcgcaccuuccagaaagacggagucucccucgcucggcaaagugguaccacugagccuugaaaagacaaagccuucauccaguucuaggcagcuggaccggaaagcguuggggagcgcccgcucccccgagggagcuagaggcucagaagguaggguggagccaaaggccgaaccuguuucuagcaccgaggcaaguucccucgggcagaaagaucuggaggcugccggagcagaacguagcccgugccccgaggccgcugcgccaccucccggcccacggacucgagacaacuucaccaaggccccuucuugggaagcaucagcucccccgccaccuagagaggaugccgguacacaagccggcgcucaggcaugugucuccguggccgugagucccaugagcccacaggacggggcgggaggcucggcuuuuucuuuccaggccgcacccagggccccuuccccgcccagccgccgggaugcuggguuacaagucucacugggagcagccgaaaccagaaguguugcgacuggcccaaugacaccucaggcugccgcacccccugccuuuccagaggugagggugcgccccgguucugcucuagccgcagcuguagccccuccagagcccgcggaaccgguccgagacguguccugggaugagaaagggaugacgugggaaguuuauggagccgcaauggagguggagguccucggcauggcuauccagaagcaucuggaacggcagauagaggaacacggccgucaaggggccccugcuccacccccugcagccagagccggaccagguaggagcggcucagugcgcaccgcucccccggacggggcggcaaagcggccucccggacuuuucagagccuugcugcagaguguuaggcgaccacgcugcugcagccgggcuggcccuacugccgaguga

SEQ ID NO: 56917 - RNA, 1449 nt, Artificial Sequence
  derived and/or modified sequence opt3 from GPRIN2__Homo_sapiens__XP_011538700
augcugaacgagagccucauggaaaaggccgacgcuuggggccuuucccugcccuuggaguuagaagcagccaugucuucaaguagaccugagccagggccgugggcgccccugagcccuaggcuacagccacucucccaaucuucgucaagccugcuuggagaaggucgggagcagcgccccgagcugcgaaaaaccgcuaguuccacaguguggcaggcccaguugggcgaagcaucuacucguccucaagccccagaggaagaggggaaucccccugagagcaugaagccagcuagagcauccggaccgaaagccaggcccucagcuggcggucacugguggaguagcacggucgggaacguuucuaccaugggaggcuccgaucucugccggcugcgcgccccuucagcggcagccaugcagagaagccauagugaccuggugaggucuacacagaugcggggccacuccggggcucgcaaggccagccucucguguucugcauuaggauccucaccaguacaucgagcucagcugcaacccgguggcaccagugggcagggaggccaggccccugcgggucuugaaagagauuuggccccagaggacgaaacuagcaauuccgcauggaugcugggggcuucucagcuaagcgugcccccgcucgaucugggagacacaaccgcccacucaaguuccgcucaagccgagccuaaagcagccgaacagcuugcuacuacaaccugccaugcgcugcccccagcagccuugcucuguggcaugagggagguccgggcuggcgggugcugucacgcccugccugcaacgggaaucuuagccuuccccaagcugguggcuagcguuucugagucaggucuccaggcccaacacggcgugaagauucauugccgucuuagugggggacugccaggccacagccauuguugcgcacacuuguggggucccgcggggcuagucccugaaccaggcucccgcacuaaagauguguggaccaugacaucugcuaacgaccuggccccggcagaggccucgccccucagcgcucaggaugccggaguacaggcagcuccuguugccgcguguaaggccguggcuacuuccccaucacuggaagcacccgccgcccuucacgucuuuccugaggugacccugggcaguucuuuggaagaggugccaagccccgucagagacguuaggugggaugcugaggggaugacaugggaaguguacggagcagcgguagaccucgaggugcugggugucgccauacagaaacauuuagaaaugcaauucgagcagcugcagcgggcuccggccuccgaagauucacuaagcguggagggccgacgcgggccucucagagcaguuaugcagucucugaggcggccauccugcuguggaugcaguggcgcugcccccgaguga

SEQ ID NO: 56918 - RNA, 2331 nt, Artificial Sequence
  derived and/or modified sequence opt3 from GPRIN3__Homo_sapiens__XP_005262993
augggcaccgugcccgacccucugagaagcgccaagacaucccucaucgcugcaucugggaaagaggaugaccuuggagaaccacaggccgcgucaccgaggcaccggcccgcucuguugugcaagaacgccaaugguuucaguggcgccccugccgagccagauuuaagcccccgcgcugcagccgaagcucugaugcaagucugugagcaugaaacuacgcagccugacauguccucuccagggguuuuuaacgaggugcagaaagcccccgcgaccuucaauucgccuggaaacccacagcuaccgggcucaagccaacccgcagccagugcuccuuccucugccgcaggucgagaucucauucacacaccacugacuaugcccgcuaaucagcauaccugccagagcauaccuggggaccagccaaacgccaucacauccucaaugcccgaggauagucuuaugcguagccaaagaaccucuaauagggaacagccggagaagccuuccugucccguaggaggcgugcugucaagcaguaaagaccaggucucuugcgaauuuccauccccugagacuauucagggcacagugcaaacccccguuacggcggcccggguggucagccacucgucuuccccaguagggggacccgagggugaacgccagggcgcaaucugugauucagagaugagaaguugcaagccuuugacuagggaaagcggguguuccgagaacaagcagccaucugugaccgcuagcggaccgcaaggcacaacuucaguuacuccccagccuacaccacucaccagugaacccuccgccugcccuccaggucccgagaaagugccgcugccugcucagcggcagaugagccgcuucaaggaggccucuacgaugacuaaucaagcagaaucagagauuaaagaagucccaagucgagccuggcaggacgcugaggugcaggcgguggcaagcgucgaauccagaucuguuucgacaagccccuccauccugaccgccuuucucaaggagucaagggcuccugagcauuucgaacaggagcaauuacgggugauaugucacaguucugggagccacacucuggaacuuuccgauucaacauuggcaccccaggagagcucucagugcccaggaaucaugccucagguacauauucaagcagccgcugccgaauccaccgcauuucagcgugagaacaaacuggcgagucuacccggcggcgugcucaagacgagcucuaucaaucuggucuccucaaacgcucagcacaccuguaaggaggacgggcgccuugccggaaugacaccagugagagaagagaguacugccaaaaagcuggcagguaccaauagcucguccuugaaagcuacagccauugaucagaucucuauaagcgcaugcucacaagcugaaaccaguuacggccucgggaaguucgagaccaggccguccgaguuugccgaaaagacaaccaacggacauaaaacugacccugacugcaaacugucugauagcuguggcuccauuucaaaggcggaccacagcgguaguuuagaucccacgaauaagggggacgcccgggagaaaaagccagcuucuccccagguugugaaagaaaaggaguccacaggcaccgauacuagcgacgcaaaaacccugcuccuuaacccuaagucgcaggaaucaggaggcacagagucugccgcuaacccaacccccaguccuauccgaaagaaucaagaguccacucuggaagagaaccgccagacaaaaacggccaccagcuugucucuaccgagcgauccaaugggggacuccucacccggaagugguaagaaaacuccuagcagaucugucaaggcauccccaaggcggcccucacgcgugagugaguuccugaaagaacagaagcucaauguaacagcggccgcugcccagguuggccugaccccuggggauaagaaaaagcaacuuggagcagacagcaaacugcaguugaagcaguccaaaagagugagggaugucgugugggacgaacagggcaugacaugggaggucuauggugcuucucucgacgccgagucgcuggggauugcaauccaaaaccacuuacagcgucagauccgggaacaugagaagcugauuaagacucagaauagccaaacccgaagaucaauauccagugauacgucuagcaacaaaaagcuaaggggccgccagcacuccguguuucagucaaugcuccaaaauuuccggagaccgaacugcuguguuaggcccgccccaucuagcgugcuggacuga

SEQ ID NO: 56919 - RNA, 984 nt, Artificial Sequence
  derived and/or modified sequence opt3 from GPS2__Homo_sapiens__NP_004480
augcccgcccugcucgagagaccuaaacuuagcaacgcuauggcaagggcccugcaccggcauaucaugauggaacgcgagcgaaaacgucaggaagaggaagagguggacaagaugauggagcaaaagaugaaggaggaacaggaaagaaggaaaaagaaggagauggaggaacggauguccuuggaggaaaccaaagagcagauuuuaaagcuggaagagaaacuacucgcgcugcaggaggaaaagcaccaacuuuuccugcaguugaaaaagguccuccaugaggaagagaagcgcagaaggaaagaacagucugaucugacaacucugacgucagcugccuaccagcaaagucucaccguucacacaggcacucauuuacugagcaugcagggguccccaggaggucacaaucggccgggcacccuuauggcagccgaccgcgcuaagcagauguuugggccccagguguugacaacccgacacuauguaggaucugcagccgcuuucgccggcacuccugagcauggucaauuucaggggucgccaggaggcgcguacggcacagcacagcccccuccacacuaugggcccacccaaccugccuacucaccaagccagcagcugagagcuccgagugccuuccccgcagugcaguaucuaucccaaccucagccacagcccuacgcuguccauggacacuuucagccuacgcaaacugguuuccuccagccaggcggggcccugucucuucagaaacagauggagcacgcgaaccaacagaccggauuuagcgauuccucaagucugaggcccaugcauccgcaggccuugcacccugcacccggccuccuggcuagcccacaguuaccugugcaaaugcagcccgccgguaagucuggguucgcugccacaucccagccaggaccccggcugccuuuuauacaacauucacagaauccacguuucuaucacaaauga

SEQ ID NO: 56920 - RNA, 2028 nt, Artificial Sequence
  derived and/or modified sequence opt3 from GPSM1__Homo_sapiens__NP_001139110
auggccggccccgcuccuccagcagccgacgagcugccggggcccgcggcuagaaggcucuacagccggauggaagccuccugccuugagcuggcauuggaaggagagcgcuuauguaaggccggugauuucaaaaccggcguggcauuuuucgaagcugccguccagguugggacagaggaccugaagacucuaucugcuaucuauucacaacucggaaacgccuacuuuuaucugaaagagcacggccgagcgcuugaauaccauaagcacgaucuguugcucgcacguacgauuggugacagaaugggggaggccaaagcuaguggaaaucugggcaacacccugaaggugcucggcagguucgaugaagccgcaguaugcugucagcggcauuuaagcauagcucaggagcagggggacaaggugggagaggcccgcgcgcuguauaauaucgguaacgucuaccacgccaaaggcaagcaacuuuccuggaaugcagcuaacgccacacaggauccugggcauuugccacccgacgugagagaaacucugugcaaggcuucugaguuuuaugaaaggaaucuaucgcucguuaaagagcugggagaucgggccgcacagggccgcgccuacgguaaccuugggaauacccacuaccuguugggaaacuucacagaagcuaccacuuuucacaaagagcgacucgcgauugcaaaggaguucggcgacaaggccgcugaaagaagggccuauucaaaucugggcaacgcacauguguuuuuagggcgguucgaugucgccgcugaguacuauaaaaagacacugcagcucagccgucaacuucgcgaccaggccguggaagcacaggcguguuacagucugggaaauaccuauacguugcuacaggauuacgagagagcugccgaauaucaccugaggcaucuccugaucgcacaagagcuugccgaccggguaggugagggccgagcuugcuggucccuggggaacgccuacguuucuaugggacgcccugcacaggcuuugacuuuugccaaaaagcaccuccagauuagccaagaaaucggcgacagacacggugagcugaccgcgaggaugaauguggcccaguuacagcugguccuagggcggcucacauccccagcugcaucagaaaaacccgaucuggccggcuacgaggcucagggagcccgcccuaagagaacucaaaggcuuagugcagaaaccugggacuugcugcgucucccacuggagcgggagcagaacggcgauagccaucacucuggggacuggcgaggaccguccagagauucacuuccccugccugugaggagccgcaaauaucaggaagguccagacgcggagcggagacccagggaaggcagucauucuccuuuggauuccgccgacgugcgcguccacguuccacgaacaagcauaccccgggcuccgucgucugaugaggaguguuucuuugaccuccugaccaaguuccaguccucacguauggaugaccaaagaugcccuuuagacgaugggcaggccggagcagcugaagccacggcagcccccacucuggaggacaggaucgcucagccaaguaugacagcgagcccucagaccgaagaguucuuugaucuaauugccuccucucaaagccgccggcucgacgaucagagagcaucagugggcagucugcccggucuuaggaucacucauuccaacgcugggcacuugcgaggccacggagaaccacaggagcccggcgacgauuucuuuaauaugcugauuaaguaccagagcucucgcaucgacgaucaacgguguccuccaccggacguacuccccagagggccuacaaugccagaugaggacuucuuuucacugauacagagggugcaggccaaacguauggaugaacaacgcgucgacuuagccggaggucccgagcagggcgcugggggaccuccagaaccccagcagcaaugccagccgggcgcaaguuga

SEQ ID NO: 56921 - RNA, 1377 nt, Artificial Sequence
  derived and/or modified sequence opt3 from GPSM2__Homo_sapiens__XP_011539605
auggaggaaaaccugaucagcaugagagaggaccacuccuuccaugugagguaccggauggaagccucuugccucgagcuugcucuggaaggcgagcgcuuguguaagucaggggauugccgagcaggagucaguuucuucgaggccgcgguucagguggguaccgaagacuuaaaaacacugagcgcuauuuauucccaacuaggcaaugccuacuuuuaucuccacgauuacgcaaaggcccuggaguaucaucaccaugaccuuacucuggcucguacgauaggggaucaguugggagaagcaaaagccucuggcaaccucgguaauacccugaagguacuggggaacuucgacgaggcuaucguguguugccagagacaccucgauauuucgagggaguuaaaugacaaagucggagaagcccgggcgcuguacaaccuuggcaauguguaucacgcaaagggcaagucauuugggugucccggaccucaggauguuggugaguucccagaagaggugcgcgacgccuugcaagcugccgucgauuuuuacgaagagaaccugagccuagugacagcacucggcgacagagcugcccaggggagggcguucggaaaucugggcaacacucauuaccuucuggguaauuuucgggaugccguaaucgcacacgagcagcgcuugcucauugcuaaagaauuuggggacaaggccgcugagagacgagccuauaguaaccugggaaaugcauacaucuuuuuaggcgaguucgaaaccgccuccgaauauuacaaaaagacacugcuccuugcuaggcagcugaaagaccgggcgguugaggcacaaucuugcuauagcuugggcaacaccuacacucuacugcaggauuaugagaaggccauagacuaccaucucaagcaccuggcuaucgcccaggaacuuaaugaucguauuggggagggacgcgcauguuggucccuggguaacgccuacacagcuuugggcaaccacgaccaggccaugcauuuugcagaaaaacaccucgagaucucaagagaagugggggauaagaguggagagcugaccgcgagguuaaaucugagcgaccuacaaaugguccucggccugucuuauuccacgaacaauucaauuaugagcgagaacacugaaaucgauaguucucuuaauggugugcggccgaaauuggggcgacgccauuccauggagaacauggaacugaugaagcucacccccgagaaagugcugaagaaucagcacuucaacguccuuauaaugagaauccauagcaugcaccugguucagguguugaaaauuguacaauacacaaagaaggacauuuucaaagagaucuga

SEQ ID NO: 56922 - RNA, 483 nt, Artificial Sequence
  derived and/or modified sequence opt3 from GPSM3__Homo_sapiens__NP_071390
auggaggccgaaagaccccaggaggaagaggacggcgaacaagggccuccacaggaugaggagggauggccgcccccuaacagcaccacaaggccauggcgguccgcucccccuucuccacccccuccagguacucgccacacggcacugggcccgcgaucagccagucuccuuagccugcagaccgaauuguuacuggaccuaguggcggaggcucagucccguagacucgaggaacaaagggccacauucuacacuccccagaauccuucuucgcuggcaccagcuccccuucggccucuggaggaucgcgaacaguuguauucaaccauccucagccaucagugccaaagaauggaggcccagaggagugaaccaccccugccgccugggggacaggagcugcucgaauuacugcuucggguccagggcggugggcgcauggaggagcaacgauccagacccccaacacacaccuguuga

SEQ ID NO: 56923 - RNA, 1272 nt, Artificial Sequence
  derived and/or modified sequence opt3 from GPT2__Homo_sapiens__NP_001135938
augggccagcaacccaucaccuuccugagacaggugauggcccucugcacauacccuaaccuucuggacagcccauccuuuccggaggaugcuaagaaaagggcacggcgcauuuugcaggccugugggggaaauucuuuagguucauauagugcgagccagggcgucaacugcauacgagaagacguugcugccuacaucacucguagagaugggggagugcccgcagacccugauaauauuuaucugacgaccggcgccuccgacgguaucucuacaauucuaaagauccucguaucagggggaggcaaaucgaggacuggcgugaugauaccaaucccccaauacccucuguauagcgcugucauuagugagcuugaugcaauccaggugaacuacuaucuggacgaagagaauuguugggccuugaacguuaaugaacuccggcgcgcugugcaggaggccaaggaucacugcgacccaaaaguccuguguauuaucaaccccgggaauccuaccggacaggugcaauccagaaagugcauagaggauguaauucauuucgcgugggaagagaagcuguuucucuuagcagacgaaguuuaccaggauaacguguacucuccagacuguagguuccacagcuuuaaaaagguccuguaugagauggguccggaguacuccucaaauguggaacuugccaguuuccauagcacaucuaaaggcuauaugggggagugcggauaccggggcgguuauauggaagugaucaacuugcaccccgagauuaaggggcagcuggucaaacuacucuccguucgccuguguccuccagugucaggacaggcugccauggacaucguagugaaucccccugucgcaggcgaagagagcuuugagcaauucagucgagaaaaggagucugugcuuggcaaccuggcuaagaaagccaaguugaccgaagaucucuuuaaucagguuccagggauccauugcaacccccugcagggagcgauguacgccuucccgagaauuuuuauaccugcaaaagcuguggaggccgcucaagcccaccagauggcacccgacauguucuauuguaugaaguuacuggaagagacugguaucugcgucgugccaggcuccggguuuggacagagggagggcacauaccacuuccggaugaccauucucccucccguagaaaaacuuaagacgguucugcagaaagugaaggauuuccauaucaacuuuuuggagaaguacgccuga

SEQ ID NO: 56924 - RNA, 1491 nt, Artificial Sequence
  derived and/or modified sequence opt3 from GPT__Homo_sapiens__XP_011515295
auggccagcuccaccggcgacagaucucaggcugugaggcacgggcugcgggcaaagguccucacacuugauggaaugaacccccgcguucgacguguggaguacgccguaagagguccuaucgugcaaagggcgcuggaauuggagcaggaauuacggcagggcgucaaaaagccauucacugaggugauucgcgcuaauauaggggacgcccaggcaaugggacaaagaccgaucacguuucugaggcagguucuagcccucugcgugaaccccgaucugcuuucaaguccuaauuucccagacgaugcuaaaaagcgggcagaacgcauucugcaggccuguggcggucauagcuugggggcuuauuccgucucuucgggaauccagcucauucgagaggacguggccagauacaucgagaggcgggauggcggcauacccgcggacccuaacaauguauuucugucaaccggggcaagcgaugccaucguuacagugcugaaacucuuagucgcuggagaaggucacacucguaccggcgugcugauuccaaucccccaauauccucuuuacagugccacauuggcagagcugggggcugugcaggucgacuauuaccuagaugaggaacgcgccugggcgcucgacguugccgagcugcauagagcacuuggacaggcuagggaucacugccggccacgagcccugugugugauuaacccgggcaaucccaccggucagguacaaacucgcgaaugcaucgaggcugugauaagauucgccuuugaagagagguuguuccuccuggcagacgaagucuaucaggacaacguguacgccgcugggucccaguuucauucuuucaagaagguuuuaauggagaugggaccuccauacgcgggccaacaggagcuggccagcuuucacuccacaucaaaaggcuauaugggggaauguggauuccgggguggcuacguggaggucgugaauauggaugcagcuguacagcagcaaaugcucaaacuuaugaguguucgccugugucccccugugccagggcaggccuugcuagaccuggucgugucucccccggcaccuaccgaucccagcuuugcccaguuccaggcugaaaagcaagccguccucgcagagcuggcggcuaaggccaaacuuacggaacagguguuuaacgaggcaccaggaauuuccugcaauccuguucagggcgccauguauucauuccccagagugcagcugccacccagggcuguagagcgugcccaagaauugggucucgcaccugacauguucuuuugccugcgguuacuggaggaaacugggaucugugucgugccaggcagcggauucggccagcgagaggggaccuaccacuuuagaaugacaauucuaccgccccucgaaaagcugaggcuuuugcuggagaagcucagucgcuuccaugcuaaauuuacucuggaguauucuuga

SEQ ID NO: 56925 - RNA, 666 nt, Artificial Sequence
  derived and/or modified sequence opt3 from GPX5__Homo_sapiens__NP_001500
augaccacacagcugagagugguccaccuccuuccccuguuguuagccugcuucguucaaacuagcccuaagcaggagaaaaugaagauggacugucauaaagaugaaaagggcacgaucuacgacuaugaggcuauugcacugaacaaaaaugaauacguguccuuuaagcaguauguagggaagcacauacuauucgugaacgucgccaccuacugcggacucacagcgcaguauccagagcugaaugcccuucaagaggaacugaaaccguacgguuuggugguucucggcuuucccuguaaccaguucgggaagcaggagccuggagauaauaaagaaauccugccaggccugaaguaugugaggcccggugggggauuugucccuucuuuccagcucuuugagaaaggcgacgugaacggcgaaaaggagcaaaagguauucucauuuuuaaaacauaguugcccacaccccagcgagauucuggggacuuucaaguccaucucuugggauccuguuaaagugcaugacauucgguggaauuuugaaaaguuccuugucggaccagaugguaucccggugaugcgcuggucgcaccgagcuaccgugucaagcgucaaaacagacauauuggcauaccugaagcaguuuaaaaccaaguga

SEQ ID NO: 56926 - RNA, 2238 nt, Artificial Sequence
  derived and/or modified sequence opt3 from GRAMD1B__Homo_sapiens__NP_001273492
augaagggauucaaacugagcugcaccgccuccaacucuaauagaucaacacccgcuuguaguccuauccucaggaagcggagccgcuccccaacuccgcagaaccaagacggggauacgaugguggagaaaggaucugaccacucgucagauaagagccccaguaccccugaacaggguguccagcgauccugcucuagccaguccggccguucagggggaaagaauaguaagagccauaagagacuuucuaaaaagucccaaucaugguacaacguucugagcccaacauauaaacagaggaaugaggacuuucggaaguuguucaaacaguuacccgauacugaacgccugauuguggacuacaguugugcacuacagagagauauacuccugcaaggcaggcuuuaucugucugagaacuggaucugcuuuuacuccaauauuuuccggugggaaaccuugcucacaguacgccugaaggacaucuguagcaugaccaaggagaaaacugcccgacugauuccuaacgcgauccaggugugcacagauucggagaagcacuuuuucaccucuuuuggugcuagagacaggacguauaugaugauguuccggcucuggcagaaugccuuacuggaaaaaccacuuugucccaaggaguuguggcauuuuguccaccagugcuacgggaacgaacugggacuaacuuccgaugacgaggauuaugugccuccagacgacgauuucaauaccaugggcuacugugaggaaauaccgguugaggaaaacgaggugaaugacucaaguagcaaauccucuaucgaaacaaagcccgaugcaagcccucaacuccccaaaaagucaauuacuaacaguacccugacauccaccggcagcucugaggccccagucucauuugacgggcuuccucuggaggaagaggcuuuggaaggagaugguagucucgagaaggaacuggcaaucgacaauauuaugggcgagaaaaucgagaugauagccccagugaacagccccuccuuagauuucaacgacaaugaagauauuccgacggagcugucugacucgagcgauacucaugacgaaggggagguacaggcuuuuuacgaagaccucuccggacgucaguauguuaacgagguguucaauuucucagucgauaaacuuuacgaccuguuguuuacaaacaguccuuuccaacgcgauuuuauggagcagagaagguucucugacaucauuuuucaccccuggaaaaaggaagagaauggcaaccagagccgggugauccuauauaccaucacucugacaaauccacucgccccuaaaaccgcgacggugcgagaaacccagacaauguacaaggcaucccaagagucagagugcuaugucauugaugccgaaguucugacucacgacgugcccuaccaugauuauuucuacaccauaaaccgcuacacacuuacuagaguagcuaggaauaagagccggcugcgcgugucuaccgaguugagauauaggaaacagccauggggucucgucaagacauuuaucgagaaaaacuucugguccgggcuggaagacuacuuucgucacuuagaaagugagcuggccaagaccgagagcacuuaucuagcagaaaugcaucggcagucucccaaagagaaggcuuccaagacgacaaccgugcgaagaaggaaacgcccucacgcccaccuccggguuccacaucuggaagaggugaugucaccggucacuacccccacagaugaagacgugggacacagaauuaagcauguagcgggcaguacccagacuaggcacaucccugaggauacaccaaauggcuuccaucuucaaagcguuucgaaauugcugcucgugauauccugugucauuugcuuuucucuggugcuucuggucaucuugaacaugaugcuguucuacaagcucuggauguuagaguauacgacccagacucugacagccuggcaggggcuacgccuccaggaacgacugccccaaagccagaccgagugggcacagcuuuuggaaucacagcaaaaauaccacgacacagagcugcagaaguggcgggaaaucauuaagaguuccgugaugcuccuggaucagaugaaagacucuuuaaucaaucugcaaaacggcauucguagcagagacuauacuuccgagucagaggaaaagaggaaucgcuaccacuga

SEQ ID NO: 56927 - RNA, 1344 nt, Artificial Sequence
  derived and/or modified sequence opt3 from GRAMD3__Homo_sapiens__NP_001139791
augaccagaaggcagcaagugcugcaggccaagcggagcauccagcagacauuccaagcucagcucaugcccuggaaguccauguuucacggccgcgaggucaagccuguugggccagaccuugaacugucugaggcagaaaacggaguggaggaaaagaagaaagccugccgaucaccgacugcgcagagucccacgccuagcguagaggcugauuccccagaccagaagaagauuauaucuuuguggucgaaaucauccuucgauggugccaguuuagcauccgacaagaaugauuguaaaaccgagucuaagaacgaccccaaaacagaacguaaaaagagcuccucaaguagccaauacaaagccaauaugcauuuucacaagcuguuccuaucugugccuacugaggaaccacucaaacaguccuuuaccugcgcucugcagaaggagauccuuuaucagggcaaacuguucgucucagagaacuggauuuguuuucauagcaagguguucgggaaagauacaaagaucaguauucccgcauuuucuguuaccuugaucaagaaaacuaagacagcccuccuggugccuaaugcucugauaaucgccaccgucacggacagauacauuuucgugucccucuuaagcagggauucgacuuauaaacugcuuaagucuguaugcggacacuuggaaaacaccuccguuggcaauucaccaaacccgaguagcgcggagaauagcuuucgggcagaccgccccucuagccugccucuagauuucaacgacgaauuuucagaucucgacggugugguccaacagagaaggcaggacauggagggguacaguuccagcggaucucaaacaccagaaucagagaauagucgggauuuccaugccacugagagccagaccgugcugaacguguccaaaggcgaagcuaagcccacacgcgccgacgcacacgucaaucgaguuccugagggcaaggcuaaaucucuuccagugcaggggcugucggaaaccguaggaaucuugcacaaggugaaaagccagaagugucccaugcuccaucacauucugaucuucuaugccauagucgugugcgcguuaauuaucuccacguuuuacaugagauauaggauuaacacucuggaggaacaacucggucuucugacaucaaucguugauacccauaauacugagcaggccgcaccgaguggcuugcggucucaggugcaguucaacgucgaggugcuaugucaagaacugacagcuaacaucguaaaacucgagaagauucagaauaaccugcagaaacuucuggaaaauggggacuga

SEQ ID NO: 56928 - RNA, 1737 nt, Artificial Sequence
  derived and/or modified sequence opt3 from GRAMD4__Homo_sapiens__NP_055939
augcugagaaggcucgacaagauccgguuccgcggccacaaacgagaugacuuucuugaucuggccgagagccccaacgcuuccgacaccgaaugcucugaugagauuccuuugaaggugccacguacaucaccgagagacagugaagaguuaagggaucccgcagggccuggaacucugauaauggccacggguguccaggacuucaaucggaccgaauuugaucgccuaaacgagaucaaaggccaucucgagauugcgcugcuugaaaagcacuuccugcaagaggaauugagaaaacucagggaggagacaaaugcugaaaugcugcggcaggagcuggaccgcgaacgacagagaaggauggagcucgaacagaagguucaagagguguuaaaggcccggacugaggaacagauggcacagcagccacccaaagggcaagcccaggcuagcaacggagcagagcgucgcucccagggccugucuucgagacuucagaagugguuuuacgaaagguucggugaguauguagaagauuuucgguuccaaccugaggagaauaccguggaaacagaggaaccauugucagcccgacgccugaccgagaacaugagaaggcuaaaacgcggggcuaagcccgucacuaauuuugugaaaaaccucagcgcccugagugacugguacuccguuuauacaucugcgaucgcauucaccguguacaugaaugccgucuggcauggaugggcuauuccucuuuuucuguucuuggccauccuccggcugagcuuaaacuaucugauagcaagaggcuggaggauccagugguccauugugccagaaguaucagagccgguugagcccccuaaggaagaucucacggugagugagaaguuucagcuuguccuggacguggcucaaaaagcccagaauuuguucggcaagauggcggacauccuagagaaaauuaagaaccuguucaugugggugcagccagaaaucacucagaaacucuacgucgcccugugggcagcuuuucuugccagcuguuucuuucccuaucgucugguuggguuggcugugggacucuacgccgguauaaaguucuuucugauugauuucaucuuuaaacggugcccucgauuaagagcaaaguacgacaccccauauauuaucuggaggucucugcccacagauccgcaacuaaaggagcgcuccucagccgcuguaagccggagacuccagacuaccaguucuagguccuacgugccuagcgcgcccgcaggccuggggaaagaagaggacgccggacgcuuccacucgacaaagaaaggcaauuuucaugaaaucuucaaccuuaccgagaaugaacgaccauuggcugucugugagaacgguuggcggugcugucugauuaaccgugauagaaagaugccuacggacuauauaaggaauggggugcucuacguuacugagaacuaucugugcuuugaaucuuccaaaucaggaaguagcaagcgcaauaaggugaucaaacuugucgauauuacagacauccagaaguacaaagugcuguccguauugcccggcucuggcauggggauagccguuagcaccccaucaacucagaagccccucguguucggagcaaugguccaccgggaugaggccuuugaaacaauucugagucaauauaucaaaaucaccuccgcugccgcaagcgguggcgacucuuga

SEQ ID NO: 56929 - RNA, 993 nt, Artificial Sequence
  derived and/or modified sequence opt3 from GRAP2__Homo_sapiens__NP_001278754
auggaggccguggcuaaguucgacuuuaccgcaagcggggaagaugagcuguccuuccacacaggggacguccucaaaauccuuucuaaccaggaagagugguuuaaggccgaacugggaucacaagaggguuacguucccaaaaauuucauugauauacaguuuccuaagugguuccaugagggcuugaguagacaccaggcggaaaacuuacugauggggaaagaggugggauuuuucaucauuagggcuagccaguccucuccaggcgacuuuucgaucucaguacggcaugaagaugacgugcaacacuucaaggucaugcgcgauaauaaggguaacuauuuucuauggacugagaaauucccgagccucaauaagcugguggacuacuaucgaacgaacaguauuucccgucagaaacagaucuuucuuagagauaggacccgggaggaccaggggcaucgcggaaauucucuggauagaaggagccaaggcggcccccacuuguccggggccguuggagaagagauacggccuucaaugaaccgcaagcucagugaccacccacccacacugccucugcagcagcaucagcaccaaccacagcccccucaguacgcaccagccccgcaacagcuccagcagcccccucaacagcgauauuuacagcaucaccacuuccaucaggaaagaagggguggcagccuggauaucaaugacgggcacugcggaacuggccuugguucugagaugaacgcugcauugaugcaucggcgucacaccgacccagugcaacugcaggccgcugggcgcgucagaugggccagggcgcuauacgauuucgaagcacucgaggacgaugagcugggauuucauuccggcgaagugguagagguucuugacucaagcaaucccaguugguggacaggccggcugcacaacaaauugggccucuucccugccaauuauguggcuccaaugacccgauga

SEQ ID NO: 56930 - RNA, 654 nt, Artificial Sequence
  derived and/or modified sequence opt3 from GRAP__Homo_sapiens__NP_006604
auggagagcguggcccuguacuccuuccaggcuaccgaaucugacgagcucgcauuuaacaagggcgauacacuuaaaauccugaauauggaagacgaucaaaacugguauaaggccgaguugagaggggucgaaggauucauucccaaaaauuacauaaggguuaagccucacccaugguauucaggucggaucagucgccaguuagcggaggagauucugaugaaacgaaaccaucuaggcgcuuuucucauccgugaaagcgaguccucuccgggggaguucucggugucaguaaauuacggagaccaggugcagcacuuuaagguccugagagaggccagcggcaaguauuuccuuugggaggaaaaauuuaacagucugaaugaguugguggauuucuacaggacuacgaccauugcaaagaaacggcaaaucuuucuccgcgacgaagaaccccugcugaaguccccuggugccugcuucgcucaggcacaguuugauuucucugcccaggacccaagccaacucuccuuuagaaggggagauauaaucgaaguuuuagagcggcccgacccucauugguggcgcgggcgaucauguggcagagugggcuucuucccaaggaguuauguccagcccgugcaccuguga

SEQ ID NO: 56931 - RNA, 759 nt, Artificial Sequence
  derived and/or modified sequence opt3 from GRASP__Homo_sapiens__NP_001258785
augacccugcuccccagcaagggcggggacacaaucgccuccgugaacggacuuaaugucgaggguauuagacacagggaaauaguugauaucauuaaggcuucuggcaacgugcugcgguuggagacuuuauacgggacgucaauccgcaaagcagaacuggaggcccgacuacaguaucucaaacaaacccuguacgaaaaguggggagaguaucguagucuuaugguacaggagcagagacuggugcauggcuuggucgugaaagacccuagcauuuacgauacacucgaauccguuaggucuugccuguauggugcggggcugcucccaggaucguuaccguucggcccccugcuugcugugccuggccggccacgcgggggagccagaagggcacggggugacgccgaugacgcugucuaccacacuugcuuuuucggcgauucagagcccccugcauugccacccccuccaccgcccgcccgcgcuuuugggccuggaccagccgaaacccccgcggugggcccugguccagggccccgagcagcccugagcagaagugcuuccguaaggugugccggaccgggcggcgggggagguggcggggcaccuggagcucuauggacagaggcccgggagcaggcgcucuguggccccggucugcguaagaccaaguaucgcucuuucagaaggcggcuucugaaauuuaucccaggguugaaucgaagccucgaagaggaagagucccaacuguga

SEQ ID NO: 56932 - RNA, 1647 nt, Artificial Sequence
  derived and/or modified sequence opt3 from GRB10__Homo_sapiens__NP_001001549
auggcccuggcuggcugccccgacagcuuccuccaccauccuuacuaucaggauaagguggagcaaaccccaagaucccagcaggacccggcagggcccggacuuccugcccagucugauaggcuggcgaaccaccaagaagacgaugucgacuuggaggcuuuaguuaaugauaugaacgccucacuggaaagucuauacagcgcauguuccaugcagucugacacagugccacuccugcagaauggucagcaugcccggucgcaaccccgcgcuucaggcccuccacgaagcauccagccccagguaaguccucgucagagagugcaaaggucccagccaguccacauucuugcagugcggcgccugcaggaggaagaucaacaguuuagaacuucuagcuugccggccauacccaacccuuucccagagcucugcgggcccggauccccuccaguucugacgcccggcucacugccgccuagucaggcugccgcgaaacaggacgugaaggucuuuagcgaggaugguaccucuaaagugguagaaauccucgcagacaugacagccagggauuuaugucaacugcuuguuuauaagucccauugcguggacgacaauucauggacuuuggucgagcaccacccccaucuggggcuagaacggugucucgaggaucacgagcugguggugcaggucgaaagcaccauggcuagugagucuaaauuccuuuuucgcaagaacuacgccaaguaugaguucuuuaaaaauccaaugaacuucuuuccugagcagaugguuacauggugccagcaauccaauggaagccagacccagcuguugcaggaaccccgacaucuccaacuguuagcagaccuggaggauucgaacauuuucucucucaucgcuggcagaaagcaguacaaugccccaacugaccacggccuuuguauuaaacccaacaaggugaggaaugagacaaaagaacugcgguugcuaugcgcggaggaugaacagacccguacguguuggaugacugccuuucgccugcucaaguaugggaugcugcuuuaccagaacuacagaaucccucaacagaggaaggcacuguuguccccauucucaaccccgguacggagugugagcgaaaauucccucgucgcuauggacuuuucuggacagacaggucgagugauagaaaaccccgccgaggcucaaagcgccgcacuggaggaaggccacgccuggcgcaaaagaucaacuaggaugaacaucuuagggagucaguccccucugcauccaagcacccuaucuacaguuauucaccggacccagcauugguuccacggacgcaucucaagagaggaaagucauaggauuaucaagcagcaaggccucguggauggucuguuccuuuugcgugacagccaguccaaucccaaggcuuuuguccugacgcucugccaccaccagaaaauuaaaaacuuccagauacugccuugugaggaugacgggcaaacauuuuucucucuugaugacggaaauacuaaguuuucggaccugauccaguugguggauuucuaucagcucaacaaaggcguacugccaugcaaguuaaagcaucacugcauucggguugcgcuguga

SEQ ID NO: 56933 - RNA, 1362 nt, Artificial Sequence
  derived and/or modified sequence opt3 from GRB14__Homo_sapiens__NP_001290351
augagccuguccgccagaagggugacccuccccgcuaucacaccuauuauacuucagaagcgggucaucaaaguuuacucugaggacgaaacuucacgcgcacuggaugugccaagugacauuacggcccgagauguaugccaauuguuaauccugaagaaccacuauauugacgaucauagcuggacccuauucgagcaccucccgcauaucggcguggaacguacaauagaggaccacgaacuggucaucgaggugcuuuccaauugggggauugaggaagagaacaaacuguacuuuagaaagaauuaugcgaaauacgaguucuuuaagaaccccauguauuucuuuccugaacauaugguuucuuucgcuacugagaccaauggagaaaucucgccaacacagauuuugcagauguuucucucaagcaguaccuaccccgagauccacgguuuccugcacgccaaggaacagggcaaaaaguccuggaaaaagauauauuucuuccugaggcggucugggcucuacuuuagcacuaaaggaacauccaaggagccucgccauuuacaauucuuuucagaauuuggcaacagugauauuuacgugagccuggcagguaagaaaaagcacggggccccaaccaauuauggauucuguuuuaaacccaacaaggcuggcggcccuagagaccuuaaaauguugugcgcagaggaggaacagucuaggacguguugggucacugccauccggcugcuaaaguacgggaugcagcucuaucagaauuacaugcauccauaucaaggacgcuccgguugcucaagccagaguauuucuccgaugcgauccaucagcgagaacucgcugguggcuauggauuucucuggccagaaauccagaguaaucgaaaaucccaccgaggcccuuucaguugcgguggaagaggggcuggcauggaggaagaagggauguuugcggcucggcacacacgguaguccuacugccagcucccagucuagcgcuaccaacauggccauucaccguucacaaccaugguuucaucacaaaauaagucgcgacgaggcacagagacugaucauucagcaaggguuagucgauggaguguuccuggugagggacucccagagcaaucccaagacauuuguccucucuaugucacauggccagaaaaucaagcacuuccagauaauuccuguugaagaugacggcgagauguuucauacccuugacgaugggcacacgcgguucacugaccugauccaauugguggaauuuuaccagcuaaacaaaggaguacugccaugcaagcucaagcacuauugugcucgaaucgcccuguga

SEQ ID NO: 56934 - RNA, 654 nt, Artificial Sequence
  derived and/or modified sequence opt3 from GRB2__Homo_sapiens__NP_002077
auggaggccaucgcuaaguacgacuucaaagcaaccgccgaugacgaacugagcuuuaagagaggcgauauucucaaagugcuuaacgaggaaugcgaccagaauugguauaaggcggagcugaacgggaaagauggauucauacccaagaauuacaucgaaaugaagccucacccaugguuuuucgguaaaauuccgagggcuaaggccgaggagauguuguccaaacaacggcaugacggcgcauuuuuaauccgcgaaucugagucagcccccggggauuucagucugagcgucaaguuuggaaacgacguucagcacuucaaagugcuacgagauggcgcugguaaguauuuucucuggguagugaaguucaauucccugaacgaacuugucgacuaccaucguucuacaucggugucaagaaaucagcagauuuuucugagggauaucgagcaaguuccucagcagccaacuuaugugcaggcauuguucgacuuugauccccaagaggacggggaacucggauuccggcgcggcgacuucauacacgucauggauaacagcgacccuaauugguggaaaggcgccugucaugggcagacgggaauguuuccaagaaacuacgugacccccguaaauaggaacguuuga

SEQ ID NO: 56935 - RNA, 1668 nt, Artificial Sequence
  derived and/or modified sequence opt3 from GRB7__Homo_sapiens__NP_001229371
augggcaaguggagacccgggcagggacacaccacagguagcgugaaaccucuguccaggucugacgccauggaacucgaucuuucaccaccgcaucugaguagcucccccgaagacuugugcccugcuccaggcacucccccugggacgccacggcccccugauaccccauuaccggaggaagucaagcgcucucaaccccugcuaaucccuacaacuggacgaaaacuccgugaggaagagagaagggcaaccucgcugccaucaauucccaacccuuucccagagcuuuguagucccccgagccaguccccuauacugggcggucccucuagcgcccggggguugcucccacgcgacgcguccagaccucacguugugaagguauacucagaagauggagcuugcaggaguguggaggucgccgcaggcgccacagcucggcaugugugugaaaugcugguucagcgcgcacacgcccugagcgacgagaccuggggccucguggagugccauccccacuuagcucuggaacgagggcuugaggaucacgaaucugucguggagguacaggccgcguggccaguuggaggugacuccagauuuguguucaggaaaaauuuugcaaaguaugaauuguucaagucaagcccccauagucuguuuccugagaaaauggucucuuccugucuagaugcccacacuggcaucagccaugaggaccucauucaaaacuuccugaaugcugggucguuuccagaaauccagggauuccuucagcugcggggcucuggucguaaguuguggaaacgcuuuuucugcuuucucagaagguccgggcuguacuauucaacaaagggaaccaguaaagauccgcggcacuuacaguacguggccgacgugaacgagagcaaugucuauguugugacgcaaggccgaaagcuguacggcaugcccacugauuucggguuuuguguaaagccuaacaaacuccgcaauggacacaagggucuuagaauuuucugcuccgaagacgagcagucuaggaccuguuggcuggcagcuuuccgguuguuuaaauauggcgugcagcuauacaagaacuaccagcaagcccagagccgccaucugcacccaucaugccucgggagucccccucugagauccgcgagcgacaauacacuugucgccauggauuucucuggacaugcaggcagggugaucgaaaacccacgugaggcucugucaguugccuuggaggaagcucaggccuggcggaaaaagacuaaucaccgacucagucugcccaugccggcaagcgguaccuccuuaucugccgcuauacauagaacacaacugugguuucacgggaggaucucgcgcgaggaaagccagcggcuaauuggccagcagggacucguggacggccuguuccuugucagagagucccaaaggaacccucagggguuuguguugucacugugucaccuccagaaaguaaagcauuaucugauccuuccaagugaagaggagggacgccuguacuucucuauggaugacggucagacccgauuuacggauuugcuccaacugguugaguuccaccaguuaaaucggggcauucugcccugccuacuccgucauugcuguacuagaguggcgcuguga

SEQ ID NO: 56936 - RNA, 1230 nt, Artificial Sequence
  derived and/or modified sequence opt3 from GREB1__Homo_sapiens__NP_683701
augggcaacagcuacgccgggcagcugaagaccacaagauucgaggaagugcuccacaauuccaucgaggcuucucuuaggucaaacaaucuggucccccggccuauuuuuagucaauuguauuuagaagcagagcagcagcuggccgcgcuagaaggagguagccgcguugacaacgaggaggaagaggaagagggcgaagggggacucgaaacuaauggcccaccgaaccccuuccagcugcauccucuuccagaggguugcuguacgaccgauggguuuugccaagcuggaaaagaccugcgauugguguccauaucuaaugaacccauggauguaccugccggcuuccuccuggugggcgucaagucgccaucacugcccgaccaccucuuagugugugcaguugauaaacguuuucugccugacgauaacgggcauaaugcccuuuugggauucagcgguaacugcgugggcugugggaagaaaggauuuugcuacuucacagaguuuaguaaucacaucaaccugaagcuaacuacccagccaaagaaacagaagcaucucaaauauuaccuggucagaaaugcucagggcacacuuaccaaggguccgcugauuuguuggaaaggguccgaguucaggucucggcaaauccccgcaagcacuugcuccucaaguuuguuuccugcccucgagagcacagcugccuucccaucugagcccgugccuggaaccaacccauccauucugaugggcgcgcagcaggcaggccccgccucagaccacccgagcuuaaaugcugccauggggccugcaguauuuaacggaaaggauagucccaagugucagcaacuggcuaaaaacaaucuccuugcccugccacgcccuucugcguuggguauccuauccaacagcgggcccccaaagaaaagacacaagggcuggucgcccgaaucuccuuccgccccagacggaggcugcccgcagggugggggcaauagggcaaaauaugagucagcuggaaugaguuguguuccccaggugggccuggucgggccugccagcgugacguucccaguggucgcuuccggagaacccguuucugugccugauaaccuccugaagauaugcaaagccaagccaguaaucuucaagguguuugucaauggugcaacucaaaugguggcccuuggccccgcugagccggcgagcccucggucacuguga

SEQ ID NO: 56937 - RNA, 432 nt, Artificial Sequence
  derived and/or modified sequence opt3 from GREM1__Homo_sapiens__NP_001178252
augagcagaaccgccuacacagugggcgcucugcuccuucuguuggggacuuuacugcccgcagccgagggaaagaaaaaggguucccagggcgcgaucccuccaccggacaaagcucuacacgucacggaaaggaaguaucucaaacgggauuggugcaagacccaaccccugaagcagacaauucaugaggaaggguguaacucucgcacuauaaucaaucgauucugcuacggacaguguaacucauuuuauauuccucgucacaucagaaaagaggaaggcaguuuccagagcugcuccuuuuguaagcccaaaaaguucaccacaaugaugguuacccuuaauugcccagagcugcaaccuccaacuaaaaagaagagggugacacggguaaaacagugucgcugcauuucuaucgacuuggauuga

SEQ ID NO: 56938 - RNA, 561 nt, Artificial Sequence
  derived and/or modified sequence opt3 from GREM2__Homo_sapiens__XP_005273283
augagagcccugagggcugagagcacuuccggcucucggcagacacccugccgcauguucuggaagcucucacuuagucuguuuuugguggcagucuuaguuaaaguggccgaagcgcgaaagaaccguccugcuggggccaucccaagcccguacaaagacggauccucuaauaacucggagagauggcaacaccagauuaaggaaguacuggcaucaagccaggaggcccuaguggucacugaaaggaaauaucucaagagugauugguguaagacgcagccccugcggcaaaccguguccgaggaggguugccgcucuagaacaauacuuaauagguucuguuacggccagugcaacagcuuuuauaucccucggcauguuaaaaaggaagaggaauccuuccagucaugugcuuuuugcaaaccacagcgcgugaccaguguccugguggaguuggagugucccgggcucgacccuccauuccgacugaagaaaauucaaaagguaaagcagugcagauguaugagcguuaaucugucugauuccgacaaacaguga

SEQ ID NO: 56939 - RNA, 1857 nt, Artificial Sequence
  derived and/or modified sequence opt3 from GRHL1__Homo_sapiens__NP_937825
augacccaggaguacgacaacaagagacccgugcugguccuccaaaaugaagcccuuuauccucagaggcggagcuacacauccgaggaugaggcuuggaaaucuuuccuggaaaacccauugacugcagccacgaaggcgaugaugucaaucaauggcgacgaagauagugcugccgcauuagggcugcuauaugacuacuauaaaguuccgcgcgagcgacguagcuccaccgccaagcccgagguggaacacccugagccagaucauucuaaaagaaacucgauucccauaguaacagaacagccucucaucucagcuggagagaauagggugcagguccugaagaacgugccauuuaauauuguucuuccccacgguaaccaacugggcaucgacaagcgggggcauuugacugcaccugauaccacagugaccgucagcauugccacuaugccaacacacaguaucaaaaccgagacgcagccgcauggauucgcugugggcauacccccugccguauaccacccagaacccacugagcgcguuguggucuuugacagaaaucucaacaccgaucaguucuccucuggugcgcaggcaccuaaugcccaaaggcggacaccagacagcacuuuuuccgaaaccuucaaggagggggugcaggaaguguuuuuccccucagaucugagucugcgcaugccgggaaugaacagcgaggacuaugucuuugauucuguuuccggcaauaacuucgaguacacacucgaagcuagcaaaucauuacgacagaagccuggcgacaguaccaugacguaccugaauaaagggcaguuuuaucccaucacucuuaaggaggugucuuccagcgaagguauucaccauccaaucucgaagguaagaucugugauuauggucguguucgccgaggacaaauccagggaagaucaauugcggcacuggaaguacuggcauucacgucagcacacagcaaaacagcgcugcaucgacauagcugauuauaaggagaguuuuaacaccauuagcaacaucgaggaaauugccuacaaugcgaucuccuucacuugggacaucaacgaugaggccaaaguuuucauuucugugaauugucugagcacagacuuuucaagucaaaagggagucaaaggccuaccucucaacauacagguggauaccuauuccuacaauaacagaagcaauaagcccguacacagggcauauugccagaucaagguuuucugugacaaaggggcugaacggaagauucgagaugaggaacgcaaacagucuaagagaaaagugucagacgucaaggugccacugcuucccagucauaagaggauggauaucacggucuuuaaaccuuucauagaccuggacacccaaccaguguuguuuauuccggauguucacuucgccaaccuccagcggggaacacaugugcugcccaucgcuagcgaggaguuagaaggcgaggguuccguacugaagcgcgggccuuacggaacugaagacgauuuugccgucccacccucuaccaaacucgcaagaaucgaggagccuaagagggugcuucuguacguucguaaagaaucggaggaaguguucgacgccuugaugcuaaagacaccaagccugaagggccucauggaggcuauuuccgauaaauaugacgucccccacgauaagaucggcaaaauuuuuaagaaaugcaagaaggggauacuggugaauauggacgauaacaucguaaaacauuacucaaaugaagacacuuuccagcuucagauugaggaggcgggagguaguuauaagcugaccuugacagaaaucuga

SEQ ID NO: 56940 - RNA, 1878 nt, Artificial Sequence
  derived and/or modified sequence opt3 from GRHL2__Homo_sapiens__NP_079191
augagccaggaguccgacaacaauaagagacugguggcccucguccccaugccuucugauccaccguucaacaccaggcgggcuuacacaucagaagacgaggcauggaaaaguuaucuugaaaauccccugacugccgcgacgaaggcuaugaugagcaucaacggcgaugaggacuccgccgcagccuugggguuacuguacgauuauuacaaaguuccucgcgacaagcgacuacucucugugucgaaagccucagauagccaagaagaccaggagaagcguaauugccugggaaccagugaggcacaguccaaccuuucugguggcgaaaauagaguacaggugcugaagacagucccagugaacuugagccucaaucaagaucaccuggagaacuccaaaagggaacaguauucaauuaguuuucccgagagcucugccauaaucccuguuuccgggauuacuguggucaaggcugaggacuucaccccaguguuuauggcucccccuguacauuacccacggggagauggcgaagaacagcgcguugugaucuucgaacagacacaauaugacgucccgucacuggcgacccacagcgcauaccucaaagaugaccagagaaguacucccgacucuacauacuccgagagcuuuaaggaugccgcuaccgaaaaauucaggucggccucugugggugcagaggaguauauguacgaccagacguccucagggacuuuucaguauaccuuagaagcuacaaagagucugcggcaaaagcagggagagggcccuaugacuuaccuuaauaaaggccaguucuaugccauuaccuugagcgaaacaggggauaacaaguguuuucgccauccaaucuccaaagugcgaucugucguuauggugguauucagcgaggacaagaauagagaugaacaacugaaauacuggaaguauuggcacucaaggcagcauaccgcgaaacagcgggugcuagacauagccgauuacaaggagaguuuuaacacgaucggaaauauugaggaaaucgcauacaacgcugucuccuucacuugggacgugaacgaggaagccaagauuuuuaucacaguuaauugccucagcaccgauuucucuucacagaaaggugugaagggccugccccuuaugauacaaauugacacuuauaguuacaacaaucguagcaacaaaccuauccaccgcgcuuauugucagauuaaggucuucugcgauaaaggggccgagagaaagaucagggacgaggagcggaagcagaaucgaaagaagggaaaaggccaggcaucccaaacacaguguaacucuucgagcgacgguaagcuggccgcuaucccauugcagaaaaaguccgauauuaccuacuuuaagacgaugcccgaccuccacucacagccggugcuguucauaccugauguacauuuugcgaauuuacaacgcaccgggcagguuuauuacaacacagacgaugagagagaaggaggcagugugcuggucaaaaggauguuccggcccauggaggaagaguuuggcccagugccuucuaagcagaugaaagaggaagggacuaagcgcguccuccuuuaugugagaaaagagaccgacgauguuuucgacgcacugauguugaaaagccccacagugaagggacuaauggaagccaucuccgagaaauacggucugccaguagaaaagauugcuaaacucuacaagaaaucaaagaaaggcauccuggucaauauggaugacaacauaauugagcacuauagcaaugaggauacuuuuauccuuaacauggaaucuaugguggagggguucaagguuacccugauggaaaucuga

SEQ ID NO: 56941 - RNA, 987 nt, Artificial Sequence
  derived and/or modified sequence opt3 from GRHPR__Homo_sapiens__NP_036335
augagacccgugaggcugaugaaggucuucguuacccggcgcaucccugccgagggccgaguggcucucgcacgugccgcggacugcgaaguagagcagugggauagcgacgaaccaauuccggcuaaagagcuugaaagagggguggccggagcacacggucuguuguguuuacuguccgaucaugucgacaagaggauacuagaugccgcuggcgcaaaccucaaagugaucucuacaaugucaguugggauugaccaccuggcccuugaugagaucaagaaacggggcauucgcgugggauacacucccgacguccugacggauaccacagcugaguuggccgugagucuccugcugacuaccugcagaaggcucccugaagcgaucgaggaaguaaagaaugguggguggacaagcuggaagccauuauggcuguguggauauggccuuacccaauccacuguuggcauaaucggguugggacggauuggucaggcaaucgcccgccgacugaaacccuuuggcgugcagagauuccuauacacagggaggcagccucggccagaggaggcugccgaauuucaagcagaguucgucucuacccccgaacucgcugcccagucggacuuuauugugguggcgugcucacugacgccugccacugagggacuuuguaacaaggauuucuuucagaaaaugaaggaaaccgcagucuucaucaauauaagccguggcgacguugugaaccaggaugaccuguaucaagcucuugccagugguaaaauugcugccgcagggcucgacguaacauccccagagccgcugcccacuaaucauccuuuacugacccucaagaacugcgugauccuuccacacauuggaucugccacacaucgcaccagaaauacgaugagccuguuggcugcgaacaaucuacuggcaggccucaggggcgagcccaugccuuccgaacugaaguuguga

SEQ ID NO: 56942 - RNA, 2721 nt, Artificial Sequence
  derived and/or modified sequence opt3 from GRIA1__Homo_sapiens__NP_000818
augcagcacaucuucgccuuuuucugcaccggcuuucugggggcuguggucggagcaaacuuccccaauaacauucaaauagguggccucuuuccuaaucagcagagccaggagcaugccgcguucagauuugcucuuucccaacugacagaaccaccgaaguuguuaccccagaucgacauuguuaacaucucugauucauucgagaugacuuacagguuuuguagucaguucagcaaagggguguaugccauuuuuggauucuacgaacggcgcacgguaaauaugcugaccuccuuuugcggcgcacuacacguguguuucaucacaccuucuuucccagucgacacuucgaaccaguuugugcuccaacugcgacccgagcuucaggaugcccugauaucaaucauugaccauuauaaguggcagaaauucguuuacaucuaugaugcugaccgugguuugagcgugcuccagaagguccuggauaccgcagccgaaaagaauuggcaagugacagcuguaaacauucugaccacuacagaggagggguacagaaugcucuuucaggacuuagaaaagaagaaagagaggcugguuguggucgauugcgaaagugagcggcuuaaugccaucuugggacagauaauuaagcuggagaaaaacggcaucggcuaucacuacauucuagcgaaucucggguucauggacaucgaucugaacaaguuuaaagaauccggagcaaaugugaccgguuuccaacuugugaacuacacggacacuaucccugccaagauuaugcagcaguggaaaaauucugaugcucgcgaccauaccagagucgacuggaaaaggccaaaguauacaagcgcccugacuuacgauggcguuaaagugauggcagaggcuuuucaguccuugcggcgccaacgaauagacaucucaagaagggggaacgccggagauugucucgcgaaccccgccguaccuuggggccaggguauugacauccagcgggcacugcagcaagugcguuucgaaggguuaaccggaaauguccaguuuaacgagaagggccgcagaacaaauuauacccugcacgugauagaaaugaaacacgauggcauuaggaagaucggguacuggaacgaggacgauaaauucguuccagcugccacggacgcucaggccggaggugauaauaguagcgugcagaaccggacuuauaucgucacaaccauucucgaggacccguacgugaugcuuaagaagaaugcaaaccaauuugaaggcaaugaucgauaugagggguacugcguagaacuggccgcugagaucgcgaaacauguuggauacucuuaucgcuuggaaauuguguccgacggcaaguacggugcaagagaccccgauacuaaagccuggaacgggauggucggcgagcuaguguauggaagggcugacgucgccguggcaccucugacaauaacccucguucgggaggaagugaucgauuucucaaagccauuuaugagccugggcauuaguaucaugaucaaaaagccccagaagucuaaaccugggguauucuccuuccuugacccacuggccuacgagauuuggauguguauagucuuugcuuauaucggagugagcguuguguuguuccucgucucgcgcuuuucucccuacgaauggcacuccgaggaguucgaagaggguagagaucagacgaccucagaccagaguaaugaauuuggcauuuucaacagccugugguuuuccuuaggggccuucaugcaacagggaugcgauaucucuccgaggagccugucaggccguauugugggugggguauggugguuuuucacacuaaucauaaucaguuccuauacugcaaaucucgcggcuuuucugaccguggagcggaugguuagcccuauugaaucugccgaggaccuugcaaagcagacagagaucgccuacggcacuuuggaagcuggaucaaccaaagaguucuuucgaagaaguaagauugccgucuucgaaaagauguggacauacaugaaaagcgcagagcccuccguguucgugaggaccacugaagagggcaugauccgcguccggaagucuaaagggaaguaugcuuaccugcucgagucgacgaugaacgaauauauagagcaaagaaaaccaugugauacaaugaagguuggagguaaucuggacagcaaaggcuacgggauugccaccccuaagggauccgcgcuuaggaaccccgugaaccuggccguguugaagcucaaugaacagggccuguuagauaaacugaagaacaaauggugguaugacaagggugagugcgggucaggcggaggcgauaguaaagacaagacuucugcucuaagccucuccaauguagcaggggucuuuuacauccugauuggaggccuugguuuggccaugcugguggcucucaucgaguucuguuauaaaucacgcagcgaaucuaagcgaaugaagggguuuugccugauaccacagcaguccaucaacgaggccauucggaccaguacauuaccccguaauagcggagcaggcgcgucuuccgguggcucaggggaaaacggaagaguugugagucaugacuucccuaaaagcaugcaaucgaucccaugcaugucccacucuagcggcaugccgcugggggccaccggacuuuga

SEQ ID NO: 56943 - RNA, 2652 nt, Artificial Sequence
  derived and/or modified sequence opt3 from GRIA2__Homo_sapiens__NP_000817
augcagaagaucaugcacauuagcgugcugcucucccccguccuuuggggccugauauucgggguuucuucaaacaguauccaaauuggagguuuguuuccuagaggcgccgaccaggaguacagcgcuuucaggguggggaugguacaguuuuccaccucugaauuucgguuaacaccacauaucgauaaucuggagguggcaaacucguuugccgucacuaaugcguucugcucacaguuuagccgcggaguguaugcuauuuucggcuuuuacgacaaaaagaguguuaacacgaucaccuccuucugugguacacuacacgugucuuuuauaacuccgagcuuccccaccgaugggacacauccuuuugucauccaaaugcgaccagaccucaaaggagcccugcuuucccugauugaauauuaccagugggauaaguucgcauauuuguacgacucagaucguggccucaguacccugcaggccgugcuggacagcgcugcagagaaaaaguggcagguaacugccaucaauguuggcaacauuaauaacgauaagaaagacgaaauguauagaucucucuuccaagauuuagagcugaagaaagagaggcgggugauccuugacugcgaacgcgauaaggucaaugacauaguggaccaggugauuacaaucgggaaacacgucaagggauaccauuacauuaucgcuaacuuggguuuuaccgauggcgaccugcuaaagauccaguucgggggagccaauguuuccggcuuucagauuguggauuaugacgauucacucguaagcaaauucauagagagauggaguacgcuggaagagaaggaguaccccggugcgcacacuaccacaaucaaauauacuucugcacuuaccuacgacgccgugcaagucaugacagaggcuuuuaggaaccugcggaagcagcgcauugaaaucucccgaagagggaaugccggagauuguuuggcaaacccugcugugccauggggccagggcguugaaauagagagggcccucaaacaagugcaggucgaagggcugagcggaaauauuaaguucgaccagaacgguaaacggaucaacuauaccaucaauauuauggaguuaaagacgaacggcccccguaagaucggguacuggucggagguggauaaaaugguaguuacucugacagaacucccuucuggaaaugacaccuccggccuugagaacaagacuguggucgugacaaccauucuggaaucaccauaugucaugaugaaaaagaaucacgagauguuggaagguaacgagcgcuacgagggguacugcguggaucuagcggccgaaauagcaaaacauuguggcuuuaaguauaagcugacgaucguuggagacggcaaauacggggcuagagacgccgauaccaagauuuggaauggaauggugggugagcucguauauggcaaagcugacaucgccaucgcaccgcugacaauuacucuugucagggaagaggugauagauuucaguaagcccuuuaugagccuggggaucuccauuaugaucaaaaagccucagaagucuaaaccaggaguuuucagcuuuuuggacccccucgccuacgaaauuuggaugugcaucguguucgcuuauauaggcgucucagugguacuguuuuuagugagucgguucuccccuuacgaguggcacaccgaggaguucgaagauggucgagaaacacaaagcucugagucaacuaacgaguuugggaucuucaauagucugugguuuagccuaggcgcguucaugcgccagggaugugacauuuccccaagaucucucucgggcaggaucguugggggagucuggugguuuuucacccugauuaucauaagcuccuauacagcaaaccuugccgcuuucuugaccguggaacggauggugucacccauugagagugccgaagaucugucuaagcagacugagaucgcauacgguacgcucgacagcggcuccacaaaagaguucuuucgcagaucaaagauugccgucuucgauaaaauguggaccuacaugaggagcgcugaaccgucuguuuuugugcguacuaccgccgaggggguggcacggguacgaaaguccaagggaaaauaugcguaccugcuugaaaguacaaugaaugaguauaucgaacagagaaagccuugcgacaccaugaaagucggcgguaaccuggauagcaagggguacggcauagcuacucccaaaggaucuuccuugaggacaccagugaaucucgccguucugaaguuaucagagcaaggcgugcuggacaaacuaaagaacaaguggugguaugauaaaggggaauguggagcaaaggacaguggcagcaaagagaagacgucggcccucucccugucuaaugucgcugguguguucuacauccuuguugggggauugggccuggccaugcucguggcacugauugaguuuugcuauaaaagccgcgcugaagccaagcggaugaagguagcgaaaaacgcccagaacaucaauccuucaaguucccagaacucucagaauuucgcuaccuacaaggaggguuacaacgucuauggcauugaaagcgugaaaaucuga

SEQ ID NO: 56944 - RNA, 2685 nt, Artificial Sequence
  derived and/or modified sequence opt3 from GRIA3__Homo_sapiens__NP_000819
auggccagacagaagaaaaugggccaaagcgugcugagggcugucuucuuucucguucuugggcuguugggacacucccaugguggcuuccccaacaccaucucuauugggggauuauuuaugcggaauacagugcaggagcacucagcauuccgcuuugccguacagcuguacaacacuaaucagaacacgaccgaaaagccuuuccaucuaaauuaucacguggaccaucucgauaguagcaacuccuuuucugucacaaaugcguucugcucgcaauuuucacgaggcguguacgcuauauucgguuuuuaugaccagaugagcaugaacacucugaccaguuucuguggggcccuucacacauccuuuguuaccccaucuuucccgacugaugcagacgugcaguucgucauccagaugcgucccgcccugaaaggagcuauuuugagccuccugggccacuacaagugggagaaauuuguguaucuguacgauacagaaagaggcuucuccauccuccaagcaauuauggaggccgcuguacagaauaacuggcagguuaccgccaggucaguggggaauaucaaggacguccaggaauuucggcgcauaaucgaggagauggauagaaggcaagaaaagcgguauuuaauugacugcgagguggaacgcaucaacacgauucuggaacagguggucauccuuggaaaacauagucgagguuaccacuacauguuggcgaaucugggcuucacugauauacuacucgagagaguuaugcaugggggagcaaacauuaccggcuuucagaucgugaauaacgaaaacccuaugguacaacaguucauucagaggugggugcggcuggacgagcgugaauuuccagaggccaagaaugcuccccuuaaauauacaagcgcccugacucacgaugcaaucuuggucaucgcugaagccuuccgcuaccucagaaggcagcggguggacguuucucgacgcgguuccgcgggggauugucuggccaacccugcagugccauggucacaaggaauugacauagagagagcuuuaaagaugguccaggugcagggcaugaccggcaauauccaguuugacacauaugggaggcggaccaacuacacgauugauguauaugagaugaaaguuagcggaagucgcaaggccgguuacuggaaugaauaugagagauucgugcccuuuucugaccaacagaucuccaacgauagcgcuucgucugaaaauaggacuauagucgugacaaccauucuggaguccccuuacgucauguacaagaaaaaccacgaacagcucgagggcaaugagcguuaugaaggguacugcguggaccuugccuaugagaucgcaaagcauguucggaucaaauacaagcugucaauugugggagauggcaaauauggugcccgagacccagaaacuaagaucuggaacgggaugguaggcgaguuggucuacggcagagcugauauugcgguggcaccgcuaacaauaacccugguuagggaagaggugaucgacuucaguaaacccuuuaugagccucggaauuuccaucaugaucaagaagccucagaaaucuaagccaggggucuucagcuuccuggauccccuugccuaugagauuuggauguguauaguguuugcuuacaucggaguaucagugguucuguucuuggucagucgcuuuuccccuuacgaauggcaccucgaggacaauaacgaggagccacgggauccccaaagcccgccugaucccccaaaugaguucgguauuuuuaacucucugugguucucauuaggcgccuuuaugcagcaggggugcgacaucaguccuagaagccuguccggaaggauugugggcgguguguggugguucuuuacgcuaaucauaaucucuucguauaccgcaaaucucgccgcuuuccugacagucgaacgcaugguuagccccauugaguccgccgaagaccuugcaaaacagacugagaucgcguacgggaccuuggacucaggcaguacaaaggaauuuuuccgacggucuaaaauugcuguguaugagaagauguggagcuacaugaaguccgccgagccaucaguguuuacuaaaaccacagcagauggaguagcccgugucagaaagagcaaaggcaaguucgcuuuccugcucgaaucuaccaugaacgaguauaucgaacaaaggaaacccugugacacuaugaagguugggggaaaccuggauuccaaggguuacggcguugccacgccuaaagggagugcacuuggaaaugcugugaaccuggccgucuugaagcucaaugagcagggccuguuagacaaacugaagaacaaauggugguaugauaagggugaaugcgggagcggcggaggcgacucuaaggauaaaacauccgcgcuaucacucaguaauguggccgggguguuuuacauacuggugggaggccuugguuuggcuaugaugguagcacugauugaguucuguuacaagagccgcgccgagucgaaacggaugaagcucaccaaaaacacucagaauuuuaagccagcuccggccaccaacacacaaaauuaugcaaccuacagagaaggguauaacgucuacggaacugaguccgugaaaaucuga

SEQ ID NO: 56945 - RNA, 2655 nt, Artificial Sequence
  derived and/or modified sequence opt3 from GRIA4__Homo_sapiens__NP_001070711
augagaaucauuagcaggcagauagugcuccuguucuccggcuuuugggggcuugccaugggagcuuuccccucuucaguccaaaucgguggccuguuuauucggaacaccgaccaggaguacacagcauuccgcuuggccaucuuuuuacacaauacgaguccuaacgcgagcgaagcuccauucaaucugguuccgcauguggauaacauugagacugccaauuccuuugcaguaaccaacgccuucugcucucaguauucgcgagggguguuugcuaucuucggacuauacgacaagcguucaguccacacacucacuagcuuuuguagugcacugcauauaucccuuaucacccccucuuucccuacagaaggcgagagccaguuugugcugcaauugagaccaucccucaggggugcccugcugucacucuuagaucacuaugaauggaauugcuucguuuuccuguacgacaccgaucggggguauaguauucuucaggcuaucauggagaaagccggacagaacggcuggcaugugagcgcgauuugugucgagaauuuuaacgacgugucuuaccgccaguugcuggaagaacuagauagaaggcaagaaaagaaauucguaaucgacugcgagauagagcggcuccagaauauucuggaacagaucguuuccgugggcaagcacgucaaaggguaucacuacauuaucgcaaaccuuggauuuaaggauaucucacuggagcgcuucauucaugguggcgccaaugugacuggguuucaguugguggacuucaacacacccauggucauaaagcucauggaucgauggaaaaagcuggaccaaagagaauacccuggaagcgagaccccacccaaauauacgagugcuuuaacuuacgauggcguucuggugauggccgaaaccuuuaggucucuccggcgucagaagaucgacauuucccgcagagguaaugcaggggacugucuugcuaacccugccgcgccauggggacagggcaucgauauggagaggacacugaaacaaguacggauacagggcuugacugggaacgugcaguucgaccacuauggacgacgcgucaauuacaccauggauguguuugagcuaaagagcacagguccgagaaagguuggcuauuggaacgacauggauaaacuggugcucauucaggacguccccacccuggggaaugauacggccgcaaucgaaaacaggacugugguaguuacaaccaucauggagucgccuuacgugauguauaagaaaaaucaugaaauguucgagggaaacgacaaguacgaaggcuacugcgucgaucuugcuucugagauugccaaacacaucgguauuaaguauaaaauagcuaucgugccagacgggaaguacggcgcccgggaugcagacacuaagauuuggaauggaauggucggcgagcugguguaugggaaagccgaaaucgcuaucgcgcccuugacaauuacccucguucgcgaggaagugauagacuuuuccaagccuuucaugucacugggaaucaguauuaugaucaaaaagccacagaaaagcaagcccgguguauuuuccuucuuagauccgcuggcauacgagauuuggauguguaucgucuucgccuauauaggcgugucuguugugcuauuucucgucagcagauucucaccuuacgaauggcacacggaggagcccgaagacgggaaggagggaccaagugaucaaccucccaacgaauuuggcaucuucaauucccugugguuuagccuuggugcuuucaugcagcaggggugcgacauuucuccaaggucauugaguggccguaucgugggaggcguauggugguuuuucacccugauuaucauaagcuccuauacagccaaccucgcagccuuucugacuguggagcggaugguuucucccauugagucggcugaagaucuugccaaacaaaccgagaucgcauacgggacacuggacagcggauccacuaaggaguucuuucgaagaucaaaaauugcggucuacgagaagauguggaccuauaugaggagugcugaaccuucuguguucacacgcaccacugccgaggguguggcacgggucagaaaaagcaagggcaaguuugccuucuugcucgaguccacgaugaaugaauacaucgagcagaggaaaccaugugauacaaugaagguugggggaaaccuggacucaaaaggcuaugguguggcuaccccgaaggggagcucuuuaggcaaugccgugaaccuggcaguacuaaaacucaaugaacagggacugcuugauaaguugaagaacaaauggugguacgacaagggcgagugcggguccggaggcggugauaguaaagacaagacuagcgcucugucucucuccaacgucgccgggguguucuauauacugguuggaggcuuaggucuggcgaugcuuguggccuugaucgaauuuuguuacaaaucacgcgcugaggcaaagcgaaugaaagucgccaagagugcucagaccuucaaucccacaagcucgcaaaacacccagaaucucgccacuuaucgggagggcuacaacguguacgggacagaauccauuaagaucuga

SEQ ID NO: 56946 - RNA, 3030 nt, Artificial Sequence
  derived and/or modified sequence opt3 from GRID1__Homo_sapiens__NP_060021
auggaggcccugacccucuggcuucugcccuggaucugccagugugugagcgucagagcugacuccauuauacacaucggcgcaauuuucgaagagaacgccgcgaaggaugacaggguuuuucaauuggcugugucugauuuaucacugaaugacgauauccuacagagugagaaaauuacauacagcaucaagguaauagaggccaacaauccuuuccaggcagugcaggaagccugcgaccucaugacucaagggauccuggcucuugucacguccaccggaugugcaucugccaacgcucugcagucguugacagaugccaugcauauuccacaccucuuugugcagcggaauccggguggcucaccccgcacugcgugccaucugaacccuagcccagacggggaggcauauacccuggccagucgacccccuguucgucucaaugaugugauguuaagacuggucacagagcuuagguggcagaaauucgugauguuuuacgacuccgaauaugauauccggggauugcaaucuuuccuggaccaggcuagccgccuaggccucgauguaucccugcagaagguugacaaaaacauuucacacguguuuaccagucuuuucacuacaaugaagaccgaggaacugaauagauacagggacacguugcggcgcgccauccuccuguuaagcccacagggugcacauucuuuuauaaacgaggcugucgagacuaaucuggccuccaaggauucacacuggguguucgugaacgaagagauuagcgaccccgaaauccucgaucuuguccacagugcgcuggggcgaaugaccguugugagacaaauuuuuccuucugccaaagacaaucagaaguguacaaggaacaaucaucggaucuccagcuugcuaugcgauccacaggagggauaucugcaaaugcuccagaucucgaaccuguaccuuuaugacucuguacugauguuggcaaacgcuuuccaccguaaacucgaagaucgcaaguggcauuccauggccucacugaauuguauuagaaaaaguacuaagccguggaacggcggcaggagcauguuagacaccauaaagaaagggcacaucacaggacugaccggugugauggaguuucgggaggauuccucuaaucccuacguccaguucgaaauucuaggcacgacuuacagcgagacauucgggaaggacaugcgaaaacucgcuaccugggauucagaaaagggacugaacggcagucuucaggagcgcccuauggguuccagauugcaagggcugacucucaaagugguuacagugcuggaagaaccauuugucaugguggccgagaauauccuuggacagcccaagagguauaaaggcuucagcauagacguacuggacgcauuggccaaggcucucggcuuuaaguacgaaauuuaucaggcgccugaugggcgguacggacaccagcugcauaacaccucuuggaaugguaugaucggcgaguuaaucucaaaacgcgcagaccuggccauuagugcuaucacgauuaccccagaaagagagagcguuguggauuucuccaagagguauauggacuacucugucgggauacuaaucaaaaagcccgaagagaaaauuucgaucuuuagccucuucgccccguuugauuucgcagugugggccugcaucgcugccgcaauuccugucgugggaguucugauauuugugcuuaaccguauccaagcgguacgggcucaguccgccgcacagccccgaccaucagccagugcuacauugcacucugccauuuggaucgucuauggcgcauucgugcagcaagguggggagagcuccguuaauucaauggcuaugagaauugugaugggcagcugguggcuguuuacucucaucgucuguucuuccuacaccgccaaccuggcggccuucuuaacagugaguaggauggacaauccuauacgcacuuuucaggaucugagcaagcagguagaaaugucuuacggaaccgugcgggacuccgcuguuuaugaguacuucagagcaaagggcacaaacccccuugaacaggauucaaccuucgccgaguuguggaggacuaucaguaaaaaugggggagcugacaacugcgucagcucgccauccgaggguauucgcaaggccaaaaagggcaauuaugcauuucucugggauguggcgguggucgaauacgccgcucugacggacgaugacuguucuguuacagugaucgggaacagcauuucaaguaaaggauauggcaucgcccuacaacaugguucccccuaccgagaccuguucucucagcggauacucgagcugcaggauaccggggaccuugauguguugaagcaaaagugguggccucacaugggccguugcgaccugacuagccaugcauccgcucaggccgauggaaaaucauuaaagcuccacagcuuugcaggcguauucugcauucuggccaucgggcuucuguuggcuugucucgucgcggcccuggaacuaugguggaacaguaauagaugccaccaggagaccccaaaagaagacaaggaggugaaccuggagcagguucauaggcgcaugaacucucucauggaugaagacauugcacacaaacaaaucuccccggcuagcauagagcugucggcccuugaaaugggagguuuggcccccacacagacccuggagccuacucgggaauaucagaauacacaguuaucagugucuacguuucucccagagcaaaguucccauggcaccagcagaacucugucuagcgggcccuccucaaaucuuccucugccacuaaguagcucugcuacaaugcccuccaugcaguguaagcacaggucaccgaacggaggccucuuccgacagaguccugucaagaccccaauccccaugagcuuucagccugugcccggugggguucugccagaggcauuggauacaucccacggcacuucuauuuga

SEQ ID NO: 56947 - RNA, 2739 nt, Artificial Sequence
  derived and/or modified sequence opt3 from GRID2__Homo_sapiens__NP_001273767
auggagguguuccccuuucugcucguccuuagcguuuggugguccagaaccugggacucugccaacgcugauucaaucauucacauaggcgcaaucuucgacgaaagugccaagaaagaugacgagguguuuaggacagcgguaggggaucugaaucagaacgaagagauuuugcaaacugaaaagaucacguucagcgugaccuuugucgacggaaauaacccuuuccaggcugugcaggaggauauucgggguauccaggaguuuuuagacaaaguuucccaacagggcauggauguggcccugcagaaggucgaaaauaacauaaauaaaaugaucacaacucuauucgacaccaugcgcauugaggaacucaaccgauaccgugauacacugagaagggcaauccuugugaugaauccagccaccgcuaagucuuuuauuacugagguaguugagacaaaccugguggcauucgacugccauuggaucauaauuaaugaagagaucaacgaugucgacgugcaggaauuggugcggcgcucgauugggagacucaccaucaucaggcaaacguuuccggucccccagaauauuucacagcgguguuuccgcggaaaccaccgaauaagcaguacucugugcgacccuaaggauccauuugcccagaauauggagaucuccaaccuguauauuuacgacaccguucucuuacuggcuaacgccuuccauaaaaaguuggaagauagaaaauggcacucuauggcgagccuuuccuguaucaggaaaaauucaaagcccuggcaaggcggucggaguaugcuggagacaauaaagaaagggggagugagcggccuaacuggcgagcucgaguucggggaaaacggagguaauccuaacguacauuuugaaauucugggcaccaauuauggggaggaacuuggacguggcgugcgcaagcuggguugcuggaacccagucacaggguugaauggaucucucaccgacaagaaacuggagaacaauaugagaggcgugguuuuaaggguggucacggugcuggaggaacccuucguaaugguuuccgagaacgugcucggcaagccuaaaaaguaccagggguuuucaaucgauguccuugacgcacugagcaauuauuugggauucaacuacgaaaucuauguggccccagaucacaaauacgguaguccgcaggaggacggcacuuggaaugggcuagucggagaacugguguuuaagcgggcugauauuggcaucucugcccucacaauuacccccgaccgagagaacguuguggauuucacuacacgcuacauggacuauuccguagguguccugcuuagaagggcagagaagaccguggacauguuugcuugucuggccccuuucgauuugagccucugggcgugcauagccgggacgguucuguuagugggccugcuagucuaccuccugaauuggcuuaacccaccccgguugcaaaugggaucgaugaccucuacaacucuguauaacuccaugugguuuguguacggcucauucguacagcaagggggagaagugccuuauaccacacucgcaacucgcaugaugaugggugcuugguggcuguuugcccuuaucguuauuaguagcuacaccgcuaaucuggccgcauucuugacaaucaccagaaucgaguccucuauucagagccuccaggaccugucaaaacagacugaaauaccauauggcacggucuuagauagugccguguacgagcacgugaggaugaaggggcugaaccccuuugagcgugacuccauguacagccagauguggcggaugaucaaucgaucuaacggaucagaaaauaacguccuagagagucaggcuggcauucaaaaaguuaaguaugguaauuacgcguucgugugggaugcagccgugcucgaauauguagcuaucaacgacccggauuguagcuucuacacaauugggaauaccgucgccgacagaggcuauggaaucgcacugcagcauggcuccccuuacagggauguguuuucucagcgcauacuugaguugcagcaaaacggggacauggauauccugaaacacaagugguggcccaagaauggacagugcgaccucuauucgagcguugauacuaaacagaaggguggcgcccuggacauuaaauccuucgcugggguguuuuguaucuuagccgcaggaauuguccugucaugcuucaucgcgaugcuugaaaccugguggaacaagcggaaaggcaguagagugccaucuaaggaggacgauaaggagauagacuuggaacaucuccacaggcgcguuaauagccuguguacagaugacgauuccccucacaaacaguuuucaaccagcucuauugaccuaacuccccuggauaucgacacacucccaacgcgacaagcucuggagcagauuuccgauuuccggaacacccauaucacuacaaccacauuuauacccgaacagauccaaacucuuagucguaccuugagcgccaaggcagccucugguuucacguuugggaaugugccugagcacagaaccggcccauucaggcaucgcgcuccgaacggaggcuuuuuccggucccccauuaaaacaaugucaaguaucccuuaccagccaacucccacccugggguuaaaccucggaaaugacccugauagaggcacaagcauuuga

SEQ ID NO: 56948 - RNA, 2757 nt, Artificial Sequence
  derived and/or modified sequence opt3 from GRIK1__Homo_sapiens__NP_000821
auggagcacggcacccugcucgcccagcccgggcuuuggacaagagacacuagcugggcucuguuguacuucuuaugcuauauccugccucaaacggcaccacaggugcuaaggauuggagguauauuugaaaccgucgagaacgaaccgguuaauguggaggaacucgccuucaaguuugcgguaacauccaucaaccggaaucgcacucugaugcccaacaccacacuuaccuacgauauucagcgaaucaaucuguucgacucuuuugaggcuucacguagagccugugaucaguuggcacucggcguggccgcucuguucgggccuagucauagcuccucugucucggcagugcaaucaauuugcaacgcccuggagguuccacacauccagacuagguggaaacaucccagcguggacaauaaggaucucuuuuauauaaacuuauacccugacuaugcugccaucagucgggcgauucuggaucuugucuuguacuauaauuggaaaacagugaccguaguuuacgaagacuccacgggacugauccgccuacaggagcucauuaaggcaccaucuagauacaacaucaaaauaaagauuaggcagcugcccagcggcaauaaggaugccaaaccucuucugaaggaaaugaaaaaggguaaagaguucuaugugaucuuugacuguucccacgagacugcugccgaaauuuugaagcaaauccucuucauggggaugaugaccgaguacuaucauuacuuuuucacaacucuggauuuauuugcacuggaccucgaacuuuaucgguacucaggagucaacaugaccggcuuccgccuguugaauaucgauaacccacacgugaguagcauuauagagaaguggucuauggaacgacuacaggcuccgcccagaccugagacaggccugcucgacgggaugaugaccacggaggccgcgcugauguaugacgccguguacauggucgcaaucgcuucccacagggccucacagcuuacuguuagcagucugcagugccaucggcacaaaccauggcguuugggaccccgcuucaugaaucucauuaaggaagcuagaugggauggucugacaggccauaucaccuuuaacaaaacuaacggguuaaggaaggacuucgaucuggacauaauuucucuaaaagaggaaggaacagagaaggccgcaggcgaaguguccaaacaccucuacaagguauggaagaaaaucgguaucuggaauagcaacucggggcugaauaugaccgauucuaacaaggacaaauccucaaauauuacggauagucuugccaaccggaccuugaucgugacaacuauucuggaggagccuuaugucauguaccgaaagagcgacaaaccacucuauggaaaugaucgcuuugaaggcuacugucuggaccuucugaaggaguuguccaacauacucggcuucaucuaugaugugaagcugguucccgacgggaaauacggagcucaaaaugacaagggugaauggaacggcauggugaaagaguuaauugaucacagagcggaccuggcagucgccccgcuaaccaucacauaugugagggaaaagguaaucgauuuuucuaaaccuuucaugacucucgggauuagcauacuguaccggaagcccaauggaaccaacccaggcguguuuucauuccuuaauccuuugagucccgacaucuggauguacguucugcucgcuugccugggugucuccuguguguuauuugucauugcccgcuucacaccauaugagugguacaacccccauccuugcaauccagauagcgacgugguugagaacaacuuuacccugcuuaauucuuucugguuuggggugggcgcauugaugcagcagggaucagaacucaugccgaaggcccugaguacuagaaucguaggcgggauuuggugguucuucacgcuaaucauaaucagcuccuauacagcuaaccuggccgcauuucucaccgucgagaggauggaaucucccauugauucggcggacgaucuggcuaaacaaacuaagaucgaguacggagccgugcgugacgguagcaccaugacauucuuuaaaaaguccaaaauuucaaccuaugagaagaugugggcauucaugaguucucggcagcagacugcccuuguucgaaauagcgaugaaggcauccagagaguguugacaacggacuacgcucuguuaauggaguccaccucaauagaauaugucacucaaaggaacuguaaucucacacagauugggggacugaucgauagcaagggcuacgguguggggaccccuauuggcucuccauaccgcgacaaaaucacaauagccauccuucagcugcaggaggaaggaaaguugcacaugaugaaagagaagugguggcggggcaacgggugccccgaggaagacaauaaagaggcauccgcucucggaguagaaaacauugguggcaucuuuauugugcuggccgcggggcuaguucugagugucuucguggccaucggagaguuuauauauaagagcaggaaaaauaacgauauugaacaggcuuucugcuuuuucuacggccuccaauguaagcagacucauccuaccaauucuacguccgguaccacacugucaacugaccuugagugcgggaaguugaucagagaggaacgcggcauccgaaaacagaguagcgugcacaccgucuga

SEQ ID NO: 56949 - RNA, 2727 nt, Artificial Sequence
  derived and/or modified sequence opt3 from GRIK2__Homo_sapiens__XP_005267002
augaagaucauuuuccccauacugagcaacccuguguuuagaaggaccgucaaacuccuucugugcuuguuauggaucggcuacucccaggggacaacucacguucugcgguucggagguauuuuugaguauguggaaucuggcccaaugggggccgaggaacuagcuuuccgcuuugcaguaaauacgaucaaccgaaaucguacccuccugccgaacacaacucuuaccuacgacacacaaaagauuaaucuguaugauucauucgaggccaguaaaaaggcgugugaccaguugagccucggaguggcugccaucuuuggccccucccauucuucgucagcaaacgccguccagagcauaugcaaugcucugggugugccucacauccagaccagauggaaacaucaaguuagugauaacaaggacuccuucuacgugucucuguauccagauuuuagcucccucucaagggcaauuuuagaccugguccaguucuuuaaguggaaaacugugacaguaguuuacgaugacaguaccgggcuuauccgguugcaggaacugauuaaggcccccagccgcuauaaucuaagacucaaaaucaggcagcugccugcugauacgaaggacgccaaaccacuucugaaggagaugaagcggggaaaagaguuccacgugauauuugauuguucucaugaaauggcggcaggcauuuugaagcaagcccucgcuaugggcaugaugacugaguacuaccacuauaucuucaccacacuggacuuauucgcccuggaugucgaacccuaccgcuauuccggggugaacaugacuggauuucgaauuuugaauaccgagaacacacaggugucaagcaucaucgagaaauggaguauggaaagacuucaggcaccuccaaagccggacucuggucuguuggacggcuucaugaccacggaugcugcccuaauguacgacgcgguccacguuguguccguagccgugcagcaauuuccccagaugacugucagcucgcugcagugcaauaggcauaaaccuuggcgguucgggacacguuuuaugucucucauuaaggaggcacacugggaaggacugaccggccgcauaacuuucaacaaaacaaauggucuuagaaccgauuuugaccuggaugugaucuccuugaaggaggaagggcucgagaagauuggaacgugggacccagcuucaggccugaacaugaccgagagucaaaaaggcaagcccgccaacaucacagauagcuuauccaauaggucucugauaguuacuaccauucuagaagaaccuuauguccucuucaaaaagagcgacaaaccacuguacgggaacgaucgguuugaaggauauuguaucgaccuuuugcgagagcugucaacaauccucgguuucacuuacgaaauucgccugguggaggauggcaaguacggggcucaggacgacgccaauggacaguggaacggcauggugagagagcuuaucgaucauaaggcagaccuggccguagcucccuuggcgauuaccuauguuagggaaaaagugauagauuuuaguaagccguucaugacacucgguaucuccauucuguaccggaaaccuaaugggaccaaccccggcgucuuuagcuucuuaaauccacugucuccugacaucuggauguauauccuacucgcauaccugggagugucaugcguccuuuucgugauugcccgcuuuagucccuaugagugguacaacccacaccccuguaauccugauagcgacguuguggaaaacaauuucacuuugcugaacuccuuuugguucggcguaggggcucucaugcagcaaggaucugagcugaugccaaaggccuuaucgacgagaauagucgguggcaucuggugguuuuucacacugauuaucauuagcuccuauaccgcaaaucuugccgcuuuucucacuguggaaaggauggagucaccgaucgauagugccgacgaucucgcaaaacagaccaagauagaguacggggcgguugaagacggagcuacaaugaccuucuuuaagaaaucuaagaucagcacuuacgauaaaaugugggccuucauguccucacgucggcagagcgugcuggucaagucuaacgaggaaggcauucagcgagugcuaacauccgacuaugcauuucugauggagaguacgaccaucgaguucguaacucaaagaaauugcaaccucacacagauuggugggcugaucgauagcaaaggcuacggagugggcacccccauggggucuccuuauagggacaagauaacaauugccauccuucaguugcaggaagagggaaagcugcacaugaugaaagaaaagugguggcgcgguaacggcuguccagaggaagaguccaaagaggcuucagccuuagggguucaaaauauuggaggcaucuuuauaguccucgcagcuggucuggugcuuaguguguucgucgccguuggggaguuccuguacaagagcaaaaagaacgcgcaguuggagaaacggucguuuugcuccgccaugguggaggaacucagaaugucucugaagugucagaggcgccuaaagcauaaaccccaggcuccugugaucguaaagacugaagaggucauuaauaugcacaccuucaacgaccgacggcugccaggcaaagagacgauggcauga

SEQ ID NO: 56950 - RNA, 2871 nt, Artificial Sequence
  derived and/or modified sequence opt3 from GRIK4__Homo_sapiens__NP_001269399
augcccagagugagcgccccucugguccuccuuccagcuuggcugguuaugguggcaugcuccccgcacucuuugaggaucgccgcgauuuuagacgaucccauggaguguucacggggcgaacgccugaguauaacccuagcuaagaaccgaaucaaucgugccccugagagacucgggaaagcaaagguagaaguggacauuuucgagcugcuuagggauagcgaauacgagacagccgagacuaugugccagauccugccaaaaggagucguggcuguuuugggucccuccucuucgccugcaucaagcaguauuaucuccaacauauguggcgaaaaggaggugccacauuuuaaagucgcccccgaagaguucgugaaguuucaauuccagcgguuuacgacccucaaucugcacccuucuaacacagacaucagcguagcuguugccgggauucugaauuucuuuaacugcacuaccgcgugucucaucugcgcaaaggccgaguguuuacugaaucuugaaaaauugcugcgccaguuccuaauuuccaaggauacacucucagugagaaugcuggacgauaccagggacccaacuccgcuucugaaagagauccgggaugacaagacagcuaccauaauuauccaugccaacgcaaguaugagccacacgauuuugcucaaagcugccgaacugggaauggucucugcguauuacacuuauaucuuuaccaauuuagaguucucccugcagcgcauggauucacucguggacgaucgagugaacauccuuggcuuuagcauuuucaaucaaagucaugccuuuuuccaggaguucgcacagucucugaaccaguccuggcaagaaaauugcgaccacguccccuuuacagguccugcuuugagcucggcccuacuguucgacgcuguuuacgccgugguaacugcagugcaggagcucaacagaucucaggaaauaggggucaagccacuguccuguggaucagcccagaucuggcaacacggcaccagucuuaugaauuaucugaggaugguggaguuggaaggccucacagggcauauugaguuuaacagcaagggacagcgguccaacuacgcucugaaaaucuuacaguucacccguaaugguuuucgccaaauaggccaguggcacguugcggaagggcugucuauggauagccaucuauaugcaucaaacauuagugacacucucuucaauacgacacugguggucaccacuauccuugagaaccccuacuugaugcugaagggaaaucaccaggagauggaaggcaacgauagauacgaggguuuuugcguggacaugcucaaagaacuggccgagauccuuagguucaauuauaagauucggcugguaggggauggaguuuacggcgugccugaagcuaacggcacauggaccgggauggucggagaguugaucgcccgaaaagcagaccucgccguggcuggucugacgauuaccgccgagcgcgaaaaggucauagauuuuuccaaaccauucaugacauuaggcaucagcauucuguauagagugcacauggggaggaagcccggauacuuuucuuuccuagacccguuuucaccuggcguuuggcuguucaugcuccuugcauauuuggcggugaguuguguacuguuccucgucgcucggcugacucccuacgagugguauagcccacauccuugcgcccagggucgcugcaauuuacuggugaaccaauacucccuuggcaauucuuugugguuucccguugggggauucaugcagcagggcucgaccaucgcaccaagagcccucagcacaagguguguguccggggucuggugggcuuuuacucugaucauuauaucaaguuacaccgccaaccuagcagcuuuccugacagugcagcguauggauguacccaucgaaucuguggacgaucucgccgaccaaaccgcgauugaguauggaacuauccacgguggcagcuccaugacguuuuuccaaaauucacgguaccagacauaucagcgaauguggaacuacauguauagcaagcagccuucuguuuuugucaaauccaccgaggaagggauugccagagugcugaauaguaacuacgcuuuccuuuuggagagcacuaugaacgaauauuacaggcagcgcaauugcaaccugacccagaucggaggcuuacucgacacaaaggguuacgggauaggcaugccagugggaucugucuuucgggaugaguucgaccuggcaauccuucagcugcaagaaaauaacagauuggagauucucaaaaggaaguggugggagggcgggaaauguccgaaggaagaggaucaucgcgccaagggacuggguauggaaaauaucggcgggauuuuuguugugcuaaucugcggacugauaguggcuauuuucauggccaugcucgaguuucuguggacccuucgacacuccgaagcaacugagguaucagucugucaggagauggugacagaauugcggaguaucauucugugccaggacagcauccauccccguagaaggcgcgcggccguuccuccaccccggccuccaauacccgaggaaagaaggccgcgaggcacggcuaccuuaucgaacgguaaacucuguggggccggcgagccugaucaacuggcacagcgccuugcucaggaagccgcacugguggcccggggaugcacucacaucagagucuguccagagugcaggcguuuccagggccuacgcgcucggcccuccccugcgagaucugaggaaagccucgagugggaaaagacaaccaauucaagugagcccgaguga

SEQ ID NO: 56951 - RNA, 2946 nt, Artificial Sequence
  derived and/or modified sequence opt3 from GRIK5__Homo_sapiens__NP_001287959
augcccgccgagcugcuccuucuguugaucguggcuuucgcaagcccuuccugccaggucuuaucuucacugagaauggccgcgauucuagacgaucaaaccguuuguggcaggggagaacggcucgcucuggcccuugcacgcgagcagauaaacgggaucauugaagugccagccaaggcucgaguagagguggacaucuuugaacugcagcgugauagucaguacgagacaacugacacgaugugccaaauuuugccgaaaggugucgugagcguucucggccccuccucuucgccugcaucagccagcaccgugagucacaucuguggggagaaggaaauaccacauaucaaagucggacccgaggaaacaccuagacugcaguaucugagguucgcuuccgugucucucuacccaagcaaugaggauguauccuuagccguuucacggauucugaagaguuuuaacuaucccagcgcgucucuuaucugcgcaaaagccgaguguuugcugcgccuagaagaacucgugagaggcuuccugauuuccaaggaaacucuuucagucaggaugcuggacgauagccgggacccuaccccauugcucaaggagauccgcgaugacaaagugaguacaauaauuaucgaugcuaaugccucuauuucccaccugaucuuacgaaaggcaagcgaacuggguaugaccucggcuuuuuacaaauauauccucacuacaauggacuucccgauucuucaucuggaugggauaguggaggacucuuccaacaucuugggauuuucaauguucaauaccagucaccccuuuuacccugaguucgucagaagccuaaacauguccuggagggaaaauugcgaggccucuacguaucugggcccagcgcucagcgccgcacugauguuugacgcuguucaugugguagugucagccguccgggaacuuaaccguagucaggagauuggcgugaagccccuggcuuguacuuccgccaauaucuggccucacgggaccagcuugaugaacuaccuccgcaugguugaauacgauggacugacagguagaguggaguucaauucuaaaggccagaggacuaacuauaccuuacggauacuggagaagucacgacaagggcaccgcgaaauuggagucugguacaguaauagaacacuagcaaugaacgccaccacgcucgacaucaaucugagccagacucuugcuaacaagacauuggugguaaccacuauccuggagaacccauauguuaugaggcggcccaauuuucaggcgcucuccggcaacgaacgcuucgaggguuucugcguggauaugcugagagaacuugcagagcuguugagguuucguuaccggcuccgacuggucgaggacggguuauauggagccccggaaccuaauggcucuuggacaggcauggugggggagcugauuaacagaaaagcugaucuagccgucgcagccuucaccaucacggcugaaagggagaaggugauugacuuuucgaaacccuucaugacccucggaauaagcauccuguaccgcguucauaugggucggaagccaggcuauuuuuccuuccuugauccuuuuucacccgccgugugguuguucaugcugcucgcauaccuggcgguaaguugugucuuauuucuggcugccagacuuucuccauacgagugguauaauccccacccuugcuugagggcacgcccacauauucucgaaaaccaguacacacuggggaauagccuaugguucccggugggaggcuuuaugcaacaggguuccgagaucaugccccgagcccugucaacucgguguguuagcgggguguggugggcuuucacccucaucauuauaucuuccuauacagccaaccuggcagcuuuucuuacuguccagcguauggaagugccuguagagagugccgacgauuuggcggaccaaaccaauaucgaauacggcacaauucacgccggaagcaccaugacuuucuuccagaacucuagauaucagacguaccagaggauguggaauuauaugcaauccaaacagccaucaguguuuguuaagaguacagaggagggcaucgcucgcguccugaacagccgguacgcauucuuacucgaaucgaccaugaaugaguaccacagaaggcugaacugcaaucuuacucagauugggggacuguuggauaccaaagguuauggcaucgggaugccccucggauccccuuuucgagacgaaauaacacuggccauccuacagcugcaagagaacaaccgccucgaaauucugaagcggaaguggugggagggcgguagaugcccaaaagaggaagaccauagggcuaaggggcuuggcauggagaauaucggaggcauuuucaucguguugauaugugggcugauuaucgccguguuugucgcaguuauggaguucauuuggucuacccgucgcagcgcggagucagaagagacucccgccuuacacccggcugccugccaguguagugcacucggaccucggacaccacugaaagagcccuccaugcuucuggugaaggugccuucuacgagaguacaggucgcuuuuagcaggaccucccuacgacaggugugccccuuccuccugcaacaucaguugucaagccuguacuggauccaggccacuaacguucagauauguugccacuuuaguucuuuaaaaccauccccugaucucacauuucccccaagccaucggccgcugucgucacuucuguucaccgcauuggccgcuguggguggccucccugacgcgucuaguuucuuuuucccacccaucuccagcugucccccucugcaaucugggauuggaccaugccacagcacagaagccacucuagucaccuccaauuuccacguguga

SEQ ID NO: 56952 - RNA, 2658 nt, Artificial Sequence
  derived and/or modified sequence opt3 from GRIN1__Homo_sapiens__NP_000823
augagcaccaugagacugcucacacuugcccuguuguucuccugcucuguggcuagggcagccugugaccccaagaucgucaacauuggcgcgguuuuaucaacucggaaacacgagcagauguuucgcgaagcugugaaucaagccaacaagcgacaugggaguuggaaaauacagcugaaugcaacgagcguaacccacaagccuaacgccauccagauggcucuauccgugugcgaggaucucauuucuucgcaggucuacgcaauccuggugucacauccaccgacacccaaugaccacuucacuccuaccccaguuagcuauacagccggauuuuaccguauucccgugcuuggucugaccacuagaaugaguaucuauuccgauaaaucuauacauuugagcuuccucaggacagucccuccauacucccaccaaucaagugugugguuugaaaugaugcggguauauagcuggaaccacaucauucugcugguuucugacgaucaugagggccgcgcugcccagaagagacucgaaaccuuacuggaggagagggaauccaaggcggagaaagugcuucaguucgaccccgggacgaagaaugucacugcauugcugauggaagccaaagagcuagaggcucgggugaucauucucucagccagcgaagaugacgcagcuaccguguaccgcgccgcggccaugcugaacaugacaggaaguggcuaugucuggcuuguuggugagcgagaaaucucugggaaugcacugagauacgcuccugauggaauauugggccuccagcugauuaacggcaagaaugaguccgcccacaucagcgacgcuguggggguaguggcccaagcaguccaugaauuacuggagaaagagaacauuacugauccaccgaggggauguguggguaauaccaacaucuggaagacaggcccccucuuuaagcggguucuuaugucgucuaaauacgccgacggggugaccggacgugucgaguucaaugaagauggcgaccgcaaguuugcuaacuauuccaucaugaaccugcagaauagaaaauuggugcagguagguauuuacaacgggacgcacguuauaccuaaugacaggaagaucauuuggccaggaggcgaaacugagaaaccccggggcuaucagaugucaacacgacuaaagaucgugaccauacaccaagaaccuuucgucuacgugaaaccaacucugagugaugggacaugcaaggaggaguuuaccgucaacggagaccccgugaagaaaguuauuuguacggguccgaaugauaccagcccuggcucuccccgccauacagugccacagugcuguuauggguucugcaucgaccuccugaucaaacuugcgagaacuaugaacuuuaccuacgaaguacaccuggucgcagauggaaaguucggcacacaggagagggugaauaacuccaauaagaaagaauggaacgguaugaugggggaguugcucagcggccaagccgacaugauuguugcuccucugacuaucaauaacgaacgggcccaguauauugaguucucaaagcccuuuaaguaccagggauuaaccauacuggugaaaaaggagaucccacgcaguacacuagauuccuucaugcagcccuuucaaagcacccucuggcugcuugucggcuugucugugcauguaguggcaguuaugcuguaccuccuggacagauucucaccuuuugggagguucaaagucaauagugaagaggaagaggaggaugcccuuacucugagcuccgcuaugugguuuucuuggggaguguugcucaacucggguauuggcgaaggggccccacguagcuucuccgcacggauccugggaauggugugggcgggcuuugcuaugaucauugucgccucauauacggcaaauuuagccgcuuuccugguucuagaccgaccggaggaaagaauaacagguaucaacgaucccaggcuccgcaacccuagugacaaguuuauuuacgccaccgugaaacagucuagcguggacaucuauuuccggagacagguagagcuguccacuauguacaggcacauggaaaagcauaauuaugagucagcagcugaggccauucaggcgguccgcgauaacaaacuucacgccuuuaucugggacagcgcuguguuggaguucgaagcaucucaaaagugugaucugguuaccacaggggaacucuucuuucgauccggcuucggaauaggcaugcggaaggacaguccauggaaacagaaugugagccugucuaucuuaaagucccacgagaacggguuuauggaagaucuggacaaaaccuggguccguuaccaggagugcgauucaagaaguaaugcccccgcuacucuuacauucgagaacauggccggaguguuuauguugguugcggguggcauuguggcagggaucuuccucauuuuuaucgaaauagccuauaagaggcauaaggacgcucgccggaaacagaugcaacuggccuucgcagcuguaaaugucuggagaaagaaccuacagcaguaccacccuacggauauuaccggaccacugaaucucagcgaccccucgguguccacuguggucuga

SEQ ID NO: 56953 - RNA, 4395 nt, Artificial Sequence
  derived and/or modified sequence opt3 from GRIN2A__Homo_sapiens__NP_000824
augggcagagugggguacuggacccugcucguccuucccgcccuguugguuuggaggggaccugcuccaagcgcagccgcggagaaggguccgcccgcuuuaaacaucgccgugaugcugggccacucccaugacguaacagaacgggagcuacgcacucucugggggccugaacaggcagccggacugccacuugaugugaaugucguggcucuguugaugaaccgaacggaccccaaaucucucauuacccacguuugcgaucugaugucaggcgcacguauacauggucugguguucggggacgauacagaccaagaggccgucgcucagaugcucgauuuuaucaguagccacacuuucgugccuauuuuaggaauccauggcggcgccuccaugauuauggcggacaaggauccaaccucuacauuuuuccaguuuggggcaucgauccagcaacaggccaccguaaugcugaaaauaaugcaggacuaugauuggcacguuuucucacuugugacuacaaucuuucccggauacagagaguucauuagcuuugucaagaccacgguggacaauaguuucguggguugggauaugcagaacgucaucacuuuggacaccuccuuugaagacgcuaaaacacaaguucagcugaagaagauucacucuagcgugauccuacucuauuguuccaaagaugaggccguacugauacuuucagaagcaaggagucugggcuugacuggguacgacuucuuuuggauugugccuagccucgucucuggaaauaccgagcugaucccaaaggaguucccguccggcuuaauuucagugagcuaugaugacugggauuacagucuggaagcucggguucgcgacgguaucgggauccucacaaccgccgcgucuuccaugcuugagaaauucagcuauauucccgaagccaaggcaucgugcuacggacagauggagagaccugaagugccaaugcauacgcugcaccccuuuauggucaacgugacuugggauggcaaagacuugucuuucacagaggaaggcuaccagguacauccuaggcuaguugugauaguccugaauaaggaucgggagugggagaagguggggaaaugggaaaaccacacccucucccugcgccacgcugucuggccacgauauaagucauuuagugacugugagcccgaugacaaucaucuuagcaucgugacucuggaagaggccccguucguuauuguggaagacaucgauccuuugacagagaccugcguaagaaacacgguccccuguaggaaauuugugaagauaaauaacuccaccaaugagggaaugaacguuaaaaagugcuguaaagguuucugcauugacauccucaagaagcugucucggacagugaaauuuacuuacgauuuauaucuggucaccaauggcaagcacgggaaaaaggugaacaacguauggaauggaaugaucggcgaagugguuuaccaacgugcugucauggccguggguagccuaacaauuaacgaggaacgcucagagguggucgacuucaguguuccauuuguggaaacugggaucuccgugaugguaagcagaucuaauggcaccgucucaccuagugcauuccucgagcccuuuagcgccuccguguggguuaugauguucgugaugcugcuuauugucucugcuauagcgguguuuguuuucgaguauuucucgccagugggauacaacaggaauuuggcaaaaggcaaggcaccccaugggccuagcuuuacaaucggaaaggcuauuuggcugcucuggggucugguauucaacaauuccgucccagugcagaacccgaaaggcaccacuucaaagaucauggugagugucugggccuuuuucgcaguuaucuuucuugccucuuauacggcuaaucuggccgcauucaugauucaggaagaguuuguggaucaaguaacaggguugagcgacaaaaaguuccagcggccccacgauuacuccccuccauuucgauucggaaccgugcccaacggcucaacugaacgcaauauaagaaacaauuacccuuauaugcaucaguacaugaccaaauuuaaccagaagggugucgaggacgcgcucgugagccugaagacagggaaauuagaugcuuucaucuaugacgccgcaguucugaauuacaaggccggcagggaugagggauguaagcuagugaccauuggcucuggguauaucuuugcuacuacaggauacgguauugcccuccaaaagggcuccccauggaaacggcagaucgaccuggcacuuuugcaguucgucggggauggagaaauggaggaacuggagacgcucuggcugaccggcauaugccacaacgaaaagaacgaggugaugaguagccaguuagacaucgacaauauggcugguguuuucuauaugcuggccgcggccauggcucuuucuuugauuacuuuuaucugggagcaccucuucuacuggaagcugcgcuuuuguuucacaggggugugcuccgauagacccggccuacuguuuucaauuaguaggggaaucuacagcugcauacauggcguccacauugaagagaaaaagaaaucgccggacuucaaccucaccgggucccaaucuaauaugcugaaacuuuugcguagcgccaaaaacaucucaaguauguccaauaugaacucuagccggauggauuccccuaagcgagccgcugacuuuauucagagaggaucacugaucauggauaugguaagcgacaaaggcaauuuaauguauagugauaacaggucuuuccaggguaaggaauccauauuuggggacaauaugaacgagcuccagacauucguggccaaucgccaaaaggauaaccugaauaacuacguuuuucagggacagcauccacuuacucugaaugaaagcaaccccaacaccguggaggucgcagugucgacggagucaaaagccaauucucggccuagacaguuguggaagaaaaguguagacuccaucaggcaagauagccucucucagaaccccgugagccagcgcgacgaagcgaccgcugagaaucgaacacacucccugaagucaccacgguaucuaccugaagagauggcccacagugauauuagcgaaacuucuaaccgugcaaccugucauagagagcccgacaauuccaaaaaccacaagacaaaggacaauuucaaaaggucagucgcuaguaaguacccaaaagauugcagcgagguugaacgcacuuaucugaagaccaaauccucuucgccgcgggacaagaucuacacgauugauggcgagaaggaaccugguuuccaucucgaucccccacaauuuguggagaacgugacacugcccgagaaugucgacuucccugacccauaucaggaucccagcgaaaacuuuagaaaaggcgacucaacccuuccuaugaauaggaacccguugcacaaugaggaagggcuguccaacaaugaucaguacaaguuauacaguaaacauuucacucucaaggacaaaggaucuccacacagcgagacauccgaacgauaucgccagaacucaacccacugucggucuugccugagcaacaugcccacuuacaguggccauuuuaccaugagauccccuuucaagugugaugccugccuuaggauggggaaucuguaugacaucgacgaggaucaaaugcuacaggagacaggaaacccagcaacgggcgaacagguguaccagcaagacugggcccagaauaacgcucuccagcugcagaagaauaaauugcguauaagccgccaacacucuuaugauaacauuguugacaagccccgggagcuggauuuaucaagaccuuccaggaguaucagccucaaagaccgagaacggcugcuugaggguaauuuuuacgggucgcuguucucuguaccguccagcaaguugucaggcaaaaagaguucucucuuuccccagggacuggaagauuccaaacgcagcaagucacuacugccagaccauaccagugauaacccuuuccuucacagccauagagacgaucagaggcucgugaucggucggugucccuccgacccauauaagcacucucugccuagccaagcggucaaugauuccuacuugcgaucaucucugagaaguacugccucguacugcagccgcgacuccaggggccacaacgacguguauauuucugagcauguuaugcccuacgcagcuaauaaaaacaauauguauucaacaccacguguguuaaacagcuguuccaaucggagagucuacaagaaaaugccgaguaucgagucugauguguga

SEQ ID NO: 56954 - RNA, 4455 nt, Artificial Sequence
  derived and/or modified sequence opt3 from GRIN2B__Homo_sapiens__XP_011518932
augaagcccagagccgagugcuguagcccuaaauucuggcuggugcucgcuguccuugcaguuuccggcucuagggcccggucacagaagaguccaccgagcaucgggauugcggugauacugguaggaaccuccgacgaaguggcuaucaaagaugcccacgagaaggacgauuuucaucacuugucugucgugccccgcguugaauuaguggcaaugaacgagacagacccuaaaucgauuaucacucgaauuugcgaucugaugucagaccguaagauccaaggugucguguucgccgaugacacggaucaggaagcuauagcacagauccuagacuuuauuagcgcccagacccucacaccaauccugggcauucaugggggaaguuccaugaucauggcugauaaggacgagucuagcauguucuuucaauucggccccuccauagagcagcaggccucaguaaugcuuaauauuauggaagaguacgauugguauaucuuuaguauuguuacuaccuacuucccugguuaucaggacuuugugaacaaaaucagaagcacaaucgaaaauucuuucgucgggugggagcuggaggaaguguugcuccuggacaugucccuggaugacggagauucaaagauucaaaaccagcucaaaaaguuacagagcccaauaauccugcuuuacuguaccaaagaggaagcgacuuauauuuuugagguggcaaauagugucggcuugacaggcuacggguauaccuggaucguucccucucugguggccggagacacggauacuguaccugcugaguucccaaccggucuaauauccgugagcuacgacgaaugggauuacggccucccggccaggguccgggacgggauugcaaucaucacaacugcugccucggauaugcugucugagcacuccuuuauucccgaaccuaagucaaguugcuauaacacccaugagaagcgcaucuaccagagcaauaugcuuaacagauaucugauuaaugugacauucgaaggaaggaacuuguccuucucugaggacggcuaccaaaugcacccaaaacucguuauaauccuguuaaauaaggaacggaaaugggagcgcguggguaaguggaaagauaagagccugcagaugaaauauuacgucuggccccgaauguguccugagaccgaggaacaggaagacgaccaccucucaauugugacgcuugaggaagcgccauuuguaaucguugagaguguggauccccuguccgggacuugcaugagaaacacagucccgugucaaaagaggaucgugaccgagaauaagacugacgaggaaccuggauauauuaaaaagugcuguaaaggcuucugcauagauaucuugaagaaaauuagcaagucugucaaguuuacauacgaccuauaccuggugaccaacggcaaacaugggaagaaaaucaauggaacguggaacgguaugauuggcgaaguugugaugaagcgggccuauauggcaguagggucacucaccaucaacgaggagcguagugaagucguggauuucagcguucccuuuauagagacaggaaucuccgugauggucucucgcucgaauggcacugugagcccauccgcuuuccuggaaccuuuuucagccgacguaugggugaugauguucguuaugcuucugauugucagugcuguggccguguuugucuucgaguacuuuucucccguugguuauaacagauguuuggcagaugggagggaaccaggcggacccagcuucaccaucggcaaagccauuuggcuccuguggggguuaguguuuaauaacuccgugccuguacagaauccaaagggaacaacuucaaagaucauggucagcgugugggcuuucuucgcgguuauauuucuggcaucuuacaccgccaaccuagcugccuucaugauucaggaggaguauguggaccaggucuccggucucagugauaaaaaguuucaacggccgaaugacuucucucccccuuuucgauucggcacagugccaaacgggagcaccgaacgcaauaucagaaacaauuacgcagagaugcacgccuauaugggaaaauuuaaccagaggggcguugaugacgcucugcuuuccuugaagacugguaaacuggaugccuucauuuacgacgcagcggugcucaauuacauggcugggcgggacgaaggcugcaagcugguaacgaucggaucaggcaaggucuuugccaguacaggguauggaauagcaauccagaaagauagcgguuggaagcgccagguggaccuugccauucugcaauuguucggcgauggggagauggaggaacucgaggcucugugguuaaccggaaucugccauaacgaaaagaaugaggugaugucgucccagcuggacauugauaacauggccggcgucuuuuacaugcuaggugcagcuauggcccucucucugaucacuuucauaugugaacacuuguuuuauuggcaguucagacacugcuucauggggguuuguagcggcaagcccggaaugguguuuucaauuaguaggggcaucuacuccugcauccaugggguagcgauugaggaacgucagucugugaugaacagcccuaccgccacaaugaauaacacccacuccaauauccuucggcugcuccgaacugcuaaaaacauggcaaaucugucaggagucaacggcagcccacaaagugccuuagacuucauuagaagggagucuuccguguaugauauaagcgagcaucgccggucguuuacacacucagacuguaagucuuacaauaaucccccgugcgaagagaaccuguucagugauuauaucuccgaaguugagagaacguuugguaaccuucaguugaaagacagcaauguguaccaggaucauuaccaccaccaucacaggccucauucuauugggagcgcuuccucaaucgacggacucuaugauugugacaacccacccuucaccacucagagucgcagcauuucuaagaagccucuggacaucggccuacccuccucaaaacacagucaacugagcgaucucuacgguaaguuuuccuucaaaucugaccgauauucgggccacgaugaccugauacggagcgaugucucagacaucuccacacauaccgugacauacgggaauauugagggaaacgccgcaaagcguagaaaacagcaguauaaggauagucuuaagaaaaggccagcgucugccaagagccgccgggaauuugacgagaucgaauuggcuuacagaaggcgaccuccccgcuccccagaucacaaacgguauuucagagacaaggagggccugagggauuuuuacuuagaccaauuccguacuaaagaaaauucaccgcauugggagcacguugaccucaccgauauuuacaaggagcgcucugacgauuucaagcgggacagcgugagugggggaggcccuugcacgaacagaucccauaucaaacacgguaccggggauaagcacggagucguaagcggcgugcccgccccaugggagaaaaaccugacaaauguugaaugggaagacaggucugguggcaacuuuugucgaucaugccccuccaaacuucauaauuauaguacuaccgugacagggcagaacagcggacggcaggcauguauacgcugcgaggcuugcaaaaaggccggcaaucuguacgauauuucggaagacaacucuuugcaggagcucgaucaaccugcagccccagucgcugugacuuccaaugcgagcaccacgaaguauccccagucaccuacaaacaguaaagcccagaagaaaaauagaaacaagcugaggcggcagcacucuuacgacaccuucguagaucuacaaaaagaggaagcagcucuggccccgcgauccgugagccucaaggacaaagggagauuuauggauggaucaccauaugcccauauguucgagaugagugcuggcgaaagcacuuuugcaaauaacaaguccucuguccccacagccggucaccaucaccacaauaacccugggggaggcuacaugcugagcaagucccuuuauccagaccgcguuacccagaaucccuucaucccuacuuuuggugacgaucaguguuugcugcauggcucaaaaucuuacuucuuuaggcagccgaccguggcgggggcuaguaaggcccgucccgacuuccgggcauuagugacaaacaaaccagucgugucggcccuccacggagcuguuccugcaagauuucaaaaggauaucugcauuggcaaccagagcaaucccuguguaccaaacaauaaaaacccuagggccuucaauggguccucuaacggacauguguacgagaagcugucaagcauagaauccgacgucuga

SEQ ID NO: 56955 - RNA, 3702 nt, Artificial Sequence
  derived and/or modified sequence opt3 from GRIN2C__Homo_sapiens__NP_000826
augggcggggcccugggacccgcucuccuucugaccagcuuguucggugcaugggccggcuuagggccuggacagggcgagcaagguaugacaguggcggucguguuuuccucuucagggccaccgcaggcucaguucagagccaggcugacuccccagaguuuucuagaccucccucuggaaauccaaccacuuacgguuggaguaaacaccacaaaucccagcucccuguugacucagauuugcggccuccugggcgcagcccacgugcaugggauagucuucgaggauaacguggacaccgaagcuguugcacagauccuggauuuuauuucuucgcagacacacgugccuauccucucaauuagcggagguagugccgucguguuaaccccaaaggagcccggcuccgcuuuccugcaacuugggguaucuuuggaacagcagcugcagguucuauuuaaagugcucgaggaguacgacuggagcgccuucgcggucaucacuucccugcauccuggacacgcacuuuuucuggaaggcgugcgggccguggcugaugccucacaugucaguuggcgcuugcucgacguugugacacuggaguuagguccagggggaccgcgagcacguacccaaagacugcucaggcagcuugaugcucccguauucguggccuauuguagccgggaagaggcggagguccuguuugccgaagcagcucaggccggcuuggugggcccugggcacguuuggcuagugccaaaucuggcucucggaucuacggacgcacccccugccacuuucccagucggucugauauccgugguaaccgagucauggcgccuuagccugagacaaaagguuagggauggcguggccaucuuggcucucggggcgcacaguuacuggcggcagcauggaacacugcccgcaccggccggcgacugccgcguccacccuggucccgugucuccagcucgagaagccuuuuauagacauuuacugaacgucacuugggaggggagggauuucuccuucagcccuggcggauaccuagugcagcccaccaugguugugauugcacucaaucggcaccgucugugggaaaugguaggccgcugggagcacgggguccuuuauaugaaauacccaguguggcccagauauucggccucuuugcagccuguuguggacuccaggcaucugacagucgcuacccucgaggaacggccauuugugaucguagagucaccggaucccggaacggguggcugugugccuaacacuguuccaugccgacgccaaaguaaucacacauucagcuccggggacgucgcccccuacaccaagcuguguugcaaaggauuuuguauugacauccuuaagaagcuggcaagaguggugaaauucucuuacgauuuguaucucgucacuaacggcaagcaugguaaaaggguucgcgggguguggaauggcaugauaggagaaguguacuauaagcgggcggacauggcuauuggcagccugacaaucaacgaggaaagaucagagauuguagauuuuagugucccuuucguggagaccgggaucuccguuaugguggccaggagcaauggaacggucucuccaucagcauuuuuagaacccuacaguccggccguguggguuaugauguucgugaugugccugaccguagucgcuaucacaguguuuauguucgaguauuuuagcccuguguccuacaaccagaaucuaacucgugguaaaaagucuggcgggccagccuucaccauuggaaagucggucuggcuccugugggcacuuguuuuuaacaauagcgugcccauagaaaacccucggggcacaacuuccaaaaucaugguauuggugugggcuuucuucgccgucauuuuucuggcgucauauaccgccaaccucgcugcauucaugauccaggagcaguacauagacacagugaguggucugucugauaagaaauuucaacgaccccaggaccaguacccaccuuucagauuugggaccguucccaauggcagcacugaaaggaacauucgcuccaauuaucgggauaugcacacgcauauggugaaguucaaccagagaucagucgaggacgccuuaacaagccugaaaaugggaaaacuugaugcuuuuaucuacgacgccgcaguguugaauuauauggcgggcaaggaugagggguguaagcucguuaccaucggaucuggcaagguguucgccacuaccgguuacgggauugcuaugcaaaaagacucccacuggaagagggccaucgaccuggcacuacugcaguuucucggagauggcgaaacacagaaacuggagaccgucuggcuuagugguauuugccagaacgaaaagaaugagguaaugagcucuaaauuggacauagauaacauggcuggcguguucuauaugcuguuaguugccauggggcucgcacugcuuguguuugccugggagcaccuggucuacuggaaguugcgccauuccgugccaaauucaagucaacucgacuuccugcuagcuuuuagccgaggaaucuauucguguuucuccggcguacagucucuggcgagcccgccucggcaggccucacccgaucucacugcaaguuccgcucaagccucugugcugaagaugcuucaggccgcucgugacauggucacaacggcagggguuagcuccucauuggauagagccaccaggacuauugaaaacuggggaggcggucgccgggcgccacccccuagcccaugccccacaccuagaagugggccgucuccaugccugcccaccccugacccacccccugagccgucccccacaggauggggcccaccugaugguggcagggcugccuuagugcgacgcgcaccccagccaccugggcggcccccaacuccgggaccuccccucagcgacgugucgagagucucaaggcguccagccugggaagcucgcuggcccgugcggaccggccacugugggagacaucugucugcaagugagaggccucuuuccccagcccgaugccacuacagcucuuucccccgggcggaucgcagcggaagaccuuuucugccgcuauucccagaacucgaggaccugcccuugcugggcccugagcaguuagcuaggcgggaagcccuccugcacgcagccugggcucgagguuccagaccccgccaugccucacuuccaaguagcguugcagaggcuuuugccaggccuucuucccugcccgcgggguguacgggaccagccugcgcacguccugauggccacucagcuugucggagauuggcccaagcucagaguaugugccucccgaucuacagggaagcaugucaggagggugaacaggccggcgcccccgcuuggcaacaucgccagcacguaugccugcaugcgcacgcacaccuaccauucuguuggggagccgugugcccucaucugcccccaugugcuagccacggguccuggcuuucuggcgccugggggccucucggacaucgaggcagaacccuggguuuggggacaggauaucgggacucgggcggccuggacgagaucagcagggucgcacgcgggacucagggauuucccgguccgugcaccuggcguagaauuucauccuuagagagugaaguguga

SEQ ID NO: 56956 - RNA, 4011 nt, Artificial Sequence
  derived and/or modified sequence opt3 from GRIN2D__Homo_sapiens__NP_000827
augagaggcgccgggggacccagggguccucggggcccagcuaagaugcugcuccuucuggcauuggccugcgcgagcccguuccccgaggaagcuccugggccaggaggcgccggugggcccggaggcggcuuagggggagcacgcccucugaacguggcccuagucuuuuccgguccagcuuacgcagccgaggcugcccgacucggccccgcgguugcagccgcugugcguucuccugggcuggacguaagaccaguggcccuuguccugaauggaucagauccgaggaguuuggugcuccagcugugugaccugcucagcggcuuacggguucacgguguggucuucgaagaugacucccgcgcacccgcuguggccccuauccuggauuuucuuucugcgcaaaccucguugccaauuguagccguucaugggggagcagcucuggugcuaacacccaaagagaagggcucaacuuuccuccagcugggcagcaguacggaacagcagcuucaagucauauuugaggugcuggaggaauaugacuggaccuccuucguggccgucacaacuagagcuccugggcacagggccuuuuugucuuacaucgagguucucaccgauggaagccugguggguugggaacaucggggcgcauuaacacuggacccaggggccggagaggcuguacucuccgcgcagcuucgcucagugagugcacagauucgacuguuguucugcgccagagaggaagcugagcccgucuuuagggccgcagaagaggccggccuaaccgguagcggguaugugugguucaugguuggcccgcagcuggcuggaggcgggggaucuggugccccuggcgaacccccacuccugccugggggagcaccccuuccagcgggccuguuugcugugcgguccgccgguuggcgugaugacuuggcacgcagagucgccgcugggguggccguaguugcaaggggcgcucaagcccuccugcgggauuacggauucuuacccgagcugggccacgacugucgagcgcagaaccgcacucauagaggggagucacuacacagguauuuuaugaauaucacaugggauaaccgggacuacagcuucaaugaagacggauuccucgugaacccuagucuggucgugauuucucuuacccgcgauagaacgugggaggucguggguuccugggaacagcagacuuugaggcugaaauauccacucuggagccguuacggccgguuucugcaaccgguugacgauacccagcaccuuacaguggccacucuggaggaacgacccuucguaaucgucgagccugcugacccaauaucggggaccugcaucagagauucugugcccuguaggucccaguugaaucgcacacauucaccuccacccgacgcaccgcggccugagaagagaugcuguaaaggauuuugcauugauauccucaagaggcuggcccacaccauuggcuucaguuacgacuuauaucugguuacgaacgguaagcaugggaaaaagaucgauggcguguggaauggaaugauaggcgaagucuuuuaccaacgcgcugacauggccauugggagccuaacuaucaacgaggaacgauccgagauuguggauuucucuguaccauuuguggaaacaggaaucagcguuauggucgcacggucaaauggcaccgugagucccuccgcguuccucgagccuuauagccccgccgugugggucaugauguuuguuaugugucugacugugguggcuguaacagucuucaucuuugaguaccuuucuccaguggguuauaaccguucauuggccaccgggaaaagaccuggaggcaguacguucaccauugguaagagcauauggcugcucugggcacugguuuuuaauaacuccgugcccgucgaaaauccaaggggcacaacuucuaaaaucaugguguuaguuugggcuuucuucgccgugauuuuucuggcaucguacaccgccaaccuugcugcguucaugauccaggaggaauauguagacacagucagcggguuguccgaccgcaaguuucagcggccgcaggagcaauacccuccccucaaguucggaacugugccaaacggcucaaccgagaaaaauauaagaaguaacuaccccgauaugcacucuuauauggugagguacaaucagccucgagucgaagaggcccugacacagcuaaaggcagggaaacuggacgcuuuuauuuaugaugccgccguucucaacuacauggcucgcaaggacgaaggaugcaaacuggugaccaucggcagcgguaagguauucgcaacuacgggguauggaaucgcccuucacaaaggcucccgguggaagagaccaauugauuuggcgcuguuacaguuucucggugacgaugagaucgaaaugcuggagaggcuuuggcugucaggcauuugucauaaugacaagauagaggugaugagcucuaaauuggauaucgacaacauggcuggggucuucuacaugcuccugguggccaugggacuaucccugcucguuuuugcaugggaacaccugguguauuggcgucuucgccauugcuugggccccacacaccggauggauuuccuguuagccuuuaguagagggauguacagcugcuguucugcugaggcagccccuccgccagcgaagcccccuccacccccucaaccgcuccccuccccagcuuacccugcccccaggccagcaccuggacccgccccauucgucccgcgagaacgggcuucaguggaccgcuggagaaggaccaaaggcgccgguccucccgggggagcaggccuggcugaugguuuucaucgguauuacggcccaauugagccccaggggcuuggacugggccuaggggaagcccgagcggccccuagaggagcagcuggccgcccacucagucccccugccgcucagccgccacagaagcccccucccagcuauuucgcaaucguuagggacaaagagccagccgagccucccgccggugcuuucccaggguuuccuucgccgcccgcgcccccugcagccgcugccacugcagugggacccccacugugccguuuggccuucgaagacgaguccccucccgcuccggcgcgguggccaagaucugauccugaaagccaaccccuguuaggcccaggcgccgggggagccgguggcaccgggggagcuggcgguggggcccccgcagccccuccgcccuguagggcugccccaccucccugcccuuaccucgaccuggagccaucacccagugauuccgaagacucugagagccuuggaggcgcgucccugggcggguuggagccuuggugguuugcagauuucccauaucccuacgccgaacgccucggaccgccuccaggucgauauuggucagucgacaagcugggcggguggagagcuggaagcugggauuaccuacccccucggaguggcccagccgcuuggcacuguaggcacugcgcaucucuggagcuucucccaccgccucgccaucuguccuguagccacgacgguuuggaugggggauggugggcacccccaccucccccaugggcugccggcccccugccucguagacgggcaaggugcggcuguccacgcucgcauccgcaccgacccagagcgucacaccggaccccugccgcugccgcaccacaucaccauaggcaccgcagagcugccgggggaugggacuuacccccuccagcacccacaucuaggagucucgaagaucuguccagcugcccucgggccgcuccggcgcgucgccuuacugguccaucucgacaugccagaagguguccccacgcagcucacuggggcccuccccugccaacagccagccaucggcgccacagagggggagacuugggcacgaggcgggguuccgcccauuuuucaagucucgagagcgagguauga

SEQ ID NO: 56957 - RNA, 3348 nt, Artificial Sequence
  derived and/or modified sequence opt3 from GRIN3A__Homo_sapiens__NP_597702
augagaaggcugagccucugguggcuucugucccgggugugcuuguuacugcccccuccaugugcccuaguccucgcuggcguuccgucuucaaguagccacccccagccuugccaaauccugaagcgcauugggcaugcagugcgaguaggagccgugcaccuucagccauggaccacagcgccccgugcugccuccagagcaccugacgauucuagggccggugcucagcgggacgagccagaacccggcacucgcagaucgccugcaccaucaccgggggccagguggcugggaagcacguugcauggccggggucccccugggagucgcaaaccaggagagggcgcucgagccgaagcgcucuggcccagagaugcacugcuguucgccgucgacaaccucaauaggguggagggcuuacugccuuacaaccuuuccuuggaaguugugauggcuauagaggccgggcugggagaucuaccacuccugcccuuuucuagcccguccucaccuuggaguagcgaccccuucucuuuucuucaguccgucugucacaccgugguaguucaaggugugucagcacuguuggcuuucccacagagccagggcgagaugauggaacucgaucuggucaguuuagugcugcauaucccugugauuucuaucguccggcacgaguuuccccgugaaucccagaauccacuccaccuucaacugagcuuggagaacucgcuaucuuccgacgccgauguuacagugucaauucugacuaugaauaacugguauaauuucagucuccugcuuugccaggaggacuggaacaucaccgauuuucuguugcucacacagaauaacagcaaguuccaucugggguccauaaucaauauuaccgcgaacuuacccucuacucaggaccugcuuagcuuucuccaaauccagcuggaaucaauuaaaaauaguacaccuaccguagugauguucggaugugauauggaguccauccgcagaauauuugaaauuacgacucaguucggcgucaugccaccggagcuuagguggguguugggugacagccaaaacguugaagaacugcggaccgaggggcucccccugggacuuaucgcccacggcaagacaacucagucuguguuugaacauuacguccaggacgcaauggagcugguggcucgagccguagcuaccgccacaaugauucagccugaauuggcacucaucccaucaaccaugaauugcauggagguugaaacgacuaaccugacaaguggccaauauuuaagccgcuuccuggccaacaccacuuucagagggcuauccggaucuaucagggugaaagguucgacaauugucagcuccgagaauaacuuuuucauauggaaucuccagcacgaucccaugggcaagccuauguggacccggcuggggucauggcagggaggcaagaucgugauggacuacgguauuuggccagagcaggcucaacgccacaaaacgcauuuucagcaccccaguaagcuacauuugagagucgugacccugaucgaacacccguucguuuuuacaagggagguggaugacgaagggcucuguccugcgggccagcugugcuuagauccaaugacuaacgacucuagcacccuggauucccuuuucagcagcuugcauucuuccaaugacacaguacccauaaaauuuaagaaauguugcuauggauacuguauugaucuccuggagaagaucgcagaagacaugaacuucgauuuugaccuauauaucgucggcgacgggaaguacggagccuggaaaaauggucacuggacuggccuggugggggaucuccugcguggaaccgcucacauggccguuacaaguuucagcauuaacaccgcacggucucaggugaucgacuuuacuuccccuuucuuuucaacgagucuuggcauuuugguccgaacaagagauaccgccgcucccauaggugccuucauguggccacugcauuggacuaugugguuagggaucuucguggcacuccacauuaccgcgguauuucugacacuuuacgaguggaagucaccuuucggccugacccccaaaggaaggaaucgcucgaagguguuuuccuucucuagcgcuuugaacaucugcuaugcccuccuguuuggccggacuguugcaaucaaaccaccgaagugcuggacagggagauuccuaaugaaucugugggccauauuuuguauguucugccucucaacguacaccgcuaaccuggccgcagucauggugggagagaaaauuuaugaggagcuuagugguauccaugacccuaaguugcaccaccccucccaaggcuuuagguucgggacugugcgcgaaucuagcgcugaggauuacguccgacaguccuuuccagagaugcaugaauauaugcggcguuacaauguucccgccacaccugacggaguggaguaucugaagaacgauccagaaaaauuagacgcguucauuauggauaaggcccuccuggacuacgaggugucaaucgaugcugacuguaaacuucugaccguaggcaagcccuuugcaauugaagguuacgggaucggccuaccuccgaauagcccacucacagccaacauaagugagcugaucucucaguauaaaucccacggauucauggauauguugcaugacaagugguacagagucgugcccugcggcaagaggagcuucgcuguuacugagacccugcagauggggauuaaacacuuuucgggauuauucgugcuccuguguaucggcuuuggucuuucaauucugacgaccaucggggaacauauagucuaucgcuugcuccugccucggauuaagaacaaaucuaagcuacaauacuggcugcacacaagucagagacuucacagggccaucaauacuuccuucauugaggaaaaacagcaacauuuuaagaccaagcgaguggagaaacgcagcaacguuggaccacggcagcucacaguguggaauacuucuaaccugagccacgacaauagaaggaaguauaucuucuccgaugaagagggccagaaccaguuggguauacguauccaucaagacauuccccugccuccgcgccggagagaguuacccgcacucaggaccacgaauggcaaagcggauucacugaacguaagucgaaauagcgucaugcaggaacuuucugagcuggaaaagcagauccaggugauucggcaagaguugcagcucgccgugucccgcaaaacagaacuggaggaguaccagagaaccucaaggacuugcgaaaguuga

SEQ ID NO: 56958 - RNA, 3132 nt, Artificial Sequence
  derived and/or modified sequence opt3 from GRIN3B__Homo_sapiens__NP_619635
auggaguucgugagagcccuguggcucggccuugcucuggcauuggggcccggaagcgccgguggccacccucagccaugcggggucuuagcgaggcugggaggcuccguucggcuaggugcucuccugccgcgcgcaccccuugcccgagcccgugcuagagcagcccuggcuagggccgcguuggcaccucggcucccacauaaccugucucuggaacucgugguagccgcucccccugcccgcgacccagcaucauuaaccagagggcugugucaagcucuugugcccccuggagucgccgcguugcuggccuuuccagaggcaaggccggaacuacuccagcugcacuuccuugcugccgcuacagagacucccgugcugaguuugcuccggcgcgaagcccgagcaccucugggcgccccaaaucccuuucauuuacagcugcacugggcuagcccucucgagacgcuucuggauguuuugguggcgguccuacaggcacaugccugggaggacgugggccuggcucucugcagaacccaagauccagggggacugguagcccuuuggacauccagggcaggucggcccccgcagcugguuuuggaccucucucgucgcgauacuggcgacgccgggcugagagcuagguuagccccuauggcagcgcccgugggaggcgaagcuccagucccugccgcagugcugcuagguugugauaucgcccgggcucgacgcgugcucgaggccguucccccagggccccacuggcugcuuggaaccccuuugccaccgaaggcacugcccacagcuggccucccuccaggccugcuugcccugggggaaguugcgagacccccuuuggaggccgcuauucacgacauagugcagcucguagcaagggcccugggaucggcugcccaggugcaaccaaaacgggcauuacugcccgcgccggucaacugcggugaucuacagccugccggcccagagucacccgggcgcuuccucgcuagauuucuggccaauaccagcuuccagggaaggacuggcccuguguggguuacagguaguucccaggugcauaugucucgucacuuuaaggucuggagccuucggcgagaccccagaggggcaccagcuugggccaccgugggcuccuggagggauggacaauuggaccuggaaccuggcggggcaucagccagacccccaccgccucagggagcucagguauggcccaaacuccggguugugacgcuguuagagcauccauucgucuuugcgagagaucccgacgaagacggucaauguccugccggccagcugugccuugauccagggacuaacgacagugcaaccuuggaugcucucuucgccgcccuggcuaauggaagcgcacccagggcccuacgcaaguguugcuacggcuauuguaucgaccugcucgagcgacuggcggaagauacaccuuuugacuucgagcuuuacuuggugggugaugggaaauauggcgcucugcgggacggacguuggacuggcuuagucggggaucuccuggccggacgcgcacacauggccgugaccucuuuuuccauuaacucagcuaggagccagguuguggacuucacaaguccguucuuuucuaccucccuugguaucaugguacgcgcacgggauacggccagcccaauuggcgcguucauguggccccugcacuggucgacuugguugggggucuuugcugcccuccaucugacagcacuauuccugaccguguacgaguggagaucuccuuauggacucacuccaaggggccgaaaucgcuccacagucuuuucauacaguagcgcccugaaccuuugcuaugcuaucuuguuccggagaaccguguccucuaagacgcccaaguguccuaccgguaggcuguuaaugaaucucugggccauauuuugccugcuuguccugagcucauacacagcaaaccuagcugccgugaugguaggggacaaaacuuucgaggaacucaguggcauccacgacccgaagcugcaucaccccgcgcagggauuucguuucggcaccgugugggaauccagcgccgaggcauacauuaaaaagucuuuuccagauaugcaugcucacaugcgccggcacucagccccuacaacucccagagggguugcuauguugaccagugacccaccuaaacugaaugcauucaucauggauaagagcuuacucgacuaugaagucuccauugaugccgacugcaagcugcuuacagugggaaaacccuuugccaucgagggcuacgguauagggcugccacaaaacucuccguugaccucgaaucucagcgaguucauuuccagguauaagucaaguggauucaucgaucugcuacaugacaaaugguacaagauggugccuuguggcaaacgagucuuugcuguuacugaaacgcugcagaugucuauuuaucacuucgcgggucuuuuugugcuccugugcuugggccuggggagcgcauuacucuccucacugggagagcaugccuucuuucggcuugcucugccccgcaucagaaagggcagcagguugcaguacuggcuccacacaucucagaaaauccaccgggcccugaacaccgaaccacccgagggguccaaggaagagacugcagaggccgaaccuaguggaccagagguggaacaacagcagcagcaacaggaucagcccaccgcuccugagggcuggaagcgagcgagacgcgccguagacaaagagaggcguguccgguuccuacuggaaccggcagugguuguggcuccagaggccgaugcagaagccgaggcugcccccagagaagguccugucuggcuuuguagcuaugggaggcccccagcggcacgcccuacaggagcuccccagccaggcgagcuccaagagcuggaacgaagaauugagguggcccgggaaagguugcgccaggccuuaguucguagaggucagcugcucgcucaacugggcgacucugcacggcauaggccucgccgacuucugcaggccagagcugccccggcagaggcgcccccacacuccgggcggccuggaucacaggaauga

SEQ ID NO: 56959 - RNA, 1116 nt, Artificial Sequence
  derived and/or modified sequence opt3 from GRINA__Homo_sapiens__NP_001009184
augagccacgagaaguccuuccuggugucuggcgacaacuaucccccuccaaauccgggguaccccggagguccucagccacccaugccuccauacgcccaacccccuuauccaggcgcuccguacccccagccuccauuucagcccucaccuuaugggcagccaggauacccccauggcccgaguccuuauccccaagguggguacccacagggaccuuacccccagggcggcuauccacaggggcccuacccucaagaaggauauccacaggguccguacccccagggcggguauccucagggaccauacccccaaagcccuuucccacccaacccguauggccagccucaggucuuuccaggucaagaucccgacuccccucagcacgggaauuaccaggaggaaggacccccaucuuacuaugauaaccaggacuucccugcaaccaauugggaugacaaaucgaucagacaagccuuuauuaggaagguuuuccucgugcuuacacugcaguugucaguaacuuuaagcacggugagugucuuuaccuucguggcggagguuaaaggcuuugugcgggaaaacgucuggacauacuauguguccuacgcuguauucuuuauaucucugaucguucuaagcugcuguggcgauuuccgccgaaagcaucccuggaaucucguggcccuguccguccuuacugcaucacugaguuauaugguggggaugauugccagcuuuuacaacaccgaggcugugaucauggcagucggaauuacaaccgccguuugcuucacugugguaaucuucucuaugcagacacguuaugacuuuaccuccuguauggguguguugcucgucucaauggugguucuguucauauuugcuauccugugcauuuucaucagaaauaggauucucgagaucguguacgccagcuuaggcgcgcugcuuuuuacguguuucuuggcagucgauacucagcugcuacucgggaacaaacaacugagucuuucuccagaagaguacguguuugccgcucugaauuuguauaccgacauaauuaacaucuuccucuacauucugacaaucaucggacgggccaaggaauga

SEQ ID NO: 56960 - RNA, 3231 nt, Artificial Sequence
  derived and/or modified sequence opt3 from GRIP1__Homo_sapiens__NP_066973
augaucgccgugagcuucaagugcagaugucagauucugaggcggcucaccaaagacgagucccccuacacaaagucugcuucacaaacuaaaccuccagauggcgcacuugccguccgccgacagaguauaccggaagaguuuaaggggagcacgguuguggaacugaugaaaaaggagggaaccacauuggguuuaacuguauccggcgggaucgacaaggauggaaaaccccgugugucuaaccugagacagggcgguauugcggcuaggucggaccagcuagaugucggggacuauaucaaggccgugaauggaauuaaccucgcaaaauuccggcacgaugaaaucauaucacugcuuaagaauguuggcgagcgcgugguccuggagguggaauacgaguugccuccaguaagcguucaaggcaguuccgugaucuuuagaaccgucgaagugacacuccauaaagaggggaacaccuucggauuugugauuagggguggcgcccacgacgaucggaauaagucucgccccgucguuaucacuugcgugcgaccugggggaccagcugacagagagggcacaauuaagcccggugauaggcugcugagcguagacgggauccggcucuuaggaaccacgcaugcagaagccauguccauacugaaacaguguggccaggaggcugcccuuuugauugaauaugaugugucagucauggacaguguggcgacugcaagcggcccucugcuaguugagguggccaagaccccaggggcuucucucggagucgcccugacaacuuccaugugcuguaacaaacaggugaucguaauugacaagaucaaaucagcaagcaucgcugaucguugcggugcccuucacguuggcgaccauauucugaguauagaugggaccucuauggaauacuguacauuggcggaggccacccaauuccucgcaaauacgacugaccaggugaagcuggagaucuuaccgcaccaccagacacgccuggcucucaaaggacccgaucaugccgcucuugucuccagcucguuuucuccuaccuccaugucagccuauagucugagcuccuugaacaugggcacucuaccaagaucucuguacagcacaucacccagggguaccaugaugcggcgacgccucaagaagaaagacuucaagaguucccugagccuugcaucuucaacgguggggcuggccggccaggucgugcacaccgaaacaacugagguuguguugaccgcugauccuguaacaggauuuggcauucaacuccaggggagugucuucgcgacugaaacccugagcuccccacccuuaaucucuuauauagaggcagacucgccggccgaaagaugcggagugcugcagauuggugauaggguuauggcuaucaauggcaucccuacagaggacagcaccuuugaggaagccucccaacuacuccgggauucaaguauuacuucuaaagugacgcuggagaucgaguucgacgucgcagagagcgugauucccuccucagggacauuucauguaaaacuuccaaagaagcacaacguggaauugggaauaaccaucagcucuccuuccagucgcaagcccggcgacccacugguuauuagcgauaucaaaaaggguucugucgcccacagaacugggacccucgagcugggcgacaaacuucuggcuaucgauaauauuagguuggacaacuguuccauggaggaugccgugcagauacuccagcagugcgaagaccuggugaaguuaaaaauccguaaggaugaggacaauucagaugaacaagagaguagcggagcaauuaucuacacagucgagcugaagcgguacggcgggccccuaggaauuaccaucucggguacugaagaaccuuucgacccaauaaucauuuccucucucacaaaaggcgggcuggcggaacgaacgggagcuauccauauuggcgauagaauccuugccauaaacagcucaaguuugaaggguaaaccgcuguccgaggcaauucaccuccugcagauggccggggaaaccguuacuuuaaagaucaaaaagcagacagacgcucagucugccagcucccccaagaaauucccuauuucaagccaucugagugaucuuggcgacguggaggaggacucuuccccagcacaaaagcccggaaaauugagcgauauguauccuucgaccgugccaucaguagacucugcugucgauaguugggacggcuccgccaucgauacaagcuacgggacucagggaaccucuuuucaggcgagcggcuauaauuucaacacguacgacuggaggucccccaagcagcgcgguucacucaguccggugaccaaaccucggagccaaacauauccagauguugggcugucuuacgaagacugggauagauccacugccucaggauuugcuggcgcagccgacagugcugagaccgaacaggaggaaaacuucuggagccaggcccuagaggaucuggagacauguggucaguccggcauacucagggaacuggaggaaaaggcagaccgccgagugucucuucggaauaugacuuugcuggcgaccaucaugucggggagcacgaugucauuaaaccacgaggcccccacaccucguucccaacucggaagacaggcuaguuuucaggaaaggucuagcucccgcccccauuauucacaaaccacucggucuaauacacugccaagcgaugucggcagaaaaagugugacccuuaggaagaugaagcaggagauuaaagagaucauguccccuacucccguugaacugcacaaggugaccuuguacaaagacagcgacauggaggauuucggguuuucuguagccgacggacuccuggaaaagggcgucuacgugaaaaacauucgaccagcagguccgggggaucuaggaggccugaagccuuaugaccgccuccuucaggugaaucacguccggacaagagauuucgacugcugccugguugugcccuugaucgcugagucagguaacaagcuggauuuaguaauauccaggaauccacucgccagucagaaaagcauugaccaacagucgcugcccggcgauuggucugagcagaacuccgcauuuuuccagcaaccuagccaugggggaaaucuugaaacgcgugagccaaccaacacucuguga

SEQ ID NO: 56961 - RNA, 1692 nt, Artificial Sequence
  derived and/or modified sequence opt3 from GRK1__Homo_sapiens__NP_002920
auggacuucggcagccuggagaccguggucgccaacuccgcuuuuaucgcagccagagggucuuucgauggaucaaguagccagcccuccagggacaagaaauaccucgcgaaacuuaaacugccuccauugucuaagugcgaaucguuacgggauucacugagccuagaguuugaaaguguuugucucgagcaaccgauugguaaaaagcuguuccagcaguuucuucaguccgcugaaaagcaucugcccgccuuggagcucuggaaagacauagaggauuaugacacagcagauaaugaccugcaaccucagaaggcccagacuauccuggcucaguaccucgauccacaagcaaaauuauucugcucuuuucuggacgaaggcauuguggccaaguucaaagaggggcccguagaaauccaggauggacuuuuucagccuuugcugcaggcuacgcuagcccaccucggccaagcgccauuccaggaguaucuggguagccuuuacuuucugcgcuucuugcaguggaaguggcucgaggcacaacccaugggggaagacugguuucuggauuuccgaguguuaggaaagggcggcuucggggaggucuccgccugucagaugaaagcuaccggaaagcuguaugccugcaaaaagcucaacaaaaagcgucuuaaaaagagaaaggguuaccagggcgcaaugguggaaaagaagauucugaugaaaguucacucaagguuuaucgugaguuuggcuuaugccuucgagacaaaggcggaccuaugucuggucaugacuauaaugaaugggggagacauccgguaccauauuuacaacgugaaugaagagaacccuggcuuuccagagccgcgcgcccucuucuauaccgcacagaucauuugcggucuggaacaccuucaucaaagaaggaucguauaccgggaucugaaacccgagaauguuuugcucgacaacgaugggaaugugcgcauaagcgaccugggauuagcugucgaacugcuagauggccagucuaagacaaagggcuaugccgggaccccuggauuuauggcuccagagcuccugcagggugaagaguacgacuucuccguggauuauuuugcccuuggcgugacuuuguacgagaugauugcagcccgagggcccuucagagcuaggggagaaaaagucgagaacaaggaacugaaacaccggaucauuucagagccuguuaaguauccagacaaauuuagccaggcgaguaaggauuucugugaagcacuccuggagaaggaccccgagaaacgucuuggcuuucgcgaugaaacaugcgacaagcugagagcccacccguuguucaaagaccucaauuggaggcaacuggaggcugguauguuaaugccucccuuuaucccagauucuaagaccguguacgccaaagacauccaggauguaggggcauucuccacggugaagggcgucgccuucgacaagacugauaccgaauuuuuccaggaguuugcuacaggaaacuguccuauucccuggcaggaggaaaugauagagacuggcaucuucggggaacugaauguguggcggagcgacggacaaaugccagaugacaugaaagguauuucgggcgggucuuccucaaguagcaaguccggaaugugccuaguuucuuga

SEQ ID NO: 56962 - RNA, 1641 nt, Artificial Sequence
  derived and/or modified sequence opt3 from GRK4__Homo_sapiens__NP_001004056
auggagcuggaaaacaucguggccaauagccuccuucugaaggcuagacaggagaaagacuacuccucuuugugcgauaagcaacccauuggcaggcgguuauuccgccaguuuugugacaccaaaccuacacugaagcgacacauagaguuccuagaugcagucgccgaauaugaaguugcggacgaugaggaccguucagauugcgggcucaguauccuggacagauuuuucaacgauaaacuugcugccccacugccggagauucccccugacgugguaacugaauguagguugggacucaaggaggaaaauccaagcaagaaagcauuugaggagugcacgcggguggcccauaacuaccugcgcggugaacccuucgaggaauaucaggaguccucuuacuuuucgcaguuccugcaauggaaguggcucgaaagacagccugucaccaaaaauacauuuaggcacuaucggguguuaggcaaggguggauucggcgagguuugugcuugccaggugcgcgcaacugguaaaauguacgccuguaagaagcugcagaaaaagcgaaucaaaaagagaaaaggggaggcuauggcccuuaacgaaaagaggauuuuggagaaaguccaaucacgguuugugguaagccuggcguaugcauacgaaaccaaggaugcccuaugccucguucugacaaucaugaauggaggcgaccuuaaguuccauauauacaaccugggcaauccaggguuugaugagcagcgugcuguguucuaugccgcagaauuguguugcggacucgaggaccugcagcgcgagagaaucgucuacagggacuuaaaacccgaaaacauucugcucgaugaccggggucacauccgaauuagugaucuuggccuggcuaccgagaucccugaagggcagcgcgugagaggaagggugggcacugucgguuauauggccccagagguugugaauaacgaaaaguacacauucuccccggacugguggggguugggaugucuaauauaugagaugauucaaggccauucucccuuuaaaaaguacaaagagaagguaaagugggaagagguggaucagcggaucaaaaaugacaccgaagaguauagcgagaaguucuccgaagaugcgaaaucaauuugccgcaugcugcucacgaagaacccuaguaaaagacugggcugccguggggagggagccgcaggggucaagcagcacccaguguuuaaggacaucaauuucaggcggcuugaagcuaacaugcuggagcccccuuuuuguccagauccccacgccguuuacugcaaagacguguuggauaucgaacaauucagcgucgugaagggcauuuaccucgacacugcugacgaggauuuuuaugcccgauucgcaaccggguguguaucuauaccguggcagaacgagaugaucgaauccggaugcuuuaaagacauuaauaagucagagagcgaagaggcccugccuuuagaucuggacaaaaacauccauacacccguuaguagaccaaauaggggcuucuuuuaccgccuauuccggagaggugggugucucacuauggugccuucugaaaaggaggucgagcccaagcagugcuga

SEQ ID NO: 56963 - RNA, 1773 nt, Artificial Sequence
  derived and/or modified sequence opt3 from GRK5__Homo_sapiens__NP_005299
auggagcuggaaaacaucguggccaauaccguccuccuuaaggcuagagagggcgggggagguaaaaggaagggcaaaagcaagaaauggaaggaaauucugaaguucccccacauaucccagugcgaggacuugcggcgcacaaucgaucgagacuacuguucuuuaugcgauaaacaaccuauugggcgucugcuauuuagacaguucugugaaacuaggccaggacucgagugcuauauccaguuucuggacucaguugcagaguacgaagugacgccggaugagaaacuuggcgaaaaagguaaggagauuaugaccaaauaucugacacccaagaguccuguauucaucgcccagguggggcaagacuuggucagccagacugaggaaaagcuccugcagaaaccauguaaggagcuguuuuccgcgugcgcucagucugugcaugaauaccuccggggagagcccuuccacgaauauuuagauucgauguuuuucgaccgcuuucugcaauggaaauggcuugagagacagccuguuaccaagaacacauucaggcaguaccggguguugggcaaaggcggguuuggagaggucugugccugccaggugcgcgcaaccgguaagauguaugccuguaaacgacuggaaaagaagagaauaaagaagaggaaaggcgagucaauggcucuaaaugaaaagcaaauccucgagaaaguaaacagccaguucguugugaaucuggcauacgccuacgaaacuaaggaugcucuuugccuggucuugacaauuaugaacgggggagaccucaaguuucauaucuauaauaugggcaacccagguuucgaggaggaacgggcccuguucuacgcggcagagauuuuaugugggcuggaagaucuccaccgugagaauaccguguaucgcgaccuuaaacccgaaaacauccuguuggaugacuacggacauauaagaauuagugaccuaggccuggccgugaagaucccugagggcgaucucauuagggggcgggucggaacgguugguuauauggcuccagaggugcugaauaaccagcgauacggccuuuccccggacuauugggggcugggaugcuugaucuacgaaaugaucgagggccaaucucccuuucgcgguagaaaagaaaagguaaaaagggaggagguggaucggcgcguccucgaaacugaggaaguguacagccacaaguucuccgaggaagccaagucaauuugcaaaaugcuguuaaccaaggacgcaaaacagagacuggggugucaggaggagggcgcugccgaaguuaagaggcacccauuuuuccguaauaugaacuuuaaacggcuagaggcgggaaugcucgauccacccuucgugccugacccacgagccgucuauugcaaggaugugcuggacauagaacaguuuaguacaguaaagggcguuaaucuugaucauacugacgaugacuucuacagcaaauuuucuaccggguccgugucaauccccuggcaaaacgagaugauugaaacagaguguuucaaggaguugaacgucuuuggaccgaaugguacccugccucccgaccucaacagaaaucacccaccugaacccccuaaaaagggccugcuucagaggcuguucaaacgccagcaucagaacaauagcaagaguucucccuccagcaaaacgucguuuaaccaccacaucaauucuaaccauguguccucaaauaguacugggagcuccuga

SEQ ID NO: 56964 - RNA, 1683 nt, Artificial Sequence
  derived and/or modified sequence opt3 from GRK6__Homo_sapiens__NP_001004105
auggagcuggaaaacaucguggccaauaccguccuccuuaaggcuagagagggcgggggagguaacaggaaaggcaagagcaaaaaguggcggcagaugcugcaauucccccacauuucccagugcgaagaguugcgcuuaucucuggaacgagacuaccauucacuaugugagcgucagccuauagggagacuccuguuuagggaguucugcgcaacacggccagaacuuagucgcuguguugccuuucuggauggaguggcggaguaugaaguaacuccggacgauaaaagaaaggcuugcggcaggcaguugacgcaaaauuuccucagccacaccggucccgaccugaucccugaggugccacggcagcuggucacaaacuguacucagcgccucgagcaggggcccugcaaggauuuauuucaagaacugacccgacuuacacaugaguacuuguccguggccccuuucgcagacuaucuggauucuauuuacuuuaauagauuccuacaguggaaauggcucgaaaggcagccaguuaccaagaacacuuuucggcaguaucgugugcugggaaaaggcggcuucggggaggucugugccugccaagugcgcgcuacaggaaagauguacgcauguaaaaagcuggaaaagaaaagaaucaagaaaaggaagggugaggccauggcucuuaaugagaaacagauuuuggaaaagguaaacucgcgguuuguugugucacucgccuaugcguacgagaccaaagacgcacugugcuuaguccugacgcucaugaauggcggggaucuuaaguuccacaucuaccauaugggacaggccggcuuucccgaagcucgagccguguucuaugcagcugagauauguugcggucuggaagacuugcaccgcgagagaaucguguacagggaucuaaagccugagaacauucugcucgacgaucacgggcauauccggauuagcgaccugggacuugccguccacguuccagaaggccaaacuaucaaaggccgcguggggaccguaggauauauggcgccggagguggucaagaaugaaagauacacauucagucccgacuggugggcccuggguugcuugcucuaugagaugauagcaggccaguccccuuuucagcagaggaaaaagaaaauuaagcgugaagagguggagcggcugguuaaggaagugccagaggaauacucugagcgauucagcccccaagcuagauccuuauguucacagcugcuaugcaaagauccugccgagaggcucgggugucgcggaggcagugcucgggaagucaaggagcauccacuguuuaaaaaguugaacuucaaaagacuuggugccgggaugcuggaacccccguuuaagccugacccccaggcaaucuauugcaaggaugugcucgacauugagcaguucagcacuguaaaaggcguugaacuggagccaaccgaucaagacuuuuaccagaaguucgccacaggaucugugccuauccccuggcagaaugagauggucgaaaccgaguguuuucaggaacuuaacguguucggccuggauggguccgucccacccgacuuggauuggaaaggacaaccuccagcuccgcccaagaaaggucuccugcagagguuauuuucacgccagcgauga

SEQ ID NO: 56965 - RNA, 1662 nt, Artificial Sequence
  derived and/or modified sequence opt3 from GRK7__Homo_sapiens__NP_631948
augguggacaugggcgcccuggauaaccucaucgcuaauaccgcauaccuucaggccagaaagcccagcgacugcgauuccaaagagcugcaaaggcggcgccgaucuuuggcguuaccugggcugcagggaugugcugaacuacgucagaagcucucacugaacuuccacagucuuugcgagcagcaaccaauugguagaaggcuguuucgggacuucuuggccacagucccgacuuuucgcaaagcagccacguuccucgaagauguucagaauugggagcuggcugaagagggccccaccaaggacagcgcacugcaggggcucguggccacaugugcuuccgccccugcgccaggaaacccccagccauuuuuaucucaagcaguagccacuaaaugccaggcugccaccacagaggaagagagaguggcagcugucacccuggccaaggcggaagccauggcauuccuucaggagcagccuuuuaaggauuucgugacuucggcuuuuuaugacaaauucuugcaauggaagcuguuugagaugcagcccguuucagauaaauacuucacagaauuuagggugcuaggcaaggguggguucggagaggucugugccgugcagguuaaaaauaccggcaagauguaugcuugcaagaaacucgacaagaaacggcugaagaaaaagggcggggagaaaauggcccuucuggagaaggaaauauuggagaagguaagcaguccuuucaucgugucccucgcauacgccuuugagucuaaaacgcaucuguguuuagucaugagccugaugaacggaggugaucucaaguuccacauuuauaaugugggcacucgcgggcuugacaugucccgagugaucuuuuacucagcucaaauugcgugcggaaugcugcauuugcacgaacuaggcaucgucuauagagauaugaaaccagagaacguucugcucgacgaccuggguaauuguaggcuuagugaucugggguuggcaguggaaaugaagggaggcaaaccgauaacccagcgggccggcacaaacggguacauggcucccgagauccucauggaaaagguaagcuacucuuauccuguggacugguucgccaugggaugcuccauuuacgagauggucgcaggucguacuccauuuaaggauuauaaagagaaggugucaaaagaagaccugaagcagcgcaccuuacaggaugagguuaaauuccaacaugacaauuuuacagaagaggccaaggauaucuguagacuguuccuagcuaagaaacccgaacagaggcucggcagccgggagaagagugacgauccucgaaaacaccacuuuuucaagaccauuaacuuuccacgccuggaggccgggcuuaucgaacccccguucgugccugaccccucugucguguacgcaaaagauauagcggagauugacgacuuuuccgaaguaagaggaguugaguucgaugacaaggauaagcaguucuuuaaaaauuucgcuacgggcgccgugccaaucgcauggcaggaggaaauuaucgagacugguuuguuugaagaacugaacgacccuaauaggcccacagggugcgaagagggcaacagcucgaagucuggagucugccuccugcuuuga

SEQ ID NO: 56966 - RNA, 2721 nt, Artificial Sequence
  derived and/or modified sequence opt3 from GRM1__Homo_sapiens__NP_001264995
auggugggccugcuccuuuucuuuuuccccgccaucuuucuggaagucagcuuguuaccuagauccccagggaggaagguucugcuagcuggagcaucuucacagcggaguguggcccgcauggacggugauguaauuauaggcgcucucuucagcgugcaccaucaaccgcccgcggaaaaagucccugagcgaaagugcggggaaauccgugagcaguacggcauucagagaguggaagccauguuucacacccuggacaaaaucaacgcagauccaguucuucugcccaauauuacauugggauccgagaucagggacucuuguuggcauucgucaguggcccucgagcagagcauagaguucauccgggauagucugauuuccauccgcgacgaaaaggaugguauuaacagaugccugccugacgggcaaucucucccacccggaaggacuaaaaagccuaucgcuggcgucauaggcccagggagcuccucaguggcaauucagguacagaauuuacugcagcuuuuugauaucccgcaaauugccuauagugcuacgagcaucgacuugucugauaagacccuguacaaauauuuccuacggguugugcccuccgacacacuccaggcccgcgcgaugcuggauaucgucaagcgauacaacuggacuuaugugucagcagugcacaccgaaggaaauuacggugagagcggcauggacgccuuuaaagagcuugcugcccaggaagggcuguguauugcacauagugacaagauauauucuaacgcuggagagaaauccuucgauagauugcucaggaagcugcgggaacguuuaccuaaggcccgcgucguugugugcuuuugugagggcaugacaguaagaggucugcucagcgcgaugaggcggcuugggguggucggagaguucucgcugaucggcucugacggcugggccgaucgagacgaagugauugagggguacgaaguugaggcaaauggagguaucaccauaaaauugcaguccccagaagugcgcucauuugaugacuacuuccuaaagcugagacucgauacuaacacaaggaaucccugguucccugaguuuuggcaacaccgguuccagugccgccugccaggccaccuucuggaaaaccccaauuuuaaaagaauuuguaccgggaacgagaguuuggaggaaaauuauguccaggacagcaagaugggauucgugaucaacgcuaucuacgccauggcucauggccuccaaaauaugcaccaugcccugugcccgggucacguaggguuaugugaugcaaugaaaccuauugacggcuccaagcugcuagauuuucucaucaaaucuagcuucauuggaguuucaggcgaggaagugugguuugacgagaagggggacgcccccggaagguaugauauaaugaaccugcaguacacggaagcuaaccguuaugacuacguccacguggguacuuggcaugagggcguccuuaauaucgaugacuauaagauucagaugaacaaaaguggggugguucgguccgugugcagcgagccauguuugaagggacagaucaaaguaauccgaaagggcgaagucucuugcugcuggauuuguaccgcgugcaaagagaaugaauacgugcaagaugaguucacauguaaggcaugcgaccuggguugguggccuaacgccgaucucacugggugugagcccauaccaguuagauaccuggaauggucaaauaucgagaguauuaucgcuauugccuuuagcugccuuggcauccuggugaccuuguucgucacacucauauuugugcuguauagggacacccccguagugaaguccucuucgcgcgaauuauguuacaucauucuggcaggaaucuuccuaggcuauguuugcccuuuuacgcucauugccaaaccaacuacaaccagcuguuaccugcagcggcuuuuggucgggcuguccucagcuaugugcuauagugcccucgugacuaagacaaacagaaucgcaaggauacuggcgggaucuaaaaagaaaauuuguacccgcaagccgcgauucaugagcgcuugggcccaggugaucauugcauccaucuuaauaucaguccagcugacgcuuguugugaccuugaucauuauggagcccccuaugccaauccucagcuaccccucuauuaaggaaguguaucugaucugcaauacauccaaccuagguguagucgccccucugggcuacaaugggcuccugauaaugaguugcacuuacuaugcuuucaaaacccggaacgugccagccaauuuuaacgaggcaaaguacauugcuuucacaauguauacuaccuguaucaucuggcuugccuuuguucccauuuacuucggaagcaauuauaaaaucauuacaaccugcuuugcggugucuuuguccgucacuguggcccugggcuguauguucacgccgaagauguacauaaucauugcuaaaccugagcguaacguuagaucagcauuuacaaccagugaugugguaaggaugcacgucggugacgggaaguuaccaugccgcagcaauacuuuccucaacaucuuucggagaaagaaagccggcgcuggaaacgccaagaaaaggcaacccgaguucucgccuaccucccagugucccucugcacaugugcagcuguga

SEQ ID NO: 56967 - RNA, 2619 nt, Artificial Sequence
  derived and/or modified sequence opt3 from GRM2__Homo_sapiens__NP_000830
augggcagccugcucgcccuucuggcuuuguuacugcuauggggagcaguggccgaggggcccgcgaagaaaguccucacccuggaaggugaccuuguucugggcggguuguucccugugcaccagaagggaggcccagcugaggauugcgguccgguaaacgaacauagagggauccaaaggcucgaggccaugcuguuugcacuggaccggauuaaucgcgauccccaccucuuaccuggagugcgacugggcgcccauauacuugacuccuguucuaaagauacacacgcuuuggaacaggcacuggacuucguccgugccucacuaaguagaggcgcugaugggagcaggcauaucugcccagacggauccuacgccacucacggugaugcgcccacggcaauuaccggcgugaucgggggaucuuauucggacguuucaauucagguggccaaccuccugcggcuuuuucagaucccucaaauaagcuacgcuaguacauccgccaagcugucugauaaaagccgcuaugacuacuucgcaagaacugucccacccgacuuuuuccaggcuaaggccauggcggagaucuugagguuuuucaauuggaccuauguguccacaguagccucagagggcgauuacggugaaaccgggauugaggcauuugaacucgaggcucgggcccgcaacaucuguguugcuacuagcgagaaggugggacgagccaugagcagagcagccuucgaaggcgucgugagggcucuguuacagaaaccuucugcgcggguggcaguccuguuuacacguuccgaggacgcccgcgaacuccuugcugccucacagagacugaaugcaaguuucaccuggguugccagugauggcuggggagcuuuggagucugugguagccggguccgaaggugcagcggagggcgcuauuacgaucgagcuagccagcuauccaauaucggacuuugcaucuuacuuccaaucccuggauccguggaacaauucaaggaaccccugguuccgggaauuuugggagcagcgauuccgcugcaguuuuagacagagggacugugccgcucacagccuccgggccgugccuuucgaacaggaguccaagauuauguuugucgugaaugcaguuuacgcuauggcccaugcgcugcacaacaugcaucgcgcccuuugcccaaauacuaccagacugugugaugcuaugaggcccgugaacgggcgucgguuguauaaagacuucguccucaaugugaaguuugaugcaccuuuccgaccagccgacacacacaacgaaguaagauuugauagguucggagacggcaucggucgcuacaauauuuuuacuuaucugcgggcugggucuggcagauacagguaucaaaaaguuggauacugggccgagggcuuaacccuggauacaagccuaauccccugggcaucaccgagugcggggccucuccccgccucccgcugcagcgagccaugucugcagaacgaagugaagucuguccagccuggagaggugugcuguuggcuuugcauccccugccaaccauaugaauaccgauuggacgaguucaccugugcugacugcggucugggcuacuggcccaacgccucacucacgggguguuuugaacugccucaggaguauauucgguggggagaugcaugggcugucggcccagugacuauagccugccuuggugcacuggccacauuguucguucucgggguguucguacgucacaaugcuaccccggucgugaaggcgaguggcagagagcuguguuacaucuuacugggaggcguuuuucuaugcuauuguaugacuuucauuuuuaucgccaaacccagcacagcagugugcacccucaggcgccuggggcuuggaacggcuuucuccgucuguuacucugccuugcugaccaagacaaaccggauagccagaauuuuugguggcgcuagggaaggggcacagcgaccucgcuucaucucgccagccagccagguggcgaucugccucgcucugauuuccggacaauuacugaucguaguggccuggcuuguugucgaggcacccggcacugguaaagaaaccgccccugagcggagagagguggugacauugagguguaaucaucgugacgcuucaaugcucgggagucuggcauauaacguccuacugauugcccucugcacucuguacgcguuuaagacccgcaaaugcccagaaaauuucaacgaggcuaaguuuauaggcuucacaauguauaccacuuguaucauuuggcuugccuuuuugcccaucuucuacguuacgucuagcgauuaccgggugcagacaaccacuaugugcguguccguaucacugagcggaucugucguguuaggcugucucuuugcaccgaaacugcacaucauucuuuuccagccucagaagaauguugugucccauagagccccaaccaguagguucgggagcgcugccgcacgagcuucuuccucacugggacaaggcagugguagccaguuuguccccacagugugcaacgggcgggaaguuguggacucgaccacuuccucuuuguga

SEQ ID NO: 56968 - RNA, 2640 nt, Artificial Sequence
  derived and/or modified sequence opt3 from GRM3__Homo_sapiens__NP_000831
augaagaugcugaccagacuccaggugcuuacacuggccuuguucagcaaaggcuuuuuacugucccuaggggaccacaacuuccucaggcgggagaucaagauugaaggagaucugguccuugguggccuguuucccauaaaugagaaagggacuggaacggaagagugcggccgcaucaacgaagaccgagguauucaacguuuggaggcuaugcuguucgcaaucgaugagauuaauaaggacgauuaccuccugccugggguuaaacucggagugcauaucuuagacaccuguucuagagauacauaugcccuggaacagucacuugaguuuguaagggcgaguuugacuaagguggacgaagcugaguacaugugcccagauggcagcuaugccauacaggagaacaucccgcugcuaauugcaggcgucaucgggggauccuacucuucggugucaauucagguugccaaucuccugcggcuuuuccaaaucccccagauaagcuaugcuaguaccuccgcaaagcugucugacaaaagccgcuacgauuauuuugccagaacagugccuccagacuucuaccaggcuaaggccauggcggaaauuuugagguuuuucaacuggaccuacgucuccacuguggcaucagagggugauuauggcgaaacagggaucgaggccuuugaacaggaggcucggcuccgcaauauuuguaucgccaccgcagagaaaguaggacgaaguaacaucagaaagagcuacgacucuguuauuagggaacuguuacaaaaacccaaugcucggguggucgugcuguucaugcguuccgacgauucacgcgagcucauagccgcggccagcagagcaaacgcuaguuuuacguggguggccucugacggcuggggugcucaggaauccaucauuaaggggagcgagcacgucgccuauggagcaaucacucuugaacuggccucgcagccuguuaggcaguucgaucgguacuuccaaucuuugaauccauauaacaaucaucgaaaccccugguuucgcgacuucugggagcagaaguuucagugcucccuacaaaauaaaagaaaccacaggcgggugugugauaagcaucuggcuauagacucaaguaacuacgagcaggaaagcaaaauuauguucguagugaaugcggucuaugcaauggcccacgcucuccacaagaugcagcgcacccugugcccuaacacaacuaaacuuugugaugccaugaagauccuggacggcaaaaaguuguacaaggauuaccuccugaaaaucaauuuuaccgcaccauucaacccgaauaaggacgccgauuccauugugaaauuugacacauucggcgacgggaugggaagauauaacguuuuuaauuuccagaacguggguggcaaguacucuuauuuaaaagucgggcauugggcugagacccugagccuagauguaaauucaauccacuggaguaggaacuccgugcccacgagccaaugcucugacccuugugccccaaaugaaaugaagaacaugcagcccggagauguuugcuguuggauuugcauaccuugcgagccauacgaauaucucgcagacgaguuuacuuguauggauugcggcucaggucaguggcccacagcggaccugaccggguguuacgaucuuccggaggacuauauccguugggaagaugcuugggccauuggcccugugacuaucgcaugcuugggauucauguguacaugcauggucgugaccgucuuuaucaagcauaauaacacgccccuggugaaagccaguggccgggagcucuguuacauucugcuuuucgggguuggacugagcuacugcaugaccuucuuuuucauagcuaagccauccccugugaucugugccuugcgaagacucggucuggggucuucguuugcaauuugcuauagcgcuuuacugacaaaaacuaauuguaucgccaggauuuucgacggcguaaagaacggagcgcagcgccccaaauuuaucuccccaucaagucaagucuucauaugccuaggccucauccuggugcagauuguuauggugucugucuggcuuaucuuggaagcccccgguacccggagauacacacuggcugagaagagggagacugugauucucaagugcaacguaaaagauagcuccaugcugaucucauuaaccuaugacgugauacugguuauucuuuguacagucuacgcauuuaagacccgcaaaugcccugaaaauuucaacgaggccaaguuuaucggguucacuauguauacgacauguauuaucugguuggcuuuucucccaauauucuacgugaccagcucugauuaucgagugcagacuaccacaaugugcaucuccgucagucugagcggcuuuguugugcuaggaugucuguucgccccgaaagugcacauuauccucuuccagccccaaaagaauguagucacccaccggcugcaucuuaaccguuuuucuguguccggcacugggacaacguacucacagaguagcgcaucgaccuacguuccuacugugugcaauggaagagaagucuuggacuccacaaccucuagccuguga

SEQ ID NO: 56969 - RNA, 2739 nt, Artificial Sequence
  derived and/or modified sequence opt3 from GRM4__Homo_sapiens__NP_000832
augcccggcaagagagggcugggaugguggugggccaggcucccucuuugccuguuguuaagccuguacgguccauggaugccguccucucuaggcaaacccaaggggcacccucauaugaacucaauccggauugacggagauauaacccucggcggucuguucccagugcacgggcgcggaagugagggcaaacccuguggcgaacuuaagaaagagaaggggauccaucgacuggaagcuauguuguuugcacucgaccguauuaauaacgauccugaccugcugccaaauaucacacucggagccagaauuuuagauacuugcagcagggacacgcacgcgcuggagcagucccuuaccuucguccaagcauugaucgaaaaggaugguacagagguucgguguggcucugggggacccccuauaaucacuaaaccagagcgcgugguaggcgugauuggugccucggggucaagcgucaguaucaugguggcaaacauucugagacuauuuaagaucccgcagauauccuaugccucuaccgcucccgaccucagcgauaauuccagguacgacuucuuuucacggguugugccuagugauacauaucaggcacaggccauggucgacauugugcgcgcucugaaauggaacuacguaagcaccguugccucugaaggauccuauggcgagucaggcguggaagcguucauccaaaagagccgagaggaugggggagucugcauugcacagagugugaaaaucccaagagagcccaaggccggugaauuugacaagaucauuaggcggcuucuggagacuucuaaugcucgugccgugauaaucuucgcaaacgaagacgauauucgcagagucuuggaggcugccaggcgggcgaaucagacaggccauuucuucuggaugggguccgacagcuggggaucgaaaaucgccccuguucuccaccuggaagagguggcagagggcgcuguaaccauauuaccaaagcgaaugucugugcgcgguuuugauagauacuucuccucaaggacgcuggacaacaaucggcgcaacauuugguuugccgaauuuugggaggauaauuuccacuguaaacucaguagacaugcucuuaagaaagggagccacgucaagaaaugcacuaacagggaacguaucggccaggacuccgccuaugagcaagaaggaaaggugcaguuuguuaucgaugcaguguacgccaugggccaugcucugcacgcgaugcaccgggacuugugucccgggcgagucggacuaugcccgagaauggauccuguggacgguacccagcugcucaaguacauuaggaauguaaacuucucuggcaucgcagggaaccccguuacauuuaaugagaacggagaugccccaggccgcuaugacauuuaccaguaucaacugcggaaugacagcgcugaguacaaagugauagguucauggacugaucaucuucaccugagaaucgaaaggaugcauuggccugggaguggccagcaguugccccgcuccauuuguagccucccaugccaacccggagagcgaaagaaaaccgucaagggcaugccuuguugcuggcacugcgaaccauguacaggguaucaguaccagguggaccgguauaccugcaaaacguguccguacgauaugcgucccacugagaacagaacaggaugcaggccuaucccaaucauuaagcuggaaugggguucucccugggccgucuuaccucuguuccuagcagugguuggcauagccgcuacccucuuugugguaaucacuuucguccgcuacaaugacacaccaauugugaaggccucagggcgggagcugaguuauguucuuuuggcaggaaucuuucuguguuacgcgaccacguuccucaugauugcugagcccgaucuggguaccugcagccuuagaaggaucuuucugggcuuggggauguccauaucuuaugccgcacuccugacaaaaacuaaccgaaucuaccgcauuuucgaacagggcaagcggucggugagcgccccgagauuuaucuccccugcuucacaauuagccauuaccuucagucugaucucucuacagcuccugggaauaugugucugguuugugguagacccaagccauuccgugguugauuuccaggaccagaggacacuugauccccguuucgcacgcggcgucuugaaaugcgacauuucagaucugagccucaucugucuguuaggguauucuaugcugcuuauggugacuugcaccguguacgcuauuaagacacggggagucccugagaccuuuaaugaagccaaacccaucggcuucacuauguauacgacauguauaguuugguuggcguuuaucccaauuuucuuugguaccucccaaagugccgacaagcucuacauccagacuaccacacugaccgugagcgugucucuauccgcuucaguaagucuggggaugcucuacaugccuaaggucuauauuauccuguuccaccccgagcagaacgugccaaaaagaaagaggagccuuaaagcaguugugacugccgcuacaaugucgaauaaguuuacgcagaaaggaaacuuccgaccgaauggcgaggccaaguccgaauugugcgagaaccuggaagcuccugcguuagccaccaagcaaacuuacgucacauauaccaaucacgcuauauga

SEQ ID NO: 56970 - RNA, 3543 nt, Artificial Sequence
  derived and/or modified sequence opt3 from GRM5__Homo_sapiens__NP_000833
auggugcugcuccuuauccugagcgucuuguuacugaaggaggacguuagaggcuccgcccagucuucagaaaggcgggugguagcucacaugcccggggauauuauaaucggagcacuauucagugugcaucaccaaccuaccgucgacaaagugcaugagcgcaagugcggugccguucgagaacaguacggcauucagcguguggaggcgaugcuccacacacuggaaagaaucaacagcgauccaacucuucugccgaauauuacguuggggugugagaucagggacuccugcuggcauucugcugucgcccucgagcagucgauagaauuuauccgggauucacugauuagcagugaggaagaggagggacuggugcgcuguguagacggcuccucuagcuccuucagaagcaaaaagcccaucguuggugugauugggccuggaaguagcucugucgcaauccaagugcagaaccucuuacagcuguuuaauauaccacagauugccuauuccgcuaccucaauggaucuuagcgacaaaacauuguucaaguacuuuaugagggugguccccagugaugcacaacaggcccgggcuaugguugacaucgugaagcgcuauaacuggacuuacguaucugccgugcacaccgaaggcaauuauggcgaguccgggauggaagcguucaaagauaugagcgcaaaggagggaauuugcaucgcccacucguacaaaaucuauucuaacgcuggugaacaguccuuugacaagcugcugaaaaagcucacaucacaucugccuaaggcccgagucguggcauguuucugcgagggcaugaccguuagagggcuucugauggcuaugaggcgguugggacucgccggcgaguuucuguuacuggguagugaugggugggcggaccguuacgacgugacugauggauaccagcgcgaagccgucggcggcauuacaauaaaacuccaaagcccagacgugaagugguucgaugacuauuaccuuaaacugagacccgagaccaaucacaggaacccuugguuucaggaguucuggcagcaucgguuucaaugucgauuggaaggguucccacaggaaaauuccaaguauaacaaaacgugcaauucuagccuaacucugaagacccaccacguacaggauucaaaaaugggauucguuaucaacgcaauuuacaguauggcuuauggucuccauaauaugcagaugucccuguguccgggcuacgccgggcuuugcgacgcuaugaagcccaucgauggacgcaagcuguuggagagccucaugaaaacaaacuuuacuggcgugucuggugacaccauacuguucgaugagaauggggacucaccuggcagauaugaaauuaugaacuuuaaggagaugggaaaagauuacuucgacuacaucaacgucggcaguugggacaauggggaauuaaagauggaugacgaugagguguggagcaaaaaguccaacaucauuaggucugucuguucggaaccaugcgagaagggacaaaucaaagugauucggaagggugagguuagcugcuguuggacaugcacccccuguaaagaaaaugaguauguguuugacgaauacacgugcaaggccugucagcugggcuccuggccuacugaugaccuaacagggugcgaucucauaccaguacaguaucugcgcuggggagaccccgagccgaucgcagccgucguguucgcuugucuuggcuugcuggcgacccucuuuguuacuguggucuucauuaucuacagagauacaccugugguaaaaucaaguucuagggagcugugcuauaucauucuugcagguauaugucugggguacuugugcaccuuuugucucaucgccaagcccaagcagauuuauugcuaccugcaacguaucggcauuggauuaagcccagcuauguccuacucagcccuggugacgaaaaccaaccggaucgcacgaauacuagccggcagcaagaaaaagaucugcacgaaaaagccuagauucaugucugcuugugcccagcucguuauugcauuuauccugauuugcauccagcuugggauaauugucgcguuguucaucauggaacccccagacauuaugcacgauuaucccuccaucagggagguguaccugauauguaauacuaccaaccucggaguggucacaccucuggguuauaauggcuuacugauccuuaguugcacuuuuuacgcuuucaagacccgcaacguuccagccaauuucaacgaagcaaaauauauugccuuuacaauguacaccacuuguaucauuugguuggcuuucgugccgaucuauuuugggagcaauuacaagauaauuacgaugugcuucucugugucccucucagccacaguagcacugggauguauguuuguccccaaaguguacaucauccuagcuaagccugagcggaacguuagaagugccuucaccacuagcaccguggucaggaugcaugugggcgacgguaaaucguccucugcggccagccgcucaaguucccugguuaaucucuggaagcgacgggggucuagcggcgaaacacuguccucaaacggaaaaagcgugaccugggcucagaaugagaagaguucucguggccaacaccuuuggcagagauuguccauucauaucaacaagaaagagaacccaaaucagacugcaguaauuaagcccuuuccuaaaagcacagaaucgagggggcugggagccggcgcuggugccgggggaucagcaggcggugucggcgcgacagggggagccggcugcgcuggggccggaccaggcggucccgagucuccggaugcagggccuaaggcuuuauaugacguggccgaagcagaggaacacuucccagcccccgcucgcccucggagucccuccccaauaagcacccucucucacagagcgggaagcgccuccaggacugacgaugacgugccuucacugcauagugagcccgucgcacgaucaucuuccucacagggcagucuuauggagcaaaucagcuccguugugacacgcuuuaccgcuaacauuucugaacuaaauucgaugauguugagcacagccgccccaucaccggguguaggcgcuccucucuguuccaguuaccugauccccaaagagauucagcuaccaacuaccaugacgaccuucgcagaaauccagccccugccugccauagaggugacagggggagcgcaaccagcugccggcgcacaggccgcuggggaugcagcccgggaaucucccgcggcuggaccugaggccgcagccgcuaagccggaccucgaggaacuggucgcccuuacuccacccagcccuuuuagagauuccguggacucaggcucuaccacaccaaacagccccguuagugaguccgcauugugcaucccuagcucuccgaaguaugauacucugauuaucagggacuacacccagucauccaguagcuuauga

SEQ ID NO: 56971 - RNA, 2634 nt, Artificial Sequence
  derived and/or modified sequence opt3 from GRM6__Homo_sapiens__NP_000834
auggccagacccaggcgggcucgcgagccucugcucguggcacuucugccauuggccugguuagcgcaggcuggccuggcccgagcagccgggagcguccgucuagcuggaggucucacccugggcgggcuuuucccgguucacgcaagaggagccgcuggcagggccugcggucaacugaagaaagaacagggggugcaucgguuggaggcgaugcucuacgcacuggaccgcguaaacgccgaucccgaacugcucccuggagugagauuaggcgcuaggcugcuugacacauguucccgggauacuuaugccuuggagcaggcacugucuuuuguccaggcucuaauccgcggccgaggggacggagaugaaguggguguuagaugcccaggcggggugcccccucucaggccagcgcccccugagcgggucguggccguaguuggagccucagcaaguagcguguccauuauggucgcuaaugugcugcgucuuuucgccauaccacaaaucucuuacgcuucgacggccccggagcugucagacagcacccgcuaugacuuuuucaguagagugguucccccugauuccuaccaggcacaggccauggucgauauugugagggcuuugggcuggaacuauguaucuacacucgcgagcgaagguaauuacggggaguccggaguggaagcauuuguccagaucucacgggaggccggcggcguguguauugcucaaaguaucaagauaccacgagagcccaaaccuggggaguucagcaagguuauccgcagacugauggaaacuccaaacgccaggggaauuaucauuuuugcaaaugaagacgauauccggcgcguguuagaggccgcuagacaggccaaccugaccggucacuuccucugggucggcucugacuccuggggagcaaaaacaucacccauacuuagccuggaagauguggcgguaggggcuauuaccaucuugccgaagagggccaguauugacggcuuugaccaguauuucaugacucguucucuagagaauaaccggcgaaauaucugguuugcagaguucugggaagagaacuuuaauugcaagcugacauccagcgguacccagucggaugacucuacgagaaaauguacuggggaagagaggaucggccgcgauuccaccuacgaacaagagggaaagguucaguucgugauugacgccgucuacgcuauagcccaugcacuccacucaaugcaucaggcucugugcccuggccacacagggcuuugucccgccauggagccaacugauggacggaugcuguugcaauauaucagagcggugagguucaacgguagugccggcaccccugucauguuuaaugaaaacggggacgcucccggacgcuacgauauuuuccaguaucaggcaacaaauggcagcgccuccucugguggguaccaggcugugggccaaugggccgagacccuccgacuggacguugaagcauuacaguggagcggagauccacacgaggugcccucaagucugugcucccuaccuuguggcccaggggaacggaaaaagaugguaaaaggagucccgugcuguuggcauugcgaggcgugcgacgguuaucguuuucagguggaugaguucacgugugaagccugccccggcgacaugagaccuacuccaaaccacacaggguguaggcccaccccuguugugcgccucagcuggucuucaccaugggcugcacccccgcugcuuuuggccguccugggaaucguggcuacuacaaccguaguggccacguuuguucgguacaacaauaccccuauagucagagcaaguggcagggagcucagcuaugugcugcuuacagguauuuuccugaucuacgccaucaccuuuuugaugguggcugaaccaggggcggccgucugcgcagcucgacgccucuuccugggcuuaggaacuacacuguccuacucugcccuacucacuaagaccaaccggauuuauagaaucuuugagcagggcaagaggucgguuacacccccucccuucauuagcccaaccucccaacuggugauaacuuuuucacuuacgaguuugcaagugguagggaugaucgccuggcugggagcucguccuccccauucugucauugacuacgaggaacagcgcacaguggauccagagcaggcacggggcguucucaaaugugacaugagcgaucuguccuuaaucgguugccugggguauucacuuuugcucauggugaccuguacugucuacgccaucaaggcgagaggagugccggaaaccuucaaugaggcuaaaccuauuggcuuuacaauguauaccacuugcauaaucuggcuggccuucguucccauuuucuuugguacagcacagagcgccgaaaagaucuacauucagacgaccacucuaacagugucucugucccucagugcuagcguaucucugggcaugcuuuaugucccaaaaaccuacgugaucuuguuccaccccgagcagaacgugcagaagaggaaacgaucccugaaggcaacaucaacugucgccgcgccuccaaagggggaggacgcugaagcccacaaauga

SEQ ID NO: 56972 - RNA, 2748 nt, Artificial Sequence
  derived and/or modified sequence opt3 from GRM7__Homo_sapiens__NP_000835
auggugcagcugagaaagcuccuuaggguccugaccuugaugaaauuccccugcuguguuuuagaggugcugcuaugcgcccucgcugcagccgcgcggggccaagaaauguacgcuccucacagcauccgcauugagggggacguaacacugggaggucuuuuuccagugcaugccaagggcccguccgggguccccuguggagauauaaaacgagaaaacggcauccaccgucuggaggcaauguuguaugcccucgaccagauuaauucugauccuaaccugcugccaaaugugacucucggugcuagaaucuuagacacgugcucaagggauaccuacgcacuggaacagagucuuacauucguucaggccuugauucaaaaggacacuagcgaugugcgguguaccaacggggagcccccugucuuugugaaaccagagaagguaguuggagugaucggcgcuuccgggucuucggucucaauaaugguggccaauauccugcgccuauuccagauuccccagaucagcuaugcgaguacagcaccugaacucuccgacgauagaagguacgacuuuuucucucggguggucccaccggauagcuuucaggcccaagcuaugguugacauugugaaggcccugggguggaacuauguauccacccuugcaucagagggaaguuacggugaaaaaggcguggagagcuucacucagaucucuaaggaggcugggggacugugcauagcccaguccguccgcauuccccaggaacgaaaagauagaacaaucgacuuugacaggauuaucaagcaauugcucgauaccccuaauucacgggcggugguuaucuucgccaacgacgaggauauuaaacagauacuggcagcugccaagcgugcugaccaggugggccauuuucuuugggucgguagcgauaguugggggucuaagaucaauccacugcaccaacaugaagacauugccgagggagcaaucacgauacagcccaaacgcgccacuguggaaggcuucgaugcuuauuuuaccuccagaacacucgagaacaauaggcggaacguaugguucgcggaguacugggaagagaauuucaacuguaaguuaacuauuagcggcucgaaaaaggaagacaccgaucgaaaaugcacagggcaggagcgcaucggaaaggacucuaauuacgaacaggaggguaaaguucaauuugugaucgaugcagucuaugccauggcucacgcccugcaccauaugaacaaggacuugugugcagacuacagaggcgugugcccugagauggaacaggccgggggaaagaaacuacugaaguauauuaggaacgucaauuucaacggcuccgcugguaccccagugauguuuaauaaaaacggggaugcccccggccgguacgacaucuuccaguaucagacgacuaauacaucaaacccgggauaccgccucauuggccaauggaccgaugagcugcagcuuaauauagaagacaugcagugggggaagggaguuagagagaucccugcaaguguguguacucugcccugcaaaccaggucagaggaagaagacacaaaaaggcaccccuugcuguuggacgugcgaacccugugauggguaucaguaccaguuugacgagaugaccugccagcacuguccauacgaucaacgucccaacgagaaucggacaggaugccaggacauuccuaucaucaaguuggaauggcauagcccaugggcgguaauuccggucuuccucgcuaugcugggcauaaucgccacuauuuuugugauggcaaccuucauccgauauaacgauacacccauuguuagagccuccgguagggaguuaucuuacgugcugcuaacugggaucuuucucuguuauauaaucaccuuccugaugauugcuaaaccugacgucgccgugugcagcuuucgccggguauuccuuggcuugggaauguguaucucauacgcagcucugcucacaaagaccaauagaauuuauaggaucuuugaacagggcaaaaagagugugacugccccacgccugauaucccccacgagccaacuugcgauuacaucuucacugaucaguguucaguugcucggggucuucauuugguucggaguggauccuccaaacaucauaaucgacuacgaugagcacaagaccaugaaucccgagcaggcccgaggugugcugaaaugcgacauuacugacuuacagaucauuuguagccugggcuauuccauccuacucaugguuaccugcacagucuacgcuauaaagacccggggcgugccggaaaacuuuaaugaggcaaaaccuauuggauucacuauguacacaacgugcaucguguggcuggccuuuaucccaauuuucuuuggcaccgcucaaucugccgaaaaacuuuauauccagacuacaaccuugacaauuucgaugaaccugagcgcauccguagcgcucgguaugcuguacaugcccaaggucuauauaaucauuuuccacccugaguuaaacgugcagaagcguaagagaucauuuaaagccguugugacugcugccaccaugaguucuaggcugagccauaagcccuccgaucgcccaaauggggaagcaaaaacggagcuuugugagaacgucgacccuaauucacccgcugccaagaaaaaguacgugagcuauaacaauuugguuaucuga

SEQ ID NO: 56973 - RNA, 2727 nt, Artificial Sequence
  derived and/or modified sequence opt3 from GRM8__Homo_sapiens__XP_006716001
auggugugcgagggcaagagaagcgccuccugucccugcuucuuucugcucaccgcuaaauucuacuggauccuuacaaugaugcagaggacucacucucaagaauaugcacauucaauucgggucgacggggauauaauccugggagguuuguuuccuguucacgccaagggcgagcgcggggugccauguggagaacucaaaaaggagaaaggcauucaucgacuggaagcgaugcuauacgcuaucgaccagauuaacaaggauccggaccuccugaguaauaucacgcuugguguacguauacuggauaccugcagcagagacacauaugccuuggagcagucccucacuuucgugcaggcacugaucgagaaggaugccucugacgucaaaugugcuaacggggaucccccuauuuuuaccaagccagacaaaaucucgggagugauuggcgcagccgcuucaagcguuaguaucaugguggccaauauacugagguuauucaagauuccccaaaucuccuacgcgucuacagcaccugaauuaagcgauaacacccgguaugacuuuuucucccgcgucgugccacccgauucauaccaggcccaggcuaugguagacauuguuacugcccugggcuggaauuaugugaguacacuugcaagcgaggggaacuacggagaaucuggugucgaggcuuuuacccagaucuccagagagaucggcggggugugcauugcccaaucacagaaaauaccuagggaaccacggccgggagaguucgaaaagaucauuaagcgcuugcuggagacgcccaaugcgcgagccgugaucauguuugcaaacgaagacgauauaagaaggauucuagaggcugccaaaaagcucaaucagagcggccacuuccuguggaucgguagugacucuuggggguccaaaaucgcuccugucuaccagcaagaggaaauugccgagggagcaguuacuauccuuccaaagcgggccagcauugauggcuuugaccguuauuuccgcucgagaacccuggcuaacaauaggcggaacgugugguucgcggaauuuugggaggaaaauuucggcuguaaauuggggucucauggaaagcgaaacucccacaucaaaaagugcacaggucucgagcgcauagcaagagauucaaguuacgagcaggaaggcaagguacaguuugugauugacgccgucuauagcauggcuuacgcccugcacaauaugcauaaagauuuaugucccggguauaucggacugugcccuaggauguccacuaucgacggcaaggagcuccuugguuacauucgggcagugaacuucaacgggucugccggcaccccaguuacauuuaaugaaaacggagaugcucccggccgcuaugacauauuccaauaccagaucaccaauaaaagcacggaguacaaggugauugggcacuggacuaaccagcugcauuugaaagucgaagauaugcagugggcccacagagagcacacacauccggcaucaguguguagucuaccuugcaagcccggagagaggaagaaaaccguaaaggguguuccaugcuguuggcacugcgaacguugugagggcuauaauuaccaaguggacgaacuguccugcgagcucuguccucuggaccagcggcccaacaugaaucgaacugggugccagcuuaucccaauuaucaaacuggaguggcauagccccugggcggucgugccugucuuuguggcuauauugggaaucauugccacaaccuucguuaucgugacguuuguaagauauaacgauaccccaauugucagggcaucuggccgcgaacucucauacgugcuguuaacagguaucuuccuguguuauaguauaacuuuucuaaugauugccgcuccggacaccaucauuugcagcuuccggagaguuuuucucgggcugggcauguguuucuccuacgccgcacuuuugacaaagacuaauaggauccaccgcauauucgagcagggcaaaaagucugugaccgcucccaaguuuaucucgccugccagccaacuggucauuacauucucccucaucucagugcagcugcuuggaguauuugugugguucguugucgauccaccccauauuaucauagacuauggggaacagcgaacccuggauccugagaaagcgcggggaguguugaagugcgacauuagugaucucucucugaucuguagcuuagguuacuccauccugcuaauggugacuugcacggucuacgccauuaaaacacguggcguuccagaaaccuuuaacgaggcuaagcccaucggguucacuauguauaccacaugcauuauauggcucgcauuuaucccgauuuucuuuggaaccgcccagucagcugagaaaauguacauccaaacuacaacgcugaccgugagcaugucucuuuccgccagugugagcuugggcaugcuguauaugccuaagguauacauuaucauauuccacccagaacagaauguccagaagagaaaaaggucuuuuaaggcagugguuacugcggccacaaugcaguccaaacucauccaaaaggguaacgaccgccccaauggggaggugaaaucagaacugugugagaguuuagaaaccaacacaagcucgacuaagaccacguauauuuccuacucuaaucacagcaucuga

SEQ ID NO: 56974 - RNA, 1782 nt, Artificial Sequence
  derived and/or modified sequence opt3 from GRN__Homo_sapiens__XP_005257310
auguggacccuggugagcugggucgcccucacagcuggccuuguugcagggacuagaugccccgacggacaguucuguccuguggccugcugucuggauccagguggcgcguccuacucuugcuguaggccguuguuagacaaguggcccacgacccugucacggcaccuagggggaccuugccaaguagaugcucauuguagugccggccacagcugcaucuuuacaguguccgguacuucuucguguugcccauuccccgaggcagucgccuguggggacggacaucacugcugcccucgcggcuuucauuguucagcugauggccgaagcugcuuccagcguagugggaacaauuccgugggagcaauucaguguccagacucucaguuugaaugccccgauuucagcaccuguugcguuaugguggacgguuccuggggcuguugcccuaugccacaagccucauguugcgaggauagaguccacuguugcccgcacggggcuuuuugcgaccucgugcauacaagguguauaacccccacuggaacacacccucuggccaaaaagcugccagcgcagcggaccaaccgcgcaguagcccugaguagcucuguuaugugccccgaugcuagauccagguguccugacggcucaacgugcugugaauugccaagcgguaaauaugggugcugucccaugccgaaugccacuugcuguagugaucaucuccacugcuguccucaggacaccgugugcgaccugauccagucuaagugccuguccaaagagaacgcaacaacugaucucuuaaccaagcugcccgcucacacagucggagacgugaagugugauauggaagugagcugcccagacggcuacaccuguugccggcuucaaucgggcgccuggggguguugcccuuucacgcaggcggucuguugcgaggaucauauucacuguugccccgccggauuuacuugugacacacagaaagguaccugcgagcagggcccacaucaaguucccuggauggaaaaggcuccugcacacuugucucugccagauccgcaggcccuaaaacgcgacgugcccugcgauaauguauccucauguccuaguagcgacacuugcugucagcucacauccggggaguggggaugcuguccaauccccgaagcugugugcuguucugaucaucaacacugcuguccucagggcuauaccugcgucgccgagggucagugucagcgagggagcgagauuguggcaggccuggaaaagaugccagccagaagggcuucacuuagucacccccgggacaucggaugcgaccaacauacguccugcccgguuggccagaccuguugcccuagccuugggggaucuugggcguguugccaguugccacacgcaguguguugcgaggaucgucagcauuguugccccgccgguuacacauguaacgucaaagcucgcucaugcgaaaaggaggugguaagugcccaaccugcaacuuuccucgccagaagcccccacguuggcgugaaggacgucgaauguggggagggacacuuuugccaugauaaucagaccugcuguagggacaaccggcagggcugggcuugcuguccauaucgacagggugugugcugugccgaucgcagacacugcuguccugcaggguucaggugcgcggcucggggcacaaaaugucugcgcagagaggcccccaggugggacgcaccauuacgugauccggcccugcggcaacuccuuuga

SEQ ID NO: 56975 - RNA, 654 nt, Artificial Sequence
  derived and/or modified sequence opt3 from GRPEL1__Homo_sapiens__NP_079472
auggccgcucagugcgugagacuggcaaggcggagccuccccgcccuugcgcuguccuugcgcccuucuccacgauuacuguguaccgcuacaaagcagaaaaacucaggccaaaaucuagaggaagacauggggcagagugagcagaaggccgauccgcccgcaacugagaaaacgcuccuggaagaaaaggucaaacuugaggagcaacugaaggaaaccguugagaaguacaaacgugccuuggcugacacagaaaaccucagacagaggagccagaagcugguggaggaggcaaaacuguauggaauccaggccuucugcaaggaucucuuagaaguagcugacgugcuggagaaagccacucaaugugucccuaaggaagagauuaaggaugacaauccacaccuuaaaaacuuguacgaaggucuggugaugaccgagguucagauacagaagguguuuacaaaacauggccuacucaagcugaaucccgucggggcgaaauucgauccuuaugagcacgaagcacuuuuucauaccccaguggagggaaaggaacccggcacuguagcccugguuuccaaaguggguuacaaguugcacgggcggacacuccgcccugcucuggucggaguggugaaggaggccuga

SEQ ID NO: 56976 - RNA, 426 nt, Artificial Sequence
  derived and/or modified sequence opt3 from GRP__Homo_sapiens__NP_001012530
augagaggcagggagcugccccucgugcuucuggccuuggucuuaugccuggcuccucgggggcgcgcaguuccacuaccggccggagguggcaccgugcucacaaagauguacccccgagggaaccacugggcgguaggacaucugaugggcaaaaagagcacuggugaauccucuucagugagugagcgugggagccuuaaacagcaacugagagaauauaucaggugggaggaagcugcccggaauuugcucggacugauugaggcaaaggagaaccgcaaucaccagccuccacagcccaaagcccugggcaaccagcaaccuuccugggacucugaagauucgucaaauuucaaggacgucggcagcaaggggaaaggaagucagagagaggguaggaacccacagcucaaucagcaauga

SEQ ID NO: 56977 - RNA, 1155 nt, Artificial Sequence
  derived and/or modified sequence opt3 from GRPR__Homo_sapiens__NP_005305
auggcccugaacgacugcuuccuccuuaaucuggagguggaucacuuuaugcauuguaacaucagcucccacucugcugacuugcccgucaaugaugacuggucacauccuggcauuuuauacguuauaccagcaguguaugggguaaucauucugaucggacuaauugguaacaucacccucauaaagaucuucugcacagugaaaaguaugagaaaugucccgaaccuguuuauuagcucccuugcccugggcgauuugcuccugcugaucacuugugcgcccguggacgcuucuagguaccucgccgaucggugguuauucgggcgcauuggaugcaagcugaucccuuuuauacagcuuacgucgguuggcgugucagucuucaccuugacagcacugagcgccgaccgauauaaagcuauugugcguccaauggauauccaagcaagucacgcccuaaugaagauuugucucaaagcugccuuuaucuggaucauuuccaugcugcuugcgauacccgaagcaguauucucugaccugcauccuuuucacgaggaaagcacuaaucagaccuucaucuccugcgccccauacccccacucaaacgaguugcauccuaagauucacaguauggcuagcuuucucguuuucuaugugaucccacugucuauaauuuccgucuacuauuacuuuaucgccaagaauuuaauccagucagcauacaaccugccgguggaagguaauauucaugugaaaaagcagaucgagagcagaaaaaggcucgcuaagacaguccuuguuuucguggggcuguucgccuuuuguugguugcccaaccacguaauuuaucuauaccggaguuaucacuacucugagguggauaccuccaugcugcauuucgucacuagcauaugcgcgcgccuccuggccuuuacaaauucgugugugaacccuuucgcacuuuaucuguugucuaaauccuuuagaaagcaauucaauacccagcuccugugcugucagccaggauuaaucauuaggucacacaguacgggccggagcacuaccugcaugacaucccugaagucuacuaaccccagcguugcuaccuuuucacuaaucaacggcaauaucugccaugaacgcuacguguga

SEQ ID NO: 56978 - RNA, 957 nt, Artificial Sequence
  derived and/or modified sequence opt3 from GRSF1__Homo_sapiens__NP_001091947
auggaggacgugcugaacuucuuuagcgauugcagaaucaggaauggcgaaaacgggauucacuuccuccuuaaucgggacggaaagcgccgaggugaugcccugauagagauggaauccgagcaggacguccaaaaggcuuuggaaaaacaucguauguacaugggccagagauauguugagguguacgagaucaacaaugaagauguagacgcauuaaugaaaucucuacaggugaagucaagucccgucgugaacgaugggguugugaggcugcggggacucccuuauagcuguaaugagaaagacauugucgacuuuuucgccggccugaacaucguggauauuaccuuuguaauggauuaccgcgguagaaggaagacaggggaagcguauguucaguucgaggagccagaaauggcuaaucaagcccuucugaagcaccgggaggaaaucggaaaccgcuacauagagaucuuuccgucccgaagaaaugaagugaggacucaugucggcucuuauaaaggcaagaaaauugcaucguuccccacggccaaguacaucaccgagccugagaugguguuugaggaacacgaagugaacgaggacauucagccaaugacagcuuucgaaucagagaaagagaucgaauugcccaaggaggucccugaaaagcucccagaggcagccgauuuugggacuaccagcagucugcauuucguucacaugcggggacugcccuuucaggcuaaugcccaggacauaauuaacuucuucgcgccucucaaaccagugcguaucacaauggaauacuccucuagcgguaaggcaaccggcgaggccgacguacacuuugagacucaugaagaugcuguggccgcaauguuaaaagaccgcucccacguccaucacagauauauugagcuguuccuuaauucaugcccgaaggggaaauga

SEQ ID NO: 56979 - RNA, 873 nt, Artificial Sequence
  derived and/or modified sequence opt3 from GRXCR1__Homo_sapiens__NP_001073945
augcugaagagagagaugaaacccgaaagcgacaggccucggaaggugcgcuuccgaaucgccuccucucacucaggccguguccucaaagagguuuacgaagaugggcagccaaguggaagccuugacuccgagugcgcuucuauuugugguauagauggccugggggacucggauggacaacagaacggccauaucgaaucagagggugacgagaaugaaaacgaucaggacagcuuguuagugcuggcaagagccgcgagugagaagggguuuggaaccaggcggguaaauauucuauccaaaaacggcacagugcgcggcgucaaguauaaggugucugcugggcaggcccucuucaauaaccugacuaaaguucuucaacagccgagcacggaucuggaauuugacagaguggucaucuacaccacaugcuugagggugguacggacuaccuucgagcgcugugagcucguucgaaagauuuuucagaaucacagagugaaauucgaagagaagaacaucgcacugaauggagaauaugguaaagagcuggaugaaaggugccggcgugucuccgaggcccccucacucccugugguguuuauagacggccauuacuuagggggagcugagaagauccugaguaugaacgaaagcggcgagcuucaggauauuuugacaaagaucgaacgcguccaacacccacaugagugucccucuugcgguggguucggauuucugccuuguuccguuugccacggcucaaaaaugagcauguucagaaauuguuuuaccgacaguuucaaggcacuaaaaugcacugccuguaacgaaaauggccuccagaggugcaagaacugcgcuggguga

SEQ ID NO: 56980 - RNA, 747 nt, Artificial Sequence
  derived and/or modified sequence opt3 from GRXCR2__Homo_sapiens__XP_011535976
auggaggaccccgaaaagaaacugaaccaaaagagcgauggcaaaccuagaaaggugagguucaaaaucuccucuucauacagugggcggguccucaagcagguuuuugaggacggacaggaacuugagagcccaaaggaagaguauccgcacuccuuccugcaggagucuuuggaaaccauggaugguguguacggcucgggggagguaccccgcccucagaugugcucaccaaaauuaacagcccaacgaauuagcguguuucgugaaggaaaugcuuauacucuggcaggcggucagcccagauucaacgacuacaaggccaaugaucauaaaccucuaccaauaaucgacuuugggaagauuaucauuuauacgaacaaucucaaaaucauaaggacccccauggauaagcgggacuucguccgcaagauccugcagaaagaggaggaagcggaggaagagagucuuaugaacaaggaagaguccuacggaggcagagaucagcacgacaggccucugguggaggcugaaucuacauugccacaaaaucgguauacucaggagggcgauauuccggaagacagcuguuuucauugccgcggguccggaucagccaccuguagucucugccacgguagcaaauucucuaugcuggcaaaccgauuuaaggaguccuacagagcccugaggugucccgcuugcaaugaaaacggccuccagccuugucagaucugcaaucaauga

SEQ ID NO: 56981 - RNA, 618 nt, Artificial Sequence
  derived and/or modified sequence opt3 from GSC2__Homo_sapiens__NP_005306
auggccgcugcagccggcggggcggcuagcagaaggggagccggucggcccugcccuuucuccaucgagcacauucugucuucacucccagaacgcagucuuccggcacgagccgcuugucccccucagccagcaggccgucaaagccccgccaagccugaggaaccaggggcucccgaggccgcgccuugcgcauguugcuguugcuguggaccaagagccgcuccgugcggucccccugaagccgcagcuggccugggggccagguuggcguggccauuacggcugggacccgccgugccucuaucccucggcgcaccagcuggcgggucuggagcccugcccggugcugucggcccggggucgcagcgcagaaccaggcggcaucgcacaauauuuucagaggagcagcuucaggcccuggaagcauuguucguucaaaaccaguacccugacgugagcacucgagagagacucgccggaaggauccggcugcgugaggaacgcguagaggugugguuuaaaaauagaagggcuaaguggcggcaccagaaacgagcgagugcauccgcccgccugcuccccggcgucaagaaaucuccaaaggguagcuguuga

SEQ ID NO: 56982 - RNA, 774 nt, Artificial Sequence
  derived and/or modified sequence opt3 from GSC__Homo_sapiens__NP_776248
augcccgccagcauguucuccaucgacaacauucuggcugcaagaccuaggugcaaggauucugugcucccagucgcccacucagcggcugccccgguuguguuucccgcacuucauggcgacagucuguacggggccagcggaggugcuuccucugauuauggcgcauucuacccucggccaguagcccccgggggagcuggcuugccugccgcggugucggguucacgcuuaggguauaauaacuacuuuuauggacagcugcacguccaagcagccccagugggccccgcuuguugcggcgccguuccuccacuaggggcacagcaguguagcugcgugccgacacccccuggauacgaggguccaggcaguguccucgugucccccguaccucaucagaugcugccauauaugaauguugggacccuuucucgaacugaacugcaauugcucaaccagcugcacugucguagaaaaaggcggcaucgcacgauauucaccgacgagcagcuggaagcucucgagaauuuauuucaggaaacaaaguaccccgaugugggaacuagagagcaacuggccaggaaaguccaccuucgggaggaaaagguggaggugugguucaaaaaccgccgagcgaaguggagaaggcagaagcggagcuccucagaagagagugagaaugccgaaaaauggaacaagaccucuagcuccaaagcaucaccggagaagcgugaagaggaaggcaaaagcgacuuggauagugacucuuga

SEQ ID NO: 56983 - RNA, 1338 nt, Artificial Sequence
  derived and/or modified sequence opt3 from GSDMA__Homo_sapiens__XP_006721895
augaccauguucgagaacgugacaagagcccuggcuaggcagcucaauccccggggcgaccuuacuccucuggauagcuugaucgacuuuaagcgcuuccacccauuuugcuuaguccugcgaaaacguaaguccacgcuauucuggggagcaagauacguuaggaccgauuauacacuccuggacgugcuugaaccggggucuucacccagugauccuacugacaccgguaacuuuggcuucaaaaauaugcuggauacacggguagagggggacguggaugucccaaagaccgugaaaguuaagggaacugccggcuugagccaaaacuccacacucgaagugcagacccugucugucgcgcccaaggcucuggagacggugcaggaacgcaaacucgccgcagaccaucccuuuuuaaaggagaugcaggaucaaggugagaaucuguacguaguuauggaaguggucgagacugugcaggaagugacccuugagagagccgggaaagcugaggcauguuucucguugccauuuuucgccccucugggacuacagggcucaauuaaccacaaggaagcugucacaauaccuaaaggcugcguucucgccuuuagggugcggcagcugaugguaaaggggaaggacgagugggauaucccacauauuuguaaugacaacaugcaaacuuucccgcccggagagaaaagcggugaggaaaaggugauccuuauucaggcgagugacgucggcgaugugcacgagggguuucgcacccugaaagaggaaguucagcgagagacacagcaaguggaaaaguuguccagagucggacagucuagccuccuguccucauuaaguaaacugcucggcaagaaaaaggagcuucaggaccuggaauuggcacuagagggugcccuggauaaggggcaugaggugacccucgaagcucugccuaaagacguacuucugagcaaggaggccguuggagcaaucuuguauuucgugggcgcucucacggaacugucugaggcccaacagaaauuacuggucaaguccauggagaaaaagauacuaccagugcagcucaagcuggucgaaucaacuauggagcagaauuuccuuuuggauaaagaaggcguguuuccccugcaaccugagcuccugagcagucuuggggacgaagaacugacauugaccgaggcgcucguuggacugucugguuuagaagugcagagguccggcccacaguacaugugggaucccgacacucugccgcggcuaugcgcccucuaugcagggcugagccuuuugcagcaacugacaaaggcuucguga

SEQ ID NO: 56984 - RNA, 1251 nt, Artificial Sequence
  derived and/or modified sequence opt3 from GSDMB__Homo_sapiens__XP_011523318
auguucagcguguuugaggaaaucaccagaauugucguuaaggagauggacgccggcggggauaugauagcugugaggucccugguagacgcagaucgguuccgcugcuuucaccucgugggagaaaaacgaacauucuuugguugucgucauuacacuacgggccuuacccugauggacaucuuggauacagacggggauaagugguuagacgagcuggauucuggacuacagggccaaaaagccgaguuccagauucucgacaacgucgauucaacuggugaacugaucgugagacuucccaaggagauuaccaucagugggagcuuucagggauuccaccaucagaaaauaaagaucuccgaaaauaggauuucucaacaguaucuggcgacauuggagaaccggaagcucaaacgcgaacugccuuuuucguucagaucaaucaauaccagggagaaccuguaccucguuacugagacauuagaaaccgugaaggaggaaacgcugaaaagcgaccggcaguauaaguuuuggagucagauuucccaaggccaccuuucuuacaaacauaagggccagcgcgaggucacuaucccaccgaaucgaguguugagcuauagaguaaagcagcugguuuuccccaacaaagaaaccaugaauauacacuuuagggggaagacaaaauccuucccugaggagaaggauggagcuucaaguugccuagguaaaagccucggcucugaagacucccggaacaugaaggagaaacuggaagacauggagucagugcuuaaggaucugacugaagagaagcguaaagacgucuugaauagccucgccaagugucuggggaaagaggauauucgccaggacuuagaacaaagagugagugaggugcugaucucuggagaacuccacauggaggauccagacaagccccuucuguccagcuuguucaacgcagccggcguccuaguugaagcuagggcaaaagccauucuggauuuucucgacgcucugcuugagcugucggaggaacagcaguucguggccgaggcguuggaaaaggguacccucccucuguuaaaggaucaaguaaaaucugugauggagcagaauugggacgagcuggcauccucaccacccgauauggacuacgacccugaagcccggauccuaugcgcucucuaugucgugguuaguauccugcuugaguuggccgaagggccaacaagcguguccucuuga

SEQ ID NO: 56985 - RNA, 1527 nt, Artificial Sequence
  derived and/or modified sequence opt3 from GSDMC__Homo_sapiens__NP_113603
augcccagcaugcuggagagaaucuccaagaaccucgugaaagaaauuggcucuaaggaccuuaccccugucaaauaccuguugucagccacaaaguuaaggcaguucguuauacugcggaaaaagaaggauagucgcagcuccuuuugggagcaaucugacuaugugccaguagaguucucgcuaaaugauauccucgaaccgucaagcagugugcuggaaacugucgugacggggcccuuucacuucuccgacauuaugauccagaaacauaaggcugauaugggaguuaacguggguauugaggucucugugagcggcgaggcauccguagaccacgggugcucacuugaauuucagaucguuaccauaccuaguccaaaucuggaggauuuccagaaacgaaaguugcucgaccccgaaccuagcuuucugaaagagugucguagaaggggagauaaccuguacguggucacagaggccguggaacucaucaauaacacuguguuauaugacucuuccucagucaauauucugggcaagaucgcgcuuuggauuaccuacgguaaggggcaaggacagggcgagagcuugcggguuaaaaagaaagcucugacacuacagaagggcauggugauggccuauaaacgcaagcagcucguaaucaaagaaaaggcaauacugauuagugaugacgaugagcaaagaaccuuccaggacgaauacgagaucucugagauggugggguauugcgccgcuagguccgaaggacuucugcccagcuuucauacuauuucgccaacauuguucaacgcaucuuccaaugacaugaagcucaaaccugagcuguuuuuaacccagcaguuccugucaggucaccucccaaaguacgaacaaguccauauccuuccggugggccggaucgaggaacccuuuuggcagaacuucaaacaucugcaggaggagguuuuccaaaagauuaaaacguuggcccagcuaaguaaggaugugcaggacgucauguuuuacagcauacuggcuaugcuccgcgaucgaggggcccugcaggaccuuaugaauaugcuggaauuggauuccucuggacaccucgacggcccugguggggcgauccugaagaaauuacaacaggauagcaaccacgcaugguucaauccaaaggaccccauucuguaucuacucgaggccaucauggugcugucagauuuucagcacgaccuuuuggcuuguaguauggagaaaagaauacugcuccagcaacaggaacugguaagguccauucuugaaccuaacuuccgguacccauggagcauccccuuuacucugaagccggaguugcucgccccucugcagucugagggauuagcaaucaccuauggccugcuagaagagugcggccuccguauggaacuggauaauccccgcucaacaugggacguugaggcuaaaaugccacuuagugccuuguacgggacucugagccuccugcagcaauuagcggaggccuga

SEQ ID NO: 56986 - RNA, 1455 nt, Artificial Sequence
  derived and/or modified sequence opt3 from GSDMD__Homo_sapiens__NP_079012
augggcagcgccuucgagagaguggucaggcggguugugcaggaacuggaccacgggggagaguuuauccccguaaccucccuccaaucuucaacagguuuccagccuuacugccuugugguccgcaagccaaguagcuccugguuuuggaagccgcgauauaagugugugaaccugucuauuaaagauauauuggaacccgacgcugcagagccugauguucagcguggcagaucguuccauuuuuacgacgccauggaugggcagauccaaggaucaguggaauuagcggcuccaggccaggccaagauugccgguggggcagcugucagcgacaguuccucuacuagcaugaauguguauucccugucaguagaucccaacacguggcagacccuacuccacgagaggcaucugcggcagccugagcacaaaguucuucaacagcugcgcaguagaggagacaauguguacgucgugacagaaguguugcagacucagaaggaggucgaaguuaccaggacacauaagcgggagggcagcggccgcuucucucucccaggggcaaccugccugcaaggagagggucagggccaccugucccagaaaaagacugugacaauccccucagggagcacccucgccuuucgaguagcucaauuagugauugauagugaccuggauguccuuuuguucccugacaaaaagcagagaacguuucagccaccggccacuggacacaaaaggucuaccuccgaaggcgcguggccccagcugccuagcggucuaucgaugaugcggugucuccauaacuuccugacagauggggugccagcagagggagccuuuacugaagacuuccaaggccuucgugcugagguugaaaccaucucuaaggagcuggaguugcucgaccgcgaacugugccaguuacugcucgagggccuugaaggggugcugagagaucaguuggcccuaagggcacuggaggaagcucucgagcagggacaaucccugggucccgucgagccucuugacggcccagccggggcggugcuggaauguuugguacucucaaguggaaugcugguucccgaguuagccauaccgguggucuaucugcuaggcgcacucacaaugcugagcgaaacccagcacaaacuuuuggcugaggcccuggaaucccagacgcuccuggguccucuugagcugguggggucuuugcucgagcagagcgcucccuggcaagaacggucaacuaugagucugccaccuggcuuacugggaaauuccuggggcgagggggcccccgcauggguccuacucgaugaaugcggacuggagcuuggugaggacacaccacauguguguugggaaccccaggcccagggccgaaugugcgcuuuguacgcgagccuggcacuccugucuggguuaucacaggagccucacuga

SEQ ID NO: 56987 - RNA, 3342 nt, Artificial Sequence
  derived and/or modified sequence opt3 from GSE1__Homo_sapiens__NP_001127945
augggccccaucauugugccuccagggggacacagcgucccguccacacccccuguugugaccauagccccaacuaagacgguaaacgguguguggagaucugagucaaggcaggacgcuggcagucggagcuccucugggggacgcgaacgacugaucgucgagcccccucucccacaagaaaaagcaggcggucccgccauuccuucgcaucuucugucaaccccauacccguucggguugagccccaguuccgugguucaggauucucguuuuccuccauuaaaucugcagagacccgugcaccaugucgugccuccaagcacaguaacugaggacuaucuaagguccuuccggcccuaccacaccacagaugaccuccgcaugucaagucugccgccucuuggacuggaucccgcgaccgcugccgcauauuaccauccaagcuauuuggccccucaccccuuuccacaccccgcuuucagaauggacgauucuuacugccucuccgcacugaggucaccuuuuuauccaaucccgacucccggcagccugccuccacuccaucccagugccaugcacuuacaucugucuggcguucgguacccuccagaacuuucccacagcucguuggcugcccugcacucugagcgcauguccgggcuaucagcggagcgacuccagauggacgaagaacugagaagggaacgggagcgugagcgcgaaagagagagggaacgggaggcagaucgagaacgcgagaaggagagagaaagggagcgggaaaaagagcgcgaacaagagaaggagagagaaagggagaaagaacgugagcgggaacuugagcgacagagagagcagagggcccgcgaaaaggagcuguuggcugccaaggcacucgaacccaguuuccugccgguggcugaguuacauggacugcggggucacgccacagaggaaagaggcaaaccuagcgagcagcucaccccaacgagggcggaaaaacuuaaggacgccgggcugcaagcacccaagccuguccagcaucccuugcacccagugccuacuccccaucacaccgugccaucccuaauuucuaaccacggaaucuuuagccugccgucaaguuccgcugccacagcucuccugauacagcgcacuaaugaggaagagaaauggcuugcccgacagcggcgucugagacaagagaaggaagauaggcagagccaggucucugaguuccgccaacagguuuuggaacagcaucucgacaugggccggccucccgugccagcagaggccgaacacagacccgagucaaccacaaggccugguccaaaccgacaugagcccgggggacgcgauccuccgcagcacuuuggcggcccacccccucugaucaguccaaagccccaauuacacgcugcgccuaccgcacuguggaauccgguaagccuaauggacaacacgcucgaaacucggagagccgagucccauucucugcacucgcaucccgcugccuucgaaccaagcaggcaggcagccgugccucuugucaaaguggagcguguguuuugucccgaaaaggcugaggaggggccacgcaaacgggaaccugcccccuuggacaaguaccagccaccgccucccccacccagagagggagguucccuggaacaccagccuuuccucccaggccccgggccuuuucuggcagagcuugagaaaucaacacaaaccauucugggacagcagagggcgaguuugccgcaggcugccacuuucggcgaacucucugguccacugaagcccgggagcccuuaucgacccccaguuccucgggcacccgauccagccuacaucuaugacgaguucuuacaacagcgcagaaggcuggucuccaaacuagaucucgaggagcggcgaagacgcgaagcucaggagaagggcuacuauuacgaccuggaugacucauaugaugagagcgacgaagaggaagugagggcccaucuucguugcguagcagagcagccuccguugaagcuggauacaucuuccgaaaaacucgaguuucugcaauuauucggacugaccacgcagcagcaaaaggaggaacuuguugcucagaaacggagaaagaggcgccgaauguugagagagcggagucccagcccaccuaccauucagucuaaaaggcagacacccuccccacgccucgcccugucaacucguuacaguccugacgaaaugaauaacagccccaauuuugaggaaaagaagaaauuccuaaccaucuuuaaccugacacacauaucggcggagaagagaaaagauaaggagcggcucguggaaaugcugagggccaugaaacaaaaggcucuuuccgcagccgucgcugacucuuugacuaauagcccgcgcgacucaccagccgugagucuguccgagccugcaacccagcaggcgucuuuagaugucgaaaagcccgugggcguugccgcuagccucuccgacauuccaaaagccgcagagcccgggaagcuggaacaggugcgaccucaagaacuuucaagaguacaggagcuggcuccggccagcggagaaaaagcacgguugagugaggcccccgguggcaagaaaucucucuccaugcugcacuacauccgcggggcugcgccaaaggauauuccugucccccuaagccauucgacaaacggaaagucaaaaccuugggaaccauucguggccgaggaguuugcacaccaguuccaugaaucuguucugcagaguacccaaaaggcucuccagaaacacaagggcuccguggccguccugagcgccgagcagaaucauaaaguggacacuucuguacacuauaacauccccgaacuucaaagcuccucaagggcuccuccaccccagcacaauggucagcaggagccgccuacggcaagaaaggggccacccacacaagaauuggauagggacagugaggaggaagaggaagaggaugacgaagauggcgaggacgaggaagaggugccuaaacggaaguggcagggaaucgaagccguuuuugaggcguaccaggagcauauugaggagcagaaccuggaacgucaagucuuacagacccagugucgccgacucgaggcuagacacuauagccugucucuuacugccgaacagcugucccauucaguggcagagcuaaggagucaaaagcagaaaauggugagcgagcgggaacgccuccaggccgagcuggaucacuugagaaagugccuggcuuuaccagcaaugcacuggcccaggggcuaccucaaaggguauccgcgguga

SEQ ID NO: 56988 - RNA, 996 nt, Artificial Sequence
  derived and/or modified sequence opt3 from GSG1L__Homo_sapiens__NP_001103233
augaagaccagcagaaggggccgggcccugcucgcuguggcacuuaaccuguuggccuuacuguucgcgacaacugcuuuucuaacgacccacuggugccaggggacacaacgcguccccaaaccuggauguggucagggcgggcgagccaauugcccaaacuccggagcaaaugccacugcuaacggcaccgcagccccggcugccgcggcagccgcugccacagcaucugguaaugggcccccuggaggcgcucucuacucaugggagaccggcgacgaucguuuccuguuuagaaacuuccauacugggaucugguauaguugugaagaggaacuuagcggacugggugagaagugcagguccuuuauugacuuggccccagcgucugaaaaaggcguucucuggcugucggugguaucagaggugcuguacauacucuuacuggucgugggguucagccuuauguguuuggagcuguuucacaguuccaauguuaucgauggacuaaagcucaacgccuucgcagcuguguuuacaguccugucuggccuucuggguaugguggcccauaugauguauacccagguauuccagguuacggugagcuuggggcccgaagacuggcggccucacuccugggauuacggauggucauuuugccucgcuuggggcaguuucacuuguugcauggccgcaagcgucaccacauuaaauucuuauacuaaaaccgugauugaguuucgccauaagagaaagguguucgaacaaggcuacagggaggagccaacauucaucgaccccgaagccauuaaauauuuucgggagcgcauggaaaagcgagauggguccgaggaagacuuccaccuggauuguagacacgagagguacccugcucggcaucagccacacauggcggacucauggccgcguagcagugcacaggaggcccccgaacugaaccgccagugcuggguccucggacauuggguuuga

SEQ ID NO: 56989 - RNA, 1452 nt, Artificial Sequence
  derived and/or modified sequence opt3 from GSK3A__Homo_sapiens__NP_063937
augagcggcgggggacccuccgguggcgggccuggaggcucugguagagccaggaccucaaguuucgcugagccagggggaggcggcgggggagguggcgggggaccgggcgguagcgcauccgggcccggaggcacaggcgggggaaaggccucugugggugcgaugggcgggggagucggcgcuucgucaagcggugggggcccuggaggcagugggggagguggcuccgggggaccaggcgccgguacuucuuuucccccuccagggguuaaacugggccgggacagcggaaaggugacgaccguaguggcaacacucggccaggggcccgaacgcucccaagaggucgccuacacugauaucaaagugauuggaaacgguucauucggcguuguguaucaggcucgacuugcagaaacccgugagcuggucgccauaaagaaaguguugcaggacaagagauuuaagaauagggaauuacagaucaugcggaaacuggaucacugcaacauuguacgccuaagauacuucuuuuauaguagcggggagaagaaagacgagcucuaccugaaucuuguucuggaauaugugccugagacagucuacaggguggcucggcacuucaccaaggccaaauugacuaucccaauucucuaugugaaggucuacauguaccaacuguuucgcucucuggcguauauccacucccagggaguuugucaucgagauauaaagccgcagaaccucuuaguggaccccgauacagcaguacugaaacuuugcgacuucggcucagccaagcaguuggugagaggugaaccuaaugucagcuacaucuguaguagguauuaccgggcuccagagcugauuuuuggggccaccgauuauacgucuuccaucgacguguggagcgcaggcugcguucuagcugagcuccugcuuggacaacccauuuucccuggcgauucggggguggaccagcuggucgaaaucauaaaaguguugggaacuccaacccgugagcagauucgcgaaaugaaccccaauuacacagaguuuaaguucccgcagaucaaagcccacccuuggacuaagguauuuaaaucuagaacacccccagaagcgauugcccucuguuccucacuguuagaguauaccccuaguagcaggcugucuccccucgaggcaugcgcucauuccuucuucgaugaacuucggugucugggcacccaauugccaaacaaucgaccccuaccuccacuguuuaacuucagcgccggugagcucucaauccagccgagucugaaugcuauccuuauucccccucaucugcgcuccccagccgggacgacuacauugacccccagcucucaggcacucacugaaacaccuaccucaagugacuggcaaagcacggacgccaccccaacacugacuaacuccucuuga

SEQ ID NO: 56990 - RNA, 1263 nt, Artificial Sequence
  derived and/or modified sequence opt3 from GSK3B__Homo_sapiens__NP_001139628
augagcggcagacccaggaccacauccuucgccgagucuugcaagccugugcagcaaccaucagcuuuugggaguaugaaagucagccgggacaaggauggauccaaaguuacuacggugguagcaaccccgggucagggccccgaccgcccucaggaagugucuuacacagauacuaaggucaucgggaacggaucguucggcgugguuuaucaggccaaacugugugacucaggugagcucguggcgaucaagaagguccuucaagauaaacgauuuaagaaucgugaacugcagauaaugagaaaauuggaccacugcaacaucgugagguuacgguacuucuuuuauagcaguggggagaagaaagaugaaguauaccugaaucuaguucucgacuaugugccagagaccgucuaccgcguggcuagacauuauuccagggccaagcagacacugcccgugauuuacgucaaacuuuacauguaucagcuguuccggucuuuggcauacauccacagcuuuggaauuugucaucgcgauaucaagccucaaaaccuccugcuggacccagauaccgccguucucaaguuaugcgacuucggcuccgcuaaacagcuggugcgaggcgagcccaauguaucauauauauguaguagauacuauagggcaccugaacuuaucuuuggggccacugauuacacaagcucuauugacgugugguccgcuggaugcgucuuggccgagcugcuacucggucagccaaucuucccgggcgacucagggguggaucagcugguugaaauuaucaaggugcuuggaacccccacgcgggagcaaauacgugagaugaacccuaauuauacugaauuuaaauucccacagauuaaggcgcaccccuggaccaaagucuuucgcccuagaacaccacccgaggcaaucgcccuguguagcagguugcucgaauacacuccgaccgcucggcugacaccuuuagaggccugcgcacauaguuucuucgacgaacugcgagaucccaacgugaagcucccaaauggccgcgacaccccugcucuuuuuaacuucacgacucaggagcugucuuccaaucccccauuggccacaauucuaauucccccucacgcgagaauccaagccgcagcuagcaccccaacuaacgccacagcugccucggaugcaaauaccggugacagggggcagacgaacaaugccgcuucugcguccgcaucaaacaguaccuga

SEQ ID NO: 56991 - RNA, 2349 nt, Artificial Sequence
  derived and/or modified sequence opt3 from GSN__Homo_sapiens__NP_000168
auggcaccccacagaccugcuccagcacugcucugcgcccuuagccuggcguugugugcuuuaucccugccggugagggccgcaaccgccucucggggcgcuucacaggcaggggcuccccaaggacgcgucccugaggcccgaccaaacaguaugguuguggaacaucccgaguuccuaaaggccgguaaagaaccuggccuccagaucuggcguguagagaaguuugaccuggugccaguccccacaaaucuuuacggggauuucuuuacuggagacgcguaugugauucugaaaacgguucaguugagaaacggcaaucuccaguacgaucugcacuauuggcuggguaacgaaugcagccaagacgaguccggggcagccgcuauauucaccgugcagcucgaugacuacuuaaauggaagggccguccagcaucgggaggugcagggcuuugaaucugcaacauuccugggcuauuuuaagucggggcuuaaauacaagaagggagguguagcuucaggcuucaaacacguugugccuaacgaggucguggugcaacgcuuguuucaggucaaggggagaaggguugugcgggccacugaaguaccagugagcugggagaguuucaauaacggagauuguuuuauccuggaccuaggcaauaacauucaucaguggugcgguuccaauucuaaccgcuaugagcgacucaaagcgacccaggucagcaaggggaucagagauaaugaaagguccggacgggcccgugugcacguuucagaggaaggcacagagccggaagcaaugcugcaagugcuuggccccaaaccugcucugccagccgggaccgaggacacugcuaaggaggaugccgcaaaccgcaaguuggccaaacucuacaaggucaguaauggagcugguacaaugagcgugucucugguagcggacgaaaaccccuucgcacagggcgccuuaaaauccgaggauuguuuuauucuggaccacgggaaggacggaaaaaucuucguuuggaagggcaaacaggcuaacaccgaagagagaaaggccgcacucaagacggccucagauuucauaacuaaaauggacuacccuaagcaaacccaggugagcguccuuccagaagguggggagacaccccuguuuaaacaguucuuuaagaauuggagggauccggaccagacugauggcuugggacuaaguuaucugucuucccauaucgcuaacguggagcgggucccuuucgacgccgcaacccuccacacaagcaccgcgauggcugcccaacauggcauggaugacgaugggacgggacagaaacagauuuggcgaaucgaagguucgaauaaggugcccguugacccagcaacuuacggccaguuuuaugggggagauucuuacauuauccuguauaacuaccgccacggcgguagacaagggcagauaauuuauaauuggcagggcgcccaguccacacaagacgagguggcugccucagcaauccuuaccgcucagcuggacgaagaguugggaggcacuccuguacagaguagggucgugcaggggaaggaacccgcccaccucaugagccuguucggagguaaaccaaugauuaucuacaagggcgggacaucccgggagggaggccaaaccgcgcccgccucuacgcgcuuauuucagguuagagcuaacagcgccggugccaccagggcuguggagguccugccuaaagccggggcacuaaauucaaacgaugcguucgugcucaagacaccaagugccgcuuaccuguggguaggcacuggagccuccgaagcagagaaaaccggcgcucaggaacuuuugcgugugcugcgggcccaaccgguucaggucgcagaggggagcgagcccgacggauuuugggaagcccucggcgguaaggcugcguaucgaacaucuccuagacugaaggauaaaaagauggacgcccauccacccaggcuuuucgcaugcucaaauaaaaucgggcgcuuugugauugaggaagugccuggagagcugaugcaggaagauuuggcuacugacgaugucaugcuccuggacaccugggaucagguuuucgugugggugggcaaggacagucaagaggaggagaaaacagaagccuuaaccagcgccaagcgguacauagaaacugauccagcuaacagagacaggcgcacgcccaucacaguagucaagcaggguuuugagccgccuuccuucgugggcugguuccuggggugggaugacgacuauuggucuguugauccacuagaccgagcaauggccgaacucgcggcuuga

SEQ ID NO: 56992 - RNA, 1911 nt, Artificial Sequence
  derived and/or modified sequence opt3 from GSPT1__Homo_sapiens__NP_001123478
auggaccccggcagcgggggagguggcgggggaggcggugggggaggcuccucuucaggcaguagcuccucugauucggccccugacugcugggaucaggcugacauggaggcaccagggccgggacccugugguggcgggggaucacuggccgcggcugccgaagcacaaagagagaaccucagcgccgcuuucaguaggcagcuuaaugugaacgcaaagccuuuugucccaaauguucacgccgcugaguucgugcccuccuuucugcggggcccugccgcgccacccccuccagcaggaggggccgcuaacaaucauggagccggcucuggcgcagggggacgcgcugccccgguagagagcucccaggaagaacagucauugugcgaggguaguaacagcgcggugucuauggaauuauccgagcccaucgaaaauggcgagaccgagaugucaccugaagagagcugggaacacaaagaggaaauuagugaggccgagccagggggaggcucucugggugaugggcgacccccugaagaguccgcacaugaaaugauggaggaagaggaggaaauaccaaagcccaaaagcgucguggcuccgccuggcgcccccaagaaagagcacguuaacguggucuucaucggacauguggacgcuggcaagucgacaauugggggacaaaucauguaccuaacugguaugguagauaagcguacgcucgaaaaauaugagagagaagccaaggagaaaaauagggagaccugguaccugucuugggcacuugacacaaaccaggaagaacgggauaagggcaaaacuguugaaguggggcgcgccuauuuugagaccgagaagaagcacuucacaauucuggacgcuccaggacacaaauccuuugucccuaauaugaucggcggugcgucacaggcagauuuggccgugcucgugauaagugcuagaaagggggaguucgagaccggcuuugaaaaaggaggccagacuagggagcaugccaugcuggcaaagacagccggggucaaacaccugaucguucucauuaacaagauggacgaucccaccgugaauuggagcaacgaacgguacgaggaguguaaagaaaaguuaguaccauuccugaagaaagugggauuuaaucccaagaaagacauccauuucaugccuugcuccggucuuacgggcgcuaacuugaaggagcaaucugacuuuuguccaugguauauugggcugccguucauccccuaccuagauaaccucccuaauuucaaccgcagcgucgacggaccaauacgacugcccauuguggauaaauauaaggacaugggcacuguugugcuugguaagcuggaaucagggaguaucugcaaaggccagcaguuggucaugaugccuaauaagcacaacguggagguacucgguauucuguccgaugacguugaaaccgauacaguggccccaggcgagaauuuaaaaaucagacugaaggggaucgaggaagaggaaauucuccccggauuuauacuuugugacccgaacaaucugugccacagcggcaggacuuucgaugcacagaucgucauuaucgagcauaaaucuauaauuuguccugguuacaacgcgguguugcacauccauaccugcaucgaagaggucgagauuacagcucuaaucugucugguggacaagaagucaggggagaaaaguaagacccggccacguuuuguuaaacaagaucaggugugcauugcccgccucagaacggcaggaacuauaugccuggaaacauucaaggacuuuccccagaugggcagguucacccuucgggacgaagguaaaacuaucgccauuggcaagguacugaaguuggucccugagaaagauuga

SEQ ID NO: 56993 - RNA, 1887 nt, Artificial Sequence
  derived and/or modified sequence opt3 from GSPT2__Homo_sapiens__NP_060564
auggacagcggcuccucuucaagugauagcgcccccgacugcugggaucagguggacauggaguccccugggucugcuccaucgggagauggugucucaagcgcaguugccgaagcgcaaagagagccgcugaguuccgcuuucucuaggaagcucaacgugaaugccaaacccuuuguaccuaacgugcacgcagccgaguucguccccagcuuucuucggggcccaacccagccuccaacacugcccgcuggguccggaucaaaugacgaaacuuguacgggcgcagguuacccucaggggaagcgcaugggacgaggcgccccaguggaaccgagucgugaggagcccuugguuagcuuagaaggcucuaacuccgcugugaccauggagcugucagaaccugucguggagaauggggagguagaaauggcccuagaggaaagcugggagcauaguaaagaaguuucugaggcggagccaggagguggcuccagcggggauucgggacccccugaagagucuggccaggaaaugauggaggaaaaggaggagaucagaaaauccaagucagugauugucccaaguggugcacccaagaaagaacacgugaacguggucuucauagggcauguugacgccggaaagagcacaaucggcggccaaauuauguuucucacugggaugguggauaaaaggacccuggagaaguaugaacgggaggcuaaagaaaagaaucgcgagacaugguaccuuuccugggcccuggacaccaaccaggaggaaagagauaagggaaaaacuguagagguggguagggcauauuucgaaacagagcggaagcacuuuaccaucuuggacgcuccgggccauaaaucuuucgucccuaauaugauugggggagccagccaggcggaucucgccgugcugguuaucucagcacgcaagggcgaguuugaaacggguuucgagaaagggggccagacucgagaacacgcuaugcuggccaagaccgcuggagugaaacaccucauagucuuaaucaacaagauggacgaccccacagugaauuggaguauugagagauacgaagagugcaaggagaaacugguaccauuucuuaagaaaguuggcuucuccccuaagaaagauauccauuuuaugcccuguagcggguugacuggagccaacauuaaggaacaaucugacuucugcccaugguauaccggucugcccuucaucccuuaccuagauaaucucccaaacuuuaauaggucaauagacggcccgauucggcugcccaucguggauaaguauaaagacauggggacagucgugcuuggaaagcuggagaguggcagcauuuucaaaggucagcaguuggucaugaugccuaacaagcacaacguggaaguucucgggauccuguccgaugacaccgagacggauuuuguggcaccaggcgaaaauuuaaaaauccgucugaagggaauugaggaggaagagauacuccccggcuucauccuuugugacccuucuaaccugugccauucggggcgcacuuuugauguacagauugucaucauagaacacaagagcauuaucuguccaggauacaaugccguguugcacauccauacaugcauugaggaaguugagaucaccgcucuaauuucccugguggacaaaaagucaggugagaaaaguaagacuagacccagguucgucaaacaagaccagguguguauagcgcggcuccgaacagcaggcaccaucugccuggaaacguuuaaggauuucccgcagauggggcgcuuuacccuuagagacgagggaaagacaauugccaucggcaaaguacugaaguuggugccugaaaaagauuga

SEQ ID NO: 56994 - RNA, 1569 nt, Artificial Sequence
  derived and/or modified sequence opt3 from GSR__Homo_sapiens__NP_000628
auggcccugcuccccagagcucuuagcgcaggcgccgggccuuccuggaggcgggcggcucgcgccuuccgaggauuucuguuguuacugccagagccggcagcccuaacccgugcucucucuagagcaauggccugcaggcaggaaccccaaccucaggguccacccccugcugccggcgcgguggcaucauacgacuaucuggucaucgggggaggcaguggugggcuugccagcgcucggcgcgccgcagagcugggagcuagagccgcgguuguggaaucccacaaguugggcggcacauguguaaacguggggugcgucccaaagaaggugauguggaauacugccguucauucugaguucaugcacgaucaugcagacuacggauuucccucgugugaagguaaauucaacuggagggugauuaaggagaaacgggaugcuuaugucucacgccucaaugccauauaccagaacaaucugacgaaaagccacaucgagauuauccgaggccaugcugccuuuaccagugacccuaagccaacaauugaaguguccgggaaaaaguauacugcaccgcacauccugauagccaccggaggcaugcccucuacaccucacgagagccagaucccaggugcuucccucgggauuaccucagauggauucuuucaauuagaagaacugcccggcagaaguguaaucguuggcgcgggguacauugcaguggagauggccggaauccuuagcgcuuuggguucuaaaacuucccugaugauaaggcaugacaagguccuacggucauucgauagcaugauuaguacaaacugcaccgaggagcucgaaaaugccggcguggaggugcugaaauuuucucaggucaaggaaguuaagaaaacgcuuuccgggcuggaggugagcaugguaacugcagugccuggacguuugccagucaugaccaugauccccgacguggauugucuccugugggccauuggccgcguuccgaacacaaaggacuuaucgcugaauaaacucgguauccagacugaugacaaggggcacaucauuguggaugaguuccagaacaccaaugucaaaggcauauaugcugugggagacguaugcggcaaggcccuucugacaccuguugcaaucgcggcugggagaaaauuggcccauaggcuauuugaauacaaggaggacucuaagcuggauuacaacaauauucccaccguggucuucucccacccaccuaucggaacggugggucucacugaagacgaggcaauacacaaauauggcauugaaaacgucaagacauacucaaccaguuuuacucccauguaucaugccgugacaaaacggaagaccaaauguguuaugaagauggugugcgcuaauaaggaggagaaaguagucgggauccacaugcaaggacugggcugugaugaaaugcuucaggguuucgccguggcaguuaagaugggggcuacgaaagccgacuucgauaacaccguggcgauccauccaacaagcuccgaggaacuggucacuuugcgauga

SEQ ID NO: 56995 - RNA, 1425 nt, Artificial Sequence
  derived and/or modified sequence opt3 from GSS__Homo_sapiens__XP_011527098
auggccaccaacuggggcagccugcuccaggacaagcaacagcuugaggaacuggcuagacaggcaguggauagggccuuggcggagggggucuuacugcggacaucccaggaacccacuucuucagagguugugaguuacgcuccuuucacgcuauuuccaagccucguaccguccgcccugcuugaacaagcauaugccgugcagauggacuucaaucuguuggucgaugcugugucucagaacgcagccuuucucgagcagacccugucgucaacaaucaaacaagacgauuucacugcucgccuguuugacauucacaagcagguucucaaagagggaauagcccagaccguguucuuaggucugaaucgaagcgauuacauguuucagcguagugcggacggcucccccgcacuuaagcaaaucgaaauuaacacaaucucugccagcuucgggggauuggcuuccagaaccccugccguccauaggcacgugcugucaguacuaaguaaaacuaaggaggcaggcaagauucucagcaauaacccaucuaaaggucuggcucuugggaucgccaaggcgugggaacuguauggaucccccaaugccuugguucuccugauagcacaggagaaagagcggaacaucuuugaucagcgcgcuauugaaaaugaguuacuggccagaaacauccaugugauuaggcggacauucgaagacaucucagagaagggcagccucgaucaagaccgccgacuuuuugucgauggccaggaaauagcugugguguacuucagagacggguauaugccuaggcaguacagucugcagaauugggaggcccgguugcuacuggagcguucucacgcagccaaaugcccagacauugcuacccaacucgcgggaacgaagaagguccagcaggaacugucccgccccgguaugcuugagaugcuguugccuggccagccagaagcaguugccagacucagggcuacuuuugccgggcuguauagcuuagaugugggagaggaaggcgaccaagcaaucgccgaggcucuggccgcaccgucgcgguucguacuaaaaccccagcgagagggugggggaaacaaucucuacggcgaagagauggugcaggcgcugaagcagcuuaaagauucugaagaacgcgcuuccuacauuuugauggaaaagaucgagccugagccauucgaaaacugucugcucagacccggcaguccugccagggucgugcaaugcaucucagagcuggggauuuuuggaguuuaugugcggcaggagaaaacccuugucaugaauaagcaugugggucaccuguugcgcacaaaagcaauagagcacgccgacggcgggguagcugccggaguugcagugcucgauaacccauaccccgucuga

SEQ ID NO: 56996 - RNA, 669 nt, Artificial Sequence
  derived and/or modified sequence opt3 from GSTA1__Homo_sapiens__NP_665683
auggccgagaagcccaaacugcacuacuucaacgcuagaggcaggauggaaagcacccgguggcuccuugcagccgcggggguggaguuugaagagaaguucaucaaauccgcugaagaccuggauaaguugcgcaaugacggauauuuaauguuucagcaagucccuaugguugagauugaugguaugaaacuggugcagacacgagccauacuaaacuacaucgcaucuaaguauaaucucuacggcaaggacauuaaagagcgugcccugaucgauauguauauugaagggaucgcugaccuuggagagaugauacuguugcucccaguaugcccgcccgaagagaaggaugcaaaacuggcccugaucaaggagaaaauuaagaacagauacuucccugcuuuugaaaaggugcucaaaucacauggccaggacuauuuagucgguaauaagcugaguagggccgauauccaccuuguggaguugcuguacuacguugaggaacuagacagcucccucauuucuucguucccacugcuuaaagcgcugaagacucggaucucaaacuugcccacggugaaaaaguuucuccagccugggagcccacgcaaacccccuauggaugaaaagagucuggaggaggcaagaaagauauucagguuuuga

SEQ ID NO: 56997 - RNA, 669 nt, Artificial Sequence
  derived and/or modified sequence opt3 from GSTA2__Homo_sapiens__XP_011512834
auggccgagaagcccaaacugcacuacagcaacaucagaggcaggauggaauccauucgguggcuccuugcugcagccgggguggaguucgaagagaaguuuauaaaaucugcggaagaccuggauaaguugcgcaaugacggauauuuaauguuccagcaagucccuaugguugagaucgaugguaugaaacuggugcagacccgagcuauucuaaacuacaucgccucaaaguauaaucucuacggcaaggacauuaaagagaaggcacugaucgauauguauauagaagggaucgccgaccuuggagagaugauucuguugcucccauuuagucagccggaagaacaggaugcuaaacuggcacugauccaagagaagacuaaaaaccguuacuuccccgccuuugaaaagguacucaagagccauggccaggacuauuuaguggguaauaaacuguccagagcugauauucaccuugucgaguugcuguacuacguggaggagcuagacucuucgcucaucagcucauucccucugcuuaaggcccugaaaacaaggauaaguaacuugccaacgguuaagaaauuucuccagcccggguccccucggaagccacccauggaugaaaaaucucuggaggagagccgcaagauuuucagauuuuga

SEQ ID NO: 56998 - RNA, 669 nt, Artificial Sequence
  derived and/or modified sequence opt3 from GSTA4__Homo_sapiens__XP_005249092
auggccgcuagacccaagcugcacuacccuaacggcagggggcggauggagagcgugcgcuggguccucgcagccgcgggaguugaguucgacgaagaauuucuugagaccaaagaacagcuguauaaguugcaagaugguaaucauuuacuguuccaacaggugccaaugguagagaucgacggcaugaagcuagugcagacacgauccauucuccacuacauagcugauaaacauaaccuguuugggaaaaaucuuaaggagcguacucugaucgacauguaugucgaaggaacguuggaucuccuggagcugcucauuaugcacccguucuuaaagcccgacgaucagcagaaagaagugguuaacauggcccagaaggcaaucauuagauacuuuccuguguucgagaaaauccugaggggccauggucagucuuuucuugucgggaaucaauugucacuggccgacgugauacuacuccagaccauccuggcucuugaggaaaagauuccaaacauccugagugcauuccccuuuuugcaggaguauacaguaaaacucagcaauauuccuacuaucaagcgguuccuggaaccaggauccaagaaaaagcccccuccagaugagauauacguucgcaccguguauaacauuuuuagaccguga

SEQ ID NO: 56999 - RNA, 669 nt, Artificial Sequence
  derived and/or modified sequence opt3 from GSTA5__Homo_sapiens__NP_714543
auggccgagaagcccaaacugcacuacagcaacgcuagaggcuccauggaaucuaucagguggcuccuugcagccgcggggguggagcuggaagagaaguucuuggaaucagcugaggacuuagauaaacugcggaaugacggaagucuacucuuucagcaagucccuaugguugagauugaugguaugaagcuggugcagacccgcgccauacuuaacuauaucgcaagcaaauacaaucuguauggcaaggacaugaaggaacgagccuugauugauauguacacagaggggaucguagaccucacugaaaugauucugcugcucuuaaucugccagccagaggagcgugaugcuaaaacggcacuggugaaggagaaaauaaagaacagauauuucccggccuuugagaaaguccuuaagucccauaggcaggacuacuuggugggaaauaagcugucuugggcugauauccaccuaguugaacucuucuauuacguggaggaacuggacucgucacuuauuagcaguuuuccccuguugaaagcccucaagacccggaucuccaaccugccuacagucaaaaaguucuuacaaccaggcucucagcgcaaacccccuauggaugaaaagagccuggaggaagcgagaaaaauuuuuagguucuga

SEQ ID NO: 57000 - RNA, 1902 nt, Artificial Sequence
  derived and/or modified sequence opt3 from GSTCD__Homo_sapiens__NP_001026890
augaaggccaucaaaaagagccugaccgaggaagaguaccucuaucuugacuucucccaccagacagaaggcugcauuuuuccccugcauacuucugugacguuguucuuacugucauacugugauugcaaaauauuuaagaucugucuagucguuaccaaagaggugaguagagacagcucccuccugagggaugaccuuauucaagauguagaaauccagauuaucucucggcaggagcugccuccaauagugcagaacugcuguuugccggcugucguggagcgcucggacaauuucugccgagcagggcucgccguugugcugcgucacaucauucaaaagucauaugaagcggauccccugaagaaagagcucuuagaacugcuuggauuuaagaaaacauguuugaaggcuugcgccgaggucagccaguggacuagacugugugagcuaaccaucccucucgcaauugaaaacuuccugagggagaguuccgaccagccacccacaaucccuguggaaauacuucagcuggagaaaaaguugucugaaccaguacggguucauaaugaugacaagcuccgcagacaaaaacugaagcagcagaaagccgaugguguggggcccccuuuaaccaagggcaaagcuaagagcaaaguccacacucaggagacauccgagggacuggacucaaguagcaagucucucgaacuuaagguggcauuuuccaaacugaccgugcaagaggaaccagccacgacuaacagggagccgucacauauucggaaggcuaaagccagcgauuugcccccucuagaacacgucuucgcggagggccuguacuuuacccucgcagacaucguucugcuuccaugcauucaccauuuccuggugaucaucagucgcaaguuuucugagaaauugguagaguucccccuccuggccuccugguaucagcgaauacaggaggugccuggugucaagacagcugccagcaagugugggauucaauuuuuacaucugccaaaacuacucacuaccucgacagaacagcaccccaaucugugcgaggugccgggaguugaagaacagucugacccucuuuucaucggcggccccagaccaaccauggcaaaguugauggagaaagggauugaagugauguucuccccucaccccugcccaacguggacucuggauuggaacguccuccccgcugccgugucaccuaaggagggaaaaaugaguagcgacagggcgcugcggaagcagcaacagcuuaauaaccugguauacguugugacaaaucaggccaagccaggugaucguaucgucgacuuuuguuccggcgggggacacgugggcauagucuuggcacauaugcucccgucuugccaggugacccugauugaaaacaaagaguuaagccugauccgcgcuaagaaaagaucagaugagcuaggucucaguaauaucugguucauucaagccaacauggaauauuuuacugggauguucaauaucggaguugcucugcacgccuguggcguggcaacagacaugguaauugagcauugcauaaagaccagggccuccuuugucacgugucccugcuguuacggcuucauccagaacaccagcaaauuuaauuucccuaagucugaacaguuuaagaaaacacuuucauacaaggagcacaugauuuugugccgguucgcugaucagacugcggugcaacugccaccccagcgacgccucaucgggaaacaguguaugugccugguugacuuagauagagcaagggccgcugaagaguguggauauagugugcaggucaucagcauggagccugaauccugcucuccaaagaacaacaugauuguggguguacccauauga

SEQ ID NO: 57001 - RNA, 849 nt, Artificial Sequence
  derived and/or modified sequence opt3 from GSTK1__Homo_sapiens__NP_001137151
augggcccccugccuagaaccguggaacucuucuacgacguccuuagcccauauuccuggcugggguuugagaucuugugcagguaccagaacauuuggaauauaaacuuacaacugcggccgucucuaaucacaggaauuaugaaggauucagguaauaaacccccuggccuccugccacgcaaggggcuuuauauggccaacgaccugaaauugcuccgacaccaucugcagauccccauucacuucccuaaggauuuucugaguguuaugcucgagaaagggagcuuauccgcuaugcguuuccugacugcagugaaucuugaacauccagagauguuggaaaaggccucuagagagcuguggaugaggguauggucgcgggugucagucggccuaugggagagcaguggucgcacgcucgacgauuuucugaccuuccccagacacguguuuaggguuaugauccuuccuccaccgggaggauccacagugcugcccgucacuccuuugucuccacaucggcuccccgcgguguucagcuccucacagaacgaagacauaaccgagccucagaguauccuggcugccgcagaaaaggccggcaugagcgcugagcaagcacagggcuuacuggagaaaauugccacaccaaagguuaaaaaucagcucaaggaaaccacugaggcugccugucgcuacggggcguuuggacuucccaucacaguagcacacguggauggucagacccacaugcuguucggcucugaccgaauggaauugcuagcccaucugcucggggagaaauggaugggaccgauuccucccgcugucaacgccagacuguga

SEQ ID NO: 57002 - RNA, 897 nt, Artificial Sequence
  derived and/or modified sequence opt3 from GSTM3__Homo_sapiens__XP_011539598
augaacgagguguggcugcccccugccggcaaagggggagcuagcaccuccgguccacuccuuucuugcucaacaccggcaagagucccuccuaggggccggcaggcccugaauccaaacgcggggaucagucgcgcuugugcccgacccugcggagcagccgaagcucgugacggcgagagaggugggggaggcguuagggcacccgcccggggcccacgccccuugaugagcgggauuaagccuuuaccacugacugugucccuaguacucgaaggaucugaggcuagacaccauguggucagggugguuuacgguucgcgggugcugggcuauucaugggccccggauuacgaccgcagccaauggcuugaugucaaguucaaacuggacuuggauuuucccaaucucccuuaucugcuggacgggaagaacaaaauaacgcagaguaaugcgauccuccgauacauugcaagaaagcacaacauguguggagaaaccgaggaggaaaagaucaggguggauauuaucgagaaucagguaauggacuuccggacacaguuaauacgucugugcuauuccucugaucaugaaaaacuuaagccacaauacuuggaggagcugcccggccagcuaaaacaguuuagcauguuccucgguaaguuuuccugguucgccggggaaaaacugacuuuuguugacuuccuuaccuaugauauccuggaccagaaccgcauuuuugauccuaaguguuuggacgaguucccaaaucucaaggcuuuuaugugcagauucgaagcccuggagaaaaucgcagcuuacuuacaaucagaccaguuuuguaagaugcccauuaacaauaaaauggcccaguggggaaacaagccggugugcuga

SEQ ID NO: 57003 - RNA, 627 nt, Artificial Sequence
  derived and/or modified sequence opt3 from GSTO1__Homo_sapiens__NP_001177931
augagcggcgaguccgccagaucucuggggaagggaucagcucccccugguccagugccggaaggcaguaucaggauuuacagcaugcgguucugccccuuugcagagcgcacccgacucguccuuaaagccaaggggauacgucacgaaguuaucaacauuaaucugaaaaacaagccugagugguucuuuaaaaagaauccauucggauuggugcccguauuagaaaacucccagggccaacugaucuaugagucugcgauuacaugugaguaccuagacgaggcuuauccugguaagaaacuccugccagaugaccccuacgaaaaggccugccagaaaaugauccuugaacuguuuucgaagguguugacuaauaaaaagacgaccuucuuugggggaaacucaauaagcaugaucgauuaucucauuuggccuugguucgagagacuggaggcaaugaagcugaaugaaugugucgaccauacaccaaaacucaaguuauggauggccgcuaugaaagaggauccgacugugagugcacugcuuaccuccgaaaaggacuggcagggcuuuuuggagcuguaccuacagaacucucccgaagccugcgauuauggccucuga

SEQ ID NO: 57004 - RNA, 630 nt, Artificial Sequence
  derived and/or modified sequence opt3 from GSTO2__Homo_sapiens__NP_001177942
augagcggcgacgccaccagaacacuggggaagggaucccagcccccugguccagugccggagggccucaucaggauuuacucuaugcgguucugccccuauucacaccgcacucgacuuguccugaaagcuaaggauauacgucaugaaguugugaacaucaauuugagaaacaaaccugagugguacuauacgaagcacccauuugggcauauucccguauuagaaaccagucaaugucagcugaucuacgagagcgugauugcaugcgaauaucuagacgaugccuacccuggaaggaaacucuucccauaugaccccuacgagcgggcgcgccagaagaugcugcuugagcuguuuuguaagaucuuggaauaccagaauacaacuuucuuuggcgguaccugcauauccaugaucgauuaucuccuguggccuugguucgagagacuggacgucuacgggauucucgauugugugucucacacaccagcuuuaaggcuguggaucucggccaugaaaugggacccgaccguuugcgcacuuuugauggauaagucaauuuuucaaggauuccugaaccuauauuuucagaauaaccccaaugccuucgacuuuggccucuguuga

SEQ ID NO: 57005 - RNA, 633 nt, Artificial Sequence
  derived and/or modified sequence opt3 from GSTP1__Homo_sapiens__NP_000843
augcccccuuacaccguggucuauuucccaguuagagggaggugcgccgcucugcggaugcuccuugcagaccagggccaaagcuggaaggaggaagugguaacaguggagacuuggcaggaaggaucccugaaagccucuuguuuguacggucaguuaccgaaguuucaggauggcgaccugacgcuauaucaaucaaacaccauccuccgccaccuggggcgaacacuuggacuguacggcaaagaucagcaggaggcggcuuuggucgacauggugaaugaugguguugaagaccuccguugcaaguauauuagucugauauacacuaacuaugaggccgggaaagaugacuacgugaaggcacugcccggacagcucaagccuuucgagaccuuacugagccaaaaucagggcggcaaaacauuuaucgucggggaucagauuuccuucgccgacuacaaccuuuuggaucugcuacucauccaugaagugcuggcuccaggaugucuugacgcauuuccccuguugucugccuauguagguagacucucggcuaggccuaagcugaaagccuucuuagcgucaccagaguacguuaaucugcccauuaacggcaaugggaagcaguga

SEQ ID NO: 57006 - RNA, 723 nt, Artificial Sequence
  derived and/or modified sequence opt3 from GSTT1__Homo_sapiens__NP_000844
augggccuggagcucuaccuugaccuguugagccagcccugcagagccguguauaucuucgcuaagaaaaacgauauuccuuuugaauuaaggauagucgaccugaucaaggggcaacaccuauccgaugcauucgcccagguuaauccacucaaaaaggugccggcgcugaaagacggagauuuuacccuuacagagucuguagcuauucuguuguaccucacucggaaguauaaggugcccgacuacugguauccucaggaucugcaggcccgcgcacgagucgacgaauaccuggccuggcaacauacgacccuccguagaucauguuuaagggcucuguggcacaaagugauguucccaguuuuucuuggugagcccgugaguccucagacauuggcagccacucuggcugaacuagaugucacccuccagcugcuugaggacaaguuccugcagaacaaagccuuuuugacaggcccacauaucagccucgcggaucugguggcaauuaccgaguuaaugcaccccguaggggccggaugccaaguuuucgaaggccggccuaagcuggcuacuuggcgccagagaguggaggccgcagucggugaagaccucuuucaggaggcucaugaggugauccuuaaagccaaggauuucccaccggcggaccccacaauaaagcagaaacugaugccuuggguguuggccaugaucagguga

SEQ ID NO: 57007 - RNA, 735 nt, Artificial Sequence
  derived and/or modified sequence opt3 from GSTT2B__Homo_sapiens__NP_001074312
augggccuggaacucuuccuugaccuggugagccagcccuccagagccgucuacaucuuugcuaagaaaaacgggauuccuuuggaguuaaggaccguugaucuggugaagggacaacacaaaucuaaggaguuccuacagauaaauucacucgguaaacugccaacacuuaaggacggcgauuuuauccugacugaaaguagcgcaauuuugaucuaucucuccugcaaguaccagacgccggaccauugguaucccucugaucugcaggcccgggcgcgcguacacgaguaccugggguggcaugcugacuguauucgaggaaccuucggcaucccucucugggugcaagucuuagguccacugauaggggugcagguucccgaagagaaaguggagcguaacagaacagccauggaucaggcacuucagugguuggaagacaaguuucugggagauaggccuuuccuagccggccaacaggucacucucgcugaccugauggcacuugaggaacugaugcagccaguggccuugggcuaugagcucuuugaggggcggccccgccuggcugccuggagaggaaggguagaagcguucuuaggugcagagcugugccaggaagcccacucgaucauucucucaauccuugagcaagcugccaaaaagacccugccuacaccaagcccggaagcauaccaggcuauguugcuacggauugcccgcauccccuga

SEQ ID NO: 57008 - RNA, 735 nt, Artificial Sequence
  derived and/or modified sequence opt3 from GSTT2__Homo_sapiens__NP_000845
augggccuggaacucuuccuugaccuggugagccagcccuccagagccgucuacaucuuugcuaagaaaaacgggauuccuuuggaauuaaggaccguugaucuggugaagggacaacacaaaucuaaggaguuccuacagauaaauucacucgguaaacugccaacacuuaaggacggcgauuuuauccugacugaaaguagcgcaauuuugaucuaucucuccugcaaguaccagacgccggaccauugguaucccucugaucugcaggcccgggcgcgcguacacgaguaccugggguggcaugcugacuguauucgaggaaccuucggcaucccucucugggugcaagucuuagguccacugauaggggugcagguucccaaagaaaagguggagcguaacagaacagccauggaucaggcacuucagugguuggaggacaaauuucugggagauaggccuuuccuagccggccaacaggucacucucgcugaccugauggcacuugaggagcugaugcagccaguggccuugggcuaugaacucuuugaggggcggccccgccuggcugccuggagaggaaggguagaggcguucuuaggugcagaacugugccaggaggcccacucgaucauucucucaauccuugaacaagcugccaagaaaacccugccuacaccaagcccggaggcauaccaggcuauguugcuacggauugcccgcauccccuga

SEQ ID NO: 57009 - RNA, 651 nt, Artificial Sequence
  derived and/or modified sequence opt3 from GSTZ1__Homo_sapiens__NP_665877
augcaggccggcaagcccauccuguacagcuauuucagauccucuugcucauggagggugcggauugcucucgcacuuaaagggauagacuacgagaccgucccuaucaaccugauuaaggauggaggucaacaguuuaguaaagacuuccaggccuugaauccaaugaagcagguuccgacauuaaaaaucgauggcauuacuauccaccaaagccuggcgauaaucgaauaucuagaggaaaugcgccccacgccucgacuccugccacaggaccccaagaagcgugcuuccgugagaaugauuucugaucuuaucgccgggggcauucagccucugcagaacuugucgguacucaaacaagugggagaggaaaugcagcugaccugggcacagaaugccaucacaugugguuuuaacgcucuggagcagauacuccaaucaacugcagggauuuacugcgucggagacgaggugaccauggccgauuuaugucugguuccacagguggcuaaugccgaaagguucaaggucgaccuuacacccuauccuaccaucagcaguauuaacaaacgguugcuggugcuagaggcguuucagguaucccauccaugccgccaaccggauacucccacagaacucagagcauga

SEQ ID NO: 57010 - RNA, 795 nt, Artificial Sequence
  derived and/or modified sequence opt3 from GSX1__Homo_sapiens__NP_663632
augcccaggagcuuccugguggacucccucguccuuagagaggccggcgaaaagaaagcuccugaggggucuccaccgccccuguuuccuuacgcaguuccacccccucacgccuugcauggauuaucaccaggugcgugccacgcucggaaggccggccugcuaugugugugcccccucuguguaaccgcaagucagcugcaugggccuccaggaccgcccgcccuuccucuguugaaagcuagcuucccacccuuuggcucccaauauugccacgcaccucucggucgccagcauucugccgugucgccaggggucgcucacggacccgccgcggcagccgcugccgcagcucuguaccagacaucauauccgcugccugauccccgacaguuccacuguaucagcguggacaguuccucuaaccaacucccaagcuccaagcguaugagaacugccuuuacgucaacccaguuacuggaacuugagagggaguucgcgaguaauauguacuugagccggcugcgcagaauugaaauagccacauaucuaaaccucucugagaaacagguuaagaucugguuucagaauaggcgggugaagcauaaaaaggaaggcaaaggcuccaaccaccgcgggggagguggcgggggagcaggcggugggggaucagcuccucaaggcugcaagugugccagccugaguucugcuaaaugcuccgaggaugacgaugaacuucccaugagcccaucgucuuccggcaaggacgaucgagaccugacugucacccccuga

SEQ ID NO: 57011 - RNA, 915 nt, Artificial Sequence
  derived and/or modified sequence opt3 from GSX2__Homo_sapiens__NP_573574
augagcagauccuucuacguggacucucugaucauuaaggauaccucaaggcccgccccuagucucccagagccgcaccccggcccugacuuuuucauaccacuugggaugcccccuccacuggucaugagcguuuccggacccgguugcccuucucggaaaucgggcgcuuuuugugugugcccauuguguguaacaucacauuuacacagcagucgcggguccgugggagcaggcucugguggggccggagcgggcgucacuggcgcugggggaagcgguguggccggcgcagccggggcucugccgcuacucaagucccaguucucaagugcacccggagaugcccaauuuugcccucgaguuaaccaugcucaccaucaccaccauccaccccagcaccaucaccaccaucaccagccucagcaaccaggcagcgccgcggcagccgcugccgcagcugccgcggccgcagcugccgcugcccugggucauccccagcaccaugcaccgguguguacggccaccacauauaaugucgcugacccucguagauuccacugccuuacuaugggagggucugaugcgucccaggugcccaacggcaaaaggaugcggaccgcauuuacaucaacccagcuguuggaacucgagcgcgaguucagcaguaauauguaccugucuagacugaggcggaucgaaauugccacuuaucucaacuuauccgaaaagcaaguaaaaaucugguuucagaaucgccgaguuaagcacaagaaagagggcaaggggacacagagaaacagccaugcuggauguaaaugcguggguucgcagguccacuacgccaggucugaggacgaagauucccugucaccagcaagugccaaugacgauaaggagauuagcccucuuuga

SEQ ID NO: 57012 - RNA, 1377 nt, Artificial Sequence
  derived and/or modified sequence opt3 from GTDC1__Homo_sapiens__NP_001006637
augagcauccugauuauagaggccuucuacggcgggucccacaagcagcucguggaccuucugcaagaagaguugggagauugcgucguuuauaccuuacccgcuaaaaaguggcauuggagagcaaggacaucugcccuguacuuuucacagacuaucccuauuagugaacacuaucggacgcuauucgcgagcuccgugcucaaccugaccgagcuugcugcccugcgcccagacuuggguaaacucaagaaaauccuguacuuucaugaaaaucagcugauuuauccgguaaagaagugucaggagcgagauuuccaauacggcuauaaccagauccucucuugcuuaguggcagacgucgugguuuuuaauucgguguucaacauggagucauuucugacaagcauggggaaauucaugaaacuuauacccgaucaccguccuaaggacuuggaaaguaucauuagaccaaagugucaggucaucuacuuucccauuagguucccugaugugucccgguuuaugccaaaacauaagacuacccaccugaagaaaaugcuaggacucaagggcaaugguggggccguacugucuauggcacuucccuuccagccugagcaacgcgacagcgaagaucuguugaaaaacuuuaauuccgagugcgacacacacuguggacucgauaccgcuagacaggaguaccugggcaacucauuaaggcaggaaagugaccugaagaaaagcacuucuuccgauaauucaagcagucaucacggcgagaacaagcagaaucucacaguugacccaugcgacauccuugggggaguggauaaccaacagcggcuguugcauauagucuggccgcaccgcugggaacacgacaaagaucccgagucuuucuucaaggugcuaaugcaucugaaggaccucggucugaauuuucacguguccguccuuggcgaaaccuucacggauguuccugacauuuuuagcgaggccaaaaaggcucuggggucgucuguguugcauuggggauaucucccauccaaagaugacuacuuccagguacuguguauggccgauguggucaucucaacugcgaagcacgaguuuuucggcguggcaauguuagaagccguuuauugcgguuguuacccccugugcccuaaagaccuaguguauccagagauuuuucccgcugaauaccucuauaguaccccggagcaacugagcaagcgacuucagaacuucuguaagagaccugauaucaucaggaaacauuuguacaagggggaaauugcccccuuuuccugggcagcucugcacggaaaauuccggucucuccugacaacugagccacgugaggaccuuuga

SEQ ID NO: 57013 - RNA, 1131 nt, Artificial Sequence
  derived and/or modified sequence opt3 from GTF2A1__Homo_sapiens__NP_056943
auggccaacagcgcuaauaccaacacagugcccaagcuguacagauccgucaucgaggacguuauuaaugaugugagggacauauuccucgaugacggcguagaugaacaggugcuuauggagcugaaaacuuugugggaaaacaaguuaaugcaaucucgggcagucgacggguuucacucagaggaacagcagcugcuacuccaggugcaacagcagcaucagccucaacagcagcagcaccaucaccaucaccaccaucaacaggcccagccacaacagacgguuccgcagcaggcgcaaacccaacaggugcugauccccgcuagucagcaggccacagcaccucaggucauugugccagauagcaaacuuauccagcacaugaaugccuccaacaugucugcugcagccacugcugccacccuggcguugcccgcaggaguaacaccuguucagcaaauucucaccaauucgggucagcugcuccaggugguccgcgccgcuaacggcgcccaguauaucuuccaaccacagcagucaguggugcuccaacagcaggucauaccccagaugcaaccugggggaguucaggcaccagugauccagcagguauuagcuccgcugcccggcgguauuagcccucaaacuggggugaucauucagccacagcagauccuuuuuacaggaaauaagacccaagucauacccacgacuguggccgcgccuaccccagcccaggcacagauuacagcuacuggccaacagcagccccaggcccaaccggcucagacccaggccccuuugguucuacagguggacggcacaggggauaccaguuccgaggaggacgaagaugaggaagaggacuacgaugacgacgaggaagaggauaaagaaaaggacggagcagaggauggucaagucgaagaggagccccugaacucugaagacgaugugagcgacgaggaaggccaggagcuguucgauacggaaaauguaguugugugccaguaugacaagauccaucgauccaaaaacaaguggaaauuucaccugaaggaugggauuaugaaucuuaacggacgugacuacaucuucucaaaagccaucggcgaugcugagugguga

SEQ ID NO: 57014 - RNA, 1335 nt, Artificial Sequence
  derived and/or modified sequence opt3 from GTF2A1L__Homo_sapiens__NP_001180416
auggccugccugaaccccgugcucugggagaccaagguccuucagagcaaagcuacagaagacuucuuuagaaauuccauccaaucuccucuguucacuuugcaguuaccacacucacugcaucagacgcuacagaguagcaccgcaucccucguuauuccggccggcaggacacugcccucuuuuacuaccgcggagcuugggacaucgaacucaagcgcuaauuucaccuuuccuggauacccaauacacgugcccgccgguguaacucugcaaacagugaguggccauuuguauaaggucaacgugccuaucaugguuaccgaaacguccgggcgggcaggcauucuccagcacccaauccaacagguguuccagcagcugggacagcccucugucauucagacuagcgugccucaacugaauccauggucccuccaggccaccacagagaaaucacagcgcaucgaaacuguauuacaacagccggcuauacugcccagugguccuguugaucgaaagcaucuugagaacgcaaccagcgacaucuuggugucuccagggaaugagcacaaaauuguccccgaagcccugcuaugucaccaggaguccucacauuacaucagccucccuggagugguguuuaguccacaggucucucaaacaaacuccaauguugaaagcgugcugucgggcucugcuuccauggcccagaaccuucacgaugagucacugaguaccagcccccauggcgcguugcaccagcacguaacggacauucagcuccauauccugaagaaucguauguaugggugcgauuccgugaagcaaccgagaaacauagaggaaccuucuaauauucccgucagcgagaaagacucaaacagucagguggauuuauccaucaggguuacugacgaugacauuggagaaaucauccagguggaugguagcggcgacacaucuucaaaugaggaaauugggaguacccgggaugcagacgagaacgaguuccugggaaacauagacggcggugaucucaaggucccagaagaggaagccgacagcaucuccaaugaggauucugcuacuaacucgagcgacaaugaagauccucaggugaacauuguagaggaggacccccuuaauuccggggaugacguuucagaacaagaugugccagaccuguuugauacagacaacgucaucgugugucaguacgacaaaauacaccgcaguaagaauaaauggaaguucuauuugaaggauggagucaugugcuuuggcggcagagacuacguguucgccaaagcaauuggggaugcugagugguga

SEQ ID NO: 57015 - RNA, 330 nt, Artificial Sequence
  derived and/or modified sequence opt3 from GTF2A2__Homo_sapiens__NP_004483
auggccuaccagcuguauagaaacaccacacucggcaauagccuucaagagucccuggacgaauugauccagucucagcagauuacuccccaauuagcucuacaggugcugcuccaguucgauaaggcaauaaacgccgcgcuggcucagaggguccggaaucgcguuaacuuucgagggucacuuaauacguaccguuucugcgacaacguguggaccuuuguacugaaugauguggaguucagagaagucacagaguugaucaaaguggacaagguuaaaauuguggccugugauggaaagaacacugguaguaauaccacagaauga

SEQ ID NO: 57016 - RNA, 1320 nt, Artificial Sequence
  derived and/or modified sequence opt3 from GTF2E1__Homo_sapiens__NP_005504
auggccgaccccgaugugcugaccgaggucccugcugcacucaagagacuugccaaauacguuaucaggggcuucuaugggauugaacacgcgcuggcuuuggacauauuaauccggaacagcugcgugaaggaggaagauaugcuggagcuacucaaauuugaccgcaagcagcugcgauccguacuuaauaaccugaaaggagauaaguucauuaagugucguaugagaguggaaacagccgcagacgguaaaacuacgaggcauaauuacuauuuuaucaacuaccggaccuuggucaaugugguuaaguauaaacucgaucacaugcgcagaaggauugagacagacgagcgggauucuacuaaccgcgccucauucaagugcccaguguguaguagcaccuuuacagaccuggaagcuaaucaacuguucgauccgaugaccggcacuuuucgaugcacauucugucauaccgaggucgaagaggacgaguccgcaaugcccaaaaaggaugccagaacgcucuuagcuagguuuaacgaacagaucgagccuauauacgcccugcuucgggaaacugaggacgugaauuuggcguaugaaauccuggagccagagcccaccgaaauuccugcacuaaagcagucuaaagaccacgccgcuacaacugccggggcagcuucgcucgccggaggccaucaccgugaggcgugggccaccaaggguccaucauacgaagaucuguacacacagaacguaguuaucaauauggacgaucaagaggaccuucaccgcgcaagccuggaagggaaaagugcuaaggagagacccauuugguugagggaguccaccgugcagggagccuauggcucugaagauaugaaagagggcgggaucgacauggaugcuuuccaggaacgggaggaaggacaugccgguccugacgauaacgaggaggucaugcgagcacuccugauacacgaaaagaaaacgagcuccgccauggcuggcucagugggggcggcagccccagugacugcugccaauggaagugacagcgagucugaaacauccgagucagaugacgacagcccgccccgcccugcagccgucgcuguucauaagagagaggaagaugaggaagaggacgaugaauuugaggagguggccgacgauccaauuguaaugguggcaggcaggcccuucaguuacucugaagucucccagcggccugaguuaguggcgcaaaugaccccagaagagaaggaggcuuauaucgccaugggucagcgcauguuugaagaccuguucgaguga

SEQ ID NO: 57017 - RNA, 876 nt, Artificial Sequence
  derived and/or modified sequence opt3 from GTF2E2__Homo_sapiens__NP_002086
auggaccccagccugcucagagagagggaacuuuucaagaaacgggcccuguccaccccuguggucgagaagcgcucugcuucaagugaaagcuccucuucgucaagcaaaaagaaaaagacaaagguugagcacggcgggaguuccggaucuaaacagaacagcgaucauuccaaugguucauuuaacuugaaggcauuaaguggcagcucuggguacaaauucggagugcuggccaagaucguaaauuauaugaaaacucgacaccaacguggcgacacgcauccacuaacccucgaugaaauucuggacgagacacagcaccuugauauaggucugaagcagaagcagugguugaugacugaggcgcucgugaacaauccgaaaaucgaagucauugacgggaaguacgcuuuuaaacccaaguauaacgugagagauaaaaaggcccugcugaggcucuuagaccaacaugaucagcggggacugggcggcauccuuuuggaggacauugaagaggcacugccuaauucccagaaagccguuaaggcucuaggggaucagauccucuucgugaaccgcccagacaagaaaaagauacuguuuuucaaugauaaaucaugccaauuuagcgucgacgaggaguuccagaaacuuuggagaagugugaccguagacucuauggaugaagaaaagaucgaggaauaccugaagaggcagggaauuuccagcaugcaggagucgggucccaagaaaguugcaccuauccaacggcgcaagaaaccagccucucagaagaaacgaagauuuaagacacacaacgagcacuuggcuggcgugcucaaggacuauuccgauauuaccucaaguaaauga

SEQ ID NO: 57018 - RNA, 1554 nt, Artificial Sequence
  derived and/or modified sequence opt3 from GTF2F1__Homo_sapiens__NP_002087
auggccgcucugggccccagcucccagaacgugaccgaguacgucguuagagugccuaagaauacaacuaaaaaguauaacaucauggcauucaaugccgcggacaaaguaaacuuugcuacguggaaucaagccaggcucgaacgggaucuuucuaacaagaaaauuuaccaggaggaagagaugccagaaucaggggcaggaagugaguucaaucgcaagcugcgagaggaagcccguagaaagaaauaugguauaguguugaaggaguuuaggccggaagaccagcccugguuacugcgggucaacggcaaaagcgggcgcaaguucaaaggaaucaagaagggcggugugaccgagaauacauccuacuauauuuuuacucagugcccugauggggcuuucgaggcauuuccaguucacaacugguacaauuucacaccccuagccagacauaggacccucaccgcugaagaggccgaagaggaaugggagcggcgcaacaaagugcugaaucacuuuucuaucaugcaacagcgaagacuuaaggaccaggaucaggacgaggaugaagaggaaaaagagaagaggggacggcguaaagcgucggaacugcgcauucaugacuuggaggaugaccucgagaugucaagcgaugcaagugacgccuccggcgaagagggcgggagagucccuaaggcuaaaaagaaggccccacuggcaaaaggagguaggaagaaaaagaaaaagaagggcucugaugacgaggcuuucgaagacagcgaugacggggauuuugaaggacaagagguggacuauauguccgauggcucaaguagcucucaggaggaacccgaguccaaagccaaggcgccucagcaggaagaggguccaaaagggguagacgagcaaucagauagcagugaagagucugaagaggaaaagccgcccgaggaggacaaagaagaggaagaggaaaagaaggccccuacuccacaggagaaaaagcggcgaaaagauuccagcgaggaaucggacucuuccgaggaaucagauaucgacagugaggcaagcuccgcucuguucauggccaagaaaaagacacccccuaagcgcgaaagaaaaccaucuggaggcagcucaaggggcaacagucggcccgggaccccguccgcugagggagguagcacgucuucaacucuccgcgccgcagccaguaaguuagagcagggcaaaagaguuagcgaaaugccugcugcgaagaggcugcgucuugacaccgggccccaauccuugucuggaaaaucgacaccacagccucccagcggcaagacuaccccaaauuccggugaugugcaggucacagaggacgcagugcggcgauaccugaccagaaaacccaugacgacuaaggaucuacucaagaaauuucagacaaagaaaaccgggcugucaagugaacaaacugugaacguccuugcccagauacugaagagguugaacccugagcgcaaaaugaucaaugacaagaugcacuucucucucaaggaguga

SEQ ID NO: 57019 - RNA, 750 nt, Artificial Sequence
  derived and/or modified sequence opt3 from GTF2F2__Homo_sapiens__NP_004119
auggccgagagaggcgaacuggaccucaccggggcuaagcagaacacaggaguguggcuugucaaaguucccaaguaccugagccaacagugggcaaaagccuccgguaggggcgagguggggaaguugcggaucgcgaaaacucagggacgcacggaaguaucuuucaccuuaaaugaggaucuggcuaacauucacgacauaggcgguaagccugccucagugagugcaccacgagaacauccguuuguccuacagagcguugggggacaaacacucacuguguucaccgaguccucuucggauaagcugucacuugagggcaucgugguccagcgugccgaaugcagacccgcugcaagcgagaauuauaugaggcugaaacgguugcagauugaagagaguuccaagccugugcgccucucucagcaacuggacaaaguaguuacaaccaacuacaagccaguggccaaucaccaguauaacaucgaguacgaaaggaaaaagaaggaggauggcaaaagagcucgggccgacaagcagcauguccuggauaugcucuuuagcgcguucgaaaaacaccaguauuacaauuuaaaggaccugguggauauuacuaaacaacccguggucuaucuuaaggagaucuugaaagaaauagggguucagaacgugaagggaauccauaagaauacaugggagcugaaaccugaguaccgccacuaccagggugaagagaaguccgacuga

SEQ ID NO: 57020 - RNA, 1647 nt, Artificial Sequence
  derived and/or modified sequence opt3 from GTF2H1__Homo_sapiens__NP_001135779
auggccaccagcuccgaggaagugcugcucaucgucaagaaaguuagacagaagaaacaagacggcgcucuuuaccugauggcagagaggauugccugggcgcccgaagggaaggaucgguucacaauaucucacauguaugcugacaucaaaugccagaagauuucaccugagggaaaggccaaaauccaguugcaguuagugcugcaugcaggggauacuacgaacuuucacuucaguaaugaaagcaccgccguaaaggagcgcgacgcugugaaagaucuacuccaacagcugcuuccaaaguuuaaacgaaaggcaaacaaggagcuggaagagaaaaaucguauguugcaggaagacccgguccucuuccagcuguacaaggaucuggugguuucccaagugauuucugccgaggaguuuugggcuaacagacucaaugucaacgccacagacucgucaagcacuucuaaucauaaacaggaugugggcaucuccgcggcauucuuagccgacguaaggccccagaccgauggguguaacggacugcgguauaaucuuacaucugacauaaucgaaagcauuuuucgcaccuacccugcuguuaagaugaaauaugccgagaacgugccacacaauaugacugaaaaggaguucuggacaagauuuuuccagucccauuacuuucacagggaucgguugaacaccggcucaaaagaccuguucgcagaaugcgcuaagaucgacgagaagggucuaaaaacgauggucagucucggggugaagaauccccugcuugaucugacugccuuggaggacaaaccucucgaugaaggauauggcauuagcucugugccauccgcgucaaacagcaagaguaucaaagagaauaguaacgccgcaauaauuaagcgcuuuaaccaccauuccgcuaugguccuggccgcuggcuuacgaaagcaagaagcccagaaugagcagaccagcgaacccucgaacauggacgguaauucuggagaugcagacuguuuccaaccugccguuaaaagagcuaagcugcaggaguccaucgaguacgaagaucucgguaaaaacaauucagugaagacaauugcgcuuaaccugaaaaagagugacagguacuaucacggcccaacuccgauccagagcuugcaguacgcaaccucccaagauaucauuaauucuuuccagagcauacggcaggagauggaagccuauacacccaagcuaacccagguacugucaaguuccgcugccagcucuacgaucacugcacucucaccugggggagcccugaugcaaggcgguacacagcaggcuauuaaccagauggugccaaaugacauccaaagugagcuuaaacaucuguacgucgccgugggggaauugcuccgucacuuuuggagcugcuuccccguuaacaccccuuuucuggaggagaagguggucaaaaugaaguccaauuuagaacgcuuccaggugacuaaacuguguccauuucaggagaagauaagaaggcaguaucuaucuacaaaccucguaucgcacauugaagagaugcugcaaaccgcauacaauaaacuucauacguggcagagccggcgauugaugaagaagaccuga

SEQ ID NO: 57021 - RNA, 1188 nt, Artificial Sequence
  derived and/or modified sequence opt3 from GTF2H2C_2__Homo_sapiens__NP_001035955
auggacgaggaacccgagagaaccaagaggugggaaggcggguacgagcggacaugggaaauccugaaagaggaugagagcggaucccucaaggccacuauugaagacauacuuuucaaagcuaagcgcaaacgaguguuugagcaccauggucagguccgucugggcaugaugagacacuuguauguugugguagaugggucuaggacgauggaagaccaagauuuaaagccuaaccggcugaccugcacacuaaagcuccuggaguacuucguggaggaauauuuugaccagaauccaaucucacagauuggaaucauugucacuaaaaguaagcgcgcagagaaacuuaccgaacugagcggcaacccgagaaagcauaucacauccuugaaagaggccguggauaugaccugucacggugaacccucucucuacaauucgcugucaauggcgaugcagacucugaagcauaugccugggcacacaagcagggagguucucauaaucuucaguuccuuaaccacgugcgacccaucuaacauuuaugaucugaucaagacucuuaaagcugccaagauucgggugagcgucaucggauuguccgcagaggugcgcguauguaccguucuggcccgagaaacaggcggcacuuaccacgugauacuagacgagucacauuauaaagaacuccugacccaccaucuuagucccccuccagcuucuagcuccucagagugcagccugauuagaaugggguuuccccaacacacaaucgcaaguuugucugaucaggacgccaagccuuccuucagcauggcucaccucgauggaaauaccgaaccaggucugacguuaggcggguacuuuuguccgcagugcagggccaaauacugugagcugcccgucgagugcaagauuuguggacucacucuugugucggcgccucaucuggcacggucuuaucaccauuuguucccacuagacgccuuucaggaaaucccccuggaggaauacaacggcgagcguuucugcuaugguugucaaggggaacucaaagaccagcacguguacgucugcgcuguuugccagaauguguuuuguguagauugcgacguguucguccaugauucccugcacuguugcccuggauguauccacaagauuccagcccccucaggcguguga

SEQ ID NO: 57022 - RNA, 1017 nt, Artificial Sequence
  derived and/or modified sequence opt3 from GTF2H2C__Homo_sapiens__XP_005248650
augagacaccuguacguggucguugacggcagcaggaccauggaggaucaggaccucaagcccaaccggcuuacaugcacucugaaauuguuagaauauuucguggaggaauacuuugaucaaaauccuaucucccagauugggauaaucguaacgaagucuaaacgcgccgagaagcugaccgaacuaucaggaaacccacgaaaacauauuacaagucucaaggaggcuguggacaugacuugucacggugagccgagccuguauaauucccuuucuauggcaaugcagacccugaagcauaugcccggccacacaucgcgugaagucuugaucauuuucucaagccucaccacuugcgauccuaguaacaucuacgaccugauaaaaacacugaaggccgcgaaaaucagaguguccguuauugggcucucugcugaggugagggucuguaccguguuagcccgggaaacgggaggcacuuaucauguaauccuggaugagagccacuacaaggagcuuuugacccaccaucuguccccacccccugcaucaaguagcucugaaugcucccuaauucgcauggguuuuccacagcacacaaucgccucacucagcgaccaagaugcuaaacccaguuucucuauggcacaucuggacgggaauacugagccuggacuuacccugggcggcuauuuuuguccacagugcagagccaaguacugugaauugccgguugagugcaagauaugugggcucacacugguguccgcuccccacuuagccaggagcuaccaccaucuguucccucucgaugcguuucaggaaauuccacuugaggaguauaacggagaacgguucugcuacgguugucagggcgagcugaaagaccaacacgucuaugugugcgcagugugccagaaugucuuuuguguugauugcgacguguucguacaugacucguugcacuguugccccggguguauccauaagauuccugccccaucuggaguguga

SEQ ID NO: 57023 - RNA, 1188 nt, Artificial Sequence
  derived and/or modified sequence opt3 from GTF2H2__Homo_sapiens__NP_001506
auggacgaggaacccgagagaaccaagaggugggaaggcggguacgagcggacaugggaaauccugaaagaggaugagagcggaucccucaaggccacuauugaagacauacuuuucaaagcuaagcgcaaacgaguguuugagcaccauggucagguccgucugggcaugaugagacacuuguauguugugguagaugggucuaggacgauggaagaccaagauuuaaagccuaaccggcugaccugcacacuaaagcuccuggaguacuucguggaggaauauuuugaccagaauccaaucucacagauuggaaucauugucacuaaaaguaagcgcgcagagaaacuuaccgaacugagcggcaacccgagaaagcauaucacauccuugaaaaaggccguggauaugaccugucacggugagcccucucucuacaauucgcugucaauagcgaugcagacucugaagcauaugccugggcacacaagcagggaaguucucaucauuuucaguuccuuaaccacgugcgacccaucuaacaucuaugaucugauuaaaacucuuaaggcugccaaaauccgggugagcgucauaggauuguccgcagaggugcgcguauguaccguucuggcccgagagacaggcggcacuuaccacgugauucuagacgaaucacauuauaaggagcuccugacccaccaugucagucccccuccagcuucuagcuccucagaaugcagccuuaucagaaugggguuuccccaacacacaauugcaagucugucugaucaggacgccaaaccuuccuucagcauggcucacuuggauggaaauaccgagccaggucucacgcugggcggguacuuuuguccgcagugcagggccaaguacugugaauuacccguggagugcaaaaucuguggacugacucucgugucggcgccucaucuugcacggucuuaucaccaucuguucccauuggacgccuuucaggagaucccccuagaagaguacaacggcgaacguuucugcuaugguugucaaggggagcugaaggaccagcacgucuacguuugcgcugugugccagaauguauuuuguguggauugcgacgucuucgugcaugauucccuccacuguugcccuggauguauucacaagauaccagcccccucaggcguuuga

SEQ ID NO: 57024 - RNA, 804 nt, Artificial Sequence
  derived and/or modified sequence opt3 from GTF2H3__Homo_sapiens__NP_001258796
auggugcugggcaacagccaccucuucaugaauagauccaacaaacuugccgucaucgcuucucauauucaggagucaagguuucuguaccccgggaagaauggacgguugggugacuucuuuggcgauccugggaacccaccggaauuuaaucccaguggaagcaaggacggcaaauaugaguuacugaccuccgcaaacgaaguuauaguggaggaaaucaaggaucuaaugacaaaaucugacauuaagggucaacacacugagacgcuccuggccgggucgcuugcgaaggcucugugcuacauccaucgcaugaauaaagagguaaaggauaaccaggaaaugaaaucacgaauuuuggugaucaaggccgcagaggacagcgcccuccaguauaugaauuuuaugaacgucauauucgcugcacagaaacaaaauauccugauugaugccugugugcuggacagugauuccggacucuuacagcaggcuugcgacaucaccggcggccuguaccuuaagguuccucagaugccaucuuugcugcaauaucuacucuggguguuucugcccgaucaggaccagcguagccagcuuauucugccuccacccguccacguggauuacagagccgcguguuucugccauaggaacuugaucgaaauaggguauguauguuccguuugccucucaauuuucuguaauuucaguccuaucugcacaacuugugagaccgcauuuaagauuagccugccaccgguguuaaaagccaagaaaaagaaacugaaggucucugcuuga

SEQ ID NO: 57025 - RNA, 1389 nt, Artificial Sequence
  derived and/or modified sequence opt3 from GTF2H4__Homo_sapiens__NP_001508
auggagagcacccccuccagaggccugaacagggugcaccuccagugccggaaucuucaagaguuccugggaggguugucuccuggugucuuagaccgccuguacggccauccagccacaugucuagcuguuuuucgagaacucccgucacuggcaaagaacugggugaugcguaugcuuuuccuggaacagcccuugccucaggccgcgguagcucucugggugaaaaaggaguuuaguaaagcccaggaagagagcacugggcugcuguccggacucagaaucuggcacacgcaauuacugccaggcggucuucagggguugauucugaaucccauauucaggcagaaccuacggaucgcacuccugggaggcggcaaggccuggucugaugacaccucgcagcuugggccugauaaacaugcucgcgacgucccaucacuggauaaguaugcagaggaaagaugggaggugguuuugcacuuuauggugggaagccccagugccgcugucucccaagaccucgcccagcuguuaucucaggcgggucugaugaaaagcacagaaccuggcgagccaccgugcauuacuuccgcaggguuccaguuucuccuucuggauacccccgcccaauugugguacuucaugcuacaguaucugcagacagcucaaucaaggggaauggaccucguggagauccugaguuuucuuuuccagcugagcuuuucuaccuugggcaaggauuacuccguagaagguaugucagacagccuccugaauuucuuacagcaucugcgggaguuugggcuaguuuuccagcgcaagcgaaaaaguagaagguauuacccuacucggcucgccauuaaccugucuuccggagugagcggcgcaggcgggacaguccaccaaccaggauucaucgugguggaaaccaauuaucgucuuuacgcuuacacggagucggaauugcagauagcccugaucgcgcucuuuucugagaugcuguaucgcuuccccaacauggucguugcccaggugacuagagaguccguacagcaagcaauugcuucagguaucaccgcccagcagauuauccacuuucuuaggacacgggcucauccugugaugcugaagcagacuccagucuugcccccgaccauaacagaucaaauucgacucugggaacuggagcgcgacagauuaagguucaccgaaggcgugcuguacaaucaguuucuaagucagguugauuucgagcuccugcuugcccacgcacgggaauugggggugcuggucuuugagaacagcgccaaacgccucauggugguaacgccugcuggacauuccgacguuaagagauucuggaagaggcagaaacacucuagcuga

SEQ ID NO: 57026 - RNA, 216 nt, Artificial Sequence
  derived and/or modified sequence opt3 from GTF2H5__Homo_sapiens__NP_997001
auggugaacguccugaagggcguucucaucgagugcgaccccgccaugaaacaguuccuucuguacuuggaugaaagcaaugcuuuagggaagaaauuuauuauacaagacaucgaugacacccacguguucguaauugcagagcuggugaacguccuacaggaaagagugggagagcucauggaucagaaugccuuuucccugacacagaaguga

SEQ ID NO: 57027 - RNA, 825 nt, Artificial Sequence
  derived and/or modified sequence opt3 from GTF2I__Homo_sapiens__NP_001267729
auggcccagguggcuaugagcacccugcccgucgaggacgaagaguccucugaaucaagaaugguugugacauuccucaugagugcacuugagagcaugugcaaggaacuggccaaauccaaggcggagguagcuuguaucgccguguacgagacugaugucuuugugguuggcacggaaagggggcgggcauucgugaacacccgcaaagacuuucaaaaggauuucgucaaauauugcguggaggaagaggagaaggccgcugaaaugcacaagaugaaaucuacaacucaggcaaaucgaaugucgguagacgccguugagauugaaaccuugcguaagacaguggaggauuacuuuuguuucugcuauggaaaggcuuuagguaaaucaaccgucgugccugugccauacgagaaaaugcugagagaccagagcgccgucguugugcagggccuaccggaagggguagcguuuaagcaucccgagaacuaugaucucgcaacucugaaguggauacuugaaaauaaagccggaaucaguuucauuaucaagaggccuuuucuggagcccaaaaagcacgugggcggucgggucauggugacagacgcugaucgcuccauuuugucuccagggggaagcuguggcccuaucaaaguuaagaccgaaccaacggaggacuccggcauaucacucgaaauggccgcagugacugucaaagaggagagugaagaucccgacuacuaucaauacaacauccaggggagccaucacucuuccgagggaaaugaagguaccgagauggaagugccugcugagggcuga

SEQ ID NO: 57028 - RNA, 2931 nt, Artificial Sequence
  derived and/or modified sequence opt3 from GTF2IRD1__Homo_sapiens__NP_001186136
auggcccugcucggcaagagaugcgacgugcccaccaacggguguggaccugauagguggaauagcgcuuucacacggaaagacgagaucauuacuucccuugucucugcacuggauucaaugugcagugccuugagcaaguuaaacgcggaaguugcuuguguggccguacacgacgaguccgcauuuguggucgguacggaaaaaggccgcauguuccugaaugcccgaaaggagcuacagucugauuuucuccguuucugccugucggcugcacaacauagagccgcuaccucacagcuugaagggagggugguucggcgcgugcugacagucgccagcagagcguuguguccaacuggaggcccgcccuggaaagacccugaggcagagcacccaaagaaggugcagaggggugaagggggaggccggagucucccccgcuccucucuggagcauggcagcgauguauaccugcuccgaaaaaugguugaagagguguuugacgucuuauauuccgaggcccuggggagagcuucaguggugccucuuccauacgaaagguugcugcgggagcccggacuacucgccguccagggucugccugaaggccuugcauuccgucgcccagcugaguaugauccgaaggcccugauggcgauauuggaacacagucauagaaucagguuuaaacucaagcggccccuggaggacgggggacgagauagcaaagccuuaguugagcugaacggcgugucucucauuccuaaggguucccgcgacugcgggcuucacggacaagcaccaaagguacccccucaggaucugccacccaccgcuacaucaagcaguauggccucuuucuuguacuccaccgcucuaccgaaucacgccaucagagaacugaaacaggaggcaccuagcuguccccucgccccaucggaccugggccuuucuaggccuaugcccgaaccaaaggcuacuggcgcgcaggacuuuuccgauugcugugggcaaaaacccacaggaccugguggcccacugauucagaacgugcaugcaucaaagcggaucuuguucaguauaguccacgacaaaagcgagaagugggaugccuuuaucaaagaaaccgaggacauuaauacgcuccgcgagugcgugcagauccuguucaacuccagauaugcugaagccuuagggcuggaucauaugguuccggugcccuacaggaagauugcaugugacccugaggccgucgaaaucgugggaauaccagauaagauucccuuuaaacguccuugcacuuauggcguaccaaagcuaaaacggauccucgaggaacgacacucuauucacuucaucaucaagagaauguucgacgagaggauuuuuaccgguaauaaauucacaaaggauacuaccaagcuggagcccgcuagcccgccugaagacacaucagccgagguuagucgcgcaaccgugcuugauuuggcggggaacgcucgguccgacaaaggcagcaugucugaagacugcggaccaggcacgucaggggagcugggaggucucagacccauaaagaucgagccugaagaucuggacauuauccaggucacugugcccgauccaaguccuacaagcgaggaaaugaccgacuccaugcccggccaucuuccaucugaggauucgggguacggaauggaaaugcugacugacaaaggcuugagcgaggaugccaggccggaggaacgcccugucgaggacucccacggugaugugauacgaccccuccggaagcaaguugaacuguuauuuaauacacguuacgcaaaagccauugggaucucagagccagugaagguacccuauaguaaguuccugaugcauccugaggaacuauuugucgugggccucccagagggaaucucucugagaaggcccaacuguuucggcauugcuaaacuucgcaagaucuuggaagccagcaauuccauucaguuuguuauaaaacggccugagcugcucaccgaaggggugaaggagccgaucauggacucacaggaaagagauagcggagacccacuggucgaugagucuuuaaaaaggcaagguuuccaggagaacuacgacgcacgacugucccgcauugacaucgcuaauacgcuucgggaacaggugcaggauuuguuuaacaagaaguauggcgaggcccucgggaucaaauaccccguacaagugccuuauaagagaauuaaaaguaacccaggaagcguuauaaucgaaggccugcccccugguauuccguucaggaagcccugcaccuuugggucucagaaucuagagcguauccuggcggucgccgacaaaauuaaguucacagugacucgcccauuucagggccucaucccuaaacccgaugaggacgaugcuaaccggcugggagaaaaggugauacuuagagagcaggucaaggaauuguucaaugagaaauacggcgaagcacugggguuaaacaggccaguucucgugccuuauaagcugauccgagacucccccgaugccguggagguaaccggacuuccagacgauauuccguuccggaauccuaacacauacgacauccaccgccuggagaaaauuuugaaggcuagagaacaugucaggauggugaucauaaaucaacuccagcccuuugccgagauuuguaacgaugcaaaaguuccagcgaaggacucaaguauccccaagcggaaacgaaagagagugagcgaaggcaauucggucuccucuagcucaaguuccucuagcuccucaagcaguaacccugauucuguggccuccgcuaaucagauuagccugguucaguggccaauguacaugguggacuaugccggucuaaacguacaacugcccgggccucucaauuacuga

SEQ ID NO: 57029 - RNA, 2850 nt, Artificial Sequence
  derived and/or modified sequence opt3 from GTF2IRD2__Homo_sapiens__NP_775808
auggcccagguggcugucagcacccugcccguugaggaagaguccucuucagaaacaagaauggugguaacuuuccucgugagugcacuugagagcaugugcaaggaacuggccaaauccaaggcggaggucgcuuguaucgccguguacgagacggacguuuuuguggucggcaccgaaagggggugcgcauucgugaacgcccggacagauuuucaaaaagacuucgcuaaguauuguguagcagagggauugugcgaaguuaaaccuccauguccggugaaugguaugcagguccacucuggcgagacugagauuuuacgcaaggccguggaagauuacuuuugcuucuguuaugggaaggcucugggaaccacagugaugguccccguuccuuacgagaaaaugcuacgagaccagucggccgugguagugcagggccucccagaaggugucgcguuucaacaucccgagaacuaugaucuggcaacccuuaaguggauacuggaaaauaaagccgggaucucauucauuaucaaccguccuuucuugggaccagagagccagcucggcggccccgggauggugacugacgcugagagaaguauuguuuccccuucugaaagcugcggaccaaucaaugugaagacagagccgauggaagauuccgguauaucacugaaagccgaggcagucagugugaagaaggaaagcgaggaccccaacuacuaucaguacaauaugcagggcucucacccuuccucaaccagcaacgagguaaucgaaauggagcugccaauggaagauaguacgccccucguuccuucugaggaaccaaaugaggaccccgaggcugaagugaaaauugaggggaacacuaauuccagcucggucaccaacucugccgcgggaguggaagauuuaaauaucguccaagugacaguuccggacaacgagaaggagaggcuguccucaauugaaaagaucaagcagcuucgggaacaggugaaugauuuguucagucgcaaauuuggcgaagccauagguguagacuucccugucaaggugcccuacagaaaaauuacuuuuaacccaggguguguugugaucgacggaaugccucccggcgucguguucaaggcaccaggcuaucuggagauuagcuccaugaggcggauccuagaagcugccgaguucaucaaguuuaccguaauucgcccccucccugggcuggagcuuucuaacgugggaaaacgaaagauagaucaggaagguagaguuuuccaagagaaaugggaaagggcuuacuuuuucgucgaggugcagaauaucccaacaugccugauuuguaagcagagcaugucagugaguaaagaauauaacuugcggcgucauuaccaaaccaaucacuccaagcauuaugaccaguacauggagcgcaugagagaugagaagcuccacgaacugaaaaagggcuuaaggaaauaucugcucgggagcucugacacggagugcccggaacagaagcaggucuuugccaaccccucaccuacucaaaagaguccaguucagcccguggaggaucuugcaggaaaucugugggaaaaguugcgggagaagauccgcagcuucguggccuacuccauagcuauugacgagaucacagauaucaacaauaccacucagcuagcgauuuuuauccgaggcguagacgaaaacuucgaugucucugaggaacugcucgacacagugccuaugaccgguacgaaaucggggaaugagauuuuuagcagaguugagaagucccugaaaaaguucugcauagauuggucaaaacuugugagugucgcaucuaccggcacaccagccaugguggacgcuaacaauggacugguuacuaaguugaaaagcaggguggccaccuuuuguaaaggcgcagaacucaaguccaucugcuguauuauccaccccgagucacugugcgcccagaaauuaaagauggaccauguaauggaugucguggugaaaagcgucaacuggaucuguucucgggggcugaaucacuccgaauuuacaacucuacucuacgagcuggacagucaauauggaagccuuuuguacuauaccgaaauuaaguggcugucucgcggucucguucugaaaagauuuuucgagucccuugaggaaauagauucauucaugaguagcaggggcaagccgcugccucaguugucguccaucgacuggauucgugaucucgcuuuucugguggacaugacaaugcauuuaaacgcccugaauaucucucuacaggggcacagccagauuguaacccaaauguacgaucucauccgggcauuccuggcgaaacuuugcuugugggagacucaccugacgcgaaacaaccucgcucauuuuccaacacugaaauuagccucaagaaaugaaagugacggacugaacuauauacccaagaucgcagagcuuaaaaccgaguuccagaagagguuguccgauuuuaaacucuacgagucugagcugacucuauucagcuccccuuuuucaaccaagauugacagcgugcacgaggaacugcagauggaagucaucgaucuccaguguaauacagugcugaagaccaaauaugacaagguuggcauucccgaguucuacaaauaccuuugggguaguuauccaaaguacaaacaucacugcgccaagaucuugucuauguuuggguccacuuauauaugugaacaacuguucagcauuaugaaguuaucgaaaacaaaguacugcucacagcucaaagauucucagugggacagugugcugcauaucgcuacguga

SEQ ID NO: 57030 - RNA, 1098 nt, Artificial Sequence
  derived and/or modified sequence opt3 from GTF3A__Homo_sapiens__NP_002088
auggaucccccugccguggucgcugagagcguuuccucucugaccaucgcagacgccuucauugcggcuggcgaaucaagugccccaacaccgcccagaccugcacucccaaggcgguuuauaugcagcuuccccgacuguuccgccaacuacucuaaggcuuggaaacuugaugcacaccugugcaagcauacuggggagcgcccuuuugugugugacuaugaaggaugcgguaaagccuucauccgagauuaccacuugucgcgucauauuuuaacgcacaccggcgagaagccauuuguaugugcugccaaugggugcgaccagaaauucaacacaaagucaaaucugaagaaacauuuugaaagaaagcacgagaaccaacagaaacaguauaucuguagcuucgaggauugcaagaaaacuuuuaagaagcaccagcaacuaaaaauucaucagugucagcacaccaaugaaccccucuucaagugcacacaggagggauguggcaaacauuuugcgaguccuuccaagcugaaaaggcacgcaaaggcccacgaagguuacgugugccaaaaagggugcucuuucgucgcuaagaccuggacugagcuucugaagcaugugcgggagacacacaaagaagagaucuugugugaaguuugccgcaagaccuuuaaaagaaaggacuaucucaaacagcauaugaagacgcacgccccagagagggaugugugucggugcccgcgcgaaggauguggccgaacuuacaccacagucuucaaccugcagagccauauacuguccuuccacgaggagucaagacccuuugugugcgaacacgcaggcugugggaagacuuucgcuaugaaacagagucucaccaggcaugccguaguucacgacccugauaagaaaaagaugaaauuaaaggugaagaaaagccgggagaagcguucucuggcgucccaucuuucaggauauaucccacccaaacgcaagcaaggucagggcuugagccugugccagaauggggaaaguccuaacugugucgaggacaaaaugcuaucuacaguggccgugcucacccugggauga

SEQ ID NO: 57031 - RNA, 6330 nt, Artificial Sequence
  derived and/or modified sequence opt3 from GTF3C1__Homo_sapiens__NP_001511
auggacgcccuggagagccuccuugaugaaguggcucuggagggcuuggacggguuaugccugcccgcacuaugguccagacucgaaaccagggucccuccauucccgcugccccuugagccuuguacacaggaauuucuguggcgggccuuggcgacucacccaggaaucucuuucuacgaggagccccgcgaacgaccugaucuccaacugcaggaccguuaugaggaaauugaucuggagacggguauacucgagucaagaagggacccaguugcuuuagaagauguguaccccauccauaugauucuggagaacaaggacggcauccaggggaguugccgguauuuuaaggaacgcaagaauauuaccaacgauaucagaacaaaaagccuucagccuagguguacuauggucgaggccuucgaccgguggggaaagaaauugauaaucguggcaucccaagccaugcgcuaccgagcucugauuggccaggaaggugauccagaccuaaagcucccggauuuuucuuauugcauccuggagagacuugggaggucgcgguggcagggagagcugcagcgugacuugcacaccacagcauucaaggucgacgccggcaaacuccauuaccaccgcaagauucugaauaaaaacggcuuaaucaccaugcaaucacaugugauaagacugcccacuggggcucagcagcacagcauucuccuucuguugaauagguuucacguugaucggcgaaguaaguaugacauccuaauggaaaaacuguccgugaugcucucuacacgcaccaaccauauugagacgcugggaaaacuuagagaagaacuggguuugugugaaaggacuuucaagcggcucuaccaguacaugcugaaugccggcuuagcgaaagucgugagccugcgccuacaagagauccacccugagugcgggccauguaagaccaaaaagggaacagauguaaugguuagaugccucaaacugcuuaaggaauuuaaaaggaacgaccaugaugacgaugaggacgaagaggugaucuccaagacuguacccccuguggauauuguguucgaacgugacauguugacccagacauaugaucugauagagcggcgaggcaccaaggguaucucacaggcagagauuagagucgccaugaauguugggaaacucgaagcuaggaugcugugucgccuucugcaacgguuuaaggugguaaaaggauucauggaggacgaaggcagacagaggacgacuaaguacaucaguugcguguuugccgaggagagcgacuugucucgccaguaucagcgagaaaaagcacgguccgagcuccugacaaccgucucauuagcuagcaugcaagaagagagucugcuaccagaaggcgaggauacuuuccucucugaguccgacagcgaagaggaacguucgucuuccaagagaagggggcgcggaucacagaaggauacacgggccagugcgaaccugagacccaaaacccagccgcaccacagcacgccuaccaaggguggcuggaaagugguuaaucuucaucccuugaagaaacagccaccuuccuuccccggggccgcagaggaaagggcuugucaaucucuggccagccgagacucacuccuggauacaaguuccgugagcgagccaaacgucucuuuugugucacacugcgcugacaguaauagcggagauauagccguaauugaggaaguucgcauggagaaccccaaggaauccucuucgagcuuaaagacuggccggcauuccucaggucaggacaaaccucacgagaccuacagacugcuuaagaggcguaauuugaucaucgaagcagugacaaaccuccgccugauugagagucuauucacuauccagaaaaugauuauggaucaggagaagcaagaaggggucucuaccaaaugcuguaaaaagagcauagugcggcuggucagaaaccucuccgaggaaggccugcuuagguuguaucgaacaaccgugauccaggacggaauuaaaaagaaaguugaucuggugguacauccaucaauggaccagaaugauccguuaguccggagcgccaucgaacaggugcgcuuuagaaucucuaacuccaguacugcuaauaggguuaagacgagccaacccccugugccacagggcgaggcggaagaggacucucaggggaaagaaggacccuccgguucaggcgacagucaacucagcgcaucgucccggucugagagcgggcgaaugaagaaaucagauaacaagaugggaauuacaccucugagaaauuaccacccaauagucgugcccggccuuggucgcagucugggguucuugccgaagaugccuaggcuccguguagugcacauguuucugugguaucuaaucuacggccauccagccuccaacaccguugaaaaacccucuuucauuagcgagcggagaacuaucaagcaggaguccggaagggcuggcguccgcccuucaagcagugggucugccugggaagcaugcuccgaggcccccagcaaaggaucgcaggacggugugaccugggaagcugagguggaacuggccacagagaccgucuacguugaugacgcaucauggaugcgauauauuccaccuauccccgugcacagagauuuuggcuucgggugggcgcucgugucugacauacugcuuuguuugccacugaguaucuuuauucagaucguacaagucuccuacaagguggauaauuuagaggaguuccucaacgacccgcugaaaaagcauacucuuauucgguuucugccuaggcccauccgccagcagcuacucuauaagcguagauacauauucagcguuguggagaaucugcagcgguugugcuauaugggacuguuacaauuuggcccaacagaaaaauuccaggauaaggaccaggucuucauuuuucucaaaaagaacgcugugaucguugauacgaccauuugugacccccacuacaaucuggccaggucuagccgcccuuucgagcgaagacuuuaugugcugaacuccaugcaggauguagaaaauuacugguuugacuugcaaugcgucugucucaacacuccacuggguguggugcggugccccaggguccgcaaaaauucaaguacagaccaggggagcgaugaggagggcucucuacagaaggaacaagaguccgcaauggacaagcacaaccuggaaagaaaaugugccaugcuugaguacaccacaggaucaagggagguuguggaugaaggccucaucccuggggacggacugggcgcugccgguuuggauaguagcuucuaugggcaucugaagcggaacuggauauggacuuccuacaucauuaaucaggccaagaaggagaacaccgcugccgaaaauggauuaacgguacgucuccagaccuuucugucuaaacgcccgaugccacuuucggcgcgaggcaacagcagacugaauaucuggggugaggccagggugggcucagaauugugcgcugggugggaggagcaguucgaagucgaccgggagcccucccucgaucgcaacagaagggugcggggaggcaagagucaaaagcgaaaaagacugaagaaagacccugggaagaaaauuaagcgcaaaaagaagggagaauuuccaggcgagaaaucuaagaggcuacgguaucacgaugaagcagaccagagcgcccugcagcguaugacaagacuuaggguuacuugguccaugcaggaggauggucuccugguguugugucgcaucgcuucaaaugucuuaaacaccaaagugaaggggcccuucguuacauggcaagugguccgggacauacugcaugccacuuuugaggaaucucucgacaaaaccagccacaguguaggaagacgagccagguacauugugaagaauccucaggcguaucugaacuacaagguuugccuugccgagguguaucaggauaaagcucuggucggcgacuucaugaaucgccggggugauuacgacgauccgaaggugugcgccaacgaauuuaaagaguucguagaaaaguugaaagagaaguuuuccagcgcacuaagaaauucuaaccuggagauccccgacacgcuccaggaacuguucgcucguuacagggugcuugccaucggcgaugagaaggaccaaacacggaaagaagaugaguuaaauucagucgacgauauucauuuccugguucuccagaacuugauccaguccacccuggcacucagugacagccagaugaagucguaucaaucuuuucagacuuuccgccuguaccgagaguauaaagaucacgugcuugugaaggccuuuauggaaugucagaaaagaucccuggucaacaggcggcgcgugaaucacacauuggggccaaagaagaacagagcucuaccuuucguucccaugagcuaccaacugucacagaccuauuacaggauuuuuacuuggcgauucccaaguaccauaugcacagagucuuuucaguuccucgaccggaugcgugcggccggaaaauuagaccagccugauagauuuuccuucaaggaccaagauaauaacgaacccacgaaugacaugguagcauuuagccuggauggcccagggggaaacuguguggcuguccuuacccuguucucacucggcuugaucaguguggacguucgcauuccggagcagaucauuguggucgauagcuccaugguggaaaaugagguaaucaaaucucuggguaaggacgggagccucgaggaugacgaagaugaggaagacgaucuggacgagggagucggcgguaaaaggcgguccauggaagugaagccugcccaggccucacauacuaacuaucuucuaaugagaggcuacuacucucccgggauaguuaguacacgcaaucugaacccaaaugacucgaucguggucaacagcugccagaugaaguuccaauugagguguacccccgugccugcucgauuacggccagcagccgcgccccuggaggagcucacaaugggaacuuccugccugccugauaccuuuacgaaacuuauuaauccgcaggaaaacacauguucucuggaggaguucguucuccaguuggagcugucaggcuauagcccagaagaccuaaccgcugcccuggagauccucgaggcaauuaucgccacugggugcuuuggaauagauaaggaagaacuuagaaggcgcuucuccgcucuggaaaaagcaggcggugggcguacccggacauuugccgacuguauucaggcguuauuggagcaacaccaggugcuggaggucggaggcaauacugcuagacucguggccaugggcagugcauggcccuggcugcuucauucuguaaggcugaaggaucgcgaagacgccgauauccagcgagaggacccucaagcucggccccucgaagggagcucauccgaggauaguccaccugaaggacaggcacccccaagccacucuccuagagguaccaaaaggcgcgcauccugggcuucagagaacggcgagacagacgccgaagggacgcagaugaccccggcgaagagacccgccuugcaggauagcaaccuggcaccaucguuaggaccuggcgcugaggacggugccgaagcucaagcacccucuccaccucccgcccuagaggacacugccgcugcgggggcagcccaggaagaucaggagggagugggcgaguucaguuccccgggccaggaacaacugagcgggcaggcucagccaccugagggaucagaagacccccgggguuuuacagaguccuucggcgccgcaaauaucucucaggccgcuagggaacgugauugcgagagcguuuguuuuauugggcgaccauggcgcgucguggacggacaucucaaccuucccgugugcaaaggcaugauggaggcgaugcuguaccacauaaugaccagaccugguaucccggaaaguuccuugcugcggcacuaucaagggguccuccagcccguagccgugcuggagcuucuccagggacuggagagcuugggcugcauuaggaagcgcuggcugagaaagccacggccuguuucuuuauucucaacucccguggucgaggagguggaaguuccuaguucccuagaugagagcccaauggcauuuuacgaacccacacuggacuguacccucaggcuuggccgaguguucccucaugaggucaauuggaacaaauggauccaccuguga

SEQ ID NO: 57032 - RNA, 2010 nt, Artificial Sequence
  derived and/or modified sequence opt3 from GTPBP1__Homo_sapiens__NP_004277
auggccaccgagagaagcagguccgcuauggacucucccgugccugcaucaauguucgccccagaaccgaguagccccggcgcggcucgggccgcagccgcugcagcccgccugcacgggggauuugauuccgacugcucugaggauggugaagcucucaacggcgagccugaacuugaccugacaucgaaguuggucuuaguuucaccaacuagcgagcaguacgauagucugcuacgacaaaugugggagcguauggacgaaggguguggagagacgaucuaugugauuggccaggguuccgaugggaccgaauacggacucucugaggccgacauggaggcgagcuaugcaacaguaaaauccauggccgaacagauagaggcugaugugauccugcuuagagaaaggcaggaggccggcggccggguccgcgacuaccuggugagaaagaggguuggggauaaugacuucuuggaagugcgggucgcagugguaggaaacguugaugcugguaaaucaacucuccugggcgugcugacccauggggagcucgacaauggacgcggcuuugcccgacaaaaguuauucagacacaaacaugagauugaaagugguaggacaagcucugucgggaacgacauccugggauuugauuccgagggcaauguggugaacaagcccgacucacacggcgggagccuugaauggaccaagauuugcgagaaaaguacuaaggucaucacauucauagauuuggcgggacaugaaaaauaucugaagaccacgguuuuugguaugacuggccaccuaccugacuucuguaugcucaugguggggucuaaugccggaaucguaggcaugaccaaagagcaccugggucuugcacuggcuuugaacgugccagucuuugugguugugacaaagauugauaugugccccgccaauauccuccaggagacucugaaguuacugcagcggcuccuuaaauccccugggugucguaagauuccaguccuggugcagagcaaagacgauguaaucguuaccgcuucgaacuucucuuccgaacgcaugugcccgauauuucaaauuucaaaugugacaggcgagaacuuggaccuacugaagauguuccucaaucugcuuagucccagaaccagcuacagggaagaggaaccugccgaguuucagaucgaugacacguauuccgucccaggagugggcacugucgugucugggacaacccugcggggauugauuaaacucaacgauacucuguuacugggucccgacccucuaggcaauuuccucagcaucgcaguuaagucaauccaucgaaaacgcaugccagugaaggagguaagagggggacagacagccaguuucgcucugaagaaaauuaagagguccagcauacggaaaggcauggucauggugucuccccgccuuaacccgcaggcgucaugggaauuugaggcagaaaucuugguucugcaccauccuaccacgauuagucccagauaccaagccauggugcacugugguagcaucaggcagaccgcuacaauacucuccauggacaaggauugccugcguacuggggacaaagccaccguccacuuccgguuuauuaagacaccagaguaccuucauaucgaucagcgacugguguucagagagggcaggacuaaggcaguaggaaccaucacaaaauugcuccaaaccacuaacaauucuccuaugaacucgaagccccagcagauuaaaaugcagagcacgaagaaaggcccacugacaaagcgcgacgaagggggacccuccgguggcccugccgugggggcuccaccgcccggagaugaggccucaaguguuggcgcaggucaaccugcggcuucuagcaauuuacagccacagcccaagccuuccucagggggccggagaaggggaggccagcgccacaaagucaagagccaaggggccugugugaccccagcaucuggaugcuga

SEQ ID NO: 57033 - RNA, 1416 nt, Artificial Sequence
  derived and/or modified sequence opt3 from GTPBP3__Homo_sapiens__NP_001122327
auguggagaggccuguggacccucgccgcucaggcagccagggggccccggcgccuuugcacacgacguagcuccggagcgccugcuccagguucuggcgccacuaucuucgcacugucaagugggcaaggaagauguggcauugccgugauaaggacgagcgguccggcuuccgggcacgcauugcggaucuuaaccgcuccccgcgaccugccucuagccagacaugccucucucaggcugcuuucggauccacggucaggagagccccuggaccgcgcguugguccucugguuuccuggcccacagagcuucacaggcgaagauugcguugaguuucacgugcaugggggacccgcaguagugagugguguccugcaggcccugggcuccgugccugggcuccgaccagcugaagccggagaguucacuagaagggcauuugcuaacggcaaguuaaaucugaccgaaguugagggucuugccgacuugauucacgcggagacagaagcccagcggcgucaagcacugcgccagcuagauggggagcucggacaucuguguagaggcugggcugaaacccuuacuaaagcccuggcucacguggaggccuacaucgacuucggcgaggaugacaacuuggaagaggggguccucgaacaggcagauauugaggugagggcccugcagguagcuuuaggagcgcaccuccgggacgcacgacgcggucaaagacucaggucuggcguucauguggucgugacagggccgcccaaugccggaaagagcucccuugugaaccuguugucacggaaaccugucaguaucguuagcccagaacccggcaccacgcgcgaugugcuagagacuccuguagaccuggcugguuuuccagugcuccugucugauaccgccgggcuuagagagggcgucggacccguggaacaggagggcguuaggcgugcacgggaauccugcaauuuccuggccacaguggucgcuucagugggggcccagagcccgagugacucuucccagcgauugcuccugguauuaaacaagagcgaccugcuaucgccugagggacccgguccaggcccugaucugcccccacaucugcuuuugucuugucugacuggggaaggacucgacggccugcuugaggcacugagaaaagaguuggcggcuguuugcggugaucccuccaccgacccuccacuccugacaagggcccgccaccaacaccacuuacaggggugucuggaugcacuaggccauuauaagcagucaaaggaccucgcccuggcugccgaagcacuucggguggcuagaggacacuugaccaggcugacgggcgggggagguacugaggaaauacucgauaucauuuuucaagacuucugcgucggcaaauga

SEQ ID NO: 57034 - RNA, 1905 nt, Artificial Sequence
  derived and/or modified sequence opt3 from GTPBP4__Homo_sapiens__NP_036473
auggcccacuacaacuucaagaaaaucaccgugguccccagcgcuaaggacuuuauugaucugacacucuccaaaacucagagaaagacgccuaccguuauacauaaacacuaucaaauccauaggauucggcacuucuacaugcgcaaggugaaguuuacacagcagaauuaucaugaccgacuuucucagauccugacugauuucccaaaauuggacgauauucacccguuuuacgcagacuuaaugaacauccuguaugauaaggaccacuacaaacuagcccucggccaaauaaauaucgcgaagaaccugguagauaauguggcuaaagacuauguccgucuuaugaaguacggggauucacuguacagaugcaagcaguugaaaagggccgcacucggacggauguguaccgugauuaagcgccagaaacagagucuggaguaucuggaacaaguuagacagcaucucagcagguuacccacaaucgacccuaacacccggacucugcuuuugugcgguuacccaaaugugggcaaguccucuuucauuaacaaagucacacgcgccgauguggacguacagcccuaugcuuuuaccacgaagucgcuguucguugggcacauggacuacaaauaucuacgauggcaaguggucgauacuccuggaauccucgaccauccacuggaggauagaaauaccauagaaaugcaggcaauuacagcccuugcucaccugagggccgcgguguuguacgugauggaccucucagagcaguguggccacggucugcgggaacaguuagagcuguuucaaaacauccguccccucuucauuaauaagccucuuaucgucguugcaaacaagugcgaugugaaacgcaucgccgagcugagcgaagacgaucagaagauuuuuacugacuugcagagugagggguucccaguaauagaaaccuccacacuaaccgaggagggagugaucaaagucaagacggaagcaugugauagacugcucgcccauaggguggagacuaaaaugaagggcaauaagguuaacgaagugcugaaucggcuucaccuggcaauuccgacacgacgcgacgauaaagagagacccccuuuuaucccagaaggcgucguggcuaggcggaagcgcauggagaccgaggaaucuaggaaaaagagagagcgugacuuggaacucgagaugggggacgauuauauacuggacuuacagaaauacugggaucugaugaaccuaagcgaaaagcaugacaagauucccgagaucugggagggacacaacaucgccgauuacauugacccugcgaucaugaaaaagcucgaagaacuggaaaaagaggaagaacuucggacugccgcuggugaguaugauuccguaucagaaagugaggacgaagagauguuggagauucgacaacuggcuaagcagauaagagagaaaaagaagcucaaaauccuggagagcaaggagaaaaauacacagggcccaaggaugccccgcaccgccaagaaaguucagcggacggugcuugagaaggaaaugagaucucugggggucgauauggacgauaaagacgaugcucauuacgccgugcaagcaaggcgcucccgaucaauuacccggaagcguaagagagaggacagcgccccgccuaguucugucgcuagguccggaagcugcucgcgcacaccccgggacgugucuggcuugagagauguuaaaauggugaagaaagcgaagacuaugaugaaaaacgcacagaagaagaugaauaggcucgguaaaaagggggaggccgaccgacacguauucgauaugaaaccaaagcaccuguuauccggaaaacgcaaggcuggcaagaaagaccggagauga

SEQ ID NO: 57035 - RNA, 504 nt, Artificial Sequence
  derived and/or modified sequence opt3 from GTSF1__Homo_sapiens__NP_653195
auggaggaaaccuacacagacagccuggaucccgagaagcuccuucagugcccuuaugacaaaaaccaccaaaucagagccuguagguucccauaccaucugauuaagugccggaaaaaucacccggauguggcuuccaaguuggcaacuugucccuuuaacgcccgccaucaggucccucgagcggaaauaucucaccauaucucaaguugcgacgaucguagcuguauugagcaggacguugugaaucagacgagauccuuaaggcaagaaacccuggcugagucuacauggcagugcccacccugugaugaggacugggauaaagaccuaugggaacagacuucgaccccuuucguauggggcacaacccacuauucagauaacaauagcccagccaguaacaucgugacugagcacaagaauaaccucgcauccgggaugcggguccccaagucucugccuuacgugcuuccauggaaaaauaacggaaaugcccaguga

SEQ ID NO: 57036 - RNA, 606 nt, Artificial Sequence
  derived and/or modified sequence opt3 from GUCA1A__Homo_sapiens__NP_000400
augggcaacgugauggagggaaagagcgucgaggaacuguccucuaccgaaugccaccagugguacaaaaaguucaugacagagugucccucagggcaacucacucuuuaugaauuuagacaguucuuuggucugaaaaauuugaguccuagcgccucccaguacguugagcagauguucgagacguuugacuucaacaaggauggcuauaucgacuuuauggaauacguggcugcauuaucucugguacuaaaagggaagguggagcaaaagcucaggugguauuucaaacuguacgaugucgacggaaauggcugcauugaucgggacgaacuucugaccauaauccaggccauucgcgcgaucaacccauguucggauacaacuaugaccgcugaggaguuuacagacaccguguucucaaagauugauguuaauggugacggggaauugagccucgaggaauuuaucgagggagugcagaaagaucagaugcugcuggacacucucacacgaaguuuagaucugacccguauagucagaaggcuucaaaacggcgaacaggacgaggagggcgccgacgaagcagccgaggcugcaggguga

SEQ ID NO: 57037 - RNA, 603 nt, Artificial Sequence
  derived and/or modified sequence opt3 from GUCA1B__Homo_sapiens__NP_002089
augggccaggaguucagcugggaagaggccgaagcugcaggggagaucgacguggccgaacugcaagagugguacaagaaauuugucauggagugccccuccggaacccucuucaugcacgaauuuaagagauucuuuaaaguuacagaugacgaggaagcgucucaguauguggaggguauguucagggcuuuugauaagaacggcgacaauacuauugauuuccuugaguacguagccgcacugaacuugguguuacgggggacgcuggaacauaaacuaaaguggaccuuuaagauauaugacaaagauggaaauggcuguaucgaccgccucgagcugcuuaacauugucgaagguaucuaccagcugaagaaagccugccgacgugaguugcagacagaacaagggcagcuccugacuccugaggaggugguugauagaauuuuccugcucguggacgaaaauggagauggccaguuaucacugaacgaguuugucgaaggcgcuaggcgggacaagugggugaugaaaaugcuucagauggauaugaauccaaguagcugguuggcacaacagcgcagaaaguccgccauguucuga

SEQ ID NO: 57038 - RNA, 720 nt, Artificial Sequence
  derived and/or modified sequence opt3 from GUCD1__Homo_sapiens__NP_001271183
augagaaccgaggccgaagcugcagggcccccucuggagccaggcgacuucgugcagcucccgguccccguuauccaacagcuuuaccacugggauugcggacuggccuguagcaggaugguguugcgguauuuaggucagcuggacgauuccgaauuugagcgcgcgcuacagaagcuccaacugacacgaucuauuuggacuauagaccuugcuuaccugaugcaucacuucggcguacgucauagauuuugcacgcagaccuuggggguggauaaaggauauaagaaccagucauucuacaggaaacacuuugacacagaagagacucgggucaaucaacucuucgcccaggcaaaggccuguaaagugcugguugagaagugcaccgugagugucaaggauauccaggcucaucuggcacagggccacguggccauuguacucguuaacagcgguguguuacacugugaccugugcuccucuccugucaaauauuguugcuuuacaccaucggggcaucacuguuucugccgcacccccgauuaccagggacauuuuaucgugcuuagaggcuauaauagggcuacuggcuguauuuucuacaacaauccugccuacgcggaccggaugugcucaacaagcaucaguaacuuugaagaggcacgcaccuccuaugggacggaugaagacauauuguucguguaccuggauucuuga

SEQ ID NO: 57039 - RNA, 2199 nt, Artificial Sequence
  derived and/or modified sequence opt3 from GUCY1A2__Homo_sapiens__NP_000846
augagcagaaggaagaucuccucugagucauucaguagccugggcuccgacuaccucgaaaccucucccgaggaagagggggaaugcccucuuucgcggcuguguuggaacggaucacgcagcccaccgggucccuuggagccuaguccagccgcugcagccgcggcugccgcacccgccccuacaccagcugcauccgccgcugccgcggcagccacugcuggcgcccgacgugugcagagaaggcggcgcgucaauuuagauucucugggggagagcauuuccagacuaacggcacccucaccucaaaccauacagcagacacucaaaaggacucugcaguauuacgaacaccaaguuaucggauaucgggacgcugagaagaacuuucauaauauuaguaaccgcugcagcuacgccgaucacucuaauaaagaagagaucgaggacguguccggcauucuucaguguaccgcgaacauccuggguuugaaguucgaagagauacagaaacgauuuggggaagaguucuuuaauaucugcuuccaugaaaacgagagaguacucagggccgugggaggcacacugcaggacuuuuucaauggcuuugaugcacugcucgagcacauucggaccucauucgggaagcaagcuacuuuagaaagcccaaguuuucuguguaaggagcuuccggaaggaacauugaugcugcauuauuuccacccccaccauaucgucgguuuugccaugcuaggcaugauuaaagcugccgggaagaaaaucuaccgucucgauguggagguugaacagguggcaaacgagaagcugugcucugacgucuccaauccuggaaacuguagcugccuuaccuuccugauaaaagagugugaaaauacgaacauuaugaagaauuugccacagggcacuucucaggugcccgccgaucuccgcaucucgauuaacaccuucugcagagcuuuuccuuuccaccugauguuugacccauccaugucaguauuacaacugggugaggggcucaggaagcagcuucggugugauacacauaaaguucugaaguucgaagacugcuuugagaucgugagucccaaagucaacgcgacuuucgaacgaguguugcuacgccugagcaccccguuugugaucagaacaaagccugaggcauccggaucugagaauaaagauaaggucauggaaguuaaaggccagaugauucacgugcccgagagcaacucaauacucuuccugggcaguccaugcguagacaaacuugacgaacugauggggaggggauugcaccucuccgauaucccuauucaugacgccacccgggaugugauccuggucggugagcaagcuaaggcccaggacggcuuaaagaagcgcauggauaaacugaaggcaacgcuagagagaacucaccaggcccucgaagaggagaaaaagaagacaguggaccugcuuuauagcauauuucccggggauguugcucagcaauuguggcagggacaacaggugcaggccaggaaauucgacgaugucaccaugcuguuuucugacauugugggcuucacugcaaucugugcgcagugcacaccaaugcagguaaucucaaugcucaaugagcuguacacccguuuugaucaucagugugguuuccuugacauuuacaagguugaaacgaucggggacgcuuauugcguggccgcaggccugcaccggaaaaguuugugucaugccaagcccauugcucucauggcccugaaaaugauggaguuaagcgaggaaguccugaccccugauggacgaccaauacaaaugagaaucggcauucacuccgggucugugcuagcaggagucguggguguuaggaugccgcgcuacugccucuucggcaacaaugugacacuggcuucgaaguuugagagcgggucccacccccggagaaucaacguaucaccuacuaccuaucagcuuuugaagagggaagagaguuucacauuuaucccacgcucucgagaagaacugcccgacaauuucccuaaagagauuccaggaauauguuacuuucucgaaguccggacuggccccaagccgccuaaaccaagccuguccucaagccguaucaagaaagugucuuauaacauugguaccauguucuuaagagagacaucccuguga

SEQ ID NO: 57040 - RNA, 1368 nt, Artificial Sequence
  derived and/or modified sequence opt3 from GUCY1A3__Homo_sapiens__NP_001124157
augcccccuugcuuccacaacgacuguagcgaguuugugaaucagccauaccugcucuauuccguccauaugaagucuaccaaaccgucacuuagucccagcaagccucaauccucucugguuaucccaacaucguuguucugcaaaacuuuucccuuccacuuuauguucgauaaggacaugacgauuuuacaguuuggcaacgggauaagaaggcugaugaaucggcgcgauuuccagggaaaaccuaacuuugaagaguacuucgaaauccuaaccccaaagauuaaucagacauuuucagguaucaugacuaugcucaacaugcaauucgugguacgagugcguagaugggacaauagcgucaagaaaaguuccagggugauggaucugaagggccagaugauuuauaucguugagucuagcgccauacuuuuucuggggucccccuguguggaccgguuggaagauuucaccggacgcggccucuaccugucagacaucccuauucauaacgcucugagagaugucgugcucaucggugagcaggcaagggcccaggacgggcugaaaaagcgguuaggaaaacuuaaggcgacauuggagcaagcucaccaggcccuggaagaggaaaagaaaaagaccguagaucuacucugcaguauuuucccaugugagguugcacagcagcuguggcaaggccaggugguccaggccaaaaaguuuagcaaugugacuaugcuuuucucugacaucgugggcuuuacagcuauaugcucccaauguucaccgcugcaggucauuaccauguugaacgcacucuauacgcgcuucgaucagcagugcggggagcuggacguuuacaaaguggaaacuaucggagacgccuauuguguagcugguggcuuacauaaggagagcgauacccacgccgugcaaauugcgcugauggcacucaaaaugauggaacuuagugacgaggucaugucuccccacggggaaccuaucaagaugcgaaucggacugcauuccggcagcguguuugccgguguugugggggucaagaugccaagauacugcuuguucggaaauaacgugacacuagcuaauaaauuugagucguguucuguacccaggaagauuaacguuuccccuacuaccuaccggcugcucaaagauugcccaggcuucguguuuacaccccguucacgcgaggaacugccgccuaauuuccccagugagauaccaggcaucugccacuuucuugacgccuaucagcaggggaccaacagcaagccuuguuuccagaaaaaggaugucgaagacggaaacgcaaauuuucuggguaaggcuuccggcauugauuga

SEQ ID NO: 57041 - RNA, 1860 nt, Artificial Sequence
  derived and/or modified sequence opt3 from GUCY1B3__Homo_sapiens__NP_000848
auguacggcuucgugaaccacgcccuggagcuccuugucaucagaaauuaugggcccgaaguuugggaggacauuaagaaagaagcucagcuggaugaggaaggacaauuuuuggugaggauaaucuacgacgauagcaagaccuaugacuuaguagcagccgcguccaaagugcugaaccuaaaugcuggugagauucuccagauguucggcaagauguuuuucgucuuuugccaggagucuggguacgauacaauccugcgggugcuuggaucaaacguucgcgaguuccugcagaauuuggacgcccuccaugaucaccuggcaacuauuuauccuggcaugcgagccccaaguuuucguuguacggacgcugaaaaagguaaggggcugauccuccauuacuauagcgaaagagagggauuacaagauauagugaucggcauuaucaagaccgucgcacagcagauucacggcacagagaucgacaugaaagugauacagcaaaggaacgaagagugcgaucauacucaguuccugauugaagagaaggaauccaaagaggaggacuuuuacgaagaucuugaccgguucgaggaaaaugggacccaggagucucgcaucucgccguacacauuuuguaaggccuuccccuuucacauuaucuucgacagagauuugguaguuacccagugcggaaacgcuaucuauagggugcugccucaacuacagccagguaauuguucacuccugagcgucuucagucuugugcggccccacauugacauauccuuucauggcauccugucucacauuaacacuguguucgucuugcgcagcaaagaagggcuccuggauguugagaaguuagagugcgaagacgagcugacaggaaccgaaaucuccugucuccgacuuaagggccagaugauauaccugccugaggccgauucaauuuuguuucuaugcaguccaagcgugaugaaucuggacgaucucacgagaaggggucuguaucuuucugacaucccccugcaugaugcgacucgggacuugguacuccugggggaacaauuccgugaggaguacaaauuaacccaggaacuggagauccuaacagaucgccuccagcugacucuuagagcauuggaagacgagaagaaaaagaccgacacacugcucuauuccgugcugccuccaucagucgccaacgagcuuaggcacaaacggccggugcccgcuaagcgauacgauaauguuaccauucuguuuagcggaaucgugggcuucaacgccuuuuguaguaaacacgcaucuggcgaaggggcuaugaagauugucaauuugcucaacgaccuguauacgcgcuucgauacuuuaacagacuccagaaagaacccuuuuguguacaaaguagagaccguuggagauaaguacaugacugugagcggucugccagaacccugcauacaucacgccaggucgaucugucaucuagcgcucgacaugauggagauugccggccagguccaaguggauggggaaucuguccagaucacaaucggcauucacaccggagaggugguuacgggugugauagggcagcggaugccucgcuauugccuguucggcaauaccguaaaccuuacauccagaacugagaccacaggagaaaaaggcaagaucaaugucucagaguacacuuauaggugcuugaugaguccagaaaacagcgacccccaguuucaucuggagcaccgugggccgguguccaugaaaggaaagaaggaaccuaugcaaguuugguuccucucucggaaaaauaccgguacagaggagaccaagcaggaugacgauuga

SEQ ID NO: 57042 - RNA, 3222 nt, Artificial Sequence
  derived and/or modified sequence opt3 from GUCY2C__Homo_sapiens__NP_004954
augaagacccugcuccuugaccuggccuuguggagcuuacuguuccagcccggcuggcuauccuuuucuucacaagugagucagaacugccacaaugggagcuacgagaucuccguccucaugaugggaaacucugcuuucgcagaaccucugaaaaaucuugaggaugccguuaacgaaggucuggagauugugagaggcagguugcagaaugcggggcucaacguaacagugaaugcuacuuuuauguauucggacggacugauacauaacucaggcgauugucggagcaguacgugcgaaggucuggaccucuuacgcaagaucuccaaugcccagcgaaugggguguguccugauuggaccaucuugcaccuacagcacauuccaaauguaucuugauacugaguuguccuacccgaugaucucagcaggcaguuuuggccugagcugugacuauaaagagacccuaacacgucucaugucucccgccagaaagcugauguacuuccuugugaacuuuuggaaaaccaaugaucugccuuucaagacuuauuccuggucaacaagcuacguuuacaagaacgggaccgaaacggaggacugcuuuugguauuugaaugcucucgaagcaagugugucuuacuucucccacgagcugggauuuaaagucguguuaaggcaggauaaggaguuccaggacauucugauggaucauaaccggaaaagcaauguaaucauaaugugugguggcccagaauuucucuauaaacuuaaaggggaccgcgccguugcugaggauaucgugauuauccuggucgacuuguucaacgaccaguacuucgaagauaacgugacugcccccgacuauaugaagaaugugcuaguccugacccucucgccuggaaacucucugcuuaauuccucauuuaguagaaaccugagcccaacaaagagggauuucgcguuggcauaccucaauggcauucuguuauuuggucacaugcugaaaaucuuccuagagaacggggaaaauauaacuacccccaaguuugcccaugcuuuccggaaccucacauuugagggauaugacggcccuguuacccuggaugacuggggcgauguggacuccacgaugguacuuuuguacacuucuguggauacaaagaaguacaaaguccugcucaccuaugacacucacgugaauaagacauacccaguugauaugagcccgaccuucacguggaaaaacucaaagcugcccaaugacauuaccgggcgcggaccucaaauccuuaugauugccguguuuacacugacuggugcagucguguugcuccuguuaguagcucugcuaaugcuccgaaaguauagaaaagacuacgagcugaggcagaagaaauggagucacaucccacccgaaaacaucuucccucuugagaccaaugaaacaaaccauguuuccuugaagauugaugacgauaaacggcgugacacuauacagcgccugagacagugcaaguaugauaagaaaagggugauccucaaggaccugaaacacaaugauggcaacuuuaccgagaagcagaaaauugaauuaaacaagcugcuucaaaucgacuacuauaauuugacaaaguucuacgggaccgucaaacucgauacuaugauauuuggagugauugaguacugugagcggggcagccugcgagaaguccuaaacgacacgaucucuuauccagaugguacauucauggacugggaguucaagaucucagugcuguacgauauugccaaagggaugaguuaucuccauagcuccaagaccgaaguucacggccgccugaaaucuacuaauugcgugguagacucgagaauggucgugaagaucaccgacuuuggauguaacagcauucuucccccgaagaaagauuuguggacagcgccugagcaccugaggcaggccaauauaucccaaaagggcgacguuuacucauaugggaucauugcacaggaaaucaucuuacggaaagagaccuucuacacucucaguugccgcgauagaaacgagaagauuuuuaggguggaaaauucuaacggaaugaaacccuuccguccagaccuguuucuugagacagcugaagagaaggagcuggaagucuauuugcucgugaaaaauugcugggaggaagauccugagaagcggcccgacuucaagaaaauagaaacgacccuggccaagaucuuuggucuauuccaugaucagaaaaacgagagcuacauggacacucugauucgaagacuccagcuguacuccaggaaucuugagcacuugguagaagaacgcacacaacuguauaaggcugaacgggauagagccgacagguuaaacuuuaugcuccugccacgccuugugguuaaaucacugaaggagaagggcuucgucgaacccgagcuauacgaggaagugaccaucuauuuuagcgauauugugggguucacaacuaucuguaaauacucuaccccuauggaggucguugacaugcucaaugauauauauaaguccuuugaccauaucguggaccaccaugauguguacaaaguagaaacgauuggagacgcauauauggucgccaguggccugccaaagcgaaacgguaaucggcacgcuaucgauauugcgaaaauggcauuggagauccugagcuucauggggaccuucgaauuagagcaccucccgggccugcccauauggauucguaucggagugcauucuggcccuugcgccgcugggguugugggaauuaagaugccaagauacugucuuuuuggugacacagucaacacugccuccaggauggagucaaccggccugcccuugcgcauccacgugagugggagcacaauagcaauccucaagcggacugaaugccaguuccuguacgagguuagaggagaaaccuaucuaaaaggcagggguaacgagacgacauacuggcugaccgggaugaaggaucagaaauuuaaucuuccuacuccacccacaguggagaaccagcaacgacuccaggccgaguucucggacaugauugcuaauucccugcagaagcgccaggccgcaggcauccggucucaaaaaccgagaaggguagcgagcuauaagaagggaaccuuggaguaccugcaguuaaacacuaccgauaaagaaucaacauauuuuuga

SEQ ID NO: 57043 - RNA, 3312 nt, Artificial Sequence
  derived and/or modified sequence opt3 from GUCY2D__Homo_sapiens__NP_000171
augaccgccugcgcuagaagggcaggcgggcugcccgacccuggacucugugguccagccuggugggcgccgagccuuccccggcugccucgcgcuuugccacgauuaccccugcuacuccugcuucuguugcuccagccuccagcccuguccgcaguguucacagucggcguucuggggcccugggccugcgauccuaucuuuucucgugcuagaccagaccucgcagccagguuagcugccgcgcggcugaaccgcgauccgggacuugcaggcggucccagauucgagguggccuugcugccugaaccauguaggacucccgggucacuaggagcuguaaguagcgcccucgcacggguguccggccuggucggcccugugaauccagcugccugccgccccgcggagcuucuggccgaagaggcagggauugcuuugguuccguggggauguccuuggacgcaagccgaagguaccacagcucccgccgugacuccagcagccgacgcucucuacgcgcuguuacgagcauuuggcugggccagagucgcucuggugaccgccccucaggaucucuggguagaggcagggaggucucuuucgacagcccugcgggcucguggauugcccguugccucagugaccagcauggagccacuagaccugaguggcgcacgcgaagcgcucagaaaggucagggaugguccccgggugacugcugugauaauggucaugcacuccguucugcuugggggagaggaacagcgauaucuguuggaggccgcagaggaacucggccugacagacggcucuuuaguguuccugccuuuugauaccauccauuacgcccuaagcccagggccggaggcucucgccgcacuggcuaacuccucacagcuucgcagagcccacgacgcgguauugacgcugacuaggcauugccccagugaaggaagcgugcucgauucucugcggcgcgcccaagagagaagggaacuuccuuccgaccugaauuugcagcaggucucaccacucuucgguaccauuuaugaugcuguguuucuguuagcacguggcguugccgaggcucgggccgcagcgggaggacgaugggugagcggcgccgcugucgccagacacaucagggacgcacaggugcccgguuucuguggggaccugggcggagaugaggaaccuccauuuguacuacucgacacagaugcugccggcgaccgccuguucgcaacuuacaugcuugaucccgcccgggggaguuucuugucugcuggaaccagaaugcauuuuccgagggguggcuccgcgccugggccagaccccagcugcugguuugauccuaacaauauuuguggaggcggucuggagcccgggcucguuuuccugggcuucuuacugguggucggaaugggccuugccggggcauuuuuggcucacuaugugcgccaccgacuccugcauaugcaaauggucucgggaccaaacaaaaucauacuaacaguggacgauaucaccuuccugcacccucaugguggcacgucucggaagguugcccaggggucccguucaagucucggagccagaagcauguccgacauuaggucuggccccagccagcaccuggauucaccaaauaucgguguguacgaaggggaccgcguauggcuuaaaaaguuuccgggcgaccagcacauugcuauccggccugcaacuaaaacagccuucaguaaguugcaagagcugagacaugaaaacgucgcguuauaucucggacuguuucuugcuaggggcgccgaggggcccgcagcccugugggagggaaauuuggcugugguuuccgaacacugcacccgaggcagccuccaggaucugcuagcacagcgcgagauaaagcuggacuggauguucaaaucuucacuccugcuugauuugauuaaggguauccgguaccugcaucacagagggguggcccauggaagguuaaaaagucguaacuguauugucgacggccgcuuugugcucaagaucacugaucacggucacggccggcugcuugaagcgcaaaaaguacugccagagcccccuagagcugaagaccagcuauggacagccccagagcuccugagggaucccgcauuggagcgacgggggacccuggccggagacguguucagcuuagcuaucauuaugcaggaaguugucugccgcuccgccccuuacgcaaugcucgagcugacgccggaagagguggugcagagagucaggucuccacccccucuuugccggccacugguuucgauggaucaagcucccguggaguguauauugcucaugaagcagugcugggccgaacagccugagcugcgaccgagcauggaccauaccuuugaucuauucaagaauaucaacaaaggcagaaagacaaauauuaucgacuccaugcugcgcaugcuugaacaguauucaaguaaccucgaggaucugauaagggaacguacugaggaguuggaacuggagaaacaaaagaccgaccgguuacucacacagaugcugcccccaucuguggcggaagcccuuaaaacugggaccccuguagagcccgaauacuuugagcaggucacacuguauuucagcgacauugugggauuuaccacuaucuccgcaaugucagagccaaucgaaguuguggauuugcucaaugaccuguacacgcuauucgaugcuauuaucggcagccacgacgucuauaagguggagacaauuggugaugccuacaugguugcuucugggcugccucagagaaacggacaaaggcaugcagccgaaauagccaacaugucccuugacauccucagugcugugggcaccuuccgcaugcgacacaugcccgagguaccaguccggauuagaaucggucugcacagcggcccguguguggcggggguggucggauugacuaugccuagguauugcuuauuuggcgauaccguuaauacagcaucucgcauggaauccaccgggcugcccuaccguauccaugugaaccucucaacuguagggauucugagagcccuugacaguggcuaccagguggagcugcgggguaggacagaguugaaagggaagggagcugaagauacguucuggcuagucggccgccgagguuuuaauaagccaauacccaaaccuccagaccugcagcccggcagcucgaaccacgggaucucccuccaggagauuccuccggaaagacggaggaagcuggagaaagcccgcccaggacaauucucuuga

SEQ ID NO: 57044 - RNA, 3327 nt, Artificial Sequence
  derived and/or modified sequence opt3 from GUCY2F__Homo_sapiens__NP_001513
auguuccugggccucgggagauuuagcaggcuugugcugugguucgccgcuuuucggaaguuguuaggacaccauggucuggcauccgccaaauuccuauggugccucugucugcuuucugucaugucacugccccaacaaguuuggaccuugccuuacaagaucggcgugguagggccaugggcgugcgacagucucuuuagcaaagcucugccggagguggccgcacgccuggccauugaacgaauaaaccgugaucccuccuucgaccucucuuauucguuugaguacgucaucuuaaaugaagauugucagacaucaagagcucugagcaguuucauuucccaccaucagauggcaucuggauuuaucggcccuacuaacccagguuauugcgaggccgcuagccuuuugggaaauuccugggacaaggggauuuucucaugggccugugugaacuacgaacuggauaauaaaaucaguuaucccacguuuagcaggacccuaccuucuccaauacggguucucgugacagucaugaaguacuuccagugggcgcacgcaggcgugaucuccucagacgaggauauuuggguacauacugccaaccgcguugcuagcgcccugagaagucacggccuucccgugggggucgugcugaccacaggacaagacucucaguccaugaggaaggcauugcagcggauccaccaggcugaucgcauucgaaucauaauuaugugcaugcauagcgcccucaucgguggcgagacccaaaugcaccuguuagaaugugcgcaugaccugaaaaugacugaugggacauauguguuugucccuuacgacgcccuccuuuacucgcugccauauaagcacaccccguacagaguuuugaggaauaaccccaaacuacgggaggcauaugaugcugugcugacgauuacuguagaaucucaggagaagaccuucuaccaggccuucacagaggcugccgcacguggagaaaucccugagaaacucgaauuugaccagguguccccacuguucggcacuaucuauaauucaauuuacuuuauagcccaagcuaugaacaaugcgaugaaggagaacggucaggcaggggccgcuagucuuguccagcacagccgcaauaugcaauuccauggauuuaaccagcugaugagaaccgacuccaauggcaacggcaucucugaauaugugauuuuggauacaaaccucaaggagugggagcugcacagcaccuacacgguugacauggaaauggaguuacugagguucgggggaacucccauccauuuuccugguggccggccaccccgagccgaugcaaaaugcugguucgccgaagggaagauaugucacggaggcauugacccggcuuuugccaugauggugugccuaacacuccugaucgcacuuuugucaaucaaugguuucgcguacuuuauucgcagaaggaucaacaaaauucagcugauaaaggggccuaaucggauccuccugacccuugaggaugucacuuucauuaacccccauuuuggcaguaaacgcggauccagagcuagcgugucuuuccagaucacaucagaaguacaaaguggcaggagcccacgucuguccuucucuucggggagcuugaccccugccacguaugaaaauuccaacaucgcaauuuacgagggagacuggguuuggcucaagaaauuuucacugggugauuucggcgacuuaaagaguauaaagucucgggccagcgauguguuugaaaugaugaaagaccugcgacacgagaauaucaacccccuacucggguucuuuuaugauuccggaauguucgcuauugucaccgaauuuuguucaagaggcagccuggaggacauccuuacaaaucaggacgugaaguuggauuggauguucaaaucuucccugcuccuggacuuaauuaaggguaugaaauaccugcaccauagggaauuuguccacgggcgccuuaagagucggaacugcgugguugauggcagauucguguugaagguaacugacuauggauuuaaugauauccucgagaugcugaggcuaagcgaggaagagucuuccauggaggagcugcucuggaccgccccagagcugcuucgcgcaccccgaggcucacgguuggggaguuucgcuggagacgucuacagcuuugccauaaucaugcaggaagugaugguucgugguacaccuuucugcaugauggaucugccagcgcaggagauuaucaacagacucaaaaagccgcccccuguguauaggccagucgugcccccugaacaugccccacccgaguguuuacaacugaugaaacagugcugggcugaagcagccgagcagcgcccgacuuucgacgagauuuuuaaucaguucaagaccuuuaacaaaggcaagaagacaaauaucauagauucgaugcuucggaugcuggaacaauacuccucuaacuuggaggaccucauuagagaaaggaccgaggaacuggagaucgagaaacagaagacugaaaaacuacugacgcagaugcucccuccaagcguagcugagucacugaagaaaggguguacaguggaacccgagggauucgaucuuguuaccuuguacuuuagugacauugucggcuucacuaccaucuccgccaugucugaaccuauagaggugguggaucuguuaaacgaccucuauacacuguuugacgcaaucauugguagccacgaugucuacaagguugagaccaucggggacgcguauaugguggccuccggccuucccaagcgaaauggaucacgccacgcugccgaaauugcaaacaugagccuggauauccuaaguucugugggcacuuucaaaaugcggcauaugccagagguaccugucagaauaaggauugggcuccacuccggacccgugguugcuggcguggucggucugacaaugccacguuacugcuuguuuggggacacggugaauaccgccagccgcauggaaucgacuggacugccguaucggauccauguuucauuaucuacagugaccauccuccagaaccugagugagggcuacgagguagaacuuagagguaggacagagcugaagggcaaagggacugaagagaccuucugguugauuggaaagaaaggcuuuaugaagccucuccccgucccacccccuguggauaaagacgggcaagugggacacggccugcagccagucgaaaucgcagccuuccagcgacggaaggcugagcgccagcuaguuagaaauaagcccuga

SEQ ID NO: 57045 - RNA, 657 nt, Artificial Sequence
  derived and/or modified sequence opt3 from GUK1__Homo_sapiens__NP_001152862
augcugagaaggccccucgccggccuugcugcagccgcgcuggggcgggcuccuccagacggaaugagcgguccgcgccccguggucuuguccggcccuucuggggccggaaagucaaccuuacugaaacgacuacuccaggagcacaguggcaucuucgguuuuagcguuucccauacaacucguaacccaagacccggggaagagaauggaaaggauuacuauuucgugacgagggaaguaaugcaacgggacauugcagccggcgauuuuauagagcacgcugaguucucuggcaaccuguacgggaccucgaaaguggcaguccaggccgugcaggcuaugaaucgcaucugcguucuugacguggaucugcagggagucagaaacauuaaggccacagacuugaggccuaucuauauuucagugcaaccacccagccuccauguacuggaacagcggcugcgccagcgaaauacugagaccgaagagagucucguuaaaagauuagcggcagcccaggcugauauggaauccucuaaggagccuggucuguuugacguggucaucauaaacgauagccuugaccaagccuacgcagaguugaaggaagcucuguccgaggaaaucaaaaaggcccagaggacaggcgcguga

SEQ ID NO: 57046 - RNA, 876 nt, Artificial Sequence
  derived and/or modified sequence opt3 from GULP1__Homo_sapiens__NP_001239597
augaacagagccuucagcaggaagaaagacaagaccuggaugcacacacccgaggcucuguccaaacauuuuaucccuuacaaugcaaaguuccucggcucuacugaaguggagcagccaaaagggacggaagucguucgggaugccgugcgcaaacuuaaguuugcgcgacacauuaaaaagucagagggacaaaagauaccgaagguagaacugcagaucaguauuuauggugugaaaaucuuggagcccaagaccaaggagguccagcauaacugccaguuacaccguauuagcuucugugcugacgauaaaacagacaagagaaucuuuacuuucauaugcaaagauuccgaaucuaauaagcaucuguguuacguguuugacucggagaaaugcgccgaagagaucacccuaacaauuggccaagcauucgaucucgccuauaggaaguuucuggagucagggggaaaagacguugaaacccggaagcagaucgcuggccuucagaagcgcauucaggaucuggagacugaaaacauggaguugaaaaauaaggugcaagaccucgaaaaccagcugagaaucacacaggucagcgcaccuccagccgguaguaugacccccaaauccccuucuacggauauauucgacaugauuccauuuagccccaucucccaccagucaaguaugccuacuaggaaugggacccaaccaccgcccgugccuagccggucuacagagauuaagcgcgaucuguucggagcugagccauuugaccccuucaacuguggcgccgcggacuucccuccagauauccaguccaaacucgacgaaaugcagcgacaaagauggaggggcucaaagugggauuga

SEQ ID NO: 57047 - RNA, 1956 nt, Artificial Sequence
  derived and/or modified sequence opt3 from GUSB__Homo_sapiens__NP_000172
auggccagaggcagcgcuguggcaugggccgcgcuggggccccuccuuuggggaugcgcucuggguuugcagggcgggauguuauacccucaagaguccccaucuagggaauguaaggagcuggacggacuauggucauuccgggccgauuuuagugacaaccgccgacguggcuucgaggaacagugguauagaaggccgcucugggaaagcggucccaccgucgauaugccuguuccauccucuuuuaaugacaucucgcaggauuggcggcugcgccacuucgugggguggguaugguacgagagagaggugauucuucccgaaagguggacacaggaccugcggacucgcgucguguugcgaauaggaucagcacauagcuaugccaucguuugggugaacggcgucgauacgcucgagcacgaaggcggguaccugccuuuugaggcugacauuaguaaucuggugcaaguaggaccacuccccuccagauuaaggaucaccauugcaaucaacaauacacugacuccuaccacacuuccaccggguaccauacaguauuugacugauacaucuaaauaccccaagggcuauuucguucagaacaccuacuuugacuucuuuaauuacgccgggcugcagcggagcgugcuacucuauacgacuccuaccacauacaucgaugacauuacugucaccacauccguggagcaagauucaggacuggugaacuaucagaucagugucaaaggcagcaaucuuuucaagcuggaaguucguuugcucgacgcugagaacaaagugguagccaaugguaccgggacgcagggacagcugaaggugccaggcgucucuuuaugguggcccuaccugaugcaugaacgcccugcguaucucuacucccuugaggugcaacugacugcacagacaucauugggcccaguuagcgacuuuuauacccuacccguggggauuagaacugucgccgugacaaagagucaguuccugaucaacggaaaaccguuuuacuuccacgguguaaauaagcaugaagaugcugacauaaggggcaaaggguucgauuggccucuccugguuaaggacuuuaaccuucugcggugguugggagccaaugcauuccgaaccucucacuaccccuaugcugaggaggugaugcaaaugugcgaucgcuacggcauugucgugaucgacgaauguccaggugucgggcucgcccugccucaguuuuucaacaacguguccuuacaccaucacaugcagguuauggaggaagugguaagaagggauaaaaaucaucccgcggucgugauguggagcguugccaacgagccagcaucgcaccuggaaucugcuggcuauuaccuaaagauggugauugcccacacgaagucccucgaccccucacggccugucaccuuugugaguaauagcaacuaugcugccgauaaaggagcaccauacguagacgugaucugccuuaauuccuauuacucuugguaccaugauuauggccaccuggaguugauccagcugcaacucgccacacaguucgagaacugguacaagaaauaucagaagccgauuauacagagcgaauacggggcugagacuaucgcgggauuucaucaagaucccccucugauguucaccgaagaguaucagaaaucacuucuggaacaguaccacuugggucucgaccagaagcgcagaaaauauguugucggcgagcugauuuggaauuuugcagacuucaugacagagcaaaguccaacuaggguguuagggaacaagaagggaaucuuuacccgucagcggcagcccaaauccgccgcuuuccugcuacgagaaagauacuggaagauagccaaugagacaagguacccucauagcguggcaaaaucucagugucucgaaaacucacuguuuaccuga

SEQ ID NO: 57048 - RNA, 1002 nt, Artificial Sequence
  derived and/or modified sequence opt3 from GYG1__Homo_sapiens__NP_001171649
augaccgaccaggccuucgugacacugacuacgaacgaugcuuacgcaaagggcgcccucguccuugggagcucccugaaacaacacagaaccacaaggcgguugguuguguuagcgacuccccagguaucugacucaaugcgcaaggugcuggagaccgucuuugaugaagugaucaugguugacgugcuagauaguggagacagcgcucaucucacacugaugaaacgaccugagcuuggugucacccugacuaaguugcacugcuggucccucacacaguauucuaaauguguguucauggaugccgacacccugguacuggcaaauauugaugaccucuuugaucgugaagaguuaucggccgcuccagacccgggcuggcccgauugcuucaacucagggguuuuuguguaccagccuagcgucgaaacguauaaucaacugcuucauuuggcaagugagcagggauccuucgacggcggugaccaggggauacugaacaccuuuuucucuagcugggccacuacagauaucagaaagcaccuaccauuuauuuacaaucucuccucaaucaguauuuauagcuaccugcccgcuuucaagguguuuggagccucugcgaaagugguccauuuccuuggcaggguuaagccuuggaacuauacuuacgacccaaaaaccaaguccgugaaaucagaggcacacgaucccaauaugacacacccugaauuucugaucuugugguggaacauauucaccacgaauguacucccacuguuacagcaauucggccuggugaaggacacuuguagcuacgucaacguggaggauguuaguggggccaucucucaucucucccuuggagaaauuccggcuauggcccagcccuuugugagcucggaggagcggaaggaacgcugggagcagggucaggcagacuauaugggcgcugauucuuucgacaauaucaaaagaaagcuggauacauacuugcaauga

SEQ ID NO: 57049 - RNA, 1413 nt, Artificial Sequence
  derived and/or modified sequence opt3 from GYG2__Homo_sapiens__NP_001073324
augagcgugaccgaccaggccuucgucacacuggcuacuaacgauaucuacugccaaggcgcacucguucuugggcagucccugagaaggcaccgguugacgcgcaaguuagugguacugauuaccccacaggugucuucacuacuccgagucauacugaguaaaguguuugacgagguuaucgaagugaaucuuauugauagcgccgacuauauccaucuggcguucuugaagcguccugagcucggacugacacugacuaaacuccacuguuggaccuuaacacauuacuccaagugcgucuuucuggaugcugacacccuuguguugucuaacguagaugaacuguucgacagaggugaguuuucggccgcaccagauccgggcuggcccgacuguuucaauucagggguuuuuguguuccagccuagccuacacacucauaaacuccugcuucaacacgccauggaacacggaaguuuugauggcgcugaccagggucuguugaacuccuucuuuaggaauuggucuacaaccgauauucauaagcaccucccauucaucuauaaccugagcuccaauacgauguacacuuauucacccgcauuuaagcaguucgggaguagcgccaaagucgugcauuucuuaggaucuaugaagccuuggaacuacaaauauaauccacaguccggcucagugcuggagcaaggcagcgcuaguucuucccagcaccaggccgcguuucuccaccuuugguggaccgucuaccagaacaauguucugcccuuguacaagagcgugcaagcaggggaggcccgggcuucgccuggacauacacuaugccacucugacguagguggcccaugugccgacuccgcaucaggggugggagaaccgugcgagaacaguacucccagcgcuggcgucccuugugccaauuccccacuggguucuaaccagcccgcgcaggggcucccugaaccaacccaaauaguggaugagacacugagccuucccgagggacgcagaucagaagacaugaucgccugcccggagaccgaaacgccugcaguuauuacuugugauccccugagucagccauccccucagcccgcugacuucacagagaccgaaacuaucuugcagccagccaauaaaguggagagcgucucuucagaggaaacauuugagcccagucaagaacucccugcugaggcccugagggaucccagcuuacaggacgcacuggaaguggaucuagccguauccguuucucagauuucgaucgaggagaaggugaaggaacucagcccggaggaagagagacgcaaaugggaagagggccgaauagacuauaugggcaaggaugcuuucgcgcggauucaggagaaacuggacagguuucuucaauga

SEQ ID NO: 57050 - RNA, 2166 nt, Artificial Sequence
  derived and/or modified sequence opt3 from GYLTL1B__Homo_sapiens__NP_001287650
augcugcccagaggcaggccucgggcccucggggcugcagcccuucuguuguuacugcuacuccugggauuccuucuguuugguggcgacuuggggugcgagcgccgagaaccaggaggccgugcgggugcuccgggguguuuccccggaccucucaugccaagagugcccccugauggcaggcugcggcgcgccgcagcccuggacggcgauccaggggcuggacccggugaccacaacagaagcgauugcggcccucagccaccgcccccuccaaagugugagcucuuacaugucgcaaucguuugcgccgggcacaauuccucuagggacgugauuacccugguaaaaucaauguuguuuuaccggaagaacccccuucaucugcaccuagugacagaugcugucgcccgcaauauacucgaaacucuguuccauacguggauggugccugcgguucgagugaguuuuuaucacgcagaccaacuuaaaccacaggucagcuggauccccaacaagcacuacuccggacuguauggcuugaugaaacucgugcugccgucugccuuaccugcugagcuggccagaguaauuguucucgauaccgacgugacauucgcaucggauaucucagaacuuugggcucuguuugcccauuucagcgacacucaggcgauugguuuggucgagaaucagagugauugguaccuagggaaccuguggaagaaucacaggcccuggccagcccucggacggggcuuuaacaccggcgugauccugcuucgucuggaccgcuugagacaagcagggugggagcagauguggaggcucacagcucggcgagaacuguuaucccugccugccaccucucuagcugaccaggauauauucaaugccgugaucaaggagcaucccggacucguccagcgccugccauguguuuggaacgugcaacuuagcgaccacacuuuggcagaaagaugcuauuccgaggccucagaucugaaaguaauucacuggaauagucccaagaaacucagggugaagaacaaacaugucgaguuuuuccggaauuuuuaccugacauuccuugaauaugacgguaaccuguugcgcagagaacucuucguguguccuagccagccaccgcccggcgcugaacagcugcagcaagcguuagcacagcuggaugaggaagacccuugcuuugaguucaggcagcaacagcuaaccguucaccgugugcaugucacguuucucccacacgagcccccuccaccccggccgcaugaugugacucugguagcccagcuuucuauggaccgauugcagaugcuggaagcucucuguagacacuggccugggccaaugucccuggccuuauaccugaccgaugcagaggcccaacaguuccuucacuuuguugaggcuucacccguguuggccgcaaggcaggacgucgcguaccauguggucuaucgcgagggaccucucuaccccgugaaucagcugcggaacguugcucuagcccaagcacugacaccauauguguuccucagcgauaucgacuuucugccugccuacagucuuuaugacuacuugagagcuucuauugaacagcugggcuuagguuccaggcgcaaggccgcacucguaguccccgcuuucgagacucugcgauaucgguuuagcuucccacacucgaagguggagcuucuggccuugcucgaugcggggacccuguacacauuucguuaccaugaauggccgagaggccacgccccuaccgacuaugcuagguggcgcgaggcacaggcccccuaccggguucagugggcugccaacuaugaaccauacguggucgugcccagagauugcccuagguaugacccacgauucguaggauuuggcuggaauaaaguggcacacaucguugagcuagaugcgcaagaauacgagcugcucguccugcccgaggccuucacgauacaucuuccucacgcuccgucuuuggacauuucccgcuuccggucaaguccaacuuauagagauugucugcaggccuuaaaggacgaauuucaucaggaucucagcaggcaccauggggcagcugcccugaaauaccuucccgcacugcagcaaccucaguccccagcccguggauga

SEQ ID NO: 57051 - RNA, 453 nt, Artificial Sequence
  derived and/or modified sequence opt3 from GYPA__Homo_sapiens__NP_002090
auguacggcaagaucauuuucgugcugcuccuuagcgagauagucuccaucucugcccugucaaccacagaaguugcuaugcacacgaguacuagcuccucugugaccaaaucguauauuucaagccagacaaacgacacucauaagagagauaccuacgcagccacacccagggcgcacgagguaagugaaaucuccgugcggaccgucuauccuccagaggaagagacuggggagcgcgugcaauuggcucaucacuuuucugaaccggagauuacauuaaucauauucggaguuauggccggugugaucggcaccauucugcuaaucagcuacgggauucgacgucucaucaaaaagucccccucagacgucaaaccucugccaagucccgauacggacgugccucuuagcucuguagaaauagagaauccagagacuuccgaucaguga

SEQ ID NO: 57052 - RNA, 276 nt, Artificial Sequence
  derived and/or modified sequence opt3 from GYPB__Homo_sapiens__NP_002091
auguacggcaagaucauuuucgugcugcuccuuagcgagauagucuccaucucugcccugucaaccacagaaguugcuaugcacacgaguacuagcuccucugugaccaaaucguauauuucaagccagacaaacggggagacuggacaauugguacauagauuuaccgugcccgcaccugucgugaucauuuuaaucauacugugcguuauggccgguaucauuggcacaauccuacucauuaguuacaccaucaggcggcugauaaaggcguga

SEQ ID NO: 57053 - RNA, 324 nt, Artificial Sequence
  derived and/or modified sequence opt3 from GYPC__Homo_sapiens__NP_001243513
auggccagcgcuuccaccacaaugcacacuacgaccaucgcagagcccgacccuggcaugucuggguggccagauggaagaauggaaacaucaacuccgaccauuauggacauaguggucaucgccgguguuauugcggcuguggccaucguacuggugagucuccuuuucgucaugcugagguacauguaucggcauaagggcacauaccacaccaacgaggcaaaagggacugaauuugccgagagcgcugaugcagccuugcagggagaccccgcuuuacaagaugccggcgacuccucucgcaaggaauauuucauuuga

SEQ ID NO: 57054 - RNA, 237 nt, Artificial Sequence
  derived and/or modified sequence opt3 from GYPE__Homo_sapiens__NP_002093
auguacggcaagaucauuuucgugcugcuccuuagcgggauagucuccaucucugccucaaguaccacaggaguugcuaugcacacuagcacguccucuucggugaccaaaucauauauuagcagucagacaaacgguaucacucugauuaauuggugggcaauggccagaguaaucuuugaggugauguuggucgugguuggcaugauaaucuuaauuuccuacugcaucagguga

SEQ ID NO: 57055 - RNA, 2022 nt, Artificial Sequence
  derived and/or modified sequence opt3 from GYS1__Homo_sapiens__NP_001155059
augccccugaacagaacccucagcauguccucucuuccuggccuggaggacugggaagaugaguucgacuuggaaaaugccguguuauuugaggucgcuugggaaguugcaaacaagguagggggaaucuacacagugcugcagacuaaagccaaggugacgggugaugaguggggcgacaauuauuuccuagucgggccauacaccgagcaaggagugaggacacagguugaacuccuggaggcgccgacucccgcucuuaaacggacccuggauucaaugaacaguaagggcugcaaauuuuuggcccagagcgaagagaagccucacguggucgcacauuuccacgaguggcucgccgguguggggcugugucugugccgcgcucgacgucucccaguagcaacaauuuuuaccacucaugccacauuacugggaagauaucuuugugcuggcgccguugacuucuacaauaacuuggaaaauuuuaacguggauaaggaggcgggcgaaaggcagauauaucaccgguacugcauggagcgcgcagccgcucauugugcccacgucuucaccacggugucccaaaucacugcaauugaagcucagcaucugcuaaaaagaaagcccgacaucgugaccccuaaugggcucaacgucaaaaaguuuucugccaugcacgaguuccagaaucugcacgcgcagucgaaagccaggauucaagaguuuguucggggacauuucuauggucaccuugauuuuaaccuggacaagacauuguacuucuucaucgcaggccgcuacgaauuuucaaauaagggggcugauguguuccucgaggcccuggcucgauuaaacuaucugcucagaguaaauggaagcgaacagacuguggucgccuuuuucauaaugccagcaaggaccaacaacuuuaauguggagacacuuaaaggccaggccguucggaagcagcugugggacaccgcuaacacggugaaagaaaaguucggucguaaauuguacgagagucuacuggucgggucccuccccgauaugaauaagaugcuggacaaagaggacuuuacuaugaugaagcgcgcgaucuucgcaacacaaagacagucuuuuccuccagugugcacccacaacaugcuugaugacagcuccgauccgauucugacuacaaucaggcggauuggauuguucaauucaagugccgaccgaguaaagguuaucuuucaucccgaguuccucagcucuaccuccccucuguuaccaguggauuaugaagaauuuguccgcggcugucaccugggcguguuccccucauacuaugagccuuggggguacacgccagcugaaugcaccgucaugggaauacccagcauuaguacaaaccuaucugguuucggcuguuuuauggaggagcauaucgccgacccguccgcauaugggauuuacauccucgauagaagguuccggagccuggacgauucgugcucucagcuuacuuccuuuuuguacucauucugucaacagagucgcagacagaggaucauucagcguaaucggaccgaacgacugagcgaccuccuggauuggaaauaucuuggaagauacuauauguccgccaggcacauggcucugucuaaggccuuuccugagcauuucacauacgaacccaacgaggcagacgcggcucaaggcuaucgcuacccacggccugccagcgugcccccaucacccaguuuguccagacacagcucuccucaccagucagaggacgaagaggauccaaggaaugguccgcucgaagaggacggggaacgcuaugaugaggacgaggaagcagccaaagaucgacggaacauacgugcucccgaguggccuagaagggccaguugcacuagcuccaccucuggcucgaagcgcaauagcguugacacagcaaccuccucaagucugucuacuccaagcgaacccuuauccccuacgucaagccugggagaggaacggaacuga

SEQ ID NO: 57056 - RNA, 2112 nt, Artificial Sequence
  derived and/or modified sequence opt3 from GYS2__Homo_sapiens__NP_068776
augcugagaggcaggagccucuccgugaccucucuugggggacugccccagugggaggucgaagaguugccuguugaagaguuacugcuauucgaaguggccugggagguaacaaacaagguggguggcaucuacacugucauucaaacgaaagcuaagaccacagcagacgaguggggagaaaauuauuuucucauagggccauacuucgagcacaacaugaaaacucagguggaacagugcgagccgguuaaugaugccgugcggcgcgcggucgacgcuaugaacaagcauggcugucaggugcacuuuggucgauggcugaucgaggggucacccuauguaguucuuuucgauauuggauacagugccuggaaucuggaccguuggaaaggcgauuugugggaagcaugcagcgugggcaucccuuaucaugacagagaggccaacgauaugcucauuuuugggucccugaccgcuugguuccugaaggaagucacagaccacgcagauggaaaguacgugguggcccaauuucaugaguggcaggcugguaucggccucauauuaucuagggcccggaaacugccaaucgcgaccauuuucacuacacacgcaacccuuuuggggcgcuaucugugugccgcuaauaucgacuuuuacaaccaccuagauaaguucaauauugacaaagaagccggagagagacagaucuaccauagguauugcauggagcgggcaucgguccacugugcucauguuuuuacgacugugucagaaauaaccgccauugaggcggaacacaugcucaagcgcaaacccgauguagugacaccuaacggccugaaugucaagaaguucagcgccgugcacgaguuucagaaccuucaugcaauguacaaagcucgaauccaagacuucguuagaggucacuucuaugggcaucuggacuuugauuuggaaaagacucucuuccuguuuauugccggaagguacgaguucaguaauaaaggcgcugacaucuuuuuagagucccugucucggcucaacuuccuucugcguaugcacaagagcgauaucaccgugauggucuuuuucauuaugccagccaaaacaaauaacuuuaacguggaaaccuugaagggccaggcaguacgcaaacagcuaugggacguugcccauuccgugaaggagaaguucgggaaaaagcuguaugaugcucuccugagaggagaaauacccgaccuuaaugauauccuggacagggaugacuugacgauuaugaaacgggcgaucuuuucaacucagcgacaaagucucccuccagucacaacccacaacaugauagaugacagcacugacccgauucugucuacaauccgcagaaucgguuuauucaauaacaggaccgaucgggugaaggucauucugcaccccgaguuucuauccucaacgagcccucuccugccaauggacuacgaagaguucgugcgcggcugccaucuugggguuuuccccaguuauuacgagccuuggggauacaccccagcagaauguacagugaugggcauccccucuguaacuaccaauuuguccgguuuugggugcuucaugcaggagcacgucgccgauccgacagcuuauggcauuuacauaguggacagaagguuucguagcccugaugacucguguaaccagcugacuaaauuccucuauggauuuugcaagcaaucucggcgacagagaaucauucagaggaaucgcaccgaacggcuguccgaucuucuggacuggagauacuugggcagguauuaccagcaugcccgccaccucacacugucacgagcauuccccgauaaguuucacguugaguuaaccaguccaccuacuacggagggguucaaauauccccggccaagcuccgugcccccuucuccaagcggaucacaagccaguuccccgcagagcucugacgucgaagaugagguggaagacgagcguuacgaugaagaggaggaagcugagagagacaggcugaacaucaagucacccuuuagucuaagccauguaccucacgguaaaaagaaacuccauggcgaauacaagaauuga

SEQ ID NO: 57057 - RNA, 1368 nt, Artificial Sequence
  derived and/or modified sequence opt3 from GZF1__Homo_sapiens__XP_005260860
auggagagcggcgccgugcugcucgaauccaagucuucacccuucaaccuucugcacgagaugcaugaauugagauuacuggggcaccuaugcgacgucaccguuaguguggaguaccagggaguaaggaaagauuuuauggcucauaaggcagugcucgccgcgacaagcaaauucuuuaaggaagucuuccugaaugagaaauccguggacgguacucggacgaacguuuaucuuaaugaggugcaagucgcugauuuugccucuuuccuggaauuuguguacaccgcaaagguacagguugaggaagaccgcgugcagcgaauguuggaggucgccgagaagcucaaaugucuggaucugucggaaacaugcuuccagcucaagaaacaaauguuagagucagugcugcuugaauugcagaacuuuagcgagagucaggaaguggaggucuccucuggcagccagguuuccgcugccccugcaccacgugcuucaguggccacugacgggccgcaccccaguggacugaccgauagccuagacuauccuggcgagagagcgucuaaugguauguccucagaucucccacccaagaaaagcaaggacaagcuggauaaaaagaaagaaguagugaagccuccauaccccaaaaucaggcgggcaagugggcgccuugccggaagaaaggucuucguggagauuccuaaaaagaaguauacaaggcggcugcgcgaacaacagaaaaccgcugagggcgacguuggcgauuaccgauguccacaggaccagucuccggacagaguggggacugaaauggagcaagucuccaagaacgagggaugccaggccggugcagaauuggaggaacucagcaaaaaggcuggccccgaggaagaggaggaagaggaagaggaggaugaagagggggagaaaaagaagucgaauuuuaaauguucuauaugcgagaaggccuuccuguaugaaaaauccuuuuuaaagcauucaaaacacaggcacggaguggcgacagagguaguuuaccggugugauaccugcggccagacguucgccaaccguuguaaucugaagagucaucaacgccacgugcauagcuccgagagacacuucccuugcgaacucugugguaagaaauuuaagaggaaaaaggacgucaaacggcacgugcuucagguccaugaagggggaggcgaacgacaccgcugcggccagugcgggaagggacugucuagcaagacugcauugagacuacaugagaggacccacacaggugaccggccauacggcuguacugaaugcggggcucgcuucucacagcccagugcccugaaaacccauaugagauga

SEQ ID NO: 57058 - RNA, 789 nt, Artificial Sequence
  derived and/or modified sequence opt3 from GZMA__Homo_sapiens__NP_006135
augagaaacagcuacagguuccuggccuccucucucucaguggucguuagucuucuguugauccccgaggacgugugcgaaaagauuauaggcgggaaugagguaaccccucacagccggccauauaugguguuacugucccuagaucgcaaaacaaucugugcuggagcacucauugccaaggacuggguccugacugcggcucauugcaaccuuaauaaacgaucucaggugauccugggugcccacucgauuacgcgugaggaaccgaccaagcaaaucauguugguuaaaaaggaauuucccuacccuuguuaugauccagcaacaagagagggcgaccucaagcugcugcagcucacugagaaagccaagauaaacaaauacgugaccaucuuacaucugcccaagaaaggggaugacgucaagccuggaacaaugugccagguggcuggcugggguaggacccacaauucagcaagcuggagugauacucuucgggaaguaaacauuacaaucauugaccgcaagguuuguaaugauagaaaccauuauaauuucaacccagugaucgggaugaauauggucugcgccggauccuugaggggcggccgggacucuuguaacggggauagcggaucaccccugcuaugcgaggguguguuucgcggcgugaccuccuucgggcucgaaaauaaauguggagacccucgaggcccaggugucuacauacugcuuaguaagaaacaccugaacuggauuaucaugacgauuaagggggcuguuuga

SEQ ID NO: 57059 - RNA, 744 nt, Artificial Sequence
  derived and/or modified sequence opt3 from GZMB__Homo_sapiens__NP_004122
augcagcccauccugcuccuucuggccuucuuguuacugccuagagcugacgcaggcgagauuauagggggacacgaagccaagccacauagcaggccguacauggcguaucuaaugaucugggaucaaaaaucccucaagcggugcgguggcuuucugauucgcgacgauuucgugcuuaccgcugcccacuguugggggucuucaaucaacgucacacugggagcacauaauauuaaagagcaggaacccacucagcaguuuaucccuguuaagcgaccaauaccccacccugccuacaaccccaaaaauuucaguaacgacaucauguugcuccaacuggagcguaaggcuaagagaacgagggcagugcagccacugcggcucccuagcaauaaagcccagguaaagccaggccagaccugcuccguggcugguugggggcaaacagccccguuaggaaaacauucucacacucugcaggaagucaagaugaccgugcaggaggaucgcaaaugugagucggaccuuagacacuauuacgauucaacaauugaauugugcguuggcgaccccgagaucaagaagaccagcuuuaaaggcgauagugggggaccucugguguguaacaaggucgcgcaggguauuguguccuauggcaggaauaacgggaugccaccccgggcaugcacuaaaguaucuagcuucguucauuggaucaagaaaacaaugaagcgcuacuga

SEQ ID NO: 57060 - RNA, 483 nt, Artificial Sequence
  derived and/or modified sequence opt3 from GZMH__Homo_sapiens__NP_001257710
augcagcccuuccugcuccuucuggccuuuuuguuaaccccuggcgcugggacagaggaaaucauuggaggucacgaggcaaagccacauagcagaccguacauggccuucgugcaauuucugcaggaaaaauccaggaagcggugcggcgggauccuaguccgcaaagacuucguucucacugcggcucacugucagggaucuucaauaaacgugacgcugggcgcccauaauauuaaggagcaggaacgaacccaacaguuuauccccguaaaacguccuauuccacaccccgcauauaacccuaagaauuucaguaacgauaucaugcuucugcagggugacagcgggggaccauuggugugcaaggaugucgcccagggcauacucuccuacggcaauaaaaaggggacacccccuggaguguauaucaaaguuucucauuuucugccauggauuaagagaacuaugaaaaggcuguga

SEQ ID NO: 57061 - RNA, 795 nt, Artificial Sequence
  derived and/or modified sequence opt3 from GZMK__Homo_sapiens__NP_002095
augaccaaguucagcuccuuuucucuguucuuucucaucgugggcgccuacaugacacacgucugcuucaacauggagauuauagggggaaaagaaguuucaccccauaguagaccuuuuauggcuagcauccaguaugguggccaccaugugugugggggaguacuuauugacccacaaugggugcugacugcagcccacugccaguacagguucacgaagggccaguccccgaccgucguguugggugcgcauucuuuaucgaaaaaugaggcuucaaagcagacacuggaaaucaaaaaguuuauucccuucagccggguuaccagugauccucaauccaacgacaucaugcuagugaagcuccagacugccgcaaaacugaauaagcacgucaaaaugcuucacauacgcucuaagacaagccugcgauccgggaccaaauguaaggugacuggauggggcgccacagauccagacucauugcgucccagugauacccucagagagguaacgguuacugugcugagcaggaagcugugcaacucucaguccuauuacaauggcgacccuuuuaucaccaaagauauggucugugcuggggacgcaaagggacagaaagauucaugcaagggugacagcggcgggccacucauuuguaaaggaguguuccaugccaucgugaguggcggucacgaaugcggggucgcuacaaagcccggaauuuauacuuuacugaccaaaaaguaccaaacauggaucaagucuaaccuuguuccuccacauaccaauuga

SEQ ID NO: 57062 - RNA, 774 nt, Artificial Sequence
  derived and/or modified sequence opt3 from GZMM__Homo_sapiens__NP_005308
auggaggccugcgugagcucccugcucguccuugcucugggcgcauugucuguugggucaaguuucggaacccagaucauugguggcagagaagugauaccccacagcaggccuuacauggccuccuuacaacggaacgggucucaucuguguggaggcgugcuaguacacccaaaguggguccucacagcggcucauugccuggcccagcgcauggcacagcuucgacugguguugggucuccacacucuggacucgccggggcugacguuucauaucaaagccgcuauucagcacccccguuauaagccuguuccagcacucgagaaugauuuagcccugcuucaauuggacggaaaagugaagcccucaagaaccaucaggccucuggcucuaccaagcaaacggcaggucguggccgcgggcacacgcuguaguauggcaggcugggggcucacucaccagggagguagacuguccaggguacuucgggaacuggauuugcagguucucgacacccgcaugugcaacaauucucgauucuggaacggcagccugucccccucaaugguguguuuagccgcugauaguaaggaccaagccccuugcaagggggauagcggaggcccacuggucugugguaaagggagagugcucgcaggagugcuuucuuuuuccucaagggucugcacagacauuuucaagccgcccguugcuaccgccguggcgccuuacguaagcuggauccggaaagugacuggccguagugccuga

SEQ ID NO: 57063 - RNA, 585 nt, Artificial Sequence
  derived and/or modified sequence opt3 from H1F0__Homo_sapiens__NP_005309
augaccgagaacagcacauccgcccccgcugcaaagccuaaaagagccaaggcgucuaaaaagucaacugaccacccaaaauacagugauaugaucguggcugccauucaggcagaaaagaauagggccggcagcucccggcaaucuauacagaaguauaucaaaucgcauuacaaggucggggagaacgcugacucacagauuaaacugagcaucaagcgccucguuacgaccggagugcuuaaacagacaaaggguguaggcgcaaguggguccuuccgacuggccaagucugaugaaccgaaaaagagcguggcuuuuaaaaagacuaaaaaggagauuaaaaaggucgccacccccaagaaagcguccaagccuaaaaaggcagccucaaaagcuccaacaaagaagcccaaagccaccccugugaagaaagcaaagaaaaaguuggcugccacuccaaagaaagcgaagaaacccaagacaguuaaagccaagccugugaaggcaaguaaaccaaagaaagcuaagccggucaaacccaaggccaaaagcucugcuaagcgugccggaaagaaaaaguga

SEQ ID NO: 57064 - RNA, 642 nt, Artificial Sequence
  derived and/or modified sequence opt3 from H1FX__Homo_sapiens__NP_006017
augagcguggagcuggaagaggcccuccccgucaccacagcugaaggcauggcaaagaaaguuacuaaggccgggggauccgcggcucuuucuccuucaaagaagaggaaaaacaguaagaagaaaaaucagccagguaaguacagccaacuggugguagagacgaucaggcgguugggcgaacgcaacggguccucuuuagccaaaauuuauaccgaggcaaagaaagugccgugguucgaccagcagaauggacgaacauaccugaaguauucgauaaaggcccuaguccagaacgauacucuccugcaagugaaaggcaccggugcuaaugggucauuuaaacuuaaccguaaaaagcuggagggaggcggcgaaagaagaggggcacccgccgcugccacagcgccugcaccaaccgcccacaaagcuaagaaagccgcacccggagcugccgguagccggcgcgcggacaagaagccugccagaggccagaaaccagagcagaggagucauaagaaaggggcaggagcuaagaaagauaagggcgguaaggccaaaaagacugcugccgcagggggcaaaaagguuaaaaaggccgcuaagcccuccgugccuaaagucccaaagggacggaaauga

SEQ ID NO: 57065 - RNA, 390 nt, Artificial Sequence
  derived and/or modified sequence opt3 from H2AFJ__Homo_sapiens__NP_808760
augagcggcagagggaagcagggagguaaagugagggccaaggcuaaaucccggucuucacgcgcaggccugcaauuccccgucgggcgaguucaccgucuccuuagaaagggaaacuacgccgagagggugggcgcgggugcuccuguauaucuggccgcaguguuggaauacuuaaccgccgagauccuggaacuagcugggaaugcagcccgggacaacaaaaagacacgcauuauaccaagacaucuccagcuggcuaucaggaaugaugaggaacuuaacaagcuguugggaaaagucacuauugcccagggcggcgugcucccgaauauccaggcgguucugcugcccaagaaaacggagagucaaaagaccaaaagcaaguga

SEQ ID NO: 57066 - RNA, 432 nt, Artificial Sequence
  derived and/or modified sequence opt3 from H2AFX__Homo_sapiens__NP_002096
augagcggcagagggaagaccggagguaaagccagggcuaaggcaaaaucccggucuucacgcgccggccugcaguuccccguggggcgaguccaccgucuccuuagaaagggacauuacgcggagaggguuggcgcuggugccccuguguaucuggcagccguauuggaauacuuaacagcugagauccuggaacuagcagggaacgccgcucgggacaauaaaaagacucgcauuauaccaagacaccuccaacuggccaucaggaacgaugaggaacuuaauaagcuguugggaggcgugacgauugcgcagggcgggguccucccgaacauccaggcagugcugcugcccaaaaagaccagugccacaguuggaccuaaagcuccaagcgguggcaagaaagccacucaggcaucccaagaguauuga

SEQ ID NO: 57067 - RNA, 1119 nt, Artificial Sequence
  derived and/or modified sequence opt3 from H2AFY2__Homo_sapiens__NP_061119
augagcggcagauccgggaagaaaaagaugucuaaacugucaaggagugcccgggcuggagugaucuuccccgucggucgccucaugcgauaccuuaagaaaggcaccuuuaaguaucguauuagcguuggggcaccuguguacauggccgcgguaauagaguaucuggcugccgaaaucuuggaguuagcaggaaacgccgcuagagacaauaagaaagcaaggauugccccacggcacauccugcuagcuguggccaacgaugaggaacucaaucagcugcuuaagggcgucacaauugcguccgguggggugcugccgcgcauccaucccgaauugcucgcaaagaagagaggaacuaaaggcaagucugagacgauacugucgccuccacccgagaagaggggccggaaagccaccucagggaagaaaggagguaagaaaagcaaggcugccaaaccucgcacaaguaagaaguccaaaccaaaggacucugauaaagaaggcacuagcaacuccaccucagaggacgggcccggagauggcuucacaauccugaguagcaagucucucguuuuaggucaaaaacugucccuuacccagucagacauuagccacaucgggaguaugcgaguggaaggaauuguccauccuacuacagcagagaucgauuugaaggaggacauaggcaaggcucuggaaaaagccggcgggaaggaguuucuagaaaccgugaaagagcucagaaagucucagggaccacuggaaguagcggaggccgcaguuucccagagcucgggucuugcugccaaauucgugauucacugccauaucccgcaauggggcucugauaagugugaggaacagcuggaggaaacgauuaagaauugcuuguccgcugccgaggacaaaaagcucaaaucagucgcauuucccccuuucccaagugggaggaacuguuuucccaagcagacugccgcucaggugacccugaaagcgaucagcgcacacuucgaugacuccucugccagcucauuaaagaauguguacuuucuccuguucgauagugaauccaucggaauuuauguccaagagauggcuaaacuugacgccaaauga

SEQ ID NO: 57068 - RNA, 1116 nt, Artificial Sequence
  derived and/or modified sequence opt3 from H2AFY__Homo_sapiens__NP_004884
augagcuccagaggcgggaagaaaaagucuaccaaaacaucaaggagugccaaggcuggagugaucuuccccgucggucggaugcugcgcuacauuaaaaagggccacccuaaguaucgaauagggguuggagcaccaguguacauggccgcgguacucgaguaucuuacugcugaaauccuggaguuggccggcaacgcagcccgugacaauaaaaaggguagagugacgccgaggcauauuuuacuggcugucgcaaacgaugaagaacuaaaucagcuccugaaaggggugaccaucgccagcggaggcguucuucccaacauucacccugaacuguuggcuaagaaacggggcuccaaggggaagcucgaggccaucauaacaccacccccugcgaaaaaggcaaaaucuccaucgcaaaagaaacccgugucaaagaaagccggagguaagaagggcgcucgcaaaagcaagaaacagggggaggucaguaaggccgcauccgcugacucuacuaccgaaggaaccccugccgauggcuuuacagugcugagcacuaaaucccuguuccucggucagaaguuaaaucugauccauucagagauuaguaaccuugcgggguuugaaguagaggccaucauuaauccaacaaacgcagacaucgauuugaaggacgaucugggaaauacccuagagaaaaagggcggcaaagaguucguugaggcugugcucgaacugagaaagaaaaacgggccgcuugaggucgccggagcugccgugagcgcaggucacggccugcccgccaaguuugugauacauugcaauucuccugucuggggagcugacaagugugaagaguugcucgagaaaacgguuaagaacugccuggcguuagcagaugacaaaaagcugaaauccauugccuucccaucaaucgggagcggcaggaaugguuuucccaagcagacugcugcccaacucauucuuaaggcaaucaguucuuacuucguguccaccaugagcucgucuaucaaaacaguauauuuugugcuguucgauuccgaaucaauugggauauacguccaggagauggccaaguuggacgcuaacuga

SEQ ID NO: 57069 - RNA, 387 nt, Artificial Sequence
  derived and/or modified sequence opt3 from H2AFZ__Homo_sapiens__NP_002097
auggccggcgggaaggcuggaaaagacagcgguaaggcaaaaaccaaggccgugucccggucucagagggcgggccugcaauuccccgucgggcggauccaccgccaucucaaaucacgaacaacgagucacggacguguuggcgcuacugccgcaguguacagcgccgcuauucuugaguaucugaccgcagaaguauuggaguuagccgguaacgcuuccaaggaucugaaggugaaaagaauaacaccuaggcaucuacagcucgccaucagaggggacgaggaacuggauucucuuauuaaggcgacuaucgcaggaggcggcgucauuccacacauccauaaaucgcugauagggaagaaaggacagcagaagaccguguga

SEQ ID NO: 57070 - RNA, 528 nt, Artificial Sequence
  derived and/or modified sequence opt3 from H2BFWT__Homo_sapiens__NP_001002916
augcugagaaccgaggugcccaggcucccucggagcacaacugccaucgucugguccugccaccuuauggcuacggcaucugccauggcgggcccaucaagugaaaccacaagcgaggaacagcugauuacucaagagccgaaggaagcuaacuccaccacaucucagaaacagucgaagcagcgcaaacgagggcgucauggacccagaaggugucacucaaauugccggggugacagcuucgccaccuacuuucgcagaguuuugaagcaagugcaucagggcuuaagucuguccagggaggcaguaucugugauggauagccuaguccacgacauacucgaucggaucgccacugaggcugggcaucuggcacgcuccacaaaacgacagaccauuacggccugggaaacuagaauggcugugaggcuucuguugccuggacagaugggcaagcucgccgagucagaagguaccaaggcgguucugcggacaagucuguaugcaauccaacagcagcguaaauga

SEQ ID NO: 57071 - RNA, 411 nt, Artificial Sequence
  derived and/or modified sequence opt3 from H3F3B__Homo_sapiens__NP_005315
auggccagaaccaagcagacagcuaggaaaagcacuggcgggaaggcaccccggaaacaacuggccacgaaggcggcucgcaaauccgccccuucuaccggaggugugaagaagccacaccgauaccguccgggcacagucgcacucagagagaucaggcgguaucagaaaucaacugaacuucugauucgcaaguugcccuuccagagauuaguuagggagauagcccaggacuuuaaaaccgaucugcgguuccaaagugcugcaaucggggcccuacaggaagcuagcgaggccuaccucgugggacuguuugaagacacaaaccuuugcgcgauucaugcaaagcgcguaaccaucaugccuaaagauauucagcuggcccgaagaaucaggggcgagcgggcuuga

SEQ ID NO: 57072 - RNA, 861 nt, Artificial Sequence
  derived and/or modified sequence opt3 from HAAO__Homo_sapiens__NP_036337
auggagagaaggcugggcgugcgggccugggucaaggaaaaccgcgggagcuuccagcccccuguuugcaauaaacucaugcaccaagagcagcuuaaggugauguuuaucggagguccaaacacccgaaaagacuaccauauugaagagggcgaagagguauucuaucagcuggagggggauaugguguugcgugucuuagaacagggaaagcacagagacgugguuauaaggcaaggcgagaucuuucugcuaccggcucgggugccccauuccccucagcgcuucgcaaauacagucggucucgugguagaaagaaggcggcuggagacugagcuugaugggcugcgcuacuauguuggagacacgauggauguguuguuugaaaaaugguucuacuguaaggaccucggcacccagcuggccccaauuauccaggaguuuuucucuucagaacaauaucgaacaggcaagcccauuccugaucagcugcucaaagagccacccuuuccuuuaaguacuagaagcaucauggaaccaaugucccuggacgcguggcuugauucucaccauagggaguugcaggcugggaccccgcugucgcuauucggagacacauacgagacccaggucauagccuauggucaaggcucaagcgaagggcuccggcagaacguggauguguggcuguggcagcuugagggaaguuccgucguuacuaugggcggucgucgccugucuuuggcacccgacgauagccuccugguguuagccgggacauccuacgcuugggaaagaacccaaggaucaguagcacugagugugacgcaggacccugccugcaagaaaccacucggcuga

SEQ ID NO: 57073 - RNA, 1605 nt, Artificial Sequence
  derived and/or modified sequence opt3 from HABP2__Homo_sapiens__NP_001171131
augagccugcucgagucccuugaccccgauuggaccccugaccaguacgauuauucuuacgaagacuauaaccaagaggaaaauacaucaaguacucugacgcacgccgagaacccagauugguacuauaccgaagaccaggcugauccgugccagcccaauccuugugagcauggcggggacugcuuggugcacggaagcacauucacuuguuccugcuuagcaccauuuucugguaacaagugucagaaaguccaaaauaccugcaaggauaaccccuguggcagagggcagugccugaucacacagucgccuccauacuauagguguguuugcaaacaucccuacaccggaccuucauguagccaggugguaccagugugccggccgaaucccugccaaaacggcgccacuuguagucgccacaagcgacguuccaaauucacaugcgcguguccugaccaguuuaaggguaaguucugcgagauugggucugaugacuguuacgucggagauggcuauagcuacagaggcaaaaugaauaggaccgugaaccagcaugcuugccuauauuggaacucccaccuccugcuucaggaaaauuacaauauguuuauggaggacgccgaaacgcacgggauaggagagcauaacuucugucggaauccagacgcagaugagaagcccuggugcuuuaucaaaguuacuaacgacaaggugaaaugggaauauugugaugucucagccugcagugcucaagacguggcauacccugaggaaagcccaaccgagcccucuacaaagcugccggguuucgauuccuguggcaagacugaaauugccgagcgcaaaaucaagagaauuuaugggggauuuaaaucaaccgcuggcaagcacccuuggcaggccagcuugcagaguucucucccccugacaaucuccaugccacaaggucauuucugcgggggagcgcugauacacccuugcuggguacucaccgcagcccacuguacggacaucaaaacuaggcauuuaaagguugugcugggcgaucaggaccuuaaaaaggaggaauuucacgagcagagcuuccgggucgaaaagauuuuuaaauacucgcauuacaacgagcgcgaugaaaucccccacaaugacauugcuuugcugaagcuaaaaccaguggauggccauugcgcccucgagucuaaguaugugaaaacagucugucugcccgacggguccuucccuucaggaagugagugccacaucagcgguuggggcguuaccgaaacugggaagggaucccgacagcuucuggacgcaaaggugaaauugauagcuaacacacucuguaauucuagacaacuguacgaucacaugauugacgauagcaugaucugcgccggcaacuuacagaagccaggucaggacaccugucagggggauucaggcggaccgcugacgugcgagaaagacggcaccuauuacguauaugggauugugaguuggggacucgaaugugguaagaggcccggcgucuacacacaagugacuaaauuccuuaauuggaucaaggcgaccaucaaguccgagagcggguuuuga

SEQ ID NO: 57074 - RNA, 1242 nt, Artificial Sequence
  derived and/or modified sequence opt3 from HABP4__Homo_sapiens__NP_055097
augaagggcgcccuggggagccccguggcugcagccggagcggcuaugcaggaguccuucgguugcgucguugccaacagauuucaccaacuccuugacgaugaaucugacccuuucgauauccugagggaggcagaacggcgccgacagcagcaguugcaacguaaaagaagggacgaggccgcugcagccgcuggcgccgggccacggggaggccgcucaccggcgggugcaagugggcauagagccggagcuggcggcaggcgggaaagccagaaggagcgcaaauccuuacccgccccuguggcacagcgaccagauucucccgggggaggucugcaggcuccuggccaaaagagaaccccaaggcggggagagcagcagggguggaaugacucgcguggccccgaagguaugcuagagcgcgccgaaagaaggucauaccgggaguaucgaccuuacgagacagaacgccaggcggauuuuacugccgagaaauucccagacgaaaagccgggggauagauuugacagggaucggccccuccgcggaagaggcggcccucgugggggaaugaggggucggggccgagggggaccaggcaacagaguauucgacgcauuugaucaaagggguaagcgcgaguucgaacgguaugggggcaaugacaaaauugcugugagaacggaggacaacaugggaggcuguggggucaggaccuggggaagcgguaaggauacaagugacguggagcccacugccccuauggaggaaccaaccguuguggaagagucccagggcacacccgaagaggagucuccggcuaaagucccugaacuggagguggaagaggaaacccagguacaagagaugacucuugaugaguggaagaaucugcaggaacagacacgccccaaaccagaguuuaacauacgaaagccugaaagcaccguucccuccaaggccguggucauccacaaaucaaaguaccgggacgauauggugaaagacgauuaugaggacgauagucauguguuccguaagccagcaaaugacauuacgagccaguuggagaucaacuuugggaaucuccccagaccuggaaggggcgcccgcggugggacucggggcggaagaggcaggauucgacgcgcugaaaacuacgggccacgggcggaggucguuaugcaagauguggcaccgaaucccgacgacccugaagauuucccagcccugucuuga

SEQ ID NO: 57075 - RNA, 867 nt, Artificial Sequence
  derived and/or modified sequence opt3 from HACD1__Homo_sapiens__NP_055056
augggcagacugaccgaggccgcugcagccgggagcggauccagggcggcugguugggccggcucucccccuacacuccuuccacugucaccgacgaguccccggugcgcagccacuauggcuagcuccgacgaagaugggaccaacggaggcgcaucugaggccggugaagaccgcgaggcuccuggggaacgacguagauugggaguguuagccacagcguggcugacuuucuacgauaucgcaaugaccgccggcuggcuaguccucgcuauugccaugguuagguuuuauauggagaagggcacacaccgggggcuguacaaaucgauacagaagacccuuaaauucuuucaaacuuucgcacuguuggagaucgugcauugucucauuggaaucguaccaacaucagugauugucaccggugugcagguuagcagucgcaucuuuaugguguggcugauaacgcacuccaucaagcccauucagaaugaagagucugucgugcuguuccucguagcuuggacuguuaccgaaaucacaagauauagcuuuuacacuuucuccuuacuggaccaucuuccuuauuuuauuaaaugggccagguacaacuucuuuaucauauuguauccagugggcgucgcgggggagcugcuaaccauuuacgccgcacucccccacgugaagaagacaggaauguucucaauccggcugccuaauaaauacaacgugaguuuugauuauuacuauuuccuucugauuaccauggcuagcuacaucccauuguucccgcagcucuauuuucauaugcugcgccaacgaagaaaggucuuacacggcgagguuaucguggaaaaagacgauuga

SEQ ID NO: 57076 - RNA, 765 nt, Artificial Sequence
  derived and/or modified sequence opt3 from HACD2__Homo_sapiens__NP_940684
auggccgcuguggcagccaccgcggcugccaagggcaacgggggagguggcgggagagcaggagccggcgacgcuagcgguacaaggaaaaagaaagggcccggaccucuggcaacugccuaccucgucaucuauaauguugugaugacggcuggcuggcuuguaauugccgugggccugguccgggcguacuuggcaaagggguccuaucacucuuuauacuauucaauagagaaaccacugaaguucuuucagaccggagcccuacucgaaauccugcauugcgcuauugguaucgugccgaguagcguugugcuuacauccuuccaagucaugucucgcguguuucugauuugggccguaacucacucgguuaaggaggugcagucagaagauagcguccucuuguucgugaucgcauggaccauaacagagaucauucgauacaguuuuuauaccuucucccugcugaaccaucuccccuacuuaaucaaaugggcucguuacacucuguuuauugugcuuuauccuaugggcgucucuggggaauugcugacaaucuacgccgcgcuaccauucguuagacaggccggacucuauagcauaucccugcccaauaaguacaacuuuucauucgacuauuacgcauuucuuauucugaucaugauuaguuauaucccuaucuucccacaguuguacuuucacaugauucaucaaaggcggaaaauacucagccacaccgaggagcacaagaaauucgaauga

SEQ ID NO: 57077 - RNA, 699 nt, Artificial Sequence
  derived and/or modified sequence opt3 from HACD4__Homo_sapiens__NP_001010915
augggcccccuggcccucccugcuuggcuucagccaagauacaggaagaacgcauaucuguucaucuacuauuugauucaauuuugcgggcacagcuggauauucaccaauaugacagugcgguuuuucuccuuuggaaaagacucuauggucgauacuuucuacgccaucgguuuaguuaugcgccugugucagucagugagucuacucgagcugcuucauauuuauguaggcaucgaaagcaaccaccuguugccgcgauuucuccagcugacggagcguauuaucauacuguucguggucaucaccucccaggaagaggugcaagaaaaguacguugugugcguccucuuuguguucuggaauuuacuggacaugguaagauauacauacucuaugcuuucgguuauugggaucucauacgcgguguugacuuggcugagccagacccuauggaugcccauuuauccucucuguguccuggcugaggccuuugcaaucuaccagagucuuccauauuucgaguccuuuggaacauacucuaccaaacugcccuucgauuugagcauauauuucccuuacgugcucaagauuuaucugaugauguuauuuaucggcauguacuucacuuacucccaucuguauucagaaaggcgggacauucucgguaucuuuccaaucaaaaagaagaaaauguga

SEQ ID NO: 57078 - RNA, 2730 nt, Artificial Sequence
  derived and/or modified sequence opt3 from HACE1__Homo_sapiens__NP_065822
auggagagagccauggaacagcugaacaggcucacccggagccuucgccgagcucguacaguggagcugcccgaagacaaugagacugcagucuacacguugaugccuaugguuauggccgaucaacacagauccgugucugaauuacugucaaacaguaaguucgacguaaauuaugcguuuggcagggugaaacggagccuacuccauaucgcugccaacugcggguccgucgagugucuggugcuucuguugaagaaaggagcaaauccaaacuaccaggauauuucugguugcaccccgcuccaccuggccgcucgcaauggccagaagaaauguaugucgaagcugcucgaguauucagcagacguuaacauaugcaauaacgaaggguuaacagccauccauuggcuggcugugaauggaagaacugagcuuuugcacgaucugguccagcaugugagcgacguagauguugaagacgccaugggccaaaccgcgcuacacguggcaugucagaacggucacaagacaaccguccagugccuccuggauaguggggccgacauuaauaggcccaacguguccggagcuacuccucuuuacuucgccuguucucauggccagcgggauacagcacaaauccuguugcuccgcggcgcuaaauaucugccagacaagaauggggugacccccuuagaucugugcguccagggagguuacggcgagacgugugagguucucauucaguaucacccucgacuuuuucagacuaucauacaaaugacccagaacgaagaccugagagagaacauguugaggcaagugcuagaacaucugagccagcaguccgagucacaguaccucaaaauccugacaagucuugccgaaguagcgacuaccaaugggcacaagcuguugagccucucuuccaacuacgacgcccagaugaaaucacuguuacggauugugcguauguucugccacgucuuucgcaucggaccaagcagucccucuaauggcauugauauggguuauaacgggaauaagacaccuagaucccaaguguucaagccacuggagcuacucuggcauagccuggacgaguggcuuguuuugaucgcaaccgaacugaugaaaaacaagagggauucgacggagauaacuucuauucuccugaaacagaagggacaggaccaggaugcugccuccaucccgcccuuugaaccuccaggccccggcucauacgagaaucuuaguacagggacccgggaaagcaaaccugacgcucuggccggacgacaagaggcauccgccgauugucaggacgugauuucuaugacugcuaaccgcuugagcgcggucauccaggcauucuauaugugcugcucaugucagaugccacccgguaugacaaguccgagauuuaucgaguucgugugcaagcacgaugaaguacucaaauguuuuguuaauaggaacccuaagauuauauucgaccauuuucacuuccuguuagagugccccgaacugaugucccgguucaugcauaucauuaaggcccaaccauuuaaagaucgcugugagugguucuacgaacaccuacacagcggccagccugacucugacauggugcauagacccgucaaugagaacgauauccuccuggugcacagggacucaauauuucguaguagcugcgaggucguguccaaggcuaauugugccaaacuuaagcaggggauugcaguucgguuccauggagaagagggcaugggucagggggugguacgagaaugguuugauaucuugucuaacgagaucgucaauccagacuaugcccuguucacccaaucggcugauggcacgaccuuucagcccaacagcaacuccuacgugaauccugaccaccucaacuauuucagauuugccggacagauucugggcuuagcacugaaucacaggcaacuuguuaacaucuacuucacacgcucauuuuacaaacauauuuuggggauaccagugaauuaucaggaugucgcgaguaucgacccggaguacgcuaagaaccuccaguggauucuggauaaugacaucucugaucuaggacuggaacucacuuucagcguggagaccgacguauuuggugccauggaagaggugccccugaagccuggcgggggauccauccuuguuacacagaacaauaaagcagaauauguccaauuggugacugagcugcggaugaccagagccauucagccacagauaaacgcuuucuuacagggcuuccacauguuuauucccccuucacucauccaacuguucgaugaguacgaacuugagcuguugcucagcgguaugccagaaaucgacgugucugacuggauuaagaauacagaguauaccuccggguacgaaagggaggaucccgucauccagugguuuugggagguuguggaagacauaacucaggaggaacgcgugcugcuacugcaguucguaacgggcaguagccgagucccgcauggaggcuuugccaacaucaugggagggucuggucuccaaaauuucacaauugcagcugugccuuauaccccaaaccugcuucccacuuccucaaccugcaucaauauguugaaacugccugaguaccccaguaaggaaauuuuaaaagaucggcuccugguugcccuucacuguggcagcuacggguauacaauggcguga

SEQ ID NO: 57079 - RNA, 1737 nt, Artificial Sequence
  derived and/or modified sequence opt3 from HACL1__Homo_sapiens__NP_036392
augcccgacagcaacuucgccgagagauccgaagaacaggugucuggcgcuaaggucaucgcacaagcccugaaaacccaggauguugaguacauuuuugggauagugggaaucccuguaacagagauugcgaucgcugcccagcagcucgguauuaaguauaucggcaugaggaaugaacaagcagccugcuacgcugcaucagccauaggguaucuuacuagccggccaggagugugucuggucgugagcggcccggguuugauccacgcuuuagggggaauggccaacgcgaauaugaacugcuggccccugcuaguuauuggcggcuccucugagcgcaaucaggagacgaugggggcauuccaggaauuuccucagguggaggccugucgacucuacaccaaauucucggcucguccaucaagcaucgaagccauucccuuugucaucgagaaggcagugagaaguuccauauauggaaggccuggugcuugcuacguagacauuccagccgauuucguuaaccugcaagugaaugucaacucuaucaaauauauggagcgguguaugagucccccuauuuccauggcggaaacaucagccgugugcacugcagcuagugugauccgcaaugccaagcagccacuucugaucauuggcaagggggcugccuacgcacaugccgaggaaagcaucaaaaaguuggucgagcaguacaaacucccguuucugcccaccccuaugggaaagggcguugugccagacaaccaccccuauuguguaggugcugcgagaucuagggcacugcaguucgccgaugugauaguccucuuuggggcucgguuaaauuggauucugcauuucggacuuccuccacgcuaccaacccgacgugaaauuuauccagguugauauaugcgccgaagaguugggcaacaaugugaagccggcagucacacugcuaggcaacauucacgccgugaccaagcagcuccuggaggaacuugacaaaacuccuuggcaauaucccccagaguccaagugguggaaaacacugcgagaaaagaugaaaucaaaugaggcugccagcaaggaauuggcaaguaaaaagucucucccuaugaacuacuauaccguauucuaccauguucaggagcagcugcccagagauuguuuuguggucuccgagggggcgaacacgauggacaucggaaggacuguguuacagaauuaucugccacggcaccgucucgaugcugguaccuucggcacaaugggggucggacuuggcuucgccaucgcagccgcugugguugccaaggaccgcagccccggucaauggauuaucugcguggaaggggauucggcauuuggcuucucuggaauggagguagaaacuauuuguagauacaaccugccuauaaucuugcuagucgugaauaacaauggcauuuaccagggguuugacaccgacacauggaaagagaugcugaaguuccaggaugcuaccgccguugugccaccgaugugccuccugcccaacucccacuaugaacaggucaugacggcguuuggagguaaaggcuacuucgugcaaacuccugaggagcuucagaagucacugaggcagaguuuggccgacacaaccaaaccaagccucaucaauaucaugauugaaccccaggcuacucggaaggcacaagauuuucauuggcugacacgauccaacauguga

SEQ ID NO: 57080 - RNA, 2292 nt, Artificial Sequence
  derived and/or modified sequence opt3 from HADHA__Homo_sapiens__NP_000173
augguggccugcagagcuaucggcauucugagcagguucuccgcauuucggauacuccgcucucgaggguacaucugucguaacuucaccggaucaagugcccuucugacaagaacucacauuaauuauggugucaagggcgacguugcggugguaaggaucaacagccccaauuccaaagugaacacguugucuaaggaguuacauucggaauuuucagaggucaugaaugaaauuugggcuagcgaucagauccggagugccgugcugauauccucuaaaccugggugcuucaucgcaggagccgacauuaacaugcuagcugcauguaagacccuccaagagguuacacagcugagccaggaagcccagcgcaucguggagaaacuugagaaguccacuaagccaauugucgcugccaucaauggcucaugccugggugggggauuggaaguggcgauaaguugucaauacagaauugcaaccaaagauaggaagacaguacucggcaccccggagguucugcugggcgcccuccccggggcuggagguacucagcgguuaccuaaaauggugggcgucccagccgcacuggacaugaugcuuacagggcgcagcauccgagcugauagagccaagaaaaugggauugguggaccagcugguggaaccccuaggcccuggucucaagccacccgaggagaggaccauugaauaucuggaggaagucgcgaucacguuugccaaggggcuugcagauaaaaagaucucuccuaaacgggacaagggacugguugagaaauugacugcuuacgccaugaccauuccauucgugcgucagcaaguauauaagaaaguggaagagaagguccgcaagcagacaaaaggccucuacccggcuccccugaagauaaucgaugugguuaaaacuggcauugagcagggguccgacgccggauauuuaugcgaaucacagaaguuuggugagcuggugaugaccaaagaaagcaaggcacucaugggccuuuaccacgggcaaguccuguguaagaaaaacaaguucggagccccucagaaagaugugaagcauuuggcuauccuaggcgcgggucugaugggggcaggcauagcccagguaaguguugacaaaggacucaagacaauucugaaggaugcuacccuuacggcccuggacagaggccaacaacagguguuuaaaggguugaaugacaaggucaaaaagaaagcacucacuucuuucgagagggauuccaucuuuagcaaccugacaggacaguuagacuaccaagguuucgaaaaggccgauauggugaucgaggcugucuuugaggaccugucgcuaaagcaccgggugcucaaagaaguugaggccgugauuccagaucauugcaucuucgcaucuaauaccuccgcgcugcccauuucagaaauagcugccguaaguaagcgaccugagaaagucaucggcaugcacuauuucagcccaguggacaagaugcagcuuuuggaaauuaucacuacagagaaaaccuccaaggauacgucugcaagcgccguugcuguggggcugaaacagggaaaggucaucauugugguaaaggacggccccgguuuuuacaccacacgcugucucgccccgaugaugucagaggugauaagaauccugcaggaagggguugauccuaaaaagcuggacagucuuacuaccuccuucggcuuucccgucggagcagcuacauugguggaugaggugggcgucgacguugccaaacacguggcggaagaccucgggaagguguucggagagagguuugguggcgggaacccagagcuguuaacucaaaugguaagcaaaggauuccugggccggaagucugguaagggguuuuauauuuaccaggaaggcgucaaacgcaaggaucuaaauucagacauggauaguauccucgccagccugaaacuuccucccaaguccgaggugucuucggacgaagauauucaguucagauugguuaccagguuugugaacgaggcugucaugugccugcaggaaggaauccucgcaacaccagccgagggcgacauaggggcuguguucggacugggcuuucccccuuguuuaggugggccauuccguuuuguugaucuguauggagcccagaaaaucguggaccggcuuaagaaguacgaggcagcguauggcaaacaguucaccccgugccaguugcucgccgaucaugcuaauagccccaacaagaaauucuaccaguga

SEQ ID NO: 57081 - RNA, 1380 nt, Artificial Sequence
  derived and/or modified sequence opt3 from HADHB__Homo_sapiens__NP_001268441
augaccauccugacauaccccuucaagaaccucccuacugccagcaaaugggcucuuagauuuuccauuaggccacugucuugcucaagucaguugcgggcagccccggcggugcaaacgaagaccaaaaagacauuagcuaaacccaauauacgcaacgucguugugguagacggcgugcgaacuccuuuccugcuaagcgggaccuccggacuccugcaccguacaucugucccaaaggaggugguugauuauaucauuuuugguaccgugauccaggaagucaagacuucgaauguggccagagaggcagcccuuggcgcuggguucucagacaaaacacccgcacauaccguaacgauggccuguauuagcgcuaaccaggccaugacuaccggaguuggccugaucgcgaguggucagugcgaugugauagucgcagggggaguggaauugauguccgacgugccuaucaggcacucucggaagaugcgcaaacucaugcuggaucugaauaaggccaaaagcaugggccaaagacucuccuuaauuucaaaguuuagguucaacuuucuggcuccagagcuucccgccgucagugaguucagcacaucugagacuaugggccauuccgcagaccgguuggcugccgcguuugccguuucacgccuggagcaggaugaauacgcacuacgaagccacagucucgcuaagaaagcccaggacgaggggcugcuuucugaugugguaccuuucaaggugccaggaaaagacaccgucacaaaggauaaugguaucagaccguccagccuggaacagauggcuaaauugaagcccgccuuuauuaaaccuuauggcaccgugacggcagccaacucgucuuuccucacugacggggcuuccgcgaugcugaucauggcagaggagaaggccuuagcuaugggauacaagccaaaagccuaucugagggauuuuauguacguuucacaagaccccaaggaccagcuccuucugggcccuacauaugcaaccccaaaaguguuggaaaaggccggucuaacuaugaaugauauagacgcuuucgaguuccaugaagccuuuagugggcagauucuggcaaacuucaaagcgauggauagcgacugguuugcugagaauuacaugggacggaagacaaaggucggccugcccccgcucgaaaaauucaacaauuggggcgggucccuuucucugggacacccuuuuggugccaccggcugucguuuggugauggcagccgcuaaccgccucagaaaggaagggggacaguacggccugguagccgcaugcgcugccggugggcaaggccacgcgaugaucguugaggccuaucccaaauga

SEQ ID NO: 57082 - RNA, 996 nt, Artificial Sequence
  derived and/or modified sequence opt3 from HADH__Homo_sapiens__NP_001171634
auggccuucgugaccagacaguuuaugaggagcgucuccucuucaaguacagcuagcgcauccgccaagaaaaucauuguuaagcacgugacuguaauaggcgggggacugaugggugcgggcaucgcucaaguggccgcagccacggggcauaccgucgugcucguugaccagacagaggauauucuugcuaaaucuaagaaaggaaucgaagagucgcugcggaagguggcaaagaaaaaguucgccgaaaaccccaaagcuggcgacgaguuugucgaaaagacuuugucaaccauugccacaagcaccgaugcggcaagugugguacacuccacugacuuaguuguggaggccaucgucgagaaucugaaagugaagaacgaacuauucaagcgccucgauaaauuugcugccgagcauacaauauucgcaucuaauaccagcucccugcagaucacgucaauugcuaacgccacuacccgacaggaccguuuugcgggucuucacuucuuuaauccugugccagucaugaagcugguugaagugaucaaaacaccgaugaccagucaaaagacuuucgagagcuugguagauuuuucuaaagcccucgggaagcaucccguguccugcaaagacacaccuggauucauugucaacagacugcuggugccauaccucauggaggcaaucagguuauaugaacgggauuuucagaccuguggcgacucaaauagcggccugggguucagucuuaagggagaugcuucuaaggaggacauagauacggccaugaaauugggugcuggcuaccccauggggccuuucgaacugcuagacuauguuggacucgacacuacaaaguuuauuguggauggcuggcacgagauggacgccgaaaacccacugcaccagcccuccccuagccuuaauaaacuggucgcagagaacaaguucgguaaaaagaccggggagggauuuuacaaguauaaauga

SEQ ID NO: 57083 - RNA, 783 nt, Artificial Sequence
  derived and/or modified sequence opt3 from HAGH__Homo_sapiens__NP_001035517
augaagguggagguccugcccgcccucaccgacaacuacauguaucuuguuaucgaugacgaaacaaaagaggcugcaauuguggauccuguacagccacaaaagguggucgacgccgcgagaaaacacggcgugaagcugacuacgguuuugaccacacaucaccauugggaucacgcugggggaaaugaaaaauuagugaagcuggagagcggucuaaaggucuacggcggggacgauaggauaggagcccucacucauaaaaucacccaccuguccacacuucaggugggcucucugaacguaaagugcuuggcaaccccgugucacacuucaggucauauuugcuauuucguuaguaaacccgggggaagcgaaccuccagccguguuuacaggcgacacccucuucgucgcuggcugugggaaguuuuacgagggaacggcagaugagaugugcaaagcccugcuggaagugcucggucgguuacccccugacacucgcguguauuguggccacgaguacaccaucaauaaccugaaguucgcucgacaugucgaaccagggaaugccgcgauucgugagaaacuugcaugggccaaggagaaguauuccaucggagaacccacaguuccuucuacuuuggcugaggaauuuaccuacaacccauucaugagagugagggagaaaacaguacagcagcacgccggcgaaaccgauccggugacgacuaugcgggcaguccgcagagagaaggaccaauuuaaaaugcccagggauuga

SEQ ID NO: 57084 - RNA, 1350 nt, Artificial Sequence
  derived and/or modified sequence opt3 from HAL__Homo_sapiens__NP_001245262
augcugcucgcccuuagaaucaacgugcuggcuaagggcuacagcgggauuuccuuggagaccuuaaaacaggucauagaaauguucaaugcaucuugccugcccuauguuccugagaagggaacagugggugccucaggcgaccuagcgccacucagucaccuggcucuugggcugguaggagaaggcaaaauguggagcccgaaguccgguugggccgaugcaaaauacguguuggaggcccaugggcucaagcccgucauccugaagccuaaagaaggacuggcucucauuaacggcacucaaaugaucacgucuuuaggcugugaggcaguggagagggccucggcuauugcccggcaggcggacaucguugcagcccugacccuugaaguguugaaggggacaacuaaggcuuuugauaccgacauacacgcccugcgcccacaucgaggacagaucgaggucgcauuccguuuuagaucacuacucgauagcgaccaccaucccagugaaauugcugagucccacagguucugcgaucgggugcaggacgccuauacacugcgcuguugcccucaaguacacgguguugugaaugauaccaucgcguuugucaaaaacauuaucacuacagagcuuaauucugccaccgacaacccaaugguguucgcaaauagaggcgaaacggugagcgggggaaacuuucauggcgaguaccccgcuaaagcccuggauuauuuggcuauagguauucacgaacucgccgcaaucuccgagaggcggauugaacgccuguguaauccuucauuaagugagcugccagccuuccucgucgcugaagggggacuuaacagcggcuuuaugaucgcgcauugcacugcagccgcucugguuucugagaauaaggccuugugucacccguccucaguggacagccuaaguaccucugcagccacagaggaucacguauccaugggcgggugggcugcccgaaaggcacugagagugaucgaacaugucgaacaggugcucgcgauugagcugcuugcugccugccagggaauagaguuccugaggcccuugaaaacuaccacaccucucgagaagguuuacgaccuggugcggagcgucgugcguccauggaucaaagaccgcuuuauggcacccgauauugaagccgcucacagauuacugcuagagcagaagguaugggaaguugccgcaccuuauaucgagaaauacaggauggaacauauaccagagucgcggccccucucuccgaccgcuuucucccugcaauuucuucacaagaaaucaacgaagauuccugagagugaagacuuguga

SEQ ID NO: 57085 - RNA, 255 nt, Artificial Sequence
  derived and/or modified sequence opt3 from HAMP__Homo_sapiens__NP_066998
auggcccugagcucccagaucugggcugcaugccuccuucuguuguuacugcuagccucucucaccucaggcaguguguucccccaacagacagggcagcuggcggagcuucagccucaagacagagcuggagccagggcaagcuggaugccaauguuucagcggcgccgacguagagauacucacuucccgauuuguauauuuugcugugguugcugucauagguccaagugcggcauguguugcaaaacguga

SEQ ID NO: 57086 - RNA, 648 nt, Artificial Sequence
  derived and/or modified sequence opt3 from HAND1__Homo_sapiens__NP_004812
augaaccuggugggcagcuacgcccaccaucaccaucaccaucacccccacccugcucauccaaugcuccacgagccguuccuuuuugggcccgcauccagaugccaucaggaaaggccuuauuuccaaucuuggcuguugucaccagccgacgcggcucccgauuuuccugccggagguccacccccugcagccgcugcagccgcuaccgccuacggcccagacgcgcggccggggcagagucccggacgcuuagaggcacugggcggucgacuagggcguagaaagggaagcggcccuaaaaaggaaaggcggcgcacagaguccaucaauucugccuucgcugaacucagagaguguauuccaaacguccccgccgauacuaaacugucgaagauaaaaacgcuuaggcuggcaaccucauauaucgcuuacuugauggacguucucgccaaggaugcgcagagcggcgacccugaggccuuuaaggcagaacugaaaaaggcugaugggggacgggagaguaaacgcaagcgagaacugcagcaacacgaggguuucccacccgcccucggcccgguggagaaaagaauuaaggggaggacaggauggccucagcagguaugggcuuuagaacugaaucaguga

SEQ ID NO: 57087 - RNA, 654 nt, Artificial Sequence
  derived and/or modified sequence opt3 from HAND2__Homo_sapiens__NP_068808
augagccuggugggcggguucccccaccauccugucguucaccaugagggauacccauuugccgcugcagccgcggcugccgcagccgcugcagccuccagaugcucucacgaagagaacccguauuuccaugguuggcucaucggccaccccgaaaugucaccuccagacuacaguauggcucuuagcuauucccccgaguacgccucuggggcggcaggacuggaucacucgcauuauggcggugugccuccaggggccggacccccuggcuugggcgggccaaggccgguaaagcggcgcggaaccgcuaaucgaaaagaacguagaaggacacagucaauuaacagcgccuuugcagaguuacgggaguguauacccaaugugccugcugacacuaagcugaguaaaaucaagacgcuacgccucgccaccuccuacauugcguaucugauggaucuucuggccaaagacgaucaaaacggugaagcagaggcuuucaaggccgaaaucaagaaaacagacgucaaggaggagaaaagaaagaaagaauugaaugagauucucaagucuacugugagcuccaacgauaagaaaaccaagggcaggacaggguggccacagcacguuugggcucuggaacugaaacaguga

SEQ ID NO: 57088 - RNA, 1113 nt, Artificial Sequence
  derived and/or modified sequence opt3 from HAO1__Homo_sapiens__NP_060015
augcugcccagacucaucugcauuaacgacuacgagcagcacgccaagagcgugcuuccuaaauccauauaugauuacuauaggucuggcgcuaaugacgaagagacccuggcagauaacaucgccgcguucucacgguggaaguuguacccacgcauguuacgaaaugucgcugaaacagaccugaguacuagcguucuagggcaacguguguccaugccgauuuguguaggagccacggcaaugcagagaauggcccauguggauggugagcucgcuaccgucagggcaugccagucucugggcacagggaugaugcuuucgucaugggccacuagcaguaucgaagagguggcugaggccggacccgaagcgcugcggugguugcagcucuauauuuacaaagaccgcgagguuaccaagaaacuggugagacaagcagaaaagaugggcuauaaggccaucuuugucacaguggauaccccuuaccuggguaacaggcucgacgauguacggaaucgcuucaaauuaccaccccagcugcgaaugaagaacuuugagacuuccacacuuucuuucagcccugaggaaaauuuuggggacgauuccggauuggcugccuacguugcaaaagcuauagacccaucaaucaguugggaggauauuaaguggcugagaaggcuaaccagccuccccaucguggccaaaggcauucugcggggcgacgacgcgcgugaagccgucaagcacgggcuuaacggaauccuggugucuaaucauggugcacgccaguuggauggcgugccugcuacgauagacguccucccagagauuguugaagccguggaggggaagguagagguguuccuggauggaggcgucagaaaagguacugacguguuaaaggcucuggcccucggggcaaaagccguuuuugugggaaggccgaucgucuggggccuugcuuuccagggcgaaaagggggugcaagauguacuggagauuuugaaagaagaguuucggcuagcgauggcacuguccggaugucagaacguuaaggugaucgacaaaacccucguccgaaagaauccccuggccgugucaaagaucuga

SEQ ID NO: 57089 - RNA, 1149 nt, Artificial Sequence
  derived and/or modified sequence opt3 from HAO2__Homo_sapiens__XP_011539860
augagccuggugugccucaccgacuuccaggcccacgcuagagagcaacuuuccaagucuacaagggauuuuaucgaaggcggggcagacgauucaauuacucgggacgauaacauagccgcguucaaacgcauccgacugcgucccagauacuugagggacgucagugagguugauacgcggaccacaauucagggagaagagaucagcgcuccuauuuguaucgccccaacugguuuucauugcuuaguguggccggacggcgaaauguccaccgcacgcgcccccgaggggcugagaugguuccagcuauauguacacccugaucuccagcugaauaagcaacuuauacagaggguggagucucugggauuuaaagcauuggucaucacacucgacaccccaguguguggcaaccggcgccaugauauucgaaaucagcugagaaggaaccugacucucacagacuuacagucgcccaagaaagguaaugcuaucccuuacuuccaaaugaccccaauuucaacgagccugugcuggaacgaucuuaguugguuucaguccaucacucgguugcccauaauucugaaggggauccuaaccaaggaagacgccgagcucgcuguuaaacacaaugugcagggaauuaucgucucuaaccauggcggccgucagcuggacgaagugcuugccagcaucgaugcgcugacagagguaguugcagccgugaaggggaaaauugaggucuauuuggacggaggugugcgcacuggcaaugaugugcucaaggcucuggccuuaggggcaaaauguauauuccugggaagaccuauccucuggggccuugcuugcaaggccgcggguaggucccugcggucaauugaaaccuggaguagcuuuccaggguguaagaaaaagggaccgaucacacgauugcuacgccugcccaccggcggcucucaaacgcacuccacugucugcgacgccguucucccugggccacacucagugagaaggcugauggcacauauaagccacauuaguaacacaaccacucccguacuucaggcucugcagacaccuguguucccaaaauguucuaugcccuuuuucgucuccuugaccaucaucugcuguagccucgccuga

SEQ ID NO: 57090 - RNA, 1809 nt, Artificial Sequence
  derived and/or modified sequence opt3 from HAP1__Homo_sapiens__NP_001073339
augagacccaagaggcugggccggugcugugccgggagccgccucggaccuggugacccagcugcacuuaccugcgccccgucccccucugcgaguccugcuccagagcccucagcccagccucaagcacgaggcacagggcagcgugugggaagcagagccacuuccggcucucaguuccugucggaagcuaggacgggugcacggccagccucagaggcuggggccaaagcgggagcacgcagacccagcgccuuuagugcuauccagggcgaugucagguccaugccugacaacucugaugccccauggacccgguucguuuuucaaggcccguucgggagccgcgcaacaggacgagguacuggcaaggcugccgggauuuggaaaacccccgcggccuacgugggaagaaggccuggcguauccgguccagaacgggcagcuuuuauacgugaguuggaagaggccuuaugucccaaucugccuccacccgugaagaaaaucacacaggaggacgucaaggugaugcuauaucuccuggaagagguuugcaccgcuuuccuuauucagcuguugccgccugugugggaaucagucacuuacgggauggugcuccagcgcgagagagaucugaacacagccgcaaggaucggacaaagucugguaaagcagaauagcguucucauggaggaaaacucuaaauuagaggcccugcuuggcuccgcuaaggaagagauuuuguaucugcggcaccaggugaaucuacgagacgaacuccugcagcuuuacucagauagcgacgaggaggaugaagacgaggaagaggaagaggaggaaaaagaggcggaagaggaacaagaggaggaagaggcagaagaggaucugcagugugcccaucccugcgacgcuccaaaguugaucagucaggaggcccuccugcaccaacaucacuguccucaguuagaagcacugcaggagaaacuccgccuucuggaagaggaaaaccaucaguugagagaggaggccucucaacuagauacccuggaagacgaggaacagaugcucauacuggagugcgucgaacaguuuuccgaggcuagccagcaaauggccgagcuuucggaagugcugguguugaggcucgagaauuaugaacggcagcagcaggaggucgcacgccugcaagcgcagguuuuaaagcugcagcagagauguaggauggaaacgcuacccggcuuccaagagacucucgcugaggaacugcguaccucucuucggcgaaugaucuccgacccaguguacuuuauggagagaaacuaugaaaugccccgcggggauacaucaaguuugagguacgacuuccgguacagcgaggauagagagcagguaaggggauuugaagccgaggaaggucugaugcucgcagccgacauuaugcgcggcgaggauuucacuccugcugaagaguuugugccacaggaggaacugggggccgcaaagaaagucccggcugaggaaggagugauggaggaagccgagcuuguuuccgaggaaaccgagggcugggaagagguggaacuggaguuggacgaggcgacacgaaugaaugucgugaccucugcccucgaagcuagcggucuggggcccucacacuuagauaugaacuauguacugcaacagcuagcaaauuggcaggacgcccacuaccggcgucagcucagauggaagaugcugcaaaaaggcgagugcccucauggagcccuuccagcugcaaguaggacguccugucgcagcucuugccgguga

SEQ ID NO: 57091 - RNA, 1065 nt, Artificial Sequence
  derived and/or modified sequence opt3 from HAPLN1__Homo_sapiens__NP_001875
augaaaagccugcuccuucugguguugaucuccauuugcugggccgaccacuuaucugauaacuacacccuggaccaugauagagcuauacacauccaggcagagaauggcccccaucuacucgucgaagccgagcaagcgaagguuuucucacacaggggagggaacgugacacugccuuguaaguuuuaucgggacccaacugcuuucgguaguggcauucauaaaauccgcauuaaguggacgaaacuuaccagcgauuaccugaaggaaguagacguguuugucuccaugggguaucacaagaaaacauacggaggcuaucagggucgaguguucuugaaagggggaucugauucggacgccucacucguuaucacugaucugacccuggaggacuacggccguuauaagugcgaagugauagagggccucgaggaugacacagucgugguagcauuagaucugcaggggguuguguuuccguacuuccccagacuuggaagguacaauuugaacuuucacgaagcccagcaggcuugucuggaccaagacgcagucaucgccagcuucgaucagcuauaugacgcuuggcgggguggccucgauuggugcaaugccggguggcugagugacggauccgugcaguacccuauuaccaagccacgcgagcccuguggcggucaaaacacugugccuggggucagaaauuauggauuuugggauaaagacaagucuagguacgauguuuucugcuuuacaagcaacuucaauggccgguuuuauuaccuuauccauccaaccaagcugacguaugacgaagcggugcaggcauguuugaacgauggcgcccagauugcuaaaguagggcagaucuucgccgcauggaagauacucggauacgaccgcugcgaugcugguuggcuggccgacggcuccgugcgauaccccauuucaagaccuaggcggcguuguaguccaacugaggcggccguccgcuucgugggguuuccggacaaaaagcacaaauuauauggaguuuacugcuucagagcauauaauuga

SEQ ID NO: 57092 - RNA, 1209 nt, Artificial Sequence
  derived and/or modified sequence opt3 from HAPLN4__Homo_sapiens__NP_075378
auggugugcgccagagcugcacugggccccggggcccucugggcggcugccuggggaguccuucuguugaccgcaccagccggugcucagaggggccggaagaaaguugugcacguauuagagggggaaagcggauccguggucgugcaaacagcaccuggccagguugugucucaucgcggugggacuaucguccugccgugucgauaccacuaugaggccgcugcccauggacacgacggcgugcgucuaaaguggacgaaaguaguugauccccucgcguucaccgacguguuugucgcacugggcccucagcauagagccuucgggucauacaggggacgggcugaacuucagggugauggcccaggggacgccagucugguguugcgcaacgugacacuccaagauuauggaagauacgagugcgaagucacuaaugagcuggaggacgaugcaggcaugguuaagcuggaccucgaaggugugguauuucccuaucacccuaggggagggcgguacaaauuaaccuucgcugaggcccagcgcgcgugugccgaacaggauggcauucuggcaagcgcugagcagcuucacgccgcuuggcgagacggcuuggauuggugcaacgccggguggcugagagacggauccgugcaauauccagucaauaggccccgggagccuugugguggccuagggggaacaggcucugccggugggggcggagaugcaaacggcgggcuccguaauuacggauaccgccauaacgcugaagagagauaugacgcguuuugcuucaccucgaaucugccagguaggguguuuuuccuuaagccgcugcggcccguuccuuuuucaggcgcagcccgagcuugugccgcacgcggggccgcuguggccaaggucggacaguuguucgcagcguggaaacuccagcuguuagacagaugcacugcuggcuggcuggccgaugguagcgcaagguacccaauagugaacccccgggcccgcugugggggcagaaggccuggaguacguagucucggcuuuccagacgcuacacggcgacuuuucgggguuuauugcuacagagcccccggagcaccggauccugcucccgguggcuggggguggggaugggccggcggugggggcugggcgggaggcgccagggacccagcugcauggaccccucugcacguguga

SEQ ID NO: 57093 - RNA, 1446 nt, Artificial Sequence
  derived and/or modified sequence opt3 from HARS2__Homo_sapiens__NP_001265660
augccccugcucggccuucugccuagaagggccugggcuagcuuguuaucccagcugcuacggccaccgugcgcaucuuguaccggggccgugcgcugccaaucacagggaacacgagaccucaguccccagcacauggucguucgugagaagauccuggaucuugugauuagcuguuucaaaagacauggugcgaagggcauggacacuccugcuuuugaacugaaagagacguugaccgaaaaguacggggaggauuccggacucauguaugaccugaaagaucagggcggugaacugcucucuuuaagguacgaccugacaguaccauucgcccgguaucuugcaaugaacaaggugaagaaaaugaagcgcuaccacgucgggaaaguguggagaagggagucgcccacuauaguucaaggacgguaucgcgaguuuugccagugugauuucgacaucgccggccaguuugauccuaugauuccagacgcugaaugcuugaagaucaugugugagauucugucaggccuacagcucggggauuuccugaucaaagugaaugaccgaagaauagucgauggaauguuugcagugugcgguguacccgaaagcaaguucagggccaucuguaguuccauugacaaacuugacaagauggcuuggaaggauguucggcaugagaugguggucaaaaagggccuggccccugagguggcggaccguaucggggauuacgugcaaugccacggaggcgucucuuugguugaacagauguuucaggacccacgccucagccagaacaaacaagcacuggaggguuuaggggaucugaagcuccuuuucgaauaucugaccuuguuuggaauugccgacaaaaucuccuucgaucuaucacuggcuagaggccucgacuacuacacaggcgugauauaugaggccguacugcuucagaccccgacucaggcaggggaggaaccccugaaugugggaagugucgcugccgguggcagguacgauggguuggugggaauguuugacccuaagggccauaagguuccaugugugggucucagcauuggggucgagcggaucuucuauauuguggaacaacgaaugaaaacaaagggcgagaaaguacgcaccacggaaacucagguuuucguggcgacaccccagaagaacuuucugcaggagagauuaaaacugaucgccgaacuaugggauucuggaaucaaggcagagaugcucuacaagaauaacccuaaacugcuuacccaauugcacuauugcgaguccacuggcauuccacuggucgugauaaucggggaacaggagcucaaggaaggagucauuaaaaucaggucaguggcuagccgggaggaaguugccauaaagcgcgagaauuucguggcugagauucagaaaagacugagugaaucuuga

SEQ ID NO: 57094 - RNA, 1410 nt, Artificial Sequence
  derived and/or modified sequence opt3 from HARS__Homo_sapiens__NP_001244969
auggccgagagagcugcacuggaagaacucgugaaacuucagggcgaaaggguccgggggcugaagcaacagaaggccagcgcggaguugaucgaagaggagguugcuaaauuacugaagcuaaaagcccagcucggacccgacgaauccaagcagaaguucgugcugaaaaccccuaaggagacacuuauggguaaauacggcgaagauucuaagcugauuuaugacuugaaagaucaagggggagagcuccugucacugcgcuacgaccucacuguaccauuugcacgauauuuagccaugaacaagcugacgaauauaaagcguuaccacaucgcuaaaguguauagaagggauaacccggcaaugacccggggccgcuacagagaguucuaucagugcgacuuugauauugccgguaauuucgaccccaugaucccugaugcugaaugucuuaagauuaugugcgagaucuugaguagccugcagauaggggacuuucuagucaaagugaacgauaggcggauccucgacggaauguucgccauuuguggcguuuccgauucuaaguuucgcacaaucugcucgucaguggacaaacuggacaaggucagcugggaagaggugaaaaaugaaaugguaggcgagaaggggcuugcgccagagguugcagaucgaauuggagacuacgugcagcaacaugguggcgucagucugguggaacaguugcuccaggaucccaagcugucccagaacaaacaagccuuagaggggcugggagaccucaaacuucuguucgaauacuugacucuauuuggcaucgaugacaagauaucuuucgaucugagccucgcuagaggucuggacuauuacaccggggugauuuaugaggccguccuucugcagaccccugcacaggcuggagaggagccauugggcguuggcuccguggccgccgggggaagguacgauggucucguaggcauguuugaccccaaggggcggaaagugccuugugucggacugucaaucggcguggagcguauuuucaguaucguugaacaacgcuuagaggcgcuggaagagaagaucagaacaacugaaacacaggugcuagucgcaagcgcucagaagaaacuccuggaggagaggcuuaaguuggugucugaacugugggaugccgguauuaaagcugagcuccuguauaagaaaaauccaaaacuucugaaccaguugcaauacugcgaagaggccgggauaccgcucguagcaaucauuggcgagcaggaacugaaggacggaguuaucaaguuacgguccgugaccucacgagaggaagucgacgugcgcagagaggaucuggucgaagagauaaagaggcggacgggccagccccuauguauuugcuga

SEQ ID NO: 57095 - RNA, 1734 nt, Artificial Sequence
  derived and/or modified sequence opt3 from HAS1__Homo_sapiens__NP_001284365
augagacaggacgcccccaagccuaccccagcugcauguaggugcagcggccuggcccggcgcgugcucacaaucgcguucgcccuucugauuuugggguuaaugacuugggcuuacgcagccggagucccgcuggcuuccgaucgauauggucuacucgcauuuggccuguacggggccuuccuuucugcucaccugguugcccaaucauuguuugcguaucucgagcaucguagaguggcagccgcugccaggggaccccuggacgcagcuacggcccggaguguagcgcugaccauaagcgccuaccaggaagauccugcauaucuccgccagugcuuagcuuccgccagagcucugcuuuacccaagggcccgguugcgcgugcugauggucguggacggcaaccgagcagaggaucuauauaugguugacauguucagagaaguguuugccgaugaggaccccgcuacauacgucugggaugguaauuaccaccagccuugggaaccagcggcagccggggcugugggagccggcgcauauagggagguagaggccgaagaccccggccggcucgcuguugaggcccuggugcguacucgcagaugugucugcguggcacaaagguggggagggaaacgggaagugauguacaccgcguucaaggcucuuggugauucugucgacuauguucaggugugugauucggacacacgacuggacccuauggccuugcucgagcugguacgcguguuagaugaggacccaagagucggcgcaguugggggagaugugaggauccugaacccgcucgacucaugggugagcuuucuuaguucccugcgguacugggucgccuucaauguggaacgcgcuugccagucuuauuuucauuguguaagcugcauuuccggccccuugggucuauacagaaacaaucugcuccagcaauuccuggaggccugguauaaccagaaauuucuugggacccacuguacuuucggagaugacaggcaucugacaaaucguauguugucaaugggcuacgcaaccaaguacacgagucggagccgaugcuauucugaaacuccuuccucauuucucagauggcugagccagcagaccagguggaguaaaucuuacuuccgcgagugguuauauaacgcucugugguggcaccggcaccaugccuggaugacauacgaagcgguuguguccggccuauucccauuuuucgucgccgcuacugugcucagacuguuuuaugcagggaggcccugggcccuuuuguggguccugcucugugugcaaggaguugcucuggccaaggcagcguucgccgcuuggcuucgcgguugccugcgaaugguguugcucagccuguacgccccuuuauauaugugcggccugcuaccagcaaaguuucucgcucugguaaccaugaaucagucgggguggggaacaucuggccggcguaaacuugccgcaaacuacguccccuugcugccgcucgcccugugggcuuuacugcuuuugggugggcucgugagauccguugcgcacgaggccagggcagauuggucaggcccuagucgcgcugccgaggccuaccaucuggcugcaggagccggcgcguaugugggguacugggucgcuaugcuaacccuguauugggugggaguacggagacucuguaggcgacgcacggguggcuaccgggugcagguuuga

SEQ ID NO: 57096 - RNA, 1659 nt, Artificial Sequence
  derived and/or modified sequence opt3 from HAS2__Homo_sapiens__XP_011515304
augcacugcgagagauuccuguguauccucaggauuauaggcaccacacuuuuuggggugagccuguuguuaggaaucacugccgcuuacauugucgguuaucaguucauccaaacggacaacuacuauuuuuccuucggccuguacggggcauuucuagccucucaucucauuauccagucacuguucgcguuucuugaacaccggaagaugaaaaagagucuggagacccccauaaaauugaauaagacaguugcucucugcaucgccgcauaucaggaagauccugacuaccugcgcaaaugucugcagagcgugaagcgacucacuuauccaggaauuaagguagugauggucaucgauggcaacuccgaggacgauuuauacaugauggacauuuucucugaagugaugggucgugauaaaucggccaccuacaucuggaagaauaacuuucaugagaaagggccgggagagacagacgaaucacacaaggagagcagucaacauguuacccagcuggugcuuuccaauaaaucuauaugcauuaugcagaaguggggcggcaagagagaagucauguauacugcuuucagggcauuggggcggagcguggauuacguacagguuugugacuccgauacaaugcuggaccccgccucaaguguggagauggucaaagugcuagaggaagauccuauggugggaggugucggcggggacguucaaauccucaacaaguaugacagcuggauuucuuuucuguccucagugcgcuacuggauggcuuucaauaucgagagagccugccagagcuauuuuggauguguacagugcaucaguggcccacuugguauguacaggaacucucuguugcacgaguucguggaagauugguauaaucaggaguucauggggaaccaauguuccuuuggagacgaucggcaccucaccaaucgcguccugagcuuaggcuacgcgacgaaauacacugcacgaucgaagugccugaccgaaacacccauugaguaucucagauggcuuaaccagcagacuagguggucuaaauccuacuuccgggaauggcuguauaaugccaugugguuucauaagcaccauuuguggaugaccuacgaggcuauaaucacaggcuucuuuccuuucuuucuaauugccaccgugauccaacuguucuaucgugggaaaauauggaacauucuccuguuucuucugacgguucaguuggugggacucaucaagucaaguuucgcaagcugucugcgcgguaauaucgucaugguguuuauguccuuauacucuguacuguauaugagcucacuacucccagcuaagauguucgccauugcgacuaucaacaaagccggcugggggacaaguggaagaaagaccauuguugugaacuuuauaggccugauccccgucuccgugugguucacuauucuuuuggguggggucaucuucacaaucuacaaagaaagcaagaggccuuuuucugagucaaaacagaccgugcugauuguuggcacgcuccuguacgcaugcuauugggugaugcuucugaccuuguacguaguccucauaaauaagugcggacggcgaaagaaaggccagcaauaugacauggugcuggauguuuga

SEQ ID NO: 57097 - RNA, 1662 nt, Artificial Sequence
  derived and/or modified sequence opt3 from HAS3__Homo_sapiens__NP_005320
augcccgugcagcugaccacagcccucagagucguuggcacuagccuuuucgcucuggcaguguuagggggaaucuuggccgcguacguaacggguuaucaauuuauucacaccgagaagcauuaccuguccuucggccuauauggggcuauacucggacugcaccuucugauccagucuuuguuugccuuccucgaacauaggcggaugcgccgagcaggccaggcccugaaacugccuucaccacguagagguaguguggcucucugcauugcagccuaccaggaggacccggauuauuuaaggaagugucugcggagcgcucaacgcaucuccuuucccgaccuuaaagucgugaugguuguggaugggaacagacaggaagacgccuacauguuggauauuuuccacgagguccugggaggcacagaacaggcgggcuuuuucguguggaggucuaauuuucaugaggcaggggagggagaaacugaggccucgcuacaggaagguauggaccggguacgcgauguugugcgagcuucaaccuucagcugcaucaugcaaaaguggggcgggaaaagagaggucauguauacagccuuuaaggcacucggagacaguguggauuacauacaggugugugacuccgauaccguccuggacccugcuugcacuaucgagaugcuuaggguucuggaagaggauccacaggugggcgguguagggggagacgugcagauuuugaacaaguacgacucuuggaucagcuuccucuccucaguccgguauuggauggccuuuaauguggaacgugcgugucaaaguuacuucggcugcguucaguguauuagcggcccccuggggauguaucgcaacucuuuacugcagcaauuccucgaggauugguaccaccagaaauuucuuggauccaagugcucauucggugacgauagacaccugacaaauaggguguugagccuaggcuaucggaccaaauacacggcccgaaguaagugucugacugaaaccccuacaaaauaucuccgcuggcugaaccagcagacuagauggucuaaguccuacuuuagggaguggcuuuacaauagccugugguuccauaagcaccauuuguggaugaccuaugagucggucgugacaggguuuuucccauuuuuccucaucgcaaccguaauacaacuguuuuaccggggacgcauuuggaacaucuuacuguuccuacucacgguucagcuggugggcauuaucaaagcuacuuaugccugcuuucuuagagguaaugcugaaaugaucuucaugucuuuguacucccugcucuauaugucaagucugcuucccgccaagauuuuugcaauagccacaaucaacaaaagcggguggggcaccuccggaaggaagacuauugucgugaauuucaucggccugauaccugucucuauuuggguggcuguuuugcucgggggacuggcguacacagcauauugucaggacuuauucagcgagaccgaacuggccuuucuagugucaggugcuauccucuacggcugcuacuggguagcccugcuuauguuguaucuggcaaucauugcccgucggugcgggaaaaagccagagcaguacagucucgcuuucgccgaagucuga

SEQ ID NO: 57098 - RNA, 1260 nt, Artificial Sequence
  derived and/or modified sequence opt3 from HAT1__Homo_sapiens__NP_003633
auggccggcuucggggcuauggagaaguuucugguggaauacaaaagcgcagucgagaagaaacucgccgaauauaagugcaacaccaauacagcgaucgagcuuaaacugguuagauuccccgaagacuuggagaacgauauuaggacuuucuucccugaguacacgcaccaguuauuuggagacgaugaaaccgcuuucgguuauaagggccugaagauacuacucuacuauaucgccgggucccugucuacaauguuucggguggaguacgcaucaaaaguagacgaaaauuucgauuguguggaggccgacgaugucgagggaaagauucgccaaaucauuccaccgggcuuuugcacuaacaccaaugacuuccuuagucuguuggaaaaagagguggauuuuaagcccuucgguacacuccugcauaccuauagcguucuguccccuacugggggagaaaacuuuacauuccagaucuacaaagcugacaugaccugucgaggcuuccgugaguaccacgaaagacuccagacguuuuuaaugugguucauagagacugcaucuuuuaucgauguggacgaugagagguggcauuauuuccuggucuuugaaaaguacaauaaggacggcgccacccuuuucgcuacagugggguauaugacuguauacaacuauuacguuuauccagacaaaacccggccccgcgugucgcagauguugauucugacaccuuuucaaggacagggucacggcgcccagcuacucgagaccguccauagauacuacacggaauuuccaacugugcuggauaucacagcggaggaccccucaaagagcuaugugaaacuuagggauuuuguccugguuaaguugugccaggaccucccuuguuucagucgggaaaaacugaugcaaggguuuaaugaggauauggcaauugaggcccagcagaaguucaaaaucaacaagcagcacgcucgccgaguguacgaaauauuaagacugcucguaaccgacauguccgaugccgagcaauauaggucuuaccggcuugacauuaagcgucgccugaucagcccauauaaaaagaaacagagagauuuggcaaagaugaggaaaugccuacggccggaggaacugacuaaucagaugaaccaaauugaaaucuccaugcagcacgagcagcucgaggaaucauuucaggagcugguggaagacuaccgacgcgucaucgagagacuugcucaagaguga

SEQ ID NO: 57099 - RNA, 1095 nt, Artificial Sequence
  derived and/or modified sequence opt3 from HAVCR1__Homo_sapiens__NP_001166864
augcacccccagguggucauccugagccucauucuucaucuggccgacuccguugcuggcucugugaagguagggggagaggcagguccuucagugaccuugccaugccacuacaguggcgccgucacaagcauguguuggaacagaggguccugcucuuuauucacuugucaaaauggaauaguguggacgaacggcacccauguuacauauaggaaagauacucgguacaagcugcuaggugaccucucgcgccgagaugugucacugaccaucgaaaauacagcggucagcgacagugggguguauugcugucguguagagcacagaggaugguuuaacgauaugaaaauuaccguuucccuugaaaucgugccgcccaaggucacuacaaccccuauugugacgacugugccaaccgucacaacuguuaggaccucuacaaccgugcccacgacuacaaccguaccuaugacuacagugccaaccacgaccguccccacaacuaugagcaucccuaccacaacuaccgugcugacaaccaugacuguuuccacgacaaccucagugccaacuaccacaaguauaccgaccacuacaagcguccccgugacgaccacuguaucuacauucguuccuccaaugcccuugccucggcagaaucaugagccaguggcuaccucccccucaagcccgcagccugccgaaacacaccccacuacccuccagggcgcaauccgcagagagccaacgaguucuccucuguacuccuauaccacagacggcaacgauacugucaccgagagcucggacgggcuguggaauaacaaucaaacacagcucuuuuuagaacacucucugcuuacugccaacaccacgaaaggaauuuacgcuggugugugcaucuccgucuuggugcugcuagcacuccugggcguuauuaucgccaagaaguauuucuuuaaaaaggaggugcagcagcuuucaguaaguuucagcucccugcaaauaaaggcuuugcagaaugccgucgaaaaagaggugcaggcggaggauaacauuuacaucgaaaauucucucuacgcaacagacuga

SEQ ID NO: 57100 - RNA, 906 nt, Artificial Sequence
  derived and/or modified sequence opt3 from HAVCR2__Homo_sapiens__NP_116171
auguucagccaucugcccuuugacugcgugcuccuucuguuguuacugcuacucaccagauccucugaggucgaauacagggccgagguuggccagaacgcuuaucugccuuguuucuacacaccagcagccccggggaaucuugugcccguaugcuggggaaagggugcguguccuguguuugaaugcggcaacgucgugcugcggacugaugagcgcgacguuaauuauuggacgucacgauacugguugaacggggauuuccguaaaggagacgugagucucaccaucgaaaaugucacacuggcugauagcggcauuuauuguugcagaauacaaaucccagguauuaugaacgacgagaaguuuaaucugaaacucgugaucaagcccgccaaaguaacuccugcaccaaccaggcagcgggauuucacagccgcuuuuccccgcauguuaaccacuagagggcacggaccugcagagacacagacccugggcucccuuccagacauuaacuugacgcagaucucuacucuggccaaugaacuaagggauucgcggcucgcuaacgaccugcgcgauucaggcgccaccauacgaaucgggauuuacaucggagcggguauuugugcaggccuugcccuggcuuugaucuucggggcccucauauuuaagugguauagccacaguaaggagaaaauucaaaaucuguccuuaaucucucuggcaaaccucccgcccagcggacuugcuaaugccguugcggaaggcauuagauccgaggagaacaucuacacaaucgaagagaauguguacgaagucgaggaaccuaacgaguauuacugcuaugugucaaguaggcagcagccaagccagccccuggguugucgguucgccaugccuuga

SEQ ID NO: 57101 - RNA, 696 nt, Artificial Sequence
  derived and/or modified sequence opt3 from HAX1__Homo_sapiens__NP_001018238
augagccuguucgaccucuuuagaggcuucuuuggguuccccggaccuagguccuuuucuccagguggcgggauccgguuccacgauaacuuuggauucgacgaucuugugcgcgacuuuaauucaauuuucagugauaugggcgccuggacccugccgagccaucccccugaguugccaggucccgaauccgagacaccuggggaacgauuacgugagggacagacucugagagacucuaugcuaaaguacccagauucgcaccaacccaggauauuuggcggcguccucgaaucagacgcucggagcgagaguccucagccagcaccggauugggggucccagcgccccuuccauagauuugacgauguuuggccuauggacccacaccccaggacgcgggaggauaacgaccuggacucucaggugagccaagaaggacuugguccuguacugcagccacagcccaaauccuauuucaagucaaucagugugaccaaaauuacaaagccggauggcaucgucgaggaacgccgaacugugguugacagcgaggggagaaccgagacaaccgugacuaggcaugaagccgauucuuccccucggggagaccccgagucaccacguccucccgcguuggaugacgcuuucagcauucucgaucuguuucugggccgcugguucagaaguagguga

SEQ ID NO: 57102 - RNA, 429 nt, Artificial Sequence
  derived and/or modified sequence opt3 from HBA2__Homo_sapiens__NP_000508
auggugcugagccccgccgacaagaccaacgucaaagcugcauggggaaagguuggggcccacgcgggagaguacggugcugaagcccucgagagaauguuccuuuccuuuccuacaacuaaaacguauuucccacauuuugaucugucucacggcucagcacaggugaaggggcauggcaaaaagguagccgacgcuuugaccaaugcaguggcccacgucgaugacaugccgaacgcuuuaagugcccugagcgaucuacaugcgcacaagcucaggguggaccccguuaauuucaaacugcuuucccacugccuguuggugacacucgcagcccaucugccugcugaauuuacuccagccguccacgcaucucuggauaaguuccucgcuucggugucaaccguauuaacaagcaaauaccgguga

SEQ ID NO: 57103 - RNA, 444 nt, Artificial Sequence
  derived and/or modified sequence opt3 from HBB__Homo_sapiens__NP_000509
auggugcaccugacccccgaggaaaagagcgccgucacagcucucuggggcaaaguuaacguggacgagguagggggagaagcacuugguagacuguugguggucuacccuuggacucagagguucuuugaguccuucggcgauuuaucuacgccagacgccgugauggggaauccgaagguuaaagcgcauggaaagaaagugcugggcgcuuuuucagauggucuagcccaccucgacaaccugaaggggaccuucgcaacacuuagugaacugcauugcgauaaguugcacgucgaccccgagaauuuucggcuccugggaaacgugcugguauguguucucgcccaucacuucggcaaagaguuuacuccuccagugcaagcugcauaucagaaggucguggccggcguggcuaaugccuuagcgcacaaauaccauuga

SEQ ID NO: 57104 - RNA, 444 nt, Artificial Sequence
  derived and/or modified sequence opt3 from HBD__Homo_sapiens__NP_000510
auggugcaccugacccccgaggaaaagacagccgucaacgcucucuggggcaaaguuaauguggacgcaguagggggagaggcccuugguagacuguugguggucuacccuuggacucagagguucuuugagagcuucggcgauuuauccucuccagacgcggugauggggaacccgaagguuaaagcucauggaaagaaagugcugggcgccuuuucagauggucuagcacaccucgacaaucugaaggggacguucagucaacuuagcgaacugcauugcgauaaguugcacgucgaccccgaaaacuuucggcuccugggaaaugugcugguauguguucucgcccgcaacuucggcaaagaguuuaccccucagaugcaggcugcauaucagaagguggucgccggcguggcuaaugccuuagcgcauaaauaccacuga

SEQ ID NO: 57105 - RNA, 444 nt, Artificial Sequence
  derived and/or modified sequence opt3 from HBE1__Homo_sapiens__NP_005321
auggugcacuucaccgccgaggaaaaggcugcagucacaagccugugguccaaaaugaacguugaggaagccggcggggaggcgcucggaagacuucuggugguauaccccuggacucagagguuuuucgacucuuuugguaauuugucaaguccuagcgcuaucuuaggcaacccaaaggugaaagcccaugggaagaaaguccugacguccuucggagaugcaauuaagaauauggacaaccuaaagccggccuuugcuaaacucucugaacugcacugcgauaaacuucauguggaccccgagaauuucaagcuguugggcaacguuauggugauaauccucgcaacccacuuugguaaggaguucacaccugaaguccaagccgcuuggcagaaacuggugucggccguagcgauugcacuggcccauaaguaucacuga

SEQ ID NO: 57106 - RNA, 627 nt, Artificial Sequence
  derived and/or modified sequence opt3 from HBEGF__Homo_sapiens__NP_001936
augaagcugcuccccagcgugguccuuaaacuguucuuggccgcuguuuuauccgcacuggugaccggcgagucucuagaaagacucaggcgggggcuggccgcgggaacaucaaacccugacccaccgacuguaaguacggaucagcuucugcccuuggguggcgggcgcgaccgaaaggugcgugaucuccaagaggcugaccuggaucugcucagagucaccuuaagcuccaaaccucaggcccuggcaacaccaaauaaggaggaacacggaaaaaggaagaagaaaggcaagggucuugggaaaaagcgggaccccugcuugcgcaaauacaaggauuuuuguauccauggagaaugcaaguaugugaaagagcugagagccccuucuuguauuugccacccaggcuaccauggcgagaggugucacgggcuaucgcuccccguugaaaaccggcuguauacuuacgaccauaccacaauacuugcuguggucgcagugguacugucaagcguuugcuugcucgugaucgucggacuguuaauguuccgcuaucaccgaagagguggcuacgauguggagaaugaagagaaggugaaacuggggaugaccaacagucacuga

SEQ ID NO: 57107 - RNA, 444 nt, Artificial Sequence
  derived and/or modified sequence opt3 from HBG1__Homo_sapiens__NP_000550
augggccacuucaccgaggaagacaaggccacaaucacuagccugugggggaaagugaacgucgaggaugcuggaggugaaacgcucggcagacuucugguuguguaccccuggacccagagguuuuucgacuccuuugggaauuugucuucagcaagugccauuaugggaaacccuaagguaaaagcgcauggcaagaaaguguuaacaagccugggugaugcuacuaagcaccuagacgaucucaaggggaccuucgcccaacuguccgagcuucauugcgacaaacugcacgucgauccagaaaauuuuaaguugcucggaaacgugcugguuacagugcuggcaauacauuucggcaaagaguuuaccccggagguccaggccucuuggcagaagauggugacugcuguagcaucggcccucucaagccgguaucacuga

SEQ ID NO: 57108 - RNA, 444 nt, Artificial Sequence
  derived and/or modified sequence opt3 from HBG2__Homo_sapiens__NP_000175
augggccacuucaccgaggaagacaaggccacaaucacuagccugugggggaaagugaacgucgaggaugcuggaggugaaacgcucggcagacuucugguuguguaccccuggacccagagguuuuucgacuccuuugggaauuugucuucagcaagugccauuaugggaaacccuaagguaaaagcgcauggcaagaaaguguuaacaagccugggugaugcuauaaagcaccuagacgaucucaaggggacuuucgcccaacuguccgagcuucauugcgacaaacugcacgucgauccagaaaauuuuaaguugcucggaaacgugcugguuaccgugcuggcaauccauuucggcaaagaguuuacaccggagguccaggccucuuggcagaagauggugaccggcguagcuucggcacucucaagccgguaucacuga

SEQ ID NO: 57109 - RNA, 426 nt, Artificial Sequence
  derived and/or modified sequence opt3 from HBM__Homo_sapiens__NP_001003938
augcugagcgcccaggagagagcucaaaucgcacaggugugggaccucauugccggccacgaagcgcaguucggggcugagcuucuguugagguuauuuaccgucuaccccuccacaaagguuuauuucccucaucugucugccugccaggaugcaacucaacuacucucacacggacagcggaugcuggccgcugugggugcagccguacagcauguggacaaccuucgcgcugcccugaguccauuggcggaucuccacgcacugguccugcgaguggacccggccaauuuuccccucuuaauacaguguuuccauguugugcuggcuagccaccuucaagaugaauuuacgguccagaugcaggccgcaugggacaaauucuugaccggcguggcuguaguucugacagagaaguaccguuga

SEQ ID NO: 57110 - RNA, 1575 nt, Artificial Sequence
  derived and/or modified sequence opt3 from HBP1__Homo_sapiens__NP_001231191
auggccaccggccugagcgagcaccauaacauggugugggaagucaagacaaaucagaugcccaacgcuguucaaaaacuccuucuggugauggacaagagagcauccgggaugaaugauucuuuggaguuacugcagugcaacgaaaaucuaccuucaaguccaggauacaacagcugugacgagcacauggaacucgaugaccugccggagcuucaggccguacaguccgaucccacucaaucugguauguaucagcugucgucagacgugagccaucaggaguacccuaggaguuccuggaaucagaacacgucugauaucccagaaaccacauaucgggagaaugaagucgacugguugacugagcucgcgaacauugcuaccagcccccaauccccucugaugcagugcucauucuacaaucgcaguagcccagugcacauaaucgccacaucuaaaucccugcauucauaugcacgacccccuccaguuagcaguucuuccaagagcgagccggccuuuccccaccaccauuggaaagaagagaccccugugcgucacgaaagagcuaacucggagucugaauccggcauuuucuguaugucaagucucagcgaugacgaugacuuaggguggugcaauuccuggccaucuacugucuggcauuguuuucugaagggaacaaggcuuugcuuccacaagggcagcaacaaagaguggcaggauguggaggacuuugcacgggccgaagguugugacaaugaggaagauuugcagauggggauccacaagggauacggcucagacggccugaaacuacucagucaugaggaauccguuagcuucggggagucuguacugaaacuuaccuuugaucccggaacgguggaggacggucuguugacugucgaaugcaagcucgaucacccuuucuaugugaagaacaagggcuggucaaguuuuuacccaagccugaccgugguccaacaugggauucccuguugcgagguucacaucggagacguguguuuaccgccuggccaucccgaugcuauaaacuucgacgauuccgguguauuugacacauucaaaucuuacgauuuuacuccaauggacucgagcgccguguauguccuguccucaauggcgcgccagagaagggcaagucucucuugcgggggaccuggcggccaggacuucgcccggagcggguucuccaagaauugcggaucacccgguagcucucaacuuuccaguaacagccuguacgcuaaagccgugaagaaucacucuuccggcaccguuucagcaacaaguccaaacaaauguaagcgccccaugaaugcuuuuauguuguucgccaaaaaguaucgaguggaauacacccagauguauccugggaaggauaacagagcgaucagcgucauucuaggagacagguggaaaaagaugaaaaaugaggaacggcguauguacacgcuggaggccaaggcacucgcugaggaacagaaacgccugaacccagauugcuggaagagaaagaggacuaauucgggcucccagcaacacuga

SEQ ID NO: 57111 - RNA, 429 nt, Artificial Sequence
  derived and/or modified sequence opt3 from HBQ1__Homo_sapiens__NP_005322
auggcccugagcgcugaggacagagcacucgugagggcccuuuggaagaaacugggcuccaacgucgggguuuacaccacagaagcguuggagcggacuuucuuagcuuuucccgccacgaagaccuauuucucucaccuggaucuaucaccuggaaguagccaggugcgcgcacauggucaaaaaguagccgacgcucucucccuggcaguggaacgacuugaugaccugccacacgccuugucugcucucucgcaucugcacgccugccagcugcgugucgauccggcgucauuucagcucuuaggccauugucugcuugugacauuggcaagacacuaccccggggacuucagcccugcccugcaggcuagucuagauaaguuucucucccacguuaucucugcccuggugagcgaguauagguga

SEQ ID NO: 57112 - RNA, 1929 nt, Artificial Sequence
  derived and/or modified sequence opt3 from HBS1L__Homo_sapiens__NP_001138630
auggccagacacaggaacgugcggggcuacaauuaugacgaggauuucgaagacgaugaccuguacgggcagagcgucgaggaugacuauugcaucucccccucuaccgcucgccucuacucaugucuugaucauaugcgagaaguucugggagacgcagugccugaugagauuuugauagaagccguauuaaagaacaaauuugacgugcaaaaggcgcugagugguguccuagagcaggaucgugugcagagccucaaagacaagaaugaggcuacaguuuccacuggcaaaaucgccaaggggaagccaguggauucucagacgucgagaucagaaagcgagauugucccgaaaguggcaaagaugaccguaaguggcaaaaagcaaacaaugggauucgaaguucccgguguguccucugaggagaacgggcacagcuuucauacuccucagaaaggaccacccaucgaagacgccauugcuuccucagacguccuggagaccgcaaguaagagcgccaauccuccacacacaauccaggcuucugaggaacaguccucaacccccgccccugugaagaaaagcggcaaacuuaggcaacagauagaugugaaagcggaacuggagaagcggcagggcgggaaacaguugcucaaccuggucguuaucggacauguggacgcagguaagaguacucugaugggccacaugcucuauuuacuggggaauauuaacaaacgcacaaugcacaaguacgagcaagaaucuaagaaagccggaaaggcuuccuucgccuaugcauggguacuugaugagaccggcgaagagagagaaaggggugugacgauggacgucgggaugacuaaauuugagaccacaacuaaggugaucaccuugauggaugcuccaggacauaaagacuucauuccgaauaugaucacaggcgccgcgcaggccgauguugcagugcuggucguggacgcuagccggggcgaguuugaagccggguucgagaccggaggucagacgcgcgaacacggccuacucguacgaucgcuggggguuacucaacuugcuguggccgucaacaagauggaucaggugaauuggcagcaggagagauuucaagaaauaacaggaaagcugggccauuucuugaaacaggcagguuuuaaggagucugacgucggguucauucccaccuccggccucucaggagagaaccugaucacuaggagucagagcuccgaauuaacaaaaugguacaagggccugugccuccuugagcagauugauucuuuuaaaccuccacaacggagcaucgacaagcccuuccgucugugugugucagacguuuucaaggaucaggggaguggauuuugcaucaccgguaaaauugaagccggcuacauacagacgggggaccgcuugcuagcuaugccuccaaaugagaccuguacagugaagggaaucacucugcacgaugagcccguagacugggcggcagccggcgaucacgucucccucacccugguggguauggacauuaucaaaauaaacguugggugcauuuucuguggcccgaaggugccuaucaaggcuugcacaagauuuagggcccggauccuuauuuucaauaucgaaauucccauaacuaagggauuuccaguccuguugcauuaucagaccgugagcgagccugcaguaaucaagcgacucauuucugugcugaacaaaucaacaggcgaaguuaccaagaaaaagcccaaauucuuaacuaaggggcaaaacgcccuggucgagcuacagacgcagcgcccaaucgcucucgaacuguacaaagauuuuaaggagcuuggaagauucauguugagguaugguggcaguacaaucgccgcagggguggugaccgagauuaaggaauga

SEQ ID NO: 57113 - RNA, 429 nt, Artificial Sequence
  derived and/or modified sequence opt3 from HBZ__Homo_sapiens__NP_005323
augagccugaccaagacagagagaacuaucauuguguccaugugggccaaaauaucuacgcaggcugacaccaucggcacagaaacucucgagaggcuuuuccugucacacccccaaaccaagacauacuuuccucauuucgauuugcacccagggagugcacaguuacgggcccauggaagcaaagucguugcggcugugggugacgccguaaaguccauugaugacaucggcggggcacugucuaaacuaucggaacuccacgccuauauucugcgcguggauccggucaacuuuaaacuucugucacauugcuugcucgugacccuggcugcacgauuccccgccgacuuuacugcugaggcccacgcggcaugggauaaguuccugagcguugugaguuccguccucacagaaaaguaccguuga

SEQ ID NO: 57114 - RNA, 1041 nt, Artificial Sequence
  derived and/or modified sequence opt3 from HCAR1__Homo_sapiens__NP_115943
auguacaacggcagcugcuguagaaucgagggggacaccauuucccaggugaugcccccucugcucauagucgccuucguucuuggagcucuggguaauggcguggcauugugcggguuuuguuuccacaugaagacauggaaaccaucuacuguauauuuauuuaaccuggccguggcggauuuccuacucaugaucugccugccguuuaggacggacuacuaucuucggcgccgacauugggcuuucggagauauucccugucgugucggccuguuuaccuuggccaugaauagagcagguucaaucguguuccucacaguuguggccgcugacagguacuuuaaggucgugcacccucaucacgcaguaaacacuauuaguacccggguugccgcugggaucgugugcacacugugggcccuggucauacucggaaccguguauuuacugcuugaaaaucauuugugugugcaagagacugcggucagcugcgaauccuucaucauggagucugcaaacggcuggcacgauauuauguuucagcuggaguucuuuaugccacuaggcaucauucucuucuguucguucaaaaucguuuggucacugcgcagaaggcagcagcuugcccggcaagcucgcaugaagaaagccacacgauuuauaauggugguagcaauuguguucauuaccugcuaccugcccagcgucagugcuagauuguauuuucucuggacggugccuuccucugccugugacccaagcguucacggggcgcugcauaucacuuuauccuucaccuacaugaacucaaugcuggauccccucguguacuauuuuaguagcccuucuuucccaaaguuuuacaauaaacuuaagaucugcucccugaagccgaaacagcccggacacucaaagacacagaggccugaagagaugccaaucagcaauuugggucggcguaguugcauuucugucgccaacuccuuccagagccaaucggacggccagugggauccccauauaguggaauggcacuga

SEQ ID NO: 57115 - RNA, 1092 nt, Artificial Sequence
  derived and/or modified sequence opt3 from HCAR2__Homo_sapiens__NP_808219
augaacagacaccaucugcaggaccacuuccucgagaucgauaagaaaaauugcuguguguuuagggacgauuucauugucaagguucuucccccugugcugggcuuggaauuuauauucggguuacugggaaacggucuagcccucuggaucuuuugcuuccaucugaaaagcuggaaguccucucggauuuuucuuuucaaucuggcuguagcagacuuuuugcucaucauuugucugccauuccugauggauaacuacgugcgccgaugggacuggaaauuuggcgauaucccgugccgucucauguuauucaugcuggccaugaauagacaagggucaauaaucuuucuuaccgucguggcgguugacagguauuuccgggugguccacccccaucacgcuuugaacaagauuaguaaucgcacagccgcaaucauuagcugucugcuauggggaaucacuauaggccucacggugcaucugcuuaagaaaaagaugccuauucagaacgguggggccaaucugugcuccucuuucucgaucugucacaccuuucaguggcacgaggcuauguucuugcucgaauuuuuccugccauuaggaauuauccuguuuugcucagcaagaaucauuuggagccucaggcagcggcaaauggaucgccaugccaaaauaaagcgagcuaucacauucauuaugguaguugccaucguguuugucauauguuuccuucccagugugguggucagaauuaggaucuuuuggcuguugcacacuuccggcacccagaacugcgagguuuaccggucuguggaccuagcguucuuuaucacacugagcuucaccuauaugaauagcaugcucgauccuguaguguacuauuuuucaaguccauccuuccccaacuucuuuucuacucugauuaaucguugucuucagcgcaaaaugacaggcgaaccugacaacaauagauccaccucagucgagcugacgggggauccaaacaagacuaggggagcaccggaggccuugauggcuaacagcggugaacccuggaguccuucuuaccucggcccaaccucccccuga

SEQ ID NO: 57116 - RNA, 1164 nt, Artificial Sequence
  derived and/or modified sequence opt3 from HCAR3__Homo_sapiens__NP_006009
augaacagacaccaucugcaggaccacuuccucgagaucgauaagaaaaauugcuguguguuuagggacgauuucauugccaagguccuucccccuguucugggcuuggaauuuauauucggguuacugggaaacggucuagcucucuggaucuuuugcuuccaucugaaaagcuggaaguccucucggauuuuucuuuucaaucuggcaguggccgacuuuuugcucaucauuugucugccauucguaauggauuacuaugugcgccgaucagacuggaaauuuggcgauaucccgugccgucugguccucuucauguuugcgaugaacagacaagggaguauaaucuucuuaaccgugguugcuguggacagguacuuccgggucgugcacccccaucacgcccugaauaagauuagcaacuggacagcagccaucauuuccugucuuuuguggggaaucacuguaggccugacgguucaccuacucaagaaaaagcugcuuauacagaaugguaccgcuaacgugugcauuucuuuuucgaucugucauacauuccgcuggcacgaggcaauguuucuguuggaguucuuucucccucuggggauuaucuuauucugcucagccagaaucauuuggagccugaggcagcggcagauggaucgccaugcuaaaauaaagcgagccaucacuuuuauuauggucguggcgaucguguucgucauauguuuucucccaaguguugugguaaggauucacaucuucuggcuucugcacaccuccggaacacaaaauugcgaaguguauagaucugucgacuuggcauuuuucaucacccugagcuuuacuuacaugaacuccaugcuagaucccgugguuuauuacuucucaaguccuagcuucccaaacuuuuucucuacacucauuaaucggugucugcagcguaaaaucaccggcgaacccgacaauaaccgcuccacgucaguggagcuuacuggcgauccuaauaagaccagaggggccccagaggcucugauugccaacagcggagaaccguggagucccucuuauuuggguccuacauccaacaaucauagcaagaaaggccacugccaucaggagccagcaucgcucgaaaagcagcuggggugcuguauagaguga

SEQ ID NO: 57117 - RNA, 807 nt, Artificial Sequence
  derived and/or modified sequence opt3 from HCCS__Homo_sapiens__NP_001116080
augggccugagccccuccgccccugcuguggcaguccaggccucuaacgcgucagcuaguccaccgagcgggugccccaugcacgagggaaagaugaaagguuguccuguuaauaccgaaccauccggccccacaugcgagaagaaaacuuacucugugccugcccaucaagaaagagcauaugaguacguagaauguccaaucagggggacggccgcugagaacaaggagaaucucgaccccucgaaccuuaugccuccaccgaaucagacccccgcaccugaucagccauucgcccugucaacagugcgggaagagagcaguauuccccgcgcugacuccgagaaaaagugggucuauccuucugaacagauguuuuggaacgccauguugaagaaaggauggaaguggaaagaugaggacauaagccaaaaggauauguacaauaucauucgaauccacaaccagaauaacgaacaggcguggaaagagauuuuaaagugggaagcacugcaugccgcugagugcccauguggccccucccuaauccguuucggugggaaggccaaagaauauucaccgagagcaaggauacggaguuggaugggauacgagcucccuuuugaccgccacgauuggaucauuaauagaugcggcacugaggugagguauguuaucgacuacuacgauggcggggaagugaacaaggacuaucaguucaccauucuggauguccggcccgcucuugacagccugucugccgugugggaucgcaugaaaguagcgugguggcgauggacauccuga

SEQ ID NO: 57118 - RNA, 6108 nt, Artificial Sequence
  derived and/or modified sequence opt3 from HCFC1__Homo_sapiens__NP_005325
auggccagcgcugugucccccgcaaaccugccugccguccuccuucagccacgcuggaagaggguugugggcuggucugggccgguaccccggccucgccacggacaccgagcgguggcuaucaaagagcugauugucguguucgguggcgggaacgaaggaauaguugacgaguugcacguguacaacaccgccacuaaucaaugguuuaucccagcaguccguggcgauauucccccugguugcgccgcuuauggguucgugugugacggaacuagauuacugguauuuggcggcaugguugaauacgggaaguauucaaacgaucuauacgagcuccaggcaaguaggugggaauggaaacggcugaaggccaaaacgccaaagaauggacccccuccaugcccgcgccuuggucauagcuucucccuggugggcaacaaguguuauuuguuugggggacucgcuaaugacucugaggaucccaaaaacaauaucccuagauaccugaacgaccuguauauucucgaguuaaggccaggcucgggugucguggccugggauauccccauaaccuacggggugcugccuccaccccgggaaucacacacugcggucguuuacacugagaaggacaauaaaaagagcaaacuugugaucuauggaggcaugaguggcugccgcuugggggaucuguggacccuagacauugauacacucaccuggaacaagccgucccugucuggaguagcaccucuuccccgaagccugcauuccgccacuacaaucgguaauaagauguacguguucggcgggugggucccauuggugauggacgauguuaaaguggcuacccacgaaaaggaguggaaauguacgaacacucucgccugccugaauuuagacaccauggcaugggagacaauucugauggacacucucgaagauaacaucccuagagcuagggccggacacugugcggucgccauaaacacccggcuuuauauuuggucaggccgugacgguuaccgcaaggcauggaauaaccaggugugcuguaaagaucugugguauuuggagacagaaaagcccccacccccugcuagaguacagcuaguuagggccaauaccaacagucuggaggugagcuggggagcugucgccacggcagacucuuaccuccugcaacuucagaaauaugauaucccagccacugcugcgacagcaaccuccccgacucccaauccugugccaucaguccccgccaacccuccaaagagccccgcuccggccgcagccgcuccugccgugcagccacugacacagguuggcauuaccuugcucccccaagcagcgccugcucccccaacgaccacaacuauccaggugcugccuaccguacccggaaguucuaucuccgucccaacagccgcacggacucagggcgugccggccguuuuaaaggugaccgggccucaggcuacaaccggaacuccccuggucacgaugcgaccagccagccaagcagguaaagcucccgugacaguaaccucgcuaccugccggcgugcgcaugguugucccaacucagucugcgcaggggaccgugauuggauccucaccccaaaugaguggcauggccgcucucgcagccgcugccgcagcgacacagaagauaccuccgagcuccgccccaaccgugcugucuguccccgcugguacuacaaucguuaaaacgauggccgugaccccugggacuacaacccuuccagcaacagugaagguagcuagcucacccgucauggugaguaauccugccacuagaauguugaaaaccgcagccgcucagguuggcacguccgugagcucugcgaccaacacaucaacuaggccgauuaucaccguccauaagaguggaacagugacuguugcccagcaagcacaggugguaaccacggucgugggcggggugacaaagaccauaacucuggucaaaagccccauuuccguuccaggagguucugcucucaucucgaaucugggcaaggugaugagcguagugcagacaaaaccuguccagaccuccgccgugacugggcaagccucaaccggacccguuacacagaucauucagacgaagggcccacuuccugcugguaccauccugaaauuggugacaagugcagacgggaagcccacaaccauuauaacaacuacccaggccucuggcgcgggaacgaagccaacaauccucggcauuagcuccgucucaccgagcaccacuaaaccugggaccacaacuaucaucaagaccauucccaugucugcuauaaucacacaagccggagcaacgggcgugaccuccaguccagguauuaaaagccccaucacuauuaucacaaccaagguuaugacuucugggacaggagccccugcuaaaauaaucaccgcagugccaaagauugccacgggccacggucagcagggcgucacucagguagugcugaagggggcgcccggacaaccuggcaccaucuuacggacaguuccgaugggcggggugcgccuggucaccccagugacuguauccgcugugaaacccgccgucacaacccuaguugugaaggggacaacuggugugaccacgcucgggacagucaccggaacugugucaaccagucuggcaggcgccgguggccauagcacaucggcuucccuugccacuccuauuaccacguuggggacaaucgcaacccugucuagccagguuauaaaccccacugcuauuacaguaucagccgcgcagaccacucucacagccgcaggaggccugaccacgccaacuaucaccaugcaaccugugagucagcccacacaggucaccuuaauuacagcuccauccgggguggaagcccagccuguucacgaucugccggugucuauccuugcuagccccacuaccgagcaaccaacggcaacagucacuauagccgacuccggacagggcgaugugcagccugguaccguaacauuggucugcucaaaucccccaugugagacccacgaaacugggaccacaaacacggccacuaccacagugguugcuaaucucggaggccauccucagcccacccaagugcaguuugucugcgacagacaggaggcggcagccagccuggugacaaguacaguuggucagcaaaacggcucuguggucagggugugcuccaauccgccaugugaaacccacgagacggggacuacaaacaccgcuaccacugccacaagcaacauggcaggacagcauggcugcucgaauccucccugugaaacccacgagacagggacuacgaacaccgccacaacugcuaugucaucuguaggagcgaaucaucagcgugaugcccggcgagcaugcgcugccggcaccccagcagugaucagaauuaguguugccacaggugcucuagaggccgcgcaaggguccaaaagccagugucagaccaggcagacuucugcaacgagcaccacaaugacugucauggccaccggagcucccugcuccgccggcccucugcucggcccgucaauggcucgcgaacccgggggacggaguccagcauucgugcaacuggccccucuuagcucuaaggugagauuguccucacccaguaucaaagaccugccugcugguaggcacagccacgccgucuccacagcagcgaugaccagaucuucgguaggcgccggggagccacgaauggcucccgugugugagagcuuacagggaggcucaccuuccacuacaguuacggugaccgcccucgaggcacugcuuugcccaagugcuacugucacacagguguguucuaaucccccgugcgaaacccaugagaccgguacaacuaauacggccaccacaagcaacgcaggguccgcccagcggguuuguucaaauccuccaugcgagacucacgaaaccggaacaacccauacugcuacgacagcgaccucuaacggcggcacugggcaacccgagggaggucagcagccuccagccggccgucccugcgaaacccaccagacaacuagcaccgggacaacgaugaguguguccgucggagcacuguugccggacgcuaccagcucucacagaacuguggagucaggccucgagguagccgccgcaccuuccgugacaccccaagcugguaccgcccugcuagcgccauuuccuacucagaggguuuguaguaaucccccaugcgaaacacaugagaccgggacgacccacacagcuacuaccgucacaagcaacaugucgucuaaucaggaucccccuccagccgcauccgaccagggagaaguggagagcacucaaggcgauucagugaacauuaccaguucuuccgccaucacaaccacugucagcucaacgcugacacgcgcuguuaccacugugacccagaguacaccgguacccggcccuagcgugccacccccugaagaacuccaggucuccccagggccccggcaacagcugccuccgagacagcuuuugcagucugcaagcacggcccugaugggagaguccgcggaaguguuaucagcuucucaaaccccagagcuccccgccgcaguugaccugaguucgacuggugaaccuagcuccggccaggagucugccgggucagcuguggucgccacaguagugguucagcccccaccucccacccagagcgaaguggaucaacuuucccugccacaggagcuaauggcagaggcucaggccggaacuacaacccucauggucacaggccugacuccggaagaguuggcggugaccgccgcagcugaagccgcagcucaggccgccgcgacggaggaagcucaagcacuggccauacaggcugucuuacaggccgcacaacaggccgugauggguaccggggagccuauggacacaagugaggcugcggccacuguuacccaggcagaacucggacaucugucugcugagggccaggaaggccaagccacaacuauucccaucgugcuuacccagcaggagcuggcagccuugguacagcaacagcagcuccaggaggcucaagcccagcagcagcaccaucaucugccaacggaagcgcuagcacccgccgauagccugaaugacccugcuaucgagucaaacugucuuaaugaacucgccgggacagugccauccaccgucgcacuguugcccaguacugcuacagagagccuggccccuucuaacaccuucguugcuccgcaaccaguggucguggccucccccgcaaaguuacaggcggccgcuacucucaccgaaguagccaacggaauugagucacugggugugaaaccugaucuuccacccccucccagcaaggcaccaaugaagaaagagaaucagugguuugacguuggcgugaucaaggggacaaacgucauggugacgcacuacuuccugccgccugaugacgcuguccccucggaugacgacuugggaaccgugccagauuacaaucaacucaaaaagcaggaacugcagccuggcacugccuauaaauuuaggguugcagguauuaacgccugcgggcgaggacccuucucugagauaagugcguucaagacaugucuaccaggcuuuccuggcgcucccugcgccaucaagauuuccaaaagcccggacggggcacaucugaccugggaaccaccuucaguaacuuccggaaagaucauugaguacucuguguaucuugccauccagagcagucaagcugguggcgaacucaaauccagcacacccgcccagcuggcauucaugcgcgucuacugugggccaucucccucaugcuuggugcagaguuccagcuuaucuaaugcucacauagauuauaccacgaagccugccaucauuuuucggaucgcggcuagaaacgagaaaggauacggcccggccacacagguuagguggcugcaagagaccucgaaggacucaagcgguacuaagccagcaaauaaacgucccauguccaguccugaaaugaagucugcccccaaaaagagcaaagcugaugggcaguga

SEQ ID NO: 57119 - RNA, 2379 nt, Artificial Sequence
  derived and/or modified sequence opt3 from HCFC2__Homo_sapiens__NP_037452
auggccgcucccagccugcucaacuggagaaggguguccucuuucaccggcccugucccacgggcacgccacgggcaucgagccguugcgauccgugagcuuaugauuauauuuggagguggcaaugaagggaucgcugacgagcugcacguguacaacacagccacuaaucagugguucuugccggcaguaagaggagauauucccccuggcugcgccgcucaugguuuugugugugacgggacgaggaucuuagucuucggaggcaugguggaauauggccgguacucaaacgagcuguaugaacuacaagcaagucgcuggcucuggaagaaaguuaagccacacccgccuccaagcgggcugcccccuugcccaagacuuggacauuccuuuucucuguacgguaauaaauguuauuuguucggcgggcucgccaacgagucggaggauucaaauaacaaugugccgagguaccugaacgacuuuuaugaacuggagcuccagcacggaagcggcgucguggguuggaguauucccguaaccaaggggguugugccuuccccacgggaaucucacacagcugucaucuacugcaaaaaggauagcggaucccccaagauguacguguucggcggcauguguggggcccgcuuagacgaucuguggcagcuugacuuggagacuaugucauggaguaaaccugagaccaagggaacagugccacugccccgaagccuacauaccgcgucugucauagguaauaaaauguauaucuuuggcggguggguuccgcacaagggagaaaacacugagacauccccucaugauugcgaauggagauguaccucaucuuucaguuaccucaaucuggacacgacugaguggaccacacuugugucugauucccaggaagacaaaaagaacagcaggccccggccacgugcaggccacugcgccguagcuauugguacucgccuguauuuuuggucggggagagauggcuacaagaaagccuugaauagccaaguguguugcaaggaccucugguaucuggacaccgagaaaccucccgcaccaucccagguccaguuaaucaaggcuacaaccaacucauuccacgugaaaugggaugagguuaguacgguggaaggauaccugcuccagcuuagcacugaccugcccuaucaagccgcguccucugauagcucagccgcaccuaacaugcagggcgucaggauggacccacaucggcaggggaguaauaacauugugcccaauuccaucaacgauacaauaaauagcaccaagacugagcagcccgcuacaaaagaaaccucuaugaagaacaagccugacuuuaaagccuugacggauucaaaugcuauucuauacccaagucuggccagcaacgcauccaaucacaacucucauguaguugacaugcuccgaaagaaugagggaccccacaccucggccaacguggguguccugagcuccugucuugaugugcgcacagucaucccugaaacuucagugaguucuaccguuagcuccacacaaacuauggugacccagcagacaauuaaaaccgagucaagcucuacuaauggcgcuguagucaaggacgagacgucccugacaaccuucaguacuaaaagcgaaguggaugagaccuacgcguugccagcaacaaagaucucuagaguugaaacccaugccacugcuacacccuucuccaaggagacgccgucaaacccuguggccaccgucaaagcaggggaaaggcaauggugcgacgugggaaucuuuaagaauaacacugcccucguaagucaguucuaucuguuaccaaaaggcaagcagagcauuucgaaaguggguaacgcugacguucccgauuacucccugcuaaagaagcaggaccucgucccugggacaggcuaucgguuucgcguggccgcaauaaauggaugcggcaucgggcccuucucuaaaauuagcgaguuuaagaccuguaucccaggauucccuggugcgcccucagcugugagaauaaguaaaaacgucgagggcauucaccuguccugggaaccaccgacaucuccuagcgggaauauccuugaguacuccgccuauuuggcaaucaggacugcccaaauucaggauaaccccucacagcugguuuuuaugcguaucuacugcggacucaagaccagcuguauugugacggcuggccagcuggccaaugcacacauagacuauaccagucggccagcuaucguguuccgaauuucugccaaaaacgaaaaggguuacgggcccgcgacacaaguaagauggcuucagggcaauaacaagaaagccccucugaauuga

SEQ ID NO: 57120 - RNA, 1578 nt, Artificial Sequence
  derived and/or modified sequence opt3 from HCK__Homo_sapiens__NP_001165601
augggcgggagaagcuccugcgaggaccccggauguccuagggaugaggaacgggccccacgcauggguugcaugaagucuaaauuccuccaggugggcgggaacaccuuuucaaagacagaaacgagugcuagcccgcacugucccgucuacguuccugacccaacuuccaccaucaaacccggaccuaauucucauaacucgaauacaccaggcauucgagaggguucagaagauauaaucgugguagcacuguaugacuacgaggccauucaccaugaggaucuuagcuuccaaaagggggaccagauggugguccuggaagagaguggagaaugguggaaagcgcguuccuuggcuacuagaaaggagggcuauauccccucuaacuacguggccaggguugauagcuuagagaccgaagagugguuuuucaagggcauuucccggaaagacgcagaacgccagcugcuagccccugggaauaugcucggaucauuuaugaucagagauagugagacaaccaaggguagcuauucucuguccgugagggacuacgauccacggcagggcgacacugucaaacacuauaagauacgcacacuugauaacgggggauucuacaucucaccgcgaagcaccuuuaguacgcugcaagaauugguggaccauuacaaaaagggcaaugacggucucugccagaagcugucuguacccuguauguccagcaaaccucagaagccaugggagaaagaugcuugggagauucccagagaaucgcugaagcucgagaaaaaguuaggggcaggacaguucggcgaaguuuggauggccacuuauaacaaacacaccaagguggcugucaagacaaugaaaccuggcucuauguccguggaggccuuucuggcggaagcaaaugugaugaagacucuucaacacgacaaauuggucaagcugcaugccguugugaccaaagagccaaucuacauuaucacagaguucauggcuaaggggucacuacucgauuuucugaagagugacgaaggaagcaaacagccccuuccgaagcugauagauuucuccgcccagauugcagaggguauggcuuuuaucgaacagaggaacuauauucaccgggacuugcgugccgcgaauauccucguaucugccagccuggugugcaaaaucgcagauuucggcuuagcucgcgucauugaggacaacgaauacaccgccagagagggggcuaaguucccuauaaaauggacggcccccgaggcaaucaauuuuggaucauucacuauuaagagugaugugugguccuuuggcauccugcucauggaaauaguuacauaugguaggauuccauacccugggaugagcaaccccgaggugauccgggcccuugaacgaggcuaucgcaugccaagacccgagaauuguccugaggaacuguacaacaucaugaugaggugcuggaagaaccggccagaggaacgcccgaccuucgaguacauucaaucugucuuggacgauuuuuauacugcuacagaaucacaguaccagcaacagcccuga

SEQ ID NO: 57121 - RNA, 1461 nt, Artificial Sequence
  derived and/or modified sequence opt3 from HCLS1__Homo_sapiens__NP_005326
auguggaaaagcguggucggccacgacguuuccgugucuguagagacccagggggaugacugggauacagaccccgauuucgugaacgacaucucagaaaaggagcaaagauggggagccaagacuauugaagguaguggcaggacggagcauauaaauauccaccagcugcggaacaaagucagcgaagaacaugaugugcuccgcaagaaagagauggaauccgggccuaaggcuucucacggauacggcggucgauuugggguugagcgugacagaauggauaagucggcagugggacaugaauaugucgccgagguggagaaacacucaagccagaccgacgcggcuaagggcuucggcgggaaauacggaguagaaagggaucgggccgacaagagugcaguugguuuugauuauaaaggcgagguggaaaagcacacaucccagaaggacuacucucgcggguucggaggcagauauggugucgagaaagacaagugggauaaagccgcucuuggguacgacuauaagggagaaacugagaaacaugagagccaaagggauuacgcaaagggcuuuggcgggcaguacgguauucagaaagaccggguggauaaguccgccgugggauucaaugaaauggaggcuccaaccacagccuauaagaaaaccacuccgaucgaagcggcaucaaguggcacacgcgggcugaaggccaaauuugagagcauggcugaagagaagcgaaaaagagaggaagaggaaaaggcccagcaagucgcaaggcggcagcaggagcguaaggcuguuaccaaacgcucucccgaagccccucagccagugauugcgauggaggagcccgccguaccugcaccauugcccaagaaaaucuccucagaggcuuggccuccagugggaacgccgcccagcagugagucugaaccugucagaacuuccagggagcacccagugcccuuacugccuauacggcaaacccuaccagaggacaacgaagaacccccggcccucccuccccgaacacuggaaggccuucagguugaggaggagccaguguacgaggcugaaccugagcccgaaccagagcccgaaccugagccagagaaugauuaugaagacgucgaggaaauggaucgccaugagcaggaagacgagccggagggugauuacgaagaggugcuggaacccgaggacagcucguucucuuccgccuuggcagggucaaguggcugcccugccggagcuggcgcgggggcaguagcccucggaaucagcgcuguugcccuguaugacuaccaaggugagggcuccgaugaacugucuuuugacccagaugacgugauuacugauaucgagauggucgacgaagggugguggagaggaaggugucacggccacuucggucucuuucccgcaaacuaugugaaguuacuggaguga

SEQ ID NO: 57122 - RNA, 2673 nt, Artificial Sequence
  derived and/or modified sequence opt3 from HCN1__Homo_sapiens__NP_066550
auggagggcgggggaaagcccaacagcuccucuaauucaagagacgaugguaacaguguguucccugccaaagcuagcgcaaccggcgccgggccagcggcugccgaaaagaggcugggaacaccgcccggcggugggggagcaggcgccaaagagcacggcaauuccgucugcuuuaagguugacgggggagguggcgggggaggcggugggggaggcggcgaggaaccugcugggggauucgaagaugcagaggguccacggcgccaguacggcuuuaugcaacgacaguucacuucuaugcuccagcccggggugaacaaauuuucgcuucguauguucggaucacagaaggccguagagaaggaacaagagagagugaaaacggcuggcuuuuggaucauucauccuuauagcgacuucagguuuuacugggaucugauaauguugaucaugauggucgguaauuuagugauuaucccaguugggauuaccuucuuuacagaacagacuaccacacccuggaucauauucaacguggccagugacaccgucuuucugcuagaucucaucaugaauuuccggacuggcacagugaacgaggacuccucugagauuauccuggauccuaagguaauuaaaaugaauuaucuuaagagcugguucguuguggacuuuaucuccucaauaccagucgauuacauuuuccugaucguggaaaaaggaauggacagugagguguauaagaccgcgcgcgcauugagaauugucagguuuacgaagauccucagccugcugcggcucuuacgccugucucgacuuaucagauacauucaccagugggaagagauauuccauaugacuuaugauuuggccuccgcuguugugaggaucuuuaaccugauuggcaugaugcuacuccugugucacugggacgggugccuucaguuccugguaccguugcuccaagacuuucccccugauuguugggugucacugaaugaaauggucaacgacagcuggggaaaacaguacaguuacgccuuauucaaggcaaugucucauaugcugugcaucgguuauggcgcucaggccccaguguccaugagcgaucucuggauaaccaugcuuucgaugauuguuggggcgacauguuacgccauguuugugggacacgcaacugcucugauccagucuuuggacuccucacggcgucaauaucaggagaaauacaagcaggucgagcaauauaugaguuuccacaaacuacccgccgauaugcgccagaagauccaugacuacuaugaacacagauaccagggcaaaauuuuugaugaggaaaauauccugaacgagcucaaugacccucugagggaagagauugugaacuucaacugccggaaacuuguagcuaccaugccacuguuugccaaugcagaucccaacuucguuacagccauguugagcaagcuccgauucgagguguuucagccgggugacuacauaauccgcgaaggggcugucggcaagaagauguauuucauucaacauggaguggcgggcgucaucaccaaauccucuaaggagaugaaacugacggaugggagcuacuuuggagaaaucuguuuacugacuaaggguagaaggacagcaucagugcgggccgacaccuauugccgccuauacagucucuccguugacaauuucaacgaggugcuggaagaguauccuaugaugagaagggcuuuugagacuguagccauugaucgucuugaccggauaggcaagaaaaauagcaucuugcugcagaaguuccagaaagaucucaacacaggggucuuuaauaaccaggaaaaugagauucugaagcaaaucgugaaacacgaccgagaaaugguucaggcaauugcccccaucaacuacccacagaugaccacgcuuaauucuaccucaaguacaacuaccccuacaagcagaaugaggacucagucucccccaguguauaccgcuacaucccugucgcacagcaacuugcauucccccucaccuaguacccaaacuccacagccgucugccauacucagccccuguuccuacacgacagcagucugcucaccuccagugcagagcccccuggcggcucgcaccuuccacuacgccucuccuacugcaucccaguuaagucugaugcaacagcagccacaacagcagguacagcaaagccagcccccgcagacccagccucaacagccaucuccccagccucagacacccggauccucaaccccaaagaaugaggugcauaagaguacucaagcccuacacaacacaaaucucacgcgggagguuagaccucugagcgcuucgcagcccucccuuccacaugaagucucuaccuugaucagcaggccgcacccuacugugggcgagucacuggccaguauuccccagccagugacagcaguccccgguaccgggcuccaagcuggcggacgcuccacaguuccucagcgagugacucuguuucggcagaugucuagcggcgccaucccacccaaccguggggugccuccggcgccacccccuccagccgcugcauuacccagagaauccucaagcguacugaacaccgauccugacgccgagaaaccgagguucgcuaguaaucuuuga

SEQ ID NO: 57123 - RNA, 2670 nt, Artificial Sequence
  derived and/or modified sequence opt3 from HCN2__Homo_sapiens__NP_001185
auggacgccagaggcgggggagguaggcccggcgagagcccuggggcuaccccagcaccgggacccccuccacccccuccacccgccccuccacagcaacagccgcccccuccacccccuccagcgcccccgccuggccccgguccagcuccuccccagcacccaccccgggccgaagcacugccuccagaggccgcugaugaagggggaccgcgcggccgacuccguuccagagacucuucaugcggcaggcccgggacaccuggagcagccaguacugcuaaggguagcccaaacggcgagugugggcggggagaaccccagugcuccccugccggcccagagggucccgcgcgcgggccgaaagugucuuucucguguagaggagcagccucaggcccugcuccaggccccgggccugccgaggaagcaggaagcgaggaagcuggucccgccggcgagccaagggggagucaagcguccuuuaugcagcggcaguucggagcccuucugcagccuggcgucaauaaguuuucuuugcgcauguucgguagccaaaaagcaguugagcgagaacaggagagagugaaguccgcuggggccuggaucauucaucccuacucagauuuuagguucuauugggacuuuacgauguuacuguucaugguaggcaaccuaauaaucauuccagugggaaucaccuuuuucaaagaugaaacaacugcuccguggauugucuuuaaugugguuagugacaccuucuuucucauggaucuggugcuuaacuuccggacaggcaucgucauagaggacaauaccgaaaucauucuggauccugagaagaucaagaaaaaguacuugcguacuugguucgugguagacuuuguuagcucuauucccguggauuauaucuuccucauagucgagaaagggauugacuccgaaguguacaagacagcccgcgcacugagaaucgugagguuuaccaaaauucugucacucuuacggcugcuucgauugagccgccugaucagauauauccaccagugggaggaaauuuuccauaugacguacgaucuagccagugcugucaugaggauaugcaaccucaucucuaugaugcugcuucugugucacugggacggaugcuugcaguuucucguuccaaugcugcaagacuucccccggaauuguuggguguccauuaacgguaugguaaaucauagcuggucggaguuauauucuuuugcgcuguucaaggcaaugucccacaugcucugcaucggcuacgggcgccaggccccugaaucaaugacugauauauggcuuaccaugcugaguaugauugugggagcuacauguuacgccauguuuaucggccacgcaacugccuugauccagagccuagacuccucuagaaggcaauaucaggagaaguacaaacaggucgagcaguauaugagcuuccauaagcugccagcugauuuucgucagaaaauucacgacuacuaugaacaucgguaccaagguaagauguucgaugaggacucaauccucggggaacugaacggcccccuucgagaggaaauugugaauuuuaacugcagaaaacugguugccaguaugccuuuguucgcaaaugcggauccgaacuucgugaccgcuaugcucacaaagcugaaauuugaggucuuccagccaggagacuauauaaucagggagggcaccauugggaagaagauguacuuuauccagcacggagugguauccguuuuaacgaaagguaauaaggaaaugaaacugagcgauggcucuuacuucggggagaucugucuacucacucgcggacggagaacagccucagugagggcagacaccuauugccgccuguacagucuuagcgucgauaacuuuaacgaaguguuggaggaguaucccaugaugcgacgggccuucgaaacugucgcuauugaccgucuggacagaauaggcaagaaaaauuccauccuccugcacaaggugcaacaugaucuuaacucugguguuuuuaauaaccaggagaaugccauuauccaggaaauugugaaguacgacagggagaugguacagcaagcagaacuggggcagcgcgucggcuuguucccuccacccccuccgcccccacaggugacaucggcuaucgccacccuccagcaagcggccgcuaugagcuuuugcccucagguugcacggccccuggugggaccauuagcccugggcuccccuaggcuagucagacgacccccaccggggccugcucccgccgcagcgucaccaggacccccuccacccgccaguccuccgggcgcuccagccucuccccgcgcaccucggacgagccccuauggugggcucccagcugccccucuggcaggacccgcccuuccagcuagaagguugucccgugcgucacgcccucugagcgccucucagccgucccucccccacggcgcaccagguccugcugccaguacccggcccgccucuagcuccacaccaagacugggcccuacucccgcugcaagggccgcggcuccgucaccagaucgacgggacagugccagcccuggggcagccggaggcuuagauccccaagacucggcucgcuccagacugucuagcaaccuuuga

SEQ ID NO: 57124 - RNA, 2325 nt, Artificial Sequence
  derived and/or modified sequence opt3 from HCN3__Homo_sapiens__NP_065948
auggaggccgaacagagacccgcugcaggcgccagcgagggggcgaccccuggacuggaagcugugccaccggucgccccuccuccagcaacagccgcuuccggucccaucccuaagucuggcccagagcccaaaaggcggcaccucgggacucuucugcaaccuacgguuaacaaguucucauugcgcguguuuggaagucauaaagcaguagaaauugagcaggagcgagucaagagcgccggcgcuuggauaauccacccauacuccgacuuccguuuuuauugggauuuaauuaugcugcuacucaugguggguaaucugaucgugcuuccgguugggauuaccuucuuuaaagaagagaacucucccccuuggaucguguucaauguccugucggacacauuuuucuugcucgaucuggugcugaacuuuagaacuggaauaguaguugaagagggcgccgagauccucuuagcgccaagggcaauucggacccgcuaccugagaacaugguuccuuguggacuugaucucaagcauucccgucgauuauaucuuucuggugguggaacuagagccuaggcucgacgccgaagucuacaagaccgcucgggcccugcgcauaguucgauucacuaagauucuuagucuguugagacuccugagguuaucccggcugauccguuauauucaucagugggaggaaaucuuucacaugacauacgaucucgcaucugcugugguacgcaucuucaaucuuauuggcaugaugcuguugcuaugccauugggacgggugucugcaguuccucgugccaaugcugcaagauuuucccccggacugcugggucagcauaaaccacauggugaaucacuccuggggaagacaguauucacaugcccuuuucaaagcgaugagucacaugcuguguaucgguuacggccagcaggccccuguugggaugcccgaugugugguugaccaugcucagcaugauugucggagcaacgugcuacgcuauguuuaucggccaugccacugcucugauacaaucuuuagacuccucaaggcggcaguaucaggagaaguacaaacagguggagcaauauaugagcuuccacaagcugccagccgauacccgacagcgcauucacgaauacuaugagcauagauaccaggguaaaauguuugacgaagagaguauccuaggggaacucucugagccucugagggaggaaaucauuaacuucacaugucggggacuuguagcacacaugcccuuguuugcccaugcugacccauccuucguuacugcggugcugaccaagcuccgcuuugaggucuuccaacccggcgaucugguggucagagaaggcagcguggggaggaagauguauuuuauccagcacggacuucugucgguuuuggcacguggugcccgggacacacgacucaccgauggcucuuacuucggggagauuugccuguuaacgagaggaaggcgcacugcuuccgugcgggccgacacauacuguagacuguauucacuaaguguagaucauuuuaaugcaguccucgaagaguucccuaugaugaggcgcgccuucgagaccguggcuauggaccgacugcuucggauaggcaaaaagaacagcaucuugcagcguaaaagauccgaaccaucuccggguagcucagggggcauuauggagcagcaccugguucaacacgauagggacauggcccgcggagugcggggcagagcacccaguacuggggcgcagcucuccggaaagccuguccugugggaaccauuagugcaugcuccccugcaggccgcagccguaacaagcaauguggcuaucgcccuuacccaccagagggguccuuugccacucucucccgauucaccggcaacgcugcuagcucgaagugccuggcgcagcgcgggcuccccugccucuccacugguucccguccgggcugggccuugggcaucgaccagcagacuccccgccccacccgcuaggacacugcaugccucccuuucacgugcaggacgcagucaagugucuuugcugggucccccaccgggcgggggcggacggagauuaggcccuagggggcgaccccucagcgcgucccagccaucacugccccagcgggccacuggagacgguagcccuggccgcaaagggucuggauccgagagacuuccacccaguggccuguuggcuaagccuccgaggaccgcccagccaccccggccuccagugcccgagccugcaacaccgcgaggucuccaacugagcgcuaacauguga

SEQ ID NO: 57125 - RNA, 3612 nt, Artificial Sequence
  derived and/or modified sequence opt3 from HCN4__Homo_sapiens__NP_005468
auggacaagcugcccccuagcaugagaaaaaggcucuacucccuuccacagcaagugggcgccaaggcuuggaucauggaugaggaagaggacgcagaagaggaaggggccggaggucggcaggauccgucucgccgaucaauucgucugagacccuugccuaguccaagccccuccgcggcugccggcgggaccgagucuaggucgucagcauuaggagccgcugacagcgagggcccugcacggggugccgggaaaaguuccacaaacggagauugccgcagauucaggggcucucuggcuagccuaggcuccagagggggagguucaggcgggacuggaaguggcagcucucacggucaucuccacgacuccgccgaggaacgccgacugauagcggaaggggaugcaucaccaggagaggacagaacgcccccuggccuugccgcugagccagaaaggccgggcgccagcgcacagcccgcugccaguccuccacccccucagcaaccaccccagccggcgucugccuccugugagcagccuagcgucgauaccgcaaucaagguugaagggggagcugccgcuggugaccagauucugcccgaggccgaagugcgguugggccaagcaggguuuaugcagcgucaguucggagccaugcuccagccaggcguaaauaaauuuucgcugcgcauguucgguucucaaaaggcuguggagagagagcaggaaagggucaaguccgcgggguuuuggaucauucauccuuauucagauuuccgguuuuacugggaccugacaaugcucuuacugauggugggcaaccuuaucauaauccccguuggaauuacuuucuuuaaagaugagaauaccacaccauggaucguguucaacgucgugagugacaccuuuuucuugauugaccugguacuaaauuuucgaacuggcaucguuguggaagauaacacagagauaauucucgacccccagcgcaucaagaugaaauaucucaagagcugguucauggucgauuucauuuccucuaucccuguggacuacaucuuucuuauuguggaaaccagaauagauagcgaggucuauaaaacggcaagggcccugcggaucguucgcuucacuaagauuuugucacuccugagauuacugaggcucagucgucuuauccgguacauacaccaaugggaggaaauuuuucauaugaccuaugaccuggcuuccgccgugguacgaaucgugaauuugaucgggaugaugcuacugcucugccacugggauggaugucugcaguuccuugucccaaugcugcaggacuuuccggaugacugcugggugagcauuaacaauaugguuaacaauucuugggguaagcaguacucauacgcauuguucaaagccaugagucacaugcucuguaucggcuaugggagacaagcucccgugggaaugagcgaugucuggcugacaauguuauccaugauugugggcgccacuugcuacgcaauguuuauaggucaugcgaccgcucugauccagucucuagacucgagcaggcgccaguaucaggagaaguacaaacaaguagaacaguauauguccuuccacaagcucccuccagacacacggcagcggauucaugauuacuaugagcacagguaccaggggaaaauguuugacgaagagucaauccugggcgagcuuagugaacccuugcgcgaggaaaucauuaacuucaauugucgaaagcugguugccucuaugccucucuuugcaaacgccgauccaaauuucgugaccagcaugcugacgaaacuucgguuugaggucuuccaacccggagacuacauaauccgugagggcacuauugggaagaagauguauuucauccagcacggaguggucuccgugcugacaaaagguaacaaggaaaccaaauuggcugauggcucauacuuuggggagauuugccuccugacuagaggaaggcgcacagccagcguucgggcagacaccuauuguagauuauacucucuguccguggauaacuucaaugaaguacuagaggaauauccgaugaugaggcgagcuuuugagacggucgcccucgaccgccuggaucggaucggcaagaaaaacaguauacuuuugcauaaggugcagcacgaccugaauagcgguguuuucaacuaccaggagaaugaaaucauucaacagaucgugcagcaugauagagagauggcgcacugcgcccauaggguccaagcugcagccucugcuaccccuacaccaacucccgugauuuggaccccucucauccaggccccucugcaggcagcggccgcuacaacuuccguagccauagcauuaacccaccacccacgucugccugcugccauuuuucggcccccaccggggucaggccuuggaaacuugggcgcagggcagacaccucgccaucucaagagacugcaaagucuaauccccagcgcccugggaucggcuuccccagcgucuagccccucacagguggacaccccuaguuccucuagcuuccacauucagcagcucgccggcuuuuccgcaccagcuggucugucaccccuuuugccuagcaguucuuccagcccgccacccggggccuguggaucgccuucagccccaacucccucugcuggcguugcagccacgacaaucgcggguuucggccauuuucacaaagcucugggagggaguuuauccagcucugauagcccucuccugaccccgcuucaacccggcgccagguccccacaggcagcccagccuucacccgcuccaccuggggcacgaggaggccuggguuugcccgaacacuuccucccaccgccucccaguagccggucuccauccucaagucccgggcagcugggacaaccuccaggcgagcuaagccugggucucgccacuggcccccuguccaccccugaaacaccgccacgccagcccgagccucccucucuugucgcgggggcuucgggaggcgccagcccagugggguuuaccccuagaggaggcuugucacccccaggucauuccccugggccgcccaggacuuucccaagugcaccuccccgggccucuggaagccacggcucccuguuacucccacccgcuucaucucccccgccaccucaggugccccaacgaagagguacaccaccccugacgccuggccgccuuacccaggaccugaagcuaauaagcgccagucagccggcacucccccaggacggggcucaaacucugaggcgugccuccccacauagcucuggagagucaauggcggccuuuccuuuguucccccgggcaggcgggggauccggcgguagugggagcucgggaggccugggcccuccagggagacccuauggagcuaucccuggucagcacgucacauuaccaaggaaaaccucuuccggcagccugcccccgccucugucacuuuucggggcccgcgcuacaaguucuggaggcccaccccugacugcagguccucagcgagaaccaggggccagacccgagccgguucgguccaaguugccuagcaaucucuga

SEQ ID NO: 57126 - RNA, 396 nt, Artificial Sequence
  derived and/or modified sequence opt3 from HCRT__Homo_sapiens__NP_001515
augaaccugcccagcaccaagguguccugggccgcugucacacuccuucuguuguuacugcuacucccuccagcacugcuuucuucaggcgccgcggcucagccgcugcccgacugcuguagacagaaaacuugcaguuguagguuguacgagcuccugcacggggccggaaaucaugcagccgguauccugacgcucggcaagcggcgcagcgggccuccaggauuacaaggccgacugcagcgucuuuugcaggcuuccgguaaccacgcagccgggauucugaccaugggaagaagggcuggcgccgaacccgcgccucggccaugccuaggccgcagauguucugcacccgccgcugccucgguugcaccugggggacaaucagguauauga

SEQ ID NO: 57127 - RNA, 1335 nt, Artificial Sequence
  derived and/or modified sequence opt3 from HCRTR2__Homo_sapiens__NP_001517
augagcggcaccaagcuggaggacucucccccuugcagaaacugguccucagccagugaacucaaugagacacaggaaccauuccuuaacccgacugauuacgacgaugaggaauuucugagguauuuguggcgggaguacuuacaccccaaggaguaugaaugggugcugaucgcuggguacauuauagucuucguuguggcacuaaucggaaauguacucgugugugucgccguguggaagaaccaucacaugcgcacgguuaccaauuauuuuauugugaaccugagccuugcggacguccuggugacaaucacuugcuugccugcuacccucguaguugauauuacagagaccugguucuuuggucaaucccuguguaaagugaucccauaccugcagacugucucugugucggugucaguccucacauuaagcugcauagcccuggaccgaugguaugcaaucugucauccccuuauguucaagaguaccgccaaacgugcuagaaauuccauuguuaucauuuggaucgugucuugcauaauuaugaucccucaggcaauuguaauggaauguagcacgguguuuccaggcuuggccaacaagacuacccuguucacagucugcgaugagagguggggaggggagaucuaccccaagauguaccacaucuguuucuuccuagugacuuauauggcuccucucugccugaugguucuugccuaccugcagauuuuucggaaauuguggugucgccaaauaccaggcaccuccucagugguccagagaaaguggaaaccgcuccagcccgugagucagccuagggguccagggcaacccacaaagagccggaugucugcgguagcagccgaaaucaaacagauucgcgcucgaagaaagaccgccaggaugcugaugaucguuuuacugguguucgcaauaugcuaucucccuauuuccauccuuaauguccugaagcggguguuuggaauguucgcucauacggaggaccgugaaacugucuacgccugguucacauuuucacacugguugguguaugcgaacagcgccgcaaauccaaucauuuacaacuuccuaaguggcaaauuucgcgaggaauuuaaggcugccuuuucuugcuguugccugggcguucaccauagacaggaggauaggcucacccgggggcgaacuuccacagagagccgcaaaucgcugaccacgcagaucucuaauuucgacaacauuuccaaacuuucagaacaagugguacugaccaguauaagcacauugcccgcugccaauggagcagguccgcuccagaacugguga

SEQ ID NO: 57128 - RNA, 279 nt, Artificial Sequence
  derived and/or modified sequence opt3 from HCST__Homo_sapiens__NP_001007470
augauccaccugggccauauucucuuccuucuguuguuacccguggccgcugcacagaccacaccuggggagagaagcucccugccagccuuuuacccgggaacuucugguucaugcaguggcugugggagccuaucccucccccugcuugcgggacuggucgcugccgacgcaguugccucuuugcucauagugggcgcuguauuccugugcgcaaggccucggcgcucgccagcccaagaugguaagguguauaucaacaugcccgggcgaggauga

SEQ ID NO: 57129 - RNA, 1950 nt, Artificial Sequence
  derived and/or modified sequence opt3 from HDAC10__Homo_sapiens__NP_001152758
augggcaccgcccugguguaccacgaggacaugacagcuacuagacuccuuugggaugaccccgaaugcgagaucgaaaggccugagcggcugacggcagccuuggaucgcuuacgacagcgugggcuggaacaaagaugucuaaggcucagcgcgcgggaggcuuccgaggaggagcugggacuuguccauucuccagaauauguuucacuggugcgcgagacccagguauuggguaaggaggaacuccaggcccugaguggccaguucgacgcaauuuacuuucacccgagcacauuccauugcgccagacuggcugcaggggccggacuccaauuaguggaugcuguccugacuggcgccgugcagaacggucuugcguugguuaggcccccugggcaccauggacagcgggcagccgcuaauggcuuuuguguguucaacaaugucgccauagcagcugcccacgcgaaacagaagcacggccugcaucgcauccuagugguagacugggauguucaccaugggcaagggauucaguaucucuuugaggacgauccauccgugcuguacuucucuuggcaccgauaugaacacgguagauuuuggcccuuccuuagggagucggacgccgaugcagucggccgggggcagggacugggcuuuaccgugaacuugccuuggaaucagguggguauggggaacgcugacuacgucgccgcuuuccuccaucuguuacugccacucgccuuugaaggacaaaugcaggcaacacccgagugcuucgcccaccuuacccagcuguugcaaguucuagcuggcggccgugugugugcgguacuggagggaggauaucaucucgaaucacuggcagagagcgugugcaugacuguccagacacuucugggugauccugccccaccguugaguggccccauggcuccuugucaguccgcccucgaaucuauccagagcgcacgcgccgcucaagccccacacuggaaaucccugcagcagcaggacgugaccgcaguucccaugucaccuaguagccauucuccagaggggagacccccgccuuuacugcccggaggcccagugugcaaggcggcugccuccgcaccuucaagccuacucgaccaacccugucugugcccagcccccagugucaggacggcuguggcccuuacuaccccugauauuacauugguacugccaccggacguuauccagcaggaagcaucugcucuccgggaggagacugaagccugggcgcgaccccacgagucccuggcccgcgaagaggcucuuaccgcacuggguaaauugcucuaccuguuagaugggaugcuggacggccaggugaauagcggaauagccgcuaccccugccucggcagcggccgcuacacuagaugucgccgugagaaggggccucucucacggggcacaacggcugcuuugugucgcuuugggacagcuggaccgcccacccgaucucgcccaugacgguagaucccugugguuaaacaucaggggcaaggaagcagccgcucugucaauguuucacgugaguacgccucuuccaguuaugacugggggauucuugagcugcauucucggccuggugcuaccccuggcguacgguuuccagccggaucucguacuggucgcccuugggccuggccauggauugcagggcccacacgcagcucuguuagccgccaugcuccgugggcuggcuggaggucgggugcuugcacuguuggaggaaaauuccacaccccaacucgccggcauccuggcgcgaguucuaaacggggaagcuccucccucucugggaccaagcucaguggccaguccugaggacguccaggcacucauguaucugagaggccagcuugaaccccaauggaagauguugcagugccacccacaucugguggccuga

SEQ ID NO: 57130 - RNA, 891 nt, Artificial Sequence
  derived and/or modified sequence opt3 from HDAC11__Homo_sapiens__NP_001129513
augggccuggagaagcuccaccccuucgacgccgggaaauggggaaaggugaucaacuuucuuaaagaagagaagcuguugagcgauuccauguuagucgaagcuagagaggcaucugaagaggaccugcuaguugugcauaccaggcgguaccucaaugagcugaaacgcaagguacuucgaccucugcguacacagacugguggcacgauuauggccgggaaguuggcgguggaaagaggaugggcuauaaacgucggcgguggguuccaccauugcucaagugauaggggaggcggcuuuugugccuaugcagacaucacccucgccauuaaauuccuguuugagcggguggaagggaucagccgcgcuacaauuaucgaucuggacgcacaccaaggaaauggucaugagagagauuucauggacgauaagaggguuuacauaauggacguguauaaccggcacaucuacccaggcgaucgcuuugccaaacaggcuauucgaagaaaggucgagcucgaaugggggacugaggacgaugaauauuuagacaaaguggagaggaauaucaagaagucccugcaggaacaccuuccggacguaguuguguacaacgccggaaccgauauuuuggagggcgaccggcugggugggcuaucuaucucgcccgcgggaauagucaaacgugaugagcucguguuccgcauggugagaggcaggcgggucccuauucugaugguuacaucaggcggguaucagaagcgaaccgcacgcaucauugccgacagcauccuuaaucuguuuggauugggucucaucggcccagaaagucccuccgugucugcucaaaacagcgauacuccucuguuaccacccgccguaccuuga

SEQ ID NO: 57131 - RNA, 870 nt, Artificial Sequence
  derived and/or modified sequence opt3 from HDAC1__Homo_sapiens__XP_011539611
augaccgugagcuuccacaaguacggcgaguauuuucccgggacaggagaccugagagauaucggugccggcaaagggaaguacuaugcugucaacuacccucucagggacggaauugaugacgaauccuaugaggcaauauucaaaccaguuaugucuaaggugauggaaauguuucagccgucagccguagugcuucaaugcggcagugauagccuguccggugaccgguugggguguuucaauuuaacuaucaaaggacaugcgaagugcgucgaguuugugaagucuuucaaccugcccaugcuaaugcucggcggcgggggauacacgauucgcaauguugcucgauguuggaccuaugaaacagccguggcacuggauacugagaucccuaacgagcuuccauacaaugacuacuuugaauauuucggucccgauuuuaaacugcacauuucgccuucaaacaugaccaaucagaacacaaaugaguacuuggaaaagaucaaacagcgucucuucgagaaccugagaaugcugccacaugcccccggcguccagaugcaagcuauaccugaggacgcaaucccagaagagagcggggaugaagacgaggaugacccggacaagaggauuaguaucugcuccucugauaaacggauugccugugaagaggaguuuagcgacuccgaagaggaaggagagggcggucgcaaaaauucaaguaacuucaagaaggcuaagagagugaaaaccgaagaugagaaggagaaagaccccgaagagaagaaagaaguaacugaggaagagaagacaaaggaggaaaaaccugaggccaaggggguuaaagaagaggugaagcucgcguga

SEQ ID NO: 57132 - RNA, 1467 nt, Artificial Sequence
  derived and/or modified sequence opt3 from HDAC2__Homo_sapiens__NP_001518
auggccuacagccagggcgggggaaagaaaaaggugugcuauuacuaugacggugauaucggcaacuacuauuacgggcaaggacaccccaugaaaccucauagaauuaggaugacccacaaucugcuccuuaacuauggccuguaccggaagauggagauauaccgcccacauaaagcuacagcagaagagaugacuaaguaucacuccgacgaauacaucaaguucuugcgaucuauucguccggauaauaugucagaguauaguaaacagaugcagagauuuaacgucggugaagacugucccguuuucgauggguuauuugaguucugccagcugagcacgggaggcuccguggccggcgcgguaaagcuaaauaggcaacagaccgacauggcugugaacugggccgggggacuccaucacgccaaaaagucugaggcaucggguuuuuguuacgucaaugauaucgugcuggcuauucuugaacuguugaaauaucaccagcggguucucuacaucgacauagauauccaucacggcgacgggguggaggaagcauucuauacaacugaucgcgucaugaccgugucauuucauaaguacggagaguacuucccuggcacaggugaccugagagauauuggggccggaaagggcaaauauuacgcuguaaacuuuccaaugagggacggcaucgacgaugagagcuaugggcagauuuucaagcccaucauaaguaaaguuauggaaauguaccaaccuuccgccgugguccugcagugcggagcggacucucucagcggugaucgguuaggcuguuuuaaucugaccgugaaggggcacgcaaaaugcguggaggucguuaagacuuucaaccuuccauugcugaugcuaggaggcgguggguauacaauucgcaauguggcccgauguuggaccuacgaaacggcuguagcccucgacugcgagauccccaacgaacugccuuauaaugauuacuuugaguacuucggcccagacuucaaacuucacauuuccccgucaaacaugacuaaucagaacacccccgaguauauggaaaagaucaagcagagacuguuugagaacuugaggaugcucccucaugcaccaggagugcaaaugcaggcuauccccgaagaugccguccacgaggacaguggcgaugaagacggggaggauccugacaaacggauuagcauacgugcgucugacaagcgcaucgccugugaugaggaguucuccgacucagaagaugaaggagaggguggcagaaggaauguggcagaccauaaaaagggggcuaaaaaggcccggauugaagaggauaagaaagagacagaagacaagaaaacugauguuaaggaggaagacaaaagcaaggauaacaguggagagaagaccgacacaaaaggcaccaagucugagcagcuguccaauccauga

SEQ ID NO: 57133 - RNA, 1287 nt, Artificial Sequence
  derived and/or modified sequence opt3 from HDAC3__Homo_sapiens__NP_003874
auggccaagaccguggcuuacuucuaugaccccgaugucggcaacuuucacuacggggcaggacauccuaugaaaccacacagacuggcccucacacauagccuuguucugcacuaugguuuguacaagaaaaugaucguguucaagccguaucaggcgucccaacaugacaugugcagguuucacucugaggauuacauugacuucuuacagcggguaucacccacuaauaugcagggcuuuacgaaaagucugaacgcuuucaaugugggggaugacuguccugucuuuccaggacuauucgaauuuugcagccgcuauaccggcgccucccuccagggugcaacacaacugaacaauaagauaugugauaucgccauuaacugggcugggggacuucaccaugcaaagaaauucgaggccucuggcuuuugcuacgugaaugacaucguuauuggcauccuggaauugcucaaguaccacccccgagugcuguauauagauaucgacauucaucacggggauggaguccaggaggcuuucuaccugacugaccgugugaugaccguaucguuucacaaauaugguaacuacuucuucccuggcacaggggauauguaugaaguuggagccgagucaggcagauacuauugucucaaugugccauuaagggacgguaucgacgaucagagcuacaagcaucuguuucagcccgucauuaaccaagugguggacuucuaccagccuaccugcaucguccuucaguguggggcggauaguuugggaugcgaccggcugggcuguuuuaaucuauccauacgcggccacggggagugcguugaauaugugaaaucuuucaacauuccacuccugguacuuggagguggcggguacacugugagaaaugucgcaagguguuggacauaugagaccagccuguugguggaagaggccaucuccgaggaacucccguacucagaguauuuugaauacuucgcucccgauuuuacgcugcauccugacguuaguacucggauugagaaccagaauagccgccaauauuuagaucagauccgacagaccaucuucgaaaaccugaagaugcucaaccacgccccaucugugcaaauucaugacguccccgcagaucuucugacauacgacagaacugaugaggcugacgccgaggaaaggggaccugaggaaaauuacucccggccagaggcgcccaacgaauuuuaugacggcgaucacgacaaugauaaggagucagacguggagauauga

SEQ ID NO: 57134 - RNA, 3255 nt, Artificial Sequence
  derived and/or modified sequence opt3 from HDAC4__Homo_sapiens__NP_006028
augagcucccagucucaccccgacggccugucagggagagaucaaccuguggagcuccuuaacccagccagggucaaucauaugccgaguaccguugacguggcuacagcacugcccuugcagguagccccuagcgcggugccaauggauuuacggcuggaccaccaguucucccuacccgucgcugaaccugcccuccgcgagcagcaacugcagcaggaacuucuggcauugaagcagaaacaacagauccagcgacagauucucauagccgaguuucaacgucagcaugaacagcugucuagacaacacgaggcucagcugcaugagcacaucaagcagcagcaagaaaugcucgcaaugaaacaccagcaggaguuacuggaacaucagaggaaacuugagcggcaccgccaagagcaggaauuggagaagcagcauagagaacagaagcugcaacagcuaaagaacaaagagaagggaaaagaaucggccguggcuucaacugagguuaagaugaaacuccaggaguucgugcugaauaagaagaaagcccuugcgcacaggaaccugaaucacugcauuagcagugauccacgguacugguaugguaagacgcagcauuccucuuuggaccaaagcucucccccucagucaggcgucaguaccagcuacaaccacccagugcucgggauguaugaugcaaaagacgauuuuccgcugcgcaagacagccucugaacccaauuuaaaacugcgauccagacucaagcagaaaguagcugagaggcggucaagcccucuucugcgucgcaaggacggaccaguugugacugccuugaagaaaagaccccuagaugucaccgacagugcauguucuuccgcuccuggcagcgguccaucgucucccaacaauuccucagggagugugagcgccgaaaacggaaucgcgccggccgugccuuccauucccgcagagacaucucuggcucauaggcucgucgcccgggaaggcagcgcugccccacugccucuuuacaccucacccagucugccaaauaucacuuugggccuccccgcaacagggccuuccgccggaaccgcuggucaacaggaugcggagcgacugacguuaccagcacugcagcagcgccuaagccucuucccgggcacucaccugacccccuaucuuucuacaucaccuuuggagagagacgggggagccgcucauaguccacugcuccaacacaugguucugcuugaacagcccccugcccaggcaccacuggugacuggcuugggugcccucccccugcacgcucagagcuuaguaggggccgacaggguguccccgucuauacauaagcugcggcaacaccgcccucuaggaagaacccagucggcaccacucccccagaacgcgcaggcucugcaacaucuugucauccagcagcaacaccagcaguuuuuggagaaacacaagcagcaauuccagcagcagcaacugcagaugaauaaaauuaucccuaagcccagcgaaccagccaggcagccugagucccaucccgaagagacagaggaagaacuccgugaacaccaggcacuguuagaugagccauaccuggaccggcuuccgggccaaaaggaggcccaugcucaggccggcgugcagguuaaacaggaaccuauugagucagaugaagaggaagcagagcccccacgagagguggaacccgggcaaagacagccuagugagcaggaauugcucuuuaggcaacaggcucugcuacuggagcagcagcgcauccaccaacuccggaacuaucaggccucuauggaagcggccggaauaccagucagcuucgguggccauagaccccuguccagggcucagucaagcccugcaucugccaccuuuccgguguccguacaggagccacccacgaagccucgcuucacuacagggcuuguuuacgacaccuugaugcugaaacaccaaugcacuuguggaaguagcuccucccacccagagcaugcuggccggauucagucaaucuggagucgauuacaggaaacaggucuccgugggaagugcgaguguauuagaggcaggaaagccacccuggaggagcuucagacggugcacagcgaagcacauacccuguuguacggaacaaauccccucaaccgccaaaagcuggauucgaagaaacuacugggcucccucgcgucugucuuugugcggcugccuugcgggggagucgguguggacagcgauacuaucuggaacgagguucacucagccggcgcugccagacuugcagugggguguguagucgaguugguguucaagguugcuaccggagaacugaaaaauggcuuugccguggucaggccgcccggucaucacgcagaggaaaguacaccaaugggguucugcuauuucaacuccguggccguagcugcgaaguuacuccagcagcgacugucugugagcaaaauccuuauuguugacugggauguccaccauggcaauggaacucaacaggccuuuuacuccgacccuucagugcuguauaugagccuacaccgcuacgaugacggcaacuucuuucccgggaguggagcaccagacgagguggguaccggcccuggggucggauucaauguuaacauggcuuuuacaggcggucucgaucccccaaugggggacgccgaguaucuggccgcuuuccggaccguggugaugccgauagcaucugaauuugccccugauguagucuugguguccagcggcuucgacgcgguugagggacaucccacuccacugggcggguacaauuuaucggcuagauguuuuggauaucucacgaagcagcugaugggccuugccggugggaggaucgugcuggcauuggaaggaggccacgaucucacagccauuugcgacgcuucagaggcaugugucucugcccugcuagguaacgaacuggauccccuuccugagaaggugcuccagcaacguccaaaugcgaacgcuguucgcaguauggagaaagugauggaaauccacuccaaguacuggcggugccugcagagaaccacuagcaccgccggcaggucuuugauagaggcacagacaugcgaaaaugaggaagccgagaccguaacugcuauggccagccuguccgucggggugaaacccgcagagaagcgaccugacgaggaaccgauggaagaggaaccacccuuauga

SEQ ID NO: 57135 - RNA, 3372 nt, Artificial Sequence
  derived and/or modified sequence opt3 from HDAC5__Homo_sapiens__XP_005256961
augaacagccccaaugaguccgccgacggcaugucugggagagaaccuucacuggagauccucccaaggaccagucuucacagcauuccggugacagucgaaguuaagcccgugcugccucgggcuaugccauccucuaugggagguggcgggggaggcucgcccucaccuguagaguugcgcggugcauuaguggggagcgucgauccaacucugcgagaacagcaacuacagcaggagcuccuggcccuuaaacagcaacagcagcugcagaagcaacuucucuucgcggaguuucagaaacagcaugaccaccugacgcgucagcaugaagugcaacugcagaagcaccucaaacagcaacaggagauguuagcugccaagcagcagcaagaaaugcuggcagccaagagacagcaggagcuugagcagcaaaggcagcgggaacagcagcgccaagaggaauuggagaaacagagacuggaacagcagcuacucauacugaggaacaaggagaaaaguaaggaguccgcuaucgcaucuaccgaaguuaaacuucggcugcaagaguucuugcucagcaaguccaaggaacccacaccuggaggccugaaucauucauuaccacagcacccgaaaugcuggggcgcccaccaugcuagucuggaucagagcucucccccucaauccgggccacccggaacuccuccaucauacaagcucccccuuccggguccuuaugacagccgcgaugacuuuccccugcgaaaaaccgccagugagccaaacuugaaggugagaucuaggcuaaaacagaaggucgcggaacggcguuccagcccucugcuccgcagaaaagauggcacagugauuucgaccuucaagaagagggcaguagagaucacuggggccggacccggcgcuucuuccguuuguaauucagccccagguagugggcccagcuccccuaacucuagccacucaacaauugcagagaauggauuuaccggcagugugccaaacaucccgacggaaaugcugccccagcaucgggcuuugccucuggacuccagcccaaaucaguucucuuuguacacuucacccagucucccuaacauaagccugggcuuacaagccaccgucacagugacuaauucccaccugaccgcgucuccaaaacuaucgacacagcaggaggccgaacgacaggcacuccaaagccugcgccaagggggaacccuuacggguaaguuuauguccacuucaaguauccccggcugcuugcuggggguggcucucgagggagauggcucuccgcacggucaugccagccugcuucagcacguccuguugcucgaacaggcuagacagcaguccacacugauugccguuccuuuacaugggcagucaccacuggugaccggcgagaggguagcaacuagcaugcggacagugggaaaacuaccccgccacagaccucucucuaggacccaauccaguccccugccacagagcccucaggcccuucagcaauuggucaugcagcagcagcaucaacaguuccuggagaagcagaaacagcaacagcuccagcugggcaagaucuuaacgaagaccggggaacugccccgucagccaacaacucacccggaggaaaccgaggaggaacuuacagagcaacaggaaguguugcucggagagggugcucugacuaugccucgggaaggcucuaccgaguccgagucaacacaggaagaccuagaggaagaggaugaagaggacgauggggaggaagaggaagacuguauucaaguuaaagacgaggaaggagagaguggcgcggaggaaggucccgaucuggaggaaccaggggcaggcuauaagaaacucuuuagcgacgcccagccccugcagccucuucagguguaccaagcuccauugucgcuggccaccgucccccaccaggcauuaggacgaacucaguccucuccugccgcuccgggcgggaugaaaagcccacccgaucagccugugaagcaucucuucacgacaggaguaguuuaugacaccuuuaugcugaagcaccaaugcaugugugguaacacucaugugcacccagagcacgccggcagaauccagucaauauggaguaggcuucaggagaccgggcuguuguccaagugcgaacgcauucggggaagaaaagcaacacucgaugagauccagaccguccauucugaauaccacacucugcuauauggcacaagcccccugaauaggcaaaagcucgacuccaaaaagcugcuugguccuauuucacagaaaauguacgcgguguugccgugugggggcaucggagucgauagcgacacgguguggaacgagaugcauaguucuuccgcuguucgcauggccgugggcugccuguuagaacucgcauucaagguagccgcuggggagcugaagaauggauuugccaucauucgacccccaggccaccaugcagaggaaagcaccgcuauggguuucuguuucuuuaacucggucgccauaacugcgaaacuucugcagcaaaagcuaaacguggggaaaguucucaucguggauugggacauucaccacggaaauggcacacagcaggccuucuacaacgauccuucaguccuguauaucucuuugcaucgguacgacaaugguaacuuuuuccccggcaguggggcuccagaggaagugggaggcgggccuggaguaggcuauaaugugaacguugcauggaccgguggggucgaucccccaauaggagacguggaguaccugacagccuuucguacuguggucaugccgauugcucacgaguucuccccugacguuguguuagugagcgccggcuuugaugcaguagaaggucaucucucuccccugggcggguauagcgucaccgcgagaugcuucggacaccuuacgaggcagcugaugaccuuggccggcgggcgcgugguucucgcucuggagggaggccaugaccuaacagccaucugugaugcauccgaggcuugcgugucagcccugcuuagugucgaacuccaaccacuggacgaagcaguguugcagcagaagcccaauaucaacgccguugcuacucuggagaaagugauugaaauccagagcaagcacuggucuugcguacaaaaauuugcggccgguuuagggcggucccucagagaggcacaggcuggagagaccgaagaggccgaaacagucucagccauggcucugcuuagugugggcgcagagcaggcccaggcggcugccgcaagggagcacagcccucgaccagccgaggaacccauggaacaagagccugcucuguga

SEQ ID NO: 57136 - RNA, 3648 nt, Artificial Sequence
  derived and/or modified sequence opt3 from HDAC6__Homo_sapiens__NP_006035
augaccagcacaggccaggacuccacuacgaccagacaaaggcggucucgccagaacccccagucaccuccacaggauaguagcgugacauccaagcgaaauaucaaaaagggggccgucccgcguucuauucccaaccuggcugagguuaaaaagaaaggaaagaugaagaaacucggucaagcaauggaagaggaccuuauagugggccugcaggggauggauuugaauuuagaagccgaggcgcuggcuggaacuggccuaguacucgacgaacagcugaacgaguuccacugccuuugggaugacucguuuccugaggguccagaaagacugcaugccaucaaggagcaguugauucaagaagggcuccuggauaggugugugucauuccaggcacgguuugccgagaaagaggaacugaugcucguccacagcuuagaguacaucgaccugauggaaaccacacaguauaugaaugagggagaacuucgcguguuggcugauaccuacgacaguguuuaucugcaucccaacuccuacucuugcgcaugucuagccagcggcuccgugcucagacuggucgaugcugugcuuggcgccgagauuaggaaugggauggcgaucauacggccuccaggacaccaugcacagcacucacugauggacgguuauugcauguucaaccacguagccguugcugcccgcuacgcacaacagaagcaucgaaucagaaggguguugauugucgauugggacgugcaccauggccaggggacucaauuuacauucgaccaggaucccagugugcucuauuuuagcauccaccgguacgagcagggacguuucuggccucaccugaaagcgucuaauugguccaccacgggcuuuggucaggggcaaggauacacuauuaacgucccauggaaucagguuggcaugcgcgacgccgauuauaucgcggccuucuuacaugugcugcucccgguagcacuugaauuucagccccagcugguguuggucgcugccggcuucgacgcucuacaaggggauccuaagggagagauggccgcaaccccagccgguuuugcucagcugacacaccuccugaugggccuugcugggggaaagcugauauugucacucgaaggcgguuacaaccugagagcauuagccgagggggugagcgcuagucugcauacucuacucggcgaccccuguccuaugcuggaaucuccaggagcccccugcagguccgcacaggccagcguuucgugugcucuugaggccuuggagccguucugggaagugcugguccggucuaccgagacaguggaacgagauaauauggaggaagacaacguagaggaguccgaagaggaaggcccuugggagcccccaguucucccuauucugaccuggcccgugcuucagucacgcacggggcuggucuaugaucaaaauaugaugaaccacugcaacuugugggacagucaucacccagaggugccccagagaauccucaggauuaugugucggcuggaagaguuaggacuggcaggucgcugccuaacucucacaccuagaccagcgaccgaagcugagcugcuuacuugucacagcgccgaauacgucggccauuugagggcaacagagaaaaugaagacccgugagcugcaccgggaauccucuaauuucgauagcaucuauaucugcccgucaacguuugccugcgcucagcucgccaccggggcagcuugucgacugguggaggccguuuuaaguggagaagugcugaacggcgcggccguagucagacccccuggucaucacgcugagcaggacgcagccugcggguucugcuuuuucaauuccguggcuguugccgcaaggcacgcgcaaacaauuagcggccaugcccuucgcauauugaucguggacugggauguccaccauggaaacggcacucagcacauguuugaagacgauccaucugugcucuacguaucacugcaucgguaugaccacgggaccuucuuucccaugggagaugagggugcuaguagccagauuggcagagccgcagggacaggauucacugugaauguugcuuggaacggcccuaggaugggugacgccgauuaccuagcagccuggcaccgccugguccucccaaucgcuuacgaguuuaaucccgaacuggugcuuguguccgcgggguucgacgccgcacgaggcgauccguugggaggcugucaagucucuccugagggguaugcucaucugacccacuuacucaugggacuggccucgggccggauaauucuuauccuggaagguggguacaacuugacaagcaucuccgagucaauggccgcuuguacccguagucuccugggagacccacccccucuacugacucuccccagaccaccucugucuggcgcacuugccagcauuacggaaacaauccagguucauaggcgcuauuggcgguccuugagagugaugaaaguggaggauagggagggucccucaagcucuaagcugguaaccaaaaaggcgccacagccggcuaaaccucgauuagccgaacgcaugacuacccgggagaagaagguccucgaagcaggcauggggaaagugacauccgccaguuuuggagaggagagcacccccggccagacuaauucugaaacagcuguuguggcacugacgcaagaccagccauccgaggccgcgaccgggggagcuacucuugcccagacaauuucagaagcagccauaggcggugcuaugcuggggcagaccacaagugaggaagccgucggaggcgcaacucccgaucaaaccacgagcgaggagaccguggguggcgcuauccuagaccagacaacuucggaagacgccguugggggagcgacccucggccagacaacuuccgaggaagccguagggggagcaacccuggcucagacgacaucugaggccgcuauggaaggcgcaaccuuggaucaaacuacaagcgaggaggccccuggugggaccgaacugauucagacuccauuagccucaaguaccgaccaccagacacccccuacguccccggugcaaggaaccacuccacagaucucucccagcacacucaucggcucccugagaacccuugagcuggguucagaaagccagggcgcuagugagucucaggcgccuggggaagagaacuugcucggagaggcagccggcgggcaagauauggcugacuccaugcugaugcagggaagcaggggccuaacagaucaggccauuuucuacgcagucacuccacugcccuggugcccucaucuuguggccguguguccgauacccgcugcgggucucgacgucacccagccaugcggggauuguggaacgauccaagaaaauuggguuugccugucguguuaucagguguacugcggccguuauauuaacggccacauguugcagcaccauggaaauucagggcacccucugguauuaucuuacaucgaccucagugccuggugcuacuauugucaggcauacgugcaucaccaagcucugcuugaugucaagaacauugcccaccagaauaaauuuggugaggacaugccccauccacacuga

SEQ ID NO: 57137 - RNA, 2865 nt, Artificial Sequence
  derived and/or modified sequence opt3 from HDAC7__Homo_sapiens__NP_001091886
augcacagccccggcgccgacgggacccagguguccccuggagcucauuacugcucuccaacaggugcaggcuguccgagacccugcgccgauacuccugggccacaaccccagccuauggaccugagggucggacagcggccacccguugagccuccaccggaacccacgcuccuugcgcugcagcgcccucaacgauugcaccaucacuuauuccuggcuggccuacagcagcagcguucaguggagccaaugagacucaguauggauacccccaugccugaacugcaaguagguccacaggagcaggaacuuaggcagcuguugcauaaggacaaaagcaagcgguccgccguggcaucuucggucgugaaacaaaagcucgccgagguuauccugaaaaagcagcaggcugcacuggagcgcacagugcaccccaacucaccggggauuccuuauagaacucucgaacccuuagagaccgaaggagccacaaggagcaugcugaguuccuuucuuccaccuguccccucuuugccaagcgaucccccugagcacuucccacugcggaagaccguguccgagccgaaucuaaaacuccgcuacaagcccaaaaagucacuggaacgaaggaaaaacccucuucugagaaaggagagugcuccacccagcuugcggcgucgcccugccgaaacucucggcgacucuuccccaucaagcaguucuacacccgcguccggcuguagcucgccgaaugauucugagcaugggccuaacccaauacugggauccgaagcagacucagauagaaggacccaccccacguuagguccucggggccccauccuggggaguccacauacuccucucuuucuuccccacggacuggagccagaggccggcgguaccuugccgagccgacuacaaccuauucugcuccuggaccccuccgggucucacgcuccacuucugacaguacccggauugggcccucucccauuccauuuugcccagagccugaugacuaccgaacgcuuaucaggcagugggcugcacuggccccuauccagaacaaggagcgagccucucccgccaucugcaaccgcucccccuccacccggaccuaugcagccgcggcuggaacagcuuaagacgcauguucaagugaucaaacgcucagccaagcccagugagaaaccaagauugaggcagauuccuagcgcggaagaucuggagacugacgguggcgggcccggacaggucguggaugacggccucgagcaccgugaacugggucaugggcagccagaggcccggggcccugcaccccuucaacagcacccacaggugcuguugugggaacagcaacgacucgcuggaagacugccgaggggcuccacaggggacaccgucuuacugccucuagcccagggaggucaccgcccccucucucgggcucagucgagcccagccgcacccgccucccugucagcuccugagccagcgagucaggcaagaguucuuucuagcuccgaaacucccgccaggacauugccuuucaccacgggccugaucuaugauucagugaugcucaagcaucaaugcagcuguggggacaauucucgccacccggagcaugcuggacgaauacaguccaucuggagucggcugcaggagcguggcuuaagaagccaaugcgaaugucugaggggucgcaaagccucucuugaggaauugcaguccguacacucagagcggcacgugcuccuguacgggaccaacccacuaaguagacugaagcucgauaauggcaaacuggcaggacuuuuggcccagaggauguuugucaugcugcccugcggcggggugggaguugacacagauacuauuuggaacgaguuacauagcucgaaugcugcccgaugggcagcggguuccgugaccgaccucgcuuucaaggucgccucucgcgaacugaagaacggcuuugcagugguacggccucccgggcaccaugccgaucacagcacagcuaugggauucugcuuuuucaauucaguugccaucgcauguagacagcuucaacagcagaguaaggcuuccaaaauucugaucguggacugggauguccaucacggcaacgguacucagcaaaccuuuuaucaggacccaucuguguuguacauaagccuccacaggcaugaugacgggaauuucuucccuggcuccggagccgucgacgaggugggcgcggggucaggagaaggcuuuaacguuaauguggccugggcuggugggcuggaucccccaaugggagacccugaguaucuagcagccuuccguauuguagucaugccgaucgcucgcgaauuuagccccgaucuggugcucguuagugccggcuucgacgcagcggagggucacccagccccucugggcggguaccaugugucugcuaaauguuuuggauacaugacacagcagcuuaugaacuuggccggcggggcagucgugcuggcuuuagagggaggccacgaucucaccgccauuugcgacgcauccgaagccugcguagcugcgcugcuugguaaccggguggauccccugagcgaggaaggguggaagcaaaaaccaaaucuaaacgccaucagaucgcucgaggcaguuaucaggguccauucaaaguauuggggauguaugcagcgacuggcuucuugcccugacaguugggugccccgggugccgggcgccgauaaggaagaggucgaggccguuacugcuuuggcaucccugagcguggguauuuuagccgaagaccgcccaucugagcagcucguggaagaggaggaaccuaugaaucuguga

SEQ ID NO: 57138 - RNA, 861 nt, Artificial Sequence
  derived and/or modified sequence opt3 from HDAC8__Homo_sapiens__NP_001159890
auggaggaacccgaggaaccugccgacagcggccagucccuggugccagucuacaucuauucuccggaguacguuucaaugugcgauagucucgcuaagauucccaaaagagcaagcauggugcacucccuuauagaagccuaugcgcugcauaagcaaaugagagacgaggcuucuggguucuguuacuugaacgaugccguauuaggaauccugcggcuacgccgaaaauuugagcguauucucuauguggaccuggaucuucaccauggugacggcgucgaagaugcauucucguuuaccucaaaggugaugacaguuagccugcacaaauucaguccuggguuuuucccaggaacuggcgacguguccgaugucgguuuggggaagggaagauacuauucugugaauguacccauccaggacggcauucaggaugagaaguacuaccagaucugcgaaagcguucucaaagagguguaucaagccuuuaacccuaaggcugucgugcugcagcugggcgcagacacgauagccggggauccaauguguuccuucaauaugacccccgugggaaucgguaaaugccucaaguacauuuuacaguggcagcuggcuacacuuaucuugggcgggggaggcuauaaccuggccaauacugcgagguguuggaccuaccuaacaggugucauucucgggaaaacccugucaagugagaucccugaccaugaauuuuucacugcauauggaccagacuacguucuugagauaacaccgagcugccggcccgaucgcaacgaaccucacaggauucaacagauccugaauuauauuaagggcaacuugaagcacgugguauga

SEQ ID NO: 57139 - RNA, 1767 nt, Artificial Sequence
  derived and/or modified sequence opt3 from HDAC9__Homo_sapiens__NP_001191073
augaugagcucccccgcccagccugaccugauguggaaccucgugccauggguccuuuucugcggcuguugcagaaucuuuccggaugggguugcuggaagggagcaacuguuggcacagcagcggaugcacucuaugauuucaaguguggacguaaagagcgaagugcccgucgguuuagagccuauauccccacuggaucuacgcaccgaccuccgaaugaugaugcccgugguugauccugugguccgugaaaaacagcugcaacaggagcuucuguugauccagcagcaacagcagauucagaagcaacuccugaucgccgaguuccagaaacagcaugaaaaucugacaagacaacaccaggcgcagcuccaggagcauauuaaggaauuacuggcuaucaaacaacagcaggagcuuuuggaaaaggagcagaagcuggagcaacagaggcaggaacaggagguggaacggcaccgcagagagcaacagcuaccaccccucaggggcaaagaccgggggcgcgaacgagccguagcaucuacugagguuaagcagaaacugcaggaguuucuucugucgaagucagccacgaaagauaccccuacaaacggaaagaaucauagcgugaguagacacccaaaguugugguacacugcugcacaccauaccucccucgaccaaucuagcccgccccuguccggcacaucaccuaguuauaaauacaccuuaccaggugcccaggaugcuaaggacgauuucccccugaggaaaacugaaagcucugucuccucaagcaguccugggucuggaccauccagccccaacaauggcccgacaggcucggugaccgagaacgaaacgucugugcucccucccacuccacacgccgagcagauggucucccaacagcggauacuuauccaugaagacucaaugaaucuguugagucuauauaccagcccuucccugcccaacauuacacucgggcugccagcgguucccucucagcuuaaugcaagcaacucacugaaggagaaacagaagugugagacucaaaccuugcgucagggagugccucucccaggucaguacggcgggaguaucccggccuccagcucucacccccacguaacacuggaaggaaaaccuccaaauucaagucaucaggcuuuacugcaacaccuacuccugaaggagcagaugcgccagcagaaacuuuugguggccggcggugucccccugcauccucaaagcccacucgcaaccaaggaaagaauuucccccgggaucaggggaacgcacaagcugccgcggcaucgaccucuuaaccgcacucagucugcuccacugccccagucgacauuggcccaacucgugauacagcagcagcaccaacaguuucuggagaaacagaagcaguaucaacagcagauucacaugaauaaauuacugagcaaguccaucgaacagcuaaagcaaccuggcucacaucucgaggaggcggaagaggaacugcagggcgaucaggccaugcaggaggacagagcacccaguucugggaacagcaccagguccgacucaagcgcuugcguugaugacacucuuggacaagugggugccgucaaagugaaggaggaaccaguagauucugacgaggaugcucagauucaggaaauggaguccggcgaacaagccgcauucaugcagcagguuaucgggaaagacuuggccccuggauuugugaucaaggucauuauauga

SEQ ID NO: 57140 - RNA, 1989 nt, Artificial Sequence
  derived and/or modified sequence opt3 from HDC__Homo_sapiens__NP_002103
augauggagcccgaagaguacagagaaaggggccgggagaugguggacuauaucugccaguaccugagcaccguccgcgaacgacguguuacaccugaugugcaaccaggguaucucagagcccagcuuccggaguccgcucccgaggacccugauucuugggacucaauuuucggagauauagaaaggaucauuaugccagguguagugcacuggcagaguccccauaugcacgcauacuauccugcccugacuagcuggccauccuuguuaggcgacaugcuggcggaugcuaucaacugucuaggguuuacgugggccucuucgcccgcaugcaccgagcucgaaaugaaugucauggacuggcuggccaagaugcuuggacugccugagcauuucuugcaccaucacccaucaagccagggcgguggggugcuccaaaguacaguuuccgagucuacucugauugcucugcucgcagcccggaaaaacaagaucuuagaaaugaaaaccagcgagccggaugcugacgaauccugucugaaugcccgccuuguggcguacgcaucagaucaggcccacaguagcgucgagaaggcuggauugauaucucuggugaaaaugaaguuucuacccguagacgauaacuucucccucagaggcgaagcccugcagaaggcaaucgaggaggacaaacagaggggccuuguuccuguguuugucugcgcuacacuggggaccacuggagugugugccuucgacugcuugucagaacucgguccaauuugugcgcgggagggccugugguuacauaucgaugccgcauaugcugggacagccuuucugugccccgaauuucgcggauuucucaagggcauugaguacgcugacagcuucaccuuuaauccuaguaaauggaugauggugcacuucgauuguacggguuuuugggucaaggacaaauacaaacuucaacagacuuucucuguuaacccaaucuaucugcgacaugccaauuccgggguggcaaccgauuucaugcacuggcagauacccuugagcagaagguuucggucgguaaagcuaugguucgugauucguucuuuuggagucaagaaccugcaggcccacgugcgccauggcacagaaauggcuaaguacuucgagucccucguuagaaaugacccgucauuugagaucccugcgaaaaggcaccugggccuuguggucuuccggcugaaggggcccaacugcuugacugaaaaugugcucaaagagauugcaaaggccggacgacuguuuuuaaucccagcuaccauccaagauaaacugauuauacgcuucacaguaaccagucaguuuacgacuagagacgauauccuaagggacuggaaccucauucgggaugccgcaacacugauccuuagccagcauuguaccucccaaccuucuccccgcguugguaauuugauaagccagauuagaggcgccagggcuugggccugcgggacuucacugcagaguguguccggagcaggcgacgacccaguccaggcgcguaagaucaucaagcaaccccagcgggugggugcugggccuaugaaacgagaaaacggccuccaccuggagacacuucuggauccagucgacgauugcuucagcgaagaggccccggacgcaaccaagcauaaauugucuucauuucucuucaguuaucugagcgugcagacgaagaaaaagaccguuagauccuuaucuuguaauucggugcccguaagcgcccagaagccucugccaacagaggcuuccgucaaaaacggaggcucaaguagggugcgcauuuucucucgguuccccgaagauaugaugaugcuaaagaaaagcgccuucaagaaacucaucaaguuuuacuccguuccuucauucccagagugcagcucucaaugugggcugcagcuucccugcuguccguugcaggcaaugguguga

SEQ ID NO: 57141 - RNA, 615 nt, Artificial Sequence
  derived and/or modified sequence opt3 from HDDC2__Homo_sapiens__NP_057147
auggccagcguguccucugcuaccuucucaggccacggggcaagaagucugcuccaguuucuuaggcuggucggacaauugaagcggguuccccgcacagguuggguguaccgaaacguacagcguccugagagcguguccgaccauauguauagaauggccgucauggcgauggugaucaaagaugacagguuaaauaaggaucggugcguucgccuggcucuagugcacgacauggccgaauguauugucggcgauauagcaccagccgacaacaucccgaaagaggaaaagcauagaagggaggaagaggcuaugaaacagauuacucagcuccugcccgaggaucuucggaaggaacuguacgaguugugggaagaguaugagacgcaaucuucggcagaagccaaguucgugaaacagcucgaccagugcgagaugauccugcaggcuucagaauacgaggaucuggaacacaagccugggcgccuccaagacuuuuaugauagcaccgccggaaaauucaaucauccagagauuguacaguuaguuagugagcuggaagcggagcgauccacaaacaucgcagccgcugccucugaaccccacagcuga

SEQ ID NO: 57142 - RNA, 771 nt, Artificial Sequence
  derived and/or modified sequence opt3 from HDGF__Homo_sapiens__NP_001119522
augcaccccgagggcgggcaguucgugccucaacugcucggacaucuucuggccaccaaguugaaaagauuuuuacugagcaaggguggcaggcgggcucagaucccagacgucucccgcgcaacaccgcacacuauugaugaaaugcccgaggccgcgguuaaaucuacggcuaacaaguaccagguguucuuuuucgggacccaugaaacagccuuucuaggaccuaaagaccucuucccauaugaggaaucaaaggagaaguuuggcaaacccaauaagcgaaaagguuucagugaggggcugugggaaauagagaacaauccuacuguaaaggcaagcggauaccaguccucucaaaagaagucgugcguggaggaaccagagcccgaaccugaggccgcugaaggcgauggcgacaagaaagggaacgcagagggaucaagcgaugaagaggguaaacuugucaucgacgagccagccaaagaaaagaaugagaaaggcgcucugaagcguagagccggggauuugcucgaagacaguccgaaaaggcccaaggaggcggaaaacccugagggagaggaaaaggaggcagccacccuggaaguggagcggccacugcccauggaaguugagaaaaauuccacaccuucugagccaggcagcggucgcgggcccccgcaggaagaggaagaggaggaagaugaggaagaggaagcuaccaaggaggacgccgaggcaccuggaauuagagaucacgaaucccucuga

SEQ ID NO: 57143 - RNA, 756 nt, Artificial Sequence
  derived and/or modified sequence opt3 from HDGFL1__Homo_sapiens__NP_612641
augagcgccuacggcaugcccauguauaaguccggggaccugguguucgcuaaacucaagggauacgcacacuggccugccagaaucgagcauaugacccagccaaacagguaucaagucuuuuucuuugguacacacgaaacugcguuccuuucuccgaaacggcuguuucccuacaaggagugcaaagaaaaguucggcaagccuaauaaacgccgaggguuuucagcuggauugugggagauugaaaacaauccaacgguucaggccagugauugucccuuagcaagcgagaagggcuccggugacgggccuuggccagagcccgaagccgcugagggagaugaagacaaaccuacccaugcaggcggcgggggagaugagcuggguaagccagacgaugacaaaccgacagaggaagagaagggcccccuaaagcguucugccggggauccuccagaagacgcucccaaaagaccuaaggaggccgcgccagaucaggaagaggaggcagaagccgagagggcugccgaagcagagcgggcugccgcggccgcagcugccacugcuguggacgaagagucgcccuuccucguagccguggagaacggaucagcaccgagcgaaccuggccuggucugcgagcccccacagccugaagaggaggaacuucgcgaggaagagguggccgaugaagaggcuagucaagaguggcacgcggaagcacccggugggggagacagagacucccuguga

SEQ ID NO: 57144 - RNA, 612 nt, Artificial Sequence
  derived and/or modified sequence opt3 from HDGFRP3__Homo_sapiens__NP_057157
auggccagacccaggccucgggaguacaaggcuggcgaccugguguucgcaaaaaugaagggguauccacacuggccggcccgcaucgaugaacuccccgagggagcggucaaaccuccagcuaacaaguaccccauauuuuucuuugguacccaugaaacagccuuccuuggcccuaaagaccuguuuccauauaaggaguacaaggauaaauucgggaaaagcaauaaacgaaagggauuuaacgaaggcuugugggagauugagaauaaccccgguguuaaauucacuggguaucaggcaauccaacagcaguccucuucagaaacggagggagaaggcggcaauaccgccgacgcuaguagcgaggaggaaggggaucguguggaggaagacggaaaggguaagagaaagaacgagaaggcaggcuccaaaaggaagaaaucuuacacaucgaagaaaucaagcaagcagagucggaaguccccuggggaugaagacgauaaagacugcaaggaggaggaaaauaaaucuagcuccgagggaggcgaugccgguaacgacacucgcaauaccacaucagauuuacaaaagaccagugaagggacuuga

SEQ ID NO: 57145 - RNA, 756 nt, Artificial Sequence
  derived and/or modified sequence opt3 from HDHD1__Homo_sapiens__NP_001129037
auggccgcucccccucagccagugacccaccugaucuucgacauggauggccuccuucugggguacacaggaagcauugucgcagccgcguccggugagucuucaagaggcuugcaaaguagguggacugacacggaacgguuauauagcguuguguuucaggagauaugcaaccgcuacgauaagaaauauuccugggacguaaagucucuggugauggggaaaaaggcucuagaagccgcacagaucauuaucgauguccuccagcugccgaugucgaaagaggaacuuguggaggagucacaaaccaagcugaaggaaguuuuccccacagccgcuuugaugccuggagcagagaaacucauuauccaucugcgaaagcacggcauaccauuugcccuggcuacuagcagugguuccgccucuuucgacaugaaaaccagccgucauaaggaauuuuucucccucuuuucacacaucguguuaggggaugaccccgagguccagcauggaaaaccugauccagacauuuuccuggcgugugcaaagagauuuagucccccuccagccauggagaagugccuuguguucgaagaugcuccgaauggcguagaggccgcauuggcugccggcaugcagguugugaugguccccgacgggaaccugagcagggaucuaacaaccaaagcgacucucgugcuuaauucucugcaggacuuucaaccugaacuguucggauugccauccuacgaguga

SEQ ID NO: 57146 - RNA, 3708 nt, Artificial Sequence
  derived and/or modified sequence opt3 from HDLBP__Homo_sapiens__NP_001230829
augcaccuggccgaaagagacagguggcuauucguggcuaccgucaugaugcauuuuguuagcaucaaguccggcuuccccgggcuuugcgugggaguacggucuacaaugucaaguguggcaguccugacucaggagagcuuugccgaacaccgcuccgguuuggugccucaacagauuaaaguugcgacguuaaacucugaagaggaaucggauccaccgaccuacaaggacgcuuuucccccucugccagagaaagccgcaugucuagagucagcccaggaacccgcuggcgcaugggggaauaagauacgaccuaucaaagccagcgugauuacacaggucuuccaugugccacucgaggaacguaaguauaaggauaugaaccaauucggagagggcgagcaggcuaaaaucugccuggaaauuaugcagagaacuggugcccaccuugagcugaguuuggcgaaggaccaggggcucuccaucaugguaucuggaaaacuggaugcaguuaugaaggccaggaaagacauaguggcucggcugcaaacccaggccagcgcaacagucgcuauccccaaggaacaucaccgcuuugugauuggcaagaauggcgagaaacuccaggauuuagaacugaagaccgccacuaaaauccagauuccuagaccagacgauccguccaaccaaaucaagauaacagggaccaaagagggaauugagaaggcgaggcacgaagugcuuuugaucucagccgagcaggacaaacgggcagucgaacgccuggagguugaaaaggcuuuccaucccuuuauugccgguccuuacaaucgacucgugggcgagaucaugcaggagacggggacuagaaucaacauuccacccccuaguguaaauaggaccgaaauaguguucacaggagagaaggaacaacucgcucaggccgucgcacggaucaaaaagauuuaugaggaaaaagccaacagcuuuacugugucuuccguugcugcgccaucauggcugcaccguuucaucauaggcaagaaaggucagaaucuugcaaagauuacccagcaaaugcccaaggugcauaucgaguuuacagagggggaagauaaaaucacccuggagggaccgacggaagacgucaacguggcccaggagcagauugagggcaugguaaaggauuugaucaaucgcauggacuacguugaaauuaacauagaccacaaauuccacagacaucucaucggcaagagcggggcuaauauuaacaggaucaaagaucaguauaaggugaguguccggaucccucccgacucugagaaguccaaucugauucgaauagaaggagauccacaaggugugcagcaggccaaacgcgaguuacuggaacucgcaagcagaauggagaacgagaggacuaaggaccuuaucauugaacagcgguuccaccgcacaaucauuggccaaaaaggggagagaaucagggaaauacgugauaaguuuccugaggucaucauuaacuuccccgacccagcccagaaaucggauaucgugcagcugcggggacccaagaaugaaguugagaaguguaccaaauacaugcagaagaugguggcugacuugguagagaacucuuauuccauuucagucccuaucuuuaaacaauuccauaagaauauaauuggcaaagguggggccaacaucaagaaaauucgagaagagaguaauacuaagaucgaucuaccagcagaaaacagcaauuccgagacaauaaucauuaccggcaagagagcgaacugcgaagcugccaggucucgcauccugagcauucagaaagaccucgcaaauaucgccgagguggagguuucaauaccggcuaagcugcacaacagucuuauuggaacgaaaggccggcugaucagauccaucauggaagagugugggggagugcauauucacuuucccgucgaagguagcggcucugauaccgugguaaucagggggccuucaagugacguggagaaggccaaaaagcaguugcuccaccuggcagaggaaaagcaaacaaagagcuucacuguugacauucgcgcuaagccagaguaccauaaauuuuuaauaggaaagggcggugggaaaauccgaaagguccgggauuccaccggcgcccgugugauuuuccccgcggccgaagacaaggaucaggaccugaucacaauuaucggaaaagaggaugcugugagagaagcacagaaggagcuagaggcccucauacagaaucuggacaacgucguugaagauucuaugcuuguggacccuaaacaccauaggcacuuugugauccgccggggccaaguauugagagagauugcugaagaguacgggggagucauggugucguucccaaggagcgguacucaguccgauaagguuacccugaaaggcgccaaggacugcguggaagcagcgaagaaacgaauccaggagauuaucgaggaucucgaagcccaggucacacuggagugugcuauaccccaaaaguuucaccgcucagugauggggccgaaaggaagucggauucagcagaucaccagagacuucucuguucagaucaaguuuccugauagggaagagaaugccgugcauagcacugaaccaguaguccaagagaacggcgacgaggcuggugaagggcgugaggcaaaagacugcgaucccggcuccccucgccggugugacauuauaaucauuucaggaagaaaggaaaaaugcgaggccgcaaaggaggcccuugaagcucuggugcccgugacgaucgaggucgaaguuccauucgauuugcacagguaugugauuggccagaaggggagcggaauccgaaaaaugauggacgaguucgaaguaaauauacaugugccugcgcccgagcuccagucugauaucauugccaucacaggccuggcagcuaacuuagaccgggccaaggccggucugcuagagcgcgucaaagaacuccaagcugagcaggaagauagagcacugagguccuuuaaacuuagugugaccguugacccaaaauaccacccgaagauuaucgggcggaagggagccgugauaacucagauucgauuggagcaugaugucaacauccaguucccugacaaagaugacggcaaucaaccccaggaucagaucaccauuacagguuaugaaaagaacaccgaggcggcuagagacgccauccugcgcauagugggcgagcucgaacagaugguuagcgaggacgugccacuggaucacaggguccacgcacguauuaucggggcccggggaaaagcuauuagaaagaucauggacgaauuuaaaguagauauaagguucccccaaucuggcgcaccugacccaaauugugugacuguuacaggguuacccgagaacguggaagaggccauugaucauauccugaaucuugaggaagaguacuuggcggacgucguggauuccgaagcucuccagguauauaugaagccuccggcccacgaggaggcaaaggccccaucacgcggauuugugguccgagacgcucccuggacggccaguagcucggaaaaagcaccugauauguccucuagcgaggaguucccaucauuuggcgcucagguugcccccaagacccugccuugggguccgaaaagauga

SEQ ID NO: 57147 - RNA, 6435 nt, Artificial Sequence
  derived and/or modified sequence opt3 from HEATR1__Homo_sapiens__NP_060542
augaccagccuggcccagcaacuccagagacuugcucugccccaguccgacgcaucuuuguuaucaagggaugagguggccagucugcuauucgacccuaaggaagcggcuacaaucgaucgggacacugccuuugcaauuggcugcacggggcucgaggaacugcuuggaauagauccaagcuucgagcaguuugaagccccgcuguucucccaauuggcuaaaacccucgagcgcucuguccagacaaaggcaguuaacaaacagcuggacgagaauaucucgcuguuucucauucacuuaucacccuacuuccugcuuaagccugcccagaaauguuuggaauggcugauccaucgauuucacauucaucuauauaaccaagauagccucaucgcuugcgugcugccauaccacgagacucguauauucguaagagugauccagcuucugaagauuaauaacaguaagcauaggugguuuugguugcuccccgucaaacaguccggugugccucuggccaagggcaccuuaaucacacacuguuauaaagaccugggguucauggauuuuauuugcucucucguuaccaagagcgugaaagucuucgcggaauacccaggauccucagcacagcuucgggugcuguuggccuuuuaugcuaguacuaucguaagcgcccuaguugcagcugaggacgugucugauaauauaauugccaagcuguuccccuacauccaaaagggccucaaauccucacugccugacuaucgcgcggccacauacaugauuaucugucagaucagcgucaaggugaccauggagaacacguucgugaauagucuugcaucucagauuauaaaaacucugaccaagaucccauccuugauuaaagauggucucagcugccugaucgucuuacugcaaagacagaagccggaaucgcuagggaaaaagcccuuuccucaccucuguaacguuccagaccugauaacaauucuucauggaaucucugagacuuacgacgugucccccuugcugcacuauaugcucccucaucugguagugucaaucauucaccacgucaccggcgaagagacagaaggcauggaugggcagaucuacaagaggcaucuugaggcuauucugaccaaaauaaguuugaagaauaaccucgaccaccuguuagccagccugcuauucgaggaauauaucuccuacucuagccaggaggaaauggauucaaauaaagugagucuccugaacgagcaauuucuuccauugauucggcugcucgaauccaaguauccccgcacgcuggacguuguguuagaggagcaucugaaagaaaucgcugaucuuaagaagcaggaguuguuccaccaguuugucagccucucuacuucaggagguaaauaccaguuccuggccgacagugauacaagccuaaugcugucccucaaucauccgcuggcaccugugcgaauccuugccaugaaccacuugaagaaaauuaugaagaccucuaaagaaggcguagacgagucguuuauaaaggaagcuguucuggcgagauuaggggaugacaauaucgaugugguccucagcgcaauuuccgccuucgagaucuuuaaggagcacuucucaagugaagugacuauuucuaaccugcuuaaccuguuucaaagggcugaguugagcaaaaauggagaaugguaugagguccucaagaucgccgcagacauacugaucaaagaggaaauucuauccgagaacgaccagcugucaaaucaggugguugugugccuccugcccuucaugguaaucaacaaugaugacacagaaagcgccgagaugaagauugcuaucuaccuuucuaaauccggcauauguaguuugcauccacuguuacgggguugggaagaggcccucgagaacgucauuaagagcaccaagccugggaaacugaucggaguggcaaaucagaagaugauugaacuucuggcggauaacaucaaucuaggcgaccccucuuccaugcucaaaaugguugaggaucugauaucagugggcgaagaggaaaguuuuaacuugaagcaaaaagucacguuccacgugauccugagcguauuagugucgugcuguuccucucucaaggagacccauuucccauuugcuauucguguuuucagccugcuucagaaaaagaucaagaaacuggagucagucauuacagccguggaaauccccagugaguggcacauagaauugaugcucgaccgcgggauuccuguggagcugugggcacacuacgucgaagagcuaaauuccacucagagaguugccguggaggauucuguguuucugguauucagccuuaagaaauuuaucuaugcucucaaggccccaaaauccuucccgaagggagacaucugguggaaccccgaacagcugaaggaggauucaagggacuacuugcaucuguuaauuggucucuuugaaaugaugcugaauggcgcagaugcuguccacuuccgggugcuuaugaaacuguuuaucaagguucauuuggaggacguguuccaacucuuuaaauucugcagcguccuguggaccuaugggaguucucuauccaacccucugaauugcagcgugaagacaguucuucagacucaggcccucuacgugggaugugcgaugcugucgucacaaaaaacccagugcaagcaccaguuggccucuauuaguuccccaguagucacaagcuuacugauaaaccucggcucucccgugaaggaggugcgacgcgcugcaauccagugucugcaagcccuuagcggugucgcuuccccuuuuuaucugauuaucgaucauuugauuucaaaagccgaagagaucaccagugacgcagcguacguuauacaggaccuagccacucuguucgaagagcuccagagagaaaagaaacugaagagccaccagaaacuuucugagacguuaaagaaccugcucuccugcguguauucauguccaaguuacaucgcuaaggauuugaugaaaguacugcaaggggugaauggcgagaugguccucagccagcugcuucccauggccgaacagcuguuggagaagauucagaaagaaccgacagcagugcuaaaggacgaggcuaugguucugcaccucaccuuaggaaaauacaacgaauucuccgugucucugcuuaaugaggauccuaagucgcuggacaucuuuauuaaagccguccauacuaccaaggagcucuaugcaggcaugccaacaauccaaauaaccgccuuggaaaagauuacuaaacccuucuuugcugcgaucagcgaugagaaggugcagcagaaacugcucaggaugcuguucgaccuucuaguuaacugcaagaauucacacugugcccaaacaguguccagugucuuuaaagggaucucuguaaacgcagaacaggugcggauugagcuggaaccucccgauaaggcuaagccauugggaacgguucagcagaaacgcagacaaaagaugcagcagaaaaagagccaggacuuagaguccgugcaagaggucgguggcucauacuggcagagggugacccugauacucgaacugcuucagcauaaaaagaagcugcguucuccucagauccucguacccacuuuguucaaucugcuaagccggugccuggagccacucccgcaagaacaggggaacauggaguauacaaaacagcuuauucugaguuguuuauugaauaucugccagaagcuguccccugauggaggcaaaauucccaaggacauccucgaugaggaaaaauuuaacguggagcugauaguccaauguauccgacuuagcgaaaugccacagacccaccaucacgcccugcucuugcuggguacaguugccgggauuuuccccgacaagguguuacacaauaucaugucuauuuuuacuuucaugggcgcuaacgugaugagacuagaugacaccuacucauuucaggucaucaauaagacggugaaaaugguuauaccugcacugauucaauccgacaguggagauagcaucgagguaucgaggaacguggaagagaucgucgugaagauuaucucuguuuucguggacgcccucccacauguccccgagcaccgccggcuuccuauacuggugcaguugguagauacccugggcgcggaaaaauuccucuggauucugcuuauccuccuguuugagcaguaugucacaaagacuguguuggcugccgcauacggggaaaaagacgccauucuggaggcugauaccgaauucugguuuuccguuugcugcgaguucagcgugcagcaucaaauccagucauuaaugaauauacuacaguaucugcucaagcuuccggaggaaaaggaggaaacaauuccaaaagcagucaguuuuaacaagucugagucccaggaagagaugcugcaaguguucaacguugagacucacaccagcaaacaguugagacacuuuaaguuccugucagugaguuuuaugagccagcuccuguccucuaauaacuuccuuaaaaaggucguggaaagcggaggucccgagaucuuaaaaggccuggaagagaggcucuuggagacgguacugggguacaucuccgccguggcgcagucaauggaacgcaaugcugacaagcuaacaguuaaguuuuggcgagcccugcucucuaaagcauacgaucuucuggacaaggucaacgccuugcugccuaccgagacuuucauuccagugauccggggacucgugggcaauccccugccuaguguccguagaaaagcuuuagaucuucugaacaauaagcuccaacagaacauuucguggaaaaagacaauaguaaccagguuucuaaagcuggugccggacuugcuggccaucguucagcgcaaaaagaaagaaggugaggaagagcaagcaauuaaucggcagacugcucucuauacccuuaagcuguuguguaaaaacuucggggccgagaaucccgauccauucgugccuguccugaacacagcggugaagcucaucgcccccgaaagaaaggaggaaaaaaauguuuuaggcagcgcacugcuuugcaucgcugaggugacguccacccuggaagcccuagcuauuccacagcucccuucucugaugcccucauugcugacuacaaugaagaacaccagcgagcucgucuccagugagguguaccuucugucugcauuagccgcccugcagaaaguaguggaaacauugccacauuuuauaagcccguaucucgagggaauccugucacaaguuauucaccuagaaaagaucacuuccgagaugggcagugcuagccaggcgaauauuaggcuuaccucucugaaaaagacgcucgcaacaacccuggccccucgagucuugcugcccgcuaucaagaaaacuuacaagcagauagaaaaaaacuggaagaaccauauggggccauucauguccauccuccaggagcacauuggagugaugaaaaaggaggaacuuaccucacaucaaagccagcugacagccuuuuucuuagaggcacuggacuuucgcgcccagcacucggaaaaugacuuggaggaggugggcaaaacugaaaacuguaucauugauugccucgucgcuaugguugugaagcugucugagguaaccuuccggccccuauuuuucaagcuuuuugacugggcgaaaacagaagaugccccuaaggacagacugcucacguucuauaaucuggcagauuguaucgcugagaaauugaaggguuuauuuacccuguucgccgggcaccucgugaaaccauuugcagacacucuuaaccaggucaauauaaguaagacagaugaagccuucuucgacuccgagaacgaucccgagaagugcugucugcuacugcaauuuauucucaauugcuuguacaaaaucuuccuguuugacacccagcauuucauuagcaaggaaagggcugaggcccuuaugaugccucugguggaucagcucgaaaaccguuuaggaggcgaggaaaaauuucaggagcgcguuacuaagcaccugaucccguguauagcgcaauucucaguggcaauggccgacgauuccuuguggaaaccacugaauuaucagauccuccuuaagacacgggacucuagccccaaggucagauuugcugcccugauuaccguacuagcucuggcagagaaacucaaggaaaacuacaucguguugcugccugagaguauucccuuccuugccgaacugauggaggacgaaugcgaggagguugaacaucagugucaaaaaacgauccagcaguuagagacugugcucggugaaccacugcaguccuacuuuuga

SEQ ID NO: 57148 - RNA, 2043 nt, Artificial Sequence
  derived and/or modified sequence opt3 from HEATR3__Homo_sapiens__NP_891552
augggcaagagcagaaccaaaagguucaagcggccccaguuuuccccuacaggggacugccaagccgaggcugcagccgcggcuaacggaacugguggcgaagaggaugacgggccagccgcagaacugcucgagaaacuucagcacccgucugccgaagugcgcgagugugcuugcgcaggacuggcccgauugguccagcagcgucccgcuuuaccuggccuggccagaagggaugcgguucggcgccuagguccacuccugcuugaccccucacuggcagugagagagacggccgcuggggccuugaggaaucucagugcauguggaggcuucgaaguaugcgaugacauggugaccaaggauaucaugacaccucuggucgcucugcucaaagaguguagcgccggcuuagacuccaacgaaaugucucugcaagagaagaaggaucagaaucggaacucgauugagaauauagcgaacgaaacugugaauguucuuuggaacaucugcgaguguucaagccgcgccgugaguauuuuuaauaaagaagggugcuuggagaucguccugaaguaccuaucccgauucccaaccaacguggaccucgcaauuucuguagcuuauugucugcagacaguuaccgaagauaaucccgagcuucugaaauccuuuagcgccacugcuuugaacaugcucgagucagcccuguuaaguccugugagcucuauggaaucccugcuccuuaagacacuggucgcaggaaccaucuggaauuugaaagacauaaucccaugcaagucacaggccgagauuaucaacgcucuacugaagauucucagcgaagugcuggguauggaugcgggcgagauggugauccaaaugaaagaagcagagacgcagagacuuaagacugccgcugaggccgaagagauacuggaaaauaccaacggggacgacuugauugaggaugacgaaauggagggaaucagucauaaaaggcggguccgucgcaagacauucguuucugaucuccugccgcccacugacaaagaguuaagagaaaccauugcacugcuaacagcccagcagaccgcucucgagaucaucgugaacauguguugcaaugaagauccuuccgacgaugagugggaggaacugagcucgucugacgaguccgaugccuuuauggaaaacucauucagugagugcggcggucaacuuuuuagcccauugugucugucccacgaaguacauacggcacucacuaauuaccugauucccaagaaaauauucgagaagacagcguuuccuaacucuaucgcuguggaccuuugcagcaggaauccaaccuggaagccccugauucggaaaaugaacacuauccagugucgagccuuguucugccuccagucacuggucaguuuacuggauguggagcaccuagggggagcagccgcucuccaaacacuggcccagcaucuuucccaguugcuguuuagccagccggacuucgcaaagcacguugacuuccucgaagcuauaucuucagcccugcgcgcguuacugcaaaccauggccaguaaaaauauuagccaguguaugacgccugaucagcuuaugaccuugugcaaggcuggcauccacuccucuaacgugggcgucagagugaauguaguuucgauccucgggauuacaggaagcgugcuggcaaaagaggacgguacucuagaaacccugaagaacaucggcuguuuucuccuggaggucacaacuaaggaucccucccuuguggucgccggggaggcuuuggacgcccuguucgauguguuugcagacggaaaagaagcggagagggccucaauucagauaaaguuacucagugcucugaaagaguuccaaccaguuuuuaagaugaaaauccggaaggaaggccgcgguaauuauucuaccgaucagcuuugcgugcuggacaacguaaagaugaauuugagaagguucauugccuaccaggaaacagucgagaaacgucucaccagcuga

SEQ ID NO: 57149 - RNA, 6216 nt, Artificial Sequence
  derived and/or modified sequence opt3 from HEATR5B__Homo_sapiens__NP_061897
auggaacuggcccacagccuccuucugaacgaagaggcuuuggcucagaucaccgaagccaagagacccguguucauuuuugaaugguuaagguuccuggacaaagucuugguugcggcuaauaagacagaugugaaagaaaagcagaaaaagcucguagagcaacugacuggccuuauauccucuucaccugggccaccgacgcggaagcuguuggccaaaaaccucgcugcccuguacaguaucggagacaccuuuacaguguuccagacucuggauaagugcaaugacauuauccgcaacaaagaugacaccgcugcauaucuccccacaaaguuagccgcugucgccugugugggugcguuuuacgagaaaaugggccgaaugcuggggagcgcauucccugaaaccguuaauaaccuuuugaagucccugaagucugccgagucgcagggacguucagaaauucuaaugagccuccaaaaagugcugaguggccuugguggggcugccgcauccucucauagagauaucuauaagaaugcuaggagccuguugacugaccgguccauggccguccgcugcgcgguggccaaaugucuccuggaguuacagaacgaggcaguauuuauguggacagcugaacuggagaauauagccacccucugcuucaaggcucuugaaaacucaaauuacggaguuagaguggccgucaguaaacuguugggcacggugauggcaacugcccuaaugccaaagcaggcuaccgugaugaggcagaacgucaaacgggcgacauuugaugagguucuggaacucauggcaacuggcuuccugcgcgggggaagcgguuuucuuaagucuggcggggagaugcugaaggugggaggcuccguaaaucgagaggugagagucggugugacccaagccuauguuguguucgucacaacccuagggggccaguggcucgaaaggucauuugcuacguuccugagccacguguuagaccugguaagucauccccgggccacucagacacacguugaggcaguguacucucgucgcugugucuccuucauccuaagagccaccgugggcagccuccugggcgaaaaagcucagauugccgcagcgaaggagaucugccaagcuauugggaaacagaugaaggccgucgaagcagugguuaacgauacuucgggagagaauaaaucuggugccgcugacaucgccgcaucccagcaugugaugguaugugcacuucaagaguugggcucacugguccagagucucaacgccacagcgagcccucugauacaggaagccuccauugggcuucuggagaucgugaccucuguuuugcuccacccaagcauggcugcaaggcuggccgcugccuggugcuuacgguguguggcagucgcgcugcccuuucagcuaacgccuuuccucgaucgaugcgccgaacgccugaacaaucuuaagaccucaccagaggcugugaguggauauuccuuugccauggcagcuuugcugggcgguguacaccaauguccgcucgggauuccccaugccaagggcaaaauggugguuagcaucgcagaagaccuguuaagaacagccgcucagaacucuaggcugucacuucagcggacucaggcgggaugguugcuccugggcgcccuaaugacccuggggccuagugucgugcgcuaccaccucccaaagaugcugcuuuuguggagaaauguguuccccaggagccugaaagaguuagaggcagaaaaggcucguggagacuccuuuacauggcaagucacucucgagggucgggccggcgcccugugcgcuaugcgaucuuucguugcacauugcccugaacuucugaccgaggaugugaucagaaaauugaugacaccaauugagugugccaugaccaugaugucgcacauacccagcgugaugaaggcgcacggggcucaucucaaggccuccgcagccaugguaaggcugcgccuauacgacauccuggcucuccugccgccuaaaacuuaugaaggaucauuuaacgcacuuuugcgggagcuggucgccgaguucacguuaacagauaauagugcgaacaccacuaccucucuccugagaagccuuugccacuacgacgauuccgugcugcuaggcucauggcuccaggagacagaccauaagagcauugaagaucagcugcagcccaauucugcuuccgguaguggggccuuggagcacgacccaagcucuaucuaucugaggauaccugcaggcgaggccguucccggaccauuaccccucggcguguccgucauugaugcuucaguggcccuguuugggguuguguucccucauguaaguuacaaacaccgccuucaaaugcuggaccacuuugcagaaugugucaagcaggcuaaaggagugcgacagcaggccgugcaauugaacaucuucaccgcgguccucagcgcccugaagggucuagcagagaauaagucgacucugggcccagaagagguucggaaauccgcucuuacacucgugauggggccgcuggauaaccccaauccuaucuugcguugcgccgcuggagaagcacugggcagaauggcccagguagugggugaggccacguuuauugcuaggauggcgcaguauucuuucgacaaguuaaaaagcgcacgcgacgucgugucacggaccgggcauagucucgcccugggcugucuucacagauacguuggaggcaucggguccggacaacaucugaagacuucugugagcauuuugcucgcucuggcccaggauggcacauccccagagguccagaccuggucacuacacagccuggcacuuauaguggacaguucuggucccauguauaggggguacguugaaccuacacucucccugguguugacuuuacugcucaccgucccacccagccacacggagguacaucagugccugggacgaugucuuggcgccaucauuaccacaguggguccggaacugcaaggcaacggggcuacuaccucgacaauccgcucaucuugcuugguuggaugugcgaucacucaggaucacagugacucccuagugcaggccgcagcuauuagcugccugcagcaacuccauauguucgccccucggcacgucaaucugucuagccuugugccauccuuauguguacaucugugcucaagucaccucuugcugagaagggcagccguggcuugccuccgucagcuggcccagcgcgaggcggcagaagucugugaguacgccaugagccuugcuaaaaacaccggcgauaaggagucuuccucagccaauguuagucccuuugcuccuggggugagcucccggacggacauacacugcagacaucagggagugaacaucacagaaaccggccuggaggguuugcuauucgggaugcuggauagggaaacugaccgaaaacucuguucugauauucacgacacauuaggacauaugcugucgagccuugcagucgagaagcugucacacuggcucauguugugcaaggaugugcuggccgcuuccagugacaugucuaccgccacucuccugagcuccggcaaagaugaggaagcagagaagaaagacgaaauggacgaugacaccauguuuacaacgcuuggugaggaagauaagucaaaacccuucguugcgccacggugggccacccgcguauuugcugccgacugucuaugcagaaucauuaaccugugugagaaugcagaucaagcucauuucgacuuggccuuagcaaggucugccaagcugcggaacccuacuaaugaucuccuggugcuucaccugagcgaccucauccgaauggcuuuuauggcggccacagaucacaguaaccaguugagaauggcaggccugcaggcucuagaggacauaaucaagaaauucgccuccguccccgaaccagaguuuccggggcaugugauucuggaacaauaucaggccaauguuggagcagcucuccgcccugccuucagccaggauacccccucugacaucauugcgaaggcuugccagguguguucaacauggaucggcuccggggucgugagugaucuuaacgaccugaggcguguacacaauuuauuggucagcucgcuggacaaagugcaagccggaaagggaucuuccagccagcucuaccgggagucagcaacuaccauggaaaaacuggccguucuuaaggcuugggcagagguguaugucguggccaugaacauaaagaaagaggcggaaaguaagccaaaaagagcuauuaagaauacggaugacgaugacgaugacugcgguacaaucgaugagcugcccccugacucucucauuaccuugguucagccagaacugcccacuuuauccaggcuauggcuggccgcacucaaagauuacgcccuucugaccuugccugcugaguuuagcucacagcugccgccagacgggggagccuucuauacacccgaaacuaucgauaccgcacgccuccauuaccgaaacaguugggcuccuauacugcacgccguggcgcuuuggcucaauagcacaggcuuuacguguuccgagucuaccgaggccgcagcuaucagcggucugcaaaagagauccacuucagucaacuugaaucaggccucuggcgcaguggggagugcuaagucgcugccagaaauuaacaaagaccggaugcacuuaauccuaggaguaagcauucaguuccugugcucccccaggccugaggaaccgaucgagcaugugacagccugccuccaggcccuucacacccuguuggacucucccuaugcgcgcguucauauagcugaggaucaacugauuggcgucgaacuccugucagugcuucaccguuuacugcucacuuggaauccaagcuccgugcaguugcuggucacagggguagugcagcagaucguuagagcagcccaagacuaccuacaggagaagcggaacacccugaacgaagaugacauggagaaagaggcuuguacggugcucggagagggcggugauagugggggacuuaucccuggcaagucucuggucuucgccacuauggaguugcugauguuuauucucgugaggcauaugccccaccugagcaccaaaguuucagacuccccaagucacaucgcaacaaagacccgcuuaagcgaagagucugcccgacuuguggcugcgacugucacaauucuguccgaucucccuucacuaugcagccccgccggcuguaugaccauacugccaacaaucuuguuccugauugcaagaauccucaaagacacugcuauuaagucggccgauaaucaggugccgccucccguaucugcagcccuucaagggaucaagaguauagugacccuguccauggcuaaaacggaagccggaguucagaagcaguggacagcguugauccggagcacccuggcaugcauucucgaguacucacagccagaagacuccguccccacuccugaugaggugucuauguuaaccgccaucgcucuguuucuuuggagcgccaguaacgagauuaucggugugcaaucccugcagaauggcuguaugaacagguucaaaaaugcacuaaacagcugcgacccauggguccaggcuaaguguuaucagcuccuguugucuguuuuucaacauucaaaucgcgcccugaguacacccuacauacacucccucgcuccuauugugguagaaaaacuuaaggccguggagagaaacaggccggcaagcaauaucgaacuguuagcgguccaggaggggaucaaggugcuggaaacuuugguugcccucggagaggagcagaaccgggugcagcugcuagcacuucuggucccaacccucauuucuuaucuguuggaugaaaauucguucgccucagcaagcuccgcuaguaaagaccugcaugaguuugcccuccaaaaccuuaugcacauaggcccccuguacccucacgcauucaagacgguaaugggugccgcgcccgaauuaaaagugcgucuggagacagcuguucgcgccucucaggcaagcaaggccaaagcugccgcacgacagccagcuccugccauccauuccgcgcccaccauuaaguugaagacuucauuuuucuga

SEQ ID NO: 57150 - RNA, 3546 nt, Artificial Sequence
  derived and/or modified sequence opt3 from HEATR6__Homo_sapiens__NP_071353
auggccgcugugcaggucguuggcagcuggcccuccgugcaaccuagagaggcaccaagggaagccaucccggagcgggggaacggauuccgccugcucucugcgcgacuuugcgcucugcgucccgacgauucaaguagcgccagaaccgaaauucacuuguuauuugaccagcugauauccgagaauuacucugaagguucgggcguagcaccugaggaugugucagcccuacucguccaggcuuguaggcuggugccacuuaaccagaaucaucugguuagcaaggugagucaauugauccaccaucuccugaaccggcugcaggucauuguggacgagcagcaccucgauuucuuacuggcauauacaaucuccgccauucaucagugcucuagcuggacucaccgcgaaauccuucaggcuuuggccgcgcugguauacuguaauggguccaaaugccaaaaguaucuacccgagcuccugggaaacacgggccuucugaugaaauugucagaccucgcacagagugauccugaaguuagaagggccgcugugcacuguauggccaaucugugcuuaagcgucccaggucagcccuaccuggaggagccuuaucaaaacguguguuuucaggcauuccucaccauacuucagucuccaaaguccucagacauggaugacaucacauuuugcaugcuguugcaaaaugcucuaaaagggauucagagccugcucaacggaggccggaugaagcugacucagaccgaugaacuuggcgcccuguuggcggugcucaagaaauucauguuucaugggcugccgggauuaaauaucgagaugcccacaguccuguacccuaccccacuaccccaguaugacggucgcacuccuauuaagccacaacagagugaaucuuccgccagccgacccacacucaacaaaaagaaaaagucgaagguuaaaccgaagaaaauccagcagggcgaggaagaggagaaggaaucuuccggggagauagaagcagcuccugugaccggaacgggcagaguaaaucugcacgaggguaacacuuggugucccucaagucuuggggugcagagcuugccacuggauggauccggcgccgcugaaaaagacggcgucucuagcucauucaguuccagcucuuggaagagggugucaaguagcgaguccgacuuuucugaugccgaagggggaaugcaaucgaaaaugcggagcuaccaggcaaagguucgucagggugcccucgugugcuuccuguccaccauuaagucaaucgaaaagaagguccuuuacggcuauuggagugcuuuuauuccugacacacccgagcuggggucuccacaaagcguguccuugaugacucucacccugaaagaucccucaccuaagacacgcgcgugugcauuacagguacugagcgccauccuagaaggaucuaaacaguuccucuccguugcugaggacaccagugaucauagaagggccuuuacgccauucagcgugaugaucgcaugcucuauucgggaacugcaccgaugccuuuugcuggcccucgucgcugaguccucaagucagacugugacacaaauaaucaagugucuggccaauuuagucagcaacgcaccguacgaccgccugaaacuuucguugcucaccaaaguguggaaccagauuaagcccuauaucagacacaaagauguuaaugugaggguauccucucugacucuacugggcgcgauagucagcacacaugcuccucucccagaggugcagcugcuuuugcaacagcccugcucaaguggucuggggaacuccaauucugccaccccucacuuaagcccacccgacugguggaagaaagcaccggccggcccuucccucgaagagacgucaguuagcaguccaaagggaucuuccgaacccuguuggcugauucggcuuugcaucagcaucgugguccugccuaaggaggauucguguucaggcucugacgcugggagugccgcaggauccaccuacgagcccagcccaaugcgcuuggaagcucuccaggugcugacacuacuggccagagguuauuucucuaugacucaggcguaccucauggagcugggcgaaguaauuugcaaauguaugggggaggccgauccuagcauccaacuucauggagcuaaguugcuggaagaguuaggcaccggucucauucagcaguauaaacccgacuccacagcagccccagaccagagggcuccgguguuucugguugucauguucuggacuaugaugcuuaacgggccucugccccgugcccuacaaaauucagagcacccaacccuccaggcaagugcgugcgaugcccugagcucuauauugcccgaggcuuuuuccaaccugccuaaugaccggcagauguuauguaucacagugcuccugggccuuaacgauucaaagaaucgacuggugaaagccgcaaccaguagagcuuugggagucuacguucucuucccaugccugaggcaggacgugauuuuuguggccgaugcagccaacgcuauccuaaugagccuggaggacaagucccuuaauguacgcgcgaaggccgcauggucucucggcaaccugacugauacguugaucgucaauauggaaacacccgacccuucguuccaagaggaauuuagcgggcuguuacuccugaaaaugcuucggucagcuauugaggccuccaaggauaaagacaaggugaaaaguaacgccguuagagcucugggaaauuugcuccauuuccugcagccgucucacauagagaagccaaccuuugcagaaaucauugaggaaagcauccaggcccuaauuuccacugugcugaccgaggcggcuaugaaagucagguggaacgccuguuacgcaauggguaacguguucaagaaucccgcccuuccucucggcacagcuccauggaccucacaagcauauaacgcccugacuucuguugugacaagcugcaagaauuuuaaaguacgcauccgaagugcggcugccuuguccguccccgggaagcgggaacaguacggaagcguggaucaguaugcacguauauggaacgccuuagugacggcucugcagaaaucugaggacaccaucgauuuccucgaguuuaaguacugcgucucacugagaacucaaauuugucaggcccuuauccaccuguugucccuagcaagugcuagcgaccugccuugcaugaaagaaacacucgagcugucgggcaauaugguucagucuuauauucuucaguucuuaaaguccggugccgaaggggacgauaccggcgcgccgcauagcccccaagagagggaccagauggugcgcauggcccugaagcacaugggaucaauccaggcaccaacaggcgauacugcucggagagccauaaugggguuccucgaggaaauuuuggcuguauguuuugacaguucuggaucccagggcgcacugccuggucucaccaaccaauga

SEQ ID NO: 57151 - RNA, 570 nt, Artificial Sequence
  derived and/or modified sequence opt3 from HEBP1__Homo_sapiens__NP_057071
augcugggcaugaucaagaacagccucuucggguccguggagaccuggcccuggcagguccuuucuaaaggagacaaggaagagguugccuacgaagagagagcuugcgaagguggcaaauuugcaacaguggagguaacugauaagccuguggacgaggcccugagggaagcgaugccaaaagucgcuaaguaugccgggggaacgaaugauaagggcauugguauggggaugaccgugccgauaucauucgcaguuuuucccaacgaggacggaaguuugcagaaaaaguuaaaagugugguuccggaucccuaaucaauuucagagcgauccacccgccccuuccgacaagucugucaaaauugaggaacgcgagggcaucacaguguacucgaugcaguucggcggguaugcuaaggaagcagauuacguagcccaagcuacucgacugcgugccgcgcuagagggaaccgcaacauauagaggugacauuuacuuuuguaccggcuaugauccacccaugaagccuuacgggaggcggaacgaaaucuggcuccugaaaacuuga

SEQ ID NO: 57152 - RNA, 618 nt, Artificial Sequence
  derived and/or modified sequence opt3 from HEBP2__Homo_sapiens__NP_055135
auggccgagccccugcagccugacccaggcgcugcagaagaugccgcggcucaagccguggagaccccgggguggaaggcacccgaagacgccggaccucagccagguagcuacgagaucagacacuauggccccgcuaaaugggucuccacaucuguugaaucaauggauugggacagugcaauucagacuggguucacgaagcucaacagcuacauacagggcaaaaaugagaaggagaugaaaaucaagaugaccgccccugugacauccuauguagaaccaggaucuggucccuuuucggagucaacuauuaccaucagccuuuacauuccuagugaacaacaguucgauccaccgaggccccuggaguccgacguguuuaucgaggaucgggcugaaaugacagucuucgugcgcucuuuugacggguucagcuccgcccagaagaaccaggagcaauuguuaacccuggcgucaauacuacgagaagauggaaaaguuuuugacgagaagguguauuacacugcaggcuauaauaguccugucaaacuccugaaccguaauaacgaaguguggcuuauccagaagaaugagccaacaaaagagaacgaauga

SEQ ID NO: 57153 - RNA, 1632 nt, Artificial Sequence
  derived and/or modified sequence opt3 from HECA__Homo_sapiens__NP_057301
augcccaacccuaagaauagcaaaggcgggagaaagaacaaaagggccaauuccucuggagacgagcaggaaaacggugcuggcgcacuggccgcggcuggggccgcaggagccgcugcaggcggugcccucgcugccgcggcagggugcggagccgcugccgcaggcgcuccaggcgccgggggagcggccggugcaggcggggcuggaaccggcgccgcuaaugccgcagccgcugcgggugcagccgcugccggggaugcaaagaacgaggccccgugugcuacaccccuuaucugcucauucggacggccuguggaccuggaaaaagaugacuaccaaaaggucguuuguaauaacgagcacugcccauguaguacuuggaugcauuugcagugcuuuuaugaaugggagagcuccauuuuagugcaguucaauuguauaggccgcgcccgaucuuggaacgagaagcagugccgucaaaauauguggacgaaaaagggcuacgaucuggcauuuagauucuguucgugccgcugugggcagggacaccucaaaaaggacaccgauugguaucagguaaaacggaugcaggacgaaaagaagaaaaagucagguagcgagaaaaacacaggcaggcccccuggggaagcggcugaggaggccaagaaaugcagaccacccaauaagccucaaaaaggaccaagucaugaucuaccgaggcggcacuccauggaccgccagaacucucaggaaaaggcagugggcgccgcugccuacggugcacgaagccccgggggcuccccuggacagucaccacccacuggcuauaguauccugagcccugcucauuuuucugggccaagauccucaagguaccuuggagaguuccugaagaaugccauucacuuggaaccccacaaaaaggcgauggccgguggccaugucuuucggaacgcucacuucgauuauagcccggcagggcucgccgugcaucguggaggccacuuugacaccccuguucaauuccugcgcagacuggaucucagugaguuacugacacacauccccaggcauaaacuuaacaccuuucacgugcggauggaagacgacgcucaggucggucagggggaggauuugcgaaaguucauucuggccgcacuaucugcgucccaucgcaaugugguaaacugcgcccucugucacagagcucugccaguuuuugagcaauucccucuuguggacggcacucuguucuugagccccucgaggcaugaugaaaucgaguacgacgucccaugccaccuccagggacggcugaugcacuuauacgccguguguguggauugccuggaaggcguccauaaaauaaucuguauuaagugcaagucucgcugggacggguccuggcaccagcucggaacaauguauaccuacgauauccuugcagcuucacccuguugccaggccagacugaauuguaaacauugcgguaagccuguuauugacgugaggaucggcaugcaauauuuuagugaguacagcaacguacagcaguguccacacugcgggaauuuggauuaucacuucgugaaaccguuuuccucuuucaagguccuagaagcauacuga

SEQ ID NO: 57154 - RNA, 2343 nt, Artificial Sequence
  derived and/or modified sequence opt3 from HECTD2__Homo_sapiens__NP_001271203
augagcgaggccgugagaguccccuccccugcuaccccacugguuguggcagccgcggcuccggaagagaggaagggcaaagaaucugagcgggaaaagcucccucccaucguaucagccggggcaggagccacagcuggucuugaccgcggcgcaaaagggcagauuaguacuuucagcuccuuuauaucugccgugucgccaaagaaagaggcugccgagaaccgaucaagccccgcgcaccuggucuucccuaauaucaagaacgugcgugaaccacccccuauuugcuuggauguuagacaaaagcagaggacgaguauggacgcauccucuagcgagaugaaagccccaguguuaccggaacccauccugccuauucagccaaagaccgucaaagauuuucaggaggacguggagaagguaaaauccucaggagauuggaaggcuguucaugacuucuaccuaacaacuuuugauaguuuccccgaacucaaugccgcauuuaagaaagacgcuaccgccagcuucaacacaaucgaggauucuggcauaaaugcgaaguuugugaacgccgucuaugacacccugcuuaauacuccucaagaugugcagaaaacagugcugaaggguaucauuaacuccuugcuccgggaauggaaagggccacgcaccaaggacgaucugagagcauacuucauccugcuccagaauccccaguuuaacaauacgucaacuuaugucauuuacgcucacuuacugaggcaaaucgccacccuuguugaggcugaccaucacuucuuggugcauugguuuaaaaagcaguauagccggcugagucagaagcgcuucaaacagcuaguagaacgacuccugcaauucauaucucuuagacuguuuccggccaagccugaggaguuucccccaauuacaaaauguuccugguggaucccuagcgcagccaagguguuggcucuccugaacacugcgaauaacuuaguccaucccccacugauucccuacaccgacuucuauaauucgacacucgaucacaucgaccuuauggaagaguaccacaccuggcagaacuucggaaacucucacagguuuuccuucugccaguacccuuuugugaucucaguugcagccaaaaagauuauaauccaacgggauagugaacagcagaugauuaauaucgcucgucagagccugguggacaaggucucccgcagacaaaggccagauaugaacauauuguuccuaaauaugaaagugcggcgaacgcaucugguaucugacagccucgaugagcugacucgcaagagagccgaccuuaaaaagaaacugaagguuacauuugugggcgaagcaggcuuggauaugggagggcucaccaaggagugguuccuguuacugauuaggcagaucuuucacccggacuaugguauguucacuuaccacaaagauucacauugucacugguuuaguuccuucaagugcgacaacuauagcgaguuccggcuagucggcauccucauggggcuggccguguacaauucuauuacacuugacauccgcuuucccccuuguugcuauaaaaaguugcugucaccacccauuauaccuagugaucagaacaucccagucggaauuuguaaugugaccguugacgaucucugccagaucaugcccgaacuggcucauggccuuagcgagcuguugucccacgaagguaacguggaggaagacuucuacucuacguuucaaguauuccaggaggaguuugggaucauuaaaucguauaaucucaagccgggaggcgauaagauaagcgucaccaaccagaauagaaaagaauacgugcagcuguacacagacuucuuacugaacaaguccaucuauaaacaauuugccgcauucuacuauggcuuucauucaguuugugcgaguaaugcucuaaugcuccugaggccugaggaaguggagauucuugucugcgggucuccagauuuggacaugcacgcccugcagcguagcacucaguacgauggauaugcaaagaccgaccucacaaucaaauacuucugggaugugguacuggguuuucccuuagaccugcagaagaaacuuuugcacuucacuaccggcuccgaucgggugccuguugggggaauggccgaccucaacuuuaagauuucaaagaaugagacaagcaccaacugucugcccgucgcucauacuugcuucaaccaacuaugccugccaccuuauaaaucuaagaaagaccucaagcagaaacugaucauaggcaucuccaauagugaagguuucgggcuugaguga

SEQ ID NO: 57155 - RNA, 12855 nt, Artificial Sequence
  derived and/or modified sequence opt3 from HECTD4__Homo_sapiens__NP_001103132
augggccugcuccuuguguucccccugauccagagccaguccagaaccgacccuucuuugugcaacauuacagccgaggucuuacugaauugucugagggauugccagccacucucacugacuaaggaaccggcugacugucuuaacgggauugagacgcuguugugcagcuggcucgaagagaccagcgauacaggacggcacaucccccacaagcagaaggaaaaugccgccgcggcucugguugcccuggcuugugcccgcgguucccucaagacuuuugugcacaccgugcauuuacugcagaagcagacagaccuuggcucuuugccuguggcugauguccuguaccgacugcuccugcuugaagggggaccaggcucgcccucaugccuguugggugggaaacacauugugagcuggggauaugaggacaugcucccugcuccagauaguaacaccggcuccucuagcgaaaauaaggacgccgaucugggccguuguuuaacugcugacgggcuguaccucuauacaaccaacuccguuggaagaggugugucaaaacuuggcagugggcugcauggaacguugaggggcuucgucuacugccggaaugaggaacuagagcccgguuggguggccuuugggagcggaucucugcuccaccgcccuguauccuucgauaacaaaccacacucacuguuucagguuaucgaccagaauacucuucaggugugucaggucgugccgaugcccgcgaaccaucugccuauuggcagcaccaugaguacagugcacuugucuuccgauggcacuuauuucuacuggaucuggagcccagcuucgcucaaugagaagacccccaaagggcauucugucuuuauggacauauucgaacugguuguggagaacggaguauuuguggccaauccuuuacaggaaagaacaauccugaugaggaaggagggugaauccgcuaaaucaauuaacgagaugcuacucagucggcugagccgcuaucgagccuccccaucugcaacccuugcugccuugacgggcagcacuaucucaaauacacugaaggaggaccaggcggccaacaccaguugcgggcucccccugaagaugcuuagaaaaacuccgauuuacacauguggaaccuaccuggucauguuggugccucccccaggcgguuccgggagcucugcaacgaggucacucuucggcggaaccaguggccugagcuccuuaaagauccuggcuucuucgcuaguuuauaacauaagcgaugggcaguuuacaucccgggccgaccucauugaugcugccggaucaagucugggucguggcgcacuugugccuggguugggagccugcuacgacacugucaauaacaugcuguggaccugcucuaaugauuauaucgaccaaugguguaaccccggcaaucaggcuuuccacuacgugugccagcgccucgguguaagccacauuaucacagaaccaaaagaggaagcgaucacuaccaacgagguuauuaaucaacuguuacaucacgugggggcaauguguauacaucagcugaaccuuuuggccacaaaucccaaccucccuaucaccuccguccugggcaagcagcacccaauugaagcucaucaccuaucaagcaucugcgauauaauggagaaagccauggugaauggagacacuuguauuaucagaugcauccuggucguguuucagguuguguucaaguucuuuuucucuccgcaaacggagaggaaccgggauauuauccgacgcuccggccuccugcuuuggcaguugcugauggcacccaaagaccagauuuguccugaaauacagaaggagguaugcuuagccaucaguagcgggcucaauauucuguauccaggagaaacagagaucaacaaucuucugaaguugguccucaccgaaggugagagaaacucuggccugucccaacuaagggaugugauccugacuaaccucgcugagcagcugcagaauaaccgguuugggucagacgaagacgaucacuaccgccuuaaugacgaguugcugcauuauauuuuaaaaauaguugugagagaaaguuguauccucauuaccaagugccagacagucagcaaagaugacuuccaaaagcugcuuucgaccgugcccgccgcauccucuugucugagguaccuaauggcgguacagaaccaccuccugagcaauacuaucuugauuaaaccugaugagaacgacgauucagacaguucccugcagggagagacauuaaaggugcaggaacucaagguuucuauccuggcucuugccacgcaaauacugaccggcugcgaugaggucuuggaaaugcuccaacaggugacuacagcacugaucaauagcgacauugccgaucgugagcaacggcuaaaaggucuggaacaggugaccaaggcuacaaugcuugggcaucuccugccagucuugcugacuuccuuaaugcaccccaaccuccagacccugaucauggccgacgcacuuaugccgcagcugguucaauuggugcucuacacgucacagaccgcucugcuacugaaaacacagugcccuguguuugccgagguaggcuguagcccaugcggagcgcccgaucagaagugucgacuuuucccugacgagagaaugcucgaagagaaagaggagcccggcuuucugacuggguugaagauuccagccccuugggcugcaggaaagaccgucgaaacagugcaccccguuagggacaauuauaaauucaaggagacugugcauaucccaggcgcccgcugcuuauaccugcgguuugauaguagauguucuucccaauaugacuacgauaaacucgucauauaugcugguccgaacaccaauagcaggaagguggccgaguacgggggaaacacgcugggcuaugguucgcgcucaguucuuggcacaggguggccuaaagaccuggugaagugcauuucucccccaaguuugaauuucaagguagaaggagauaccgucacuuuuuccuucgagaugcgaagcggccgggaacacaacacacccgacaaagcaauguggggguuugcguguaccgugcgugcccaggagucuagcgaagauguguccggaggccuaccuuuccuggucgaccucgcucugggucuuucaguuuuagccugcaguaugcugagaauccucuacaaugggccagagauuacuaaggaggaagaggcaugucaggaauugcugaggagcaaacuccugcagcgcugccaauggcaaguggaggcuaacggaguaaucucucccgcccuuaccccuuccccgucaccacugcccuugacaauagaggaagaucgggaguucacguacccuagugacgugcuagucccacccgugggcaacuauuuugaucugccuagaaucaggcucccgcccgguauuaugaucaaguuacgagaaauuagcggccgcgcacggccacaguucagaccuuccaucaaagagguuauacaacccgacgugauggaagagauggucgugucuuguguuauuaagcaucugaaucuuguggaugcccugcagucgcucaucaacuuucaguaccaggaggaacacgcugaggaauaugacuugcugugcaaaaucaugggggagaccuucaagaagcucaaugcgauggaaaggcaacugcagagcgucgccgagcuugagcagaaauggcagucagaaguagacgaugcaaugcaaggaaagcuagagaacaauaugccauuuuucuacgacuaucauuuuaacgaaaauaaaaugaaggagcuggaauuguuaugcuccaugaaagaggugaguuucgauggcaacgaccuggagaauaugguucucucucugcgugaaaaguuucuucaggaggugaacagccugauucagaagccuucccacccccucgcuaaaacuaagacauuggucaaaucacugaugaaucgcgccgaacuacugcuccacgugaccaucgccgcucagucugggcuuacacggagcauuaguggaacuccagcagagaccccggccuguaaguccgcgagcgagacgaaaguaauaucucaugcugugagacaaccugucuuccugaggucaauguccgcccccagugauuuagaaaugaucggcaacgaggacuuggaauuuacacgagcaaaucagcggcgcagacacguuaccagccauaggucgucuuccuucacucugcuccagagccuggccauugaggauucacgggacaagccaaccuacagugugcuucugggucagcucuuugcuuucaucgggacaaaccccgaucaagcagugucuuccagcucauucuugcuggccgcgcagacucgauggagacgcggaaauaccaggaagcaggcuuuaguccacaugcgugaacuacugacagccgcagugcggguuggcgguguaacgcaucucgugggcccugucaccauggugcuucaagggggaccaagaauugaggagcugacuugcggcgggaugguugaacaggugcaggaggccuuuggagaaacaaugaccagugucgugagcuugugugcuagguaucccaucgccugcgcaaacuccauaggccugcucuguacuaucccuuacacacgcucugaggaaaaaugccugguacgaagcggucuuguccagcucauggacagacuguguuccuugucaaaccaaaccgagucuaguucgagcgagaagcagacgaaaaagcagaaaguggcuacuauggccugggcggccuuccagguucuggcaaaucggugcguggaaugggagaaggaagaagggggauccaccgaagcuguccacucuggcuuagccaggcaagugucaagccuacugacaaaccaccucgcucgcgcaaccgaguguugcggcaaucaggccgccgggaacgaugcacuucaggacguucuguccuugcugaaugaccucagucguucucauauuggaaaggcgauccugagccagccggcaugugugucaaaacuuuuaucccugcucuuggaucaaagaccaagucccaagcugguccuaauuauccugcagcucugccgggccgcacuuccucugaugagcguggaggacugcgguaacguagaauugcccccauggucuuacuccgugccuucacugaauagcgagcaggaagaucccucggacccagccucuaaaauagcaagucuccuguuagccaaacuugcugauuauguugucccuggcugucaaacugugcuguccccgacagcgagcgagcccgacaccacacucacuaaaaccucaccaaagaacucccuaaaaggggauaaggacccuggagaggaaucugaggccguggauggcaagcugagcauuuuuauccacaaaagggaagaccagaguucccaugaggucuugcagccccugcucaguucuucagaaggucgcccauuccgacuugggacgggagcaaauauggagaagguagugaaaauggauagagacaugacaaagggcggcugcugugagguuaucaccgaagaggcugccgcagcccugcggaaagcuacuaagugggcccagaguggguugauuguguccauaggaccucccgucgaaagcaucaacccggagaccgugucuggucugucgacaggcgauaagaaaaagacugcgcaaaccucaauuugcagggaacgcaauagcgagcucgcaagaacggacccaguuaggccuuuuaucuccgggcacguggccaacaguauggcugccgaggucauugcuuuacugcacucucuucugauggcacccgaaagcaaugccgcucagaucuggacaaccacugccgagaaagugcuaucccgggcacucauguacauaccacagcugggaaaguaugcggaaucaaucuuggagaacggcaguucuagcggucguaaacuggccaagcuccagcgcauugcucgacaagccguagcagcucuuugugcccuagggggauucaaggaaacaaucaaaauuggcuccgaggugcagguuuuaggcagagggaucucaggaagcauaggugucguggcaucuauuaaugagcaggaaggcaucgccaccgugagguuucccccuaucgacugccggaagacuucccaggcuagugauacacugaccauuccguugagccgccucuguguccccagaucggaggcgcugccacuacauaaacuuuccaucacggaaaagguugugcaagccguacagucuaugcugcucccucaggaggggucacugagcauacacaccagcuugcccgcaacaggagacggcuccgcuccugugauggccgucgugaggcugcucgccgagauucggacacgagcaugccuuguuauggcucagcuguuagaagauucucuguucugugaggaauuuauccaacagugcccagccgcgguggaggucuugaaccucguagcucaggaauguagcgccggugagagacuggcagugguugaggugcaaugcgaacgccuaaggaugcuuuaccgggacugcgcccgucccccuccacccccgcugcaggcugauagaaggcagccuaaagagauuaccuggucaccaucccgcgucuuucccccugugcgggcauguauguuuaguagccaucucacaucugucacuuuccuggccgacccaucagcagggggaggcuugccccgaggcaccuucaucuaugcuacguccccguuaccugugcaggcccccagcuuuuacugggaaauagagauuguuucuuauggggauacagacgaugacacuggaccaaucgugaguuucgguuuuaccacagaagcagagaagagagauggcgccuggaccaauccuguagggacuugccuguuccacaacaacggaagggcugugcauuacaauggcucgucccuccuucaauggaaaagcguccgccuggacguuacccuaucacccggugauguggccgggaucggaugggagcggacagaaggcacgccacccccuccaggccagccggcaaaagggagagucuacuuuacuuauuguggacagcgucugucucccuaccucgaggacgugagcgguggcauguggccuguagugcacauucagaagaaaaacaccaagacaagggcuaauuucgggucccggccauuugccuaugcggaaggacaagcccaccgcaacgcagcugacuugugcaccgaucuggccgaggaaaucagugcaaauuucgaggcacuucccuuugccauggccucagacucugauaacgacgcgggcacuagcauugcuuccgauccugguacacaugggccacccugucgaauagcagccguugcuaccgcccagcagcaguacgacagugauacgagcugccacuauaaaguggagcuguccuacgaaaauuucaucacuucuggcccugacccgcauccacccccuauugcagaugacgagucagaugacgacgaugacgaugacaucccccaagaagaucacuaugcccucuuagucaaggcuugggagacaaagguguuuccaaccaucagaaggcgguuccgcaacgaggcggaaagaaaaagcggacuggaccagauuaagggcgccuugcagcuggggauggucgauauagcaaggcaaaccguggaguuucucuacgaagagaauggagguaucccucgagaccuuuaccugcccacuauugaagauaucaaagacgaggcuaacaaguucacaauugauaaaguucggaagggccuaaccguagugacacguucgccagacuccaauaacgucgccaguucugcaguggggacugcccugccgaaauucgcuaucagaggaaugcucaagacguuuggcuugcacgguguugugcuggaugucgacagcgugaaugagcuuguacagguggaaaccuaucugcgcucagaggggguuuuagucagguacugguauccuauagacaugcucgaacggcccccagccggcuacagacgcacagcgacuaacggacuggugaccuuggauaauacaaaccugcagauccauagggagcuccuucgaugugaagcagcccuggcucggcuauauugcagaauggcccugcucaacauuuucgcacccaaguugccucaccuguuuaccagguuauuccauaucccagcuauucgcgacaucacucuugagcaucugcagcuccuguccaaucaauugcuggcacccccucucccggauggcacgauaucuaguagcuccauucuucuggcucagucacuacagcauuguauccacagccagaacugcucugccaccgaccuguuuuaccaagggaauagucagacagugcgugagugguuaaacgucgcaauuacucggacccuccaccagggagaagagucccuguuggaacuuacaaaacagaucuguagcuuccugcaaaccgcgccagagcaguuucccucagaagaguucccuauaucugaguccaagguuaauauggaugugaacuuuccaggugccgcuuucguaguggucucgugcaaagaaagccagaguggcuuuagaaaggacucuucccucuauaaagcccccugggcaagggugcugguuuacggguugggacauaaggugaagcgcaauggccaacugaaccuaaucgaggcugccugcuacccucgagaugcaagccccgccaauacuggucucgcgccaccgccuacagcugaccaguaucccucagucgugcuuaguacggaucggguacacauuaaacuggggguuuccccaccucccggcgccguguuaguccugcauagccucccacuggaguucccuuuggcaauggccuuugcugagcagcuucugucuuggaagucagaggacagcgaaggaaaauccgaggaugaacccgacaccaucccgacuucugugcuccuacagguggucgagcuauugggcaacuuccuguggacaaccgacauggccgcauguguuaaggaacucguguuccaccuucuggcugaguuacugagaaccguacacacacucgagcaaaggcgccauccagccgggcugaguucgagcauugcguugcagcuuaauccuugccuggcuaugcucauggcccugcaguccgaacuacacaaauuauacgaugaggaaacucagaacugggugucaggaggcgcauguggugggucuggaggcgccgcugcgggugaccaaggcagauuuagcacguauuuccaugcccugauggaggggugcuuggcggucgccgaagugacccuccccacaaauaugaguguuacugcuuccggagugaccucagcaacagccccaaaccugucugauagcuccaguaguucuucauccagccccggccagaccccucagaguccgucucuucuguccaagcggaagaaagucaagaugaaaagggagaaggcuucgagcucagggaaacgucaguccucucgaacuguggacagugauccaacgguacucagcaucggaggcucaaagcccgaggacaugcugugguuucaccgcgccuugacacuucugauaauucuaagacaucucacccggaaggauccucaaggucuggggguuacuuccgacgcaaucgcugaugccugucaggcguuagugggacccaccgcccacagcaggcuguuggucaucucuggcauuccaacacaccucgacgaaggugugguucgcggcgcaaucagaaaggcuugcaaugcccaugggggaguguucaaggaugagauauacauuccucugcaggaagaggacacuaaaaagcccaaagauaaggcagaaggcggggacggaaaagucgagccagagaagacccuugccuuuccuggcacagacaguauggaaguguccacgagcucaucucugaccccggcuaugucgaucagcgccuccgcgaguacuucucaggcuucaauuuguagcucccaagguaucagucagacaguaucugaucucagcguggaccccuugccagcagggcuggagcuuccuauacccccaggacuguuagaaccucacgccgucuccucacaggagagccuagauaucucucucugcuccaccggcagucugggcucacuggggagcuugggagagccccucgacaacgcugaaacugccucgguuuccgauauggguucuauguauacagugaccagucuggacaaccaaccgcuugcagcccggccaauuaagggcuucgcugucguggagaucaggagccgagcgaaaauugaaaagauccgugccucacuguuuaauaacaaugauuuaauugggcucuccucucuggacggagaggaugaauugauggagaugagcacggaggaaauccuuaccguaagugugguuaaccagucccuguucgacacacagggcagcccuggucuagaggauuacuuuaaugacaaaucuauaaagggggaaaaacucgugcccggagcaagagagguccugacugaaauuuucaagucaugugcccauuccgagcagacccugagcuugacaccagcuaagcccauccgcgugagugauaucuaucucucuaaagagcaaauuaacucacagacuccuggcaaucugcuucaccuguuuuucaccaacguucggcccccaaagaaagucuuagaagaccagcucacacagauacugaggaaguacggcgugccuaaaccgaaguuugacaaguccaaauacagcaaggcagggaaagagcaacaucccgugaagguagucucgaccaaaagaccaaucacuaagccucccgccaaggauaaagcugugcuaaauucuguuagucgcacggccuuguccgaaaagaaaccaacagugaagccuaaaagccccgagaagucaaaaccggacgaaaaggauccugagaagucuccaaccaaaaagcaggagguccccgaagagaaauaucugacucuugaaggauuccacaaguucgugauugaccgggcgaggcaggauauccgaagcguuuggagagcaauucucuccugcgguuacgaccugcacuuugagcggugugccugcaucgaugugaggcaugcucagaaagccagucgcaaguggacccuggagauggacguagcauugguccaauauauaaaccagcuuugucgucaccucgcuaucacuccugccagacugcauccacacgaaguguacuuagaucccgcggacgccgcugauccucgaguggcaugccugcuaaauguuccaauugagucacucaggcugcgguucgccuugcugcagagccuuaacacgacccucgaaacuuucuuccugcccuuagucgagcugcgccaaacaccgauguauacccacuccaucgcugcauugcucaaggaagccaaaggccugauauuuuacgacacuaaggugacaguaaugaauagagugcuuaacgcuaccguccagaggacagccgaccaugcagccccugagaucacucuggauccccuagagauaguagggggagaaauucgggcgucugagaauaguuauuucugccaggcugcccgccagcucgcaagcguuccauccucacaacugugugugaaauuggccucuggcggugaccccaccuacgcuuuuaacaucagauucacgggggaagagguccacggaaccucgggcagcuuucgacauuuccuguggcaagugugcaaggaacuucaguccaguucucucagccuguuacuguuguguccuucauccgccguuaacaaaaauaagggcaaguacauccucacaccaagccccauuacuuauggggaggagcagcugcuucacuuucugggacaacuacucgguauagcaaucagggcugaugugccucugccauuggaccugcuuccgucuuucuggaaaaccuuaguaggcgaaccccuggauccugagcaggaccuccaggaagccgauauucugacauacaacuaugucaagaaauuugagaguaucaaugacgaaacugagcuagaggcguugugcgcagaaauugccucccagcaucuggcuaccgagucaccagauagccccaacaagccuuguugccgguucacguaccucacaaugaccggggaagagguggagcuuuguucucguggacgccacauccugguugccugggaaaauaaagacauauaugcugcagccaucagaucgcucaggcugcgggaguuacaaaacguggaaugcgucacugcggugagagccggcuuggguuccauuaucccacugcagcuucugacaaugcucaguccccuggagauggaacuacgcaccugugggcuuccguacauuaaucuggaguuccucaaggcucacacuauguaucagguaggauugauggagaccgaucagcauaucgaauuuuucuggggcgcacuggagauguuuacacaagaagaguuaugcaaguucauuaaauuugccuguaaccaggaacgaauaccuuucacgugcccaugcaaggacggcgggcccgauaccgcucacgugccucccuacccaaugaaaaucgccccgccugacggaacugcagguagccccgacucaagguacauucgggucgagacauguauguuuaugaucaagcugccacaguauucuucccucgagaucaugcuugaaaaacugagaugcgccauucauuaccgugaggaucccuugagcggcuga

SEQ ID NO: 57156 - RNA, 4719 nt, Artificial Sequence
  derived and/or modified sequence opt3 from HECW1__Homo_sapiens__NP_001273988
augcugcuccaccuuugcagcgugaagaaccuguaccagaauagauucuugggcuuagccgcuauggcaucccccucuaggaacucacaaagucggcgccgauguaaagagccucugcguuauagcuacaauccagaccaguuucauaacauggaucuaagagggggaccgcacgacggugucaccauccccagguccacaucugauacugaccucguuacgucggauucacggagcacccugauggugaguuccucuuauuacagcauuggccauucccaggaccuuguaauacacugggauaucaaggaagagguggacgccggggauuggauuggaauguaucugaucgacgaagucuugucagagaauuuccucgauuacaaaaaccgcggcgugaaugguagucauagagggcagauuaucuggaagauagacgcgagcucuuauuuuguugaaccugagacaaaaaucugcuucaaguacuaccacggaguguccggcgcucugagggccacuaccccaucagucacagugaagaacagcgcagcccccauuuuuaaaaguaucggcgcugaugagaccguacaagggcagggaucucggcgccugauuuccuucagccucucggacuuucaggcaauggguuuaaagaaaggcauguucuuuaauccugacccauaucugaagaucucuauacagcccgggaaacacuccauuuucccugcccuuccacaucacggacaagaacgaagaucaaagaucauuggcaacacuguuaauccgaucuggcaggcugagcaguuuaguuucgugagcuugcccacagauguccuggaaaucgaggugaaggacaaauuugccaaguccaggccuauuauaaaacgguuccuagguaagcucucuaugccagugcagcgucugcuugagcgccaugcgaucggggauagagucguuagcuacacccugggaaggcgguugcccacggaccacgugucaggccaacuccaguuccgauuugaaauuacuuccuccauccacccugaugacgaggaaauaagccugucuaccgagccagaaucagcacagauucaagauagucccaugaacaauuuaauggagagcggcuccggggagccgcgcucugaagccccugagucgagcgaauccuggaaacccgagcagcugggagaagguucaguaccagacggcccugggaaccagaguaucgagcucucuagacccgcugaggaagccgcagugaucacagaggcuggagaucagggcauggucagcguggguccagaaggggccggcgagcuucuggcgcaaguucagaaggacauucagcccgccccuuccgcagaagaguuggcugagcagcuagaucugggagaagaggccucagcucuccugcuugaagacggcgaggccccagcaagcacuaaagaggaaccgcuggaggaagaggccaccacacaaucuagggcugggcgggaagaggaggaaaaggagcaggaagaggaaggagacguguccaccuuggagcagggugagggccgccuccagcugagagcgagugucaagaggaaaagccgucccuguucuuuaccuguguccgaacuggagacgguaaucgcaucagccugcggggauccagaaacuccccggacacauuauauucgaauacacacccuacuccauaguaugccuagcgcucaaggaggcucggccgcagaggaagaggacggugccgaggaagaguccacucugaaggauucuagcgaaaaagacgggcuuucagagguugauacaguggcugccgacccaagugcauuggaggaagauagagaggaacccgagggcgcgaccccgggaacggcucacccuggccauuccgggggacacuucccaucucuggccaauggugcagcccaggacggcgauacccaccccagcacaggguccgaaucagacagcaguccuaggcagggaggcgaucauucuugugaggguugcgacgcuuccuguugcagccccucguguuacucaucuaguugcuauuccacuagcuguuacucuagcuccugcuauucagccaguugcuacagcccaucuuguuacaacgggaaccgcuuugcaucccacacccgguucucaagugucgauagcgcuaagaucuccgagucuacaguguuuucgagccaggacgacgaagaggaagaaaauucagccuucgaauccgucccugauaguaugcaaucucccgagcucgacccagagagcacuaacggcgcgggaccguggcaggaugaacuggccgcuccuuccggccauguggagagaucacccgaagggcuugagucuccaguugcaggacccagcaauaggcgcgaagacugggaggcccgaauugauagucacggccggguguuuuauguagaccacgucaaccguaccacaaccuggcagagaccuacugcugccgcaacgccagaugguaugaggcgcuccgggagcauccaacagauggagcagcugaaucggagauaccagaacauccaaaggacaauugcgaccgaacgaucugaggaagacucaggaucccagaguugcgagcaggcccccgcuggcgguggcgggggaggcgggagcgauucggaggccgaaucuucccagagcucauuggaccuccgccgggagggaagucugucuccuguuaauucccagaaaauaacuuuacugcuacaaagcccggcagugaaguucaucaccaacccagaauuuuucacagugcuccaugcuaauuauucagccuacagagucuuuaccaguagcacuugucugaagcacaugauucuuaaagugaggcgugaugcacgcaacuucgagcgguaucagcauaauagagacuugguaaacuuuaucaauauguucgccgauacaaggcuggaacucccccgaggcugggagauuaagacggaccagcaagguaaauccuucuuuguggaccacaacucucgggcuaccacuuucaucgauccucgcauaccacugcagaaugggagauuacccaaccaucugacacacaggcagcaccuucaacgguugcgaagcuacuccgcgggagaggccucagaaguuucuagaaaccgcggcgcaagucuccuggcuaggccuggucauucgcuagucgccgccauccguagccagcaccagcaugagucccugccgcucgcuuauaaugacaagauuguggcauuucugcggcagcccaacaucuucgaaaugcuucaagagagacagccaucuuuggccaggaaucacacccugcgcgagaaaauucauuacauccgaacagagggcaaccacggguuagagaagcucucaugcgaugcggaccuggugauacuucugagcuuguuugaagaggaaauuauguccuacgucccucuccaggcugccuuccaccccggauauaguuuuucuccaagauguagcccuugcucaaguccccagaauaguccaggccugcaacgggcaagcgccagggcuccgucuccuuaccgccgugauuucgaggcaaagcuaagaaacuuuuaucggaaacuggaagccaagggguucggacagggccccgguaaaaucaagcucauuaucaggcgcgaccaucugcuugaggggacuuuuaaucagguuauggcguacucccgaaaagaguugcagagaaacaagcuguaugugaccuucgugggagaagagggcuuagauuacucagguccaagccgggaauuuuucuuccuccugucgcaagagcuuuuuaaucccuauuacggccuguucgaguacucugcuaacgacacguauaccguacagauaaguccuauguccgccuuugucgaaaaucaccuagagugguucagguuuagcgggcgcauccucggacuggcauugauucaucaguaccuguuagaugccuucuuuacaagaccauucuauaaggcucuccugaggcuucccugugaccugucagauuuggaauaccucgacgaggaauuucaccagucccugcaauggaugaaagacaacaauaucacugauauucuagaccugaccuucacagugaacgaggagguuuuuggccaggugacugaacgggagcuuaagucugggggagccaauacccaggucacggagaaaaacaagaaagaauauaucgaacguauggugaaguggcgcguugagcgaggcgugguacaacagacagaggcacucgucagagguuucuacgaagugguggauagcaggcuggucaguguuuucgacgcucgggaguuggaacuggugauagccgggaccgcggagauugauuuaaacgacuggcgcaauaacacugaauauagaggaggcuaccacgauggccaucucguaaucaggugguuuugggccgcaguggagcgguucaauaacgagcagcgacugagacuucugcaguuugucacagggaccuccagcgugccuuacgaaggauucgcugccuugcgcgguucuaauggccucaggcgguuuugcaucgagaaaugggggaagauuacuucacugccgcgugcucacaccuguuucaacagacuagaccugccacccuauccuaguuacuccaugcuuuaugaaaagcuccugacagcaguugaggagacgagcaccuuuggauuggaauga

SEQ ID NO: 57157 - RNA, 4719 nt, Artificial Sequence
  derived and/or modified sequence opt3 from HECW2__Homo_sapiens__NP_065811
auggccagcuccgcuagagagcaccuccuguucgugaggcggcgcaacccccagaugcgauacacccuuucuccugaaaaucugcaaucauuggcagcccagaguagcaugccagagaacaugacauuacagcgugccaauuccgacacugaucuggucacgucugaaucgagaucaagccuaaccgcuaguauguaugaguacacacucggccaggcccaaaaccugaucauauuuugggacauuaaggaagagguugauccguccgacuggaucgggcuuuaucauauugaugaaaauucucccgcaaacuucugggacagcaaaaauaggggagugacugguacccagaagggccagaucguauggcggauugaaccugggccauacuuuauggagcccgaaaucaaaauaugcuucaaguauuaccacggaaucuccggcgcccugcgcgcuacaaccccuuguauuacugugaaaaacccagcagucaugaugggugccgaggggauggagggaggcgcuucaggcaauuugcauaguagaaagcucgugagcuuuacacugucugaucugagggccguugggcucaagaaaggaauguucuuuaaccccgacccuuauuuaaagauguccauccagccagguaaaaagagcagcuucccgaccugcgcgcaccauggccaagaacggcgcaguacgauuaucucuaauacuaccaaccccauauggcaccgagagaaauacuccuuuuucgcacugcuuacagauguguuggaaauugagaucaaggacaaguuugccaaaagcagaccuauuaucaagagguuccuggggaaacuaacuaucccaguccagcggcuccuggaacgucaggcuauuggagaucagaugcuuucguacaaucugggccgcagauugcccgccgaccacgugucugguuaucuccaauuuaagguagagguuaccuccucagugcaugaggaugcaaguccugaagcugucgggacaauacugggagugaacagcgugaauggcgacuuaggcuccccaucugacgaugaggacaugcccgggagccaccaugauucacaggucuguaguaacggaccgguuuccgaagacagcgccgcggaugguaccccuaaacacucuuucaggacgucaaguacucuggagaucgacacagaggagcucaccagcacuuccucucggacaucgcccccacgaggccgccaggauagccuuaacgacuaccuggaugccauugagcacaaugggcauuccagaccuggaaccgcaacgugcucagaaaggaguaugggcgcuucucccaaguugcggagcuccuucccaaccgacacacgccuaaacgccaugcugcacaucgauucagacgaggaagaccaugaguuucaacaggaucucgguuaucccagcucucuggaagaggaagggggccuuauaauguucuccagagcuaguagggccgacgauggaagccugacuucucagaccaaauuggaagacaauccuguggagaacgaagaggcauccacacacgaggccgcuucauuugaagauaagccagagaaucucccggaacuggcggagaguagcuuacccgcaggcccugccccagaagagggggagggaggucccgaaccucagccaucggcugaccaaggcuccgccgagcugugugggucucaggaaguagaucagcccacuagcggagcagacaccggcacaucagaugccaguggugggucccgucgggcugugucugagaccgaaagccuagaccagggcuccgagccgucacaagucagcagugagacugaaccuucugauccagcccgaacggaguccgugagcgaagcaucgacaagacccgagggagaaucagaccucgagugcgcggauucuaguuguaacgaguccguuaccacucagcugagcucuguggacaccaggugcagcucccuugaaucagcucgcuucccugagacacccgccuuuaguagccaggaagaggaggacggcgcaugugccgcugaaccaaccucuuccgggccugccgagggaucacaggaaagugucugcacugcagguagcuugcccgugguacaaguuccauccggcgaggaugaagggccgggagcugagucugccacagugccugaccaggaggaacugggcgaggucuggcagcggagagguucgcucgaaggggcggccgcugcagccgagucacccccacaggaagagggcucagcuggagaggcccaaggcacgugugaaggggcaaccgcgcaggaggaaggagccacuggcgguucccaggcuaaugggcaucaaccccugaggagucuuccuucugugcgccaggaugucagccgauaccagcggguggacgaggcccugccacccaacugggaagcacguauugauucccacggaagaaucuucuauguugaccacgugaauaggacaaccacauggcagcgcccuacugcuccgccagcgccccaaguauugcagcggucaaacucuauccagcagauggagcaacucaauagaagguaccagagcauucgacgcaccaugacgaacgagcggccugaagagaauaccaacgcaaucgauggcgccggugaagaggcugacuuucaucaggcgagugccgauuucagaagggagaauauucugccacacuccacaagccguucucgcauaacuuuacugcuacagucacccccugucaaguuucucaucuccccggaguucuuuaccgugcugcauaguaaccccagcgcauaucggauguucacaaacaauacuugccuuaaacacaugauuaccaagguuagaagggacacgcaccauuuugagcgauaccaacacaaccgggauuuggugggcuuccugaauauguucgcuaacaaacagcucgaacugccacgcgggugggagaugaagcaugaccaccagggaaaagccuuuuucgucgaucauaauucgagaacaaccacuuuuaucgacccuagguuaccccugcaaucuucccggccaacaagcgcccuugugcaccgacagcacuugaccagacagcgcucacauagugcuggcgaaguaggggaggacucuaggcacgcaggaccucccgugcucccacguccguccagcacuuucaacaccguuucacggccucaguaccaagauaugguccccguggccuauaaugacaagaucguggcguuucugagacagccaaacauuuucgagauacuacaggaaaggcagcccgaucugacacgcaaucauagucuccgagagaagauccaauuuauuagaacggaaggcaccccuggucugguccggcuuagcuccgacgcugauuugguuaugcuguuaucucucuucgaggaagagaucaugagcuacgugccaccccacgcccugcuucauccuuccuauugccagucaccgagggggucuccagugaguucgccccagaacagcccuggaacucagcgcgcaaaugcccgugcucccgcaccauacaaaagagacuuugaggccaagcugcggaacuucuauaggaaauuggaaacaaagggcuacggucaaggcccugggaaacucaagcugauuauccgccgagaucaccuacuggaggacgcguuuaaucagauaaugggauauuccagaaaggaucuccagcggaacaaacuguacguaaccuucgucggcgaagaggggcuugacuacucuggacccucaagggaauuuuucuucuuggugagccgcgagcuguuuaauccauauuacggcuuauucgaguauuccgcuaacgauacauacacuguucagaucaguccuaugucugccuuuguggacaaccaccaugaaugguucagauuuagcgguaggauucucgggcuggcacuuauccaccaauaucugcuagacgccuucuuuacccggccguucuacaaggcucuccugcguauuuugugugaucugucagacuuagaguaucucgaugaagaguuucaucagucccugcaguggaugaaagacaaugauauccacgacauacuugaucugacguucacagucaacgaggaaguguuuggacaaauuaccgagcgcgaauugaagcccggcggugccaauaucccaguuacugagaaaaacaagaaggaauacauugagcgaauggugaaauggagaaucgagaggggcguaguccagcagaccgaaagucucgugcggggguucuacgagguggucgacgcacgccugguuagcguguucgaugcuagagaacuagagcugguaauagccggaacagcggaaaucgaccuuucugauuggaggaauaacacugaguaucggggcggguaccacgacaaucauauugugauccgaugguuuugggccgcagucgagagauucaacaaugaacagcgccucaggcuguugcaauuugugaccggaacauccucaauuccuuaugagggcuucgcuagccugcgggguucgaacgggccccguagauuuugcguugaaaaguggggaaaaaucacggccuuaccaagggcucacaccuguuucaaucgccucgaucugccucccuacccgucuuuuaguaugcuuuaugagaagcuguugacugcaguggaagagacauccaccuucggccucgaguga

SEQ ID NO: 57158 - RNA, 4146 nt, Artificial Sequence
  derived and/or modified sequence opt3 from HEG1__Homo_sapiens__NP_065784
auggccagccccagagcuuccagguggccuccaccgcugcuccuucuguuguuaccccugcuacuccugccuccagcagcccccggcacccgggacccuccacccucuccugcgcgccgagcucuuucacuggccccauuggcaggggccggacucgagcugcagcuggaacguagaccggagagggaacccccuccaacacccccucgggagcgcagagguccagcuacucccggcccgaguuacagggcaccugaacccggggccgcuacgcaacggggaccaagcggccgcgccccucgagguggguccgcggaugcagccuggaagcacuggcccgagucuaacaccgaggcucauguggaaaauaucacauucuaucagaaccaggaggacuuuucgacugucucaagcaaagaaggaguuauggugcagaccaguggcaagucccacgccgcaucugaugcuccagagaaucucacauuacuggccgagaccgcggacgccagaggcaggagcggguccucaagucggacuaacuucacaauucuucccguaggauacagcuuggaaauagcaaccgcucugacgucucaauccgguaaucuagccucagagagccuccaucugccuaguucuuccagcgaauuugaugagcguaucgcugccuuccagacuaaaucgggcaccgcaucugaaauggggacagagcgcgccaugggacuuuccgaggaauggacugugcacucacaggaggcuaccacaagugcguggagcccauccuuucugccggcauuggaaaugggcgagcucaccacgcccucuagaaagaggaacagcucagguccugaccugaguugguuacauuucuaucggacugccgcuuccagcccacugcucgaucuuucuucaaguagcgaauccacagagaaacugaauaacucuaccggguugcagucgagcuccgucucacaaacuaagacaaugcacguggccaccguuuuuacggacggaggcccccgaacccuacgcagucugacagugucucucggcccugucagcaagacugagggguucccaaaagauuccagaauugcaaccacaucaagcucugugcugcuuucccccagugccguagaaagcaggcggaauagucgcguuacuggaaacccgggugacgaggaauuuaucgagccuuccaccgaaaaugaguucggccugacaucauugagauggcagaacgauaguccaaccuuuggggagcaccagcucgcuagcucguccgaagugcagaauggaucucccaugagccaaacugagacggucucaaggaguguggccccuaugcguggcggugaaauuacagcacauuggcuguuaaccaacuccacuaccucugcggacgugacagggagcuccgcuucauaccccgagggcgucaaugccagcguucugacccaguucagugauucuacugugcaguccggaggcagccacacagcacuaggggaccggucguauucagagucuaguuccacgagcucuagcgaaucccucaacucaagugccccacgaggagagagaagcaucgcugguauaucuuacggccaaguaagggggaccgccaucgaacagcgcacuuccucagaccauacagaucacaccuaucugaguagcacauuuacuaagggagagcgggcacuuuuguccauuaccgacaacucuucgagcucagauaucguggaauccaguacgucuuacauuaaaaucagcaauuccucacacucugaguacagcaguuucuuccaugcucagaccgagagauccaacauaagcucuuaugacggcgaauacgcccagccuucaacagagucccccguccugcacacuucuaaucucccaagcuauaccccgacaauuaacaugccuaauacuucggugguucuggauaccgacgcggaauuugugucugauuccagcucaaguucuuccagcucaaguagcuccucuagcuccggucccccacuuccccugccuucagucucucaaagucaucacuuguucucgagcauccucccauccacgagggccucugugcaucuguuaaagucaacaagcgacgcuuccacccccuggaguucuagcccuucaccgcugccaguaucccuaacuacaaguaccagcgcaccccucucuguuucccagacuacccugccucagucaagcucgacaccagugcuuccccgcgcccgagagacgccugucaccucuuuucagacaaguacuaugaccuccuucaugacaauguugcacagcucacaaacugcugaucugaaaucccagucuaccccgcaccaggaaaaggugauuacggagagcaagagucccucccucgucagccugccaacagagucuaccaaagccgugacuaccaacucaccuuuacccccaagucugacagaauccagcacugagcagacccuuccugcaacaucuacgaauuuggcgcaaaugucgcccaccuuuacuacaaccauccucaagacuucacagccacugaugacaaccccggggacgcuaagcuccacugccagucugguuaccggcccuaucgcugugcagacaaccgccggaaaacagcucucucugacucaucccgaaauucuuguaccacaaauaagcacagagggcgggaucuccaccgaacggaaccgugucauuguggacgcaacaacuggauugaucccccugaccucaguuccuacgagugcuaaggagaugacaaccaaauuaggugugacugccgaguacucuccagcaagcagaucccucggcaccucacccagcccucagacaacugucgugucuaccgccgaagaucuggcuccgaaguccgcgacguucgccguacagaguagcacacaaucgccaaccacuguguccucuucagcaagcguuaauaguugcgcugucaaccccugucuucacaauggggagugcguggccgacaacacauccaggggauaucauugucgcugcccucccucuuggcagggcgacgauuguagcguggacgucaaugaaugccugucaaacccauguccuuccaccgccaugugcaauaacacucaggguaguuuuauauguaaaugccccguuggguaccaguuggagaagggcauuuguaaccucgugcggacauucgugaccgaguuuaagcugaaaagaacguuccuaaauacuaccguagaaaagcacagcgaucugcaagaggucgaaaacgagaucacaaaaacccucaauaugugcuuuucugcucugccaucauauaucagguccacagugcacgcaagccgagaaucuaacgccguugugauuagucuucagacuaccuucucguuggcguccaaugucacgcuguuugacuuagcugaucgcaugcagaagugcgugaacagcuguaaaucaucugccgagguuugccagcuccugggaagccaacggagaaucuucagggcaggcucccuuuguaagcguaagaguccugagugcgacaaagauacaucaauuuguacugaccuggaugggguggcccuaugccaguguaagucuggauacuuccaguuuaauaaaauggaccauagcugccgcgcuugugaagauggcuaccggcucgagaacgaaaccugcauguccuguccguucggucugggaggguugaauugcggcaaccccuaucagcugauaacaguagucaucgcagccgcggguggcggguuacuccugauucuuggaaucgcucugaucgugaccugcuguagaaagaauaaaaacgacauuaguaaguugauauuuaagagcggcgauuuccaaauguccccauacgccgaguauccuaaaaaucccaggucucaggaaugggggcgagaggcaaucgagaugcacgaaaacggaucaacuaagaaucuccugcagaugaccgacguguacuauagcccaacaucgguccggaacccugagcuagaacgcaacggccuguaccccgccuauacgggucuuccgggguccagacauaguugcauuuuuccaggacaauacaauccuucuuucaucagcgacgagucaaggcggcgagauuacuuuuga

SEQ ID NO: 57159 - RNA, 2655 nt, Artificial Sequence
  derived and/or modified sequence opt3 from HELLS__Homo_sapiens__NP_001275996
augcccgccgagagaccugcuggcagcgggggauccgaagcaccagccaugguggagcagcuggacaccgcggucaucacaccggcuaugcucgaagaggaagaacaacuugaggccgcaggucuggaaagggagcggaagauguuggaaaaagcccgcaugucuugggaucgagagucaacugagauucguuacagaagguuacagcaucugcuagaaaagaguaacauauauagcaaauuccuccugacgaagauggagcagcagcaacuugaggagcagaaaaagaaggaaaaacuggagcggaagaaagaguccuugaagguuaaaaagggcaaaaauucuaucgacgcuucggaagagaaacccgugaugcgcaagaaaagagggagggaagaugagucauacaacauuagcgaaguaaugaguaaggaggagauccucuccguggcaaagaagaauaaaaaggaaaacgaggacgaaaauucuagcuccaccaaccugugcgucgaggaucugcagaagaauaaagacucaaacaguauuaucaaggaucggcucagcgaaacagugcgccagaauacuaaauuuuucuuugacccuguucgaaaguguaacggacaaccagugcccuuccagcagccuaaacacuuuaccggcggugucaugagaugguaucagguggaggggauggagugguuaaggaugcugugggaaaauggaauaaacggcauccuugccgaugagaugggcuuggggaagacaguacaaugcauugcuaccaucgcccugaugauucagcggggaguuccaggucccuuccuaguguguggcccucucucuacucugccaaauuggauggcggaauuuaagcguuucacaccggacauccccaccaugcuuuaccacgggacgcaggaggagcgccaaaaacuggucagaaacauauauaagaggaaaggaacuuugcagauucauccuguggugaucaccuccuuugaaauugcaaugcgggaucgaaaugcccuccagcacugcuacuggaaguaucugaucgucgacgagggccaucgcaucaaaaacaugaaguguagauuaauuagggaacugaagcgguucaacgcugauaauaaacuccuucugacagguacuccauugcagaacaaucuaucagagcuguggagccuccugaacuuucuucugcccgacguuuucgacgauuugaagaguuuugaaucuugguucgacauaaccucccucagcgagacagccgaggauaucauugcaaaagaacgcgagcaaaaugugcugcacauguuacaccaggaaagaaucccuaggauguacguaucggaguucaccgacgaaggguuuuucgagggaaagcugccaucucguaaagaucuauacgacauacggcccuaugagaacacguaccuccugaaacuucauacuaauuuugaaauuuugacaccguuccugcuccgaagacugaaguccgauguggcucuugaggucccucccaaaagggaagugguuguguaugccccacugucaaagaaacaggagaucuuuuacaccgcgaucgucaaccgcacuauugccaauauguucggcaguagcgaaaaggagacaaucgaguuguccccuaccggccggcccaaaagaaggacgcgcaagucuauuaacuauagcaaaauagacgauuuuccaaaugaacucgagaagcugaucucacagauucaacccgaaguggaccgagagcgggcaguaguugaggugaacaucccugucgaaagugaggugaauuuaaagcugcagaacaucaugaugcuacuccguaaaugcuguaaucacccauaccugauugaauauccgauagaucccgucacccaggaguucaagaucgacgaggaacuugugacaaacuccgggaaauuuuugauucuggacagaaugcucccugagcugaagaaaaggggacauaagguuuuacuguucagccagaugacuucuaugcuugauaucuugauggacuacugccaccuccgcgauuuuaacuucucacggcuggacgguaguaugagcuacuccgaaagagagaagaauaugcacucuuuuaacaccgauccagaaguguucauuuuccuaguaucgacaagggcuggcgggcugggaaucaaucucacugccgcugacaccgucauaaucuaugauagcgacuggaacccccaauccgaucugcaggcccaggaccgaugucaucgcauuggccagacaaaaccugugguuguguaccggcuugucaccgcaaauacuaucgaucaaaagauuguggagagagccgcugcgaaaaggaaguuggaaaaacugaucauacacaagaaccauuuuaagggugggcagucaggcuuaaaucucaguaaaaacuuccuggacccaaaggagcuuauggagcuguugaaaucucgugauuaugaacgcgagauuaagggaagccgggaaaaaguaaucuccgacaaggaccucgagcugcuacuggauagaucagaccucauugaucagaugaaugcaagcggccccaucaaggaaaagauggggauauuuaagauccuggagaacucugaggacuccaguccggaaugccuuuucuga

SEQ ID NO: 57160 - RNA, 3306 nt, Artificial Sequence
  derived and/or modified sequence opt3 from HELQ__Homo_sapiens__NP_598375
auggacgagugcggcagcagaaucaggcggcgcgugucccugcccaagcgaaaccguccuucucucggguguauuuucggagccccaaccgcugcagaacuugagccgggugaugaaggcaaagaggaagaggagauggucgccgaaaauagaaggcggaagacagcggggguucugcccguggagguacagccuuuguuacugucagacaguccagaaugccuagugcucggaggcggugauacuaaccccgaccugcuucgccacaugccuacggauagaggggucggagaccaaccaaaugauagcgagguggacauguuuggcgauuacgacuccuucaccgagaacucuuuuauagcucagguugaugaccuggaacagaaauauaugcaguugcccgagcauaagaaacacgccacagauuucgcaacugaaaaucucuguucggagucaaucaagaacaagcugagcauuaccacaaucggcaaucugaccgaacuccaaacugacaaacauacagagaaccagaguggguacgagggagugaccauugaaccuggugccgacuuacuguaugaugucccauccucucaggcuaucuacuuugagaaucuucagaacagcuccaaugacuugggcgaucacucaaugaaggaaagggacuggaaaaguagcucucauaacacggugaaugaggaacugccgcacaacugcauagagcaaccccagcagaaugaugaguccucaagcaagguacggacuucaucugacaugaaccgccgaaaauccaucaaggaucaccuaaagaacgcaaugaccgggaaugccaaagcucagacaccuauuuucagcagaucgaagcaacucaaagacacucugcuuucugaagagaucaacguugccaagaaaaccguggaauccucaaguaaugaucugggaccauuuuauagcuugcccuccaaggucagggaccucuacgcgcaguucaaaggcauugagaagcuguaugaauggcagcauacauguuuaacccugaacucugugcaagagcggaagaaucucaucuacagccuuccuacgucaggugggaaaacucugguggcagagauauugaugcuacaggaacugcucugcugucguaaggauguccugaugauucuuccauacguugccaucgugcaggagaaaauuaguggacuguccagcuuuggcaucgaauugggcuucuuuguagaggaguaugcugggucuaagggacgcuuucccccgacaaaaagaagggaaaagaagucacucuacaucgccaccauugagaaaggucacagucuggugaacagcuuaauagaaacuggccggaucgacucccuggggcuagucgugguugacgagcuccauaugauuggagaaggcucucgaggugcaacacuggagaugacccuugcuaagaucuuguauacgucgaaaaccacacagauaauugggaugagcgccacucugaauaacguggaggaucuccaaaaguuccugcaggcggaauacuauaccucccaguuccgcccugucgagcuuaaagaauaccugaagaucaaugacacaaucuaugagguggauucaaaggccgaaaacggcaugacuuucaguagauugcucaauuacaaauacucugacacccugaagaaaauggaucccgaccacuuaguagcacugguuacagaggugauuccaaacuauagcugccuagucuuuuguccuuccaagaaaaauugcgagaacguggcugaaaugaucuguaaguuccucucaaaggaguaccugaaacacaaggaaaaagagaagugcgaagucauuaaaaaucuuaagaacauaggaaacggcaauuugugccccgugcugaaaaggaccaucccauuugggguugccuaucaucacagcggacucacuucugaugagcggaagcuguuagaggaggcuuacuccacgggugugcugugucuuuucacaugcaccaguacuuuggccgcaggcguaaaccuccccgcccgcagagucauucugagggcuccuuauguggcgaaggaguuucuaaaacguaaucaguacaagcaaaugaucgggcgggcaggacgagccggcaucgacaccauuggugaaagcauacugauccuccaggagaaagauaagcagcagguucuggagcuuauuacaaaaccauuggaaaacuguuauucucaucuggugcaagaguucaccaaggggauccagacuuuauuucucucccugauuggccuuaagaucgcuacaaaucuggacgauauauaccacuucaugaacggaacguuuuucggcguccagcagaaaguguugcucaaggaaaaaucacugugggagaucaccguagaaagucuaagauaccugacugagaaggggcuccugcaaaaagacacaauuuauaagagcgaggaagaggugcaguacaauuuucauaucaccaaacuuggaagggccucguucaaggguacaauugauuuggcauauugcgacauccuguaccgcgacuuaaagaaaggccucgaagggcugguucuugagucccugcuacaccucauauaucugacuaccccguacgauuuggucucucaguguaaccccgacuggaugauuuauuuucggcaauucagccagcugaguccugccgaacagaauguggcugccaucuuaggagugagugaguccuucauuggcaagaaagcaucuggucaggcgaucgggaagaaggucgauaaaaacguugugaauagacucuaccugagcuuugugcuuuacacgcuguugaaggagaccaacauauggacaguauccgaaaaauucaauaugccaaggggcuauauccaaaaccuccugacuggaaccgcuucauuuagcaguugcguccuacacuucugugaggaacuggaggaauuuuggguguaccgcgcccuucucguugagcugacaaagaaauugacuuauugcgugaaggcagagcugauucccuuaauggaagucaccggcgugcucgaggggcgagccaaacagcuguacucugcuggauauaagucccuuaugcaucuggccaaugcaaacccugaaguuuuggugcggacgaucgaccaccucagccguagacaggcuaagcagauuguaucgucagccaaaaugcugcuacaugagaaggcggaggcccugcaagaagaggucgaagaacuucucaggcugccaucugauuuccccggcgcuguggcaaguuccacagacaaagccuga

SEQ ID NO: 57161 - RNA, 729 nt, Artificial Sequence
  derived and/or modified sequence opt3 from HELT__Homo_sapiens__NP_001287710
augagcgacaagcugaaagagagaaagaggacccccgugucccacaaagucaucgaaaagcggcgccgagaucguauuaacagaugccucaaugagcuuggcaaaacaguuccuauggcccuggcuaagcagucuucagggaaguuggaaaaagcagagauauuagaaaugacugugcaauaccugagggcccuacacagugcggacuucccacggggacgcgagaaggcugagcuccuggccgaauuugcaaacuauuuccacuacgguuaucaugaguguaugaaaaaucuuguacacuaccugacgaccguggaaagaauggagacaaaggauacuaaauaugccaggaucuuggcuuuucuccagagcaaggcacggcugggcgccgagccggcuuuucccccucuggggucccucccagaacccgacuucucuuaccaguuacauccugccggaccagaguucgcgggccacucgcccggugaagcagccgucuuuccucaggggucaggagcuggcccauucccguggcccccuggcgccgcacgcagcccagcucugcccuaucuuccuagugccccagugcccuuggcguccccggcccaacagcacucuccuuuucugacccccguucaggggcuagaucgacauuaccucaaccugauuggacacgcacauccaaaugcucuuaaccugcacacaccucagcaucccccaguguuguga

SEQ ID NO: 57162 - RNA, 7950 nt, Artificial Sequence
  derived and/or modified sequence opt3 from HELZ2__Homo_sapiens__NP_001032412
auggcagugugggaggcugaacagcugggcgggcuacaaaggggugaccuucugacacccccugcaccugauggggacggcaggaccgccccguuggggcagcccccuggagcgcaguuauacugcccagcuugucuggucacuugccacagccaggaggccuucgaaaaccauugugcauccucugagcacgcccaaaugguugcuuuugaucaggcacuacccugggaacaccggucaccuccacccggccucaguaaguucgagcugugcccuaaaccagaccuuugugaguauggugaugccugcacgaaggcucacagcgcccaggaacugcaggagugggugcgccgaacccaagcgguagaauugcgugggcaggcagccuggcaggacggacucgugccguaccaggagagacugcuggcugaguaucaaagguccucuucggaaguccucguguuagccgagacccuggauggcguucgggugacuuguaaucagccccuuauguaccaggcacaagaacgcaaaacccaguauucauggacauuugcuguccauagcgaggaaccuuugcugcacguggcccuacucaagcaggagccaggcgcggacuucagucugguagcccccgggcuuccuccaggaagacuguacgcaaggggugagcgguuucgcguucccuccucuaccgcugauuuccaggugggcguccgagugcaagccgcuagcuuugggacuuucgaacaguggguggucuuugacuucggaagaaggccgguuuugcuccagaaacugggcuuacagcugggucaagggcggcguccuggacccugccgcaaccucgcccuuggccacccagaggaaauggagagauggcauacaggcaauaggcacgugguaccugggguggaacggaccgcagagcagacggcccugauggcuaaguauaagggacccgcguuggcacuagaguuuaaccgauccucagucgccagugguccaaucagccccacuaauuaccgccagagaaugcaucaguuccuguacgaagaggaagcugcccaacagcagcucguggcaaaacugacccuuaggggccagguuuuucugaagacagccuugcaaacuccugcucucaacaugcuguucgccccaccgggggcauuauaugcggaggugcccgucccuucuucccugaugccagauaccgaccagggauuccuacucggccgggcugugucaacagcccugguagcacccguuccugccccagauaauaccguguuugaaguccgccuugagagaagggcuagcagugagcaggccuuguggcugcuccugcccgcacguuguugccuugcucuggguuugcaaccggaagcccggcucgugcuggagguccaguuccagauugacccuaugacguuucgauuauggcaccaggcgguggacacucugccagaggaacagcugguugugcccgaucucccuacaugugcccugcccagaccauggucuguaccuccccuuaggcgcgggaaccggaaacaggaguuggcugucgcacugauagccggcuggggaccaggcgacgggagaagggugccgccucuccugaucuacggacccuucgguaccggcaagacuuauacauuagcuauggccucccuggaaguuauucgccgaccagagaccaaagugcuuaucugcacgcacaccaauagcgcagcggauauuuacauccgggaauauuuucauucgcacgucucugggggacaucccgaggccacaccuuugcgugugauguacacugacagaccacucucccagaccgaucccguaacacugcaguauugcugucuaacugacgauaggcaggcuuuccgcccuccgacccgggccgaacuggcaagacacagggugguugucacaaccacuucacaggcucgagagcuccgcgugccagugggcuuuuucagucauauacugaucgacgaggccgcacagaugcuugaaugcgaggccuugacgccccuggcuuacgcgagccacgguacacgguuaguccucgccggggaucacaugcagguuaccccuagacuguuuuccguggcaagggcucgugccgccgaacauacucuucugcaccgcuuguuccucuguuaccaacaggagacccaugaaguggcucggcagucuagacugguauuucacgagaacuauaggugcacagacgcaauugucagcuucaucucacgacacuuuuacguggccaagggcaauccaauucaugcgcggggaaagguucccccucacccgcgccauuauccccuaauguucugucacguggcuggcaguccagauagagacauguccauggccagcuggcugaaccucgcagagaucgcccaagucguggaaaaaguucaggaggcuuacaauaccuggccuucuugcuggggaggaagggaacagcgguguauaugcgugguaucacauggugcacaggucagugcccugcgacaagagcuuagacgcagggacuugggccaggugagcgugggguccuucgaaauucugcccggacgucaguuucgggucguuguguuaucuacuguacacacaugucagucgcuccugagcccaggcgcgcuugcuccugaguucuuuacggaugccagagugcugaacaccguccuaacuagggcacaaucccagcucgugguugugggugacgccgucgcucugugcucauucggggccuguggcaaguugugggagaguuuuauccgcgaaugcguggagcgacacucuguuugccccgaaggacugagcauggagcaaguggagcagggcgucgcacaaagacggagguggccaccgcgcgggacacaggcuggagccgcgggcaauugggaagccgcaccugagcccguaggugauuuagcugaggaacaagccgcugugguuaccgcaauggugaaagccgaaccaggggacgaggcccucucccccgcuucacgugauauuacagcgacuaccgcacagacggaggccgcugccgccccugcaggagacgcugucaaggaagaugugguaccaggcgcgugugccgccggugcugccgcagccgcuggcguggagagcaccgaagccgaggacgcggaagcagauuucuggcccugggacggggagcugaacgccgaugacgcuauccuuagagagcuguuggaugaaucucaaaaagucaugguuacagugggagaggacggccuccuggacacuguggcccggccugaaucccuacagcaggcuaggcuguaugagaaccuuccgccagcagcccuccgcaagcuguugcaugcugaacccgagcgauacagacacugcaguuuugucccugagaccuucgaacgggccagcgcaaucccccuggaugacgcgucuuccgggccaauucaagugaggggacgcuuagauuguggcauggccuuugcuggugacgagguucucguacagcugcuuucaggggauaaagccccugaaggaagacugaggggccggguguuggguguccucaagcguaagcgccaugagcuggcauucgugugccgaauggacacaugggaucccagaauaaugguuccaaucaauggcagugugacuaaaauuuuugucgcugagcuaaaggacccuagccaggugccgaucuauucgcugaggaaagggcggcuucagcgcguaggacucgaaagacugaccgccgaggcaaggcacucccgguuguucuggguccaaauaguguuauggcgacagggcuuuuacuacccccuggggauuguuagagaagugcucccagaggccucuacgugggaacagggacugcgcauccuuggccuggaguauagcuugagggucccucccucagaucaggcuacaaucaccaaggugcuacaaaaauaccauacugagcugggucggguugcggggcguagagaagacuguagggccuuccucacauucaccguggauccacagggagcaugcaaccuggacgaugcucuuaguguccgcgacuuaggcccucggugugagguggccguacacauuacugacguggccuccuuuguuccccgagaugguguccuggacguggaagcaagaaggcagggcgcugccuucuaugcgccggggcgcgagccagugccuaugcuccccgcuucuuugugccaggauguccugagccuccugccaggacgggacagacuugccaucucccuguuuuugaccauggaaaaggcaucaggccaacuaaagagccugcguuucgcccccaguguagugcagucugauaggcagcucuccuacgaggaggcugaagagguuauucggcaacacccuggggcaggacgcgaauuaccggcccgacuggacagcguggaugcgugugucguggcugccugcuauuuuucgagacuucugaggcggcaucgccucagaucagacuguuucuacgagcagcccgaugaagacggcacauuggguuuuagggcagcccacauaaugguuaaagaguauaugauccaguucaaucgacugguggcugaguuucucgucgggucugaaugcacgcggaccgugacuccacugcguuggcagccugcccccagaagucaacagcuuaaggcacuaugcgagaaacauggagaucgcguaccucuguccuugcacuuaggccaccaucugcacggcgggggagguagcccacccgacacaaggcuccaucugcuugcuucucuguggaagcaagugcaguucgccgcgcggacccaagacuacgaacagaugguugaucucgucacaacugacgauaugcacccauuuuuggccccagcaggcagagaccugcgcaaagcucuagagaggagcgccuucgggcgaugugcacggggacaucagcagcaaggcggucacuacucccuacagguggauugguauaccugggcuacgucacccauuagaagguaccucgacgugguccuucagcgccagauccuguuagccuuggggcacggaggcagugccuauagcgcgcgugauaucgacggccugugccaggcuuucucucuccagcaugcacuggcccaguccuaccaacggagagcuaggucacuucaccuggccguucagcucaaggcacagccguuggauaagcugggguuugugguagacguggaggccggaagucgcuguuuccgauuacuauuuccuagcaaccgggaaacacugccagaucccugcccugucccauaugguucccuccagcuugcugagcauccccacgcgcuggccggcagaccgggguugaggcugcucuggcgcagacggguguacucugcacaaggaucgagcccuccccugccacuuccuggcaccguucccgacccacacacucucgcuguggaaaccgcccuguggaaacaguugcuggaguuagucgaacuacagagguggcccgaggcagccgcucugauucaggagaagggugaagccucacaacgucgagagcucguacaggugcagcgcucccauugugggcacuuccuugaaguugcgagagagcugggaaguggcgauacauugcaagugcagcugggcacuucucuccagcauggguuucuggucccuagcccacagcuuuggaccguggcaccgggauucuccuuaugccuggaacacgucgagcggcccggugacuguuuuucaggcaggguguaucgcgccccuagagaccgguacagggauguugacgaguacgcuugcgugugggaaccauucugugcccucgagucugcaacaggggcuguagccgaaaaugauagcgugacguugcaacaucugagugucuccugggaggcuagccgaacaccccagggacagcuacagggcgccuuucgucuggaagcagcguuccucgaggagaacugcgccgacauaaauuuuucuuguugcuaucuuugcaucagacuggaagguuugccugcuccaacugccucaccccgcccugggccguccagucugggaccaggccucaacguugaucccggcacauacaccuggguggcacacgggcaaacucaggacugggaucaggagcggagggcugacagacaggaagccccucgccggguccaccuguucgugcaucacaugggaauggagaaaguacccgaggaaguguuaaggccagguacacuuuuuaccguugagcugcucccuaagcaacuacccgaucugcgaaaagaagaggcagugagaggcuuggaagaggccagcccacuggucacgucgauugcgcucgggcggccggugccucagccccuuuguagggucaucccaucucgcuuccuggagcgucagacuuauaauauucccggaggcagacauaaguugaacccuucccagaauguggcuguucgagaagcccuggagaagccauucaccguaauccaaggucccccugggacaggaaaaaccauagugggccuccacaucgucuuuugguuccacaagagcaaccaggaacaggugcaaccgggcgggccacccaggggagagaaacgguuagguggcccuugcauucuguacugugggccaucaaauaagaguguugacgugcuugcaggacugcuacuccgcagaauggaacugaaacccuugagggucuauucugagcaggccgaggcuuccgaauuuccugugccccggguaggcagccgcaagcugcucagaaaaucaccacgagaggguaggccgaaccagagucuucggagcaucacucugcaucaccguauucgccaggccccuaaucccuacuccucugaaaucaaggcauucgauacaagauuacaaagaggggagcuguuuagccgggaagacuuggugugguauaagaaaguucucugggaggcuagaaaguucgagcuggaucgccaugaagucauacuaugcaccuguuccugcgccgcgucagcuucucuuaaaauucuggacgugcgacagauccucguggacgaggccggcauggcaacagaaccagagacucugauuccuuugguccaguuuccccaggccgagaagguugugcugcucggagaucacaaacaacuuaggccaguagugaagaacgaacggcugcagaacuuaggccuggacagaaguuuguucgagcguuaccaugaagaugcucacaugcucgacacccaguaccgcaugcacgaggggaucugugcauuuccuucggucgccuucuauaagagcaaacugaagacguggcagggacuaaggcggcccccguccgugcuuggucaugcgggcaaagaaucuugcccaguuauauuugggcacgugcaaggacaugagagaucacugcucgucagcacagaugagggcaaugaaaacuccaaggccaaucuggaggaaguggcugagguaguucgaaucaccaaacaguugacuuuagguaggaccguggaaccucaggacauugcaguccugacacccuacaacgcccaggcuagugagaucucuaaggcccuccgccgggaggggauugcaggcguggcugugagcucaaucacuaagucccaaggaagugaauggagauauguccuuguuagcaccgugaggacgugugccaaaucugaucuggaccagcgcccaacaaaguccuggcucaaaaaguuccugggcuuuguaguggaucccaaucaggucaacguggcgguuacccgugcccaagaggggcucugcuugauaggagaccaucugcuucugcgguguugcccucucuggagaucauuacuggauuucugcgaagcacagcagacuuuggugccggcuggucagguccgaguguguaggcgcccaacaaugcccagcuga

SEQ ID NO: 57163 - RNA, 5829 nt, Artificial Sequence
  derived and/or modified sequence opt3 from HELZ__Homo_sapiens__NP_055692
auggaggaccgaagggccgaaaaguccugcgaacaggcuugugaaucccugaaacggcaagauuacgagauggcacucaagcacugcaccgaagcccuucugucuuugggccaguauucaauggcggacuucacagggcccuguccuuuagagaucgagcgcauuaaaauagaaagucugcuauaccgaaucgcuagcuuccuccagcugaagaacuaugugcaggccgaugaggacugccgucauguccuuggagaaggucuggcaaaaggcgaggaugccuucagagcuguuuuguguugcaugcaacucaaggggaagcugcagccaguguccacuauucuggcaaaaucucucacgggagagucguuaaauggcaugguaaccaaggaccugacaaggcuuaaaacuuugcugucagaaaccgagacagccaccagcaacgcucuaagugguuaccacguggaagaucucgacgagggguccuguaauggauggcauuuucggccgcccccucgcggcaucacuucuagcgaagaguauacacugugcaagagauuccuugagcagggcauuuguagguacggggcccagugcaccuccgcgcacucacaagaagaacuggcagaauggcagaaacgguaugccagucgcuugaucaagcucaagcagcagaacgagaauaaacaacugagcggaucuuacauggaaacguuaauagagaaguggaugaacucccugucaccagagaaaguccucagcgaauguaucgagggugugaagguugaacauaaucccgaucuuagugugacugucucuaccaaaaagucccaccagacauggacuuuugcucugaccugcaaaccugcccgaauguuguacagaguggcacuacuguaugacgcucacaggccacauuucagcauuaucgccauuucggcgggcgauucuacaacccagguaucccaagagguucccgaaaacugccaggaguggaucgggggaaagauggcccagaauggccucgaccacuacguguauaaggucgguauagcauuuaacacggagauuuucgggacuuuucggcagacaaucguguucgauuuuggacuggaaccugugcuuaugcaacgugucaugauugacgcugccucaaccgaggaccuggaauacuugaugcaugcuaaacagcagcucguuacuacagccaagcgcugggauaguagcuccaaaaccaucaucgacuucgagccaaaugagacgaccgaucuggaaaagucuuuacugauuagauaucagauaccgcuaagcgcagaccaacucuuuacacagucagugcuggauaaaagucuuacuaaguccaacuaccagagcagguugcacgaccugcucuauaucgaggaaauugcccaguacaaggagaucucuaaauucaaucugaagguacaacuucagauacuggcuucauucauguugaccggcgugaguggcggggcgaaauacgcacagaacggacagcucuuuggucgguucaagcugacagaaacuuuaagcgaggauacccuggccggccgccuagucaugacaaaagugaaugcuguuuaucuccugcccgugccuaagcaaaaacuuguccagacccaggggacuaaagagaagguguacgaagccacgauugaggagaagaccaaggaguauaucuuuuugagacuguccagagaauguugcgaggagcucaaccugaggccagacugugauacccaaguagaauuacaguuccagcugaaccggcuucccuugugcgagaugcacuacgcacucgaccgcaucaaagauaauggaguucuguuuccugacauuucuaugacuccaaccauccccuggucgccgaacagacagugggacgaacaacuagauccuaggcugaaugccaagcagaaggaggcugugcucgccauuacaacaccccuggcaauacagcuuccaccugucuugaucauuggccccuaugguacugggaaaacauucacgcuggcgcaggcugugaagcauaucuuacaacagcaggaaacccguauccucauuuguacucacagcaacuccgccgcagaccuguacauaaaagauuaucuucauccauacgucgaggccggcaauccccaggcucggccucugcgaguguacuuuagaaacagguggguuaagacagugcacccaguaguccaucaauauugcuugaucucaagugcccacucuaccuuccagaugccgcagaaagaggacauucucaagcaccgcgugguuguggucacacugaauacuagccaauaccuaugucagcuggaucucgaacccggauuuuucacccauauccugcuugacgaggcagcucaggccauggaaugcgagacgauuaugccuuuggcgcuggccacccagaacacacggaucguguuagcuggcgaucacaugcaacucuccccauuuguauauucagaguucgcaagagaaaggaaucugcaugugagccuucuggaccgccuauacgagcacuaucccgccgaauuuccuugucgaauacuccugugcgagaacuaccggucucacgaagcuaucauuaauuauacuuccgaguuguucuacgaggggaaacugauggccaguggaaagcagccagcacauaaggauuucuaccccuuaaccuuuuucacagcgcguggugaagacguucaggagaaaaacagcacugccuuuuauaauaacgcugaagucuucgaggugguggaaagagucgaggagcucaggcgcaaguggccgguugccuggggcaaacuggaugacgggucuaucggaguggugaccccuuacgcagaucagguauuucggauuagagcugaacuuaggaagaaacgacuguccgacgucaauguggagcgcguuuugaacgugcaaggcaagcaguuccggguccucuuucugucaacggugagaacaaggcacaccuguaagcauaaacagacuccaaucaagaaaaaggaacagcuacuggaggacaguacagaagaucuugacuaugguuuccucagcaacuacaaacuguugaauaccgccauaacucgugcacaaucgcugguugccgugguaggggaucccauugcuuuaugcuccaucggccgcugccggaaguuuugggagagauucauugcgcucugucacgagaacucuagccugcauggaaucaccuuugaacagauaaaggcccagcuugaggcacuggaauugaaaaagacauauguccucaauccucuggcucccgaguucaucccaagggcccuacgacugcagcacucaggcaguacgaacaaacaacagcaguccccucccaaggggaaaucucuucaccauacccaaaaugaccacuuucagaacgauggaauugugcagccaaauccgagcgugcucaucgguaacccuauucgggccuacacucccccacccccucugggcccacaucccaauuuggggaaguccccuucaccgguccagcgcaucgacccacacacaggaaccagcauauuauauguucccgcuguguacggcgguaacguagugaugagugucccucugccagugcccuggacaggguaccaaggcagauucgcaguugauccuaggauuaucacucaucaggccgcgauggcuuauaauaugaaccuccugcagacccacggacggggcucuccgauccccuacgggcuuggacaccauccaccugugacgauuggccagccccaaaaucagcaccaggagaaggaccagcaugaacaaaaccgaaaugguaaauccgauacaaacaacagcgggccagagaucaauaagauuagaaccccugagaaaaagcccacugagccaaaacaggucgaccuggaaucgaacccgcagaaucgcucaccugagucuaggcccagugugguuuauccauccaccaaguucccccguaaagauaacuugaauccucggcacauaaaccuaccacugcccgccccucacgcacaauacgccaucccgaauagacauuuucacccacucccccagcugccuaggcccccauucccuauuccccagcagcauacacuuuuaaaccaacagcagaauaaccugccagagcagccuaaucaaaucccgccccagccaaaccaggugguccagcaacagagccagcucaaucagcaaccucagcagcccccaccucaauugucucccgcuuaucaggcaggaccgaacaaugccuuuuucaacagcgcgguagcucaccgcccacaguccccucccgccgaagcagugauuccagagcagcaacccccuccgaugcugcaggaaggccauucaccccuccgagccaucgcucagccagguccuauacugcccagucaccuuaacagcuuuaucgacgagaauccuucuggccugccaauuggggaagccuuggauagaauccacggauccguugcacuagagacucugcggcagcaacaggcuagguuccagcaguggucagagcaucacgccuuucucagucaaggcagcgugcccuacccucaucaccaccauccacacuuacagcaucugccccagccgccucuugggcugcaccaaccacccguccgcgcggacuggaagcucaccuccucugccgaagacgagguggaaacaacguauucgcguuuccaggauuugauuagagagcugagccaucgggaccagucagaaaccagggagcucgcagagaugccuccaccccagucccgccugcuucaauaccgacagguacagaguagaucuccgccugcugugcccagcccaccuuccucaacugaucacucuagccacuuuaguaacuucaaugacaacucccgggauaucgaagucgccagcaaucccgcuuuuccacagaggcuacccccucaaauauucaacucuccauucucacugccguccgagcauuuggcacccccuccauuaaaguaccuggcccccgacggagccuggacauuugcuaaucuccagcagaaccaccugaugggcccugguuucccauaugggcuucccccucugccgcaucgcccaccccagaauccuuuuguucaaauucagaaccaccagcacgcgaucggacaagaacccuuccauccacucaguagcagaaccgugucgucuuccagcuugccuucacuggaggaguacgaacccaggggcccaggucggccgcuauaucagcgucgcaucaguucuuccagcgugcagccuugcucagaggaagucaguacuccccaggauagccuggcacaauguaaagagcuccaggaccacuccaaucagucuagcuuuaacuucuccucaccagaaucuugggugaauacaaccaguucgacgcccuaccagaacauuccuugcaauggcagcucccgaacugcccaaccaagagagcuuauagcucccccuaagaccguuaaaccgccagaggaucagcugaagucugaaaacuuagagguaucaagcuccuuuaauuauaguguguugcagcaucuggggcaguuucccccucucaugccaaacaaacaaaucgccgaaucugcaaacagcucaagcccccagaguagcgccggaggcaagccugcuaugucuuacgcguccgcccugagggcacccccaaagccgcggccucccccagagcaggcuaaaaagucaagcgacccucuuucgcuguuucaggaacucucuuuggggaguuccagcggaucaaauggcuucuauuccuacuuuaaauga

SEQ ID NO: 57164 - RNA, 1455 nt, Artificial Sequence
  derived and/or modified sequence opt3 from HEMGN__Homo_sapiens__XP_011517148
auggaccugggcaaggaucagagccaccucaaacaucaccaaacccccgacccucaucaggaggaaaaccacuccccagaggugaucgggacauggucucuuagaaauagggaacuguugcggaagcgcaaagccgagguccaugaaaaggagacuucacagugguuauucggagagcagaaaaagcgaaagcaacagcguacggguaaaggcaacagaagggggcggaagcgccagcagaauaccgaacugaaaguugagccgcaaccccagauugaaaaggagauaguggagaaagcucuagcaccuaucgaaaagaagacagagccacccggaaguauuacuaaaguauuuccuagcguggccuccccacagaaggucgugcccgaagaacacuucucugaaaucugccaggagucgaacauuuaccaagagaauuuuucagaauaucaggagaucgcgguucagaaccacagcagugaaaccugucaacauguguccgagccugaagaucucucuccaaaaauguaccaggagauaagcguccugcaggacaauuccucaaagaucugccaggauaugaaagagccggaagacaacagucccaauacaugucaagugauuagcguaauccaggaucacccuuucaagauguaucaggacauggcuaaaagagaggaucuugccccaaagaugugccaggaagcagccguucccaagauucugccuuguccaaccucugaggacacugcugauuuggcaggcugcucccuccaagccuaccccaaaccggacgugccuaaggguuauauccuggauacagaccagaaccccgcugaaccagaggaguacaaugaaaccgaccaggggauagccgagacggaaggacuguuuccuaaaauucaggagaucgcggagcccaaggaucucucaacuaaaacccaucaagaaagcgcagagccaaaguauuuaccccacaagacauguaacgaaauuaucgucccuaaagccccaagucacaagacuauccaggagaccccgcauucugaagacuacuccauugagauaaaucaggagacacccggcagcgaaaaauacucgccugagaccuaucaggaaaucccaggccuggaggaauacucucccgagauuuaucaagagacgucccagcuugaagaguacucaccugaaaucuaucaggagacuccagggcccgaagauuugaguacagagaccuacaagaacaaagacgugccgaaggagugcuucccugaaccacaccaagagacuggagguccccagggccaggauccuaaggcucaucaggaagacgccaaagaugcauauacauuuccccaagagaugaaggagaaaccaaaggaggagccugggauacccgcuauucugaaugaaagccacccagagaacgacguguacuccuacguccuauucuga

SEQ ID NO: 57165 - RNA, 1251 nt, Artificial Sequence
  derived and/or modified sequence opt3 from HEPACAM__Homo_sapiens__NP_689935
augaagagagagaggggcgcccugagccgggcuucccgcgcacuccgacuugcccccuucguguaccuguuguuaauccagaccgacccucuggaaggggucaacauuacaucuccaguucgucuaauacacggaacuguggguaaaucagcgcuccugaguguacaauauagcuccacgucuucggauagaccgguggucaaguggcagcuuaaaagggacaagcccgugaccguugugcagucaaucggcacagaggucauugggacucugcggccugauuaccgcgacagaaucagguuguuugaaaauggaagccuccugcugagugaucuccaguuagcugacgagggcaccuaugaaguggagauuuccaucacagaugacaccuucacuggugagaaaacaauaaaccugaccguagauguuccaaucucucggccccaagugcuugucgccagcacgacuguguuggaacuguccgaggcauuuacccuaaauugcucacaugaaaacgggacaaagccuaguuacacuuggcucaaggacggaaaaccacugcuuaaugauagccgcaugcuguugucucccgaccagaaggugcucaccauuacacgaguccugauggaggaugacgacuuauauuccuguaugguugagaacccuaucucacagggcagaagccugccagugaaaauuaccguauacaggcggaguucucucuauaucauacuuuccacgggcgggauuuuccuguuggugacucuagucacagugugcgccuguuggaagccgagcaaacguaagcagaagaaacuggaaaagcaaaauucgcucgaguacauggaucagaacgacgaucgccugaaacccgaagcugacacccuuccuagaucuggagagcaggaaaggaagaauccaauggcacuguacaucuugaaagauaaggacucccccgagacugaggaaaacccugccccagagccccggucagcuacagaaccggguccucccggcuauaguguuagcccagccgugccugggcgaucccccggacucccaauucgcucugcgagaagguacccccggagcccugcacgcucaccagccaccggcagaacgcacaguuccccgcccagggcuccuagcucuccaggucguucacggagugccagccgaacccugagaacagcagggguccauaucaucagggagcaggaugaagcuggacccguggagauuuccgccuga

SEQ ID NO: 57166 - RNA, 3483 nt, Artificial Sequence
  derived and/or modified sequence opt3 from HEPH__Homo_sapiens__NP_001124332
augugggccauggagagcggccaucugcucugggcccuucuguucaugcaguccuuguggccccaauuaaccgacggggcaacaagaguguacuaucugggaaucagggauguccaguggaacuacgccccuaagggucggaauguuauuacuaaccagccacuagacucugauauaguggcgucaaguuuucucaaaagcgacaagaaucgcaucggcgggacguauaaaaagaccauuuacaaagaauauaaggaugacuccuacacagaugagguagcucagccggccuggcugggauuccuuggccccgugcugcaagcagaagucggugacgugaucuugauucaccucaagaacuuugccacucgaccuuauaccauccacccacaugggguuuucuacgagaaagauucugaaggaucgcuguaccccgacggcucaagcggcccucugaaggcugaugacagugugccacccgggggaucccacauauauaauuggacaaucccugagggucaugcaccaaccgaugccgacccggcuugccucacuuggauuuaccacucucacgucgacgcuccccgugauaucgcgacaggcuuaauugggccucugaucaccuguaaaagaggagcacuugacggcaacagcccaccccagaggcaggauguggaccaugacuuuuucuugcuguuuuccguaguugaugagaaucuaucauggcaccucaacgaaaauauagccacguauugcagugauccugcuagcguggacaaggaggaugaaacuuuccaggagucuaaccggaugcaugccauuaaugguuuugucuucgggaaccugccagagcuuaauaugugugcacaaaaacgcguggcuuggcaccuguuuggaaugggcaacgaaaucgacgugcacaccgccuucuuucauggccagauguugacaacuagagggcaccauaccgaugucgcgaauauuuuccccgccacauucguuaccgcagagauggugccgugggaaccuggaacguggcucaucuccugccagguaaacucacacuuuagggacgguaugcaggcucuguacaaggucaagagcuguaguauggcucccccagucgacuuacugacuggcaaagugcggcaauauuucaucgaggcccaugaaauucagugggauuacgggccuaugggacacgacggcucuacagguaagaaccuccgcgagcccggguccauaagcgauaaauuuuuccagaagucgucuucccgaaucggcggaaccuauuggaaaguuagauacgaggccuuucaagacgaaacuuuccaggagaagaugcaccuugaagaggauaggcaucugggcauuuuggggccagugauccgggcagaagucggagacacaauacaggugguauuuuacaaucgugccucacagcccuucaguaugcaaccucacgguguguuuuaugagaaagauuacgagggcaccguuuauaacgacgggagcuccuacccaggauuggucgcuaagccguucgaaaaggugacguaucgcuggaccgugcccccucaugcgggcccaacagcacaggaucccgccugccugacuuggauguacuuuucugcugccgacccuauuagagauaccaauagcggucucguggggccacugcuuguuuguagggcaggcgcccugggagcugacggcaaacagaaggggguggauaaagaguucuuucuacucuucacaguacuggacgaaaacaagucaugguauaguaaugccaaccaggcagcggcuauguuagacuuccggcugcuauccgaggauaucgaaggauuucaagacagcaaucgaaugcacgccaucaacgguuuccucuuuucuaaucugccccgccuugauaugugcaaaggcgacacugucgcauggcacuugcuggggcucggaaccgagacagaugugcauggcguuauguuccaggguaacaccgugcagcugcaggggaugagaaagggcgccgcuaugcuuuuuccgcacacuuucgucauggccauuaugcaaccugacaaucugggaacguuugagaucuacugucaggcaggcucacauagggaagcugggaugcgggccauuuacaacgugagucagugcccaggacaccaggcgacaccccgccaaagauaucaggccgcuaggauauacuauaucauggcagaggaaguagagugggauuacuguccugaccguagcugggagcgggaauggcauaaucaguccgagaaggauucuuauggcuacauuuucuugucgaacaaagacggucuccuggggagccgauauaagaaagccguguuuagagaauacaccgauggaacuuucaggaucccccgcccacggaccggcccugaggaacacuuagguauccugggcccccuaauuaagggggagguuggagacauacucacagucguguuuaaaaauaacgcuuccagaccauacucagugcacgcccauggcguccuggagaguaccacuguuuggccgcuugcagcggaaccuggggagguggugacauaucaauggaacauccccgaaaggucuggaccaggccccaaugauagcgccugcguauccuggauuuacuauucagcugucgacccuaucaaggacauguacagcgguuugguggggccacuggccauuugccagaagggaauccucgagccccacggcggucgcucugauauggaccgagaguucgcacuguuauuucugauauucgaugaaaacaaauccugguaucuugaggaaaauguugcuacgcauggcagucaggacccugggagcaucaacuugcaggaugagaccuuccucgaaucuaauaagaugcacgccauuaacggaaaacuguacgcaaaucuacggggccugacuauguaucaaggggagcguguggccugguacaugcucgcuaugggacaggacgucgaucugcauacaauccacuuucacgcggaauccuuccuuuacagaaacggcgagaauuauagggccgacgugguugauuuguuuccggguaccuucgaggugguagaaauggucgcaucaaacccagggacauggcugaugcauugucacgugacugaccaugugcacgcuggaauggagaccuuauuuacggucuucagucgcaccgaacaccucagcccccugacaguuauuacuaaggagaccgagaaagugccuccacgggauaucgaagagggcaauguaaagaugcuugguaugcagauacccauuaagaacguggaaaugcuggccucggucuugguggccaucuccguuacacuccugcuagugguccuggcucucggcggggugguuugguaccagcauagacaaaggaaacugcgacgcaaucggagaucuauucuugacgacagcuuuaaguugcugucauucaaacaguga

SEQ ID NO: 57167 - RNA, 267 nt, Artificial Sequence
  derived and/or modified sequence opt3 from HEPN1__Homo_sapiens__NP_001032647
augggcaacugggggcugggaaucgcccccuggguggacggugagagcgaacucgaguucagaaggcuuggcaugcaggggccucuggaggcuuugcggcgccgagaauggaauacccaacgugcauccuuuucuuucucauuuuuaauugcccugaguccacacacagucgauuacugccauagcuaugaacuauucaacagaagguggcacggacauguucucgcgacucagcggccgucccuguuuauacuuaugcugguguga

SEQ ID NO: 57168 - RNA, 14586 nt, Artificial Sequence
  derived and/or modified sequence opt3 from HERC1__Homo_sapiens__NP_003913
auggcaaccaugauacccccugugaagcugaaauggcucgagcaccuuaacagcuccuggauuacugaagacucugaaucaaucgcuacuagagaaggcgucgcaguucuguacaguaaguuggugagcaauaaagaaguagugccauuaccgcagcagguccugugccuaaaggggccccagcucccugauuucgaaagggagucccugucuucggacgagcaggaucauuaucuugacgcccuguugucaagccagcucgcgcuggcuaaaauggugugcagugauuccccauuugccggggcacugcggaagcgccucuuaguucugcagcgaguguucuacgcccuuucuaacaaguaucacgacaaagguaaggucaaacagcagcagcauagccccgaauccucaaguggcagcgcugaugugcacucuguauccgagcguccuagaucaagcacggacgcauugaucgaaauggggguuaggaccggccugagucuacucuuugcccugcuucggcaaucuuggaugaugccaguguccggccccggucugagcuugugcaaugaugucauucauaccgcuaucgagguggugucgucucucccuccacuguccuuagccaacgagucaaagauuccgcccauggggcuggacugucucagucaggucacuaccuuccuuaaaggcguuacaaucccuaauagcggcgcggauacccugggccgcagauuggcauccgaacuacugcucgggcuggccgcucagaggggaucucuucgguaccuguuggaguggauagaaauggcccucggugcaagcgcugugguacacacuauggagaagggcaagcuguuaucaagucaggaagggaugaucuccuuugacugcuucaugacaauucugaugcaaaugcgccgaagccuaggaucuucagccgauagaagucaguggagggagccaacccggacgagcgacggccucuguucccuguaugaggcggcccuuugcuuguuugaagaggugugucguauggcaucugacuacucgcgcacuugcgcuagccccgauuccauccagaccggugacgccccuauugucucagaaacaugugagguguauguuugggggaguaacucuagccaccaacugguggaaggaacucaggagaaaauccuccagccaaagcuggcucccuccuucucagaugcccagaccauagaggcaggccaauacugcacauuugucauuagcaccgacggcucugugagagccugugggaaaggauccuacgguaggcuuggccugggggauaguaauaaccagagcacguugaagaaacucacuuucgaaccgcaucggucuaucaagaaaguauccucaaguaagggaagcgacggccacacacuggcuuuuaccacugagggugaaguuuucucguggggcgacggggacuauggaaaguuaggccauggaaauuccucuacacagaaauacccuaagcugauucagggaccccuacaagguaaaguggucgugugcgucagcgcgggcuaucgacacucagcagccgugaccgaggauggggaacucuacacguggggagagggcgacuuuggucgccuggggcacggcgauaguaacuccagaaauaucccaacccuuguuaaggacaucucuaacgugggagagguaagcugcggcuccucacauacaauugcuuugagcaaagacgggaggacugucuggaguuucggagguggcgauaaugggaagcugggacacggcgacaccaaccggguguauaagccuaaaguuauagaagcccuccaggguauguucauccgcaaggugugugcagggucucaguccagccuggccuuaacaucgacuggccaggucuacgcuuggggaugcggcgccugucuggggugcggaucaucugaggcaaccgcgcuuagacccaaauugauugaagaacucgcugccacaaggaucguggauguaaguauaggcgacucccauugucuggcacuaagccacgauaaugagguguaugccugggguaacaacucuauggggcaaugcggacagggcaauagcaccgguccaauuacuaagcccaaaaagguuuccggccuggacgggaucgcuauccagcagauuucagccggaacgagucauagccucgcauggacagcucugccucgugaucggcaagucguggccuggcaccgaccauacuguguggaccuugaagagucuaccuuuucccacuugagaucauuccuggaaagguacugcgauaagaucaacagugagauuccgcccuuaccuuuuccaagcucccgcgaacaucacucuuuccucaaacugugucuuaagcuguugucgaaucaucucgcgcuggcccuagcuggcggggucgcaacuagcauacugggacggcaggccggcccccucagaaaccugcuuuuuagguugauggacucaaccguuccugaugagauccaggagguggugauugaaacacuguccguaggugcuaccauguuacucccaccccugcgcgagcgaauggaacuucugcacagucuacucccgcaagggccugaccggugggagucucugagcaaaggacagcguaugcaguuggauaucauccugacuuccuuacaggaccacacacaugucgccucacuccugggcuauucuagcccaagugacgcagcggaucuuuccagcgugugcacggguuacggcaaucugucugaccaacccuaugggacccagucaugucacccugauacucauuuggccgaaauucucaugaagacacugcuaagaaaccugggauucuacaccgaccaggcuuuuggcgagcuugagaaaaauuccgauaaguuccuccuggggacaaguagcucggaaaacucucagcccgcccacuugcaugagcuguuaugcucccuccaaaagcagcugcuugcauuuugccacauaaauaacaucagcgaaaauucaaguucuguugcucuguugcacaaacaucuccagcugcuacugccacacgccacugacauuuauuccaggagcgcaaaccuucucaaggagucaccuuggaauggaagugugggcgaaaaacugcgcgaugucaucuacgugagcgccgcugguuccauguugugucagauuguuaacucuuuacugcuccugcccgugagcguagcgcggccacuucuguccuauuugcuagaccugcucccgccucuggauugccuuaauagauuacugcccgccgcagaccucuuggaggaucaagagcugcaguggccacuccaugggggacccgaacugaucgacccugcuggccuuccacugccccagccugcccaaucaugggucugguugguggaucuagagaggaccauagcccugcucaucggucgauguuuaggcgggaugcugcagggaucuccggugaguccagaagaacaagacacggcuuacuggaugaagacaccccuuuucucggacggcgucgagauggauacaccucagcuggacaaaugcaugagcugucucuuggaaguugcacuguccgggaacgaggaacaaaagccauuugauuacaaacuccgccccgagauugccguguauguagaccuggcgcuuggaugcucuaaggaaccugcucggucacuauggaucagcaugcaggauuacgccguguccaaggacugggauagugcaacucugucuaacgagagcuuguuagacaccgucucaagauucgugcuggccgcucuccugaaacacacaaaucuucugucccaggcauguggcgagaguagguaucagccggguaagcaucucagcgaaguuuaccguugcguguauaaaguccgcucucgguugcuggccuguaagaaccuagagcugauucaaacuagauccucaagcagggaucgauggaucucggaaaaucaggacucugcggauguggacccccaggagcacaguuuuacccggacgauagacgaagaggcugagauggaagaacaggccgaacgcgauagagaggaagggcacccagagccugaggacgaagaggaagagagggagcaugaaguuaugacagcaggaaaaauuuuccaaugcuuccucuccgcccgggagguggcucgaagcagagaucgcgacaggaugaacucaggcgccggcuccggggcacgugcugaugaucccccaccucagucucagcaggaacggagagucagcaccgaucuucccgagggacaagacguauacacugccgcguguaauagugugauccacaggugcgcccuguuaauuuuggguguuuccccagugaucgaugaacugcagaagcgccgagaggagggccagcuccaacagccgagcacaucugcaucagaagggggaggccugaugaccagaagugagucccuuacugcugaaagccggcugguccauaccucuccuaacuauaggcucauaaagucgcgcucagagagcgacuugucccagcccgaaagugaugaggaggguuacgcccugucugggcguagaaauguggacuuagaucuagcugcaagccaccggaaaaggggaccaaugcacucccagcuggaaucacucagugacucuugggcccgccuuaagcauagccgagacuggcugugcaacuccucauacagcuuugagucugauuucgacuugacaaaaucccugggcguacacacgcucaucgaaaauguggucaguuuuguuagcggcgauguggggaacgcccccggauucaaggagccugaagagucgauguccaccucuccacaggcuucaauuaucgcgauggagcagcagcagcugagagcagaacuucggcucgaggcccugcaucaaauuuuggugcuguuaagcgguauggaagagaaaggcaguaucucccuagcugggucuaggcugagcucaggauuucaguccaguacucuccuuacaagcguccgccugcaguucuuggccggcuguuuuggucuggggaccgugggacacacaggcggcaagggggagucuggaagacuccaucacuaucaggacgguauaagggcagccaagcggaauauucaaaucgaaauccagguugcuguacacaaaauuuaccagcaacugucagcgacucuugagcgugccuuacaggcaaacaagcaucacaucgaagcucagcagcgccugcucuuggugaccgucuucgcccuguccgugcauuaucaacccguugaugugagccuagcaauuucuacgggccugcucaauguccuuagucagcugugcgggacagacaccauguugggacagccucugcagcuccugccgaaaacuggcgugucgcaauuauccaccgcccuuaagguagcuagcacacgacugcuccagauacuagccaucacuaccgguacauacgcggauaaacugucaccaaaggucgugcagucuuugcuggaccuccuuuguagccagcugaagaacuugcugucccaaacggggguucuccacauggcaaguuuuggagagggcgaacaggaggauggcgaggaagaggagaagaaaguggacucaucuggggagaccgagaagaaggauuucagagccgcuuuaaggaaacagcacgccgcugagcugcaucuuggagacuuucuggucuuccuacggcgcgugguuagcuccaaggcaauucagaguaaaauggccagccccaaguggacugaggugcuccugaauaucgcuucccaaaaguguucuucagguauuccuuuggucggcaaccugagaacaaggcuccuugcccugcacguguuagaagcaguacugcccgcgugugagagcgggguggaagaugaccagauggcccagaucguugagcgguuguuuucgcuccuguccgacugcaugugggaaaccccaauagcucaagccaaacaugcaauccagauuaaggagaaagagcaggaaaucaagcuacagaaacaaggagagcuugaagaggaggaugaaaaccugccuauucaggaggucaguuucgaccccgaaaaggcucaguguugccucguggagaauggccagauccugacucacgguucugggggaaagggcuauggcuuggccagcacaggggugaccucaggauguuaccaauggaaauucuauauagucaaggaaaaccgagguaaugagggcacgugcguagggguguccagauggccaguucaugauuuuaaccaccgcacuaccucugacauguggcuguacagggcauacaguggaaaucucuaucacaacggcgagcagacacuuacccugagcuccuucacucagggugauuuuauuacauguguguuagacauggaagcccggaccaucucauucgggaaaaauggcgaggaaccuaagcuggcuuuugaggaugucgacgcggccgaauuguacccgugcgugauguucuauagcucuaaccccggagagaaaguuaagaucugcgauaugcagaugcguggcacaccaagagaccuccugccuggggaucccauuuguaguccaguggcagcuguccuagccgaggccacuauacaacuuaucaggauucugcaucgcaccgaccgguggacguacugcaucaauaagaaaaugauggaacgacuccacaagauuaaaaucuguauaaaggaguccggacagaaacugaaaaagagcagaucagugcagucuagggaagagaacgaaaugcgcgaggagaaagaauccaaggaggaagagaaagguaagcauacacggcacggcuuggcagacuuaucggagcugcaacucagaacccuuugcaucgaaguauggccugugcuggcuguuauugggggagucgaugccggccuacgugugggugggaggugugugcacaaacagacuggccggcaugcgacccugcucggagucguuaaggagggcagcacaagugcuaaggugcagugggacgaagccgagaucacuauuucuuuucccaccuucugguccccgagcgauacgccauuguauaaucuggaaccuugcgagccccuuccauuugacguagcacgcuuccgagggcugacagccucagugcucuuagaucugaccuacuugacuggaguccacgaggacauggguaaacagaguacaaagagacaugagaaaaagcacaggcaugaguccgaagagaaaggcgauguggaacaaaagcccgagagcgagucugcucuggacaugcggaccgggcucacuucagaugacguuaaaagccaguccacaaccucuaguaagucggaaaacgagaucgccagcuuuucccuugauccuacgcugccgucaguggaaucucagcaccagauaacugagggaaagcgcaaaaaucacgaacauaugagcaagaaccacgacgucgcccaaagugagauuagagcgguacagcuauccuaucuguaccucggcgcuaugaaaucauugucugcccugcuugguuguagcaaguacgcagagcuguuacucauccccaaagugcuggccgaaaaugggcauaacuccgauugcgcuaguagcccaguugugcacgaggacgucgaaaugagggccgcauugcaguuccugaugcgacauauggugaagcgggcugucaugcguucuccuaucaagagagcccucggccuugcggaccuggagcgcgcccaggcaaugauuuauaagcuagugguucacggacugcucgaggaucaauucggcgggaagaucaaacaggaaauagaccagcaagcugaggaaucagaucccgcccagcaggcacagaccccugugacaaccuccccaagcgcuaguucuacaacuuccuuuaugucgagcucauuggaggacaccacgacagccacuacccccguaacagauaccgaaacugugccugccuccgagucuccaggagucaugccccugaguuuacuuaggcaaauguucagcucauacccgaccacaacgguucugccuacucggagagcgcagaccccacccauuuccagccucccuacaucuccaagugacgaggugggccgcaggcagucccugaccagccccgauucacagucugcucgaccggcaaaccggacugccuugucggacccuagcuccagacugaguacaucucccccaccucccgcuaucgccgucccacuccuugaaauggguuuuucacugaggcaaauugcaaaggccauggaggcuaccggggcgcgcggagaagccgaugcacagaauaucacggugcuagcuauguggaugauagagcaccccggccaugaagacgaggaggaaccucagagcgguuccacugccgauagucguccaggcgcagccguacuggggucuggaggcaaaagcaacgacccguguuauuuacagucccccggggacauuccuucagcugaugccgcggagauggaagagggauucagcgaaucuccagacaaucucgaucacacagagaacgcagccuccggcaguggucccucagcucgggggagaagcgccgugaccaggcgccauaaguuugaccuggcagcucgaaccuugcuugcccgggcugccggacuguacagaucgguucaagcacacaggaaucagucccgcagagagggcaucucucuccagcaggauccuggugcgcuguaugacuucaacuuggaugaagaacuggaaaucgaccuagaugacgaggccauggaggcuauguuuggccaagaucucacaagugacaaugauauucuugggauguggaucccagaagugcuggacuggcccacauggcacgucugcgagagcgaagaccgggaggaaguggucgugugugaguuaugcgagugcucaguuguauccuucaaccagcauaugaagaggaaucacccuggauguggccguucugccaaccgacagggguaccgcagcaauggaaguuauguggauggcugguuugguggggaaugcggauccggcaacccguacuaccugcucuguggaaccugcagagagaaauaucuggcaaugaagacaaaaagcaagucuacuucauccgaacgguacaaagggcaagcuccagacuugauuggaaagcaggauagcgucuaugaggaagacugggauaugcuugacguggaugaggacgagaagcugacgggugaagaggaguucgagcuccuggccggcccccuaggguugaaugauaggcgcauaguuccugaacccgugcaguuuccagacagugauccucugggagcaucugucgccauggugaccgcgacaaacucaauggaggagacucucaugcagaucggcugucaugguuccguagagaaaagcucgucugggagaauuacccuuggagagcaagcugccgcacuggccaauccccacgaccgggugguugcuuuaaggcgagucacagccgcagcucaggugcugcucgcccguaccauggugaugagagcgcugaguuugcuuuccgucagcggcucaucuugcagccuggcugccggccucgaaucccuggggcuaacugauauccgcacguuaguucggcugauguguuuggcagccgcuggaagggcaggucucaguaccucaccaagcgccauggcguccacaucugagagaagucgcggcgggcauagcaaggccaacaaaccgaucuccugccuggcuuaccuuucaacugcagugggaugucuggccucuaaugcuccuucggccgcaaagcuccugguacaguugugcacccagaaccuuauuagcgcugccacaggcgugaaccugaccacugucgacgacuccauacaacggaaauuccuacccaguuuucucagggguaucgcggaggaaaauaagcuggugacaucuccaaacuucguugugacgcaggccuuagucgcacuguuggcugauaaaggggccaagcuccgacccaauuaugacaagagcgagguggagaaaaagggaccucuggagcuugcaaacgcccuggcugccuguugccucucauccagauugagcucucagcaccggcagugggcggcucaacagcugguaaggacccuugcagcccacgaucgcgacaaucagacuacacugcaaaccuuagcugauaugggcggcgaccuacguaaaugcaguuucauuaagcucgaagcccaucagaacagaguuaugaccuguguguggugcaauaaaaaggggcugcuggcaacauccggaaacgaugguacuauccgagucuggaaugugacgaagaaacaguacucauugcagcaaaccuguguguuuaacaggcucgagggcgacgccgaggaaagccuggggucuccaucggaucccuccuucaguccugucagcuggucaauuucuggaaaguaucuugcuggcgcgcuggagaaaaugguuaauaucuggcaagugaacggugggaagggauuaguagacauacagccgcacuggguguccgcccucgcauggccagaagagggccccgccacagcuuggagcggcgaaaguccugagcuguugcuugucgggcggauggauggaucacugggucuaaucgaggugguugacguguccacuaugcaucgcagagaacucgagcacugcuacaggaaagacgucagcgugaccuguauugcaugguuuucugaagaucggccauucgccguaggcuacuuugacgggaagcugcuguugggaacaaaggagccccucgaaaaaggcgguaucguucugauugaugcucacaaggacacccuuaucaguaugaaaugggauccuacugggcauauacugaugacgugcgccaaggaggacagcgugaaauuauggggauccauuucuggcuguuggugcugucuccacucacugugccaucccagcaucgucaauggcauugcguggugucgccuaccagggaagggauccaaguugcagcugcuuauggcaacagguugccaaucgggccucguguguguuuggagaaucccgcaggauaccacucagaccaacgugacaucugccgagggguggugggaacaggagaguaauugccaagacggauaucgaaaaagcucaggcgcuaagugcgucuaccagcugaggggucacauaacuccugugcggaccguagccuucuccucugaugggcuggcauuggugagcggaggccuuggcgggcucaugaacaucuggucccugcgugacggaagugucuuacagacaguugugauugguucaggcgcuauccagacgaccgucuggauucccgaaguggggguagccgcguguagcaaccgcucuaaagaugugcugguugugaauugcacugccgagugggcugcagccaaccauguccuagcuacauguagaaccgcacucaagcaacagggagugcugggcuugaauauggccccaugcaugagggcuuuucuggagcggcuuccuaugaugcuccaggaacaauaugccuacgagaaaccccacguugucuguggugaccagcuggugcacuccccauauaugcagugcuuagcaagucuggccgugggguugcaucucgaucagcugcuuuguaacccucccguaccgccacaccaucaaaauugccugccugaccccgcgagcuggaacccaaaugaaugggcuuggcuagaguguuucucaacuacaaucaaggccgcagaagcccucaccaacggcgcucaguuucccgagucuuucacggucccugaccuggagccggugccagaagaugaguugguuuuucugauggacaauuccaaauggauaaacggaauggaugaacagauuaugucgugggccaccagcagacccgaggacuggcaccuuggcgggaagugcgauguguaccucuggggagcaggucgccauggccagcuggcugaagccgggcgaaaugucauggugccugcggcagcccccaguuucucccaagcucagcagguuaucuguggacagaacugcacauuugugauccaagccaauggcacuguauuagcuugcggugaggggucuuauggcaggcugggacagggcaacucagacgauuugcacguccucaccgugauuagcgcacugcagggguucgugguuacacaacuugucacuuccuguggaucugacggucacagcauggcccugaccgagaguggcgaaguguucucauggggagauggagacuacggcaagcuaggucauggcaauuccgaucggcagagacguccacgccagaucgaggcgcuccagggggaagagguagugcaaaugagcugcggauuuaaacacucugccgucgugacaagugacggcaagcuguucaccuuugggaacggagauuacggcagguugggucuggggaacacuuccaauaagaaacuuccugaacggguuacggcuuuagagggauaucagauaggccagguggcauguggucugaaccauacacucgccgucagcgcugacggcucaauggugugggccuucggggacggagauuacggcaaacuggggcuaggaaauucgaccgcaaaaucuagcccccagaagauugacguuuugugcggcaucgguauuaaaaagguggccugugggacucaauuuuccguagcucugaccaaagauggacacgucuauacauucggccaggacagacucaucggucuuccagagggccgagcgaggaaccacaaucgcccucagcagauaccggugcuggccgggguuaucauugaagauguggcagucggagcugagcauacgcucgcccuggcaaguaacggcgacguguacgccugggggucaaauucugaaggacaauuaggcuugggucacaccaaccauguacgggagcccacucuggugacagggcuucagggaaagaaugucagacagaucagcgcuggaaggugccacuccgcggccuggaccgcaccaccuguucccccacgcgcuccuggcgugagugugccccugcaacucgggcugccggauacugucccaccucaguauggagcccuacgugaggugagcauucauacaguucgggccagacuucgacugcucuaccacuuuucugacuugauguauuccucauggaggcuguuaaaccugagccccaauaaccaaaauucgaccucccacuacaacgcugguacauggggcaucguacaggggcaacuccgcccacuucuggcaccccggguguacacuuugccuauggucagaucuauuggaaaaaccauggugcagggcaagaauuaugguccccagaucacgguuaagaggauaaguacccgcgggagaaaauguaagccaauuuucgugcagaucgcccggcaagucgugaaacugaacgcuucagaucuccgacuaccuagcagggcguggaagguaaaacuggugggagaaggcgccgacgaugcaggcggggucuuugacgacacaaucacugagaugugccaggaacuugagaccggaauuguugaucugcucauaccgucccccaacgccacagcugaaguggguuacaaucgugacagauucuuguuuaacccaucugcaugucuggaugagcauuuaaugcaguucaaguuucugggcauccucaugggggucgccauucggacuaagaaaccucuugaccugcacuuggcuccccugguguggaagcagcucugcuguguuccacuaacccuggaggauuuagaagagguggaccugcucuauguacaaacgcuuaauagcaucuugcauauugaagauaguggaaucacagaggaaucauuccacgagaugauaccucuggacuccuucgugggccagagcgccgaugguaaaaugguccccaucauuccgggcgggaacucuaucccucugaccuuuuccaaucgcaaggaguacguggaaagggcaauugaguaucgacuccacgaaauggacagacagguugcggccguccgggaggggaugaguuggaucgugccagugccccuucugagcuugcugacugcuaaacagcucgaacaaaugguaugcggcaugccugagauaucagucgaggugcuaaagaagguugugcgcuacagggaagucgaugagcagcaucagcuggugcaaugguucuggcacacauuagaagaguuuucuaacgaggaaagaguucuuuucaugcgguuuguguccgggcguagccgccugccagccaauaccgcagacauuucgcagagguuccagaucaugaaagucgaucgacccuaugacagucucccuacuucucagaccugcuuuuuccaauugagacugccacccuacucaucccagcuggugauggcugagcggcucagguacgccaucaacaauugucgcagcauugacauggauaacuauaugcuuucuagaaauguagacaacgcggaaggaagcgauacagacuacuga

SEQ ID NO: 57169 - RNA, 14505 nt, Artificial Sequence
  derived and/or modified sequence opt3 from HERC2__Homo_sapiens__NP_004658
augcccuccgaguccuucugccuggccgcucaggcacggcucgacucuaaguggcuuaagaccgauauccaacuggccuuuacaagggacggcuugugcggguuauggaacgaaauggugaaggauggggagauuguauacacugguacggaaucaacccagaauggcgagcugccuccacggaaggacgauaguguugaaccgucugggacaaagaaagaggaccuaaacgauaaggagaagaaagacgaagaggaaacucccgcgccuauauaucgcgcuaaguccauccucgauucuugggugugggggaaacagccagacguaaaugagcugaaggagugccuuucggugcuggucaaagaacagcaagccuuggcagugcagucagccaccacaacccucagcgcucugcgacugaagcagcgucucguuauuuuagagcgguacuucaucgcacugaacaggacuguguuucaggaaaaugucaaggugaaauggaagaguuccggcauuucucuucccccuguagauaaaaagagcucccggccagccgguaaagggguugagggguuggcucgcgugggcucaagagccgcgcugaguuucgcauuugccuuccuaaggcgggcuuggcgcagcggcgaagacgccgaucucuguucugagcugcuucaagagucccuggacgcauugcgagcucuccccgaagccucacuguuugacgagagcacagucaguucugugugguuagaaguggucgagagagcgaccagguuccugcgguccguugugacgggggauguacacggaacuccugccaccaaggguccaggcagcaucccgcuccaggaccagcaucuugcacuggcuauauugcuagaacuggccgugcagcgugggacacucucgcaaaugcugucugcuauccuucuguugcuccagcugugggauuccggagcccaggagacugacaacgagcgcucagcacaaggcaccagugcccccuuacugccucuacuccagagauuucagagcauuaucugcaggaaagaugcuccacacuccgaaggugacaugcaucugcuuucugggcccuugagcccuaaugagucauuccugcgguaucucacacugccacaggauaacgaacuugcgauugaccugcgacaaaccgcagucgugguuauggcccacuuggaucgccucgcuacgcccuguaugccgccucugugcaguucccccacuagccauaagggaucuuuacaggaggugaucggcuggggccugauaggguggaaguacuaugccaaugucauuggaccaauccagugugaaggucuagcaaaccucggcgugacacagauugccugcgcugagaaaagauuucugauccuuucaaggaaugggcggguauacacccaagccuauaacagugacacuuuggcaccucagcugguucagggacucgcgagccgcaauaucgugaagauugcugcccacuccgauggccaccauuaccuggcauuagccgcuacaggugaggucuacucuuggggguguggcgacggaggcagacuggggcacggagacaccgugccccuugaagaaccgaaagucauaucggccuucagcgguaagcaggcaggcaaacaugugguucacaucgcuugcggguccacguauucagccgcgauuaccgccgaaggagaguuguacacauggggcagggguaacuaugggcgucucggccacggaaguucugaggaugaagcuauccccaugcugguggcaggccuaaaggggcugaagguaauagacgucgccuguggaagcggugaugcucaaacucucgccgugaccgagaauggccagguuugguccuggggagacggagauuacggcaaacuggguagagggggcucagacggaugcaagacaccuaaacuuauugaaaaguugcaggaucuggacguggucaaagugcgaugcggcagccaguuuucuaucgcauuaacuaaggaugggcaaguauauuccuggggaaagggcgacaaccagagacucggucaugggaccgaggaacacgugagguacccaaaacugcuugagggacugcagggcaagaaaguuaucgaugucgcggccgguaguacacauuguuuggcucucaccgaggacagcgaagugcacucuuggggcuccaacgaucaaugccagcauuucgacacucugcgcgugacgaagccggagcccgccgcacuaccugggcuggacacaaaacacauugucggaaucgcuuguggcccagcccagucauucgcauggaguagcugcucggaaugguccauugggcuccggguucccuuugugguggauauauguucuaugaccuucgagcagcuggaccuuuugcugagacaaguaagcgaaggaauggauggcucagccgacuggccuccaccccaggagaaggagugcgucgcuguggcgacuuuaaaucuccugaggcuucagcugcacgccgcaaucagucaucagguugauccggaauuucuaggucucgggcugggauccauuuugcugaacucuuuaaagcaaaccguggucacacucgcuagcuccgccggcgugcugucaaccguucagagcgccgcucaggcagugcuucagagugguuggucuguacuguugccuacugccgaggaacgcgcgcgagcucucuccgcccugcuaccaugugcagucagcggcaaugaggugaacaucucgcccgggcggcguuucaugaucgaccugcuugugggaucacucauggccgauggcgggcuggaaucugcuuugcacgcagccauuacagcggagauacaagacaucgaggcuaaaaaggaagcccagaaagagaaggaaauugaugagcaggaggcaaaugccaguacguuucauagauccaggaccccucuggacaaagauuuaaucaacacuggaauuugcgaaagcucuggcaagcaaugucucccccugguccagcuuauccagcagcuguugcgcaauauagcuagccaaacaguugcccggcucaaagacguggcaagaaggaucuccucaugccuggauuucgagcagcacagucgagaacgcagcgcuucucuagaccugcuucuccgguuucagagacuguugauuuccaaguuauauccaggugagucaaucgggcagaccagugacauuagcuccccugaacugaugggaguaggcucucuccugaagaaauacacagcccuucuguguacucacaucggugauauauugcccguggcggccucgauugcaagcaccucauggaggcauuucgcugaggucgccuacaucguggagggcgacuuuacggggguucuacugccagaacucguggucuccauugugcugcuuuuaaguaagaacgcuggacugaugcaagaggcaggcgccguuccgcucuugggcgggcugcucgaacaccuggaucguuucaaucaucuugccccugggaaagagcgcgacgaucacgaagaacuggcuuggcccgguaucauggagagcuuuuucaccgggcagaacugccggaauaacgaagaggugacauugauaagaaaggcggaccuagaaaaucauaacaaagauggaggcuuuuggacugucaucgacggcaagguauaugauauuaaggacuuccagacccagagccugacaggaaauuccauccucgcacaauucgccggagaggauccagugguugcuuuagaagccgcacugcaguuugaggacacuagggagucaaugcacgccuucugcgugggucaguaccuugaacccgaccaggagauugucaccaucccugaucugggcucucucagcaguccauugauagacacggaacgaaaccuggggcuccugcuuggacuacacgcuuccuaucuggcgaugagcacacccuugucuccuguggagauugagugugccaaaugguuacaaucauccaucuuuaguggcggucugcagaccagccagauccauuacucguauaacgaagagaaggaugaagaccacuguucuuccccaggcgggacuccagcaagcaaaucacggcucuguagucaucgcagagcucugggggaucacucucaagccuuccuucaggcaauugccgacaauaacauccaggaucauaauguaaaggacuuucugugccagauugagagguacugucggcaaugccaccucacaacccccauaauguucccuccagaacaccccguggaggaggucggccgauugcugcuauguugccugcucaaacaugaagaucuugggcacguugcucuguccuuagugcaugccggagcguuggguaucgaacaggugaagcacagaacucugccuaagagcgucguggacguuugucgcguaguguaucaggcaaaaugcucacucauuaagacccaccaggaacaaggcaggaguuacaaagaggucugugccccggugaucgaacgucugcgguuucuuuucaacgagcugagacccgcuguuugcaaugaucucagcauuauguccaaguuuaaauugcugucuagcuuaccaagguggcgccgaaucgcccagaagauaaucagagagcggaggaagaaacgcgugccuaagaaacccgaauccacagacgaugaggaaaagauugggaacgaggaaucagaccuagaggaggcuugcauccugccacauucuccuauuaaugucgacaaacgucccaucgcaauaaagaguccaaaagauaaguggcagccgcuccuuucgacggugaccggaguacacaaguacaaauggcugaagcagaacguccaaggcuuguauccucagagcccccugcucuccacuauugccgaguucgcucugaaagaggaaccaguggacguugagaagaugagaaaaugucuucucaagcagcuggagcgggccgaagugagguuggaggguaucgauacaauccugaaguuagcaucuaaaaauuuucuacugcccucaguccaauacgcgauguucugcggguggcagcgccucauuccugaaggaauagacaucggcgagccacuuaccgauugucugaaggacguggauuugauucccccuuuuaaccgaaugcugcucgaaguuacauucggcaaacuguaugccugggcugugcagaauaucagaaacguccuuauggacgccagcgcaaaguucaaagaguuagggauucagccggugccacugcaaacuaucaccaaugagaaccccuccggaccuagucucgguacgauaccccaggcucgguuuuugcugguaaugcuaucuaugcugacacuccagcauggcgccaauaaccuugaucuguugcugaacagcgggaugcucgcacugacccagacugccuuaaggcuuaucggaccaucaugcgacaauguggaagaggauaugaacgcuuccgcgcaaggcgccagugcaaccguucuggaagagacacgcaaggaaacugcuccuguccagcuccccgugagcgguccagagcuagccgccaugaugaagauugggaccagagugaugaggggagucgacuggaaauggggcgaucaggacggcccuccgcccgggcugggacggguaaucggugaguugggcgaagacggguggauucgugugcagugggauacaggaucuaccaauuccuaccgcaugggcaaggaggguaaauaugaccugaagcucgcagaacuuccagcugccgcgcaaccuucagcugaggauagcgacaccgaagaugacucggaggccgagcagacugaacgaaacauccaccccacagcaaugauguucaccucuacuauaaaucuguugcagacacugugucucagugccgggguucaugcugagauuaugcaguccgaagcaaccaaaacguuaugcggacugcuuagaaugcugguggagagcggcacuaccgauaagacaucauccccaaacaggcuagucuaccgggagcaacaccgcucuugguguacccucggcuuugugagaagcaucgcccugacuccucagguuugcggggcguugaguagcccccaguggaucacacugcucaugaagguggucgaaggacacgcuccguucaccgccacaagccuucaaaggcagauucuggcagugcauuuacugcaggccguauugccaucuugggacaaaacugagcgggcucgagauaugaagugucucguggaaaaacuguuugacuuccuagguucacuucugaccacgugcaguuccgauguuccucuccugagagagagcacauugcgcaggcggcgugucagaccccaggccucucugaccgcaacucacucgucaacccucgcugaagaggugguggcccuucugaggacauuacauagccugacucaauggaauggcuugaucaacaaguauauaaauucccagcuccgcaguauuacccacucuuuugucgggcggccaagcgagggagcgcagcuggaagacuacuuccccgacuccgagaacccugaaguuggcggucuaauggccgugcuugcaguaaucgggggcauugauggacgacugagacucggcggacaggugaugcacgacgaguuuggagaagguacggucacaaggaucaccccgaaaggcaagauaacugugcaauucucagauaugcgcacaugucggguuugcccccugaaucaguugaagccauuaccugcuguggccuuuaacgucaauaaccugcccuucaccgagccuaugcucaguguaugggcacagcuugugaaucuggcugggucuaaacuagagaagcauaaaauuaagaaaagcacuaagcaggccuucgccggacaaguugaccuggaucucuugagaugccagcagcugaaacuuuacauccugaaggcgggccgugcucucuuaucccaccaagacaagcugaggcagaucuugucacagccagcagugcaggaaacagguaccguccauacggaugacggggccguggucagccccgaucugggcgacaugucuccugagggaccacaacccccgaugauucuccuucagcagcugcuagcuuccgccacucagccuaguccagugaaagcaaucuuugauaagcaagaacuggaggccgcugcgcucgccguuugucagugcuuggcaguggaaagcacccaccccucguccccuggcuucgaggacuguucuucaagcgaggcuacaaccccaguagccgugcagcauauucggcccgcacgcgucaaacgaagaaagcagaguccgguuccugcccugcccauagugguccaacuuauggaaaugggguuuuccaggcggaacaucgaguucgcucugaaaucuuuaacaggagccagcgguaacgcgucaucccucccaggcguggaagcacugguagggugguugcuggaucacagugacauucaggugacugagcucagcgacgccgauaccguuucugacgaguauucagaugaagagguggucgaagacguggaugacgcugccuacuccaugagcacgggagcagucgugacagagucucagacuuauaagaagcgcgcugauuuucuuaguaaugacgauuacgccguuuauguaagagaaaacauccaagugggcaugauggucaggugcugucgagcuuacgaggaggugugcgaaggugacguugggaaagugaucaagcuggaucgggacggccuacacgaccugaauguccagugugauuggcagcagaaaggaggcaccuauugggugcguuacauucauguagagcucauaggguacccucccccaucguccagcucacacaucaagauuggagacaaagugagaguuaaggccucugucacaacccccaaguauaaauggggcagcgugacucaucaauccgugggugucguuaaggcauucagugcgaacgggaaagauaucauuguggacuuuccucagcagucacacuggaccggauugcugucugaaauggaguuaguaccaagcauccacccgggcgugacaugcgaugguugucagauguuccccauaaauggcucccgcuuuaagugcaggaacugugacgauuucgacuuuugcgaaacgugcuucaaaacuaagaagcauaauacccggcacacauuugggagaaucaacgagccuggacaaagugccgucuucuguggccgcagcgggaaacagcuuaagaggugccauuccucucagccaggaaugcugcucgauucauggagccgaauggugaaaucgcugaauguuuccaguucugugaaccaggcuagccgguugauugacggcucagagcccuguuggcaauccucugguagucaggggaagcacuggaucagacuggaaauuuucccugauguccucgugcauaggcuuaaaaugaucguagacccagccgauagcuccuacaugcccucacugguuguggucagcggaggcaauucucuaaacaaucugauagaguuaaagaccauuaacaucaauccuagugacacuacagugccgcuccugaacgacugcaccgaauaucaccgcuacauugagaucgcaauaaaacagugucguuccagcgguaucgauugcaagauucacggcuugauccuucuggggcggauuagagcugaagaggaggaccucgccgcagugccauuucuggccucagauaaugaagaggaagaggacgagaagggaaacucuggcuccuugaucaggaaaaaggcggcugggcuggaaucggccgcaacgauacgcacuaaagucuucguuuggggacuaaacgauaaggaccagcucggcggucuuaaagggagcaagauuaaggugcccaguuuuucugagacacuguccgccuuaaauguagugcaagucgcuggaggcagcaaaucacuguucgccgugaccguugaaggcaagguguaugcauguggggaggcuaccaacggacgacucggucugggcaucaguuccgggacugucccuaucccccggcagauuacagccuugagcucuuacguggucaagaagguugcggugcauucaggaggcagacacgcuaccgcccuuacagucgaugguaaaguguuuagcuggggagaaggagacgauggcaagcugggccauuucuccaggaugaauugcgacaagccacgccucaucgaggcacugaaaacuaagagaauacgggauauugccugugggucuagucacucggcugcacuaacgagcuccggagaguuguauaccuggggucugggcgaauacgggaggcucggacauggcgacaacacaacucagcuuaaaccuaagaugguuaaagugcuguuaggucaccgugucauccaaguggccugcgggucacgagaugcgcagacccuggcccucacagacgagggacugguauuuucuuggggcgacggcgauuucgggaaguugggacgcgguggcagcgaaggguguaauauuccccagaacaucgagagacuuaauggacagggcgugugccaaauagaaugcggugcucaguuuagucuggcacucaccaaguccggggucguuuggacuuggggaaaaggcgacuacuuccggcugggccacgggucagaugugcaugucaggaagccacaggugguagagggacuacgcgguaaaaagaucgugcacguugccgugggcgcuuuacauugucuggccgucacggacucuggacagguguaugcauggggagauaacgaccacggccaacaggguaaugggaccacaacuguuaacagaaaaccgaccuugguccagggacucgagggccagaagauuacacggguggcuugcggcagcucccacaguguggccuggaccacuguagaugucgcgacaccuagcgugcaugaacccguucuguuucaaacggccagggacccacuuggggcaucuuaccugggagugcccucagaugcugacuccagcgccgcaaguaauaaaaucucuggugccuccaacucgaagccuaaucgaccaagccucgcuaagauucuguugucacuugauggcaaccuggccaaacagcaggcgcuaucccacauccucaccgcucugcaaauuauguaugcacgugacgccgucgugggggcuuuaaugcccgccgcaaugaucgccccuguugaguguccgucuuucaguagcgcugcgccaucagacgccuccgcaauggccagccccaugaauggagaagagugcaugcuggcuguggauauagaagacagauugucuccuaacccauggcaggagaagcgcgagauuguaaguuccgaagaugcagucacucccagcgccgugacaccuucagcucccucugccucggcgcggccauuuaucccggugaccgacgaucucggcgcagccagcaucauugcugagaccaugacaaaaacuaaggaagacguugagucccagaacaaagccgcagguccugagccccaggcucuggaugaguucacgagucuucugauagccgacgauaccagggucgugguagaccucuugaagcugucuguguguucaagagcgggggaucgcggacgggacguccuuagcgccgugcuguccggcaugggcacagcuuacccacaaguugcagauauguuacuagagcucugcgugacugaacuggaggacgucgccaccgacagucagucugggaggcugagcucccagccugugguuguggaaucaagccaucccuauacagaugacaccucuacuuccggaacgguaaagaucccaggugcugagggcuugcgagucgaguucgauagacaguguaguacagaacggaggcacgacccucucaccgugauggaugggguuaaucgcauugugucaguccguagcggaagagaguggucggacugguccucugaacugcgaauccccggcgaugagcuuaaauggaaguuuauuagugacgguagcgugaacggguggggcuggagguucacuguauacccgaucaugccagcagccggaccuaaagaacuguuaucagaucggugcgugcucuccugucccucuauggaccuggucacgugcuugcuugauuuucgccugaaucuagcuagcaacagaaguauaguuccaaggcucgccgcaucccuggccgcgugugcucaacugagcgccuuggcagccucucaucggaugugggcucuccagcgccugagaaaacuucugacaacugaguucggccagucaaucaauauuaaccgauuacucggggagaaugacggagaaaccagggcccuguccuuuacagguagcgcacuagcugccuuggugaaaggccugcccgaggcgcuucagcggcaauucgaauaugaggauccuaucgugcgugggggaaagcagcuccugcacaguccguuuuucaagguccugguggcauuggccugcgaccuugaacucgacacgcugccauguugcgcugagacccacaaaugggccugguuucgcagauacugcauggcuucuaggguugcaguagccuuagauaagcggacuccccugccuagacuauuccucgacgagguggcgaaaaagauucgcgaacugauggccgauucagagaacauggacgucuugcaugaaucccacgauaucuuuaaacgagagcaggacgagcagcuggugcaauggaugaauaggcggcccgaugacuggacacuuagcgcuggcgguucggggaccauauacggcuggggacauaaccacagaggccagcucgggggaauugaaggugcaaagguuaaggugccaacuccuugugaggcccuggcuacauuacgucccguccagcugaucggcggggaacaaaccuuguucgccgugacggcagauggaaaacucuaugccaccggcuacggugcuggcgggcgccugggaaucggcgggacagagucuguaaguacuccaacccuucuggaauccauucagcacguguuuauaaagaaagucgcgguuaauagcggaggcaagcauugccuagcccucucaucugagggugagguguauagcuggggagaagcagaggacggaaaacugggccacgguaacagguccccuugugaucggccgagagucaucgaaaguuugcgaggcauugaggugguugacguggcugccgggggagcacauucagccugcguaacagcugcgggcgaccuguacacuugggggaagggaagguauggccgccuuggucacagcgauuccgaagaccagcucaagcccaaacugguggaggccuuacaggggcaucgggucguggauaucgcauguggaucuggcgacgcucaaacccugugcuugacagaugacgauaccguuuggaguuggggugacggcgauuacgggaagcucggaagaggcgggagcgacggauguaaagucccaaugaagauugauucccugacuggccuugguguggugaaaguagagugcgggucacaguucucugucgcccugacgaagucgggagccguguauacauggggcaaaggcgacuaccacaggcuagggcacggaagcgaugaccauguucgccguccuagacaggugcagggucuccaaggcaagaaggucaucgcuauagcaaccgggucccugcacugugugugcuguacugaagacggagagguuuacaccuggggcgauaaugacgaaggucaguugggggauggaacaacgaacgccauccagagaccccgacugguggcugcgcuucagggcaaaaaggucaauaggguggccugcggcagugcacauaccuuagccuggucuacuagcaaaccagcuucagcagggaagcugccugcccaaguacccauggaguauaaccaccuccaggaaauuccgaucauugcucugcgcaaccggcuauugcugcuccaucaccuuuccgagcuguucugcccauguaucccuauguuugaccucgagggaagccuggaugaaacagguuuaggccccucugugggguucgacaccuugagagggauucugauaagucagggcaaagaggccgcauuuaggaagguuguccaagcgacuauggugcgcgauagacagcacgguccaguggucgaacuuaaucggauccagguuaagcgauccaggucaaaagggggacuggccggccccgacggcacaaagagcguguucgggcagaugugcgcuaaaaugucuucguuuggaccugauucccuccugcuaccccaucguguauggaaggugaaauucgucggugagaguguggacgauuguggcgggggauacagcgagucaauugccgaaaucugcgaggaacuucaaaacggccugaccccacucuugaucguuacaccuaaugguagagacgagucuggggcaaaccgggauuguuaucuguuauccccggcugcccgcgcgcccgugcacagcaguauguuuagguuccugggaguccuccuuggcauugccauacgaacuggcucaccacuguccuugaaucuggcugaaccuguauggaagcagcucgcagggaugagccuaaccaucgccgaccugucugagguggacaaggauuuuauucccggacuuauguacaucagagacaacgaggcuacgagugaagaguucgaagcaaugagccugccauuuaccguuccuuccgccucuggucaggauauucagcucucaagcaaacauacacacaucacuuuggacaaucgggccgaguaugugcgccuggcuauaaacuacagguuacacgaguucgaugagcaagucgcagccgugagagagggcauggcgcgggugguccccguuccgcugcucucccuuuuuaccggguaugaacuggagacaauggugugcggaucgccugacaucccauugcaucugcucaagucuguagcuacuuacaaaggcauugaacccagugccagccuaauccagugguucugggaggugauggaaucauucuccaauaccgagcguucucuguuuuuacgcuucgucugggguaggacgcgacugccuagaacaauugcagauuuucgggggagggacuucguuauccaggugcucgauaaguacaacccacccgaccacuuucuuccugagagcuauaccuguuucuuuuugcugaaacugccacgcuacuccugcaaacaggugcucgaagagaaacuuaaauaugccauacauuucuguaagaguauugauacugacgacuacgcuagaaucgcccugacaggagaacccgcagcugaugacucaagcgaugacucugauaaugaggacgucgauuccuuugccagugacagcacccaagauuauuugacuggccacuga

SEQ ID NO: 57170 - RNA, 2799 nt, Artificial Sequence
  derived and/or modified sequence opt3 from HERC3__Homo_sapiens__NP_001258531
augaccacagaggacagcguggccguccccagacugauccagaagcucaaccaacagacuauucuucagguuuccugcggcaauuggcacugucuggcuuuggcagccgaugggcaguucuuuacgugggguaaaaacucucauggacaauuaggccuggggaaggaauuuccuucacaggcgaguccacagagggugcggagccuagagggaauaccgcucgcucagguagccgcaggcggugcccacuccuuugcucugucucuuucgggggcaguguucggauggggcaugaauaacgccggccaacugggguugucagacgaaaaagaucgcgagagccccugccaugucaagcuccugcgaacccagaaagugguuuacaucaguuguggagaagaacacacagcugugcugacuaaguccgguggcgucuuuaccuucggggccggaucuugcggccagcucggucaugacagcaugaaugaugaggugaacccucguagaguauuagaacugaugggguccgagguuacacagauugcguguggaaggcaacacacccuugcauuugugccaucaaguggcuugaucuaugccuucggcugcggggcucggggacagcuggguacuggccacacauguaaugucaagugccccagcccugugaaaggguacugggccgcacauucuggacagcuauccgcucgcgccgacagauuuaaguaucacauugugaaacaaaucuucucaggcggugaucagaccuuuguccucuguagcaaguacgaaaacuauaguccagcgguugacuucaggacgaugaaucaggcccauuacacuucucugauaaacgaugagaccaucgcaguguggcggcagaaacuuuccgagcacaauaacgcuaauacaauuaacgggguagugcaaauccugagcucggccgcuugcuggaauggcucuuucuuggaaaagaagauugacgagcacuucaaaacuucccccaagaucccuggaauagaucucaacucaacccgcguccuguucgaaaaauuaaugaacagucagcauagcaugauucuggagcagauccucaauuccuuugaaucuugucuuauuccacagcugagcucaaguccgcccgacguggaggccaugcgaaucuauuugauccuaccugaguucccacugcuccaagauuccaaguacuacauuacacugaccauaccccuugcaauggccauccugagauuggacacgaacccuagcaaaguucucgacaauugguggucucaggugugcccaaaguauuuuaugaaacuggucaacuuauacaagggcgcugugcuguaucuacucagggggcggaagacuuuccugauucccguacuuuuuaauaacuacaucacagcggcauugaaacugcucgaaaagcuguauaaaguuaaucuuaaggugaaacacgucgaguacgauaccuucuauauaccggaaauuucaaaccugguggacauccaggaggauuacuugaugugguuucuccaucaggccggaaugaaggcucguccuaguaucauucaagacacugucacacugugcagcuaccccuucaucuuugaugcccaggcaaagaccaaaauguuacagacggacgccgaacugcagaugcaaguggcuguuaauggugccaaccuacagaauguguucaugcuccugacccuugagccauugcuggcacgcuccccuuuucucguacugcacgucagaaggaacaauuuagugggcgaugcgcugcgggagcuuucuauucauucggacauagauuugaagaaaccccucaagguuaucuucgacggggaagaggcuguggaugccggaggcgucacaaaagaauuuuuccugcuacugcucaaggagcugcuuaacccaauuuaugguauguucacuuacuaucaggacagcaauuugcugugguuuuccgacaccuguuucguggaacacaacugguuucacuuaaucgggaucacaugcggccucgcaauuuacaacucaacuguaguggaucugcauuucccccuugcccuguauaagaaauugcucaauguuaagccuggacuggaggaccuaaaagagcugaguccaaccgaaggccgaucucuccaagagcugcuugauuacccgggggaagacgucgaggagacauuuuguuugaacuucaccauaugccgcgaaagcuauggagugaucgagcagaagaaacugauucccgguggcgauaaugugacugucuguaaggacaacagacaggaauuuguugaugcuuacgugaauuacguguuccagaucuccguacacgagugguauacggccuuuucaagcggguucuuaaaggucugcggaggcaaagugcucgaacuguuucaaccuucugagcuuagggcaaugaugguugguaacuccaauuacaacugggaggaacuggaggaaacagcuauuuauaagggggacuacagugccacccauccaacugugaaacuauucugggagaccuuucacgaguucccccucgagaagaaaaagaaauuccuguuguuucugacaggcagcgaucggaucccuauauauggaauggcgucuuuacagaucgucauucaguccaccgccucaggcgaggaauaccucccaguggcucacacuuguuauaaucugcuugaccugcccaaguacaguagcaaggagaucuugucggcacgccucacacaggcccuggauaacuacgaaggguucucccuagcuuga

SEQ ID NO: 57171 - RNA, 3075 nt, Artificial Sequence
  derived and/or modified sequence opt3 from HERC5__Homo_sapiens__NP_057407
auggagagaaggagccggcgcaagucccgacguaacggcagaucuaccgccgggaaagcugcagccacacagcccgcgaagucaccuggagcucaacuguggcuuuucccaagugccgcaggucuucacagggcccuguugcggcgcguggaagucacuagacaguuaugcuguagcccgggcaggcuggcuguucuagagcgcgggggagcaggcgugcagguacaucagcuccuggccgguuccgggggagcucggacgcccaaaugcaucaagcucggcaaaaauaugaagauucacucuguggaccaaggcgccgaacauaugcugauauugucgucagaugggaagccuuuugaguacgacaacuauagcaugaaacaccuccgauucgaaaguauccugcaggagaagaaaauuauccagauuaccuguggagauuaccauucccuggcgcucucuaaggguggcgaguuauuugcaugggggcagaaucugcacggacaacuuggcgucgguagaaaauucccaagcacaacuacaccccagaucguggaacacuuggccgggguuccucuggcucagauauccgccggagaggcacauucaauggcucuaaguaugagcggcaacaucuauucuuggggcaagaaugaaugcgggcagcucggacugggucacaccgaguccaaggacgauccaucacuuauugagggccuggacaaccaaaaaguggaauuugucgccugugggggaagccauagugcguugcucacccaggauggccuguuauucacuuuuggugccgggaagcacggccagcugggacacaauucuacacaaaacgagcucaggcccugccuuguggcagaacugguaggcuaccggguuacccagaucgcuugugggcguuggcauacguuggccuauguguccgaccuaggaaaagucuucagcuuugguucgggcaaggaugggcagcugggaaauggcgguacucgcgaccagcucaugccucugccagugaaagugucuuccucagaggaacuuaagcuggagagucacaccagcgagaaagaauugauuaugaucgcugggggcaaccaauccauacuccuguggauuaagaaggagaauagcuacgucaacuuaaaaagaacaaucccgacucugaaugaaggaaccguuaagagguggauugccgauguggagacaaaacgguggcagagcaccaagcgagaaauccaggagaucuucucaagucccgcaugccuaacgggcuccuuucuccgcaaaagaaggacuacagagaugaugccuguauaucuggaccuuaacaaggcccggaauauuuucaaggaauugacccagaaagauuggauaacuaacaugaucacaaccugucugaaggacaaccuccugaaacgccuuccauuucauucucccccucaagaggcucuggaaauuuucuucuugcucccagagugccccaugaugcacaucucuaauaacugggaaucacugguggucccguuugcgaaggugguuuguaaaaugagugaccagagcuccuuagugcuggaggaguacugggcaacgcuacaggaaucuaccuucucgaagcucguccagauguuuaagacagccgugauaugccaacuggauuacugggacgagagcgcugaagagaaugggaacguacaggcccuuuuggagaugcugaaaaagcuccauagaguuaaucaggugaaaugccagcugccugaauccauuuuccaagucgaugaguuacugcacaggcuuaacuuuuucguggaagucugucgucgguauuuguggaagaugacuguggacgcaucagagaauguucagugcugugugaucuuuagucacuuccccuuuaucuucaacaaucucucuaaaauuaagcugcuacauaccgauacacugcucaagaucgaaagcaaaaagcacaaagccuaccugcgauccgcugccauugaggaggaaagagagucagaauuugcacuuaggccaacuuucgacuugaccguacgccggaaccaucugauagaggaugucuuaaaucagcucagccaauuugaaaacgaggaccugagaaaggagcuuugggugucuuucuccggagaaaucgguuaugaucugggcgggguuaaaaaggaguucuuuuacugcuuguucgcggaaaugauucagccugaguauggaauguuuauguaccccgaaggcgcuaguuguaugugguucccagugaaacccaaguuugagaagaaaagguauuucuuuuucgguguccucugcgggcugagccuauuuaauuguaacguggccaaucugccuuucccacucgcacuguuuaagaaacuuuuggaccagaugccgucucuggaggauuuaaaggaacucucccccgaccugggcaaaaaccuucagacacugcuagacgaugagggagacaacuucgaagagguauuuuacauccacuucaaugugcacugggaucgcaacgacaccaaucucaucccuaacggcucaaguauuacuguuaaucaaacgaacaagcgagauuacgucagcaaguauauaaauuacaucuucaacgacucggugaaagccguguaugaggaauuucggcguggguucuacaagaugugcgaugaggacauuaucaaacuguuucauccagaagaguugaaggaugucauuguuggaaauacagacuaugauuggaaaaccuucgaaaagaacgcuagauacgagcccggcuauaauuccucucacccuacuaucgugauguuuuggaaggccuuccauaaacugaccuuagaggaaaagaaaaaguuucucguguuccugacagguaccgacaggcuucagaugaaagaucugaacaauaugaagauaacuuuuuguugcccagagagcuggaacgaacgcgaccccauccgggcauugacauguuucucaguacucuuucugccgaaguacaguacgauggagaccgucgaagaggcucuacaggaggccauuaauaacaacagaggguucggauga

SEQ ID NO: 57172 - RNA, 2961 nt, Artificial Sequence
  derived and/or modified sequence opt3 from HERC6__Homo_sapiens__NP_001158608
auguacuucugcuggggcgccgacagcagagagcugcagaggcggcgcaccgcugggucccccggagcagaacuccuucaagccgcgucuggugagcgacacucacuguuguuacugacaaaccaucgugugcuaaguuguggcgauaauagcagagggcagcucggaaggcggggcgcucagcgcggugaacugccugagccaauccaggcccuugaaacucugauugucgacuugguuuccugcgggaaggagcacucucucgcagugugucauaaaggaagaguauuugccuggggcgcuggcucggaggggcaacugggaauaggugaguucaaggaaaucucauuuacgccgaaaaagauuaugacccugaacgauaucaaaauuauccaggugagcugcggccacuaucauagucucgcauuauccaaggacucucaggucuucagcugggggaaaaauucccacggacagcugggccuugguaaagaauuucccucacaagccaguccucagagggugcggagcuuggaggggauaccacuggcucagguugccgcgggaggcgcacacucuuucgcccuaucccucuguggcacaucauuuggguggggaagcaacagugcuggucagcuggcccuuucuggccgcaaugugcccguccaauccaacaagccucugagcgugggggcauugaaaaaucucggaguaguuuacaucucgugcggcgaugcucauacugccgugcugacccaggacgguaaggucuucacauuuggggauaaccgaucuggccaguuaggauauuccccaacccccgagaaaagaggcccucaacugguggaaaggauugacgggcucgugucacagaucgauuguggaaguuaccacacucuugcguauguccauacaaccggucagguugugagcuucggccacgggccauccgacacgucuaagccgacucaccccgaggcccugaccgaaaauuuugauauuagcugcuugaucucagcagaggacuucguagaugugcaggucaagcauauauuugcuggaacauacgccaacuucgugacuacccaccaagacacaaguuccacccgggcuccuggcaaaacgcuaccagaaauuagccguaucucucagucaauggccgagaaguggauugcaguuaaacgcagaaguacugagcaugaaauggccaagagcgagaucaggaugaucuucuccucucccgcuugucugacagcgucguuucucaaaaagcgggguaccggggaaacuacaagcauugacguggaucuggagauggcacgagacaccuucaaaaagcugacgaagaaagaauggauauccucaaugaucaccacaugccuugaggaugacuugcuccgcgcccugccuugucacaguccacaucaggaggcuuuaucugucuuucugcuacuccccgaaugcccggugaugcacgauagcaagaauuggaaaaaccugguaguuccuuucgccaaggcagugugcgagauguccaaacagucacuucaagucuugaagaaguguugggccuuucugcaggaaagcucucucaauccccugauucagaugcuuaaagcugccaucauaucccagcuguugcaccaaacuaagaccgagcaggaccauugcaacgugaaagcacuccugggcaugaugaaggaauuacacaaagucaauaaggcgaacuguagacugccagagaacacauucaauauuaacgagcuaaguaaucuccugaacuuuuauaucgauaggggacggcagcuuuuccgcgacaaucauuugaugagcgaaaagaaggcuuacaugcugaugcacgagacuauccuccagaagaaagaugaauuuccucccucuccaagauucauucugagggugcgucggucccgauuaguuaaggacgcccugagacaacuuucacaggcagaggccaccgauuuuugcaaaguguugguagucgaguucaucaacgaaauuugucccgagaguggcggggugagcucggaauuuuuccacugcauguucgaggaaaugacaaagccugaguacggaauguuuauguauccagagauggguuccuguaugugguucccggcuaagcccaaaccugaaaagaaaagguacuuucucuucggcaugcugugcgggcuaucucuguuuaaucucaacguugccaaucugccauucccccuugcauuguauaagaaacuguuagaccagaagccuagccucgaggaccugaaagaacuuucaccacgccugggaaagaguuugcaagaggugcucgaugacgcugccgaugacauaggcgaugcgcuguguauccgguuuuccauucauugggaccagaacgaugucgaccuaauccccaaugguaucucuauuccgguggaucagaccaacaagagagacuacguaagcaaauauauagauuacaucuucaauguguccguuaaggccgucuaugaagaguuucagaggggguucuaccgcgugugcgagaaagaaauucugcgacacuuuuacccugaggaacucaugacugcuaucauuggcaacacggacuaugauuggaagcaauucgagcagaauagcaaauacgaacagggauaucagaagucacauccaacaauccaacuguuuuggaaggcauuccacaaacuuaccuuggacgagaagaaaaaguuccuguuuuucuuaacuggccgggaccgucuccaugccagagggauacagaaaauggagaucguguuuaggugucccgaaaccuucagugagcgcgaucacccuacaucuauuaccugccacaacauccugucccuucccaaguacagcacuauggaacggauggaggaggcucugcaggucgccauuaacaauaacagaggauuuguuucgccaaugcuaacacagucauga

SEQ ID NO: 57173 - RNA, 1173 nt, Artificial Sequence
  derived and/or modified sequence opt3 from HERPUD1__Homo_sapiens__NP_001010989
auggagagcgaaaccgagcccgaaccugugacacugcucgucaaguccccaaaccagagacacagggaccuugagcugucuggcgaucggggguggucaguuggacauuugaaagcccacuuaagucgcguguacccggaacgaccccguccugaggaccaaagacugaucuauagcgguaagcuacuccuggaucaucagugccuuagggaccuguugccaaaagagaagcggcacguacuccaucugguguguaaugucaaaucccccucuaagaugccugaaauuaacgcuaagguggcagagucgacugaggaaccagccggcucaaaucgcgggcaguaccccgaggauagcaguuccgacggacugagacagagggaaguucuccggaacuuaucuagcccuggcugggagaauauaucccgcccagaagcggcucaacaggccuuccagggucuggggccgggauuuucaggcuauacgcccuacggcuggcuucaguugaguugguuccaacagaucuaugcacgacaguacuauaugcaguaccuggccgcuaccgcagccagcggggcuuuugugccuccacccucugcccaagagauuccugucguguccgcgccagcacccgccccgauccacaaccaguucccugcugaaaaucagcccgccaaccaaaaugcagcuccacagguaguugugaacccuggagccaaucagaaccuaagaaugaaugcgcaggguggccccauugucgaggaggaugacgaaaucaacagggauuggcucgacuggacauacucagccgcaacuuuuagcguguuccugaguauacuuuauuuuuacucuucccugagccgguucuugauggugaugggggcuaccgucguuauguaucuccaccaugugggaugguuuccauuccguccccgcccuguacaaaauuuuccaaacgauggcccgcccccugacguggucaaccaggauccaaauaacaaucugcaggaggguacagaccccgaaaccgaggacccuaaccacuuaccacccgauagagacgugcuggauggggaacagacuucgccgucuuucauguccacagccuggcucguuuuuaaaaccuucuucgcuucacuucugccugagggaccacccgccaucgcaaauuga

SEQ ID NO: 57174 - RNA, 843 nt, Artificial Sequence
  derived and/or modified sequence opt3 from HES1__Homo_sapiens__NP_005515
augcccgccgacaucauggagaagaacagcuccucuccuguggcugcaaccccagccucagucaauacaacuccggauaaacccaagacggcgagugaacacagaaaaagcuccaagccuauuauggagaaaaggcggcgcgcucgaauaaacgaaucucugucgcagcucaagacccuuauccuggacgccuugaagaaagauucaagccgucauaguaaguuagagaaagcagacauucuggaaaugacaguuaagcaccuaagaaaucuccaaagggcccagaugacugcugcacuguccaccgauccaucugugcuuggcaaauaccgggccggguucagcgagugcaugaacgagguaacacgcuuucuguccaccugugaaggagugaauacugaggucagaacaagguugcucggucaucuggcuaacugcaugacccagaucaaugccaugacguaucccggccagccucacccagcgcugcaagcacccccuccaccgcccccugggccaggaggcccccagcaugccccuuucgcuccacccccgccucucgugcccauuccagguggggccgcaccucccccaggaggcgcucccuguaaguuaggcucacaggccggggaagcggccaagguuuuuggagguuuccagguggucccugcaccagacggccaauuugcuuuccugaucccgaacggggccuuugcucacaguggacccgugauaccuguauacacuagcaauucuggcaccuccguugguccaaacgccgugucacccagcagugggccuucucuuacagcagauuccauguggcggccauggcgcaauuga

SEQ ID NO: 57175 - RNA, 522 nt, Artificial Sequence
  derived and/or modified sequence opt3 from HES2__Homo_sapiens__XP_011539915
augggccugcccagaagggccggggacgcugcagagcuccgaaagagccuuaaaccucuguuggaaaagcgccgacgugccagaaucaaccaguccuuaucucaacugaaaggacuaauucucccacugcuugguagggaaaauucaaacugcaguaagcuggagaaagcggauguguuggagaugaccguccgguuccuccaggaacugccggcuagcuccuggcccacagccgcaccucugccaugugacucuuaccgcgagggcuauucggccugcguugcuagacucgcaaggguguuacccgccugucggguacuggagccugcugugucagcccgccuuuuggaacaccuguggcggagagcggcaagcgccacucuagaugggggaagggcuggcgacaguuccgguccaucugcccccgcuccugcaccagccagcgcgccggagcccgccuccgcaccugucccaucacccccuaguccacccugcgggccgggacucuggcggccuugguga

SEQ ID NO: 57176 - RNA, 669 nt, Artificial Sequence
  derived and/or modified sequence opt3 from HES6__Homo_sapiens__NP_001136325
auggcucccccugccgcaccaggcagagacaggguggggcgggaggaugaagacggaugggagacccgcggugaucgaaaggcccguaaaccgcuggucgaaaagaaaagaagggcgcggaucaacgagagccuccaggaacuucgccuguuguuagcuggcgccgaggcaaagcuggagaaugccgaaguucuagagcucacagugagaaggguacaaggggugcugcggggacgcgcucgagaaagagagcagcuucaggcagaggccuccgaaagguucgcugccggcuacauucagugcaugcacgagguccauacuuuugugucuacgugucaagcgauagacgcaaccguugccgcugaacuguugaaccaccuccuggagucaaugccccugcgggaagguaguagcuuccaggaucucuuaggggacgcccuggcaggaccuccacgugcucccggccgcuccggcuggccugccgggggagcgccagguucucccaucccuucgccaccgggccccggggaugaccuuugcucagauuuggaggaggccccugaagcagagcugagccaggcuccagccgaaggacccgaccuagugccugcugcccucggcagucugacaacugcacagauugccagauccgucuggaggccaugguga

SEQ ID NO: 57177 - RNA, 693 nt, Artificial Sequence
  derived and/or modified sequence opt3 from HES7__Homo_sapiens__NP_001159439
auggugaccagagacagggccgagaaccgggauggccccaagaugcugaaaccucucgucgaaaagcgccgacgugacagaaucaauaggagccuugaggaacugcgguuguuacugcuagagcgcacaagagaucagaaccucaggaauccaaaacuggaaaaggcugagauucuugaguucgcaguuggguaccugcgggaacgcucccgaguggagccgcccgccgcggcugccccuggaguaccaagaucucccgugcaagacgcagaagccuuggcuucaugcuaucucagugguuuuagggagugucugcugcggcucgcagccuucgcucacgaugccagcccugcggcacgugcccaguuauuuuccgcucugcauggcuaccuucgcccaaaacccccuagaccaaagccggucgaccccaggccuccagcaccccggccuucuuuggauccagccgcucccgcccuggggccggcgcuacaccagcgaccucccgugcaucagggacacccaucgccucgcugcgccuggucacccagccucuguaguccaagagcaggcgacuccggugcucccgccccucugacugggcuucugccaccgcccccuccaccccauaggcaagauggagcuccuaaggccccauugcccccgccuccagcauucuggcggcccuggccuuga

SEQ ID NO: 57178 - RNA, 558 nt, Artificial Sequence
  derived and/or modified sequence opt3 from HESX1__Homo_sapiens__NP_003856
augagccccucccugcaggagggcgcacaacucggggaaaacaagccuucuaccugcucauucaguaucgagcggauucuuggacuggaccagaaaaaggauugugugccauugaugaaaccgcacaggcccugggcugacacaugcagcuccucugguaaggauggcaauuuaugucugcaugucccuaacccacccucggggauaucauuuccuagcguuguggaccacccaaugcccgaagagagagcaaguaaauacgaaaauuauuucuccgccucugagcgccuaagccucaagcgagagcuguccugguaccguggaagaaggccucggacugcguuuacgcagaaccagaucgaaguacuugagaauguguuccgcgucaacugcuauccaggcauugauaucagagaagaccuggcucaaaaguugaaucucgaggaggauaggauucagaucugguuucagaaccggcgcgccaaacugaagcgaucacauagagaaagucaguuccugauggccaaaaagaauuuuaacaccaaucucuuagaguga

SEQ ID NO: 57179 - RNA, 1590 nt, Artificial Sequence
  derived and/or modified sequence opt3 from HEXA__Homo_sapiens__NP_000511
augaccagcuccagacugugguucucucuccuucuggccgcugcauuugccggcagggcgacagcuuuguggcccuggccucagaacuuccaaacuucagaccagcgguacguguuauauccaaauaacuuucaguuccaguacgaugucaguagcgccgcacaaccggggugcuccguucuggacgaggccuuucagcgcuaucgagaucuacucuucggaucugguucguggccccguccuuaccugacgggcaagagacacacccuugagaaaaaugugcugguagugucagucgugacaccaggguguaaccaguugcccacucucgaaagcguugaaaauuauacccugacaaucaacgacgaucagugccugcucuuaagugagaccguguggggagcucugaggggccuugaaacuuuuucccaauuggucuggaagucugcagaggguacauucuuuauuaauaaaaccgagauagaagacuucccucgguuuccacaucgcgggcugcuacucgauacgagcagacacuaccugccccuuuccucaauccuggacacuuuggaugugauggccuauaacaagcucaauguauuccauuggcaccugguugacgauccuaguuuuccauacgagagcuucaccuucccggaauuaaugaggaaaggaucuuacaaccccgugacacauauuuauacugcucaggacgucaaggaggugaucgaguacgcccggcugcgcggcauucgagugcucgcggaauuugauaccccuggccacacacuuuccugggggccaggaauccccggucuguugaccccuuguuauucaggcagcgagccaagugggacguucggacccgucaauccgucucuaaacaauacuuacgaauuuauguccacauucuuucuggagguuagcucgguguucccugacuuuuaucuccaccugggcggugacgaaguagauuuuaccugcuggaagucuaaccccgagauacaggacuucaugaggaaaaagggguucggagaggauuuuaaacagcuugaauccuucuacauccaaacucuguuggacauugugucaaguuauggcaagggcuacgucguguggcaggagguuuuugauaauaaagugaagauccagccagacacaauuauccaagucuggagagaagauauaccugugaacuacaugaaggagcucgaacugguaaccaaagcaggguuccgggccuuacugagcgcucccugguaucuaaaccguauuuccuacggaccagacuggaaggauuucuauaucguugagccccucgccuuugaggguacgccugaacagaaagcacuggugauuggcggggaggcuuguauguggggagaauacgucgacaauaccaaccuugugccacgcuuguggccgagagccggcgcggucgccgagaggcuguggucuaauaagcucacaagcgaucugacuuucgcauaugaacggcuuucacauuuucgaugcgagcuguugcgcagaggugugcaggcucagccccucaacguuggguucugugagcaagaauuugagcagaccuga

SEQ ID NO: 57180 - RNA, 1671 nt, Artificial Sequence
  derived and/or modified sequence opt3 from HEXB__Homo_sapiens__NP_000512
auggagcugugcggccucgggcuucccagaccuccaaugcuguuggccuuacugcuagcuacccuccuggcagccaugcuugcgcuguugacacagguggcucucgucguucaaguggccgaagcagccagggcuccgagcguauccgcaaagcccggaccugcccuguggccacugccccucucugugaaaaugacuccuaacuuacugcaccuugcuccagagaauuucuacaucucacauagucccaacagcacggccgguccuuccuguaccuugcuggaagaggcguuucggcgcuaucacggcuacauuuucggguuuuauaaguggcaucacgaaccagcagaguuccaggccaaaacacagguccagcaacuacucgugucuauaacucugcagucggagugcgacgcuuuuccgaauaucucaagcgaugaaaguuacacccuucugguuaaggagcccguggccgucuugaaagcaaaccgaguguggggagcucuccguggccuggaaacauucucccaguuaguauaucaggacucuuacgguaccuuuacuauuaaugagagcacaaucauugauuccccuagauucucacauagggggauccugauagacaccagucggcacuaucucccaguuaagaucauucuuaagacgcuggaugccauggcguuuaacaaauucaauguguugcacuggcauaucgucgacgaucagagcuuucccuaccaaucuauuacuuucccugagcuauccaacaagggaucauacagccugagucacguguauaccccaaaugacgugcgcauggucaucgaauacgccagacucaggggcauacggguucugcccgaguuugauacaccgggccauacucuuucuugggggaaaggacagaaggaccuguugaccccuuguuauucccgccagaacaaacucgauagcuucggucccauuaauccaacacugaacaccacguacucguucuuaacuacauuuuucaaggaaaucucugagguguuuccugaccaauucauucaccugggcggggaugaaguagaguuuaagugcugggaguccaaucccaaaauccaggacuucaugcgacagaagggauuuggcaccgacuucaaaaagcuagaaucauuuuauauccaaaaagugcucgauauuauagcaacuaucaacaaggguaguauugucuggcaggagguguucgacgauaaagcuaagcuggccccagggacaaucguugaaguguggaaggacagcgcuuaccccgaggaacuuuccagagucaccgccucuggauuuccugugauauugagcgcaccaugguaucuggaucucauuucauacggccaggacuggaggaaauacuauaagguagagccgcuggauuucggcgggacgcagaaacaaaagcagcuuuuuaucggaggugaggccugucuguggggcgaauacguugacgcuaccaauuugacaccccggcucuggccucgugcgagugcagugggggagcgccugugguccagcaaagaugucagagacauggaugacgccuaugacagguuaacucggcaccgaugccgcaugguggaaagaggaaucgcugcccagccacuguacgcaggcuauuguaaccaugagaacauguga

SEQ ID NO: 57181 - RNA, 1758 nt, Artificial Sequence
  derived and/or modified sequence opt3 from HEXDC__Homo_sapiens__NP_775891
augagcggcuccacccccuuccagaugagacuggugcaccucgaccuuaagggggccccuccaaaagucucuuaccugucagagaucuuuccguuguucagggcuuuaggagcaaacggucugcuaauugaauaugaggauauguuucccuacgaaggcccucuccggcugcuucgcgccaaguaugcguacaguccaagcgagauaaaagaaauccugcauuuggcugggcucaaugagcuggagguuauuccccuggugcaaacauucggacacauggaauuuguacucaagcauacugccuucgcacacuuacgagaggugggcuccuuuccuugcacgcugaacccacaugaagccgagucucuugcuuuggucggugcaaugaucgaccaggugcuggagcuacaccccggggcccagcgucuccacauuggaugugaugaaguuuauuaccugggcgagggcgaggcuucgagaagguggcuucagcaagaacaaaauucaaccgggaaacugugcuugagccauaugcgggccguggcgaguggagucaaggcacgcagaccuuccgugacaccacucguaugggacgauaugcugagggacuuaccggaagaucagcuggccgcuucugguguuccccagcucguggagccuguccuuugggacuauacugccgaucuggacgugcacggcaagguguugcuaaugcagaaauaccggcgcuguggguucccacagcugugggcagcuagcgccuuuaagggagcgaccggccccucccaggccgucccuccaguugagcaucaccuccgaaaccacgugcaguggcugcaaguagcagguucagggcccacagauagucuucagggaaucauacugaccggcuggcagagauacgaccauuauagcguguugugcgaacuccugccggcuggcgucccuucuuuagccgcuugucugcaacuacuccugaggggaggauucgaugaggacgugaaagccaagguugaaaaucuuuuggguaucuccucacuggagaaaacugaccccgugcggcaggcaccaugcagcccucccuguccacuccugccccuuccuuuuccacguccguggcgccagcuguucagugccggcuugucugcugggagaggacccgcgccuucccucgcagccacaagccugccauuaucgcacaagucugcuuccauuugcgccgcacuguggaugagguguuggcgggccaccggcaugucacuagcugguagugcccccacgacugcaagcggguccucuagcacccgaucaugguuuaguacauccagcccucagcgcucugcgucauggcauaguggcgcuccaagcugcagauccuggaggcuccccuguucuuggcugucgacucggaugccguggcgcagcggauggagaaagaccugcaccccugccugcuccggcuguaaacuuugcuguaggacaucagcacguugcuugccaccccggugucacccucccgcccuggcugggacgcuccugcgaacuccagaagggagagcccaugcaagggguuuacugcuugaggcuggcggggccuugcacugccaaauggcgugggccauccgcgcucacgucggagugguaccuaguggccccgcaguuucuuguccacauagcgugccggaggguccugggcagccccucggcgaacggcuggagaacacagaaggauccucaaccggcagaccagcccuauga

SEQ ID NO: 57182 - RNA, 1080 nt, Artificial Sequence
  derived and/or modified sequence opt3 from HEXIM1__Homo_sapiens__NP_006451
auggccgagcccuuccugagcgaauaccagcaccaaccucagaccuccaacugcacaggcgcugcagccgugcaggaggaacucaauccagagagaccgcccggggcggaagagagggucccugaggaagacucucgguggcagucacgcgcuuuuccacaacuuggaggucgacccggcccugagggggaaggaagucuggagagccagccacccccuuugcagacucaggccuguccagaguccucuugcuuacgugaaggcgagaagggucaaaacggggaugacucgucagcaggaggcgauuucccgcccccugccgaaguugagccaacgcccgaagcugagcugcuagcacagccuugucaugacagcgaggccaguaaacucggcgcuccagccgcagggggagaagaggaauggggucagcagcaaagacagcugggcaagaaaaagcacaggcggcgccccuccaaaaagaagagacauuggaaaccguauuacaaacuuaccugggaggaaaagaagaaauuugaugagaagcagucucugagggcgagccggauccgcgccgagauguucgcuaaggggcaaccuguggcccccuauaauacaacucaguuuuugauggacgaucacgaccaggaggaaccagaucucaaaaccggacuguacuccaagcgagcagcugccaaaucagacgauacaagugacgaugacuucauggaagagggcggugaagaggacgggggaagcgauggcaugggcggggacggaucugaguuucugcagagagauuucuccgaaaccuaugagagguaccauacugaaucacuccaaaacaugagcaagcaggaguuaauuaaagaguaucuggaacuugagaagugcuugagucggauggaagacgagaauaaccgucugcgccuagaaucuaaaagacucgguggcgaugacgcgaggguacgggagcuggagcuugaacuggaucgauugcgcgccgagaaucuccagcuguuaacagaaaacgagcugcacagacagcaagaaagggcaccucucuccaaguuuggggacuga

SEQ ID NO: 57183 - RNA, 927 nt, Artificial Sequence
  derived and/or modified sequence opt3 from HEY1__Homo_sapiens__NP_001035798
augaagagagcccaccccgaguacagcuccucugacucagaacuggaugagaccaucgaaguggagaaagaaagugcugacgagaacggcaaucucagcuccgcacuugggucuaugucgccuacaacuucaagccagauucuggccaggaagcggcgccgaggaauaaucgagaaacguagaagggaucggauuaacaauaguuuguccgaauuacgcagacuggucccaucugcguucgagaagcaaguuauggaacaggguagcgcuaaacuagagaaggccgagauccuccagaugacgguggaccaucugaagaugcuucacaccgcaggcgggaaaggauauuuugaugcccaugcucuggcaauggacuacagguccuugggcuuccgggaaugccucgccgagguagcucgcuaucugucaauuaucgaaggucuggaugccagugacccgcuccgagugagauuagucagccaccugaacaauuacgcgucucagagggaggcagccuccggggcucaugccggacuuggccacauacccuggggcacaguguuugggcaccauccucacaucgcacauccauugcugcuaccccaaaacggacacgguaaugcuggcacuaccgccucaccuacagaaccacaccaucaggggcggcucggaagcgcgcaccccgaggccccugcacugcgugcuccaccgaguggcucucuuggucccguucugccuguggucaccuccgccagcaaguugucgccaccccuccugucuuccguggcuucauuaagugccuucccuuuuagcuucggguccuuucaucugcucucuccaaacgcacuuagccccucagccccgacucaggcugcgaaucugggaaaaccuuaucgccccuggggcacagagauuggcgcauucuga

SEQ ID NO: 57184 - RNA, 1014 nt, Artificial Sequence
  derived and/or modified sequence opt3 from HEY2__Homo_sapiens__NP_036391
augaagagacccugcgaggaaaccacaagcgaguccgacauggaugaaacuaucgacgugggcucugagaacaauuacucagggcagaguacgagcuccgucauuaggcugaacucuccuaccacaacuucgcaaauaauggcccggaaaaagcgccgaggaaucauugaaaaacguagaagggaucggaucaauaacucacucagcgagcuucgcagacugguuccaaccgcuuucgagaagcaggguagugcaaaauuggaaaaggccgagauuuuacagaugacaguggaccaccugaagaugcuacaggcgaccggcgggaaaggauauuuugaugcucaugcccucgcaauggacuucauguccaucggcuuuagggaaugucugacugagguagcccgguaccuuucuagcguggagggucuggauuccucagacccguugcgcguccgacucgugagucaccugagcacaugcgcuacccaaagagaagcagccgcuaugacgucuuccauggcccaucaccaucacccccugcacccucaucacugggcggcagccuuccaucaccucccagcugccuuacugcagcccaaugggcuucacgcaucagagagcacuccuuguagguugaguaccacaucugaaguuccacccgcucauggauccgcccugcuaacugcgaccuuugcccacgcagauagcgcucuccggaugccuucgacaggcucuguggccccaugcgucccgccccuguccaccucacuucugaguuugagcgcuacggugcaugccgcagccgcugcggcaacugccgcugcccacuccuucccucucucuuuugcaggcgccuucccaaugcugcccccuaacgcugccgcagcgguagcugccgcaacagccauaagcccacccuuaucaguuagugcuaccuccagcccgcagcagacuucuucagggacaaauaacaagccuuaucgucccuggggaaccgaggugggugccuuuuga

SEQ ID NO: 57185 - RNA, 1047 nt, Artificial Sequence
  derived and/or modified sequence opt3 from HFE__Homo_sapiens__NP_000401
augggccccagagccaggccugcucugcuccuucugauguuguuacagaccgcagugcugcaagggcggcuacuccgcagccacucccugcauuaccuuuucaugggagccucugagcaggaccuggguuugucacucuuugaagcgcugggcuaugucgaugaccagcuguucguguuuuacgaucacgagagucgacguguugaaccaagaacaccguggguaagcuccaggaucucuucgcagauguggcuccaauuaucacagagccugaaggggugggaccauauguucacuguggauuuuuggacgauuauggagaaccacaaucauaguaaagaaucccacacccuucaggucauauugggaugcgagaugcaggaggacaacucuacagaaggcuauuggaaguacgguuaugaugggcaagaccaccuggaguucugucccgauacucuagacuggcgggcugccgaaccucgcgcauggccaaccaaacucgagugggagagacauaagaucagggcccggcagaaucgcgcuuaccuggaacgagauugccccgcacagcuucagcaacuguuggagcucggaagaggcgugcuggaccagcagguuccuccauuagugaaagucacacaccaugugaccagcuccguaacuacacugaggugucgggcccucaacuauuacccccaaaauauuaccaugaaguggcuuaaggauaaacagccuauggacgcuaaggaauuugagccaaaagacguucugccgaacggcgaugggacguaccagggauggaucacuuuggccgugcccccuggugaggaacagcguuauaccugccaagucgagcacccaggccuagaccagccccugauugugaucugggaaccuucaccaagugggacacucgugauaggagucaucagcggcauugcgguuuucgugguaauccuguuuauugguauccuuuucauaauucugcgcaagagacaggggucuaggggagcaaugggccacuacguguuggccgagcgggaauga

SEQ ID NO: 57186 - RNA, 4308 nt, Artificial Sequence
  derived and/or modified sequence opt3 from HFM1__Homo_sapiens__XP_011539154
augcucaagagcaacgacugccucuucucccuugagaaucuguuuuucgaaaaacccgaugagguggaaaaccacccugacaaugagaagucuuuggauugguuuuuaccaccggcuccccugaucucagaaauuccugacacccaggagcuagaggaggaacucgaaagucauaaacugcuuggccaagagaagagaccaaaaaugcugacaagcaacuugaagauaacuaaugaggauacgaacuacaucucccucacccagaaguuccaguuugccuuccccucugacaaauaugaacaggaugaccugaaucuggagggggucggaaacaaugaucucucgcacauugcagguaaguuaacauacgccucacaaaaauauaagaaccauaucggcacugaaauugcgccugagaaaagcguuccagacgauaccaagcuggugaauuuugcugaagacaagggggagaguacauccguauucaggaaacggcuuuuuaagaucucugauaacauacacggaagcgccuacuccaaugacaacgaguuggacucacauaucggcagugugaaaauuguccagaccgaaaugaauaaggguaaaagccgcaacuauucuaacuccaagcagaaauuccaguacucagcaaauguguuuacugccaacaaugcuuucagcgcaagugagaucggggaaggaauguuuaaggcccccucuuucuccguugcuuuccaaccucacgauauucaggaggugacagaaaacggccugggcagccuaaaggccgucaccgagaucccagcgaaauuucgaucgauauucaaggaguuuccguauuucaauuacauucagucuaaagcauuugacgaucuccuguacacggaccguaacuucgugaucugugcccccacuggguccggaaagaccguaguuuuugaacuugcuauuacaagacuguugauggaggugccucucccauggcugaauaucaaaaucgucuauauggcccccauuaaggcauuaugcucacagagguucgaugacuggaaggaaaaauuugguccuauaggccugaacuguaaggagcucacuggggauaccgugauggacgaucuuuucgaaauccaacacgcucauauuaucaugacaaccccagagaaaugggacaguaugacgcggaaguggcgcgauaauagccuggugcaguuggucagacuauuucugauagacgagguucacauugugaaagacgaaaacaggggacccacucucgagguaguggucucccggaugaagacagugcagucuguuagccaaacccugaagaauacuucaacagccaucccgaugcgcuucguggcggucagugccaccaucccuaacgcagaagauauugcugaguggcuuuccgacggcgagcgacccgccgugugccugaaaauggaugaaagccauagaccaguaaaguugcagaaaguugugcucgguuuuccuuguucuucaaaucagacggaguucaaguucgaccugaccuuaaacuacaaaaucgcuagugucauucagauguauagcgaucaaaagcccacacugguguuuugcgccacuaggaaggggguccagcaggcagccuccgugcuaguuaaagacgcuaaguucauaaugaccguggaacagaaacaacggcuccagaaguacgcguauucuguacgugauucgaaacugcgcgacauccuuaaggauggagcagccuaccaccacgcuggcauggaguugagcgacagaaaagucguggaaggcgccuuuacaguuggggaucugccagugcuguucacuaccuccacacuggcaaugggagucaaucuucccgcccaucuggugguaauuaagucaaccaugcacuaugcugguggcuuguuugaggaguacagugaaacugacauccuccagaugaucgggagggccggacggccucaguucgauacgacagcaaccgcggugauuaugacucgacugucuacccgcgacaaguacauacaaauguuagcuuguagagacacaguugagagcucccugcauaggcaccuaaucgaacaucucaacgccgagauuguccugcacaccaucacugaugugaacauugcaguggaauggauccggucaacacuuuuguauauacgcgcccugaaaaauccaagccacuacggcuuugcuucuggucucaacaaggacgggaucgaggccaaacugcaggaguuaugccugaagaaucuuaacgauuuguccagucucgaccugauuaaaauggaugaaggcgucaauuucaagccgacggaggcaggaagacuaauggcuugguauuacaucaccuuugaaacuguuaagaaauucuauacaauuagcggcaaggagacccugucugaccucgugacacugaucgccggguguaaagaauuucuugauauacaguugaggauuaacgagaagaaaacucugaauaccuuaaacaaggaccccaaucguaucacgauucgguucccuauggagggacgaaucaagaccagagaaaugaaagugaacugccucauacaggcgcaacuggguuguaucccaauucaggauuuugcccuuacacaggacacugcuaagaucuucaggcauggcucccgcauuacccgguggcugucagauuucguagcagcccaagagaaaaaguuugcugucuugcucaauagucugauccuagccaaaugcuucagaugcaagcugugggaaaacagccuccacgugucgaagcagcuggagaaaauagggauuacacuuuccaaugcaaucguuaacgcgggauugacuucuuuuaagaaaaucgaggaaaccgacgccagggagcuggaauuaauucucaaucgccaucccccuuucggcacgcagaucaaggagacagugauguaccugccaaaauaugaacuuaaggucgagcagauuacccgauacagcgauacuacagcugagauacuggugaccguuauccuacggaacuuugaacaacuccagacuaaacguaccgccucagacagucacuacgugacacugauuaucggugacgcagauaaccagguagucuauuugcacaagauuacggacuccgugcuguuaaaggcugggucuugggccaaaaagaucgcagugaaaagagcccucaagagcgaggaucuguccauaaaucuuaucucaagcgaauuugucggccuggacauucagcaaaaauugaccguuuucuaccucgagcccaagagguucggaaaccagaucacuaugcagcgcaagagugaaacacagauuucucauuccaaacacagcgauaucucgaccauagcuggcccgaauaaggggacaacugcgaguaaaaagccuggaaaccgggaguguaaucaucugugcaaaucuaagcacaccuguggucaugacugcuguaagauuggcguggcccaaaaaucagagaucaaggaauccacgaucagcucuuaucuaagcgaucugagaaacaggaaugcaguauccucagugccacccgucaaacgacuuaagauucagaugaacaaaagucagagcguggaccucaaggaguuuggguucacaccuaagcccucucugccauccauaucacgcagugaauacuugaauaucagcgagcugccuauuauggaacaaugggaucagcccgagaucuauggaaaaguucggcaggagccauccgaauaccaggacaaggagguguuaaacgucaauuuugaacucggcaacgaggugugggaugacuucgacgaugagaaucuggaaguuaccucuuucucgacugacaccgagaaaacaaagauuagcgguuuugggaacacucuuucauccaguaccagaggcucuaaacugccguugcaagaaagcaaguccaaguuccagagggagaugucaaauucuuuugugagcagucacgaaauguccgauaucagccucucuaacucagcuaugccuaaauucuccgccaguagcaugacaaagcugccccagcaggccggaaacgcugucauaguacacuuucaagagcguaaaccacagaaucuaucgcccgagaucgaaaagcagugcuucacguuuucugagaaaaacccuaauuccagcaacuauaagaaaguggacuucuuuauucgcaauucagaauguaagaaggagguugauuucaguauguaccauccagacgaugaagcagacgagaugaaaucucugcuuggcaucuuugaugggauuuucuga

SEQ ID NO: 57187 - RNA, 1338 nt, Artificial Sequence
  derived and/or modified sequence opt3 from HGD__Homo_sapiens__NP_000178
auggccgagcugaaguacaucagcggcuucgggaacgaaugcuccucugaggaccccagauguccuggaucacucccagaaggucagaauaacccgcaagugugccccuauaaucuuuacgcugagcagcugaguggcagcgcauuuaccuguccuagguccacaaacaaacggucuugguuguaucgcauuuuaccaucggucucacacaagcccuucgaaagcauagaugaggggcagguuacucauaauugggacgagguggauccugacccaaaccagcugcgauggaaacccuuugaaaucccuaaggccagucagaaaaagguagauuucguguccggacuacacacgcucugcggcgcgggugacauuaagucuaauaacgggcuggcuauccauauuuuucuuuguaauaccagcauggagaaccguugcuucuacaauuccgauggagacuuucugaucgucccacaaaaaggcaacuugcucauauauacagaguucggcaagaugcuggugcagccgaaugaaaucuguguuauucagagagggaugagguuuucaaucgauguguucgaggaaacucggggauacauucuggaggucuauggugugcacuuugaacuccccgacuuaggcccuaucggggccaacggacuggcaaauccacgcgauuuccuuauacccauugccugguacgaggacagacaaguaccuggcgguuacaccguuaucaacaaauaucaggggaaguuguuugcugcaaaacaggaugugaguccauucaacgucguggccuggcauggaaauuacacacccuauaaguacaaccugaagaauuucauggugauuaacagcgucgcuuuugaccacgccgacccgucuaucuucaccguucuaacugcgaaauccgugaggccuggcguagcaaucgccgauuuugugauuuuucccccacgguggggcgucgcugacaagacauuccgcccucccuauuaccaccgaaauugcaugucagaguucauggggcucauaagaggacauuaugaagccaaacaggguggcuuucugccagggggaggcagccuucacaguaccaugacgccccaugguccugaugcagacuguuucgagaaggcuucuaaagugaagcuggccccagaaaggaucgcggaugggacuauggccuuuauguucgaguccagcuugucgcucgcaguuaccaaauggggccugaaggcuucucggugcuuagacgaaaacuaccacaaguguugggagccgcugaaaucccacuuuacacccaauucacguaacccugccgaaccaaauuga

SEQ ID NO: 57188 - RNA, 1968 nt, Artificial Sequence
  derived and/or modified sequence opt3 from HGFAC__Homo_sapiens__NP_001519
augggcagaugggccugggugcccagcccuuggccaccgcccgggcugggaccuuuccuccuucuguuguuacugcuacuccugcuuccaagggguuuucagccccaaccuggcgggaaccggaccgaguccccagaacccaaugcuacagcaacuccugccaucccaacgauucuggucaccucuguuacaucagagacuccggcgaccagugcucccgaagccgagggaccucagagcggcgguuugccacccccuccacgcgcagugcccuccucuucgucaccgcaggcccaggcucucacagaagacgggcgaccuugccguuuccccuuuagauacggaggcaggaugcugcacgcauguaccagcgagggcagugcccaucggaaguggugcgcuacuacacacaacuaugaucgcgacagagccuggggguacuguguagaggcgaccccaccucccggagguccagcagcccuggaucccugcgcuuccggcccuugucucaaugggggaucuugcagcaacacgcaagacccacaguccuaucauuguucaugcccgagggccuucacuggcaaagauugugguaccgaaaagugcuuugacgagacacgguacgaauauuuagaagggggagaucgcugggcacgagugagacagggccacgucgagcagugugagugcuucggcgggaggacuuggugcgagggaacccggcauacagcuugucugaguagccccugccuuaaugguggcaccugucacuugauaguggccacggggacuacaguuugcgcguguccuccaggauuugccggccgucugugcaacaucgaacccgacgagcgcuguuuccuagguaaugggaccggcuacagaggaguggcaucuacuuccgcuucaggccucagcugccuggccuggaacagugaucuucuguaucaagaauugcacgucgacucugugggggcugccgcacuccugggauuagguccucaugccuacuguaggaauccagauaacgacgagcggcccuggugcuacguaguuaaagauuccgcucugagcugggaguauugucgacucgaagcgugcgagucgcuuacacgcgugcagcugucuccggacuugcuagcaacccugccugaaccagccucccccggcagacaggcuugcgggaggcggcacaagaaacgcacguuucucagaccuaggauuaucggaggcucaaguagccugcccgguucccauccauggcuugccgcaauuuacaucggggacucuuucugugccggcagccugguccauaccugcuggguggugucagcugcccacuguuuuagucacuccccuccccgugauagcgucucuguuguguugggacagcacuucuuuaaucggacaacugacguaacccaaacauucggcauagagaaguauaucccauacacucucuauucaguguucaacccgagugaucaugaccuggucuuaauucgacugaagaaaaagggggauagaugcgcaaccaggagccaguuugugcagccuaucugucuacccgaaccaggauccacauuccccgcgggucacaaaugccaaauugcuggcugggggcaucucgacgagaauguuucuggauacucgagcucccugcgcgaggcccuugugccuuuggucgcagaucacaaguguucaaguccagaaguguauggcgccgacaucucucccaacaugcugugcgcugguuacuuugauuguaaaagcgacgccugccagggggauuccggcggaccucucgcaugugagaagaauggcguagcuuaccuguaugggauaauuucauggggagacggcugcggucggcuucacaagccggggguuuacaccagaguggccaacuaugucgacuggaucaacgauaggauucgcccaccccgacggcugguggcgccuagcuga

SEQ ID NO: 57189 - RNA, 2187 nt, Artificial Sequence
  derived and/or modified sequence opt3 from HGF__Homo_sapiens__NP_000592
augugggugaccaagcugcuccccgcccuucuguugcagcacgucuuacugcaucuacuccugcuuccuaucgcuauuccauacgcagagggccaaagaaaaaggcggaacacaauacacgaguucaagaaaagcgccaagacuacgcugaucaaaauugacccggcguugaagaucaagaccaaaaagguuaauacagcugaucagugcgccaaccgcuguacucgaaauaaagggcuccccuuuaccugcaaggcauucguguuugacaaagcccguaagcagugucugugguucccuuuuaacuccaugucuucaggaguaaagaaagaguucggucaugaauuugaucuguaugagaauaaggacuacauuagaaacugcaucauaggcaaagggaggaguuauaagggaacagugagcaucaccaaauccggcauuaagugucagccauggucuucgaugaucccccacgaacauucauuccucccuagcaguuaccgggguaaagauuuacaagagaauuauugccgcaacccaagaggggaggaaggaggccccugguguuuuacuuccaauccugaggucagguacgaagugugcgacauuccacaguguucugagguugagugcaugacauguaacggcgaaagcuaucgggggcugauggaucacaccgaguccggaaagaucugccagcgcugggaccaccagacgccgcaucgacacaaguuccuucccgaaagauacccugauaaagguuuugacgauaauuacugcaggaacccagacggccaaccccggccuugguguuauacuuuggauccacauacccguugggaauacugcgcuauaaagacaugugcagacaauacuaugaacgacaccgaugugccccuggaaacaaccgagugcauucaggggcagggagagggcuaucgcgguacggucaauacuaucuggaacgggauuccgugucagagaugggacucacaauacccucacgaacacgauaugacacccgagaacuucaaaugcaaggaccuaagggaaaauuauugucggaacccagauggaagugagagcccuuggugcuuuaccacugaccccaauauccgagugggcuacuguucucagaucccaaacugcgauaugucccauggccaggacuguuaucgcgggaaugguaaaaacuacaugggaaaucucucacaaacaagaagcggccugaccugcaguaugugggauaagaacauggaagaccuucacaggcauauuuucugggagcccgaugccucuaagcugaaugagaacuacugccggaauccugacgacgaugcucacgggccaugguguuauacgggaaacccguugauacccugggacuacugcccuaucucccgcugugaaggcgauaccacaccaacuauuguaaaucucgaccaucccguuaucagcugcgccaaaaccaagcagcugagaguggucaacgguauaccuacaaggacuaauauuggguggauggugucguuacguuaucggaacaaacacaucuguggcggaucucugaucaaggaguccugggugcucaccgcgcgacagugcuucccaucaagagaucuuaaagacuacgaagcauggcugggcauucacgauguccaugggaggggagacgagaaguguaagcagguuuugaacgugagucagcuaguauauggucccgaaggcagcgaucuggugcucaugaaacuggcccgcccggcuguccuugacgauuuuguguccacaaucgaccugccuaauuacgggugcaccauuccagagaagacuucuuguagcguuuauggauggggcuacacggguuugauaaacuacgaugggcuccugcggguggcccacuuauauaucaugggcaaugagaaaugcucacaacaucacagaggaaaggucacacugaacgaaagugagauuugugcaggcgcugagaaaaucggguccggacccugcgaaggugacuacggcgggccucuagugugcgagcagcacaagaugaggaugguacucggaguuaucgugcccggccgcgguugugccauuccaaaucgaccugggauauucguccggguggcguauuacgccaaguggauccauaaaauuauccugaccuauaaggucccccagagcuga

SEQ ID NO: 57190 - RNA, 1173 nt, Artificial Sequence
  derived and/or modified sequence opt3 from HGH1__Homo_sapiens__NP_057542
augggcgaggccggggcuggagccggugcaagcggcgggcccgaagcguccccugaggcugaaguggucaagcugcucccauuccuugccccgggagcaagagccgaccugcaggcugcagccguuaggcacguguuggcuuuaaccggcugcggucccgggcgggcccugcuagcgggacaagcagcccuccugcaggcucuuauggagcuggccccugcaucugcuccagcccgcgaugcggcccgagcauugguaaaccucgcugccgaccccggccugcaugaaacacugcucgcugccgauccuggcuuaccagcacgucugauggggagagcccuugacccccaguggccuugggcugaggaggcggcagccgcuuuggccaaucugucaagggaaccagcaccgugugccgcucuaauggccgcacucgcggcugccgagcccgcagauaguggacuggaacggcuugugcgcgcccugugcacuccugguuacaacgcuagagccccauugcacuaucucgcaccccuguuaagcaaucugucccagaggccugcugcccgggcguuucuccuugacccagaucgcugugucgugcaacgacuguugccccuaacgcaguacccggacucuucgguuagaaggggcgggguggucggaacccugcggaacugcuguuucgagcaucgucaccaugaguggcuccugggcccugaaguggauauccuucccuuucuguugcucccacuggccgguccugaggacuucucagaagaggaaauggagcgcuuacccguagaucugcaguaucuaccacccgacaaacagagagagccugaugcugacauuaggaagaugcucguugaagcaauaaugcugcuuacagccacugcuccagggcggcaacaggugcgagaccagggagccuacuugauccugcgcgagcuccacagcugggaaccggagcccgaugucagaaccgcaugcgaaaaacugauucaggugcuuaucggcgacgagccugagaggggcauggaaaaucuguuggaggugcaagucccagaagauguugagcagcagcuccaacagcuggacugucgggaacaggagcaguuagagcgcgaacuggcgcccgagccuuggguggaaagagccacaccaaccuga

SEQ ID NO: 57191 - RNA, 2334 nt, Artificial Sequence
  derived and/or modified sequence opt3 from HGS__Homo_sapiens__NP_004703
augggcagagggagcggaaccuucgagaggcugcucgacaaggccacaucccagcuucuguuggaaacugauugggagucuaucuuacaaauuugcgaccugauacggcagggugauacgcaggcuaaauacgcagugaacucaaucaagaaaaaggucaaugacaaaaacccccacguugcccuauaugcgcucgaagugauggagaguguagugaagaauuguggccagaccguccaugaugaaguggcuaacaagcaaacaauggaggagcugaaagaccuucugaagcgccagguugaagugaauguccgaaacaaaauuuuguaccucauccaggccugggcacacgccuuucguaaugagccuaaguauaaagugguacaggauacuuaccaaauuaugaagguugaagggcauguguucccagaguuuaaggagagcgacgcuauguucgcagccgaaagagcuccggauugggucgacgccgaggaaugccacaggugucgggugcaguuuggagugaugacccgcaaacaucacugcagagcguguggccagaucuucugcgguaaguguuccucuaaauauucgacaauacccaaguuugggaucgagaaagaagucaggguuugcgagccuuguuacgagcagcugaaccggaaggcagaaggaaaagccaccucaacuacagagcugccacccgaauaucucaccagcccuuuaagucaacagucccagcugccacccaagcgcgaugagacggcccuucaagaagaggaggaauugcagcuggcccuagcacucucucagagcgaggcugaagagaaggaacgacugagacagaaauccacuuacaccucauacccuaaggccgagccaaugccgagugcgagcucugcucccccugcauccucacuuuauagcaguccaguaaauucuuccgcuccccuggccgaggacauugauccugaauuggcuagguaccucaaccggaauuauugggagaaaaagcaagaagaggcccguaaaagcccaacacccucggcaccggugccucugacugagcccgccgcucagccaggcgaaggccacgcggcaccuaccaacguggucgagaaucccuuaccagaaacagacucucagcccaucccuccauccgggggaccguucucagagccccaguuucauaacggugaaagugaggagagccacgaacaauuccugaaggcccuccagaaugcugugaccacguuuguuaaccgcaugaaguccaaccauaugagaggcaggucuauuacuaaugacagcgccgugcuuucacuguuccagaguaucaacgggaugcacccucaguugcuagagcugcucaaucaacuggaugaacggcgacuuuacuaugagggacugcaggacaaauuggcacagauacgcgaugccagaggcgcucucuccgcccugagggaggaacaccgggagaaguuacgcagagcagcggaagaggcugaaaggcagcgucaaauucagcuggcccagaaacuagagaucaugcggcaaaagaaacaggaauaccucgagguccagcgacagcuggcaauucaaagacuucaggagcaggaaaaggagaggcagaugcgcuuggaacaacagaagcagacagugcagaugcgggcccaaaugccagcuuuuccccugccuuaugcccagcuccaggcaaugccagcugccggugggguacuguaccaacccagcggaccggcgucuuucccuucaaccuucaguccagccggcagcguugagggcucccccaugcaugggguguacaugucucagccugcucccgcagccggaccauauccuucgaugcccagcacugcugccgacccauccauggucucagcauacauguauccggcgggugccacaggcgcucaggccgcaccucaggcucaagccgggcccaccgcaaguccagccuacucuagcuaucagcccacgccuaccgcuggauaccagaacguggcgucccaggccccacaaucacuucccgcaaucagccagccuccgcagucuuccacaaugggcuauauggguagucagagcgucucuaugggguaccaaccauacaauaugcagaaccugaugacuaccuugcccucccaggaugcuucacucccuccacagcaacccuauaucgccggccagcagccuauguaccaacagauggccccgaguggagggcccccacagcagcaaccucccguggcucagcagccacaggcacaaggcccucccgcccagggaagcgaggcgcagcugauuucguuugacuga

SEQ ID NO: 57192 - RNA, 1908 nt, Artificial Sequence
  derived and/or modified sequence opt3 from HGSNAT__Homo_sapiens__NP_689632
augagcggcgccgggagagcucuggcagcccuccuucuggcggcuuccguguugucugccgcauuacuggcccccggagguucaaguggcagggacgcucaggcagccccuccacgggaucuagacaagaaacgccacgcugagcucaagauggaucaagcccugcuucugauccauaacgaauugcucuggaccaaucugacagucuacuggaaaagcgagugcuguuaucacugccuguuccagguucucgugaacguaccgcagucccccaaggcggggaaaccuucugcagccgcugccucggugucaacucagcauggaagcauuuuacaacugaaugacacgcuugaagagaaggaagucugucgauuggaguaccguuuuggcgaguucgguaacuauagucugcuagugaagaauauacacaacgggguuuccgaaaucgcaugcgaucucgcugugaaugaggacccagucgauucuaaccugcccgugagcauugccuuucuuaucggacuggcgguaauuaucguuauauccuucuugagacuccuguuaucacuggacgauuuuaauaacuggaucaguaaagccauuagcucuagggaaaccgaccggcucaucaauuccgagcuuggcucaccuagccgcacagauccacuggacggcgaugugcagcccgcaacuuggagauugagugcucuaccuccaaggcugcggucugucgacaccuuccgcgggauugcccucauccugaugguguuugugaacuacggagguggcaaguauugguacuucaaacaugcuuccuggaaugggcuuacagucgccgaccugguuuuuccgugguucguguuuauaaugggaagcucgauuuucuugucuaugaccuccauccuccagcgaggcuguucaaaguuuagacuguuagguaaaauugcauggaggaguuuccugcuaaucugcaucgggauuauaaucguaaaccccaauuauugucucggaccucugagcugggauaaggugcggauuccaggcguccuucagcguuugggcgugacuuacuucguuguggccguccuggagcuccuguuugcuaagcccgugccugaacacugcgcguccgagcgcucuugucuuagccugagagacaucacaucaaguuggccacaaugguugcucauacugguauuagaagggcuguggcuaggacucaccuuccugcuucccguuccggguugcccuacgggcuacuuggggcccggaggcauuggugauuuugggaaauauccaaacuguacuggcggagcagccggcuacaucgacaggcugcuccugggggaugaccacuuauaucagcauccuuccagcgcugugcuguaccacaccgaggucgccuaugaucccgaaggaauccuugguacaauuaacucuaucgugauggcauucuugggcguccaggccgggaagauucuccuguacuauaaagcucggacuaaggacauacuaauccgauuuaccgccuggugcugcauucugggacucaucucaguggcacugacaaaaguuagugagaaugagggcuucaucccagugaacaagaaucuuuggagcuuguccuacguaaccacgcugucuucguuugcguucuuuauuuuacucguccuguaccccgugguugaugugaaaggucuuuggacugggacaccuuucuuuuauccaggcaugaacagcauacuggucuacgugggacaugaaguauucgagaauuauuuuccguuccaguggaaguugaaggacaaccaaucccacaaagaacaccucacccagaauaucguggcuacugcccuguggguucuaauugcauacauccuguaucgcaagaaaauuuucuggaagaucuga

SEQ ID NO: 57193 - RNA, 1071 nt, Artificial Sequence
  derived and/or modified sequence opt3 from HHAT__Homo_sapiens__NP_001164035
augcugcccagaugggagcucgcccuuuaccuguuggcuagcuuaggcuuccacuuuuauuccuucuacgaaguguauaaggucucuagggagcaugaagaggaacuggaccaggaguuugagcuagaaaccgauacacucuucgggggacugaaaaaggacgcaacugauuuugaguggucauucuggauggaaugggguaaacaauggcuuguuuggcuguugcucggccacauggugguaagucagauggccacgcugcuggcgcggaagaugcagcagcaagagcaugacagccucaaggcuuccuuaugcgugcuggcccuuggguugggacgccugcuauguuggugguggcucgcagagcugauggcccaccuuauguacaugcaugcuaucuauucuucgauuccucuguuggaaaccgucucaugcuggacacucggcggucuggcauuagcccaggugcuguuuuucuacguuaaauaucucgugcuuuuuggggucccagcucuguugaugcgacuagauggacugacuccgcccgcccucccucguugugugagcaccauguucaguuuuacaggcauguggagauacuucgacguaggccugcacaacuuucuuauaagguacguuuauaucccagucgggggaucccagcacggucuguugggcacccucuucucuacugcgaugacauucgcauuugugagcuacuggcaugggggauaugauuaccuguggugcugggccgcuuuaaauuggcugggcgugaccguggagaacgguguccggcgccuaguugaaacgcccuguauucaggacucccucgccagauauuucucaccucaagcaaggcggcgcuuucacgcugcccuggcgaguugcagcacuucuaugcuuaucuuguccaaucugguguuccucgggggaaacgagguaggcaagaccuacuggaaucgaauuuuuauccagggcuggccaugggugacacugucaguccuuggguuccuguauuguuacagccaugugggaauagccugggcacagacuuacgcuaccgauuga

SEQ ID NO: 57194 - RNA, 1515 nt, Artificial Sequence
  derived and/or modified sequence opt3 from HHATL__Homo_sapiens__NP_065758
augggcaucaagaccgcccugcccgcugcagagcucgggcuuuacagccugguguuguccggagccuuagcguaugcugguagaggccugcuagaagccucucaggacggggcacacaggaaagccuuccgggagucaguccgcccuggaugggaauacauuggccgaaagauggauguugcugacuuugagugggugaugugguucacaaguuuucguaacguaauaaucuucgcacucagcggucaugugcuguuugccaaacuuugcacuauggucgcuccaaagcugagauccuggauguaugccguguacggggcguuggcaguuaugggaacgaugggcccgugguaucuccugcugcucuuaggccacuguguggggcuguacgucgccucucuuuugggacaacccuggcugugccuaggucucggccuggcuucgcuugccucauucaaaauggauccucugauuagcuggcagaguggguuugugaccggaacauucgacuugcaggaaguacucuuucauggcgguuccucuuucacuguucugagguguaccagcuuugcauuagaguccugcgcucacccagaucggcauuauucacuggccgaccuccuuaaguacaauuucuaccugcccuuuuucuucuuugggccuaucaugacauucgaucgcuuucacgcucaggugagucaagucgagccagugagaagggaaggagaguuguggcacauucgggcccaggcaggccuaagcguggucgcuaucauggccguugacauauucuuucauuucuuuuauauccugaccauucccucugaucucaaguucgcuaaccgccugccugacuccgcccuugcaggccuggccuacucaaauuugguguaugauuggguaaaagcugcggugcucuuuggggucgugaacacuguugcaugucuggaccacuuagauccaccgcagcccccuaagugcaucacagcccuguacguguucgcugaaacccauuuugaccgaggaauuaaugacuggcuauguaaauaugucuacaaccacaucgguggcgagcacagcgccgugauaccagagcucgcagccacgguagcuacuuucgccauuaccacacuguggcuugggcccugcgauaucguuuauuuguggaguuuucugaauuguuucggacucaacuucgaacuguggaugcagaaacuugcagaguggggcccucuggcgagaauugaagcgucuuuguccgugcaaaugagcaggcggguccgugcccucuuuggugcaaugaauuucugggccaucaucauguacaaccuggugucguuaaauucucugaaguuuacugagcuagucgcucgcagacuccugcuuaccggguucccacagacaaccuuguccauucuguuugugacguacugcggcguucagcucgugaaggaaagggagcggacucuggccuuagaggaggaacagaagcaagacaaagaaaagcccgaguga

SEQ ID NO: 57195 - RNA, 813 nt, Artificial Sequence
  derived and/or modified sequence opt3 from HHEX__Homo_sapiens__NP_002720
augcaguacccccacccuggcccagccgcuggggcagugggagucccgcuguaugcccccaccccucuccuucaaccagcgcaucccacaccuuucuacaucgaggacauucuggguagaggcccagcugcccccacuccugcaccaacguugccgagccccaacuccucuuuuaccucauuaguuaguccuuauaggacaccaguguacgaacccacuccuauacacccagccuucagccaucacuccgcugcagcccuggcugccgcguaugggcccggaggcuuuggugggccgcuauacccuuucccccggaccguaaaugauuauacacaugcacuccugcgccacgacccacuuggaaagccucuguuguggucucccuuucuccagcgaccacugcacaaacguaagggcggccaggugagauucucgaacgaucagaccaucgagcuggagaaaaaguuugagacucaaaaauaccucucacccccugaaaggaagcgguuagccaagaugcugcagcuuagcgagcgccaggucaaaacaugguuccagaauagaagggcuaaguggcggcgcuugaaacaagagaacccacagaguaauaagaaagaagaacuggaaucccuagacucuagcugcgaucagcgacaggaccucccguccgagcaaaacaagggggccucacuggauaguagccaguguucucccuccccugcaucacaggaggaccuugaaagcgagauuagugaagauucugaccaagagguggauaucgaaggagacaaguccuacuuuaaugcugguuga

SEQ ID NO: 57196 - RNA, 2103 nt, Artificial Sequence
  derived and/or modified sequence opt3 from HHIP__Homo_sapiens__NP_071920
augcugaagaugcucagcuucaaacuucuguuguuagccguggcucugggcuuuuucgagggggacgcaaaguuuggagaaagaaacgaggguuccggcgccaggcggcgccgaugccuaaaugggaaucccccuaaacgucucaagagaagggaucggcgcaugaugucucagcuggaacuucugucaggaggcgagauguugugugguggguucuacccaagacucaguugcugucugaggagcgacuccccgggacugggccggcucgaaaacaaaaucuuuucugucaccaacaauacagagugcggcaaguuacuggaggaaauuaagugugcgcuuugcucgccccacucacaaucuuuguuccauaguccugagcgcgaaguucuggagcgagaucuagugcucccacugcuuuguaaagacuauugcaaggaguuuuucuacacuuguagagggcacauacccggauuucugcagacgaccgcugaugaguucugcuuuuauuacgccaggaaagacgguggcuuguguuucccugauuuuccacggaagcagguacgugggcccgcauccaacuaucucgaccagauggaagaauacgauaaaguggaggaaaucucucgcaagcauaagcacaauugcuucugcauucaagaggucgugagcggacugagacagccuguuggcgccuuacauuccggugacgggucacagaggcuguucauccucgagaaagaaggauaugugaagauucuuacaccagagggcgaaaucuuuaaagagccguaccuggauauacacaaguugguccagaguggcaucaaagggggagacgaacggggucuacugagccucgcuuuccaccccaacuacaagaaaaauggcaagcuguaugugucuuacacuaccaaccaagagcgaugggcaauugggccucaugaucacauccuucgcguaguugaguauacaguguccagaaagaauccacaucaggucgaccugaggaccgcccggguguuuuuggaaguggcugagcuccaccgcaaacaccugggaggccaguuacuguucggucccgacggguuucuauacauuauccucggcgauggaaugauaacucuggacgauauggaagagauggacggccuuucagauuucacagggagcgucuugagacuggacguugauaccgacauguguaacgugccuuauaguauuccaaggucuaauccccauuuuaacuccacgaaucagccgccugaaguauucgcccacggacuccaugaucccggucguugcgcgguggaccggcacccaacugauaucaacauuaaccugaccauccuuuguagcgacucgaauggcaagaaccgaucuuccgcaagaauccugcaaauuauaaaagggaaggacuacgagucagagccuaguuugcucgaauuuaaacccuucagcaauggaccacuggucggcgguuuuguguauagggggugccaguccgagcgcuuauacggcucuuacguuuucggagaucggaacggcaauuuucugacacuacagcaaagccccgugacuaagcaguggcaggaaaagccucucugucuggggaccucaggaaguugcagagguuauuucuccggccauauccuuggguucggagaggacgaguugggcgaagucuacauucugagcagcucaaaaaguaugacacagacccacaacgguaagcucuauaaaaucguggauccaaagaggccgcugaugcccgaggaaugucgcgccacgguacaaccugcucagacuuuaacaagcgagugcucccgacugugucggaauggguacugcaccccaacuggcaaauguugcugcucucccggaugggaaggcgacuuuugucguacagccaagugcgagccugcauguagacacgggggaguuugcgugaggccaaacaagugucuuugcaaaaagggcuauuuggguccccagugugagcaggucgaucgcaauauacggagagugaccagggcugggauucucgaccaaaucaucgauaugacgucguaccugcuagaccugaccagcuauauugucuga

SEQ ID NO: 57197 - RNA, 2349 nt, Artificial Sequence
  derived and/or modified sequence opt3 from HHIPL1__Homo_sapiens__NP_001120730
auggccagagcuagggcaggcgcccugcucgcgcuuugggugcugggggcugccgcacacccccagugcuuggacuuccggccuccauuucgcccgacccaacccuuacgacugugugcccaguacagcgauuucggaugcugugacgagggucgugaugcugaacuaacaagaagguuuugggcacucgccucccgggucgacgcugccgagugggcggcaugcgccggcuaugcucgcgaucugcuuugucaggaaugcucuccuuacgccgcacaucuguaugacgcugaggauccauucacucccuugagaacgguuccugggcucugucaggacuacugccuggauauguggcacaaguguaggggacuguuucggcaucucucaaccgaccaagaauuaugggcccuggagggcaaccuugcgcgcuucugccgauauuugagucuggaugacacagauuacuguuuuccauaucuacucgugaauaaaaaccugaauagcaaccuuggucacguaguggccgacgcaaaggggugccugcaguugugccucgaggaagucgcuaauggacugagaaaccccguggccaugguucaugcuagggacggcacucaccgguucuuuguggccgagcaggucggcuuagugugggcauaccugccugaucguucccgccucgggaaaccauuccuuaauaucucuagaguaguucugaccucgccgugggaaggagacgagagggguuucuugggcauugccuuccaccccucauuucagcauaaccggcgacuauacguguauuacagcgucgggauacgcaguuccgaguggaucagaauuucugaauuuagggugagcgaggaugacgaaaaugcuguggaucacuccucagagcggaucauucuggaagucaaggagccugcgaguaaccauaauggaggccaacuccuguucggugacgauggguaucuuuacaucuuuacaggagacggcggcauggcaggggauccauucggaaccuuugguaacgcccagaauaaaagcgcucuguugggcaagguucuccgcauagacguggauagaaaggagagggggcugcccuauggaaucccuccagacaaccccuucguaggcgacccggccgcacagccugaaguguacgccuuagguguccguaauauguggcgguguucuuuugaucgaggggaccccuccucaggcacuggaagaggcaggcuguucugcggggaugugggacagaacaaauuugaggaaguugacguggucgagcgcgguggcaacuauggguggcgggcuagagaaggauucgaguguuacgauaggagccuaugcgccaauacaagucucaacgaccugcuuccaauuuuugcauacccucacaccgugggcaagucuguaacggguggguauguuuaccgcggcugugaguaucccaauuugaacggacuguacaucuucggcgauuuuauguccgggcgacucaugagccugcaagaaaauccaggaacuggucaguggcaguauucggagauuugcaugggccacgggcaaaccugugaguuccccggacuuaucaacaauuacuauccuuacauaauuucuuuuggcgaagacgaagcgggugagcuguacuucauguccacaggggagccaucagcuacugccccgcggggcguggucuauaaaaucauugaugcaagucguagagcucccccuggaaagugccagauccagccagcccaggugaaaaucaggagccgcuugauucccuucgucccuaaggaaaaguuuauaccaaaaacccgguccacacccagaccgaccgccagggcaccuacgcgagcuccacgccggggcagacccacugccgcgccucccgccccaacaccuaggcccgcucguccaacccaacagccggggucucgccggggaggcgguagaaggcgagggcggcucaacagcgcaucacgcgccuucagagacggagaggugaggcugguucggccugcuggcuuaaguuccgguagcggccgaguggaaguauuugucgggggaagauggggcacugugugugaugacucuuggaauaucucaggggccgcaguugugugccgccagcugggauucgcguacgccgucagggcugugaagcgugccgaguuuggccagggugggagucuacccauucuccuggaugacguacggugugcaggaugggagagaaaccuuuuggaaugccaacauaauggcguggguacacacaacugcgagcaugacgaagaugcuggcguugucuguagccaccagaauccagaccuguga

SEQ ID NO: 57198 - RNA, 1596 nt, Artificial Sequence
  derived and/or modified sequence opt3 from HHLA1__Homo_sapiens__NP_001138567
augcugggcuuccucagcagagggcccuccaugaaacuuugcaugggacuggccuguguguugucuuuauggaacaccgucucagguaucaagggcgaggcuaagaaagaaaaggggaugacauuucugccuacuacgguuaguggacuaagggaggaagaacggaaagaaaagggcguggcauuccucgccaccacagagcugccagcgcgcagcauugaccuuuccgcucugaauuugacugagcucguaaacgguaugcugucucgagcccugaaggauucgaaaaaguuuuucucacucuuaagcgugaccaguuacuccucuuuugcauuccacaaauuuagcgucgccguguauaauauauccaaccugaagacaguugacccggcuaaauuccccacccguuacugcuauugucuuaauaacagaacuaaugauuugucagacuuuacagcacugcuaguggauaucauugggaacaguaccagcuaccucacggaaaucuucaagucuacuuccauucugucagucaaucagagcaacgagagugacugcaucuuuauaugugugaugaccggaaagucuggcaggaaucuuuccgauuucugggaaaucgaggagaaauauccuauuaucaacuacacauuuacuagcggccugucggggguauugggagccgcuacccgggguacagcccgcaccucuaagccaacgacuaaaucccaaaagacacuccccucaaccaguccuggccauuggacucagagcacaccaugggcguccgcacugagaucuagccccuggaccgaaacggccgcuccuucagagaccgaagagacauuaaauacugggaggccaccggaacugcccgcccgggcaaccgcuacaugguucagugccucccacacucucccugcgcuugccacccgccgaguugcaagaacacaguggcugaccgcugacaggcagacuugggccagcauuucuucagugccaugggcucaaacgaucagugagaaaaagcccggaggcagcuugugggagacacgguccucuccuccaaccacugccgguaccgaagaggcaaugaacacaaccucgcuacuggcccccgcugcggaaauaauggcaacuccggggagcccuucccaggccucacccacacucggagcuuucacgcauggcacccagacuccaaguccuacaaaagccaccgcaccccguuauccacagacaggcgaucugucugccgaguggcccuuuacugcuggggaggagccuguccuugugccacgcccgcaccaagugagcagaugcccccagccucuguucaaggucggagccauggcagcggcuccauugacccucgccauucagaggcugaaucccuguuuaauggagcugugccaguuuuuccaacagugucuaugcaugucccagcggucaccucgaacggaagacaugcgcuacugucucgaguacuauagcugguuucugaagaacgcaaccuacaucugccaaagaguuaaaagggugucucauucccacacacuuaagcagaaaugcuuggaaaacauuuguaagaguguauga

SEQ ID NO: 57199 - RNA, 1194 nt, Artificial Sequence
  derived and/or modified sequence opt3 from HHLA2__Homo_sapiens__NP_001269487
augaaggcccagaccgcucugagcuucuuucucauccuuauuacaucccugucuggcucacaagggauauuccccuuggcauuuuucaucuacgugccuaugaacgagcagauugucaucggaagauuagacgaagauauuauccugccaaguagcuuugagagggguuccgaaguugugauacacuggaaauaucaggacucuuacaagguacauucguauuacaaaggcucagaucaccuagagagccaggacccgcgguaugccaaucgcacgagucucuucuacaacgaaauccaaaaugggaacgcgucccuguuuuuccgacgugugucucuucuggaugagggaauuuauacuugcuacgucggcaccgcuauccaggugauuacaaauaagguuguguugaaagucgguguguuucucacucccguaaugaaguacgagaagagaaacaccaauagcuuccugaucuguuccguucugucaguguauccuaggccaauaauuacauggaaaauggacaacacccccaucagugaaaauaacauggaggaaacugggagccucgauucuuuuuccauuaauucaccuuuaaacaucacaggaagcaauaguucuuacgagugcaccaucgagaacucccugcuuaagcagacguggacuggccgguggaccaugaaagacggcuugcauaagaugcagagcgaacacgucucgcugucuugucaaccagugaaugauuauuucucccccaaccaggacuuuaaagugacauggucacgcaugaagagugggacuuucagcguccuagccuacuaucucuccucuagccagaacaccauuauaaaugagucaagauucaguuggaacaaggaacugaucaaucaguccgauuuuagcaugaaccuuauggaccugaauuugucugauucaggagaguaccucugcaacauuaguagcgacgaauauacacuguuaaccauccauacgguucacguggagccuucccaagagacugcaucucacaauaaaggucuguggauacucguaccaucggccauucuugcugcauuccuguugaucuggagcgugaaguguugcagggaacgguguugcgucccgcccggcgagcgcuguccuuccgccccagacaacggggaagagaaugugccccuaucaggaaaaguuuga

SEQ ID NO: 57200 - RNA, 1359 nt, Artificial Sequence
  derived and/or modified sequence opt3 from HIAT1__Homo_sapiens__XP_011540259
augacccagggcaagaaaaagaaaagagccgcuaacaggagcaucaugcuggcaaagaaaauuauaaucaaggacgggggaacaccccaagguauuggcuccccuucuguguaccacgccgucaucguuauuuuccucgaguuuuucgcgugggggcuucugacugcuccaacguuggugguauuacaugaaaccuuuccgaagcacacauuccugaugaauggacuaauccagggcgugaaaggucuccugucauuucuuagugcaccccugauaggggccuugagcgaugucuggggacggaaguccuuccuccugcugacuguguuuuucacaugcgccccuaucccacucaugaaaauuucucccuggugguauuuugcuguuaucucggugucaggcgucuucgcagugaccuuuagcguaguuuucgccuacguggcugacauuacccaggagcaugaacgcaguauggccuauggcuuagucuccgcgacuuuugcagccucucuggugacaagcccugcuaucggggccuaccuuggacgaguguauggugauuccuuggucguugugcuggcaaccgcuauagcccuacucgacauuuguuucauccugguagcggugccagagucacuucccgaaaagaugcguccugccaguuggggcgcaccaauuagcugggagcaggcugauccguucgccaucaugaaauuuucucccgaguccgucgcugccuucaucgcagugcuggggauuuugucaauaaucgcccaaacgauuguucucagccuguuaaugagaaguaucggaaacaagaauacuauacugcucggccuugguuuucagauucugcaguuggcuugguacggguucggaucugaaccuuggaugaugugggcggcaggcgccguggcugccauguccagcaucaccuuuccagcagucucggcccuagugucuaggacagcugacgccgaucagcaaggcguaguucaggggaugaucacugguauucggggacugugcaacggccucgggcccgcacuguauggauucaucuuuuacauuuuccacguggagcuuaaggaacugccuauaaccggcacagacuuggguaccaauacguccccacagcaucacuuugagcagaacucaaucauucccgggccgccuuuccucuuuggcgcguguaguguccuguuagcucugcuaguggcccucuucauccccgagcacacuaaucugagccuucgcuccucuagcuggagaaaacauugcggaucacacagucauccacacaacacacaagcaccuggcgaagccaaggagcccuugcugcaggauaccaaugucuga

SEQ ID NO: 57201 - RNA, 1011 nt, Artificial Sequence
  derived and/or modified sequence opt3 from HIBADH__Homo_sapiens__NP_689953
auggccgcuagccugagacuccuuggcgcagccuccgggcugagguacuggucucggcgcuugcgacccgcggcuggaucauucgccgcagugugcagucguagcgucgccuccaagaccccuguugguuuuaucggcuuagggaacaugggaaauccaauggcuaaaaaccugaugaagcacggcuauccgcuaauuauauacgacguguuccccgaugcauguaaagaguuucaggacgccggugaacaaguagugucuucgccugcugaugucgccgagaaggcggacagaaucauuacaaugcucccaacuucaaucaaugcaauugaagccuauagcggggcuaacggaauccugaaaaaggugaagaaaggcagucuucugauagauuccucuacgaucgaccccgccguuagcaaggaguuggcaaaagaaguggagaagaugggcgcugucuucauggaugccccuguguccgggggaguaggugcggccaggucaggcaaucucaccuuuaugguugggggaguggaggacgaguucgcagcugcccaggaacugcugggcugcauggguaguaacgucguguacuguggggcugugggaacaggccaggccgcaaaaauuugcaauaacaugcucuuagccaucagcaugauuggcacugcugaagcgaugaaucuggggauccggcuuggauuggauccaaagcugcuagcaaagauacucaacaugucuuccggucgcuguuggucaagcgacaccuauaaucccgucccuggcguuauggauggggugccaagugccaacaauuaccagggaggcuuugguacaacccugauggcuaaagaccuugggcuggcccaagauucugcaacuuccacaaagagcccgauuuugcucggcucgcuggcccaucagaucuauagaaugaugugcgcuaaaggauacucuaagaaagacuucuccucaguauuucaguucuuaagggaggaggaaaccuuuuga

SEQ ID NO: 57202 - RNA, 1161 nt, Artificial Sequence
  derived and/or modified sequence opt3 from HIBCH__Homo_sapiens__NP_055177
augggccagagagagauguggaggcugaugagccgguucaacgccuuuaagcgcaccaauacaauccuccaccaucuucgaauguccaaacacacugacgcugcagaagaggugcuguuggaaaagaaagggugcacgggagucauuaccuuaaaccgucccaaguuccugaaugcccuaacacucaacaugauaagacaaaucuacccucagcugaaaaagugggagcaggauccagaaacuuuucuuauuaucauuaagggugcgggcgggaaggcuuucugugccggaggcgacaucaggguuauaucugaggcagagaaagccaaacagaagaucgcuccgguguuuuuccgggaagaguauaugcugaauaacgcaguagguucaugccaaaaacccuacguggccuugauucaugggaucaccaugggaggcggcgucgggcucagugugcacggacaguuucgcguugcuacagaaaagugucuguucgccaugccugagaccgcgauuggucuguuuccagaugugggcgggggauauuuccuccccagauuacagggcaagcuggguuacuuucuugcauugacuggguucaggcugaaaggacgggacgucuaucgcgccggcaucgcuacacauuuuguggauagcgagaagcuagccaugcucgaagaggaccugcuugcacugaaauccccuucuaaggaaaauauagcuucgguauuggagaacuaccacaccgaaucaaaaauugaucgagacaagagcuucauccucgaggagcacauggauaaaauuaauaguugcuucuccgccaacacgguugaagagaucaucgaaaaucugcagcaagacggcucuagcuuugcguuagagcagcugaaggugauuaacaagauguccccaacuucacucaaaauaacccuuagacagcugauggaagggaguagcaagacauugcaggagguccuaacuauggaguauaggcugucucaagccuguaugcggggacaugauuuccacgaaggugugcgugcagugcucaucgacaaagaucagucccccaaguggaaaccugcugaccugaaggaggucaccgaagaggaccuuaauaaccauuuuaagucacugggcagcagugauuugaaauucuga

SEQ ID NO: 57203 - RNA, 2202 nt, Artificial Sequence
  derived and/or modified sequence opt3 from HIC1__Homo_sapiens__NP_001091672
augaccuuccccgaggccgacauccugcucaagagcggcgaaugcgcugggcagacaaugcuugauacuauggaggcaccuggacacuccagacaacuguuguuacagcugaacaaucagaggacgaaagguuuucuaugugacgugauuauagucguucagaacgcccucuuccgggcgcauaagaaugugcuggcugccucuucagcauaccuuaaaagucugguagugcacgauaacuugcucaaucuggaccaugauauggucagcccagccguguuucgccugguucucgacuucaucuauaccggccgauuagcugauggggcagaagccgcugccgcggcagccguggcuccgggagccgagcccucccugggcgcaguccuugcugccgcgucuuacuugcaaauuccugaccugguggcccuaugcaagaaacgucucaagagacacgguaaguauugucaucugaggggagggggcggcgggggagguggcuacgcaccauaugggcggcccggacgcggccuuagagcugccacaccuguaauccaggcuugcuacccaucgcccguugguccuccaccgcccccugccgcagaaccacccucagggccugaggccgcugugaacacucacugugcggagcuguaugcaagcggaccaggccccgccgcugccuugugcgcaagugaaaggcgguguuccccgcucugcggccuggauuuaucuaaaaagagcccucccggguccgccgcuccagagcgcccucuggccgaacgagagcucccaccaagacccgacucaccuccaagugcaggaccggcggcuuacaaagagcccccucuugcccugcccagcuugcccccucuaccauuucagaagcuggaagaggcagcucccccgucugauccuuucagggguggcuccgggucaccaggacccgaaccucccggccggccagacgguccuagccuccuguaccguuggaugaaacacgagcccgggcuuggcaguuauggagaugaacugggccgcgagagagggucuccauccgagaggugugaggaacggggaggugacgccgccgucagcccgggcgggccucccuugggacucgcaccacccccucgauacccaggcucgcuggacggucccggggcuggcggagauggcgacgauuauaagucuuccucagaagagaccgggaguagcgaagacccuuccccgccaggaggucauuuagagggcuaccccugcccucaccuggccuauggggagccagaaucuuuuggagauaaucuauacguguguauucccugcggcaaggguuucccuagcucagagcagcucaacgcgcauguggaagcccacgucgaggaagaggaggcucuguaugggcgcgcagaagccgcugagguugccgcaggcgcggccggacuuggcccgcccuuugggggaggcggugacaaaguggcuggggccccaggaggcuugggugaacugcucagaccuuacaggugcgcaaguugugauaaguccuacaaagaccccgcuacacugcggcaacacgagaagacccauuggcuuacucgcccauauccuugcacaaucuguggcaaaaaguucacccagagagggacgaugacuaggcacaugcguagccaucugggauugaaacccuuugccugcgaugcauguggcaugcgguucacccgacaguacagacucacagagcacaugaggauacauucuggggaaaagccauaugagugccagguauguggaggcaaguuugcccaacagcgcaaucugaucucacacaugaaaaugcacgcuguggguggggcggccggagcagcuggcgccuuagccggucugggcgggcuaccgggagucccuggccccgacgggaagggaaaacucgauuucccagaaggcguguucgcuguugcacggcugacugccgagcagcuuaguuugaagcaacaggacaaagcggcugccgcagaacugcucgcccagaccacacauuuucugcacgaccccaagguggcuuuagagagccuguacccucuugcaaaguucaccgccgaguugggucucuccccagauaaagcggcugaaguccugucucagggggcccaucuagcagccggacccgacggcagaacgauugauagguuuucgccuacuuga

SEQ ID NO: 57204 - RNA, 1848 nt, Artificial Sequence
  derived and/or modified sequence opt3 from HIC2__Homo_sapiens__NP_055909
auggugagcggcccccuggcccucagauggugcgcuugggcagggaggggagacauggguccugauauggagcuuccaucccacucuaagcagcuguuguuacaacugaaccagcagcggaccaaaggcuuccuaugugacgucaucauuaugguugaaaauucaauauuucgcgcccacaagaacgugcucgcggcuaguagcaucuacuucaaaucccugguacuucacgauaaucugauuaacuuggacacagauauggugucuucgacugucuuucagcaaauccucgacuucauuuauacggggaagcugcugccgucagaucagcccgccgagccuaauuuuagcacccucuuaacagcagccaguuaccugcagcuuccagaauuggcugcacugugccgacguaaacuaaagagagccggaaagcccuucggcuccgguagggcugggucuacuggaaugggccggccuccacgcagccagagacucuccaccgccucagugauccaagcgagguaucagggccugguugacgggcggaaaggagcacaugcaccccaggagcuuccucaggcuaaggguagugaugacgaacuguuuuugggcgggagcaaccaagauucugugcagggacucggccgcgccgucuguccagccgguggggaggcuggacugggcggcugcuccucaagcacaaaugggaguucuggagguugugagcaggaauuaggccuggaccucuccaaaaagagcccgccccuuccuccagccacccccgggccucaccugacuccagaugacgcggcccaauugucggacucucagcauggaucacccccggcagcuuccgccccucccguggcuaacagugccagcuacuccgagcuaggcgguacaccagaugaaccuauggaccuggagggggcagaggauaaucaccucucucugcuugaagcccccggcggacagccacgaaaaagccugagacacucaaccaggaagaaggaguggggcaaaaaggaacccguagcugggaguccuuucgagcggcgugaagcgggaccaaaagguccgugccccggcgaggagggggaaggaguuggcgaccgcgugccuaacgguauauuggcauccggggccggcccaagcggacccuauggcgagccuccauaccccuguaaggaagaggaagagaaugggaaagaugcuucugaggacucagcccagaguggaagcgaagguggcuccgggcaugcaucugcccacuauauguacagacaagagggauacgaaacggucucguauggcgauaaccucuacgugugcaucccgugugcuaaggguuuuccuagcuccgagcagcugaaugcccauguggaaacucacaccgaggaggaauuauucauuaaagaggaaggggcauaugagacaggcucaggaggcgcggaggaagaggcugaagaccugagugccccaucugcagccuacacugcugagcccaggccuuuuaagugcagcgucugugaaaagaccuauaaagaucccgccacacuacggcagcacgagaagacccauuggcucacgcgaccauucccuugcaacaucugcgggaaaauguuuacucagcgcggaacaaugaccagacacaugaggucccaucugggccuuaagcccuucgcaugugacgagugcgguaugcgguucacucgccaauacagauugacagaacacaugaggguucauucaggggagaaaccauaugaaugucagcugugcggaggcaaguuuacccagcagcguaaucucauuagccaucugcggaugcacacgucuccguccuga

SEQ ID NO: 57205 - RNA, 2367 nt, Artificial Sequence
  derived and/or modified sequence opt3 from HID1__Homo_sapiens__NP_085133
augggcagcaccgacuccaagcugaacuucagaaaagccgugauccagcucacaacuaagacgcaacccgucgaggcuaccgaugacgcauuuugggaucaguucugggccgacacagcgacuucuguucaggauguguuugcucuuguaccugccgcagaaauuagggccgugcgggaggaaucaccaaguaaucuggcuaccuugugcuacaaagcagucgagaaguuagugcagggggccgaaagcggaugucacuccgagaaagagaagcaaauaguucugaacugcucucgccuacucacacgagugcugccguauaucuucgaagaccccgauuggcgugguuucuucuggucgaccgucccuggcgcugggagaggaggccagggugaggaagacgaugagcaugccaggccacuugcggagucacuguugcucgcaauugccgaccugcuguuuugucccgauuucacugugcagagccaccggcgcaguacaguagacuccgcugaagauguucauucucucgacagcugcgaguacaucugggaagccggggugggauuugcacacuccccucagccaaauuauauucaugacaugaacagaauggaguuacugaagcuguugcugaccuguuucucagaagcuauguaccuacccccugccccagagaguggcagcacgaauccguggguccaauuuuucugcucuacugagaacaggcacgcgcucccccuguuuaccucccuucugaauacagugugugccuaugauccugugggcuacgggaucccauauaaccacuugcucuuuucagacuaccgggaaccccuggucgaggaagcagcucagguuuuaauagugacucuggaucaugacagcgccaguucugcuuccccuaccguagauggaacaaccacggguacugccauggacgaugcagacccacccggcccggagaaucucuucgugaacuaccuuagccgcauccaccgagaagaggauuuucaguucauucugaaagggaucgccagauugcuaucgaauccucugcuccagacauaucugcccaacucuaccaagaaaauucaauuucaucaggagcuucuggucuuguucuggaagcucugcgacuuuaauaaaaaguuccuguuuuucguguuaaaguccucagauguucuggacauccuagugccaauacucuuuuuccugaacgacgcuagggcggaucagagucgggucggacuuaugcacauuggcguguuuaucuugcugcuccugagcggugaacguaauuucgggguacgccuuaacaaaccuuacuccauuagaguucccauggacaucccaguguuuacuggaacacacgcagaucuguugaucgucguguuccauaagauuauaaccucuggccaccaaaggcuccagccccuguucgacuguuuacugacgaucgucgugaacguuagcccuuaucuaaaaucacucaguauggugaccgccaauaagcugcuucauuugcuggaggcuuuuuccacaacuugguuccucuuuagcgccgcacagaaccaccaucugguauucuuuuuacuggaagucuucaauaacauuauccaguaccaauuugauggcaauucuaaccuuguguaugccauaauucggaaacgaucaaucuuccaccaguuggcuaaucucccaaccgacccgcccacaauccacaaggcccugcagcgcagaaggcggacuccugagccacuaagucgcaccgggagccaggaaggaacauccauggaggguucuagacccgcagcgccugcugagccaggcacccugaaaacuucgcucguugccacgcccgggauugauaagcugacagaaaagagccaaguguccgaggacggaacccuuaggucauuggaaccggagccucagcagagucuggaggauggcucuccagcaaaaggugaacccagccaggccuggcgugagcaacggcgaccuuccacuucaagcgcuucugggcaguggucccccaccccagaaugggucuuaaguuggaaaagcaagcucccucugcagacaaucaugagacuucuucagguguugguaccccaaguggagaagauuugcauagacaaaggccucaccgaugaaucugagauccugagguuucuacagcauggaacucugguuggccuccugccagucccgcacccuauucuuauccgcaaguaccaggccaacuccgggacagcaaugugguuccggacguauauguggggagugaucuacuugagaaauguggaucccccagucugguacgacaccgacguuaagcuguuugagauucaaaggguguga

SEQ ID NO: 57206 - RNA, 2553 nt, Artificial Sequence
  derived and/or modified sequence opt3 from HIF1A__Homo_sapiens__NP_001230013
augagcucccagugcagaucucuggagaacaaguucguguuucucaaagaaggccuuggaaauucaaagcccgaggaacuggaggaaaucaggauugagaacgggcggauaaguagcgagcgccgaaaagaaaagucccgugacgccgcuagaucuaggcggucgaaagagucagaagucuucuacgaguuggcacaccaauuaccucugccacauaauguuagcagucaccuagauaaggccuccgugaugcgccucaccaucucuuaucugagaguaaggaaacuucuggacgcgggugauuuggacauugaggaugacaugaaagcucagaugaacuguuuuuaccucaaggcccuggauggcuucgugaugguccugacagacgauggggacaugaucuauauuagcgauaaugugaacaaauacaugggacucacucaguuugaauuaacgggccauuccguuuucgacuuuacccacccgugcgaucaugaggaaaugcgggagaugcugacacaccgcaauggucuugugaagaaagggaaggaacagaacacucaacgaucauucuuuuugagaaugaaguguacccugacaaguaggggacggaccaugaauaucaaaagcgcaacuuggaagguccuacacugcacaggccauauacacguguaugacaccaacucuaaucagccccaguguggcuacaaaaagccuccaaugacgugccucguacugaucugugagcccauuccucauccauccaacaucgagauuccccuugacucaaaaacuuuccugagccgucacaguuuggauaugaaguuuucuuauugcgacgaacgcaucaccgagcucaugggguacgaaccugaggaacuguuaggaagauccauauacgaguauuaccacgcccuggauagcgaccaucucacaaaaacucaccaugauauguucaccaagggucagguuacaaccggccaauauaggaugcuugcuaagagagggggauacgugugggucgagacgcaggcaacugugauuuauaauacaaagaacucgcagccacaguguaucgugugcgucaauuacguugugucuggcauuauccaacacgaccugaucuuuuccuugcagcagaccgaauguguacuaaagccgguggagucaagugauaugaaaaugacucaacuguucacaaaggucgaaagcgaggacaccuccucucucuucgauaaacugaagaaggaacccgacgcccuuacgcuguuggcuccugccgcgggugauaccauuauaagccucgacuuugggucaaacgacacagagacugaugaccagcagcuggaggaagugccauuauauaacgauguuaugcugcccaguccuaaugagaaacuacagaacaucaaucucgcaauguccccacugcccaccgccgaaacaccgaagccucuucgaagcucugcugaccccgccuugaaccaagagguggcacugaaacucgagccaaauccugaaucacuggagcuuaguuucacuaugccccagauucaggaucagaccccaagccccuccgacggaucuacacgccaaucgagcccugaaccaaacuccccgucagaguacugcuuuuacgucgauagugacauggugaaugaguucaagcuggaauugguagagaaacucuuugcugaagauaccgaggccaagaaccccuucucuacucaggacacggaucuggacuuagaaaugcuggcgccuuauaucccaauggaugacgacuuucagcuacggagcuucgaucagcucaguccccuggagucaagcucugccuccccugaaagugcaagcccacaaucuacaguuaccguguuucagcagacucagauacaagagcccaccgcuaaugccacaaccacuacagcuacgaccgacgagcuuaagacugucacaaaagauaggauggaagacauuaagaucuugaucgccuccccgucaccuacccauauucacaaagagacaacuuccgcaaccagcucgccauaccgggauacgcagucccgcaccgccucucccaacagagcuggcaagggcgugaucgaacagacagagaaaagccacccuaggucacccaauguccugaguguggcgcucucccaacguacuaccguuccagaagaggagcugaacccuaagauuuuagcacugcagaaugcccagcggaagcgaaaaauggaacaugacgggucucuuuuccaggcugugggaauagguacauugcuccaacagcccgaugaccacgccgcaacuaccagccuguccuggaagagaguaaaaggcugcaagucaagcgagcagaacgggauggaacagaaaacgaucauucuaaucccaagugaucuggccuguaggcuccugggacaaucuauggacgaguccggccuuccgcaguugacaagcuaugauugcgaggucaaugcuccuauccaggguucgcgcaaccuguuacagggggaggaacuccugcgggcccuugaccaagugaacuga

SEQ ID NO: 57207 - RNA, 1050 nt, Artificial Sequence
  derived and/or modified sequence opt3 from HIF1AN__Homo_sapiens__NP_060372
auggccgcuaccgcagccgaggcgguggcuagcggcuccggggaacccagagaggaagccggagcacuggguccugccugggacgagucucagcucaggucauacaguuucccaacacggccgaucccccgccuuagccaauccgauccucgagcugaagaacugauugagaacgaggagccagucguuuugacugacacgaauuuaguguaucccgcacugaagugggaucuagaauaccuccaggagaacauaggcaauggggacuuuucuguauauucggccucaacccacaaauuccuguacuaugaugagaagaaaauggcuaacuuucagaauuucaagccucguagcaacagagaagagaugaaauuucaugaauuuguggagaaacuucaggacauccaacagaggggaggcgaggaacggcuguacuugcagcagacacucaaugauacugucggucgcaagauugugauggacuuucugggguucaacuggaauuggaucaacaagcaacagggaaagagaggcuggggccagcugaccaguaaucucuuacugauugggauggagggaaacguuacaccagcccacuaugaugaacagcaaaauuucuucgcgcagaucaaagguuacaagaggugcauacuuuuucccccugaccaguucgaguguuuguacccauauccggugcaucaccccugcgaucggcaaucccaggucgacuuugauaacccugacuacgaacgcuucccaaauuuccagaacgugguaggcuaugagaccguuguggggcccggagacguccuguacaucccuauguauugguggcaucacauugaaucucuacucaacggcgguaucacuauuacagugaauuuuugguacaaaggggcaccaacccccaagcgaaucgaguauccgcugaaggcccaccagaaaguggcuauaaugagaaacauugagaagaugcuuggagaagcccugggcaauccucaagaggucggccccuugcucaacacgaugaucaaagggagguacaauuga

SEQ ID NO: 57208 - RNA, 2004 nt, Artificial Sequence
  derived and/or modified sequence opt3 from HIF3A__Homo_sapiens__NP_690007
auggacuggcaggaucacagaagcaccacagagcugaggaaggaaaaaucccgggacgccgcucgcucucgacguucacaagagacugaagugcucuaccagcuugcacauacgcugcccuucgccagaggcgucagugcgcacuuggauaaggcuagcaucaugagguuaaccauuuccuaucugcggaugcaucgccuaugcgccgcaggggaguggaaccagguuggagccgguggcgaaccucucgacgcuuguuaccugaaagcacuugagggguuugugaugguacugacagccgagggagauauggcuuauuugucugaaaaugugucgaagcaccucggccugucacagcuggagcucauaggucauagcaucuucgacuuuauucacccaugcgaucaagaagaguuacaggacgcccugacuccgcagcagacccuuaguagaaggaaagucgaggcgcccacagaacgguguuucuccuugcgcaugaagucuacccugacuagccgagggagaacacuaaaccucaaggcagccaccuggaaagugcugaauugcuccggacacaugagggcuuacaagccuccagcccaaacgucacccgcaggcaguccugauagcgagccaccccuucagugucugguuuugaucugcgaagcuauuccucauccaggcucucucgagccgccccuggggcggggagccuuuuuaucccgucacucacuggacaugaaauucacuuauugugaugaccgcaucgcggaaguggccgguuacagcccugaugaccucauaggcugcagugcauaugaguacauccaugcucuugacucugaugccgucuccaagagcauucacacccuguugucgaaagggcaggcugugacaggacaguacagauuucuagccaggucuggcgguuaucuguggacucaaacccaggcaacaguaguuuccgggggacggggcccacagucagagaguaucguguguguccacuuccucauuagccaaguggaagagaccggcgugguccugucccuugaacagacggagcagcauucucgacgccccauccagagaggggccccuagccaaaaggacacuccaaaccccggagauucacuggacacaccggguccuaggauauuggcuuuucuccaucccccaagucuguccgaagcggcauuagccgcugauccucggcgcuucugcagccccgaccugagaaggcuacucggcccaauucuggauggggccucuguugcagccacccccucaacuccucuugcuacacgucacccacagaguccguugagcgccgaccugcccgaugagcucccugugggaaccgagaauguacaccggcuguuuacguccggcaaggacaccgaagcaguggagacagaucuugacaucgcgcaggacgcugaugcccuggacuuggaaaugcucgcaccauacauuucuauggaugacgauuuccagcugaacgccucggagcaauuaccccgagcuuaucauagaccucugggugccgucccaaggccccgcgcacggagcuuucacgggcuauccccgccugcucucgaaccaucacugcuucccagauggggcagugacccuagguugucuuguagcucccccucacgcggagauccaagcgccucuuccccuauggcgggcgcccgaaaacggacucuggcucagaguagcgaggacgaggaugaagggguggagcuccugggaguucgucccccaaagagaucuccguccccugaacacgagaauuucuuacuguucccccuuucauugaguuuucuccugaccgguggcccagcacccgggagccuacaggacccuucgacaccacugcucaaccugaaugagccccuuggauugggcccuucccuguuaucuccguacagcgaugaagacacuacccagccaggugggcccuuccaaccuagggccggcucagcucaggccgauuga

SEQ ID NO: 57209 - RNA, 324 nt, Artificial Sequence
  derived and/or modified sequence opt3 from HIGD1A__Homo_sapiens__NP_001093138
auggagcagaagcugguggaagagauccuccaagccauuaccaugagcacagacacuggcgucucccuucccucuuacgaagaggaucaggggucaaaacugauaagaaaggcuaaagaagcaccuuucguuccagugggaaucgccgguuuugcggcuauuguagccuauggcuuguacaaguuaaaaaguagggggaacacgaagaugagcauccaccugauucauaugcggguggcagcccagggauucgucgugggcgcuaugaccguugguaugggguauuccauguaccgcgaguuuugggcaaagccgaaacccuga

SEQ ID NO: 57210 - RNA, 294 nt, Artificial Sequence
  derived and/or modified sequence opt3 from HIGD1C__Homo_sapiens__NP_001103089
augagcuccgacaaccaguggucugccgaugaggacgaaggccaacugucaagacucaucaggaagagucgggauagccccuucgugccuauugggauagcuggauuugucaccguuguguccugcggucuuuacaaacugaaguaucgccgagaccagaaaaugucuauccacuugauucauaugcguguagcagcccagggcuucguggucggggcggugacauuaggaguucuguacucgauguauaaggauuacaucagaccaagguuuuucucagagagcaaaaaguga

SEQ ID NO: 57211 - RNA, 321 nt, Artificial Sequence
  derived and/or modified sequence opt3 from HIGD2A__Homo_sapiens__NP_620175
auggccacccccggcccugugaucccagaggucccguucgaacccagcaagccuccaguuauugaggggcugucccccacaguguacagaaacccugaaucuuuuaaagagaaguucguaaggaaaacucgggaaaauccagugguccccauaggaugccucgcuacggcagccgcgcuuaccuauggucuguacucauuucaccgcggcaacagucagcgaagccaauugaugaugcguacaagaaucgcugcccagggguucacuguggcagccauuuuacugggacuagcuguuaccgcaaugaaguccaggccuuga

SEQ ID NO: 57212 - RNA, 192 nt, Artificial Sequence
  derived and/or modified sequence opt3 from HILPDA__Homo_sapiens__NP_001092256
augaagcacgugcugaaccucuaccuucugggcgucguuuugaccuuacugagcaucuucgugagaguaauggagucccuagaagggcuccuggagucucccucaccuggaacaaguuggacuacgaggagccagcuugccaauaccgaaccaacaaaaggucugccggaccaucccucccggucuauguga

SEQ ID NO: 57213 - RNA, 1260 nt, Artificial Sequence
  derived and/or modified sequence opt3 from HINFP__Homo_sapiens__NP_001230188
augcccccuccaggcaaggugccgagaaaagagaaccuguggcuccagugcgaaugggggagcuguuccuucgucugcucuaccauggagaaguuuuucgaacacguuacacaacaucuucagcagcaccuucauggaucaggugaggaagaggaggaagaggaagaggacgaucccuuggaggaagaguuuaguuguuuauggcaggaaugcggcuucuguagccuggacuccucugccgaucuaaucaggcacguguacuuucauugcuaucacacuaaacucaagcaaugggggcugcaggcucugcagucgcaggcagaccugggaccuuguauuuuggauuuccaaucacggaauguaauaccagacauccccgaucacuuucucugccugugggagcauugugaaaacagcuucgacaauccugagugguuuuaccgccacguggaggcccauagucugugcugugaauaugaggcggucggcaaagauaacccagugguucucugcgguuggaaggggugcacguguaccuucaaggaccgauccaaauuacgugaacaccugagaucucacacacaggagaagguggucgcuugccccacuuguggaggcauguuugccaauaacaccaaauuccuugaucauauuaggcggcagacaagccuggaccagcaacacuuucagugcucccauuguucaaagcgcuucgcaaccgaaagacugcuaagggaucacaugcggaaucaugugaaccacuacaaaugcccucucugugacaugacuugcccacugccgaguagccuucgcaaucacaugcgauucagacauucugaggacaggcccuuuaagugugauugcugugacuauuccugcaagaaccugaucgauuugcagaaacaccucgacacacauucagaggaaccugccuaccggugcgauuucgagaauuguaccuuuagcgcucguagucugugcucuauuaagucccacuaucgcaaaguacacgaaggcgacagcgagccaagauacaagugucauguuugcgauaaauguuucacgagggggaacaauuuaacugugcacuugcggaagaaacaucaauuuaaguggcccucgggacacccucgauuccgccucggucauuuuugcaucccacuucccggcuucgcagcccuguacgcuccgaccucuccugggacaagaaacaugaagauggccauauguggaugcuccugguuugcgacuagggucuga

SEQ ID NO: 57214 - RNA, 381 nt, Artificial Sequence
  derived and/or modified sequence opt3 from HINT1__Homo_sapiens__NP_005331
auggccgacgagaucgcuaaggcacagguggccagacccggcggggauaccauuuucggaaaaauaaucaggaaggaaauuccugcgaaaaucauuuuugaggacgaucggugccuggcuuuccacgacaucagcccacaagccccgacacauuuucucgucauacccaagaaacacaucucccagauuucuguugcagaagaugacgaugagucacuucugggucauuugaugaucgugggcaagaagugugccgcugacuuagggcugaacaaaggauaccgcaugguagugaaugaaggcagugauggugggcagagcgucuaucacgugcaucuacacguucucggaggccgacagaugcacuggccuccaggcuga

SEQ ID NO: 57215 - RNA, 492 nt, Artificial Sequence
  derived and/or modified sequence opt3 from HINT2__Homo_sapiens__NP_115982
auggccgcugcagugguccuggccgcgggccucagagcugccaggcgggcaguugccgcuaccggggugcgcggaggucagguacgaggcgcagccggggugacagacggaaacgaggucgcuaaggcccaacaggcgacucccggcggugcagccccuacgaucuucagccguauucuugauaaaucccugccagcugacauauuguacgaagaucagcagugcuuaguguuuagagacguugccccgcaagcacccgugcacuuccuggucaucccuaagaaaccaauucccaggaucucucaggcugaggaagaggaucagcagcuacucgggcaucugcuucugguggccaagcaaaccgcgaaagccgaaggauugggcgacggcuaucggcucguaauuaaugaugggaagcugggagcacagucaguuuaccaucugcacauccacgugcucgguggccgccaguuacaguggccuccaggguga

SEQ ID NO: 57216 - RNA, 2961 nt, Artificial Sequence
  derived and/or modified sequence opt3 from HIP1__Homo_sapiens__NP_001230127
auggacagaauggccagcuccaugaaacaggugcccaacccucugccaaaaguccucucuaggcggggcguuggggcuggacuugaggcagccgaacgcgagucauucgaacgaacccaaacagugaguaucaauaaggcgauuaacacucaggagguagcugugaaagaaaagcacgcccguacgugcauacuggguacccaucacgagaaaggcgcacagacauuuuggagcgucgugaauagauugccguuauccucuaacgccguucuguguuggaaguucugccauguguuucacaagcuacucagggaugggcaucccaauguccugaaagacucgcuucgguaccgcaacgagcugucagauaugagcagaauguggggacacuugagugaaggcuauggucagcucuguuccaucuaccugaagcugcucaggacuaaaauggaguaucacaccaagaauccucgguucccagggaacuuacaaaugucugaccgccagcuggaugaagcuggagagagcgacgugaauaacuuuuuccagcuuacaguagagauguuugauuacuuggaaugcgagcugaaucuauuccagaccguuuuuaacucccucgacaugucacgaagugugagcgucacugcagccggccaauguagacuggcuccccuuauucaggugauccuggauugcucucauuuguaugacuacacagugaaacuccuguucaaguuacacuccugucugccugccgauacccuccagggccauagggaccgguuuauggaacaguucacgaagcugaaagaucuguuuuaucguucaagcaauuugcaauacuucaagcgccuaauucagaucccacagcugcccgagaacccuccaaauuuccucagagcgagugcacugucugaacacauauccccggucguugugauccccgccgaggcuagcucgccugacucugagccaguacuugaaaaagacgaucugauggacauggaugccucccaacagaacuuguuugacaacaaguucgaugacauuuuugggucaaguuucagcuccgaucccuuuaauuucaacucucagaauggagugaacaaagacgagaaggaucaccucaucgaaaggcuguaccgggagauuagcgguuuaaaagcacagcuggaaaauaugaagacugagucacaacgagucgugcuacagcucaagggccauguuagugagcuggaagcugaccuugccgagcagcagcacuugcgccaacaggcggccgaugacugcgaauuucugagagcagagcucgacgaacugaggcggcagcgcgaggauaccgagaaagcucagagaucccuuagcgaaaucgagaggaaggcccaagcuaacgaacagcguuauucuaaacugaaggagaaauacucagaguuggugcagaaucaugccgaccuccugcggaagaacgcagaagucacaaaacaggugaguauggcccgacaagcucagguagauuuagagagagaaaagaaggagcuggaagacagccuagagaggauauccgaucaggggcaacgcaagacucaggagcagcucgaaguucuggagucucuuaagcaggaauuggcgaccucgcaacgggagcuucaggugcuccagggaagccuggaaacauccgcacagucagaggccaauugggcugccgaguucgcagaauuagagaaagaaagagacagucuggucucuggcgccgcucacagggaggaggaacuuagcgccuugcgcaaggagcuccaagauacccagcugaagcuagcauccacggaagagucaaugugucagcuggcgaaagaccagcgaaagaugcuccugguggguagccggaaagcugccgaacaagucauucaggaugcacuuaaccaguuggaggagccuccacugaucucuugcgccggguccgcugaccauuuacucaguacugugacaagcauuucuuccuguaucgaacaacuggagaagucauggagucaguaucuugccugccccgaagauaucagcggacuguugcacucgauuacccuccuggcacaccuaacuuccgacgcuauagcccauggcgcgacaaccugccugcgugccccgccugagcccgcugauucucucacggaagcauguaaacaguacggcagagagacccuggccuaucuugcuagcuuggaggaagaggggucacuggaaaaugccgacaguacagcaaugaggaacugcuuauccaagaucaaggcgauuggagaggaacuccugccacgcggucuugacaucaaacaggaggagcugggcgaucuaguugacaaggaaauggccgcuacuucugccgcaauagagaccgcuacagcccggauugaagggacugcaagcccuaaagaguuuuacgccaaaaauuccagauggaccgaaggacucaucucagcuagcaaggcggugggcuggggugccacaguaauggucgaugcagcugaccuggugguucaagggaggggcaaguucgaggaguugaugguguguagucacgaaaucgccgccucuaccgcucagcuggucgcagccuccaaagugaaggcggauaaggacagccccaacuuagcucagcuccagcaagccucgcgaggaguaaaucaggcaacugccggcgugguugcuucaacgauuucugggaaaagucagaucgaggaaacagauaacauggacuuuuccagcaugacccugacucagauuaagcgccaagagauggauucucagguccgggugcuugagcuggaaaacgaguugcagaaagaaagacagaagcucggagagcugaggaaaaagcauuaugaacuagccgguguggcagagggcugggaggaagggaccgaggcgagcccacccacacugcaagaagucguuaccgagaaggaauga

SEQ ID NO: 57217 - RNA, 3207 nt, Artificial Sequence
  derived and/or modified sequence opt3 from HIP1R__Homo_sapiens__NP_003950
augaacagcaucaagaaugugcccgccagaguccuguccaggcggccuggccacucucucgaggcugaacgcgagcaguucgacaaaacccaagcaauuucaauaaguaaggccaucaacacacaggaagcgccaguuaaagagaagcaugcucgacguauuauccuugggacucaccaugaaaaaggagccuuuacguucuggagcuacgcaauuggucugccguugcccuccucuucgaucuuaucauggaaguuuugccacgugcugcauaagguacuaagagauggccacccuaaugugcuccacgacugucagagguaucggagcaacauacgcgagaucggggaucuguggggacaucuucacgacagauacggccagcuggucaauguguauaccaaauugcuccugacaaagauuaguuuccaucugaaacacccacaauuucccgccggucucgagguuacugaugaaguguuagagaaggcugcagggaccgacgucaacaauaucuuccagcugacaguggaaauguuugauuacauggacugcgagcuuaaauuguccgagucuguauucaggcagcugaacaccgccauugcuguuagccagauguccucaggacaaugucggcuagccccucucauccaggugauacaggauugcagucaccuguaucauuacacugucaaacuucuguuuaaguugcacagcugucucccagcggacacacugcagggccaucgcgaucgauuccacgaacaauuucauucuuuaagaaauuucuuuaggcgggcauccgacaugcuguauuucaagcgucucauucagaucccccgccuuccugagggcccaccgaacuuccugagagccucagcuuuggccgaacacauuaagcccgugguggucaucccugaggaagcaccagaggaugaggaacccgagaaucuaaucgaaauuagcaccgggccuccagcuggagagcccguugugguagccgaccuguuugaccagacguucgguccgccuaacggcagugugaaagaugacagggaucuccaaauagaaucucugaagcgggaggucgagaugcuucgauccgaacuggagaaaaucaaguuggaagcgcagcgcuacauugcccagcucaaaagccaggugaaugcacuggagggggaauuagaggagcaaagaaagcagaagcagaaagcucugguugacaacgaacagcuaaggcacgagcucgcccaacugcgggcugcccagcuugaaggagagcgcucgcagggcuugagagaggaagcagagaggaaggccucugcuacugaagcgcguuacaauaaacugaaggagaaacauuccgaacucgugcacguccaugcagagcugcuucggaagaacgccgauaccgcuaagcagcugacagugacucaacagucacaggaggaaguagcccgaguuaaagagcaguuggcauuucaaguggaacaggucaagagagagagugaacucaaacuggaggaaaagagcgaccaguuagaaaaacugaagagggagcuagaagccaaggcuggugagcucgcccgcgcacaagaagcgcugucccacaccgagcagucuaaaagcgagcuuucaagucgguuggauacacuguccgcugaaaaggacgcccucagcggggcagugagacagagggaggccgaucuguuagcugcccagucucugguccgcgaaaccgaggcagcucuuucacgagagcaacagcggaguagccaggaacagggagaguugcaaggccgucucgccgaaagagagucccaggaacagggccugaggcagcgccuacuggacgagcaauucgcggugcuccgaggggccgcugcagaggccgcuggaauccugcaggaugccguuucuaaacuugacgaccccuugcaccugagaugcacgucgagcccagauuauuuaguguccagggcacaggaagcgcucgacgccguaucaacucuggaggaaggucaugcucaauaccuuacaagucuggccgaugcaucugcuuuggucgccgcacucacccgauuuagccaccuggccgcugacacuauaauuaacggcggggcgacaucccaucuagccccuaccgaucccgcagaccgccugaucgauacgugucgggagugcggagcuagagcccucgaacugaugggccagcuucaggaccagcaagccuugaggcacaugcaggcuucacuggugcguaccccauuacaggguauccuccagcuggggcaagagcuuaagcccaaaagccuggauguucgccaggaggaacuaggcgcaguggucgacaaggagauggccgcgacaucugcugccauugaagaugcagugcggagaaucgaggacaugaugaaucaggccaggcaugcuuccaguggaguaaagcucgaagugaacgagcggauucugaauagcuguacugauuugaugaaagcaauacggcuguuaguuaccacaucuacuucccuccagaaggagaucgucgaaucaggccgcggggccgcgacccaacaggaguucuaugcuaaaaacaguagauggacagaaggacugauuagcgccucgaaggcaguggguuggggcgccacccagcuuguggaggcugccgacaaagucguucugcacacugggaaguacgaggaauugaucgugugcucccacgagaucgcagcuucuacggcccagcucguggcggccagcaaaguaaaggcaaauaagcauucaccucaccugaguaggcuacaagaauguucccggacagucaacgagcgagcugccaaugugguugcuucuaccaaaagcggacaggaacagauugaggacagagauacuauggacuuuuccggccugucacuuauaaagcucaaaaagcaagagauggaaacccaggugcgcguccuggaguuggagaaaacacuggaggcagaaaggaugcguuuaggugagcuccggaagcagcauuaugugcuggccggggccagcggcaguccaggagaggaaguugcuaucagaccgucuaccgcgcccagguccgugacuacaaagaaaccuccacuugcacagaagcccagcguagccccucgccaagaucaccagcuggacaaaaaggauggcauuuacccagcucaguuggucaacuauuga

SEQ ID NO: 57218 - RNA, 2349 nt, Artificial Sequence
  derived and/or modified sequence opt3 from HIPK1__Homo_sapiens__XP_011539282
augaccuucuacagcuggauccccuaucacagacaggccccucugaaccauaggcgggugugcuccgcugagggcgcagggucuccaggaccggcccucgacccccgcuggcuuccuacagaagcgcaccuguuggaggcucaucgauuacugcuacaaucaguccucugugaucguccaagagaaaguauucagcugcacuuuaggcuuagcauggccucccagcugcagguuuucucucccccuucggugucaagcagugcauuuugcuccgccaagaaauugaagauagagccaucugguugggacguaagcggccaauccucaaaugauaaauacuauacucauaguaagacgcuccccgcuacccaggggcaggcaaacagcucucaccagguggccaauuucaacaucccugcuuacgaccaaggacugcugcucccagccccggcggucgaacacauugugguuacagcagccgauuccucaggcagcgcugccaccaguaccuuucagucuucccagacauuaacccaucggagcaaugugucgcugcuugagcccuaucagaaaugugguuugaagcgcaagucugaggaagucgacuccaacgggucagugcaaaucauugaggaacacccuccacugaugcuacagaauagaacuguaguuggagcagcugccacaaccacgacugugaccacaaaaaguagcuccucuagcggcgagggcgauuaccagcucguccaacaugagauccugugcucaaugacuaacaguuaugaagugcuugaguuccuggggaggggaaccuuuggucagguggcgaaguguuggaaacgguccacaaaggaaauagucgccaucaaaauuuugaagaaucaccccagcuacgcacgccagggccagaucgagguuucuauucucucacgacugaguagcgaaaacgcugacgaguacaauuucgugagauccuaugagugcuuucaacacaagaaccauaccuguuuaguauucgaaaugcuggagcagaaucucuacgauuuucuuaaacagaacaaguucucuccucugccauugaaauauaucaggcccauacuacagcaaguggccacggcucugaugaagcucaaaucgcuggggcuuauucacgccgaccugaagccggaaaauaucauguuggucgauccugugcggcagcccuaccguguuaaagugauugacuuuggaagcgcaucccaugucucaaaggccgugugcaguacuuaucuccagucucgcuacuauagagcuccagagaucauccugggcuuaccuuucugugaagcgauugauauguggagccuggguugcguaauagcagagcuauuccucggguggccccuguacccaggagccuccgaguacgaccagaucagguauauuucacaaacacagggccuucccgcugaauacuugcugagcgccggcaccaagacuacacgguuuuucaaccgagacccuaaccucggguauccacuguggcgccuuaaaaccccggaggaacacgagcuggaaacgggaaucaagucuaaagaggcaagaaaguacauauuuaauuguuuggaugacauggcccagguuaacauguccaccgaucucgaggguacagacaugcuggcugaaaaagccgauaggcgggaguauauugacuuacugaagaagaugcuaacuaucgaugcagacaaacgcaucacuccccucaagacacugaaucaucaguucgugacuaugacccaccuuuuggauuuuccucacaguaaccaugucaaaagcugcuuccaaaauauggaaauuugcaagagaagggugcacauguacgacacagucucucagaucaaauccccauuuaccacucauguggcgcccaacacgucaacaaaucugaccaugaguuucagcaaccagcucaauacuguucacaaccaggcuucggugcuggccuccucuagcaccgcagccgcugccacauuaucacuggcaaauagugauguaucccuuuugaacuaucaaucugcucucuacccuagcuccgccgcgccaguccccggcguggcccagcaggggguuucacugcaaccgggaaccacucagauuuguacacagacggacccuuuucagcaaaccuucauagugugcccacccgcuuuucagacuggccuacaggcaacaaccaagcacagcgguuucccuguccguauggacaaugccgugcccaucguaccacaggcuccugccgcacaaccccugcagauucagaguggggugcucacacaaacuugucgggagaagaucucucgacauuccuga

SEQ ID NO: 57219 - RNA, 3516 nt, Artificial Sequence
  derived and/or modified sequence opt3 from HIPK2__Homo_sapiens__NP_001106710
auggcccccguguacgagggcauggcuagccacguccagguuuucuccccucauacccugcaaucuucagcauuuugcagugugaagaaacucaagaucgaaccaagcuccaacugggacaugacaggguauggaucucacucgaaaguauacucacagagcaagaauauuccgcuuagucagcccgccacuacgaccguguccacaucucugccugucccaaaccccagcuugccuuaugagcagacuauaguguucccagguuccaccggccauaucguugugacaucagcgaguagcaccucugucacugggcaaguguuaggaggcccccacaaucugaugagaagguccacaguaucacuacucgauaccuaccagaaauguggucugaagcggaagucugaagagauugaaaacacgaguucuguucagaucauugaggagcauccuccaaugauccagaauaacgcuuccggggccacuguggcaaccgccacaacuagcaccgcuacaucgaaaaauucuggauccaacucagaaggcgacuaucaacuuguccagcacgaggugcugugcaguaugaccaauacguacgaaguguuggaguuucucggccgcgggacuuucggacaggucguuaaguguuggaaacgagguacaaacgagauaguggcaaucaagauucugaaaaaucacccgagcuaugcccgucagggccaaaucgaaguauccauucuggcuagacucucuaccgagagcgccgaugacuacaacuuugugagggcguacgaaugcuuccagcauaagaaucacacuuguuuagucuuugagaugcuggaacagaaccuuuaugauuucuugaagcaaaauaaauuuucaccccugccucuaaaguacauccggccagugcuccagcagguugcaacagcccugaugaaacuuaagagucugggguugauacaugcugaccucaaacccgagaacauuaugcugguggauccuucccgccagccauauagagucaaggugaucgacuucggaagcgccucucacguaucaaaagcaguuugcaguaccuacuuacaaagcagguauuaccgggcucccgagauuauccugggccucccguuuugugaagccaucgauauguggucccuugguugcgugauugcggagcuguucuugggguggccucuauaucccggagccucugaauacgaccagauacgcuacaucucgcagacgcagggccugccagcagaguaucuccugagcgcuggcaccaagacaacucgauuuuucaacagagauaccgacuccccuuacccccuuuggaggcugaagacaccagaugaccacgaagccgagacugggauuaaaucaaaggaggcucggaaauauaucuucaauuguuuggacgauauggcccaagucaacaugaccacagaccucgaaggaagugauaugcugguggagaaggcagaccgucgcgaauuuauagauuuacugaaaaagaugcuaaccauugacgccgauaagagaaucacucccaucgagacgcucaaucauccuuucgucacaaugacccaucugcuugacuuuccacacucuacucacgugaaaagcugcuuccagaacauggaaauuuguaagaggcggguuaauauguacgauaccgugaaccaguccaaaacaccguuuaucacccauguagcucccucaacuagcacaaauuugacgaugaccuucaacaaucagcugacuacaguccacaaccaaccuucugcggcauccauggccgcuguggcccagcgaaguaugccacuccagaccgguacagcacagauuugcgcccgccccgacccuuuucaacaggcucugauaguuugcccacccggcuuccaggggcuucaagccagcccgucuaagcacgcaggauauuccgugagaauggagaaugcggucccuaucgugacucaggcuccaggcgcccagccccugcagauucaaccugguuugcucgcacagcaggccuggcccucagggacccagcaaauccuguuaccuccagcuuggcagcagcugacgggcguagccacccauacaagugugcagcacgcaacuguuauccccgagaccauggcuggaacacaacagcuagccgauuggaggaacacucaugcgcacggcagccacuacaauccaauuaugcagcaaccggcccuccugaccgggcaugucacgcuuccugcugcacagcccuugaacgugggaguggcccacgucaugcggcagcagccaacaucgaccacuuccucucgcaaaagcaagcaacaucagucaaguguuagaaauguguccacaugugaagugucuagcucccaggcuauaucaagcccccagaggaguaagcguguaaaagagaacaccccuccacggugcgccaugguccacucuucccccgcauguagcacuucggugaccugcgguuggggcgacguugcgucaucuacaacgcgagaaagacaaaggcagaccaucgugauuccugacacuccgaguccaacagucuccgugaucaccauuagcucugauacagacgaggaggaggaacagaagcaugcccccacuagcaccguuuccaaacagcgcaagaacgugaucucauguguaacgguccacgauaguccuuauagcgacucuuccucaaauacaaguccauacagcgugcaacagcgggcugggcacaacaaugccaacgcauuugauaccaaaggaucccuggaaaaucauugcacuggcaaccccagaaccauaaucgugccuccgcucaagacacaggcuucugagguccugguugaaugugacucguuagugcccguaaauacuagccaccauucauccaguuacaagucuaaaagcuccucaaacgugaccucuacaagcggucacaguuccgggagcagcucaggcgccauuacguauaggcagcaacgcccaggaccucauuuccagcagcaacagccccugaaucuuucccaggcacagcaacacaucaccacugaucgaacaggcagucaccggcgucagcaggccuacauuaccccaacuauggcucaggcgccuuauagcuuuccccauaacucgccaucucacgggacaguccauccgcacuuggccgcagcugccgccgcugcacaccucccuacccaaccccaucuguacacguauacugccccagcggcucuaggauccaccgguacaguggcccaccugguugcaagccagggcucagccagacauaccgugcagcacacugcuuaccccgcaaguaucguccaucaggugccuguuucuauggggccaagggugcuccccuccccuacaauacacccgagccaauauccagcccaguucgcgcaccagaccuacauuucagcuagucccgccagcacagucuacacuggauauccucugucccccgcaaagguaaaucaauacccauauaucuga

SEQ ID NO: 57220 - RNA, 3585 nt, Artificial Sequence
  derived and/or modified sequence opt3 from HIPK3__Homo_sapiens__NP_001265092
auggccagccaggugcuggucuaucccccuuacguuuaccaaacccaguccucugcuuucugcucagugaagaaacucaagguagagccaaguagcuguguguuucaggaaagaaacuauccgaggacauacgucaauggccggaacuucgggaauagucaucccccuacuaaaggaucugcauuucagacgaagaucccauucaaccgcccccgaggucacaauuuuucgcuucaaaccucagccgugguucugaaaaacacagcgggcgcuacuaaggugauugccgcacaggcccagcaggcucacguccaagcaccucagauaggggccuggcguaauagauugcauuucuuagagggaccacagaggugcggccugaagcggaaaagcgaggaacuagacaaccacaguuccgcuaugcagaucguggaugaacucucuauucugcccgccaugcuucaaaccaauauggguaacccuguaacaguugugaccgcgacuacagggagcaagcagaauuguaccacgggagagggcgacuaucagcugguccaacaugagguguugugcuccaugaaaaacacuuacgaagugcucgauuuucugggccgcgggaccuucggacaggucguuaaguguuggaaaagagguacaaaugagaucguggcaauuaagauccugaagaaccacccaucauaugccaggcagggccagauagaaguaaguauccucgcucgguuaagcacugagaaugccgacgaguacaacuuugugcgcgcauacgaaugcuuccaacaccgaaaccauaccugucuggucuuugagaugcuugaacagaauuuguaugauuuccugaaacagaacaaguuuucuccgcuaccccucaaagugauuagaccuauccugcagcaaguugcuacagcccuuaagaaacugaaguccuuggggcucauucacgcggaccugaaaccagagaauaucauguuaguggaucccgucaggcagccuuaccgggugaagguaauagacuucggaucagccagccauguuaguaagaccgugugcucuacguaucugcagucccguuacuaucgcgcaccagaaauuauccucggccuucccuucugugaggcuauugauauguggagccuggguugcgucaucgccgaguuguuucuaggguggccgcuguacccuggagcucucgaauaugaccagaucagauacauuucgcaaacucagggccugcccggcgagcagcuucugaacguggggacaaaaucuaccagguucuuuuguaaggaaacugauaugucccacucaggauggcgguugaaaacacucgaggaacacgaggccgagaccgguaugaagaguaaagaagcacgaaaguacauauucaauagccuggacgaugucgcccaugugaacacgguuauggacuuagagggcuccgaccugcuagcugaaaaggcggaucgcagagaguuugugucucuccugaaaaagaugcuuuugaucgacgcagaucugaggauuaccccagccgaaacacucaaucacccuuucguaaacaugaaacaucugcuugacuuuccccacagcaaucaugucaagucaugcuuccacaucauggauauaugcaaaagucaccugaacuccugugacacuaauaaccauaauaagaccagcuugcuccggccaguggcuucuucaaguacagccacucugaccgcaaacuuuacaaagauugggaccuuacgcagccaggcccugacuacguccgcucacucuguugugcaucacggaaucccccuacaagccggcacagcacaguucgguugcggggaugcguuucagcaaacccucaucauuuguccuccagcuauccagggcauuccggccacucacggaaaacccaccucguauagcauaagagucgacaauacagugccucugguaacccaggcaccagccgugcagccccuucaaaucaggccuggcguuuugucccagacuuggucagggcguacacagcagaugcuggucccagcuuggcaacaggugacgccccucgccccggcaaccacuacacugaccagugagucuguggcuggaagccaucgguuaggugauuggggcaagaugauuuccugcucaaaccacuacaacagcgucaugccucagccacugcuuacaaaucagaucacuuugucugcgccccaaccuguuuccguggggaucgcccaugugguauggccccagccagccaccacgaaaaagaacaaacagugucaaaaucgaaguaacagccuccagaauaccaacauuccucacucugcuuucauaucccccaagaucauuaauggaaaggacgucgaggaagugucaugcaucgagacacaggauaaccagaauagugaaggcgaggcaagaaacuguugcgagacuagcauuaggcaagacucggacuccucuguuagcgauaaacagcgccagaccaucauaaucgccgacucaccaaguccggcuguguccgucauuacaaucucuagcgauacugacgaagaggaaaccucccagcggcauucacugagagaguguaaggguagccuagauugcgaagccugucaaaguacgcugaauauugacaggaugugcucucucuccagcccugauucgacacugucaaccucuaguuccgggcagagcucucccagcccaugcaaacgccccaacuccaugucagacgaggagcaggaaaguagcugugauacuguggacggcucuccuacauccgauucaaguggacacgacagcccauuugcagaguccaccuucguugaagauacucacgagaauaccgaacuugugucuucggcggacacagagacgaagcccgccguaugcagcgucguggugccuccggucgaguuggaaaacggccugaaugcugacgagcauauggccaacaccgauucaaucugucagccauuaauaaaagggcgauccgcacccggacggcucaaccaaccuagugcuguugguacucgucagcagaagcugacaucugccuuccagcaacagcaccuuaauuuuagccaggugcaacauuucggcuccgggcaccaggaauggaacggaaauuuuggccauagaaggcagcaggcauauauuccaaccucaguaacaucuaaccccuucacucugagccacgguaguccuaaucacaccgccgugcaugcucacuuggcggggaacacgcaucucggcggacaaccgacacugcuacccuacccauccagcgccacccugucuucagcagcuccugucgcccaccuccuggccucccccugcacuucccgcccaaugcuucagcacccuaccuauaauaucagccaucccucgggcauugugcaccagguuccagugggguugaacccgcggcuguuaccuucucccacaauccaucagacucaauacaaaccaauauuucccccucacuccuauaucgcugcaagcccagccuacaccggauucccccucucaccuacaaagcugagucaguacccguauauguga

SEQ ID NO: 57221 - RNA, 3054 nt, Artificial Sequence
  derived and/or modified sequence opt3 from HIRA__Homo_sapiens__NP_003316
augaagcugcucaaacccaccugggugaaccacaauggcaagccuaucuucagcgucgacauucauccagaugggacaaaauuugccacuggaggucagggccaagacuccgggaagguugugauauggaacaugucuccgguacuucaggaggaugacgaaaaagaugagaauauccccaagaugcugugccagauggacaaccacuuggcuugugugaauugcgucagauggucaaacaguggaauguacuuagcaagcggcggugaugacaagcugauuaugguguggaaaagggccacguauaucgggccuuccaccguuuucggaucuucgggcaagcuagcgaauguggaacaguggcggugugucucaauucuccgcaaccauagcggcgaugugauggacguagcuuggaguccacacgaugccuggcuggcauccugcucuguugacaauacaguggucaucuggaacgccgugaaauuucccgagauacuugcuacucugcgagggcauagcggauuggugaagggucucaccugggauccugucggcaaauacaucgcaucccaagccgacgaccguucacugaagguuuggagaacacuggauuggcagcucgaaaccaguauuacuaagccauucgacgagugugggggaacaacccacguguuaaggcugagcuggucucccgauggccacuaucuuguauccgcucaugccaugaauaacucagguccuacggcgcagaucauugagcgggaaggguggaaaacuaauauggacuuugugggacaccgcaaggcagucaccgugguuaaauucaacccaaagaucuuuaaaaagaaacagaagaauggcagcagugccaagccgucuugccccuacuguugcugugcugugggcuccaaagaucggagcuugucggucuggcugacaugccuaaagaggccucucgugguaauacaugagcuguucgacaaaucuauuauggauaucuccuggacucuuaacgggcugggaauuuugguuuguucaauggacgguaguguggccuuucucgauuucagccaagacgaacugggcgauccauuauccgaggaggaaaagucucggauccaccagagcaccuaugggaaaucacuggcaaucaugacagaggcucagcucaguaccgccgucauugaaaaccccgagaugcuuaaguaccagcgccgacaacagcagcaacagcuggaccagaaguccgcggccacgagagaaaugggaagcgcaacuucuguggcuggcgucgugaauggugagucauuggaggacauaaggaaaaaccuacugaagaaacagguugaaacacggaccgccgaugggcgucgcagaaucacuccucucugcauugcucaacuggacacaggcgauuuuaguaccgccuucuuuaauagcaucccacuuuccggaucucuggcaggcacgauguugucgagccacuccucaccccagcuccugccguuagacaguucuaccccuaacagcuucggggccuccaagcccugcacagagccagugguagcugcgucagcaaggccugccggagauagcgucaauaaagacucuaugaacgcuacuuccacccccgccgcacugaguccaagcgugcuaacaacucccucuaagauagaaccuaugaaggccuucgauucccgguuuaccgagcgaucaaaagcuacaccaggugccccggcacucaccaguaugacucccacggcgguugaacgccugaaggagcagaaucuugugaaagaguugagaccuagggaccugcucgaaagcucguccgauucugacgagaaggucccacuggcuaaagccagcucacuuaguaagcggaagcuggaauuggagguggaaacaguagagaaaaagaaaaagggccgccccagaaaagauuccaggcucaugccugugucucugagcguucaguccccagcagccuuaaccgcugagaaggaagccaugugucugucagcacccgcucuagcccucaaacugccgauuccuagcccacaacgugcguucacucuucaggucaguucugaccccuccauguauaucgagguggaaaacgaggugaccgucguugggggagugaaguugagccggcugaagugcaaucgagagggcaaagaaugggagacagugcucaccucgagaauccugacugccgcugguucaugugauguagucugcguggcaugugaaaagaggauguuaucuguuuuuaguacaugcgggcgccggcugcuuuccccuauuuugcuccccagcccaaucucuacgcugcauuguaccggcagcuacgugauggcccuaacugcugccgcaacacuguccgucugggacgugcacagacagguugugguagucaaagaggaaucacuccauaguauucuggcgggaagcgacaugaccgugucucagauacuuuugacacaacacggcaucccugugaugaaccuguccgaugggaaggccuacugcuucaaucccucauuaaguacuuggaaccucgucagcgacaaacaggauucccuggcucagugugccgacuuuaggucuucgcuuccaagccaggaugcaaugcugugcucaggaccguuggcuauuauccaaggucgcaccuccaauaguggccgacaggccgcaagacucuucucuguuccucaugugguacagcaagagacgacccuggccuaucuagagaaccagguggcugcggcccugacacuccagagcucccacgaauaccgucacuggcugcuugucuaugcaagauacuuggugaaugagggguuugaauauaggcugcgcgagaucuguaaggacuuacucggacccguucauuacucaacuggcucucagugggaaagcaccguggucggucugcggaagagagagcuucugaaagagcuacucccagugauugggcaaaaccugagguuccagcgauuguuuacagaaugccaggagcagcuggauauauuacgcgacaaguga

SEQ ID NO: 57222 - RNA, 1671 nt, Artificial Sequence
  derived and/or modified sequence opt3 from HIRIP3__Homo_sapiens__NP_003600
auggccagagagaaggaaaugcaggaguucaccaggagcuuuuuccggggccgccccgaccuguccacacucacucacucuaucgugcgacguagauaccuugcucauucagggaggagucaccuggaaccugaggaaaaacaagcauugaagcgguuagucgaggaggaacugcuaaaaaugcagguugaugaggccgcgagccgcgaagacaagcucgaucugacgaaaaagggaaagagaccaccgacccccugcuccgacccugagaggaaacgguuucgcuucaacucugagucggaaucagguagcgaggcuaguuccccagauuauuuugggcccccugccaagaauggcguggcagccgaaguaucuccagcuaaagaggaaaaccccagacgagcaagcaaggccguggaggaguccucagacgaagagaggcagcgggaucuuccugcucagcguggagaagagaguagcgaagaggaggaaaaaggcuacaaggguaagacacgcaaaaagccagucgugaaaaagcaagccccggggaaagcgucuguuuccagaaagcaggcaagggaggaaucagaggaaagcgaggccgagcccgugcagcggacugcuaaaaaggucgaaggaaauaagggcaccaaaagucugaaggagucugaacaggaguccgaggaagagauuuuggcccaaaagaaggaacagcgagaggaagagguggaggaagaggaaaaagaggaagacgaggagaagggcgauuggaagccucgcacaagaagcaacgggaggcggaaaucggcacgcgaagagagaucuuguaagcagaaaucccaggcuaagaggcuccugggagacucagauagugaagaggaacaaaaagaggccgcgagcuccggugacgauucuggccgugaccgggagccacccguacagcgaaagagcgaagacagaacccagcugaaagggggaaaaaggcucucaggcaguuccgaggaugaagaggacagcgguaagggggagccuacugccaaaggaucucgcaagauggcacgguuaggcucaacaaguggcgaagagagcgaucuggaaagagagguuuccgacucugaagcugggggagguccacaaggcgagaggaaaaaucgcucgagcaagaaguccucacgaaaagggcggacccguaguucuagcuccucaagcgauggaucucccgaggccaagggcgguaaagcuggguccggcagaaggggagaagaccauccggccgugaugcgccuuaagcgguauauaagagcaugcggcgcccacaggaacuacaaaaaguugcuggggaguuguugcagccauaaagagcgacuaucuauccuccgcgcugaacuggaggcgcuuggaaugaaggguacgccuucccugggcaagugucgggcauugaaagaacagagagaggaggccgcugaagucgccucacucgauguggcaaauauuaucagugggagcggaaggccccgucgccggacugccuggaacccacugggcgaggcugccccucccggugaauuauauagaaggacccuggacucggaugaggaacgaccacggcccgcaccuccagacuggucccacaugcgcgggauuaucucuagcgauggcgagucaaauuga

SEQ ID NO: 57223 - RNA, 648 nt, Artificial Sequence
  derived and/or modified sequence opt3 from HIST1H1A__Homo_sapiens__NP_005316
augagcgagaccgugcccccugccccagcugcauccgccgcgccggaaaagccccuggcuggcaaaaaggccaaaaagccugcaaaagccgcugcagccucuaagaagaaaccagcugggcccucagucagugagcucaucguucaggccgcgagcuccucuaaggaaagaggaggugugucgcuugcagcccugaaaaaggcuuuggccgcagcuggcuacgacguagagaaaaacaauucaaggauuaaguuagggauaaagagccuggugaguaaaggaacucuaguccaaacaaagggcacgggugccuccgggucuuucaaacucaacaagaaagcgagcuccguggaaaccaagccuggagccucaaaaguugcaacaaagacuaaggcuaccggcgccaguaaaaagcugaaaaaggcuacaggcgccagcaaaaagucugugaagacccccaaaaaggcgaaaaagccagccgcuacucggaaauccucaaagaauccuaagaaaccaaagacagucaaaccgaagaaaguggcaaagagccccgcaaaggccaaagcuguaaagccuaaagccgcaaaggcccgcguuaccaaaccaaagacggcuaaacccaagaaggccgcaccuaaaaagaaauga

SEQ ID NO: 57224 - RNA, 681 nt, Artificial Sequence
  derived and/or modified sequence opt3 from HIST1H1B__Homo_sapiens__NP_005313
augagcgagaccgcccccgcugaaacagcaacuccugccccaguggagaaguccccggcgaaaaagaaagcuacgaagaaagccgcaggcgccggggcugcaaagagaaaggccaccggacccccugucucugaacugaucacaaaagcuguugccgcgucaaaggagaggaacggucucagucuugcagcccugaaaaaggcuuuggccgcaggcggguacgacguggagaaaaauaacagccggauuaaguuaggacugaagucccuaguaucuaaaggcacucucgugcagaccaaggguacaggggcuucgggaucauucaaacugaauaagaaagccgcgagcggcgaagccaagccaaaagcaaagaaggcuggcgccgcuaaagccaagaaacccgcaggggccaccccuaagaaagcuaagaaggcggcaggagccaaaaaggcugucaaaaagacucccaaaaaggccaagaaaccagcagccgcuggugugaagaaaguugccaagaguccuaaaaaggcaaaggcggcugccaaaccaaagaaagcaacaaaguccccggccaaacccaaggcugugaaaccuaaggccgcaaagccaaaagcugccaagcccaaagcggccaagccuaaagcugcaaaggccaagaaagcugccgcaaagaaaaaguga

SEQ ID NO: 57225 - RNA, 642 nt, Artificial Sequence
  derived and/or modified sequence opt3 from HIST1H1C__Homo_sapiens__NP_005310
augagcgagaccgcccccgcugcaccagccgcggcuccaccggccgaaaaggcacccgugaaaaagaaagccgcuaagaaagcaggcgggacaccuagaaaggccuccggaccacccgucucugagcugaucacuaaggcuguugccgcgucaaaagaaaggaguggugugagccucgcagcccuuaagaaagcucuggccgcagcuggcuacgacguagagaagaacaauucccggauuaaauugggguuaaagucucuggugucgaagggaacgcuaguccagaccaaaggcacaggugccucagggagcuucaagcucaacaaaaaggcggccaguggagaagcaaaaccuaaggugaaaaaggcuggcggcacuaagccaaagaaacccguuggggccgcuaaaaagccuaaaaaggccgcaggaggugccaccccaaagaaauccgcuaagaaaacaccgaagaaagcgaagaagcccgcagccgcuaccgugacuaaaaaggucgccaaaucuccuaagaaagcaaagguggccaagccaaagaaagcugccaaaagcgcagcgaaggcuguaaaacccaaggccgcaaaaccuaagguugugaagccuaaaaaggccgcucccaaaaagaaauga

SEQ ID NO: 57226 - RNA, 666 nt, Artificial Sequence
  derived and/or modified sequence opt3 from HIST1H1D__Homo_sapiens__NP_005311
augagcgagaccgcuccccuggccccuacaaucccagcaccggccgaaaagacucccgugaaaaagaaagcgaagaaagcuggcgccacggcagggaagagaaaggccuccggaccuccagucucugagcucauuaccaaagcuguugcagccucaaaggaaaggaguggugugagccuugcugcccugaaaaaggcguuggcagccgcuggcuacgacguagagaaaaacaauucccggauaaaguuagggcugaagucucuagugucgaaaggaacacucguccagacuaagggcaccggugccucagggagcuucaaacugaacaagaaagcagcuaguggagaaggcaagcccaaagccaagaaggcgggcgccgcaaaaccucgcaagccagcuggggccgcuaaaaagcccaaaaagguggccggagcagccacaccuaagaaauccaucaagaaaaccccaaagaaaguuaagaagccggcuacugcggcagguaccaaaaagguggccaaaucugcuaagaaagucaagacaccccaaccuaagaaagccgcaaagagcccagccaaagcuaaggcccccaaaccuaaggcagcgaaaccaaaguccggcaagcccaaagugacgaaggcuaaaaaggccgcaccgaaaaagaaguga

SEQ ID NO: 57227 - RNA, 660 nt, Artificial Sequence
  derived and/or modified sequence opt3 from HIST1H1E__Homo_sapiens__NP_005312
augagcgagaccgcccccgcugcaccagccgcgccagcuccggccgaaaagacacccgugaaaaagaaagcaagaaaguccgccggcgcugcaaaaaggaaggccucugggccuccagucucagagcugaucacuaaggcuguugccgcgaguaaagaacggagcggagugucccucgcagcccuuaagaaagcucuggccgcagcugguuacgacguagagaagaacaauucucgcauuaaauugggcuuaaagucgcuggugucaaaggggacgcuaguccagaccaaaggaacaggcgccagcgguaguuucaagcucaacaaaaaggcggccuccggggaagcaaaacccaaggcuaaaaaggccggagcugccaaggccaaaaagccugcaggcgcugcgaaaaagccuaaaaaggcaacuggcgccgcuacccccaagaaaucugccaagaaaacaccuaagaaagcaaagaagccagccgcugccgcaggggcgaaaaaggcuaaaagcccgaagaaagccaaggcagccaagcccaaaaaggcuccuaaauccccagccaaggcaaaagcugugaagcccaaagccgcgaagccuaagaccgccaaaccaaaggcugcaaaacccaagaaagccgcugccaagaagaaauga

SEQ ID NO: 57228 - RNA, 624 nt, Artificial Sequence
  derived and/or modified sequence opt3 from HIST1H1T__Homo_sapiens__NP_005314
augagcgagaccgugcccgccgcuuccgcaucugccggcgucgcggcuauggaaaagcugccuacuaaaaagagagggaggaaaccagccggacucaucucagcaagucggaagguuccgaaccuuagcguguccaaacugauuacagaggccuugucuguaucgcaggaacgcguggguaugucauuagucgcucugaagaaggcacuagccgcugccggcuacgacguggagaaaaauaacagccgaauaaagcucagucugaaaucccuuguuaauaaggggauccuggugcaaacgcguggaaccggcgcgucugguagcuucaaauuguccaagaaggucauucccaaaucaacaagaaguaaggccaaaaagagcgugucugcaaaaacuaagaaacucguacuguccagggauucaaagagcccuaagaccgcuaaaacaaacaagcgggccaaaaagccacgcgcaaccacucccaaaacaguuagaagugggaggaaggcuaagggagccaaaggcaagcagcagcagaaaucuccugugaaggcgcgggccuccaaaagcaagcugacccaacaccaugaagucaaugugcgcaaggcaacgucgaaaaaguga

SEQ ID NO: 57229 - RNA, 393 nt, Artificial Sequence
  derived and/or modified sequence opt3 from HIST1H2AE__Homo_sapiens__NP_066390
augagcggcagagggaagcagggagguaaagccagggcuaaggcaaaaacccgguccucucgcgccggccugcaauuccccguggggcgaguccaccgucuccuuagaaagggaaacuacucagagaggguuggcgcgggugcuccuguguaucuggccgcaguauuggaauacuuaacagccgagauccuggaacuagcugggaaugcagcccgggacaacaaaaagacucgcauuauaccaagacaucuccagcuggcuaucaggaaugaugaggaacuuaacaagcuguugggacgggugacgauugcccagggcggcguccucccgaauauccaggcggugcugcugcccaaaaagaccgagagucaccauaaagcaaaggggaaauga

SEQ ID NO: 57230 - RNA, 387 nt, Artificial Sequence
  derived and/or modified sequence opt3 from HIST1H2AH__Homo_sapiens__NP_542163
augagcggcagagggaagcagggagguaaagccagggcuaaggcaaaaacccgguccucucgcgccggccugcaauuccccguggggcgaguccaccgucuccuuagaaagggaaacuacgcggagaggguuggcgcuggugccccuguguaucuggcagccguauuggaauacuuaacagcugagauccuggaacuagcagggaaugccgcucgggacaacaaaaagacucgcauuauaccaagacaucuccagcuggccaucaggaaugaugaggaacuuaacaagcuguugggaaaagugacgauugcgcagggcggcguccucccgaauauccaggcagugcugcugcccaagaaaaccgagucacaccauaaggccaaauga

SEQ ID NO: 57231 - RNA, 381 nt, Artificial Sequence
  derived and/or modified sequence opt3 from HIST1H2BG__Homo_sapiens__NP_003509
augcccgagccugccaagagcgcuccagcaccgaaaaagggcuccaaaaaggccgugaccaaagcgcagaagaaggacgggaaaaagagaaaaaggucucggaaggaaucauacagugucuauguuuacaaagugcugaagcaaguacaccccgauacaggaaucagcuccaaggcuauggguauuaugaacucuuucgugaaugacauauuugagcgcaucgccggcgaagcaucgcgacucgcccauuauaacaaacguucaacuauuacgagcagagagauccagaccgcugucaggcuucuguugccuggggaauuagcaaagcacgccgugagugagggaacaaaagcuguuacuaaguacaccuccucuaaauga

SEQ ID NO: 57232 - RNA, 381 nt, Artificial Sequence
  derived and/or modified sequence opt3 from HIST1H2BH__Homo_sapiens__NP_003515
augcccgacccugccaagagcgcuccagcaccgaaaaagggcuccaaaaaggccgugaccaaagcgcagaagaaggaugggaaaaagagaaaaaggucucggaaggagucauacagugucuauguuuacaaagugcugaagcaaguacaccccgacacaggaaucagcuccaaggcuauggguauuaugaacucuuucgugaaugauauauuugaacgcaucgccggcgaggcaucgcgacucgcccauuauaacaaacguucaacuauuacgagcagagaaauccagaccgcugucaggcuucuguugccuggggaguuagcaaagcacgccgugagugaaggaacaaaagcuguuacuaaguacaccuccucuaaauga

SEQ ID NO: 57233 - RNA, 381 nt, Artificial Sequence
  derived and/or modified sequence opt3 from HIST1H2BM__Homo_sapiens__NP_003512
augcccgagccugugaagucggccccagucccgaaaaagggcuccaaaaaggcuaucaacaaagcacagaagaaggacgggaaaaagagaaaaaggucucggaaggaaucauacaguguuuauguguacaaaguacugaagcaagugcaccccgauaccggaauuagcuccaaggccauggguauaaugaacucuuucgucaaugacaucuuugagcgcauugcgggcgaagcuagccgacucgcccauuauaauaaacguucaacaaucacuagcagagagauucagacggcagugaggcuucuguugccuggggaauuagccaagcacgcuguuagugagggaaccaaagcagugacaaaguacacuuccucuaaauga

SEQ ID NO: 57234 - RNA, 411 nt, Artificial Sequence
  derived and/or modified sequence opt3 from HIST1H3G__Homo_sapiens__NP_003525
auggccagaaccaagcagacagcuaggaaaagcacuggcgggaaggcaccccggaaacaacuggccacgaaggcggcucgcaaauccgccccugcaaccggaggugugaagaagccacaccgauaccguccgggcacagucgcccucagagagaucaggcgguaucagaaaucuacugaacuucugauucgcaaguugcccuuccagagauuaguuagggagauagcucaggacuuuaaaaccgaucugcgguuccaaucaagugcagugauggcccuacaggaggcuugcgaagccuaccucguagggcuguuugaagacacaaaccuuugugcgauccaugcaaagcgcgugaccauuaugccuaaagauauccagcuggcccgaagaauuaggggagagcgggcuuga

SEQ ID NO: 57235 - RNA, 312 nt, Artificial Sequence
  derived and/or modified sequence opt3 from HIST1H4D__Homo_sapiens__NP_003530
augagcggcagagggaagggagguaaaggccuggggaagggaggcgccaaaaggcaccggaaggugcuccgcgacaacauccaggguauuaccaaacccgcuauacgacgucuugcaagaaggggaggggucaagcggaucuccggccugauuuacgaggaaacacgcggcguuuugaagguguucuuagagaauguaaucagagaugccgugacuuauacggaacaugcgaaaaggaagaccgucacagcuauggacgugguuuacgcccugaaacggcaagggcgcacucuauauggauuugguggcuga

SEQ ID NO: 57236 - RNA, 411 nt, Artificial Sequence
  derived and/or modified sequence opt3 from HIST3H3__Homo_sapiens__NP_003484
auggccagaaccaagcagacagcuaggaaaagcacuggcgggaaggcaccccggaaacaacuggccacgaagguggcgcgcaaauccgcuccugccaccggaggugucaagaagccacaccgauaccguccgggcacaguugcacucagagagaucaggcgguaucagaaaucuacugaacuucugauucgcaaguugcccuuccagagauuaaugagggagauagcccaggacuuuaaaaccgaucugcgguuccaaucaagugcugugauggcacuacaggaagccugcgagagcuaccucguagggcuguuugaagacacaaaccuuugugugauccaugcuaagcgcgucaccauuaugccuaaagauauccagcuggcccgaagaauuaggggagagcgggcguga

SEQ ID NO: 57237 - RNA, 8157 nt, Artificial Sequence
  derived and/or modified sequence opt3 from HIVEP1__Homo_sapiens__XP_011512855
augcccagaaccaagcagauccacccuaggaaccugcgggacaaaauugaggaagcccaaaaggagcucaauggcgcugaagugagcaaaaaggagauacuucaggcaggggucaaaggaacauccgaaucucugaaggguguuaagcgcaaaaagaucguggccgagaaccauuugaaaaagauuccaaaaucaccguuacgaaauccccugcaggcgaagcacaagcagaacacugaggaaaguagcuucgcuguacuacauuccgccucugagucgcacaaaaagcaaaauuacaucccugugaaaaacggcaagcaguuuacgaaacagaauggggaaaccccaggaauuaucgcagaggccucaaagagcgaggaaagugucucccccaaaaagccucucuuccugcagcaaccaucugagcuucguagauggaggagcgaaggcgcugaucccgcaaaguuuuccgaccuggaugagcagugcgacucaaguagcuugucuuccaaaacacggacugauaacucagaauguauaagcagucauugcgguaccacaucuccuuccuauaccaauacugccuucgacgugcuccugaaggcuauggagccagagcugagcacacucucgcagaaagggucuccgugugccaucaagaccgaaaaauuacgccccaacaagacggcgagauccccuccaaagcugaaaaauucaaguauggaugcacccaaccagacuagccaagagcuuguugccgaaucccagucuagcugcaccucauacacagugcacaugagugcugcccagaagaaugagcaaggagcaaugcaguccgcuagccacuuguaucaucagcacgaacauuuugucccuaaaucuaaccagcacaaucaacagcugccaggcuguucaggcuucacugggagucuaaccaaccuccagaaccaggagaaugccaagcuggagcaaguguacaacauugcgguaacaagcuccguuggacuuaccucucccucgagcaggucccaggugacgccgcagaaucagcaaauggacucagccaguccucugucuaucagccccgcaaacuccacucagucaccaccuaugcccauuuauaauagcacacacgucgcuucuguggugaaccaguccgucgaacagaugugcaauuugcuccugaaagaucaaaagccaaagaaacaggguaaguacaucugugaguauugcaaccgggccugugcuaaacccaguguuuuacugaagcauauacgcagccacaccggcgaacgaccuuacccaugcgugacuuguggguuuucuuucaaaacaaaguccaaucucuacaagcauaaaaagucacacgcccauaccauuaaacuuggacugguauugcagccggacgcaggcggucuauuucugagucacgagagccccaaggcccucucgauccacuccgauguggaagacucuggggagagcgaggaagagggagcuacggaugaaagacaacaugaccugggcgcgauggagcuucagccuguccacauuaucaaaaggaugucaaacgcagagacccuguugaagaguuccuucacaccaucuagccccgaaaaugugaucggcgacuuucuccugcaggaucgguccgccgagucacaggcuguuacugaauuaccuaaaguggucgugcaucacguaaccguuagcccacugcguacagacagucccaaggccauggauccgaagccugagcuaucuuccgcacaaaaacagaaggaccuccaggugacuaacguccagccacugagcgccaauaugucgcaagggggagugucacgccuugaaaccaacgagaauucucaccagaaaggugauaugaaccccuuggagggcaagcaggacagucaugucgggacagugcacgcucagcugcaaagacagcaggccaccgauuauucccaagaacagcagggaaaacuccugagcccuaggucucuuggcagcacugacuccgguuacuucucacggagugagagcgcagaucagacgguuucucccccaacaccuuuugcgcgacgccugcccuccaccgaacaagacucagggagaaguaacggcccaagcgcugccuuggugacuaccuccacaccgucugcacucccuaccggagagaaggcccuguuacugcccggccagaugaggccaccccuagcuacuaagacacucgaagagcggauuucgaaacugauaagcgauaaugaggcccuuguagacgacaagcaguuggauucagucaaaccucgcagaacgucccugaguaggcgugggucuaucgacagcccaaaguccuauauuuucaaagauucauuccaguuugaccucaagcccgugggacggcgaaccucuagcaguuccgauaucccuaagagcccguucacuccaacagaaaaaucuaagcaaguuuuucuguuaucagugcccucccuggacugccuuccuauaaccagaaguaacagcaugccaacaacugguuacucggcaguccccgcuaauauuaucccuccgccccauccauugaggggcucucaguccuucgaugacaaaaucggggccuuuuaugaugacguguucguaagcggaccuaacgcgcccgugccacagucaggccacccucgcacccucguucggcaggccgcuauugaggauaguucugcaaaugaaucccauguccuggguacggggcaaagccuagacgagucacaccagggcugccacgccgcuggagaagccaugagugugagaagcaaggcacuggcgcagggcccccauaucgagaaaaagaagucccaccaggggaggggaaccauguuugagugugaaacaugccgcaaccgauaccggaaacucgagaauuucgaaaaccauaagaaauuuuauuguucugagcugcacgguccaaagacuaaaguggccaugcgugagccggaacauagcccuguccccggcgggcuucaaccacagauuuugcacuacagaguugcuggauccucaggcauaugggagcagaccccccaaaucaggaagcgccggaaaaugaagucugugggugaugacgaagagcugcagcagaaugaaagugggacaucgccuaagagcuccgagggcuuacaguuccaaaacgcccucggaugcaauccaucucugcccaaacacaacgugacuauuagaucagaccagcagcauaagaauauccagcuucaaaacagccacauccaucugguagcaaggggcccugagcagaccauggauccgaaauuguccacgauuauggaacagcagauaaguucugcugcccaagacaagaucgagcuccagcgacacgggacaggaauuagcgucauccagcacaccaauucacugucccgcccaaacaguuuugauaaacccgaaccuuucgagcgggcaagccccgugucuuuucaagaacuaaacagaacuggcaaguccgguucacugaagguuauugggaucagccaggaggagucgcauccaucuagggacggaagucacccucaucagcucgcccuguccgaugcucuucguggcgaauugcaggagagcucacgcaaaucccccucugaacggcacgugcugggucaaccaagcagauuagucaggcagcauaauauacaggugccugagauccucguuacagaagagccggaccgagaucuggaggcgcagugucacgaccaagaaaagagugagaaauucuccuggccccagcggagcgaaacccuuucuaagcugccaacugagaaacuaccucccaagaagaaacgccucagacuggccgagauugaacacucaaguaccgaguccagcuucgauucuacauugucgaggucacugagccgggaauccaguuuaucucauacgagcuccuuuucagcaagucucgacaucgaggaugugucuaagaccgaagcuagcccaaaaauugacuuccugaacaaggccgaguuucuuaugaucccugccggccugaauacuuugaacguacccgggugccaccgagagaugagacgcacagcuuccgaacagauaaauuguacccagacaucaauggaggucagcgaucucaggucuaaauccuucgacugcggaaguauuacuccgccacaaaccacgccucugacagaacuacagcccccaagcucgcccucccgugugggcgugaccgggcaugucccucugcuugagcggagaaggggaccgcucguucgccagaucucucugaacauugcacccgacucacacuugagcccagugcacccuacuaguuuucagaauaccgcccugcccuccguaaacgcggugccuuaccaaggcccacaguuaacaucuacuagccucgcugaauucucagccaauacccugcauucccagacacaagucaaggaucuucaggcagagacgaguaacagcucuucaaccaauguguuucccguucagcagcugugugacaucaacuugcucaaucaaauacacgccccuccaucccaucagagcacucagcugucucuacaggugaguacacaagguucgaagcccgauaaaaacuccguccugagcgggucaucuaagagcgaggacugcuucgcuccgaaauaucagcuucacugucagguguuuaccuccggaccuaguugcucaucuaauccaguucauagccuccccaaccaggugaucuccgauccugucggcacugaccacugcguaacaagugcaacccugccaacgaaguugauugauagcauguccaacucucaccccuuacugccgccugaacuccgaccccuggguucacaagugcagaaaguuccaagcucguucaugcuuccuaucagacugcaguccagugugcccgccuacuguuuugcgacuuugaccucucuaccacaaauucuggucacacaggaccuccccaaucagccuaucugccagaccaaccauagcgugguaccaauaucagaggaacaaaauuccgugccgacucugcagaagggccaccagaacgcucuucccaauccugagaaggaauucuuaugugagaacgucuuuucugagaugagucagaauagcucccugucagaaagccucccaauuacacaaaaaaucucuguugggcgguugaguccccagcaggaguccagcgccucaucuaagaggaugcuguccccugcaaacucgcucgauaucgccauggaaaaacaucagaagcgcgcuaaagacgagaauggagccgugugcgcaaccgaugugcguccacuggaggcucuuagcaguagagucaacgaagccucuaagcaaaaaaagcccauucuggugcggcagguuuguacaacugagccuuuggacggcguaaugcuagaaaaggacguguucucccagccggagaucagcaaugaagcggucaaccugaccaaugugcucccagccgauaacucaaguacggggugcuccaaauucguugugauugagcccauaagcgaguuacaagaauuugagaauaucaagucuucaacaagccugacccuuacugucagguccucuccugcacccagugaaaacacccacauuucgccacugaaauguacagacaauaaccaggagcgcaagagcccuggagugaaaaaccagggcgauaagguaaauauccaggaacaaucccagcagcccgucacuucacucucuuuguucaacauuaaggacacccagcaacuggcuuuuccaagccucaaaacgacaaccaauuucacuuggugcuaucugcuucgacagaagagucuacaccugccgcagaaagaucagaagacauccgccuacaccgacuggacugugucagcuucuaacccuaaucccuuggguuuaccaacaaaaguugcacuggcccuccugaacagcaagcaaaauaccgggaagucccuuuauugucaggccaucacgacucauaguaaaagcgaucugcucguguacucuucaaaguggaaauccagcuugaguaagagagcucugggaaaccagaaaucuaccgucguggaguuuuccaauaaggacgcgucggagauaaacagcgaacaggauaaggagaauucacuaaucaaauccgaaccccggaggauuaagaucuucgacggcgguuauaaaucuaacgaggaauacguuuacgugcgcggcagagggaggggaaaguauauuugcgaggaguguggcauccggugcaaaaagccuaguaugcugaaaaagcacauacguacacauaccgauguccgcccauaccacugcacauauuguaauuuuagcuucaagacuaaagggaaccucaccaagcauaugaaaucaaaggcacacuccaaaaagugcguggaccuuggaguaagcgugggccugauugaugaacaagacacggaggaaucugacgagaagcagcgauuuaguuacgagagauccgguuaugauuuagaagagagcgacgggcccgaugaagacgauaaugagaacgaagacgaugacgaggauucacaggccgagucuguuuugucggcuacaccuagcgucacugccuccccgcaacaccugccaaguaggucuucacuccaggaccccgugagcaccgaugaagacgugcggaucacagauuguuucuccggaguccauaccgacccuauggacguacugccacgcgcacuucugacuagaaugaccgugcucaguacagcccagucugauuacaacaggaaaacguugagccccggcaaggcucggcagcgagcggccagagacgagaaugauacuaucccuuccguugacaccucacgcagccccugccaccaaaugucuguggauuauccagaauccgaggaaauucugaggaguucaauggcaggcaaagcugucgccauaacacagagcccgucguccgugcgguuaccucccgcagccgcugagcauucuccacagaccgccgcggggaugccuaguguugcaagcccccacccagacccucaggagcaaaagcagcagaucacucuacagcccacaccgggacugccaucaccucauacccaccucuuuucccaccuuccccugcauucucaacagcagagccguacgccauacaacauggugcccgucgguggcauucacgugguaccugccggguugacuuacaguacauucgugccgcugcaagcuggaccaguucagcucaccauccccgccgucuccguggugcauagaacccugggcacucacaggaauacagucaccgaaguuagcgguacaacuaacccugcugggguggcagagcuuucuucaguagugcccuguauuccaaucggacagauacgcgucccuggccuccagaaucuguccacgcccggcuugcaaagccugccaaguuuaucuauggaaaccgugaacaucguugggcuagccaauacaaacauggcuccucaggugcacccgcccggacuggcccucaaugcagucggucuucagguacugacugcgaacccaucaucccagagcucgccugccccccaagcucauauuccaggcuugcagauccugaauauugcccucccuacccugauccccucugugagucagguugcaguggaugcucagggggccccggagaugccagcaucccaaagcaaagccugcgaaacacagccuaagcagaccucagucgcuucugcgaaccaggugagccggacugaguccccccaaggacuuccaacgguccagcgagagaaugccaagaaaguguuaaaccccccugcacccgcuggcgaccacgccagacuggauggucucaguaagauggacaccgaaaaagccgcaucagcuaaucauguuaagccaaaaccugaguugacaagcauacaggggcaaccggccuccacuucucagccccugcuaaaggcgcacagugaaguguucaccaagccaagcggacagcagacacuguccccugauaggcaaguaccccgcccaaccgcucucccucggagacagcccacugugcauuuuucagacgucucuucggacgaugacgaggaucgucuuguuauugccacauga

SEQ ID NO: 57238 - RNA, 7341 nt, Artificial Sequence
  derived and/or modified sequence opt3 from HIVEP2__Homo_sapiens__NP_006725
auggacaccggcgauacagcccuggggcagaaggcuacuagcagauccggagagacggacaaagcaucugguagguggcggcaagaacagucagccgugaucaagaugaguaccuucggcagccacgaggggcagcgccagccccaaauugaaccugagcagauaggaaacacagcguccgcucagcucuuuggcucugguaaacuugccucgccaucagaagucguucagcaaguggcagagaagcaguacccgccccaucgaccuagcccauauaguugccagcacucccugucuuucccccagcauagcuugccucaagggguaaugcacuccacuaaaccacaucagucauuagagggacccccuuggcuguuuccaggcccgcuacccaguguggccagcgaagaucucuucccuuuuccaauccacggccacucugggggauacccccguaagaagauuuccucacugaauccugcuuauagccaguacagucaaaaaucuaucgagcaggcagaagaggcccauaagaaagagcacaagccaaaaaagcccgguaaguauauuuguccguacugcuccagagcuugugccaaaccuagcguccuuaagaaacauaucaggucgcacaccggcgaacggcccuauccaugcauaccuuguggguucucuuuuaagacaaaauccaaccuguacaagcaccgcaaaucacaugcgcacgcaaucaaggccggauuggugcccuucaccgagagugcuguuagcaagcucgaccuggaagccggcuuuauugauguggaggcagaaauccauuccgacggugagcagucuacugauacagacgaggaaagcucacuguucgcugaggccagugauaaaauguccccagggcccccuauuccacucgacaucgcgagcagaggaggcuaccacggcucuuuagaagagucacuggggggaccgaugaagguccccauacuuauuaucccuaaaagugguauuccauugcccaaugaaagcucccaguauaucggcccugauaugcugccaaaccccucucuaaauaccaaggccgacgauucgcauacggugaaacaaaagcucgcacugaggcuuagcgagaagaaagggcaggacuccgagccgucacugaacuugcucaguccucacucuaagggaagcacugacuccggcuacuuuucacggagcgaaucugcugagcagcagaucuccccacccaauaccaacgccaaaaguuaugaagagauuauauucgguaaguacugccgccugagcccucgaaaugcuuuaucuguaacaacuaccucccaagaaagagccgcaauggggaggaaaggcaucauggagccccugccacacguuaacacacggcucgaugugaagauguuugaggacccugucucacagcuuauucccaguaagggagauguggacccaagccagaccucgaugcugaaauccacgaaguucaauucugaaagccgucagccgcaaaucauaccuucaaguauucgcaacgagggcaaauuguaucccgccaauuuccagggguccaacccagugcuacuggaagcucccgucgauucuagcccucucaucagauccaauucaguuccaacuagcagugcgacaaaccugaccauccccccuucucuuaggggaucccauagcuuugacgagcggaugacugguucggaugacguguucuacccgggcacaguagggauuccaccccagcgaaugcugcgcagacaggcagccuuugaguugccuucagugcaagaaggacacgucgagguggaacaucacggcaggaugcucaaggguaucucuaguuccagccugaaagagaagaaguuaucuccaggggaucggguuggcuaugacuacgaugugugucgcaaacccuacaagaaaugggaagacagcgagaccccuaagcagaacuauagagacauuuccugccugucaagucuaaaacacggaggcgaguacuucauggauccggucgugccccuccaggggguaccaagcauguuuggaacgaccugugaaaauaggaagcgucggaaagagaagucuguuggugacgaagaggauacaccuaugauaugcuccucaaucgugaguacucccgucggcauuauggcuagcgacuaugauccaaagcugcaaaugcaggaaggggugcgauccggauucgccauggcaggccaugagaaccuuucucacggucauaccgagagauuugacccuuguaggccccaguugcagccagggucgccgagccuggucucagaagaguccccuagugccaucgauucugacaaaaugagcgaucucggcggacgcaagcccccaggcaaugugaucuccguuauucaacacacaaacucacugucucggcccaauagcuucgaaagaagugaguccgcugaacuuguggccugcacucaggacaaagcaccuagcccaucugagaccugcgauucagagauauccgaagcgcccguaaguccugagugggcuccgccaggggacggagccgaaagcggcgguaagcccucgccuucucagcagguccaacagcaguccuaccauacacagcccaggcuggugcgccaacacaacauccagguuccagagauucgagugaccgaggaaccugauaaacccgagaaggaaaaggaggcacagagcaaagaaccagagaagccugucgaggaauuucaauggccgcagcggucagagacuuugagucagcuccccgccgaaaaacugccaccuaagaaaaagcguuuaagacuggcugacauggagcacucuuccggggaaagcucauucgagaguacgggaacaggccuaagcaggucccccucucaggagagcaaucucucccauucaucuaguuuuucgaugagcuucgaacgcgaggaaaccuccaagcugucugcccuuccaaaacaagacgaguuugguaagcacucagaauucuugacugugccugcaggcagcuauucccugaguguacccgggcaucaccaucagaaagagaugcggagauguucuagcgagcagaugccgugcccacacccugcugaagugcccgagguuaggucaaaguccuucgauuacggaaaccucagucacgccccagucagcggcgcggccgcuucuaccgugucccccucacgagaacgcaaaaaguguuuucuggugcggcaggcaagcuucucggggucuccugagaucagucaaggagaggucggcauggaccaguccguuaagcaggaacaguuagagcaucugcacgccggucuuagaagcggguggcaucacggaccgcccgcuguguugccaccucuccaacaggaagaucccggcaaacagguggccgguccuugcccaccccugucauccggcccucuacaccuggcacagccacaaauuaugcauauggacucucaggagagccucaggaauccccugauccagccgacaaguuauaugaccuccaagcaccuuccugaacaaccacauuuguuuccccaccaggagacuauaccuuucagcccaauccagaacgcgcuguuucaguuccaauaccccacaguauguaugguccauuuaccggcccagcagccucccugguggcaggcucacuuuccacacccuuucgcccaacauccccagaaaucuuacgggaagccaucauuucagacggagauucacaguuccuauccccucgaacauguggcagagcacaccggaaaaaagccugcugaauacgcccacacuaaagagcagacauauccaugcuacagcggcgcaucugggcugcauccgaagaaucuucugcccaaguucccuucggaucaaucaagcaaauccaccgaaacaccaagugagcagguuuugcaggaggacuuugccucugcuaacgcgggaagccuccaaucccugcccggcacuguggucccugugcguauccagacccacguuccaucauaugguagugugauguacacgucuauuagccagauccuagggcagaauucccccgccauaguaauuuguaaggucgaugaaaacaugacccaacgcacacuggugacuaaugcagcuaugcagggaaucggcuucaacauugcccaggugcucggucagcaugccggccuggagaaauauccuaucuggaaggcuccgcaaacccuuccauuggggcuggaaucaagcauacccuuaugccucccuucuacauccgacagugucgcaacucugggaggcagcaaacggaugcuuucgcccgccuccucucuggagcuauuuauggaaaccaagcagcagaagagaguuaaagaggagaagauguacgggcagaucguggaagagcucucagcgguagaacugacgaacagcgauauuaaaaaggacuugaguaggccacaaaaaccucagcuggugcgacagggaugugcuuccgagcccaaggauggcuuacagucugguagcucauccuucaguagccucucuccaucauccagccaagacuacccgucugucaguccuucgucccgggagcccuuccugccaagcaaggaaaugcuuucagggucucgcgccccccugccuggacagaaaagcuccggcccaagugagucaaaggaaucuagcgaugaguuggacaucgacgaaacagcauccgauaugaguaugagcccccaguccucuucacucccugccggcgacgggcaacuggaggaggaaggaaaaggucacaagagaccggugggcaugcuaguuaggauggcuagcgcaccaucggggaauguggccgauuccacccugcuucucacugacauggcggauuuucagcagauucugcaguuccccaguuugcggacaaccacuaccgucucuuggugcuuucugaacuauacaaaaccuaauuacgugcaacaggcuacguucaagagcucaguuuaugccuccugguguaucucuaguugcaacccaaaucccagcggauuaaacaccaagacuacacucgcacugcuucgauccaaacagaagauaaccgccgagauuuacacacuggcugccaugcauagaccuggcacugguaaauugaccucaagcucugcauggaagcaguuuacgcaaaugaaacccgacgcuaguuuccucuuuggguccaagcuggaacgcaagcuagugggaaauauccugaaagagaggggcaagggcgauauccacggggacaaagauauuggaagcaagcagacagaaccaauccguauuaaaauauucgaggguggcuauaagucaaacgaggacuacgucuauguacgggggagaggaaggggcaaauacaucugcgaagagugugguauucgcugcaagaagccgucuaugcuuaaaaagcacauccgaacccauacugaugugagaccuuacguuuguaaacucugcaauuuugccuucaagaccaaagggaaccugacaaagcacaugaaguccaaagcgcauaugaagaaauguuuggaauuaggagugucgaugacuagcgucgacgacaccgagacagaagaggccgagaaucuggaagaucuccacaaggcagcugagaaacacaguaugucuuccauuagcacggaccaucaguuuucagaugccgaagagagugacggcgaggauggcgacgauaacgacgaugacgaugaagacgaggaugacuucgacgaucagggggaccugacccccaagacucgguccaggagcacaucuccacaaccuccccgcuucucaagccuuccagugaauguaggagcugugccucacgguguccccuccgauucuagucugggccauucgagcuugaucuccuaucuaguuacccugccgucaauacgugugacucagcucaugacaccaucugacagcugcgaagauacccagaugacggaguaccaaagacuguuucagaguaaguccacugacucagaaccugauaaagaccggcuugauauccccucuuguauggacgaggagugcauguuaccaagcgaacccuccaguagcccuagggauuucucuccgucaucccaccauagcaguccaggguaugacucuucccccugucgcgauaacucgccuaagcgauaccugauucccaaaggagaccucagcccaagacggcacuugucaccuaggcgcgaccugucccccaugagacaccucucuccaaggaaggaggcagcccugcggcgugaaaugagucagcgcgaugugagcccucgaagacaucuuucaccgaggcggcccgucuccccaggcaaagacaucaccgcccgcagagaucugagcccuaggcgggagcgaagauauaugacaaccauucgcgcucccucuccaaggcgggcguuguaccacaauccuccccuaaguaugggucaguaucugcaagcagaaccgaucgugcucgggccaccuaacuuacguagaggacugccccagguuccauacuuuucccuuuacggcgaccaggagggcgccuaugagcaucccgggagcucacuguucccugaaggacccaacgauuacguauuuucucaccucccauugcauucgcagcaacaggugagggcuccuauaccgaugguccccguggguggcauucagaugguucacagcaugccaccugcccuguccagucuccaccccucuccaacucugccucuucccauggagggguucgaagagaagaagggagcaucaggcgaaagcuuuuccaaagacccguaugugcuaaguaagcagcaugagaaacgcgguccucacgcccugcaaucuagcgggccacccuccacaccuucaagcccacgguuguuaaugaagcagucuaccuccgaggauagucugaaugcuacagaacgagagcaggaagagaacauccaaacuugcaccaaagcgaucgccucacucagaauugcaacggaggaagcugcccugcuuggacccgaccagccugcaaggguccaggagccacaucagaauccccugggcagcgcccacgugucgauacgccacuucucccggccggaaccuggccaacccuguacaucugcuacccauccagaucuccacgacggggagaaggauaacuuuggaacuagucagacccccuuggcccauagcacauucuacucaaaauccugcguagacgacaagcagcuggauuuucacucuagcaaggaacuaaguuccagcacugaggagucuaaagacccuucauccgaaaagagccagcugcauuga

SEQ ID NO: 57239 - RNA, 2085 nt, Artificial Sequence
  derived and/or modified sequence opt3 from HJURP__Homo_sapiens__NP_001269891
augcugggcacccucagagccauggagggggaagacguggaggaugaccagcuucugcaaaaguugagggcuagccggcgccgauuccagcguagaaugcagagguuaaucgaaaaauacaaccagcccuuugaggauacaccugucguucaaauggcaacucugacguaugaaaccccacagggacuacggauuugggguggccgccucauaaaggagagaaaugagggggaaauccagccggccgugccccaguccccucugaaaaacgagcuuaggcggaaguaccugacacaaguagacauuuugcuccagggagcggaauauuucgagugcgcuggcaaucgcgccggucgagaugugagagucacuccacugcccucucuggcaagcccugccgugccagcucccggguacuguaguaggaucagccggaaauccccuggagacccagcaaagccggccucuucgccccgugagugggauccucuccacccaucaagcaccgacauggcuuuaguuccccgcaacgauagucugucccuucaggaaacaucuagcuccucauuuuugaguagccagccuuucgaggacgaugacauuugcaaugugaccaucucugaucuguaugccggcaugcuacauuccaugucaagacuccugagcacuaagccaaguucuauaaucuccacaaaaaccuuuauuaugcaaaacuggaauagcaggcggcgacaccgcuacaagucgagaaugaacaaaacguauuguaagggcgcgaggcggucucagcgcuccucaaaagaaaauuucauccccugcagugagccggucaaggggacuggagcacuuagagacuguaagaacgugcuggacguaagcugcaggaaaaccgguuugaagcucgaaaaagccuuucuggagguuaaucguccucagauucauaaguuagaucccuccuggaaagagcggaaggugacaccaucuaaauacagcucacugaucuacuucgacaguuccgcuacuuauaaccucgaugaagagaaucgauuuagaacccuuaaguggcugauaagcccugucaagauugugucuaggcccacaauccgccaaggccacggggaaaaccggcagagagagauugaaaucagguucgaccaguugcaucgcgaguacugucuaucaccacgaaaucagccccggcguaugugccugccugauaguugggccaugaacauguauagaggaggcccagcaagcccgggugggcuccaaggacuggagaccaggcgccuuucccugcccucuucgaaagcuaaggccaaaucauuguccgaagcguuugagaaccucggcaagcggucacuggaagccggcagauguuuaccuaaaagugacucuagcuccucacugccaaagacgaaucccacucacagcgcaacaaggccucagcagaccucugaucuacacgugcaggggaacuccaguggaaucuuccgaaagagcgucucuccauccaaaacucucucaguucccgacaaggaggugccgggucauggccgcaaucgguacgaugaaauuaaagaggaguuugacaagcugcaccaaaaauauugccuuaagaguccugggcagaugacaguaccauuguguauaggagugagcaccgauaaggcuucgauggaagucagauaccagacggagggcuuccuggguaaacucaaccccgacccucauuuccagggguuucaaaagcugcccuccucuccacuuggcugcaggaaaagccuguugggaucaaccgccaucgaagcuccuaguuccacaugcguggcccgugcaauuacucgcgacggcacccgggaucaccaguuccccgccaagagaccaaggcucucugagccgcaggggagcggacgacaggguaauucccugggcgcuucagacgggguugauaacacagugcggccuggagaccaaggcagcaguucucagcccaauuccgaggaacgcggugagaacacuagcuauagaauggaagagaaaucggauuuuauguuagaaaagcuggagaccaagucagucuga

SEQ ID NO: 57240 - RNA, 2754 nt, Artificial Sequence
  derived and/or modified sequence opt3 from HK1__Homo_sapiens__NP_000179
augaucgccgcucagcugcucgcauacuauuucaccgagcuuaaggacgaucaagugaaaaagauugacaaauaccuguaugccaugagauugagcgaugaaacauuaauagacaucaugacuagguuucggaaggagaugaaaaacggccugucccgcgauuucaaucccacggcgaccgucaagaugcuaccuacauuuguucgaucuauuccagacgggucagaaaagggagauuucaucgcucucgaccuggguggcaguagcuuucguauucuuagagugcagguaaaccacgagaaaaaucagaacgugcauauggaauccgaggucuacgauacuccggagaauaucgugcacgggucuggaucgcagcuguucgaccauguugccgaaugcuugggcgauuuuauggagaagaggaaaauaaaggacaaaaagcuccccguggguuucaccuuuucauucccuugucaacagagcaagaucgaugaagcaauucugaucacauggaccaaacgguuuaaggccaguggggucgagggagcugacgugguaaaacugcucaacaaggcaauuaaaaagcgcggcgacuaugaugccaauaucguugcuguggucaacgacacugugggcacaaugaugaccugcggguacgaugaccagcacugugaggugggauuaauaauugguacgggcacuaaugccugcuauauggaagaacugagacauaucgaucuugucgaaggggacgagggaaggauguguauuaacaccgaauggggcgcguucggugaugacggguccuuggaggauauccggacagaguuugaccgcgaaaucgaucgaggaucucugaauccaggcaaacagcuauucgagaagaugguuagcggcauguaccucggggaacuggugagacuuauucugguaaagauggcaaaagagggauugcuguucgaagguaggauaacucccgagcuguuaacccggggcaaguuuaacacauccgacgugucagccaucgagaaaaauaaggaagggcugcacaacgcuaaagagauucucacccgucuuggagucgaaccuagugacgaugacugcgugagcguucaacacguguguacgaucgucucuuuccgcuccgccaaucugguggcagcuacuuugggcgccauacuaaacagacugagggauaacaaggguacaccacggcuccgaaccacuguagggguugacggcucacuguacaagacacauccccaguauagccgcagauuucacaaaacccuuaggcggcuggugccugauagugacguccgcuucuugcucucugaguccggaagcggcaagggggcggccauggugacggcagucgcuuacagacuggccgaacagcauaggcagauugaggagaccuuagcucacuuucaccugacaaaagauaugcuacucgaagugaagaaacguaugcgggccgagauggaacugggacuucgaaagcaaacucauaauaacgcaguugugaagauguugccaucguucguaagaaggaccccggacgguacagagaauggcgauuuucuggcccucgaccucgggggaacuaacuuccgcguccuucuggugaaaauccggucuggcaagaaaagaaccguugagaugcacaauaagaucuaugcuauucccaucgaaauuaugcaggguacaggggaggaauuguuugaucauauaguguccugcaucucagacuuccucgauuacaugggcauuaaaggaccuaggaugccacugggcuuuaccuucaguuuucccugucagcaaacuagcuuagacgcggggauccugaucacguggacaaagggauucaaggcaaccgacugcgucggucacgaugugguaacucuacuccgcgacgccauuaaacgacgggaggaguucgaucuggacgugguugcugucgugaacgauaccgugggcacaaugaugaccugugccuaugaggagccuacuugcgaagucgggcuuauaguuggaacaggcuccaaugcaugcuacauggaggaaaugaagaacguggagaugguggaaggugaccaggggcagauguguaucaauauggaguggggcgccuuuggagauaacggcugcuuggacgauauucguacgcauuaugacagacugguagaugaguacucucucaaugcugggaaacagagguacgaaaagaugaucagcggaauguaucugggcgagauuguccgcaacaucuuaauagacuucaccaaaaaggguuuucuguuccgggggcaaaucucagaaacucuuaaaacaagaggaauuuuugagaccaaguucuugagucagaucgaauccgauaggcucgcccugcuacaggugcgagcaauucugcagcaacucggccugaauagcacaugugacgacucuauccuuguuaagacugugugcggugucgugucacgccgggcggcucaguuguguggcgccgggauggcagccguuguggauaaaauaagagagaacaggggacuggaccguuuaaauguaaccgucggcguggaugggacgcucuacaagcugcacccacacuuuagucgcauuaugcaucagaccgugaaagagcuuagccccaagugcaacgucuccuuccuguugucugaagacggaucgggcaaaggugcugcccucaucacagcaguuggggugcggcugagaacugaggcuagcuccuga

SEQ ID NO: 57241 - RNA, 2754 nt, Artificial Sequence
  derived and/or modified sequence opt3 from HK2__Homo_sapiens__NP_000180
augaucgccagccaccuucucgcuuacuucuuuaccgagcuuaaccaugaccaggugcaaaaggucgaucaguaucuguaccacaugagauuguccgacgaaacauuacuggagauuucuaaaagguuccggaaggaaauggagaaaggccuaggggcaacuacgcaucccaccgccgcgguuaagaugcucccuacauuugugcgcucaacuccagauggaaccgaacacggugaguuccuggcucuugaccugggcgggacaaauuuucgaguauugugggugaaagucaccgauaacggacuccagaagguggagauggaaaaucagauauaugccaucccggaggacauuaugcguggcagugguacucaacuguucgaucauaucgcagaaugccuggccaacuuuauggacaagcuccagauuaaagauaagaaauuaccccugggguucacauuuagcuucccuugucaccagaccaagcuggacgaguccuuuuugguuucuuggacgaaaggauucaagucgucaggcguggagggcagagaugucguggcucugaucaggaaggcaauacagcggcgcggggacuuugauaucgacauuguagccguugugaaugacacugucggaaccaugaugacaugcgguuacgaugaccacaacugugaaaucggccuaauuguggggacuggaagcaaugcuugcuauauggaggaaaugagacauaucgauaugguggagggcgacgaagguaggauguguauaaacauggaguggggagccuucggggaugacggcagucucaaugauauucggaccgaguucgaccaagaaaucgauaugggcucccugaacccagggaaacagcuuuuugagaagaugauuucuggaauguacaugggugaacugguccgcuugauccucguuaaaauggcgaaggaggaacuguuauucggcgggaaacugagccccgagcuccuuaauacaggacgauuugagaccaaggacaucuccgauauugaaggcgagaaagacgguauaagaaaggcaagggaagugcugaugcgguuggggcuagacccuacgcaggaggauugcguagccacucaccguaucugucagauugugucaacacgcagugcuagccugugcgccgcaacccucgcugccguccugcaaagaaucaaggaaaacaaaggcgaggagaggcuucggucuacuauaggaguggacggcuccguuuauaagaaacauccacacuucgcgaagcgacugcacaaaacagugcgcagauugguccccgggugugaugugagguuucuccggucagaagacggaagcgguaagggcgccgcaaugguaaccgcuguugccuaccgccuggcugaucagcauagagccaggcagaagacguuagagcaucugcaacuaagucacgaccagcuccuggaagugaaacgucggaugaaggucgagauggagcgagggcuuucuaaagaaacccacgcauccgccccugugaagauguugccaacauacgucugcgcuacuccggauggaaccgagaaaggcgacuuccuggcgcucgaucugggugggacaaauuuuagagugcuucugguuagggugcgcaacggcaaguggggaggcguagaaaugcauaauaagauuuaugcaaucccccaggaggucaugcacgggacuggagacgaauuguucgaucacaucgugcaguguauugccgacuuucucgaguacauggguaugaaaggcguuagccugccuuuaggguucaccuuuucguucccaugccaacagaacucucuggaugaguccauccuacucaaguggacaaaaggauuuaaggcuucaggcugcgaaggugaggacguggucacccugcuuaaagaagccauucaucggagagaggaguucgacuuggaugugguagcagugguuaacgacacugucgggacgaugaugacauguggcuucgaagauccccacugcgaggugggacugauagugggcaccgggaguaaugccuguuauauggaagagaugaggaacgucgaacucguugagggagaagagggccgcaugugcgugaauauggaguggggugcuuuuggggacaacggaugucuggaugacuuccgaacugaauuugauguggccguagacgaguuaagccugaauccuggcaagcagcgguucgaaaagaugaucuccgguauguaccuuggcgagauuguccguaacaucuugaucgauuuuaccaaaagagggcuccuguucaggggacgcauuucugagcggcuaaagacaagaggcauauuugaaaccaaauuccugagccagaucgagucagacugccucgcacugcuucaagugagggcgauuuugcagcaucugggguuagaaaguacuugugaugacuccaucauuguuaaggaggugugcacagucguggcucgacgcgccgcacagcucuguggagccggcauggcugccguuguggaucggaucagagaaaauaggggucuggacgcacuuaaaguaacggucgggguggacggaacccuguauaaguugcacccacacuuugcuaaagugaugcaugagacugucaaggaucucgcccccaagugcgacguuagcuuccugcagucugaggauggcucagguaaaggcgcggcccuaauaacagcuguggcaugucguauccgcgaagccgggcaacgguga

SEQ ID NO: 57242 - RNA, 2772 nt, Artificial Sequence
  derived and/or modified sequence opt3 from HK3__Homo_sapiens__NP_002106
auggacagcaucggcuccucugggcugagacagggagaggaaacccucucaugcagugaggaaggucuucccggcccuagcgauuccucugagcuggugcaagaauguuugcagcaguucaaggucacaagggcccaguuacaacagauucaggcuucgcugcuagggucaauggagcaggcacuccggggacaagccagcccagcgccggcuguucgcaugcugcccacuuacgugggcaguacgccucacgguaccgagcagggggacuuuguagugcuugaacugggagccacaggcgcauccuugcgaguccucugggugacucugaccggcauagaggggcaucguguugaaccaagaucucaggaguucgugaucccccaggaggucaugcugggagccggucaacagcucuuugauuucgcugcacacugcuuaagcgaauuucuggacgcccagccugugaacaaacaaggccuucaguugggguucuccuuuucauucccaugucaucagacaggacuggauaggaguacccuaauuagcuggacuaagggcuuucggugcucugguguagaggggcaggacguugugcaacuccugcgcgaugcuaucagaaggcagggagccuauaauauugacgucguggcgguggucaacgauacaguuggcaccaugaugggcugugaacccggggugcggccuugcgagguaggacuuguggucgacacggguacuaaugcauguuacauggaagaggcccgccacguggcuguucuggaugaggaccgaggcagagugugcgucuccguggaaugggggucauucagcgaugacggagccuugggcccaguacucaccacauuugaccauacucuggaucacgagaguuuaaacccgggugcacagagguucgagaaaaugaucgggggccuguaucucggagagcuuguucggcugguguuggcucaccuagcccguuguggcguccuguuugggggaugcaccucucccgcgcuccugucccaggguagcauacuucuggaacauguggccgagauggaggacccuucgacaggcgcagcucgcguccacgccaucuugcaagaucucgggcugucuccaggagcuuccgacguggaauuaguucagcaugugugugccgcaguaugcaccagagccgcucagcugugcgcggcagcccuagcugccguccucucaugucugcagcacaguagggagcaacagacgcuucagguggcaguugccacuggcggucgggugugcgaacgacacccccgcuucuguagcgucuugcaggggacagugaugcugcucgcuccugagugcgauguaucccugauuccaucuguggacggcggaggcagagggguugccauggucaccgcaguggcggcuaggcuugccgcacaucggcgccuguuggaagagacucucgcccccuucagacugaaucacgaucaauuagcugccgugcaggcacagaugaggaaggcuauggccaaaggacugcguggugaggcgagcucacuacggaugcucccgacauuuguccgagccaccccugacggcagugaaagaggggauuuccuggcucuugacuugggaggcacgaacuuuaggguucugcucgugcgcgugaccacagguguacaaaucacuuccgagauuuacagcauccccgaaaccgucgcacaggggucuggccagcagcuguucgaucauauaguggacuguauuguugacuuucaacagaagcagggauuaucaggccagagucugccacuuggguucacauuuagcuucccuugccggcaauugggacucgaucagggcauccugcuaaauuggacuaaggguuuuaaagccuccgacugugaggggcaggauguggucucucugcucagagaggcuauuaccaggcgccaggccguggaacugaacguuguggcaaucguaaaugacacagucggaaccaugaugucgugcggcuaugaggauccccgaugugaaaucggucuuauugugggcacugggacgaacgcgugcuacauggaggaauugcggaauguggccggagucccaggcgacagcgggcguauguguauaaacauggaguggggagcuuucggcgaugacgguucccuggccauguuaucaacaagauuugaugcaaguguugaccaggcuucuaucaaucccgggaagcaaagguucgagaaaaugauuagcggaauguaucucggcgaaaucgugcgccacauacugcuucaucugaccuccuuggguguacucuuucggggccagcaaauucagagacugcagacuagggauaucuucaagaccaaauuccuaucagagaucgaaagcgacucucuggcccuccgacaggugcgcgcaauucuggaggaucuuggguugccucugacauccgacgacgccuuaaugguccucgaagugugccaagcuguuagucagcgggcggcccagcugugcggagcaggcguggcugccgucguggagaagaucagagagaacagggggcuugaagaacuggccguuagcgugggagucgauggcacccuauacaagcuccacccacguuuuucuucccugguagcugcaacugugcgcgaauuggccccgcgguguguugugacauuccugcagucagaggacgguagugggaaaggagcggcuuuagucacggccguggcaugcagacucgcccaacugaccaggguauga

SEQ ID NO: 57243 - RNA, 2754 nt, Artificial Sequence
  derived and/or modified sequence opt3 from HKDC1__Homo_sapiens__NP_079406
auguucgccgugcaccugauggcuuuuuacuucagcaagcucaaagaggaccagaucaagaaagucgauagauuucuuuaucauaugaggcuguccgacgauaccuuguuagacauuaugcggcgcuuccgagcagaaauggagaagggccuggccaaagauacaaaccccacugcggcuguuaagaugcuaccuacguuugugcgugccauaccagacgggucugaaaauggagaguuccucucacuggaucuugguggcaguaaguuuagaguacugaaagugcaagucgcagaagaggggaagaggcacgugcagauggagagccaguucuacccgacccccaacgaaaucauucggggaaauggcacagaguuguuugaauauguugccgacugccucgcugauuucaugaaaacuaaggaccugaaacauaagaagcugccucucgguuuaaccuuuuccuucccaugucgccagacaaaacuggaggagggggugcuuuugucuuggaccaagaaauuuaaggcaagaggaguccaagauacugacgugguaucgaggcugacaaaagccaugcggcgccacaaggauauggacguugacauccuagcucucgugaacgauaccgucggcacgaugaugacuugcgccuacgacgaucccuauugugaagugggcgugauuaucgggaccggaacaaaugcgugcuacauggaggacaugucaaacauagaucuggucgaaggugacgagggccgaauguguaucaauacugaauggggagcauucggggaugacggcgcccuugaggauauuagaaccgaguucgacagggaacuggauuuggguagccucaacccugggaaacagcuguuugagaagaugaucaguggauuauaucugggcgaacucguucggcuuauucuguugaagauggcuaaagccggccuacuguucgggggagagaaguccucugcacuccauacaaaagguaagaucgaaacccgucacguggcugccauggagaaauacaaggagggccuggcgaauacgcgcgaaauacuuguagaccugggguuggagccaagcgaagccgacugcauugcagugcagcacgucuguacuaucguguccuuuagaucagcuaaccucugcgccgcugcccuggcagccauuuuaacaaggcugcgggagaauaagaaaguugaacgacuacgcaccacugugggaauggauggcacacucuacaagauccauccccaguauccuaaaagacugcacaaggucgugaggaaacuuguaccaaguugugacguucgguucuugcugagcgagucugguuccaccaagggggcugcgauggugacggcagucgccucacgcgugcaagcucagagaaagcagaucgauaggguccucgcccuguuucagcuuacccgugagcaacugguggacguucaggcaaaaaugcgggccgaauuggaguacggccucaagaaaaagagccauggacuggcuacagugcgaauguuaccgacuuauguaugcggccugcccgaugggaccgaaaaaggaaaguuccuagcccucgaccuggguggcacaaacuuuagaguccuuuuggugaagauuaggagugggcgccggucuguuagaauguacaauaaaauauucgcaaucccucuggagauuaugcagggaacuggcgaggaacucuuugaucacaucgugcaauguauagcggacuuccuggauuauauggguuuaaagggggcuucccugccacuuggcuuuaccuucagcuuucccugcaggcagaugucgauugacaaaggaacauugaucggcuggaccaagggguucaaagccacugauugcgagggagaagacgucguggauaugcuccgcgaggcaaucaagcgacggaacgaguucgaccuggacauuguagccgugguuaaugauacggucgguacaaugaugaccuguggcuacgaagacccuaacugcgagaucgggcuaauugcuggaacuggcucuaacauguguuauauggaagauaugcguaauauagagaugguggaagguggggagggcaaaaugugcaucaacaccgaauggggaggcuuuggggacaauggauguauugaugacaucagaacaagguacgauaccgagguggacgagggcucccugaacccagguaagcagcgcuacgaaaagaugacuucagggauguaucucggagagaucguccggcagauucugauagaucuuacaaaacaaggcuugcuguucagaggucagaucagugaaagguuacgaacgcgcggcauuuuugagaccaaguuccucagccagaucgaauccgaccggcuggcccuucugcagguuagaaggauuuugcaacagcucgggcuggauucuacuugcgaggacagcaucguggugaaagagguauguggagcagucucacgucgcgcugcccagcuaugcggcgcggggcuggccgcuauaguggaaaagcggagagaggaucagggacucgaacaccugaggaucacaguuggcguggacgguacccuuuacaaauugcauccccacuuuagucggauucugcaagagacagucaaggaguuagcaccgcgaugugacgugacuuucaugcucuccgaagaugggagcggaaagggcgccgcucugaucaccgccguugcaaaacgccuucagcaggcgcagaaggagaauuga

SEQ ID NO: 57244 - RNA, 1098 nt, Artificial Sequence
  derived and/or modified sequence opt3 from HLA-A__Homo_sapiens__NP_001229687
auggccgugauggcucccagaacccugcuccuucuguugagcggcgcauuagcccugacacagacuugggcggggucccacucuaugagguacuucuuuacgucagucagucggccuggacgcggugagccacgauucaucgcuguuggcuauguggacgauacccaauuuguacguuucgacagcgaugccgcaucccagaagauggaaccgagagcccccuggauugagcaggaagggccugaguacugggaccaggaaacaaggaacaugaaagcucauucucaaacugaucgggcaaaucuaggaacccuccgcggcuauuacaaccagucggaggacgguucacacacaauacagaucauguaugggugcgaugugggaccagacggcagauuucugaggggcuaccggcaggaugccuaugacgggaaggauuacauugcucuuaaugaggaccugcgcagcuggaccgccgcggauauggcagcccaaaucacuaaacgaaagugggaagcuguccaugccgcagagcagagaaggguguacuuggaaggacgguguguugacggucuccgucgcuaucuggagaacggcaaagagacacugcagagaaccgaucccccuaagacgcacaugacucaucacccaauuagugaccacgaagcuacccucaggugcugggccuuaggguucuaccccgcggagaucacacugacuuggcagcgggacggagaagaucaaacccaggacacagagcuuguggaaacccgaccugccggcgaugguacguuucagaagugggcagcugucgugguaccauccggggaggagcaacgcuauacuugucauguucagcacgaaggauugccgaaaccccugacacuaagaugggagcucucuagccagccuaccauaccaaucgugggcauuaucgccggccugguccuucugggggcugugauuacuggagccguggucgcagccguuauguggaggcggaaguccucagaccgcaaagguggcaguuacacacaggcugcgagcucugauuccgcacaagggucagacgugagcuugaccgccugcaagguauga

SEQ ID NO: 57245 - RNA, 1089 nt, Artificial Sequence
  derived and/or modified sequence opt3 from HLA-B__Homo_sapiens__NP_005505
augcuggugauggcccccagaaccguccuccuucuguugagcgcugcauuagcccugacagagacuugggcgggcucccacucuaugagguacuucuauacgucaguuagucggccugggcgcggagaaccacgauuuaucagcguggguuacguagacgauacccaguucgugcguuuugacuccgaugcugccucuccgagagaggaacccagggcaccuuggauugagcaagaaggcccagaguauugggaccggaacacacagauauacaaggcccaggcucagacugaucgcgagucgcuaagaaaucucaggggguauuacaaccaaucagaagcaggaagccauacccugcagaguauguauggcugcgacgucggucccgaugggcggcuucugcgcggacacgaccaguacgccuacgauggcaaagacuauaucgcuuugaaugaggaucuccgauccuggacagccgcggacaccgcagcccagauuacucaaagaaagugggaagcugccagggaggcagagcagcggcgugcuuaccuggaaggcgaguguguggaauggcugcgcagauaucucgagaacgggaaagauaaguuagaaagggccgacccuccaaaaacacauguuacccaccaucccaucucugaccacgaggcgacgcugcggugcugggcccuuggauucuacccugcagagauuacuuugaccuggcagcgagauggugaagaccagacacaagauacugagcugguggaaacccgcccagcuggcgacagaacauuucagaagugggccgcugucgugguaccgagcggggaggaacagagguauaccugucacguucaacaugagggacuacccaagccucucacgcugcggugggagccauccucacagaguacugugcccaucgucggcauaguggccggucuugcagugcuggccgucguugugaucggggcuguaguggcggcagucaugugccgcagaaaaagcucuggaggcaagggcggguccuacucacaggccgcuuguagcgauagugcccagggaucugacguguccuugacagcauga

SEQ ID NO: 57246 - RNA, 1101 nt, Artificial Sequence
  derived and/or modified sequence opt3 from HLA-C__Homo_sapiens__NP_001229971
augagagugauggcccccagggcucugcuccuucuguugagcggcggguuagcacugaccgagacaugggccugcucccacucuaugcgguacuucgacacugcggucucacgcccuggacgaggugaaccacguuuuaucaguguuggcuacguggaugacacgcaguucguaagauuugauagcgacgcugccuccccgaggggagagccccgggcaccuuggguggaacaagaggggccagaauacugggaucgcgagacccagaacuauaagagacaggcccaggcugacagggucucucuacggaaucuccgcggcuacuauaaccaaucggaggaugguucacauacacugcagcgaauguacgggugugaccuuggacccgauggcagacuguugaggggcuaugaccagagcgcauacgaugggaaagacuacaucgcccucaaugaagaucugcggaguuggacugcugccgacaccgcggcacagauaacacaacguaagcuggaggccgcucgcgccgcagaacagcucagagcuuauuuagagggaaccugcguggaguggcugaggcgguaccuugaaaacgguaaagagacuuugcagcgagccgaaccuccaaagacacacguuacccaucacccccuguccgaccaugaggcgacgcuacgcuguugggcccucggcuucuauccugcagaaaucacucugaccuggcagagagauggggaggaccaaacacaggauacugagcuuguggaaaccaggccagcuggagacggcacauuucagaaaugggccgcugucgugguaccgucuggucaagagcagcgguauaccugccacaugcagcacgaagggcugcaggagcccuugacgcucagcugggaaccuuccucacaaccaacuauucccaucaugggaauuguugccggccuggcaguguuagucgugcuggccgugcucggcgcugucguuacagcgaugaugugucgcagaaagaguagcgggggaaaggguggcucuugcucccaggcagccuguucaaauagcgcucaggggagugaugagucucuuauuaccugcaaagccuga

SEQ ID NO: 57247 - RNA, 786 nt, Artificial Sequence
  derived and/or modified sequence opt3 from HLA-DMA__Homo_sapiens__NP_006111
augggccacgagcagaaccaaggggccgcucugcuccagaugcuuccccuguugugguuacugccucauagcugggcagugccagaagccccgacccccauguggccugacgaucuacagaaucacacauuccuccauacugucuacugccaggacggauccccaucuguuggucugucagaggcguaugaugaagaccaacuguuuuucuuugauuucagucagaacacgagagugcccaggcuuccugaguuugcugacugggcccaggaacagggcgaugcaccagccaucuuguucgacaaggaguuuugugaguggaugauucaacagauagggcccaaacucgauggaaagaucccuguaagccggggcuucccaauugcugaaguguuuacccugaaaccgcuggaguucgguaagcccaauacacucgucugcuuuguguccaacuuauucccuccaaugcugacuguuaauuggcagcaccauucugugcccgucgaaggguuuggaccuaccuucgugucggcaguagacggccuuucauuccaggccuuuagcuacuugaacuucacaccagagcccagugauaucuuuuccuguauuguuacccacgagaucgaccgcuauacugcuauagccuacugggugccgcgaaaugcgcugccuucugaucuacucgaaaacguccugugcggcguggcauucgggcuuggagugcuggguaucauugucggcaucguuuugauuaucuauuuucguaaacccuguagcggggacuga

SEQ ID NO: 57248 - RNA, 792 nt, Artificial Sequence
  derived and/or modified sequence opt3 from HLA-DMB__Homo_sapiens__NP_002109
augaucaccuuccugccccuccuucugggcuugagcuuagggugcacaggagccgguggcuuuguggcucacgucgaguccacuugucugcuagacgaugcagggacgccuaaggacuucaccuacugcauuucuuuuaacaaagaucuccugacauguugggacccagaagagaauaagauggccccgugcgaguucggaguucuuaacucacuggcgaauguguugagucagcaucucaaccaaaaagauacucugaugcagagacugaggaauggccuccagaacugugcuacccacacacagcccuuuugggguagcuuaaccaaucggacucgcccuccauccguacaaguggccaagacaacccccuucaacacgcgagaaccugucaugcuggcaugcuauguguggggguuuuacccagccgaaguuacuauaaccuggcguaaaaauggaaaacuugugaugccccauucuucggcucacaagacagcacagccuaacggcgacuggacuuaucagaccuugucacaucuggcccuaacaccaagcuacggcgauaccuauacgugugucguggagcacacuggggcuccggagcccauccucagagacuggacaccuggacugaguccaaugcagacccuuaagguauccguuucugccgugacucuggguuugggccucauuaucuucagccugggggucauuuccuggaggcgggcgggacacucaaguuacacacccuuaccuggcagcaauuauucugaagguuggcauaucuccuga

SEQ ID NO: 57249 - RNA, 753 nt, Artificial Sequence
  derived and/or modified sequence opt3 from HLA-DOA__Homo_sapiens__NP_002110
auggcccugagagcuggccucgugcuuggguuccacacccugaugacauuguuaagcccccaggaggcaggagccacuaaggcggaccauauggguuccuacggcccugcuuuuuaucaaucuuacggggccucaggacaguucacgcacgaauuugaugaggaacagcuguucagugucgaccucaaaaagagcgaggcaguuuggaggcuaccagaauuuggcgauuucgcccgguuugacccgcagggugggcuggcuggaaucgcagccauuaaagcucaucuugauauacugguggagcgcuccaaccgaucucgugccaucaauguacccccuagagugaccgucuugccaaagucgaggguggagcucggccaacccaacauucugaucugcauuguugacaauaucuucccuccagugauaaacaucacauggcugcggaauggccagacugucaccgaagggguggcgcagacaucauuuuauagccagcccgaucaccucuuccgcaaauuucauuacuuaccuuucguaccaagugcagaggacguuuaugauugucaaguggaacacuggggacuggacgccccgcuuuugagacacugggagcugcagguccccauuccuccacccgaugcuauggagacccuagugugcgcccucggucuggcaaucggccuugugggguuucuggucggaacuguuuugauuaucaugggcacauacguguccucuguaccuagguga

SEQ ID NO: 57250 - RNA, 822 nt, Artificial Sequence
  derived and/or modified sequence opt3 from HLA-DOB__Homo_sapiens__NP_002111
augggcagcgggugggugcccugggucguugcccugcucgugaaccuuaccagacuggacuccucuaugacacagggaacugauucaccugaggacuucguaauccaagcuaaggcagauugcuacuuuacgaaugguaccgaaaaagugcaguucgucgugagguuuauuuucaacuuggaggaauauguucgguuugacagugaugugggcauguucgucgccuuaacaaagcuggggcagccagacgcggagcaguggaauagccgccuagaucuccuggaacgaucccgucaagcuguggacggaguauguagacacaacuacaggcuuggcgccccguuuacuguuggucggaaagugcagcccgaggucaccguguauccugagcgcacaccacuguugcaucagcacaaucuccugcauugcucugugaccggguucuaccccggagauauaaagaucaaaugguuucugaacggccaggaagagagagcaggcgucaugucgacugggccuauuaggaauggagacuggacauuccaaaccguugugaugcucgaaaugacgccagaguuaggucacguauauacuugucugguggaucauucaagccuuuugagucccgucuccguggaguggcgggcccagucugaauacagcuggcgcaagaugcuguccggcaucgcugcauuucuacucgggcugauuuuccuucugguuggaaucgugauacaguugcgagcccagaagggcuaugucagaacccaaaugucagguaacgaggugaguagggcuguacuccugccucagagcugcuga

SEQ ID NO: 57251 - RNA, 783 nt, Artificial Sequence
  derived and/or modified sequence opt3 from HLA-DPA1__Homo_sapiens__NP_001229454
augagacccgaggacaggauguuccacauccgggccgugauucugcgcgcucucagccuugcauuucuguuguccuuacgaggcgccggggcgauaaaggcugaucaugucucuaccuacgccgcauucguucagacacaccguccuacuggagaauuuauguucgaguuugacgaagaugagauguucuauguggaccuggauaaaaaggaaacgguauggcaucuagaggaguuuggucaagccuucucauuugaagcucagggcgggcucgcaaacaucgccauucugaauaacaaucuuaacacccugauccagagaaguaaucacacacaggcuacuaacgacccaccggaggugaccgucuuccccaaagaaccuguggaguugggacaaccaaauacacucauuugccauaucgauaaguuuuucccucccguucugaacgugaccuggcuguguaauggcgagcucgucacugaagguguggccgagagcuuauuucugccaaggacagacuacuccuuccacaaauuccacuaucuuaccuuuguacccucugcggaagauuucuacgacugccggguugagcauuggggguuggaucagccucugcuaaagcacugggaagcacaggagccaauacagaugccggagacgacugaaaccgugcucugugcccugggacuuguccugggcuuggugggcaucauuguggggacaguccucaucauuaagucgcugcgcucaggacaugaccccagagcucaagguacuuuauga

SEQ ID NO: 57252 - RNA, 777 nt, Artificial Sequence
  derived and/or modified sequence opt3 from HLA-DPB1__Homo_sapiens__NP_002112
augauggugcugcaggucagcgccgcucccagaaccguugcacucacagcccuucugaugguguuguuaacuuccguagugcaaggcagggcgacgccugagaacuaccuguuccaggggcggcaggaaugcuaugcuuuuaauggaacccagcgcuuccuagagcgauacaucuauaaccgugaagaguuugccagauucgacucugaugucggugaauuuagggcagugacagagcucggccggccagccgcugaguacuggaacucacaaaaggacauucuggaagagaaacgcgcaguuccggauagaauguguaggcacaauuaugaacuugggggacccaugacucugcagcggcgcgugcagccucgagucaaugugaguccaagcaagaaaggccccuugcagcaucacaaccuccugguaugccauguuaccgacuucuacccugguuccauacaagugagaugguuucugaaugggcaggaggagacagccggagucgugucuaccaaccucaucaggaauggcgauuggacuuuccagauuuuagugaugcuggaaaugacaccacagcaaggcgacgucuauaccugucagguugagcacacgucgcuugauucacccgugacuguagaauggaaggcucagagcgacagugcccgguccaaaaccuugacaggggcgggagguuuugugcugggccuaaucauuugcggggucggaaucuucaugcaucgucgcucuaagaaggugcaaagaggcagcgcauga

SEQ ID NO: 57253 - RNA, 768 nt, Artificial Sequence
  derived and/or modified sequence opt3 from HLA-DQA1__Homo_sapiens__NP_002113
augauccugaacaaggcccuccuucugggcgcuuuggcauuaaccacagugaugagccccugcgggggagaggacauugucgccgaucacguugcguccuguggugugaaucuguaccaguucuauggcccuucugggcaauacacucaugaauuugacggagaugagcaguucuauguagaccuagaaagaaaagagacggcuuggagguggccagaauuuucaaaguucggcgguuuugauccgcagggggcccuccggaacauggcaguggccaaacacaaucugaacauaaugaucaagcgcuacaauaguaccgcugcaacaaacgagguccccgaggugacuguuuucagcaaauccccugugacccuuggacagccaaauacacugauuugcuuggucgacaacaucuuucccccugugguaaauauuaccuggcucucuaacggccaaucgguuacugaaggcgugucagagacaucuuuccugaguaaguccgaucauagcuuuuucaagaucagcuaucugaccuuucucccauccgccgacgaaauauacgauuguaaagucgagcacuggggguuagaccagccccugcuuaagcauugggagccugaaaucccagcuccgaugucagaguugacggaaacuguggugugcgcccugggacuaagugucggucucaugggcauuguuguggggaccguauucaucauucagggacugcgaagcgugggcgcgucucgucaccaggguccccuuuga

SEQ ID NO: 57254 - RNA, 768 nt, Artificial Sequence
  derived and/or modified sequence opt3 from HLA-DQA2__Homo_sapiens__NP_064440
augauccugaacaaggcccuccuucugggcgcuuuggcauuaaccgccgugaugagccccugcgggggagaggacauugucgcggaucacguugcuuccuacggugugaauuucuaucagucucauggcccuucagggcaauacacacacgaauuugacggagaugaggaguucuauguagaccuggaaacuaaagaaacgguguggcagcuaccaauguuuaguaaguucaucagcuuugauccgcaguccgcccucagaaacauggcagucggcaaacauacccuggaguucaugaugaggcagucuaauucgacagccgcuacuaacgaggugcccgaaguuaccguguuuucaaaguucccugucacacuuggucaaccaaauacccugauauguuugguggacaacauuuuucccccuguaguuaauaucacuuggcucagcaacgggcacagugugacagagggagucuccgaaaccucuuuccugagcaaauccgaucauucauuuuucaagauuaguuaccugacguuucucccaagcgcagacgagaucuaugauugcaagguggagcacuggggcuuagacgaaccccugcuuaaacacugggagccugaaauaccagccccgaugucugaguugacugaaacccuggugugugcucuaggccucuccgucgggcugaugggaaucguuguggguacaguauucauuauccagggccuucggucagugggggccagccgccaucagggacuguuguga

SEQ ID NO: 57255 - RNA, 810 nt, Artificial Sequence
  derived and/or modified sequence opt3 from HLA-DQB1__Homo_sapiens__NP_001230890
augagcuggaagaaagcccugagaauccccggcgaccucaggguggcuaccgucacacuuaugcuggcaauguuguccucuuuacuggccgaggggcgggauucaccugaagacuucguuuuucaguucaagggaaugugcuacuuuacuaacgguacggagcgcgugcgauuaguaacccguuauauuuacaauagagaagaguaugcgagguucgauagugacgugggcgucuaccgggcugugacaccacaagggcgcccggaugccgaauauuggaacagccagaaagagguucucgagggaacuagagcagaacuggacaccguguguaggcacaauuacgaggucgccuuucggggcauacuucagcgccgaguggaacccacaguaaccaucuccccuucuagaacugaggcucugaaccaucacaauuugcucguuugcucggugacagauuucuauccaggucagauuaaggucaggugguuucggaacgaccaagaggaaaccgcagggguggugucaacgccccugauccguaauggagauuggacuuuccagauucuggucaugcucgagaugaccccucagcgcggcgacguuuacacaugucauguggaacacccaagccuacagagucccaucacuguagaguggagagcccaauccgaaucugcucagagcaaaaugcuguccggcgucgggggauuugugcuugguuugauauuccugggccuagggcucaucauuaggcagcggucacagaagggaccucaaggcccaccgcccgccggucugcuucauuga

SEQ ID NO: 57256 - RNA, 684 nt, Artificial Sequence
  derived and/or modified sequence opt3 from HLA-DQB2__Homo_sapiens__NP_001185787
auggcccugcagauccccggcggcuucugggcugcagccgugaccgucaugcucguuaugcuuagcacaccuguggcggaggcuagagacuuuccaaaggauuuccugguacaauuuaaaggaaugugcuacuucacuaacgguacggaaagggugcggggcgucgcccgcuauauuuacaaucgagaggaauaugggcguuuugacuccgaugugggagaguuccaggcaguuaccgaauugggcagaucuauagaggacuggaacaauuacaaggacuuuuuagagcaggaaagggccgcuguggauaaagucugucggcacaacuaugaggcagaacugcgcacaacucuacagagacaaguggagccgaccguaacaaucucacccaguaggaccgaggcccucaaucaucacaaccugcuuguuugcagcgugacugauuucuacccugcucagauuaagguccggugguuucgcaaugaccaggaagagacagccggugugguguccaccucucugauccgaaacggggauuggacguuccagauuuuggucaugcucgaaaucacuccacaaagaggagacauauauaccugucagguugagcaucccucgcugcagucaccuaucacaguggaauggaggccacgggggcccccuccagcgggccugcuccacuga

SEQ ID NO: 57257 - RNA, 765 nt, Artificial Sequence
  derived and/or modified sequence opt3 from HLA-DRA__Homo_sapiens__NP_061984
auggccaucagcggcgugcccguccugggguucuuuauuauagcuguucucauguccgcacaggagucuugggccaucaaggaagaacacgugauuauccaagcggaguucuaccuuaacccugaccagucaggagaguuuauguucgauuuugacggugaugaaauuuuccauguagacauggcuaaaaaggagaccguguggagacuggaggaauuuggcagguucgccaguuuugaggcacagggggccuuggcuaauaucgcagucgauaaagccaacuuagaaauaaugacaaagcggagcaauuauacuccaaucacgaacgugccgcccgagguuaccgugcugacaaauuccccugucgagcuacgcgaaccaaacgugcucauuugcuucaucgacaaauuuacucccccuguaguuaaugugaccuggcugcgaaacggaaagccagucacaaccggcgugucugagacuguguuccuuccccgugaagaucaccuguuuagaaaguuccauuacuugccuuuccucccaucgacagaggacgucuaugauuguaggguugaacacuggggucuggacgagccgcugcucaaacauugggaguuugaugcucccucaccuuuaccagaaaccacggagaaugugguaugcgcccuggggcuuacugugggauuggucggcauuaucauaggcaccauuuucaucauuaaggggcugcggaaaagcaacgcggcagaacgcagaggaccccuauga

SEQ ID NO: 57258 - RNA, 801 nt, Artificial Sequence
  derived and/or modified sequence opt3 from HLA-DRB1__Homo_sapiens__NP_001230894
auggugugccugagacuccccggcgggagcuguauggccguccuuaccguuacacugaugguguuguccucuccuuuagcucuggcaggagacacuaggccacgguuccuagaguacucaacgagugaaugccacuuuuucaacgguaccgagcgcguacgauaucucgaucguuacuuucauaaucaggaagagaacgugagauucgacagcgaugucggcgaauuuagggccgugacagagcuggggcggccggacgcggaguauuggaacucccaaaaggaucuucuggaacagaaacgcggaagaguugacaauuacuguaggcacaauuauggcguggucgagucuuucacugugcagcggcgcguacaucccaagguuaccguguacccuucgaaaacacagccauugcaacaccauaaccuccuggucugcucagugagcgguuuuuaucccgggaguaucgaagugcgaugguucagaaauggacaggaggagaagaccggcgucguuuccacuggccugauucacaacggggauuggacauuucagacccucgugauguuagaaacgguaccuaggucuggagagguguacacuugucaggucgaacacccaagcgugaccucaccccugacaguugaguggcgggcucguuccgaaagugcccaaagcaaaaugcuuucuggugugggcggguucgucuugggacugcuauuucucggcgcaggucuguucauauacuuucgcaaucagaaggggcauuccggacuucagccuagaggcuuccugucauga

SEQ ID NO: 57259 - RNA, 801 nt, Artificial Sequence
  derived and/or modified sequence opt3 from HLA-DRB3__Homo_sapiens__NP_072049
auggugugccugaagcuccccggcgggagcucccuugccgcucugaccgucacauugaugguuuuaucuucaagacuggcauucgccggagacacuaggccucgguuucuagagcuccgcaaaagugaaugucacuucuuuaacgguacggagcgagugcguuaccuggauagauauuuccauaaucaggaagaguuucuuagguucgacagcgauguaggcgaauaccgggcggugaccgagcuggggcgcccagucgcugaguccuggaacucucaaaaggacuugcucgaacagaaaagaggaaggguggauaauuauugccggcacaacuacggcguuggugagucguuuacagugcagcgccgaguccauccccaggugacuguauauccggccaagacccaaccucugcagcaccauaaucugcucguuuguucagugagcggguucuacccaggaaguaucgaagucagaugguuuaggaacggccaggaggagaaagcaggcgugguguccacaggguuaauucagaauggagacuggaccuuccaaacucuggucaugcuugaaacaguuccccggucuggugagguguauaccugccagguagaacacccuagcgugacguccgccuugacugucgaguggcgugcucgcucagaaagugcacagagcaagaugcugucuggcguugggggauuugugcuaggccuccuguuccuuggugccgggcuguuuauauacuucagaaaccagaagggacacuccggcuugcaaccaaccggcuuccucucauga

SEQ ID NO: 57260 - RNA, 801 nt, Artificial Sequence
  derived and/or modified sequence opt3 from HLA-DRB4__Homo_sapiens__NP_068818
auggugugccugaagcuccccggcgggagcuguauggccgcucuuaccgucacacugacuguuuuguccucuccuuuagcacuggccggagacacgcagccaagauuccuagagcaagcgaaaugcgaaugucacuuucucaacgguaccgagaggguguggaaucugauccgguacauuuauaaccaggaagaguacgcucgcuauaauucagaucuuggcgaauaccaggccguaacagagcuggggcgaccggacgcagaguauuggaacagucagaaggauuugcucgaacguagaagggccgagguggacacuuacugccgguauaauuacggagucguggagagcuucaccguucaacgcagagugcagcccaaagucacaguguacccuuccaagacccagccacugcagcaucacaaccugcucguauguucuguuaauggcuuuuaucccgguucgauagaagugaggugguuccggaacgggcaagaggaaaaagcuggagucgugucaacuggcuuaauccagaauggcgauuggacauuucagacccuggugaugcuugagacggucccucgcagcggggaaguuuacacuugccagguggagcauccaaguaugaugucccccuugaccguacaauggucugcacgaagcgaauccgcccagucaaagaugcugaguggaguggguggcuucguccuagggcuccuguuucuuggaacaggccuguucauuuauuuuagaaaccagaagggucacagcggguugcaaccuacuggacuccugucuuga

SEQ ID NO: 57261 - RNA, 801 nt, Artificial Sequence
  derived and/or modified sequence opt3 from HLA-DRB5__Homo_sapiens__NP_002116
auggugugccugaagcuccccggcgggagcuacauggccaaacuuaccgucacacugaugguuuuguccucuccuuuagcucuggcaggagacacuagaccaagguuccuacagcaagauaaguaugagugucacuuuuucaacgguacggaacgggugcgcuuucuccaucgagacaucuacaaucaggaggaagaucugcguuucgacucagauguaggcgaguauagagccgugaccgaacuugggaggccggacgcggaguacuggaacagucagaaagauuuucuggaggaccggcgcgcugccgucgauacauauugcagacacaauuacggagugggcgagagcuucacuguucagaggcggguggaacccaaggucaccguguauccugcacgcacacaaaccuugcagcaucacaaccuccugguauguuccguuaaugguuuuuacccagggucuauugaagugcgaugguucagaaacucgcaggaggagaaagccggagucgugucaacuggccugauacagaauggcgacuggacauuucaaacccucgugauguuagaaacgguccccaggagcggggagguuuacacuugccagguggaacauccuaguguaaccuccccacugacaguggaguggcgggcucagucugaaagcgcacaguccaagaugcuuucaggagucgguggcuucguguuggggcugcuauuucucggagccggccuguucaucuauuuuaagaaccaaaaaggucacagugggcuucaccccacuggacugguuagcuga

SEQ ID NO: 57262 - RNA, 1077 nt, Artificial Sequence
  derived and/or modified sequence opt3 from HLA-E__Homo_sapiens__NP_005507
augguggacggcacccugcuccuucuguugagcgaggccuuagcucugacacagacuugggcagggucccacucucuaaaguacuuccauacgucagucaguagacccggaaggggugaaccucgguuuaucagcguuggcuauguggaugacacccaauucguacgcuuugauaacgacgccgcguccccacgaauggugccgcgugcucccuggauggagcaggaagggucugaguacugggauagagaaacaaggucggcccgggacacugcacagauuuuccgcgucaaucucagaacccugaggggauauuacaaccagucagaggccggcagccacacacuucaauggaugcaugguugcgagcuggggccugauggacgguuuuugcgcggcuaugaacaguucgcuuacgacggcaaagauuaucucacccugaaugaggaccugcgaaguuggacugcaguggauacagccgcucagauauccgaacagaagucuaacgacgccagcgaggcggagcaccaaagagcauaccucgaagauaccuguguugagugguuacauaaauaccuggaaaaggggaaagagacgcuuuugcaccuggaaccacccaagacucacgugacccaucacccuaucuccgaccaugaggccacacuaaggugcugggcucucggauuuuauccagccgagauuacucugaccuggcagcaggacggugaaggccacacacaggauaccgagcuugucgaaacgcggcccgcaggggacggaacuuuccaaaagugggcugccgugguaguuccuucaggcgaggaacagcguuacacaugucacgugcagcaugagggucugccagagccggucaccuugcgcuggaaacccgcgagucaaccuacuaucccaauuguggggaucauagccggacucgugcuguuaggcagcgucguuucuggcgcagugguagcugccgugaucuggagaaagaaauccucagggggaaaggguggcagcuauaguaaagcugaauggucugauuccgcccaggggagcgagucgcacucucuguga

SEQ ID NO: 57263 - RNA, 765 nt, Artificial Sequence
  derived and/or modified sequence opt3 from HLA-F__Homo_sapiens__NP_001091948
auggcccccagaagccugcuccuucuguuguccggcgcuuuagcacugaccgacacaugggccgggucucacucacuaagguacuucaguacugcggugagccggccuggacgcggugagccacgauauaucgcugucgaauacguugaugacacgcaguuucuccguuucgauuccgacgccgcaauuccgagaauggagcccagggaaccuuggguggagcaagaaggcccacaguauugggaguggaccacaggguacgccaaggcuaacgcacagacugaucggguagcccugcgcaaucuucugagaagguauaaccagucugaggcuggaucgcauaccuugcaaggcaugaaugguugcgacauggggcccgauggacggcuccugcgcggcuaccaccagcaugccuaugacggcaaagauuacauaucacugaacgaagaccuccgaagcuggacagcggcagauaccguggcccagaucacucagagauuuuacgaggcugaagaguaugccgaggaguucaggacauacuuagaaggggaaugucuggagcuuuugcggcguuaucuggaaaauggaaaggagacccuacaacgcgcagagcagaguccucagccaacgauucccaucgucgguauuguggcuggccucguugugcugggggccgucgugacuggagcgguaguugccgcagugauguggaggaaaaaguccucugacagaaaccggggcagcuacucccaggcugccgucuga

SEQ ID NO: 57264 - RNA, 1017 nt, Artificial Sequence
  derived and/or modified sequence opt3 from HLA-G__Homo_sapiens__NP_002118
augguggucauggcccccagaacccuguuccuccuucugagcggcgcuuugacauuaacugagacgugggcagggucccacucuaugagguacuuuucagccgcgguuagucggccuggacgcggugaaccacgauucaucgcuaugggcuauguggacgauacccaguuuguacguuucgacagcgauuccgccugcccgagaauggagcccagggcaccuuggguggaacaagaggggccagaauacugggaggaggaaacacggaacacuaaggcccaugcucagaccgaccgcaugaaucugcagacacuaagaggauauuacaaccagucugaggcaucgucacacacccuccaauggaugauuggcugugaucuggguagcgacgggaggcuucugcggggauaugaacaguacgccuaugauggcaaagacuacuuggcucucaaugaggaucugcgcaguuggacugccgcggacacagcagcccagauauccaagcgaaaaugcgaggcugccaacgucgcagaacagagaagggcuuaccuggagggcaccuguguggaauggcuccaucgguauuuagagaaugggaaggaaaugcugcaacgugccgaucccccuaaaacgcacguuacucaucacccaguguuugacuacgaggcgacccuucgcugcugggccuugggauucuaucccgcagagaucauucugacauggcagagagauggugaagaccagacucaggacgucgagcuaguggaaaccaggccugcuggcgaugggacauuucaaaagugggccgcuguaguugugccaucuggagaggaacagcgguacaccugucacguccagcaugagggccucccggagccccugaugcuucgauggaagcaaagcucccugccuacgaucccaauuauggguaucguggccggguuggugguccucgcagccguugugacuggagcugcgguagcagccgugcuguggcgcaaaaagucaagugacuga

SEQ ID NO: 57265 - RNA, 2622 nt, Artificial Sequence
  derived and/or modified sequence opt3 from HLCS__Homo_sapiens__XP_005261010
augcugaucacccucugcuaccuuuaucugugggccagauggggcaggcggcccgcugaguuggugcgcgcaacaguccgacguuuaagagccuccagguguagcuucacuuuuugcggggcggcugcccagccuccaggagcacggguuugucugucucgcgguggcagaguguucugcguaucagacagucaaagcauugaagaucuaaacaagugggcccucuuucugguguccccguucauacuugaggcugaacacaucgcauuugucacggagucuauuugggugcagucggaaaaucugcagaggucaagcaguuccgagaccaucguuaaauggucugacuguugcuugccccucgccugucggccuggggauccauaccgccugauugcugaggccagcguggacaacuucuccaagcugggagucgcguuuauggaagaucgacuccauauggacaauggcuuagugccccagaaaaucguaucaguucaucugcaagauaguacacuuaaggaggugaaagaccaggucagcaacaagcaggcacagauauuggaaccuaagccagagcccucucuggagaucaaaccugaacaagaugguauggagcacguggggagagacgauccaaaggcccuaggagaggaaccgaaacagaggcggggcuccgcuucaggcagcgaacccgccggggacagugaucguggagguggcccuguggagcacuaucaucuccaccugucuuccugccacgagugucuugaacuggagaauagcacuauugaaucggucaaguucgcaucugcugagaacaucccagacuugcccuacgacuauuccucaagucucgaaagcguugccgaugagaccuccccugagcgcgaagggagaagggugaaucugacaggaaaagcgccaaacauuuuacuguacguaggcucugacagccaggaggcccucggucgguuucaugaagugcgaucaguccuugcagauugcguggacaucgauaguuauauacuguaccacuugcuagaggacuccgcucugcgcgaucccuggaccgacaauugucuccugcuuguuauugccacuagagaaagcaucccggaggaucuguaccagaaguucauggcuuauuugucucaagggggaaaggugcucggccugucaaguagcuuuacauucggcggguuucaggucaccuccaaaggagccuuacauaagacggugcagaaccugguauucucuaaagcagaccaaucggagguuaagcuaagcgugcucuccucagguugcagguaccaggaaggcccuguccggcugagucccgggcgccuucagggacacuuggagaaugaagauaaagacagaaugauugugcacgucccauucggcacuagggguggggaggccgugcugugccagguucaucucgagcugccucccucuagcaacaucgugcaaaccccagaagacuuuaaucuucugaaguccucaaacuuccgucgguaugagguauugcgagaaauccucacaacucugggcuuaagcugugauaugaaacagguccccgcucugaccccucuauaccuccugucugcggcagaggaaauuagagacccacuuaugcagugguugggaaagcacguggauuccgagggcgagauaaagagugggcagcugagccucagguuuguuucuuccuaugugucagaagucgagaucacaccgaguugcauucccgugguaaccaauauggaagccuucagcucggagcauuuuaaccuggaaaucuaccgccaaaacuuacagacgaaacagcugggaaaggugauacuuuucgcugagguuacuccuacaaccaugcgguugcucgacggucugauguuucagacuccacaagagaugggccuaauugucaucgccgcaagacagacagaagggaaaggaaggggcgguaauguguggcugucccccguggggugugcccucucuacccugcuuaucagcauuccuuugcgcucacagcugggccagcgaaucccauucguccaacacuuaaugaguguugcugugguggaggccguacgguccauucccgaauaucaggauauaaaccuccgugucaaguggccgaaugacaucuacuacucugaucugaugaaaauuggaggcgugcuuguuaacagcacgcugaugggggagaccuuuuauaucuugaucggaugcgguuucaaugugacaaacuccaauccuacuauuuguauaaacgaccucaucaccgaauacaauaagcagcauaaggcagagcugaaaccacuaagagcggauuaucugauugcuagggucgugacaguucucgagaagcugaucaaagaauuucaagacaagggccccaacucagugcuuccuuuguacuaucgcuacuggguacacagcgggcagcagguccaccugggaagugccgagggccccaaagugucuauuguggguuuagaugacuccggguuccuccagguccaucaagaaggcggagagguugugacuguacacccagauggcaauagcuuugacaugcugcggaaccuuauccugccuaagagaagguga

SEQ ID NO: 57266 - RNA, 888 nt, Artificial Sequence
  derived and/or modified sequence opt3 from HLF__Homo_sapiens__NP_002117
auggagaagaugagcagaccccugccucucaacccaaccuucaucccgcccccuuacggcgugcuuaggucccuguuggaaaauccauuaaaacugccccuacaccaugaggacgccuuuucuaaggauaaagacaaggagaaaaagcucgaugacgaaucaaacaguccuacagucccacagagcgcuuuccuggggcccacucuuugggauaagacgcugccuuaugacggagauaccuuucaauuggaauacauggaccucgaggaguuccuguccgaaaaugguauuccaccgucucccucgcagcacgaucauucaccucacccacccggccugcagccugcaagcagugccgcgccauccguuauggaccucucuagccgggcuuccgcccccuuacauccggggauaccuucacccaacugcaugcagaguccaauccgcccuggacaacugcuucccgcaaaucgaaacacaccaagccccauugauccugacacuauccaggugccaguaggcuaugagccggaucccgccgacuuggcucugucuuccauuccuggucaggaaauguuugacccacguaaaagaaaguucucagaggaggaacuaaaaccccagccuaugaucaagaaagcaaggaagguguuuauaccagaugaccucaaggaugacaaauacugggcccggcgcagaaagaauaacauggcugccaaaaggagccgggaugcgcgccgacugaaggagaaucaaaucgcaauuagagccaguuuccuugaaaaagagaacucugcucugaggcaggaagucgccgacuugcggaaggagcucgggaaauguaagaauauccuggcaaaguaugaggcucgucacggacccuuauga

SEQ ID NO: 57267 - RNA, 3030 nt, Artificial Sequence
  derived and/or modified sequence opt3 from HLTF__Homo_sapiens__NP_003062
augagcuggauguucaagagagaccccguguggaaauaccugcagaccguccaauauggcguucacgggaacuuuccuaggcucuccuacccaacauucuuuccgcgguucgaguuucaggaugugauucccccugacgauuuccuuacuucugacgaagagguagauucagugcuguuuggaaguuugcgcggucaugucgugggcuuacgauauuacacggggguugugaauaacaaugaaauggucgcccugcagcgugacccaaacaaucccuaugauaagaacgcuaucaaagugaauaacguaaauggaaaccagguuggccaccuaaagaaagagcucgccggugcacuggcguacauaauggacaauaaacuugcucaaaucgaagggguggucccuuucggagccaacaaugcauuuaccaugccacugcauaugacauucuggggcaaggaggagaacagaaaagccgugagcgaucaguugaagaaacacggcuuuaagcucgggcccgcuccuaaaacucugggauucaaucuggaauccgguuggggcucugggagggcaggaccaucguauucaaugccggugcaugccgcuguccagaugaccacagagcagcucaagaccgaauuugacaaguuauucgaggaucugaaagaggacgauaagacucacgaaauggagcccgccgaagcgauugagacaccucuuuugccacaccaaaaacaggcacuggccuggaugguuagccgggaaaacaguaaggagcuacccccuuucugggagcagcgcaacgaccucuacuacaauaccaucacgaacuuuuccgaaaaagacagaccagagaaugugcauggcgguauucuggcugaugacauggggcuuggaaagacucugaccgccaucgcaguaauauugacaaacuuccacgauggcaggccccucccgaucgaacgggugaaaaagaaucuguuaaagaaagaguauaacgucaaugacgauucuaugaagcugggcgggaacaauacuagcgaaaaagcugacggacucuccaaggaugccucacgcugcagugagcagccuagcauuucugacaucaaagagaaguccaaguuucgaaugucagaacuuagcaguucuagacccaaaaggcggaagaccgcggugcaauacauugaguccagcgauucggaagagaucgaaacaucugagcugccacagaaaaugaaggguaaauugaagaacguucaguccgagaccaagggccgugccaaagcagggucaaguaaggugauagaagacgucgcuuucgccugugcucuaacgagcuccgugccuacuacaaagaagaaaaugcugaagaagggagccugcgcaguagagggcucuaaaaagaccgauguugaagaacgccccagaacuacacucauuaucuguccacugagcgugcuuucaaauuggauugaccaauuuggucagcauaucaaaagugacguccaccugaacuucuauguguacuaugggcccgauaggauccgggagccugccuugcucuccaagcaggacauuguccugaccacguacaauauauuaacccacgauuauggcacaaaaggagacagcccacugcauucuauccgauggcuacgcgugauucucgaugaaggccacgcuaucagaaacccgaaugcgcagcaaacuaaggcaguucuggaccuugagucagaaaggcgguggguguugaccgggacacccauacagaacagucugaaagaucucuggagccugcuuuccuuucugaaguugaagccuuucauugaccgcgagugguggcauagaacuauccagaggccaguaaccaugggagaugaagguggccuccgucggcugcagucuuuaaucaaaaacauuacacugcgaagaaccaagacuucgaaaaucaaggggaaacccguccuagagcucccugagaggaagguguuuauucaacacauaacgcugagcgacgaggagcgcaagaucuaccaguccguuaaaaaugaaggacgggccacaauuggcagauacuucaacgaggguaccgugcuugcucauuaugccgaugucuuggggcugcuccugagguuacgccagaucugcugucacacuuaccugcuuaccaaugcagugucaaguaacggcccaucuggaaaugacacacccgaagaguugcgaaagaaacucauccggaagaugaaacugauucuaagcuccggcucagaugaggaaugcgccauaugucuggacagccucaccguaccggugaucacucacugcgcucaugucuuuuguaagccuugcauuugucagguuauccaaaacgagcagccacacgccaagugcccccugugccguaaugacauucaugaagauaaccuuuuggaguguccucccgaggaacuggcaagagacucugagaaaaaguccgauauggaauggacaaguagcucuaaaaucaaugcguuaaugcacgcucucacggaccugaggaagaaaaacccaaauauaaagucccuuguggugucacaguucaccacuuuucugaguuugaucgagauuccucucaaggccagcggguucgucuucacacgccuggauggaucgauggcacagaaaaagcggguugaauccauccaaugcuuucagaacaccgaggccgguucucccacaauuaugcuacugagccucaaagcuggcggggugggacugaaucuuucagccgcaaguagaguguucuugauggacccagcuuggaacccggccgcggaggaucaguguuuugacaggugccaccgacugggccaaaagcaggaaguaaucauaacuaaauucauugucaaggauuccguggaggaaaauauguuaaaaauccagaacaagaagcgcgagcucgccgcuggugcauuugggaccaaaaagccuaacgccgacgaaaugaaacaggcuaagauuaaugagauccggacgcugauagaucuuuga

SEQ ID NO: 57268 - RNA, 1467 nt, Artificial Sequence
  derived and/or modified sequence opt3 from HLX__Homo_sapiens__NP_068777
auguucgccgcuggccuggcacccuuuuacgccagcaacuucucccucuggucugcggcuuauugcucaagugccgggccuggagguuguagcuuuccacuugacccggcagccgugaagaaacccuccuucugcaucgcugauauucugcacgcaggcgucggggacuugggagccgcuccugagggcuuagccggugcgucugcagccgcucugaccgcccaucuagggucgguucacccacaugcaucauuucaggcugccgcgagaagcccccucaggccuacaccagugguagcccccagugaagugccugcaggauucccacaacggcuguccccgcuuucugcugccuaccaccaucaccacccccagcagcagcaacagcagcagcaaccucagcagcagcaaccacccccuccaccccgcgcuggcgcccugcagccgccugcaagcggcacucgagucgugcccaauccacaucacuccgggucagccccugcucccaguagcaaggauuugaaauuuggaauagaccguauccucucugcggaguucgauccaaagguuaaagaagguaacacgcugagagaccugaccucccucuuaacaggcgggaggcccgcaggagugcaucugucaggccuucagccuagcgccggucaauuuuucgcuaguuuggauccaauuaaugaggccucugcaauccuguccccgcuaaacagcaauccccggaacucgguccagcaccaguuucaggacacuuucccugggccauaugccgugcucaccaaggauacaaugccccaaaccuacaagcgcaaaagaucuugguccagggcuguauuuucaaaucugcagcggaagggacuugaaaaacgcuucgagauucagaaguauguuacuaaaccugaccgaaagcagcuggccgcaauguugggccucacagaugcgcaagugaaggucugguuccagaacagaaggaugaaauggcggcacaguaaggaggcucaggcccagaaagacaaggauaaagaagcaggcgagaagccaagcgggggagcccccgcugccgacggugaacaagacgagcguuccccgucucgcagcgagggcgaagcagagucagaaaguuccgauagcgagucucuggacauggcuccuucagauaccgaaagaacggaggggagugagaggagcuuacaucagacuaccgugaucaaagccccagugacaggagcgcugauaacugccuccucugcuggcucgggugggagcuccggcggaggcgggaauagcuuuaguuucucuagcgcauccucacucucaucuuccaguaccagcgccggaugugcuucuucccuugguggcgggggagccucagaacuguugcccgcaacacagccuaccgcgaguagcgcccccaagucgccagagccugcucagggcgcccuagguugccuguga

SEQ ID NO: 57269 - RNA, 1134 nt, Artificial Sequence
  derived and/or modified sequence opt3 from HM13__Homo_sapiens__NP_110416
auggacagcgcccuguccgauccccacaacggcucugcugaggcagggggaccuaccaauucaacaacuagaccaccgaguacgcccgaagguaucgcccucgcguacggcagccuucuguugauggcuuuacugccuauuuucuuuggggcccuaagguccgugcggugcgcacgcggaaagaacgccucugacaugccagagaccauaacaucgcgagaugcugcacguuuccccaucauugccucauguacucuccugggccuuuaucuguuuuucaaaaucuuuagccaggaauacauuaauuugcuccugaguauguauuucuuuguccuggguauccucgcuuuaucccauaccauaucuccuuucaugaacaaguuuuucccagccagcuuucccaauagacaauaccagcugcuuuucacacagggguccggagagaacaaagaagagaucauuaauuaugaguuugacaccaaggauuugguuugccugggccuaucaaguaucgugggcguaugguaccuccugaggaaacacuggauugcgaacaaucuuuucgggcuggcauucagcuugaacggaguggaacuccugcauuuaaauaacgucucuacugguuguauccugcucggcgggcuuuuuauauaugacguguucuggguuuuuggaacaaaugugauggucaccguggccaaguccuucgaggcuccuauuaagcugguauuuccacaggauuugcuagaaaaaggccuggaggccaacaauuucgcaaugcucggucugggggacguugugaucccgggaauuuuuaucgcccuucuguugcgguucgauaucucacucaagaaaaacacgcacacuuacuuuuacaccagcuucgcugcguauauuuuuggccugggcuuaacaauauucaucaugcauauuuuuaagcacgcccaacccgcacugcuauaccucgucccugcuugcaucggguucccagugcugguggcccuugcuaaaggagaggucacugaaauguucaguuaugaggaaucuaaccccaaggacccugccgcaguuaccgaguccaaggaagguacagaggccagcgcuucgaaaggcuuggagaagaaagaaaaguga

SEQ ID NO: 57270 - RNA, 1263 nt, Artificial Sequence
  derived and/or modified sequence opt3 from HMBOX1__Homo_sapiens__NP_001129198
augcugagcuccuuccccgugguccuccuugagaccaugucucacuacacagacgaaccuagauuuacuaucgagcagauugaucuguugcaaagguuacggcgcacgggcaugaccaagcaugaaauacugcacgcccuagagacacucgaccgacuggaucaggaacauucagacaaauucgggcguagaaguagcuauggagguuccucuuacggcaacucgacuaauaacguuccagcuucaagcaguaccgcaacagccuccacccagacucagcacucugggaugagcccgucccccucaaauaguuaugauacaagcccucaaccaugcaccacgaaccagaauggaagggagaacaaugagcggcuuucuacuuccaacggcaagaugucacccacccgcuaccaugcgaauagcaugggucagagaaguuauucuuuugaggcuuccgaagaagaccuggauguggacgauaaaguagaggaguugaugaggcgggacagcucggugaucaaggaagagauuaaagccuuccucgcaaaccgccgaaucucucaggccgucguggcucaaguuacagggauuucccagucaagaaucagucacuggcugcugcagcagggaagcgaucucuccgaacaaaagaagagggcauuuuaccggugguaucaguuagagaaaacuaauccuggcgccacccugucuaugcguccagcucccauaccuaucgaagacccagaguggcgccagacaccgcccccugugagcgccaccucaggcacguucagacuuaggcgggggagucgauuuacuuggcgcaaggaguguuuggcggucauggaauccuacuucaacgagaaucaauacccagaugaagcaaaaagagaggaaauugccaacgcuugcaaugccgugauccagaagcccgguaaaaagcugagcgaccuagagaggguaacaucucucaagguuuauaacugguuugcaaaccggcgcaaagagauuaagagaagggcuaauaucgaagccgcgauacuggagucacacggaauugacgugcagaguccuggcgggcauagcaacuccgaugacgucgauggaaaugacuacucugaacaggaugacucgaccagccacuccgaucaucaagacccaaucucacuugccguggagauggcagcugugaaccacacuauucuggccuuggcucgucagggcgccaaugaaaucaaaacagaggcacucgaugacgauuga

SEQ ID NO: 57271 - RNA, 1086 nt, Artificial Sequence
  derived and/or modified sequence opt3 from HMBS__Homo_sapiens__NP_000181
augagcggcaacgggaaugccgcugcaaccgccgaggaaaacucccccaagaugagagugaucagggucggaacacggaaaucucagcuggcgcgcauucaaacugacucaguuguggcuacgcucaaggccaguuacccuggucuucaguucgagauaaucgcaaugagcaccacaggcgauaaaauucuggacacugccuuguccaagaucggggaaaaaucuuuauuuaccaaggagcuggaacacgcucuagagaagaaugagguagaucucgugguccauucgcugaaagaccuuccaacagugcugccgcccggauucaccauuggcgcaaucugcaagcgagaaaacccucacgaugccguuguguuucauccaaaauucgucgguaagacuuuggagacacuccccgaaaaaucagugguagggaccagcagucugcguagagcugcccagcugcagaggaaguuuccucaccucgaguuccgguccauacgcggaaauuuaaacacgagacugaggaaacuugacgagcaacaggaauuuucugcgaucauuuuggcaacugccggccugcagcggaugggcuggcauaaucgcguugggcagauccuacacccagaggaauguauguaugcugugggacaaggugcccucggcgucgaggugcgagcaaaggaucaggacauucuggaucuuguggggguccugcacgaccccgaaaccuugcucagaugcaucgcugagagggccuuccugcggcauuuagagggaggcuguagcguuccuguggcgguacacacagccaugaaggauggucagcuguaccucacugggggaguguggucccuugacggcucagauaguauacaggaaaccaugcaagcaacaauucaugucccagcucagcacgaggacggcccggaagacgauccccagcugguggggaucaccgcccguaacauuccucgcggaccacaauuggcugcccagaaucuagguaucagccuggcaaaccuccugcuuucuaaaggcgccaagaauauccuggacguugcuagacaguugaacgaugcgcacuga

SEQ ID NO: 57272 - RNA, 16908 nt, Artificial Sequence
  derived and/or modified sequence opt3 from HMCN1__Homo_sapiens__NP_114141
augaucagcugggaagugguccacaccguuuuccuguuugcccuccuuuacuccucucuggcucaggacgccucaccccagagugaaauuagagccgaggaaauaccugagggagcgagcacuuuggcuuucguguuugaugucacuggguccauguacgacgauuuagugcaggucaucgaaggggccucuaagauucuggagacgucgcuaaaaagaccaaagcggccgcuauucaacuuugcgcuggugcccuuccaugacccugagaucgguccaguuaccauuacuacugaucccaaaaaguuucaguacgaacuucgcgagcuguacgugcagggagggggagacugcccugaaaugucaaucggagccauaaaaaucgcuuuggagauuagccucccagguaguuucaucuacgucuuuaccgaugcacgauccaaggacuaccgucugacucacgaggugcugcaacucauucagcagaagcagucucaagucguuuucguguuaaccggggauugcgacgauagaacucauaucggauacaaagucuacgaagagauagccagcacauccucaggccagguguuucaccuggacaagaaacaggugaaugaaguccuuaaguggguugaggaagcugugcaggccaguaaaguccauuugcugagcaccgaucaccuagagcaagcggugaacacguggaggauucccuucgacccuucucucaaggaggucacugugucccugucaggcccaagcccgaugaucgaaauucggaauccccuugggaagcugaucaaaaagggauuugguuugcacgagcuccugaacauccauaauagugcaaaaguugugaacgucaaggaaccugaggccggcauguggaccgugaaaacaucuuccagcgggcgccacucggucagaauuacuggauuaucuaccauagacuucagggcuggcuucucccggaagccaacacuggauuuuaaaaagaccguuucacgccccgugcaggguaucccuacguacguccuccuuaauacaagugggauuagcacaccagcccgaaucgaccuguuggaacuacuguccauaucuggaagcucacucaagaccauucccgugaaauacuacccgcauagaaagccuuacggcaucuggaacaucagugauuucguaccaccaaaugaggcauuuuuccugaaagugacuggcuaugacaaggaugacuaccuuuuucagaggguuuccagcgugucuuucucaaguauuguaccugaugcucccaaagucacaaugccagagaagacccccggguauuaccugcaaccuggacagaucccaugcagcguggacuccuugcucccguuuacgcugucuuucguucggaacggugugaccuuaggcgucgaucaguaucugaaggaaucggccagcgugaaucuagacauugcgaaaguaacacucuccgaugagggguuuuacgaaugcauagccgugucaagugcaggaacuggccgugcucagaccuucuuugacguuucugagcccccuccagucauccaagugcccaacaaugugacagucacuccuggugaacgcgccguucugaccugccuuauuaucagcgcuguggacuacaacuugacauggcagagaaaugauagggacgugcggcuggccgagccagcacgaauccgcacccucgccaaccugucccuugagcugaagucaguaaaauucaacgaugcuggggaauaucacuguauggucagcucugagggcggauccagugcggcaagcguguuuuugacuguucaggaacccccgaaggugacggucaugccuaaaaaucagucuuucacaggcggguccgaggugucaauuaugugcagugccaccggauacccaaagcccaagauagcuuggacuguuaacgacauguucaucguggguagccacagauauaggaugaccucggauggcacacucuuuauuaaaaaugccgcaccuaaggacgccgggaucuacggaugucuggcuuccaacucugccggcaccgauaaacaaaauagcacuuuacgguauauugaggcacccaagcugaugguaguccagucagaacuacucguggcgcugggugacaucacagugauggagugcaaaacgagugggauaccaccuccccaggucaagugguucaagggcgaucuugaauugcgcccauccaccuuucugaucauugacccgcuccugggauuacugaaaauccaggagacucaagaucuugacgcuggcgauuacacauguguugccauuaacgaagcagggagagccaccggaaagaucacauuggacguggguucuccucccguauucauacaggagccagcugacgugagcauggagauuggcuccaaugucacucuccccugcuaugugcagggguacccugaaccaaccaucaaauggaggcgucuggauaacaugcccauuuucucacggccuuucagcguuaguucuaucucccagcuacgaacgggagcccuguuuauacucaaucugugggcaagcgacaagggcaccuacaucugugaggcugaaaaccaauucgguaaaauucagucggagacaacugugaccgucacagggcuuguggccccguugaucggcauuucaccaucuguugcgaaugugaucgaaggacagcaacugacuuuacccugcacccuccuggccggcaacccuauaccagagagaagguggauuaagaauagugcuaugcuucugcagaaccccuauaucacgguccgcuccgaugggagcuugcauaucgagcggguacagcuccaggacggaggcgaauacacaugcguggcaucuaauguugccgguaccaacaacaaaacuacaagcguggucgugcacguacugccuaccauucaacaugggcagcagauccuauccacuauugagggaauaccggugacccugcccuguaaggcuucaggcaauccaaagccuagugucaucuggagcaaaaagggugaacucauuucuacauccucagccaaauuuagugcaggcgcggaugggagccuguauguugugucccccggaggcgaggaaucuggggaguacgugugcacggccaccaacacugcuggauaugccaagagaaaaguccagcuuacaguguacguuaggccacgcguauucggcgaccaacgagguuugucgcaggauaagccuguggagaucagcguccuggcaggggaagaggugaccuuacccugugaaguuaagucacucccaccgccuauuaucacaugggcuaaagagacucagcugauaucccccuuuaguccacggcacaccuuccuucccucuggaagcaugaagaucacggagacacguaccuccgacucaggcauguaucugugcguggccacuaauauugcagguaacgucacccaggccgugaaacuaaauguacaugucccuccaaagauccaaagaggccccaaacaccucaaggugcagguugggcagaggguggauauuccuuguaacgcucaaggaacaccgcugccagucaucacuuggucuaagggcgggagcaccauguugguggacggagaacaccauguuaguaaucccgauggcacacuguccauagaccaggcgacgccuagcgaugccgguauuuauaccugcguggcaacuaacaucgcugggacagacgagaccgaaaucacuuuacacguccaggagcccccaacaguggaagaccucgagccucccuacaauaccacguuucaggagcgcguagccaaccaacggauugaguucccauguccugccaaaggaacuccgaagcccaccauaaaauggcugcauaauggcagagagcuuacagguagggaaccaggcaucucuauucuggaggaugggaccuugcucgugaucgcuucaguuacuccuuaugacaacggagaauacauuugcgucgcagugaaugaggccggcacaaccgagcgaaaguauaaccugaaagugcacguacccccaguaaucaaggauaaggaacaggugacaaauguuuccgugcuacugaaccagcuuacuaaccucuucugugaggucgaagggaccccuagucccauaaucaugugguacaaagacaaugugcagguuacggagagcucgacaauucaaaccgugaacaauggaaagauccugaaauuguuucgcgcgacuccggaagaugcuggccgguauucuugcaaggccauuaacaucgcagguaccucccagaaauacuucaauauagacguccuggugccaccuacaauuaucgggacuaacuuucccaaugagguaagcgugguuuuaaacagagaugucgcccucgagugucaggugaagggaaccccauuccccgacauccacugguuuaaagauggcaagccucuguuccuuggcgacccgaauguggaacuguuggauagggggcagguccuccaucugaagaacgcucgucgcaaugacaaaggacgguaucaaugcacgguuucaaacgcagccgguaagcaggcgaaagacauuaagcuaacaaucuacauacccccaaguauuaaaggcgggaaugugaccacugauaucucuguacugauuaacucccuuaucaagcucgagugcgaaacaagaggacugccuaugcccgcuauaaccugguacaaggacggccagccuauuaugagcucaagucaggccuuguauaucgauaaaggucaauacuuacacaucccaagggcacaggugagcgacuccgccacuuauacaugucaugucgcuaauguggccgggaccgcagagaagucuuuucacguugauguguacguacccccuaugauugagggaaaccuggcuacgccacucaacaaacagguagugaucgcccauagccugacucuugaaugcaaggcggccggcaaucccuccccgauucugaccugguugaaagacggcguuccugugaaggcaaacgauaauauacgaaucgaggcugggggaaagaaacuagaaauuaugucagcccaagagaucgaccggggucaguauaucugugucgcuacaucuguggcaggcgaaaaggagauuaaauacgaggucgaugugcugguuccacccgccauagaagggggagacgagaccaguuauuucaucgugaugguaaacaaucuccuggaacuugauugccacgugacaggcucgccuccacccacuauuaugugguuaaaggacggucagcugaucgaugagcgcgacggguuuaaaauucucuugaacggaagaaagcuggucaucgcccaggcucaaguuagcaauaccggccucuacagguguauggcggcaaacacggccggcgaccacaagaaagaguucgaggugacaguccaugugccgccuacuauaaaguccucugggcugucagagcggguagugguuaaauacaagcccguggcacuucagugcaucgccaauggcauuccaaacccuagcaucaccuggcugaaagaugaccagcccgucaauacagcacaggguaacuugaagauucaauccaguggccgagugcuacagaucgccaagacccugcucgaagaugcugggagauauacuugugucgcgaccaaugccgcaggagagacacagcagcacauacaauuacaugugcacgaaccacccucucuggaggacgcuggcaaaaugcuuaacgaaacgguucugguaagcaauccugugcagcucgagugcaaggccgcagguaacccagucccggugauuacuugguacaaagauaaucgcuugcugucaggguccaccaguaugacauuucucaacaggggacagaucauugacaucgagagcgcccaaauaucugaugcuggcaucuauaaguguguugccauuaacuccgcgggcgcaaccgaacuguucuacucacuucaggugcaugucgcccccagcaucucggggucuaauaacaugguggcuguagugguuaauaacccuguccgucuagagugcgaagcccggggcauuccagcucccagucugacuugguugaaagacgguuccccugugagcucauucuccaauggcuuacaggugcugucugggggaagaauccucgcacugacaagcgcccagauaagugauaccggcagguauacgugugucgcuguuaacgccgcuggugaaaagcaacgcgacauugaucuucgaguguacguaccacccaauaucaugggggaggaacagaacguguccguccugaucagccaggcgguggagcucuugugccagucugacgccauuccuccgccaacucugacauggcuaaaagauggacacccccugcucaagaagccuggccuuucaaucagugaaaauagauccguucugaaaauagaggacgcucaagugcaggacaccggccgguauaccugcgaagccacuaacgucgcagggaagacagagaaaaauuacaacgugaauauuuggguacccccaaacaucggagguagcgaugaguuaacccaguugacaguuauugaaggcaaucugaucucucuccugugugagucgucagggauaccucccccaaaccuuaucuggaagaaaaagggaagcccggugcugacugacuccaugggcaggguccgcauucucaguggugggcgucaguugcaaaucucuauugcugaaaagagcgaugccgcacuguacuccugcguggccucaaacguggcuggcacggcgaaaaaggaguauaauuuacaggucuacaucagaccuaccauuacaaacaguggaucucaccccacugaaaucauaguuacccggggcaaaagcauuucccuagagugugaggugcaggggaucccacccccuacaguaaccuggaugaaggacggacauccacugaucaaagccaaggguguggaaauucucgaugagggccacauacuucagcugaagaauauccaugucucagacacugggagguaugugugcguugcagugaacgucgcuggaaugacggauaaaaaguacgacuugagcgugcacgcacccccuucuauuaucggcaaucaccgcuccccggaaaacauuaguguaguugagaaaaauagcgugucgcugaccugugaagccuccgguaucccacuccccucuauaacaugguuuaaggauggguggccugucucacugagcaacagugugcgaauccuuuccggcggaagaaugcuccggcugaugcaaacuaccauggaggacgcaggccaguauacaugcguugugaggaaugcugccggggaggaacgcaaaauuuucggauugucuguccuggugccaccccauaucguaggugagaacaccuuagaagaugugaaggucaaggagaaacagagcguuacucuaacaugugaggugacgggcaauccuguccccgaaauuaccuggcacaaggacgggcaaccacugcaggaggacgaagcgcaucacaucauaucaggaggcagauuucuccagauuacuaacgugcagguaccgcauacagguagguauaccugccuugcuuccaguccugccgggcacaaaagccggucuuucucacugaauguguuuguuucccccaccaucgcaggcgugggaagcgauggcaacccagaggacgucacagugaucuugaacucuccuacaagucugguuugugaagccuauucguaucccccagcuacgauuaccugguucaaggaugggacaccucucgaguccaaccguaacauacgcauccugcccggaggccgaacucuucaaauuuuaaaugcacaggaggacaacgccgguagauacagcugcgucgcgaccaaugaagcuggggagaugaucaaacacuaugaagugaagguguacauuccgccaaucauaaacaaaggagaucuguggggcccuggucucucacccaaggagguaaagaucaaagucaauaacacauugacccuggaaugugaggccuaugcaauuccaucugccagccuauccugguacaaggacggccagccccugaaaagugaugaccaugugaauaucgcugccaacgggcacacucuccagauuaaggaggcacaaaucucagauacgggaagguauacaugcguugcuucuaauauugccggcgaagacgagcuugauuuugacgugaacauacaggucccuccgagcuuccagaaacugugggaaaucgggaauauguuggauaccggacggaacggcgaggcgaaggacgugauuaucaauaacccaaucucccuguacugcgaaacuaaugccgcacccccucccacccucacaugguauaaggacggucauccacugacaaguagcgauaaaguuuuaauucuuccugggggacgcgugcugcagauacccagagcuaagguagaggacgccggcagguacaccugugucgcagugaacgaggcuggugaagauucccuccaauacgacgugcggguucuagucccaccuaucauuaaaggcgccaacucugaucugccggaggaagugacaguauuggugaauaagucagcccugaucgagugccucagcucggggucccccgcgccacgaaacaguuggcagaaagacggacagccucuucuggaggaugaccaccacaaguuuuugucuaauggcaggauucugcaaauccucaacacgcagauaaccgauaucgggcgcuaugucuguguggcugaaaauacugcaggaagcgccaagaaauacuucaacuuaaauguucaugugcccccaucagucauuggcccuaaguccgagaaccugacagugguugugaauaacuuuaucucucuuaccugcgaaguaagugguuuucccccgccagaccugagcuggcucaagaaugagcagccuauuaagcucaacacuaauacacugaucguccccgggggaaggaccuugcagauaauucgggcuaaaguguccgauggcggcgaauauacguguaucgccauuaaccaagcaggggagucaaagaagaaauuuagccugaccguuuacgugccacccucuaucaaggaccacgacagugagucccucagcgucgugaauguacgugaaggaacaucagugucucuugagugcgaauccaacgccgucccucccccaguuauaacuugguauaaaaacgguagaaugaucaccgagucgacacauguggaaauucuggcugauggccagauguuacacaucaagaaagcggaggugagcgacacugggcaguacgucuguagggccauuaauguggcaggacgcgaugacaagaacuuccaucugaauguuuauguaccuccgaguaucgagggccccgaacgggaggugauagucgaaaccauuucuaacccagugacauugaccugcgaugcuacugguaucccucccccaacgaucgccuggcucaaaaaucacaagcgaauugagaacuccgacagccuggaaguuagaauccuaucagggggaaguaaacuucagauagcaaggucccaacacagcgauucuggcaauuacacauguauugccucaaacauggagggcaaagcucagaaguacuauuuccugagcauccaggugccucccuccgucgccggggcggagauuccgucugacgugaguguacuccugggagaaaauguggaguuggucugcaacgcaaaugguaucccuaccccacugauacaguggcucaaagauggcaagcccaucgccucgggggaaacugagcgcauucggguuagcgcuaacggauccacccuuaauaucuacggcgcccugacaucagacacggguaaauauaccuguguggcaacuaacccugcuggggaggaagauagaauuuuuaauuuaaacgucuacgugacaccaaccauccguggaaacaaggacgaggccgaaaagcugaugacuuugguugauacaucuauuaauaucgagugcagggcuaccggcacacccccuccacaaauaaacuggcucaaaaauggccugccccuaccgcuuagcagucauauccggcugcucgccgcaggacaggugauucgcaucguacgagcacagguguccgacgucgccguguauacuugcguugcuucaaacagagccggagucgacaauaagcacuacaaccugcaaguguucgcaccucccaauauggauaacucuauggguaccgaagagauuacgguguugaaaggcagcuccaccaguauggcuuguauaacagacgggacuccagcccccagcauggcaugguuaagggauggacagccucugggccucgacgcccaucuuaccguaucuacacacgguaugguccugcagcuacugaaggcggagacugaagauucagggaaauauaccugcaucgcuuccaaugaggccggagaagugagcaagcacuuuauucucaagguuuuggagccaccccauaucaacggcagugaggaacacgaggaaauuucugugaucgucaauaacccucuggagcuuacguguauagcauccggcaucccagccccgaaaaugacauggaugaaggacgggcggccccugccucagaccgaucaagugcagacucucggagguggcgaaguuuuacgcauuucgacagcucagguggaggacaccgggagauacacuugccuggccagcucaccagcaggagaugacgauaaagaauacuuggucagggugcauguacccccuaauaucgcuggcaccgacgagccacgagauauuacagugcugcggaaccgucagguuacgcucgaguguaaguccgacgccguacccccgccugugaucaccuggcuuagaaauggugaacgccugcaagcgacuccaagggugcggauacuaucugggggaagauaucugcagauuaacaacgcugaccucggcgauacagccaauuauaccugcgucgcaaguaacaucgccggcaaaacuacacgcgaguucaucuugaccguuaaugugcccccuaacauuaaagggggaccccagagccugguaauacuucugaauaagucaacgguguuagaauguaucgcugagggugucccaacaccgaggauuaccuggcgaaaggacggcgcagugcucgccgggaaccacgcgcgguauuccauccuggagaauggauuuuugcauauucagagcgcccacguuacugauaccggcagauaccugugcauggcuacaaacgcagccgguacugacaggcgccguaucgaucuccaagugcacgucccucccucuauagcuccagggcccaccaauaugacaguaaucgugaacguucagacgacucuugccugugaagcaaccggcauuccuaagccaaguaucaauuggcggaaaaacggccaucugcuaaauguggaccagaaccaaaauuccuauagacugcucagcucaggcucuuuggucauuaucucgcccagcguggaugacacagcuaccuacgagugcacugugacaaacggggccggagaugacaagaggaccgucgaucugacgguucaggugccuccauccauagcggacgaaccgacugacuucuuaguaaccaaacacgcccccgcagugauuacauguaccgcuaguggugucccuuuuccaucuauccauuggacuaagaacggcauucgccuucugccccgaggggauggauaucggauccucucaagcggcgccaucgagauucuggcaacacaguugaaucacgccgguagauauaccugcguugcuaggaacgccgcgggguccgcucaucgccacgugacacugcacgugcaugaaccuccagucauacagccccaaccuagugagcuccacguaauccuuaauaacccgauucugcuacccugcgaggcaacuggcaccccaucuccuuucaucacguggcagaaggaaggaauuaaugugaacacaagcggcagaaaucaugccguucugcccuccgggggauuacagaucucacgggcugugagggaggacgccgguaccuacaugugugucgcacagaacccagccggcacugcucucgggaaaauaaagcugaaugugcaaguuccucccgugaucagcccacacuugaaagaauaugucauugcgguagauaagccgaucacccuuucuugcgaggccgacggacugccucccccagauauuacauggcacaaagacggccgugcaauaguggaauccauccgacagcgcguccucaguucagguagccugcagauugccuuugugcagcccggggaugcuggccauuacacuuguauggcagccaacguugcuggaucguccucuacgaguaccaaguugacagugcacgucccuccaagaauccggagcaccgagggccauuauacugugaaugagaacucacaagccauccugcccugcguagcggacgggauuccuacaccggcaauaaauuggaaaaaggauaacgugcuacucgccaaucuucugggaaaguacaccgcugaacccuauggugaguuaauccuggaaaacguugugcucgaggacuccggcuucuacacuugugucgccaauaacgcagcuggggaagauacacacaccgugucucugacgguucaugucuugccaacuuuuaccgagcuuccuggagacgugagccugaacaaaggcgagcagcucaggcugaguugcaaggccacagguauuccccuaccaaaauugaccuggacuuucaauaacaauaucauuccugcgcacuuugauuccguaaacggccacagcgaacuggugaucgagcgcgucucuaaggaagacucagggacauauguguguaccgccgaaaauuccguuggauucgugaaagcuauaggcuucgucuacgugaaggagcccccaguauuuaagggggacuacccgagcaacuggaucgaaccucucggaggcaaugcaauucuuaacugcgagguuaaaggugaucccacgccaacaauccaguggaauagaaaggggguggacauugaaaucagucaucggauaaggcagcugggaaacggcucuuuagccauuuaugguacugucaaugaggaugcuggcgacuacaccuguguggcaacaaacgaagccggggugguugagcgaucaaugucccugacccuccaaagcccucccaucauuacucuggagccagucgaaacggugaucaaugcuggaggcaaaauaaucuugaacugccaggccaccggggagccucagcccacaauuacuuggucgcgucaaggacacucuaucaguugggaugacagaguaaaugugcuuuccaacaacagccuguauauugcagaugcccagaaggaagacaccucagaguucgaaugugucgcgcgcaaucucaugggcucugugcugguucgggugccggucaucgugcagguacaugguggguuuagccagugguccgcuuggagggccugcaguguuacauguggaaaaggcauacaaaagagaucacgccuaugcaaccagccauuacccgcaaaugguggcaagccuugccaggggagcgaucuggagaugcggaacugucagaauaaaccaugccccguggacggauccuggucugaguggaguuugugggaagaguguaccaggagcugcggccgagggaaccaaacuagaacacggaccuguaauaacccuuccguccagcacggaggcaggccgugcgaagguaaugccguggagauuaucauguguaacauccgccccugcccaguucacggggcuuggucagccuggcagccuuggggaacguguucugaaucgugcggcaagggcacucagacacgugcaagacucuguaauaaucccccucccgcuuucgggggaagcuacugcgauggugccgagacccaaaugcaagugugcaaugagcgaaacugucccauucauggcaaaugggcgacuugggcauccuggagugccugcucugucagcugugggggaggcgcuaggcagcggacccgcgguugcucagacccagugccucaguaugggggaagaaagugugaaggcuccgauguacaaagcgacuuuugcaauucugaccccuguccgacacacggcaacuggaguccuugguccggguggggaaccugcucaaggacguguaacgguggccagaugcggcgcuacagaacaugcgauaauccacccccuagcaacgggggacgagccuguggcgguccagacucucagauccaaaggugcaauacugauaugugccccguggacgggucguggggauccuggcauaguuggagccaguguucagcuucuugcggcggcggggagaaaacccggaagcgucugugugaucacccggucccuguuaagggaggucgccccugcccaggcgacacaacucaggugaccagauguaacgugcaggcaugccccgggggaccucaaagggcccggggcuccgucauugguaauauaaacgauguggaguucgggaucgcguuucuuaaugccacaauuaccgacagcccaaacagugauacuagaaucauucgcgcuaaaaucacgaauguuccccgaucacugggauccgcaaugaggaagauaguaagcauccucaacccuauuuauuggaccacagccaaagagaucggcgaggcugugaauggcuucacucugaccaacgccgucuuuaagcgggaaacacagguggaguucgcaaccggggaaauuuugcagaugucucauaucgccagaggacuugacagugaugguagccugcuacucgacauaguuguguccggcuacguccugcaguuacaaucuccagcugaggugacuguaaaagacuacacagaagauuauauucagacggggccgggacagcuguacgcguauucaacccguuuguuuacuaucgacggcaucagcauucccuacacauggaaucacaccgucuucuaugaucaggcccaaggucgcaugccuuuucucguggagacccugcacgcauccucgguugagucugacuacaaccagauagaagagacucuuggguucaagauccaugcuaguauuagcaaaggagauaggucaaaucaguguccauccggcuucacacuggacucugugggccccuuuugcgccgaugaagacgagugugcagccgggaacccuugcagccacuccugucauaacgcuaugggaacguacuauugcaguugcccaaagggucucaccaucgcggccgauggccggacaugucaagacauugaugaaugcgcauuggggagacacacuugucaugcuggacaggacugcgauaauaccaucggcucauaccgaugugucgugaggugcgguagcggguuccgccggacaucugacggccuguccugucaggacauaaacgagugccaggagaguagccccugucaccaaagaugcuuuaaugccaucggaucauuccacuguggcugcgaaccgggguaucagcuuaagggaaggaaaugcauggauguuaacgagugucgccagaaugugugccguccugaccagcauuguaagaacacucgggguggcuacaaaugcauugaucuguguccaaaugggaugaccaaggccgaaaacggaacgugcaucgacauugaugaguguaaagacggcacacaccaaugcagauauaaucagaucugugaaaacacccgagguucuuacaggugcguauguccccgcggguaucggucccagggcgugggaagaccuugcauggauauaaaugagugcgagcagguccccaagccaugugcucaucaaugcucgaacacuccuggcagcuuuaaguguauuugucccccagggcagcacuuacuaggagacgguaaaaguugugcaggccucgaaaggcugccgaauuacgggacccaguacuccucuuauaaccuggcccgcuucucacccgugagaaauaacuaccaaccucagcagcacuaucggcaguacagccauuuguauuccucuuacagcgaguaucgaaacaguaggacaucacucucccguacuagacggaccauccgcaagacaugcccagaaggaagcgaggcuucucacgauacguguguugacaucgaugagugcgaaaauaccgacgcgugucaacaugagugcaaaaacacuuuuggcaguuaccaguguauuugucccccugguuaccagcugacacacaaugggaagaccugccaggauaucgacgaaugucuugagcaaaacguccauugcggcccaaauaggauguguuucaacaugcgaggauccuaucagugcauugacacucccuguccuccgaauuaccagagagauccagugagcggcuuuugccugaaaaacugucccccuaaugacuuagaaugcgcccucucaccauaugcacuggaguacaaguuggugucgcuucccuucgggauagccacaaaccaggaucugauccggcuaguagcuuauacccaagacggagucaugcacccucgcacgaccuuucucaugguggaugaggaacagacaguucccuucgcacugagggacgagaaucugaaggguguggucuacacuaccagaccauugcgggaagccgagacauaucguaugcgcgugagggcuucuagcuacuccgccaacggcacuauugaauaccagaccacauuuaucguuuauauugcagugagugcguacccguauuga

SEQ ID NO: 57273 - RNA, 1044 nt, Artificial Sequence
  derived and/or modified sequence opt3 from HMG20A__Homo_sapiens__NP_001291433
auggagaaccugaugaccagcuccacacuucccccucuuuucgccgacgaagauggcucuaaggagucaaaugaccuggcuacuacgggguugaaccacccagaagugccguacaguagcggagcaaccuccucuacaaauaaccccgaguuugucgaagauuuaucgcagggucaacugcuacagucagagagcaguaaugccgcggagggcaacgaacagagacaugaggacgaacagagguccaaacgcgggggauggucuaagggccggaaacgaaagaaaccucuccgugauagcaaugcuccaaagucaccccugacugguuauguuagauucaugaacgagaggcgggagcaacuucgcgccaagagaccugaagugccauuucccgagaucaccaggaugcuggggaaugaaugguccaaauugccuccagaggaaaagcagcgguaccucgacgaggcagaucgcgacaaagagcgauauaugaaggaacuggagcaguaccagaaaacagaagccuauaagguauucaguagaaagacccaagauaggcagaaaggaaagagccaccggcaggacgcugcacgucaggccacucaugaucacgagaaagaaacagaggugaaggagcgcucugucuuugacauuccgauauucaccgaagaguuucugaaccauuccaaagcuagagaagccgagcucaggcaauuacggaagucaaauauggaauuugaggagcgaaacgcggcacugcagaaacacguggaaagcaugcgcacggccguugagaagcucgaaguggaugucauccaggagagaaguaggaauacuguguugcaacagcaccuggagacccuacggcagguacucacaucuuccuucgcuagcaugccccugccuggcucgggcgaaacuccaaccguugacacaauugacucuuacaugaaccgccuucauuccaucauucuggccaauccccaggauaacgagaacuucaucgcaaccgugagagaagucgugaauagguuggaccguuga

SEQ ID NO: 57274 - RNA, 954 nt, Artificial Sequence
  derived and/or modified sequence opt3 from HMG20B__Homo_sapiens__NP_006330
augagccacggccccaagcagccuggggccgcugcagccccagcgggagguaaagcuccgggccaacaugggggauucguggucaccguuaagcaggagagaggcgaaggucccagggccggggagaaaggaucccacgaagaggaaccugugaagaaacggggcuggccaaagggcaagaaacgcaagaaaauccugcccaacgggccuaaggcaccaguaacaggauacgugcgauuucucaaugagcguagagagcagauuaggacucggcaucccgaccuuccuuucccagaaauaacgaaaaugcugggugccgaguggucuaaguugcagccgaccgaaaagcaacgcuauuuagaugaggcugagagagaaaaacagcaguacaugaaggagcugagggcauaucagcaaucagaagccuacaaaaugugcacagagaagauccaggagaaaaagauuaaaaaggaagacaguagcuccggccuaaugaacacucuccugaaugggcacaagggaggcgauugugacgguuuuucuaccuucgauguccccaucuuuacagaggaguuccuugaccagaacaaagcucgggaagccgaacugcgccgauugagaaagaugaauguggcguuugaggaacagaacgcaguucuccaaaggcauacccagucgaugucaagcgcccgggagcgucuggagcaggaacuggcucucgaggaacgcagaacuuuagcccugcaacagcagcuucaggcagugaggcaggcuuugacagccaguuucgcgucccugccugucccagggaccggagagacgcccacucuaggcacccucgauuuuuauauggcccggcugcacggcgcaauugaacgagacccugcucaacacgagaaacuuaucgugcgcauaaaggagauccuggcccagguagcuucugaacauuuguga

SEQ ID NO: 57275 - RNA, 291 nt, Artificial Sequence
  derived and/or modified sequence opt3 from HMGA1__Homo_sapiens__NP_665912
augagcgaguccucuucaaagaguagccagccccuggccuccaaacaagaaaaggacggcaccgagaaaagagggaggggacggccucgcaagcagccaccgaaagaacccucugaggugccuacaccaaagcgaccccgugguagaccuaagggcucgaaaaacaagggggcugcaaaaacuaggaagacgaccacaacuccaggacggaaaccccgcggcagaccuaagaagcucgaaaaagaggaggaagaggguaucucacaggaaagcagugaggaggaacaguga

SEQ ID NO: 57276 - RNA, 357 nt, Artificial Sequence
  derived and/or modified sequence opt3 from HMGA2__Homo_sapiens__NP_001287847
augagcgccagaggcgagggggcuggacagcccuccaccucugcacaaggucagccugccgcgccagcuccgcagaagaggggccgggggcgcccccgaaaacagcaacaggaaccuacaggagagccaucacccaagcguccuagaggcaggccaaaagguaguaagaacaaaagccccuccaaggccgcacagaagaaagccgaagcuacuggggagaagcggccucgcggaagaccaaggaaauggccgcagcaagugguccagaagaaacccgcacagguuaauguggcccugccuggcaaggaccacccaggcaaccucaucuaccuucuguucucuaagaaugcuacguga

SEQ ID NO: 57277 - RNA, 477 nt, Artificial Sequence
  derived and/or modified sequence opt3 from HMGB1__Homo_sapiens__XP_005266425
augggcaagggggaccccaaaaagccuagaggaaaaaugagcuccuacgccuucuuugugcagaccugcagggaggaacacaagaaaaagcauccagaugcuucugucaacuucucagaguuuaguaagaaauguagcgaacgguggaagacaauguccgcaaaagagaaggguaaauucgaagacauggccaaggcggauaaggcucgcuaugagcgagagaugaaaacuuacaucccgcccaagggcgaaacgaaaaagaaauuuaaggacccuaaugccccaaaacgucccccuucugcauucuuucuguucugcucggaguauagaccaaagauuaagggggaacaccccggacucucaauaggcgauguugccaagaaacuuggugagauguggaacaauaccgcugcagacgauaaacaaccuuacgagaagaaagccgcuaagcugaaggaaaaauaugagaaguuuuga

SEQ ID NO: 57278 - RNA, 630 nt, Artificial Sequence
  derived and/or modified sequence opt3 from HMGB2__Homo_sapiens__NP_001124161
augggcaagggggaccccaacaaaccuagaggaaagaugagcuccuacgccuucuuugugcagaccugcagggaggaacacaaaaagaaacauccagauucuucagucaauuucgcugaguuuaguaagaaguguagcgaacgguggaaaacaauguccgcaaaggagaaaucuaaguucgaagacauggccaaaucggauaaggcgcgcuaugaccgagagaugaagaacuacguuccgcccaaaggugauaagaaaggcaagaaaaaggacccuaaugcuccaaaacgucccccuucagccuuuuuccuguuuugcagcgagcacagaccaaagaucaagagugaacaucccgggcucuccauuggagauacugcaaagaaacuuggcgagauguggucugaacaaagcgccaaagacaagcagccuuaugagcagaaagcugcaaagcugaaggagaaauacgaaaaggauauagccgcuuauagggccaaagguaaguccgaggcggggaaaaagggaccaggccggccgacgggcucaaagaaaaagaacgaacccgaggacgaagaggaggaagaggaagaggaagaugaggacgaggaagaggaagaugaggacgaagaguga

SEQ ID NO: 57279 - RNA, 603 nt, Artificial Sequence
  derived and/or modified sequence opt3 from HMGB3__Homo_sapiens__NP_001288157
auggccaagggcgaccccaaaaagccuaaagggaagaugagcgcuuacgcauucuuugugcagaccugcagagaggaacacaaaaagaagaacccagaggucccgguuaauuucgccgaauuuuccaaaaaguguucugagagauggaaaacaaugucaggaaaggagaaaaguaaguucgaugaaauggcgaaggcugacaaagugcgguaugaucgcgagaugaaggacuacggucccgccaaaggcgggaagaaaaagaaagauccuaacgcaccaaagcgacccccuagcggauuuuuccuguuuugcuccgaguuccguccaaagaucaaaucuacuaaucccggcauuucgauaggugacguagccaagaaacucggggaaauguggaacaaucuuaacgauucagaaaagcaaccuuauaucacgaaagcugcaaagcugaaggagaaauacgagaaggacguggccgauuauaaaagcaagggaaaauuugacggcgcuaagggcccagccaaggucgcgaggaaaaagguggaagaggaagaugaggaagaggaggaagaggaagaggaagaggaggaagaggaagacgaguga

SEQ ID NO: 57280 - RNA, 2667 nt, Artificial Sequence
  derived and/or modified sequence opt3 from HMGCR__Homo_sapiens__NP_000850
augcugagcagacucuucaggaugcacggccuuuuuguggccucccaucccugggaggucaucguugggaccgugacacugacuauuugcaugaugucuaugaacauguucacgggaaauaacaagauaugugguuggaauuacgaaugcccuaaauuugaggaagacguauugucaagugauaucauuaucuuaaccauuacacgguguaucgcuauacuguauaucuacuuccaguuucaaaaccuacgccagcucggcagcaaguauauucuggggaucgcaggacuuuucacuaucuuuuccucuuucguguuuucgaccgucgugauucacuuccuggacaaagaguugacaggccucaaugaagcccugccauuuuuccugcucuuaauagaucugucacgagcgagcacccuugcuaaguuugccuugaguuccaacucucaggacgagguucgugagaauauugcaagagguauggccauccuggggccgacuuucacacuagaugcucucguggaaugccuggucauuggagugggcaccaugagcggcguaaggcagcuugagaucauguguugcuucggguguauguccguucuggcaaacuacuuuguguucaugacguuuuuccccgccugcgucucauuggugcucgaacugagucgggagagccgcgagggaagaccuaucuggcaauuaucucauuuugcuagggugcuggaagaggaagagaauaaaccaaaccccgucacucagcggguuaagaugauuaugucccucggucuugugcugguacacgcccauucacgcuggauagcggacccuagcccacagaauaguaccgcagauacaucuaagguguccuugggccuagacgaaaacgucagcaaacgaaucgagcccucggugucucuguggcaguucuaucucuccaagaugauuucaauggauaucgagcaaguuauaacucugagucuugcccuguugcucgcugugaaauacaucuuuuucgaacagaccgagacagaaagcacccuguccuuaaagaauccuauuacgucuccagucgugacucagaaaaagguaccggacaacuguugcagaagggagcccaugcugguucggaauaaccagaagugugauagcguggaagaggagacagggaucaaccgugaacgcaaagucgaggugauuaagccucuagucgccgaaaccgacacuccaaauagagcaacauuugugguuggaaacucaagucuccuggauaccuccagcgugcuuguaacgcaagagcccgaaaucgaguugccuagggagccacggcccaaugaagagugccugcagauucucggcaacgcugaaaaaggugccaaguuccugucugacgcggagauaauccagcuugucaaugccaaacacauuccggcauauaagcuggagaccuugauggaaacacacgagcgaggggugucaauccgcagacaacuccugaguaaaaaguuaagcgaaccuuccucucugcaguaccuacccuacagggacuauaacuacucgcucguuaugggagcuugcugugagaaugugaucggcuauaugccaauuccugucggcguggccgggccccugugccuugaugaaaaggaguuucagguaccaauggcuacuaccgagggauguuugguggccagcacaaaccgggguugccgcgcaauaggccucgggggaggcgccuccucaagaguucuggcugacgguaugacuagggggcccgucgugcgucugccucgggcgugugauagugcagaagugaaagccugguuagagaccucugaaggcuucgcugucaucaaggaggccuuugacagcacaucccgauucgcaagacugcagaaacuucauaccucaauugccggaaggaauuuguacauccgcuuccaaagccggucuggcgaugcuauggggaugaacaugauuuccaagggaacugaaaaagcccucaguaagcugcacgaguauuuuccagagaugcagauccuagcaguuagcgguaauuacugcacggacaagaaaccggcggcuauaaacuggaucgaaggcagagggaagucuguggugugugaggccguaauucccgcaaaagucgugagggaaguucugaagacaaccacugaggccaugaucgaagugaauauuaacaaaaaucucgucggauccgcuauggccggcucaaucgguggguauaacgcacaugcugccaacauagugaccgcgauuuacaucgccugcggccaggaugcugcacagaauguuggaaguagcaacuguauuacacugauggaggccucgggcccuaccaaugaggaccuuuacaucuccugcacuaugccaucuauagaaaucgggacagugggagguggcacgaacuugcugccccaacaggcuuguuuacagaugcucgggguacagggagccugcaaggauaauccuggcgagaacgcacgccaacuggcgcgaauugucugcgguaccgugauggccggggaacuuagccugauggcugccuuggcagcuggccaccucgugaagucacacaugauccauaaucggaguaaaauuaaccugcaggaccuacagggagccuguacuaagaaaacagcauga

SEQ ID NO: 57281 - RNA, 1563 nt, Artificial Sequence
  derived and/or modified sequence opt3 from HMGCS1__Homo_sapiens__NP_002121
augcccggcagccugccucucaacgccgaggcuugcuggccaaaggacguggggaucgucgcacuugaaauuuacuucccgucccaguauguugaucaagccgagcuggaaaaauacgacggaguggaugcggguaaguauaccauaggcuuggggcaggcuaaaaugggauuuuguacagacagagaggauaucaauucuuuaugcaugacuguagugcagaaccugauggaaaggaauaaccuaucauacgacuguauuggccggcucgaggucgguacggagaccaucauugauaagaguaaaagcgugaagacaaaucugaugcagcuuuucgaagaguccgggaacacugacaucgaaggaauagauaccacaaaugccugcuauggcggcaccgcagccguuuuuaacgcugugaauuggaucgagucuucgucaugggacgggcgcuacgcacuggucguggccggagauauugcuguauaugccacugguaacgcgcgacccacaggcgggguuggagcaguggccuugcucaucggcccuaaugcuccacugauuuucgagcguggucugagagggacccacaugcaacaugccuacgacuuuuacaagcccgauaugcucagcgaauauccuaucgucgacggaaaauuaaguauacaguguuaccuguccgcacuugacaggugcuauucuguguacuguaagaaaauucacgcucaguggcagaaggagggcaacgauaaagacuucacguugaaugauuuuggcuucaugaucuuucauagcccauauugcaagcuggugcaaaagucccuagcccggaugcuccugaacgacuuccuuaaugaucagaaccgcgacaaaaacucaauuuacagugggcuggaagcguuuggagaugucaaguuggaggacacuuauuucgauagagacguugaaaaagccuuuaugaaggcaagcucugaacucuucucccagaaaaccaaggcuucacuguuagugagcaaucagaacgguaauauguacacaaguucuguauacggcucccuggccagcgugcucgcucaauauucgccccagcagcuugccgggaaaaggaucggagucuucucuuacggcuccggucuggcagccacuuuguauucacuaaaggugacccaagaugcuacaccugggagugcgcuggacaagaucaccgcaagccucugugaccugaaaucccggcuugauucucgcacgggcguugccccagacguguuugcugagaacaugaagcugcgagaggauacucaccauuuggucaauuacauuccgcagggaagcauagacucacucuucgagggcacaugguaucuggugagaguagaugaaaaacacaggcggaccuacgcccgucgccccacuccuaacgacgauacauuagacgaggggguuggacuggugcacaguaauaucgcaaccgaacauauuccaucccccgccaagaaagucccuagacuaccagcuacggccgcagagcccgaggcggcugugaucagcaacggugaacacuga

SEQ ID NO: 57282 - RNA, 303 nt, Artificial Sequence
  derived and/or modified sequence opt3 from HMGN1__Homo_sapiens__NP_004956
augcccaagagaaaagugagcuccgccgagggcgcugcaaaggaggaaccuaaaaggcggucugcccgccugucagcgaagccaccggcuaaagucgaagccaagcccaagaaagcagccgcuaaggacaaaaguagcgauaagaaaguucagaccaaggggaagcgaggagcaaaagguaagcaagccgagguggcuaaccaggaaacaaaagaggaccucccugccgagaauggcgaaacuaagacggaggaauccccagcgucugaugaggcaggggagaaagaagccaagucggacuga

SEQ ID NO: 57283 - RNA, 273 nt, Artificial Sequence
  derived and/or modified sequence opt3 from HMGN4__Homo_sapiens__NP_006344
augcccaagagaaaagccaagggcgacgcuaaaggggauaaggcaaaagugaaggacgagccucagaggcggagcgcccgccuguccgcgaagccagcuccgcccaaaccugaaccacgacccaagaaagccucugcaaagaaaggagagaagcucccuaagggucguaaaggcaaggccgaugcugggaaagacggaaacaauccagcaaagaacagagaugccucaacccuucaaagucagaaagcugaaggcacaggugacgccaaguga

SEQ ID NO: 57284 - RNA, 849 nt, Artificial Sequence
  derived and/or modified sequence opt3 from HMGN5__Homo_sapiens__NP_110390
augcccaagagaaaagccgcuggccagggggacaugaggcaagagccuaagcggcgcagcgcacgacuguccgccaugcucgugccagucaccccggaaguuaaacccaagcguacaucuucaaguagaaaaaugaagacuaagagcgauaugauggaggaaaacaucgacacguccgcgcaggcuguggccgagaccaaacaggaagcaguaguggaggaggauuacaaugaaaacgccaagaauggagaggcuaaaauuacagaagccccugcaucugagaaggagauagucgaagugaaagaggaaaacaucgaggacgcuacugaaaaggguggcgagaagaaagaggccguugcggcagaagugaagaaugaggaagaggaucagaaagaagacgaggaggaucaaaacgaagagaagggggaagccggaaaagaggacaaggaugaaaaaggcgaggaggacgguaaggaagauaagaaugggaacgagaaaggagaagacgcuaaggagaaagaggauggcaagaaaggcgaagacgggaagggaaauggugaggacggcaaggaaaaaggggaggaugaaaaggaggaggaagacaggaaagagaccggagauggcaaggaaaacgaggacgguaaagaaaagggggauaagaaagagggaaaggacgucaaagugaaggaggaugaaaaagagcgggaagacggcaaggaggaugaaggcgggaaugaggaggaagccggaaaggagaaagaagaccuuaaggaggaggaagaggguaaagaagaggaugaaauuaaggaggacgacggcaaaaaggaggaaccacagucgaucguauga

SEQ ID NO: 57285 - RNA, 3879 nt, Artificial Sequence
  derived and/or modified sequence opt3 from HMGXB3__Homo_sapiens__NP_055798
auggacgccagcuacgauggcaccgaggugacagucguuauggaagagaucgaagaggcuuauugcuacacuucccccgggccuccaaagaaaaagaaaaaguauaaaauucacggagaaaagacgaagaaaccgagaucugcauaccugcucuauuacuaugacauauaccuuaaggugcagcaagagcugccccauuugccucagucagagaucaacaaaaagauuagugaaagcuggagguuacuguccguagccgagcggucuuacuaucuagaaaaagcgaagcucgagaaggagggucuggauccaaauucgaaacuuucagcucugaccgccgugguccccgacaucccuggcuuccgcaagauuuugccacgaagcgauuacaucauaauccccaaaaguucccuccaggaagaccguucuuguccucagcuggagcugugcguggcacaaaaccagaugagcccaaaggggccgccccucguuuccaauacagccccugaaacugugccaucacacgcuggaauggcagagcaguguuuagccgucgaagcucuggccgaggaggugggcgcgcuuacccagaguggugcaguacaagaaauugccacaagcgagaucuugucucaggauguucugcuagaagacgcuucccucgaggugggggaaucacaucagcccuaucagaccagccuggucauugaggagacucuugugaacggaaguccugaucugccaacaggcucuuuggccgugccccacccgcaagucggcgaauccguuagcgugguaaccgugaugagagacucgucugaguccucaaguagcgcuccugcaacgcaguuuaucaugcucccccugccagccuacuccgucguggaaaauccuacuucuauaaaauuaaccacaacuuauaccaggcgggggcauggaacaugcaccagccccgguuguucauucacguacguuacucgccacaagccacccaaaugcccuacauguggcaacuuucuugggggaaaguggauuccaaaggagaaaccggcgaaggugaaagucgaacucgccaguggcguguccagcaaggguucuguaguuaaaagaaaucagcaacccgugaccacugagcagaacucaaguaaggagaaugcaagcaagcugacacuggaaaacuccgaggcugucucucaguugcuaaauguggccccuccaagggaagucggggaggagucggaaugggaggaagugaucauuagcgaugcucacguucuggugaaagaggcccccggaaacugcggcaccgcaguaacgaagaccccugucgugaaauccggcguucagccagaagugacacucgggacuaccgacaaugauucacccggagccgacgucccgacaccuagugaggguacuucuaccagcuccccacugcccgcuccuaagaaacccacaggcguggaccuucugaccccagggucacgggcgccugaguugaagggacgcgcacgaggcaagcccagccuccuggccgcugccagaccaaugagggcaaucuuaccggccccuguaaacgugggucgggggucuuccaugggccugccccgugcucgccaagccuucagucuaagcgauaaaacuccaucuguuagaacguguggacucaagcccuccacacugaaacagcuuggccagccuauccagcaaccaucagggcccggagaagucaaguugccuagugguccgagcaauaggaccucccaggugaaaguggucgagguuaagccagacauguuucccccuuauaaguacucgugcacugugacccuggaucucggccuggcaacaucucgggggcgaggaaaauguaagaacccaagcugcucauacguguauaccaaccgccauaaacccagaauuugcccuaguuguggcguaaaucuugcgaaggacaggacugaaaagacaacgaaggcuauagaggucuccucuccgcugcccgauguguugaacgccaccgaaccacucagcacugcacagcgggagauccagcgccaauccacacugcaguuacugagaaaaguucuacagauuccugagaaugaaucagagcucgccgaaguguucgcucugauccacgagcuuaacagcaguagguugauacugucuaaugucuccgaagagaccgugacaauugagcagacuagcuggucgaacuacuaugaaucacccucuacccaaugccuccuguguaguuccccauuauuuaagggugggcagaauagccuggccggcccucaggagugcuggcuuuugacggcaucucgucuccaaaccguuacagcucaggugaagaugugucugaacccccauugccuagcccugcacagcuucaucgacaucuacacuggacucuuuaauguaggcaacaaacugcuugucuccuuggaucuguuauucgcgauucggaaucagaucaagcucggggaagacccacgagugucaauuaacgugguccugaaaaguguucaggagcaaaccgagaagacacuuacuagcgaagaacugucucaguugcaggaacuccuguguaauggauauugggccuuugagugccuaaccgugagagauuacaacgacaugauaugugguaucugcggcguagcuccgaaaguggaaauggcacagagguccgaggagaauguccuggcccucaagucaguggaguucacguggccugaguuucuggggaguaacgaaguuaacguggaggauuucugggcuacaauggaaaccgaggucauugagcaaguggccuuccccgcaagcaucccaaucacuaaguuugacgcguccguuauugcccccuucuuuccuccacuuaugcgcggagcuguggucguaaauacagaaaaagacaagaacuuggaugugcagcccguuccuggcucugguucggcccuggugcgguuacuccaggaggggaccuguaaacuggacgaaauaggcagcuauucagaggaaaaacuucagcaucugcuaagacaaugcggaaucccguucggcgcagaggauuccaaagaccagcucugcuuuagucuguuggcucuguacgagucuguccagaauggggccagggcaauucgcccaccccgacacuucacuggaggcaagaucuacaagguguguccucaccaaguagugugcgguagcaaauauuuaguccguggggaauccgcccgggaucauguugaccuccuggcuucaucuagacacuggcccccaguguacguggucgauauggcgaccagcguggcccuuugugcagaccugugcuauccugaguugacaaaccagauguggggaaggaaucagggcuguuuuaguucccccacggaaccaccuguuagcguaucuugcccggagcuccuggaucagcauuacaccguggacaugacugagacagaacacucaauucaacaccccgucaccaagacagcuacucgccggaucgugcaugccggucuacagccaaacccuggcgaucccuccgccgggcaccauagucuggcucuuuguccagagcucgcaccuuaugccaccauacuggcgagcaucguugacucgaaacccaauggagugagacagaggccgauugcuuucgauaacgccacgcacuacuauuuguacaaucgacugauggacuuuuuaacaucucgcgaaaucgucaaccggcagauucacgacaucgugcaauccugccagccaggcgagguagucauaagagauacccucuacaggcuggggguggcacagauuaagacugaaaccgaggaggaaggagaggaagaggaaguugccgcuguggcagaguga

SEQ ID NO: 57286 - RNA, 1806 nt, Artificial Sequence
  derived and/or modified sequence opt3 from HMGXB4__Homo_sapiens__NP_001003681
auggccuacgacgauagcgugaagaaagaggacugcuucgauggcgaccacaccuuugaagauaucgggcuggcugcaggaagaucccagagggagaagaaacggucuuauaaggacuuccuccgcgaagaggaagagauugccgcgcaaguccgaaacucaaguaaaaagaaacuuaaggauagcgagcuguacuuuuuggguacagacacucauaagaaaaagcguaaacacuccucugaugacuauuacuauggcgauauaucgucauuagaaagcagucagaagaagaaaaagaaauccucuccccagagcacggacaccgcuauggaucugcuaaaggccaucacauccccucucgcagccgggucaaaaccaaguaagaaaacuggagaaaagagcucuggcuccucaagccauagugagucuaagaaagagcaccauagaaagaaaguuuccgguagcucgggggagcugccgcuugaagacggaggcucucacaaguccaaaaagaugaagccccuguacgugaauaccgagacauugacccucagggaaccugacggccugaaaaugaagcugauucucucaccaaaagagaaggggaguagcuccguagaugaagagucuuuccaguaucccagccaacaggcuacugugaaaaagucaaguaagaaauccgcacgggacgagcagggagccuuacugcuuggucacgaauugcagagcuuucugaagacagcucgcaaaaagcauaaaucuucaagugaugcccacagcuccccuggcccagagggguguggaucugacgcgucgcaauucgcagaaagccauuccgccaaccuagaucucucaggccuggagcccauccuugucgaaagugacucuagcuccgguggggagcuggaggcuggagaauuggugauugaugacucauacagagagaucaagaagaaaaagaaaagcaagaaaucuaagaaaaagaaggauaaagaaaagcacaaagagaagaggcacuccaaaaguaagcggagccucggccugucugccguuccugugggcgaagucaccgugacguccgggccaccgcccucaauaccuuacgcaggagcugccgcgccacccuuaccucugccaggucuccauacugacggccacagugagaagaaaaagaaaaaggaggaaaaagauaaggagcgcgaacgaggggagaagcccaaaaagaaaaauaugagcgccuaucagguauuuugcaaggaguacagaguuaccaucguggcagaccauccgggaauugacuucggcgaacuuucgaaaaagcuggcugaggucuggaagcaguugccugaaaaagauaagcuaaucuggaaacagaaggcccaauaucugcagcacaaacagaacaaggcugaggccacaacugugaaaaggaaggcauccucuagcgaagguucaaugaaggugaaagccaguuccgucgggguucucucuccccaaaagaaaagcccaccuaccacaaugcugcuucccgcuuccccagcgaaggcacccgagaccgagccuauugacguggccgcucaucugcaguugcucggcgaaucacugagcuuaaucggacaccggcugcaggagacggaaggcaugguagccgugagugggucucuauccguccuccuggauagcauaauuugugcacuuggaccauuggccugccugacuacacagcucccggagcugaaugguugucccaaacaagugcuuucgaacacccuggacaauaucgcuuacauuaugccuggcuuguga

SEQ ID NO: 57287 - RNA, 3459 nt, Artificial Sequence
  derived and/or modified sequence opt3 from HMHA1__Homo_sapiens__NP_001245257
augagcagaggccagagggugcugaaggggcuccuuggaugggucugcaccuggacaugggccuggcgggcccgccugggugcacgaggcuguggguugcacguuuuaugcccccgugaccugccucuaccaccggaggaacuccccagaaaagauggagccgacgcgguguucccuggcccaucccuggagcccccugcugguucuucagggguaaaggccacuggaacgcuuaaaaggccaaccagucugagccggcaugcauccgccgcuggcuuucccuugucuggcgcagccucguggacacucgggcgcucacacagaagcccucugacugcugccaguccaggagaacugccgaccgagggugcgggccccgauguggucgaagacaucucccaucucuuagcagauguggccagguucgcugaggggcuggagaaacuuaaagaauguguuuugcgggacgaucugcuagaggcccgccgaccuagagcacacgaaugccucggagaggcucugagggugaugcaucaaauuauaucuaaguacccacuucugaacacagucgagaccuugacugccgcgggcacacucaucgccaaggugaaagcauuucacuaugaaagcaauaacgaccuggagaagcaggaguucgaaaaggcuuuagaaaccauugccguagcuuuuuccucaacgguuagugaguuccugaugggugagguggauagcucuacucuccuugccgugcccccuggggacuccucacagagcauggaaagucuguacggaccaggcucugagggcacacccccguccuuggaagauugugacgcagggugccuaccugccgaggaagucgaugugcugcuccagcggugugagggaggugucgacgcugcgcugcuuuaugcaaagaauauggccaaauacaugaaggaccugaucagcuauuuggagaagcguaccacucucgaaauggaguuugcuaaaggccugcaaaagauugcccacaacugccgccagucgguuaugcaggaaccccauaugccauuacugucuaucuacucccuagcacucgagcaggaucuggaguucgggcacucaauggugcaagccguaggaacccuucagacacagaccuuuaugcagccuuugacgcugagaaggcucgaacaugagaaacggcgaaaggaaauaaaagaggcuuggcaccgcgcccaaagaaagcugcaggaagcagagaguaaucuuaggaaagcgaagcagggcuaugugcaacggugugaggaccacgauaaggcucgcuuccuggucgccaaagcagaagaggaacaggccgguagcgcucccggggccggcuccacugcaacaaagaccuuggacaaaagaaggcgucucgaggaagaggcuaagaacaaagccgaggaagcgauggccacuuaccggacaugcguggcugaugcaaagacccagaagcaggagcuggaagacacgaaaguuaccgccuuacgacaaauccaggaggugauuagacagucugaucagacaaucaagagcgcuacuauuucauacuaucaaaugaugcauaugcagaccgccccacugcccguccacuuucagaugcuaugugaaaguuccaaacucuacgacccuggacagcaauaugcaagccaugugaggcagcugcagcgcgaucaggagccagacguacacuacgauuucgagccgcauguuucugcgaaugccuggucacccgugaugcgggcuagaaagaguagcuuuaacgucuccgacguggccaggccugaagcagcuggcucuccacccgaggaagggggaugcacagaggguacuccugccaaagaccaccgcgcaggccgagggcaccaaguccauaagucguggccacuuagcaucuccgauucagacaguggauuggaucccggcccgggugccggggacuucaagaaauucgaacggaccucuagcuccggcacaaugucaagcaccgaggagcugguggauccugacggaggcgcuggggcgucugccuuugaacaggcagaucucaauggaaugacuccagagcugcccguugcugugccuuccggucccuuccgucacgaaggcuuaaguaaggccgccagaacgcauaggcugcgcaaacuucggacaccagcuaagugcagagaguguaacagcuauguauacuuucagggggcagagugcgaagaguguugcuuggccugucacaaaaagugccucgaaacccuggcgauacaauguggacacaagaaacuacagggcaggcugcaacucuucggucaggacuuuucucaugcugcccgauccgcaccugaugggguccccuucauugugaagaaaugcguuugugagaucgaacgccgggcccugagaacuaagggcauuuauagggugaauggagucaaaacccguguggagaaacuuugccaggcuuuugagaacggcaaggaauugguagagcugucacaggcaaguccacacgacaucagcaauguguuaaagcucuaccugcgccagcuuccggaaccucugaucucguuccgguuguaccaugagcucguugggcuggccaaggauucccuaaaagcggaagcugaggccaaggcagccucuagaggaaggcaggacggcagcgagucagaagcugucgccguggcacuggcuggucgacuccgggagcugcuucgcgauuugcccccagaaaacagagccagucugcaauauuuacucaggcaucugcggcgaauuguggaggucgaacaggacaauaaaaugacacccgggaaccuuggaauaguuuuuggcccuacccugcuaagaccacgccccacugaggcgacagugucccucucuagccugguggacuacccucaccaggccaggguaaucgagacguugauuguccacuauggucugguguucgaagaggaaccggaggagaccccaggcgggcaggaugaauccucaaaccaacgugcagagguugugguccaggugcccuacuuagaagcuggagaggccguuguguauccucuccaggaagcugcagccgacggcugucgggagagcagaguagucaguaaugauucugacuccgaucuggaggaagccagcgagcuucugucgucaucugaagcuagugcguuggggcaccucuccuuucuggagcaacagcagagcgaagcaucucuagagguggccagcggaucccauucaggcagugaggaacagcuggaggcuacugccagggaagacggugauggggacgaggauggaccagcacaacagcuuagcggcuucaacacaaaucagucuaacaaugugcuccaggcuccccugccuccgaugcgcuugcgagguggcagaaugacccugggguccugccgggaaaggcaacccgaguuugucuga

SEQ ID NO: 57288 - RNA, 2178 nt, Artificial Sequence
  derived and/or modified sequence opt3 from HMMR__Homo_sapiens__NP_001136028
augagcuuccccaaggccccucugaaaagauuuaacgacccauccggcugcgcuccgucucccggggcauacgaugugaagacccucgagguccuuaaaggaccuguuucauuccagaagagucaaagguuuaaacagcagaaggaaagcaagcagaaucugaacguggacaaagauacaacuuugccagccuccgcgcggaagguaaaaucuucggagucaaagaaagaaagccaaaagaaugacaaggauuuaaaaauccuggagaaggaaauucgcgugcuacuccaggagcgaggugcucaggaccguagaauacaggaucuggagacggaacuugagaaaauggaagccaggcugaacgcagccuugcgggagaagaccagucucuccgcuaauaacgcaacacuggagaaacaacugaucgaacucacucgcaccaaugaguuacugaagucuaaauucagcgaaaacggcaaucagaagaaccuuagaauuuugucccuggagcuaaugaagcucaggaauaaacgggaaacaaagaugcgcgggaugauggccaaacaggagggaauggagaugaagcugcaggucacccaacgaucacuugaagagagucagggcaaaaucgcucagcuggaagguaaguuggugagcauugagaaggagaaaaucgacgaaaagucugagacugaaaaacuccuggaguauauagaagagaucuccugugccucagaucaaguugaaaaguacaaauuagacauugcgcagcuggaggagaaccucaaggaaaagaaugaugagauccuuagccugaaacagaguuuggaagagaacauugugauccuaucuaagcaggucgaggaccugaaugugaaaugccaacuccuggaaaaggagaaagaagaucacguaaacagaaacagggagcauaaugaaaaccuuaaugcagagaugcagaaccugaagcagaaguuuauauuggagcagcaagaacgggagaaacuccagcagaaggaacugcagauugacuccuuacugcaacaggagaaagaacuaagcucgucucuccaccagaagcuguguuccuuccaggaggagaugguuaaagaaaagaaucuuuuugaggaagaguugaaacaaacacuggacgaacucgauaagcugcagcagaaggaggagcaagccgaacgucuugugaaacagcuggaggaagaggcuaagucacgcgccgaggaauugaaacuccuggaggaaaaguuaaaagggaaggaggcagaacuggagaagaguagcgcugcccauacccaggcgacgcuacuccugcaggagaaauaugacuccaugguccaaucucuugaagaugugacugcccaguucgagagcuacaaggcauugaccgcuucagaaaucgaggaccugaaacucgaaaacaguucccugcaggagaaggccgcuaaagccggaaagaaugcagaggaugugcagcaccaaauuuuagccacagaaagcucuaaccaggaguaugucagaaugcugcuugacuugcagacuaagucagcucucaaagaaaccgagaucaaggaaaucacaguuaguuuucugcagaaaauuaccgaucuacaaaaucagcugaagcagcaagaggaggacuucaggaaacagcucgaagaugaggaaggccggaaggcggagaaggagaacacgacugcagaacugacagaggaaauaaauaaauggcgacuuuuguacgaggaacuguauaacaagaccaaacccuuucaguuacagcucgacgccuucgagguggagaagcaagcucugcuuaaugaacauggcgccgcacaggagcagcugaacaaaauccgcgauagcuacgccaaguugcucgggcaccagaaucugaaacaaaagauuaagcacguagugaaacuaaaggacgaaaacucccagcugaaaucugaggucucgaagcucagaugccagcuggcuaaaaagaagcagagcgaaacuaaacuucaagaggaguugaacaaggugcugggaaucaaacauuuugacccuuccaaggccuuccaccaugaaucaaaagagaauuucgcauuaaagacaccacucaaggaagguaacaccaauuguuacagggcgcccauggagugccaggaaaguuggaaauga

SEQ ID NO: 57289 - RNA, 867 nt, Artificial Sequence
  derived and/or modified sequence opt3 from HMOX1__Homo_sapiens__NP_002124
auggagagaccccagccugacagcaugccacaagaucuguccgaagcccucaaggaggcuaccaaagaagugcacacacaggcagagaacgccgaguucaugaggaauuuucagaagggccaggucacucgggacggguucaaacuuguuauggcgucucuguaccauaucuauguggcuuuggaggaggaaauugagcgcaacaaggaaucaccgguauuugcccccguguacuucccugaggaguuacaccgaaaagcagcccuggaacaagaucuagcuuuuugguauggaccacguuggcaggaggucauacccuacacgccugcaaugcagagauaugugaagaggcuccaugaaguuggucggaccgagccagaacugcuuguggcccacgcuuacacacgcuaucugggcgacuugagugggggacagguccucaagaaaaucgcccaaaaggcgcuggaucugcccagcuccggcgagggucucgcauucuuuacuuucccuaauauugccucugcuaccaaauuuaagcaguuauacagaucgaggaugaacucacuggagaugacaccagccgugcggcagcgcguaaucgaagaggcaaaaaccgcuuuccuuuugaauauucagcuguuugaagaacuacaagaacuccugacucaugacacaaaggaucagagcccgagucgagcccccgggcuuagacagagggcguccaacaagguucaagacucugccccuguggagaccccacggggaaaacccccucugaauacgcguagccaggcaccauugcuccgcuggguccugacuuuauccuuccugguggcuaccguggccgucggccucuacgcuauguga

SEQ ID NO: 57290 - RNA, 951 nt, Artificial Sequence
  derived and/or modified sequence opt3 from HMOX2__Homo_sapiens__NP_001120676
augagcgccgagguggaaaccuccgagggcgucgacgaaucugagaagaaaaacucaggggcucuggaaaaggagaaucagaugagaauggcagaucucagugagcuucugaaagaaggaacaaaggaggcccacgacagggcggaaaacacucaauucguuaaagacuuuuugaaggguaauaucaagaaagaguuauucaagcuggcuacgaccgcccuauacuuuacauauagcgcacucgaggaagagauggaacggaacaaagaucaucccgccuucgcuccucuguacuuuccaauggagcuucaccgcaaggaagcacugacuaaagauauggaguauuucuuuggcgagaauugggaagaacaggugcagugcccgaaggccgcucagaaguacguagagcguauucauuauauagggcaaaacgagcccgaauugcucguggcccacgcguacacccgauauaugggagaccuguccggcggucagguccugaaaaagguggcacagagagcccucaaauuaccuucuacaggggagggaacccaguucuaccuguuugagaauguugauaacgcucaacaguucaagcagcuuuacagggcccggaugaaugcauuggaccugaacaugaaaacuaaggaacgcaucguggaggaagcuaauaaagccuuugaguauaacaugcagauuuucaaugaacuagaucaagcgggcucgacacucgccagagagacccuggaggacggcuuuccaguccaugaugggaagggagacaugaggaagugucccuucuacgcagcugaacaggauaaaggugcccuugagggcucaagcugcccuuuccggacggcuauggccgugcugcgcaagccaaguuugcaguuuauccucgcagccgggguagcucuggcggcaggauuacuggccugguauuacauguga

SEQ ID NO: 57291 - RNA, 516 nt, Artificial Sequence
  derived and/or modified sequence opt3 from HMP19__Homo_sapiens__NP_057064
auggugaagcugaacagcaaucccuccgagaaaggcaccaagccuccaucugucgaagacggguuccagacaguuccgcucaucacuccccuugaggugaaccaucugcaauugccugccccagaaaaaguaauugugaagacgagaaccgaguaccagcccgaacagaaaaauaagggaaaguuuagggucccuaaaauagcugaguucacagugacuaucuuaguuucacuggcacuagccuuucucgcgugcauuguguuccuggucguguauaaggcuuuuaccuacgaucacaguuguccagaggguuucguauauaaacacaagcggugcauccccgccagccuugacgcauacuauuccucucaggauccuaacucgcgcucacgauuuuacacaguuauuagccauuauaguguggccaaacaauccaccgcucgugcaaucggcccauggcugucugccgcugccgucauacacgaaccgaagcccccuaagacucaggggcauuga

SEQ ID NO: 57292 - RNA, 420 nt, Artificial Sequence
  derived and/or modified sequence opt3 from HMSD__Homo_sapiens__NP_001116838
augagcaucuccucugcccuggcuaugguguucaugggcgcaaaggggaacaccgccgcgcagaugucacaagcucucugcuuuaguaaaauuggaggugaggacggcgauauacacagaggguuccagagccuucuggucgccaucaauaggacagacacugaauacguuuugcggacggcaaacggauuauuuggcgagaaguccuaugauuuccugaccgguuuuacagacucuugugggaaauucuaccaggccacuauuaagcagcuagauuuugugaaugacaccgaaaaaucgacaacccgcguaaacucauggguggcugauaagacuaagggagagaauauccuccuguucuauuuugacaacauucuuaauagcuucaucgucaguucccugcaaaacugccagauauga

SEQ ID NO: 57293 - RNA, 1047 nt, Artificial Sequence
  derived and/or modified sequence opt3 from HMX1__Homo_sapiens__NP_061815
augcccgacgagcugaccgaaccuggcagagccacaccagcuagggcaagcuccuuccucaucgagaaccuucuggccgcggaagcuaagggggccggacgggcaacucagggugauggcucucgcgaggacgaagaggaggaugacgaugacccggaagaugaggacgccgaacaagcucgacguagaagguugcagcggcgcagacaguuacuggcagggacgggacccggcggugaggccagggcucgggcccuacucgggccuggagcgcugggccuuggcccacgcccuccuccagggcccggaccuccauuugcacuggguugcggcggggccgcucgaugguacccgagagcccacggaggcuauggugggggauugucacccgauaccagugacagggauagcccugagacaggcgaagagaugggccgggcagaaggggcuuggccacguggacccgguccuggcgccgugcagcgcgaggcggccgaacucgcagcuagagggccagccgcuggaacugaggaggccuccgaacuggcagagguccccgccgcugcgggcgaaaccaggggugggguuggcgugggaggcgggcggaaaaagaaaacacgaaccguauucucucgcucgcaaguguuucagcuggagucaacuuucgaccucaagagauacuuaagcagugcagaaagggccggacuggcugccucccuucaguugacagagacccaggucaaaauuugguuucaaaaucggcgcaacaaguggaagagacagcuggcagccgagcuagaagcugccucucucagcccgccuggugcacagaggcuggugcguguucccgugcuuuaucaugaguccccacccgcggcugccgcagccgggcccccagcuacgcugcccuucccuuuggccccagcagcuccggcgcccccuccaccccuccugggcuuuucaggagccuuagccuacccucuggcugcauucccagccgcugccaguguccccuuucuccgggcacagaugccgggccuuguguga

SEQ ID NO: 57294 - RNA, 546 nt, Artificial Sequence
  derived and/or modified sequence opt3 from HN1__Homo_sapiens__NP_001002032
augaccacaacuacgaccuucaagggcguggaccccaacagcagaaauuccucuaggguccugcggccuccagggggagguucaaacuuuagucucggcuucgaugagccgacagaacagcccguucgcaaaaauaagauggccagcaacaucuuugggacuccugaggaaaaucaggcuuccugggcaaaaucugccggagcgaagucgucaggcggucgagaggaccuugaaagcagugggcugcaacguagaaacuccucugaggcuagcuccggagauuucuuggaccugaaaaagauguggacccagacaugccaggccgcauggggcagggugaagcggucaccauguuuacuacgccucugccccgccagauggccuaggccacaaugucaccccgaggaaauuccucuggcugcaaguccagccagcucuuggguauccucagauugcccggagcggugucgcagcgugugcuuucuucaugcuugugaacugcacaauuugagucucaccguccaucugcuggaccucuuccacuga

SEQ ID NO: 57295 - RNA, 573 nt, Artificial Sequence
  derived and/or modified sequence opt3 from HN1L__Homo_sapiens__NP_653171
auguuccaggugcccgacagcgagggcgggagagccggauccagggcuaugaagccuccagguggcgaaucuucaaaccuguuugggaguccggaggaagcaacccccagcucccggccuaaccgcauggccucuaacaucuucggaccaacagaggaaccccaaaauauuccuaaacgaacuaacccacccggcgguaaggggucgggaauauuugaugagucaacgccuguccagacccgucagcaccucaauccaccgggcggcaaaacaagcgacaucuucgggagucccguuacugcgaccuccagacuugcucauccuaacaagccaaaagaucacguguuucugugcgagggagaggaacccaagucugacuugaaggccgcaaggagcauuccugccggugcugaaccaggcgagaaaggguccgcacggaaggccggacccgcuaaagagcaggaaccgaugccuacaguagauucacaugagccccgcuuaggcccaagaccuaggagucacaauaaggugcugaaucccccaggugggaaaagcucuaucuccuucuacuga

SEQ ID NO: 57296 - RNA, 1896 nt, Artificial Sequence
  derived and/or modified sequence opt3 from HNF1A__Homo_sapiens__NP_000536
auggugagcaagcugucccagcuccaaaccgagcuucuggccgcuuuguuagaaucuggccugucaaaagaggcacuaauccaggcccucggggaacccggaccuuaccugcuugcgggugagggcccacuggacaagggggaaaguugcggaggcgguagaggggaguuggcugagcucccgaacggacugggcgaaacaaggggcagcgaggaugaaacugacgaugacggggaggauuucacgcccccuauucugaaagagcucgaaaauuuauccccagaggaagccgcacaccagaaggccgucguugagacccugcuucaggaagaccccuggcggguggcuaaaaugguaaagucuuauuugcaacagcauaacauaccucagcgcgagguggucgauacaacuggacugaaucagucgcaccuaucacaacaucucaacaaggguaccccaaugaaaacacagaagcgagcagcccuguacaccugguaugugcguaaacagagagagguugcucagcaauuuacucacgccggccaagggggacuuaucgaggaacccacaggcgacgaacugccuaccaagaaagguaggcggaaucgcuucaagugggggccagcgagccagcagauuuuguuucaggcauacgagagacagaagaacccgaguaaagaagagagggagacgcucguggaagaguguaaucgggccgaaugcauccagcgcggagucucccccucucaagcucagggccugggcagcaacuuagugacugagguacgaguuuauaauugguucgccaacagaaggaaggaagaggcauuucggcauaaacuggcuauggauaccuacuccgggccuccacccggaccugguccaggccccgcccucccggcgcacucaaguccugggcuucccccuccagcccugagccccucuaaggugcacggaguccguuauggccagccagcaacauccgagacugcugaagugcccucaagcaguggugggccuuuggugaccgucucuacaccacuacaucagguuuccccgaccggccuggagcccagccacucgcuccugucuacggaagccaaacuuguguccgcugccggaggcccucugccacccguaucaacuuugacagcacuccauagucuggagcaaaccagcccuggguuaaaucagcagccacagaaccugauuauggccucccuacccggagugaugacuaucgguccgggcgagccugcuucucucgggccaacauucaccaauacgggagcgagcacccuggucauaggccuugcaucaacacaagcccagagugugcccguuaucaacuccauggguagcucuuugacuacccugcagccugugcaguuuucacaaccccuccacccaaguuaccagcagccucugaugcccccaguccaaagccacgugacacaguccccguucauggcuacuauggcccagcuucagucuccucaugcacuguacucgcacaagcccgaaguagcccaauauacccauacaggguugcucccacagaccaugcugauuacugacacgacaaauuuaagcgcucuggccucccuaacccccacuaaacagguuuuuaccucagauacagaggcaaguucugaaagcggccuccacaccccugcgucccaggcuacuacacugcaugugccaucacaagaccccgccggaauccagcaccuucagccugcacaccgcuugagcgccucuccgacggucuccaguagcucucuggugcucuaccaguccucagauaguagcaacggccaaucgcaucuguuaccauccaaccacucugucauugagaccuucaucagcacucagauggcuucaaguucccaguga

SEQ ID NO: 57297 - RNA, 1674 nt, Artificial Sequence
  derived and/or modified sequence opt3 from HNF1B__Homo_sapiens__NP_000449
auggugagcaagcugaccucccuccaacaagagcuucugucugccuuguuaucaaguggcgucacaaaagaaguucuggugcaggcucuagaggaacuccugcccagcccuaacuucgggguaaaacuugagacucugccauuguccccgggaucuggugcagaacccgacacgaagccuguguuucacacccucacaaauggccaugccaaggggagacugucgggagaugagggcucagaggacggugaugacuacgauacuccacccauccugaaagaacuccaggcguuaaacaccgaggaagcugccgagcagagggcagaggucgaccggaugcugagcgaagauccuuggcgcgccgcuaagaugauuaagggguauaugcaacagcacaauauaccacagcgagaggugguugacgugacaggacuuaaccagagucauuugucccaacaccugaauaaaggcacccccaugaagacucagaaacgugcagcccuauacacaugguaugucagaaagcagagggaaauccuccggcaguucaaccaaaccgugcagucuagcggcaauaugacggauaaauccucacaggaccaacugcuuuuucuguucccugaguuuagucagcagagccaugggccaggacagucugaugacgcuugcuccgaaccgacuaacaagaagaugcgcagaaauagguucaaauggggucccgccucacaacagauuuuguaccaggcguaugaucggcagaagaacccuagcaaagaggagcgcgaagcacucguagaggaauguaaucgagccgagugccugcaaagaggcguuaguccaucuaaggcucacggguuaggauccaaccuggugaccgaagucaggguguacaauugguuugccaaccggcguaaagaggaggcauuccgccagaagcucgcuauggacgccuauagcucgaaucagacacacucucuuaacccccuguugucccauggcucaccucaccaucagccaaguagcucucccccgaacaaacuauccggugugagauacagccaacaggggaauaacgaaaucacuucaaguuccaccauuagccaccacggaaauucugcgauggucacaucacagaguguucugcagcaagugagcccugccucccucgaccccggccauaaccugcuuucuccagauggcaagaugaucucgguaagcgggggaggucugccucccguguccaccuugacgaauauacacucacucagucaucacaacccacagcagucucaaaaucugaucaugacucccuuaagcggcgucauggcaauugcucagucccugaacacaucacaggcccagagcgugccuguuaucaauucuguggcugggucccuagccgcacuccaaccaguccaguuuagucagcagcugcauagcccgcaccaacagccccuuaugcagcagucuccuggaucccacauggcccaacagccauucauggcugcggugacccaguugcaaaacucacauauguacgcacacaagcaggagcccccucaguauagucauacuagcagguuuccaucggccaugguaguuacagacaccuccucuauuagcacgcugaccaauaugucaaguuccaaacaguguccccuccaggcuugguga

SEQ ID NO: 57298 - RNA, 1425 nt, Artificial Sequence
  derived and/or modified sequence opt3 from HNF4A__Homo_sapiens__NP_000448
augagacugagcaagacccucguggacauggauauggccgacuacuccgcugcacuugaucccgccuauacaacucuggaguucgaaaacguccagguuuugacgaugggcaaugacaccucuccuucagaggggacaaacuuaaaugcgccaaacagucugggagugagcgcucuaugcgccaucuguggugauagggcaacuggcaaacacuacggggccuccucuugcgacggauguaagggcuuuuuccggcgcucgguacguaaaaaucauauguauucaugccgauuuagcagacaauguguggucgauaaggacaaaaggaaccagugccgguacugucgccucaagaagugcuucagagcugguaugaaaaaggaagcagugcagaaugagagggaucggauuaguacccgccgauccucuuaugaagacagcucccugccgucaauaaacgcccuucugcaggcugagguuuugaguagacaaaucacaagccccgugucugggauuaauggagauaucagggccaaaaagauugcguccaucgcagacgucugugagucaaugaaagaacagcuccuggugcugguagagugggccaaguacauaccugcuuuuugcgaacucccauuagaugaccagguugcccugcuucgggcacacgcuggcgagcauuugcugcuaggcgccaccaagcguagcaugguguucaaagacguccuccugcuugggaacgauuauaucgugccccgccacuguccugagcuggcggaaaugaguagagugucuauuaggaucuuggacgagcucguccugccauuucaggaauuacaaauugaugacaaugaguacgccuaccugaaggcaaucauauucuuugaucccgacgcuaaaggacucuccgauccugguaagauuaaacggcuucgaagccagguucaggugucgcuggaagacuauaucaacgaucgccaguacgacucuagaggcagguucggggaguugcuacugcuccugccaacucuucaauccauuacauggcagaugaucgagcagauccaauuuauuaagcuguucggaauggccaaaauagauaauuugcuccaggaaaugcuguuaggcgguucaccgagugacgcuccccaugcccaccacccucugcauccacaccuaaugcaggagcauauggggaccaacguaaucguggcaaauacgaugcccacucaccucagcaacggacagaugugcgaauggccucggccacgcggccaagccgcuacccccgagacaccgcagccuucucccccaggcggguccggaagcgaaccuuauaagcugcuucccggugcggucgcaacuauugugaagccauugucagccaucccccagccuaccauaacaaaacaggagguuauuuga

SEQ ID NO: 57299 - RNA, 1338 nt, Artificial Sequence
  derived and/or modified sequence opt3 from HNF4G__Homo_sapiens__NP_004124
auggacauggccaacuacagcgaggugcuggaucccaccuauacaacucucgaguucgaaacgaugcagauccuuuacaauuccucugacucaagugcuccugaaaccagcaugaacacaacugauaauggcgucaacugccugugugcaauuugcggggacagagccaccggaaagcacuauggugcguccucuugugauggcugcaaaggguuuuucaggcggucgauacgcaagucacauguuuacagcugucgauuuagucgucaaugcgugguagacaaagauaagagaaaucaguguagguauugccgguugcgcaaauguuucagagcuggaaugaagaaggaggccgugcagaacgaaagggaccggaucuccacacgccgaucuaccuuugauggcagcaauauuccauccaucaacacuuuagcacaggccgaggucagaucaaggcaaauuagugugagcucuccggguuccucaacagacaucaauguuaaaaagauagcuagcaucggggaugugugcgagaguaugaaacagcagcugcuaguccucguggaaugggcaaaguacauucccgccuucugugagcugccucuugacgaucagguagcucuguugcgggcccacgcgggagaacaucuccugcugggcgcaaccaaacguucuaugauguauaaggacauccucuuacugggcaacaauuacguuauucaccgcaacuccugcgagguggagaucagcagagucgccaauagggugcuugacgaauuggugcggccauuucaagagauacagauugaugacaacgaauacgcuugccugaaggccaucgucuucuuugaucccgacgcaaaagggcuaucggauccuguuaagauuaaaaauaugcgauuccaggugcagaucggacucgaggacuauaucaacgaucgccaauacgacucuagagguagguuuggcgaacugcuucuguugcucccaacgcugcaguccauuacuuggcagaugauagagcaaauccaguucguaaaguuauuugggauggugaaaauugauaaccugcuccaggagaugcuucugggaggcgcuucaaaugacgguagucauuugcaccaccccaugcauccucaccuaagccaggauccacugaccgggcaaacaauccuccugggaccgauguccacucuuguccaugccgaccagauaucuacccccgaaacaccucugccaucacccccucagggcagcggccaggagcaauauaagauugcggccaaccaggcaagugugaucucccaccagcacuugagcaaacagaagcaacucuga

SEQ ID NO: 57300 - RNA, 156 nt, Artificial Sequence
  derived and/or modified sequence opt3 from HNMT__Homo_sapiens__NP_001019245
auggccagcuccaugagaucucuguucucagaccacggcaaguacguggagaguuuuaggcgguuccucaaccauagcaccgaacaccagugcaugcaagaguuuauggauaagaaacuucccgggaucauuggacgcuaucagaauuguugcuga

SEQ ID NO: 57301 - RNA, 918 nt, Artificial Sequence
  derived and/or modified sequence opt3 from HNRNPA0__Homo_sapiens__NP_006796
auggagaacagccagcugugcaaacucuucaucggcggccuuaaugugcaaaccuccgaaucuggacugagaggucacuuugaggccuucggcacauugacugacugugucguugugguaaacccccagacgaagaggucacggugcuuuggguucgugaccuacaguaaugucgaagaggcugaugcagccauggcggcuagcccucaugccguggacggaaacacaguugaauuaaagcgcgcagugucccgagaggauucugcccguccaggcgcucacgcaaaagucaagaaacuguuugugggugggcuaaagggagacguagccgagggcgaucucauugaacauuucucgcaguuuggcacuguugagaaggcugaaauaaucgccgacaaacagucagggaagaaaagaggauucgguuuuguguauuuccaaaaucacgaugcggcagacaaggccgcugucgugaaauuucauccgauucagggccacaggguggaggucaagaaggccguucccaaagaggauaucuacagcgggggaggcggugggggaagucgguccucucgcggcggcagagggggaaggggucggggcgggggacgcgaccagaacggccugagcaagggugggggcggaggcuauaauuccuacgggggauaugguggcgggggaggcgguggguacaacgcauauggcggaggcgggggagguucaaguuacggcgggagcgauuacggaaauggcuucgguggguuuggcucuuauucccagcaccaaucaagcuacggaccuaugaaaaguggcgggggaggcggugggggagguucuuccuggggcggccgaagcaacucggggccauauagaggaggcuacgggggaggcgguggguauggagggucuuccuucuga

SEQ ID NO: 57302 - RNA, 963 nt, Artificial Sequence
  derived and/or modified sequence opt3 from HNRNPA1__Homo_sapiens__NP_002127
augagcaaguccgagucucccaaagaaccugagcagcugagaaaacucuucaucggcgggcuuucauuugaaaccacagacgagagucugaggagccacuucgaacaauggggaacuuugacggauugcguggucaugcgggacccaaacaccaagcgcucccgagguuuuggcuucguuacauacgccacuguggaggagguagaugcugcaaugaaugcccguccgcauaagguggacgggagagucguggaacccaaaagggcgguuucucgggaggauucgcagcgcccuggagcucacuuaaccgugaagaagauuuuugucggcgguauaaaagaagacacagaggagcaucaccugagagauuauuucgaacaguacgggaagaucgaggugauugaaaucaugaccgacaggggaucaggcaaaaagcggggcuuugccuucguaacuuuugaugaccaugauagcguugacaaaauugugauccagaaguaucacacagucaacgggcacaauugugaggugcgcaaggcacuaaguaaacaagaaauggccuccgcuucuagcucccagcgaggaagaucagguaguggcaacuucgggggaggcaggggugggggauuuggcggcaaugauaacuucgggcggggagguaauuuuagcggccgugggggauucggcgguucucgcgggggcggaggcuacgggggauccggugacggcuauaacggguucggaaaugacggcucaaacuuuggugggggcggaagcuacaaugauuucggcaacuauaauaaccagaguucuaauuuugggccaaugaagggagguaacuucggcgggagauccagcggacccuacggcggugggggccaguacuuugcaaaaccuaggaaccaaggaggcuaugggggaucgucuuccucaaguagcuacggcuccggucggcgauucuga

SEQ ID NO: 57303 - RNA, 1026 nt, Artificial Sequence
  derived and/or modified sequence opt3 from HNRNPA2B1__Homo_sapiens__NP_002128
auggagagagaaaaggagcaguucaggaaacuguuuaucggcgggcucagcuucgaaaccacagaggaaucccuucggaacuacuaugagcaauggggaaagcugacugacugcguggucaugcgcgaucccgccucuaaacgaucacgugguuuuggcuucguuacguuuaguagcauggcugagguggacgcagccauggcggcuagaccucacuccauugaugggaggguaguggaaccaaagcgggccgucgcacgcgaggaaucuggaaaaccgggcgcccaugugaccguuaagaaguuguucgugggugggauaaaagaggacacagaggaacaccauuuaagagauuacuuugaggaauauggaaagaucgacacuauugagaucauuaccgauaggcagucgggcaaaaagcggggcuucggguuugucacauucgacgaucacgaccccguggauaaaaucguacugcagaaguaccauaccauaaauggacacaacgcugaaguucgcaaggcacuaucacgacaggagaugcaagaggugcagagcaguagauccgguaggggcgggaauuuuggauucggcgacucucggggugggggaggcaacuuuggcccugggccaggaagcaauuuccgugguggcuccgauggguauggaucaggccgcgguuucggggacggcuacaacggauauggcgggggacccgguggcgggaauuuuggaggcaguccugguuacgggggcggaagaggcggguacggagguggcgggccaggauauggcaaccagggugggggcuacggaggcggguaugacaauuacggaggcgguaacuaugggagcggaaauuacaacgauuucggcaauuauaaccagcaacccucuaauuacgguccuaugaaauccggcaacuuugggggaucaaggaacaugggcgggccauacggaggcgguaauuaugggccgggaggcagcgguggcagugggggauacggcgggcggucucgauauuga

SEQ ID NO: 57304 - RNA, 1137 nt, Artificial Sequence
  derived and/or modified sequence opt3 from HNRNPA3__Homo_sapiens__XP_005246437
auggaggugaagcccccuccaggcagaccgcagcccgacagcgggaggcggcgccgacguagaggagaagagggucacgauccuaaagaaccagagcaacugaggaaacucuucaucggcgggcuuuccuuugaaaccacagacgauucucugcgggagcauuucgagaaguggggaacuuugacggacugcgucguuaugcgcgauccccagaccaagagaucaaggggcuuugguuucgugacauacaguuguguagaagagguggacgccgcuaugugcgcacggccucacaaagucgaugggcgcgugguugaaccaaagcgagccgugagcagagaggacuccgucaagcccggagcgcauuuaacugugaaaaagauuuuuguaggcggcauaaaagaggauaccgaagaguauaaccugagggacuacuucgaaaaguaugggaaaaucgagacaauugaaguuauggaggaucggcagucuggaaagaagcgugguuuugcuuucgugaccuuugacgaucacgacacugucgacaaaaucguggugcagaaguaccauacaauuaauggccacaacugugaggucaaaaaggcccuaucgaaacaagaaaugcagucagcagggagccagcgcggaagaggcggugggaguggaaauuucaugggcaggggcgggaacuuuggagguggcgggggaaauuucggccggggugggaacuuuggcggacgaggcggguauggagguggcgggggaggcucccgcgguucuuacgggggcggagauggcggguauaauggauucgguggcgacgggggaaacuacggcggugggccuggcuacagcuccagaggaggcuaugggggaggcgguccaggguacggaaaucagggcgguggcuaugggggaggcgggggauacgauggcuauaacgagggugggaauuucggaggcgguaacuacggcgggggaggcaauuauaacgacuuugggaauuacucaggacaacagcagaguaacuacggcccgaugaagggugggagcuucggaggcaggucuuccgguucacccuauggcgggggauacggcagcgggggaggcagugguggguauggaucucggcgcuuuuga

SEQ ID NO: 57305 - RNA, 858 nt, Artificial Sequence
  derived and/or modified sequence opt3 from HNRNPAB__Homo_sapiens__NP_004490
augagcgaggccggcgaggaacagcccauggaaaccacaggggcuacugagaacggacacgaagcagugccugagggugaguccccagccggcgcggggacgggagcugccgcaggcgccgguggggcuaccgcagccccgcccucuggaaaucaaaacggcgcugaaggcgaccagaucaaugccucaaagaacgaggaagaugcggggaaaauguucgucggaggucugaguugggacacaagcaagaaagaucucaaggacuacuuuacuaaauucggcgagguuguggauugcaccauuaagauggacccuaauacagggagauccaggggauuuggcuucauacuuuuuaaggaugcagccucuguagagaaagugcuggaccagaaggaacaucgguuggauggucgcgucaucgaccccaaaaaggcuauggccaugaaaaaggauccagugaagaaaauuuucguugggggauuaaacccugaggcaaccgaagagaagauccgagaauauuuuggcgaguucggcgagauugaagcuaucgagcugccaauggaccccaaacuaaauaagcguagaggguuuguguucauaacuuuuaaagaagaggaaccugucaagaaagugcucgagaagaaguuccacacaguaucgggaucaaaaugugagaucaagguugcccagccaaaagaaguguaccaacagcagcaguaugguagcggcgggaggggaaaccggaaucgcggcaacagagguagugggggcggaggcgggggagguggccaaggguccaccaauuacggaaagucucagaggcggggcggucaucagaacaauuauaaaccguacuga

SEQ ID NO: 57306 - RNA, 921 nt, Artificial Sequence
  derived and/or modified sequence opt3 from HNRNPC__Homo_sapiens__XP_011535013
auggccagcaacgugaccaauaagacagaccccagauccaugaacucuagggucuucaucggcaaucugaacacucucguugugaaaaagucagauguagaggcuauuuuuaguaaauacgggaagauagugggaugcagcguccacaaagguuucgcauuugugcaguauguuaaugaacggaacgcccgcgcggcuguggccggcgaggacgggcgaaugaucgcaggacaaguccuugauauuaaucuggccgcugaaccuaaggugaaccguggcaaggccgguguaaaaagauccgcagcugagauguacgggucuguuacggaacauccaucgccgucacccuuguuaagcaguuccuucgaccuggauuaugacuuucagagggauuacuaugaccggauguacucuuauccugcccgcgugccacccccuccacccaucgcgagagcagucgugccuagcaagaggcagcggguguccggaaauaccucacgccgaggcaaaaguggcuucaacagcaagucugggcagagaggauccucaaaaagcgguaagcuaaagggcgaugaccuccaagccauuaaaaaggagcugacacagaucaaacagaaggucgauagucuucuggagaauuuggagaaaauagagaaggaacagucuaaacaagcuguugagaugaagaacgacaaguccgaggaagaacagagcucgucuuccgugaaaaaggaugaaacuaauguaaaaauggagucagaagggggagccgacgacagugcagaggagggcgaucuccuggacgaugacgauaacgaagacaggggugaugaccagcuggagcucaucaaggaugacgaaaaagaggcugaagagggggaggaugaccgggacagcgccaauggagaagaugacuccuga

SEQ ID NO: 57307 - RNA, 864 nt, Artificial Sequence
  derived and/or modified sequence opt3 from HNRNPD__Homo_sapiens__NP_001003810
augagcgaggaacaguucggcggggacggagccgcugcagccgcgaccgcugccguggguggcuccgcaggggagcaggaaggagccauggucgcugcaacacagggcgccgcugccgcggcagguucuggggccggaacuggcggcgggacggcuucaggagguaccgagggcgggagugccgaaagcgagggagcaaagaucgaugcuuccaaaaacgaggaagacgagggcaagauguuuauuggugggcugucuugggauacaacuaaaaaggaccucaaagauuacuucucgaaguuuggagaaguuguggacugcacccuuaagcuggaucccauaacaggcagaucaaggggcuucggguuuguauuguucaaagagagcgagaguguggacaaggucauggaucagaaagaacacaaguuaaauggaaaagugaucgacccuaagcgggccaaggcgaugaaaaccaaggagccaguuaaaaagauuuuuguggguggccuguccccggauacucccgaagagaaaauccgcgaauauuucgggggauuuggcgaggucgagucuauugaacuaccuauggacaacaagacaaauaaacgacgugguuucuguuuuaucaccuucaaggaggaggaaccagugaagaaaauaauggaaaagaaauaccauaacguagggcucagcaagugcgagaucaaaguugccauguccaaggagcaguaucaacagcagcagcaauggggcucaagaggaggcuuugcagggagggcucggggacgcgguggcgaucagcagaguggguacggaaaggugagcagaaggggcggucaccaaaauucuuauaaacccuacuga

SEQ ID NO: 57308 - RNA, 1092 nt, Artificial Sequence
  derived and/or modified sequence opt3 from HNRNPDL__Homo_sapiens__NP_001193929
auggaggugcccccucggcugagccacgucccaccgccccucuucccuuccgccccagcuacccuugcaucuaggucacugagucauuggcggccccgcccuccacgacaguuggcccccuuacugccuagccuagcgccauccucugcucgucaaggcgccagaagggcacagcggcacguuacagcccagcagccgucgcgccucgcugggggagcagccaucaaggguggcagaaggcggcgccccgaccuguuucgaagacauuucaaaucaagcaguauucaaagguccgcugccgcggcagccgcuacucggacggcccgucagcacccuccagcagauucuagcgugaccauggaagacaugaacgaguacuccaauauagaagaguuugcugaagggucaaagaucaacgccaguaaaaaucagcaggaugacggaaagauguucauuggcggucuuagcugggauacaucuaaaaaggaccugacugaguauuugucccgcuuuggggagguaguggauugcaccaucaagacagaccccgucaccggaagaucaaggggcuucggcuuuguacucuucaaagaugcggccagcguugacaaggugcuggaacugaaagagcauaagcucgaugggaaauuaauugacccuaagcgggcaaaggcucugaaaggaaaggaaccacccaaaaaggucuuuguggguggccuuaguccggauacuucugaggagcaaaucaaagaauacuucggggccuuuggagagauagaaaacaucgaguugccuauggacacaaagaccaaugaacgacgcggcuucuguuuuauuacguauacugacgaggagcccgugaaaaagcugcuagaauccagauaccaccagaucgguagcgggaagugcgagauuaaaguugcucagccaaaggaaguguauaggcagcaacagcagcaacagaaaggaggccggggcgccgcagccgggggacgcgguggcaccagagggaggggacguggccagcagucgacauacgguaaggcuucuagagggggcggaaaccaccaaaauaacuaucagccuuacuga

SEQ ID NO: 57309 - RNA, 1248 nt, Artificial Sequence
  derived and/or modified sequence opt3 from HNRNPF__Homo_sapiens__NP_001091676
augaugcugggccccgaagggggagaagguuucguggucaagcucagaggccuuccuuggagcugcuccguugaggacgugcagaacuuucugucugauuguaccauccacgacggggccgcuggaguacauuucauuuacacaagggaaggccggcaaucaggugaggcauuuguggaauuggggagugaggaugacgucaaaauggccuuaaagaaagaucgcgagagcaugggacaccgauauauagaaguguucaagucccaucguacugagauggacuggguucugaaacacucuggcccaaauucggcggauucagcuaacgacggcuuugugagacuaagggggcucccguucggaugcacgaaggaagagaucguccaguuuuucagcggucuggagauugugcccaauggcaucacccuuccuguagauccagaagggaagauuacaggagaggccuuuguucaguucgcaagucaggaacuggccgagaaggcuuugggcaaacauaaagaacggaucggucaccgcuacauagagguguuuaaguccucucaagaggaagucagaagcuauuccgaucccccucucaaauucaugucagugcagaggccagggcccuacgaccggccuggaacugcacgccgauauaucggcauugugaagcaggccggccuggagagaaugaggccaggggcuuacaguaccggauaugguggcuacgaagaguacagcgggcugucugacggauauggcuuuacaaccgaucucuucggucgggacuuauccuacugucugucagggauguaugaccaccguuacggcgauagcgaguucacuguccagaguacaaccggacauugcguucacaugcgcggccuuccguauaaggccacggagaacgacaucuacaacuuuuucucucccuugaauccugugagaguacauauugagaucgggccagauggaagggugacuggugaagcggacgucgaguuugcaacccacgaagaggccguggcugccauguccaaagaucgggcaaauaugcaacaccgauauauagaacuguuccuaaacagcacaacuggcgcuucgaauggggccuacucuucccagguuaugcagggaaugggcgugucagcggcccaggcaaccuacaguggucucgagagccaauccgucucuggguguuauggcgcuggauacagcggccagaacucaaugggaggguaugacuga

SEQ ID NO: 57310 - RNA, 1350 nt, Artificial Sequence
  derived and/or modified sequence opt3 from HNRNPH1__Homo_sapiens__NP_005511
augaugcugggcaccgaagggggagaagguuucguggucaagguuagaggccuccccuggagcugcuccgccgacgaggugcagagguuuuucucugauuguaaaauccaaaacggggcucaggggauucgguuuauauacacacgcgaaggccgaccuucaggugaggcauucguagaacuugagagugaggacgaagugaagcuggccuugaaaaaggaucgugagacuauggggcacagauaugucgaaguguuuaaaagcaauaacguugagauggacuggguguuaaagcauacgggaccaaauuccccggauaccgcgaacgacggcuucgucaggcugcggggccuacccuuugggugcucuaaggaggaaaucgugcaguucuuuucgggacucgagauuguaccuaaugguaucacacugccaguugauuuccagggccgcucaacuggggaggcuuuugugcaauucgccagccaggagauugcagaaaaagcccuuaagaaacacaaggagagaaucggacauagguacauagagaucuuuaaaaguucccgggcugaaguccgcacccacuaugaucccccucgaaagcugauggcaaugcagagaccaggccccuacgacaggccuggugccgggcggggauauaacucuauuggccguggcgcuggguucgagcgcaugagaaggggagccuacgguggcggguauggaggcuacgacgauuacaaugguuauaacgacggguacggcuucggaagcgaucgguuuggccgagacuugaauuauuguuucuccgggaugucagaccaucgcuacggagaugguggcaguacauuucagagcaccacugggcacugcgugcacaugagaggacucccauauagggcgacagaaaacgacaucuacaauuucuuuucuccgcugaaccccgugcggguccauauugagaucggcccugauggucgcguuaccggggaagcagacguggaguucgccacgcacgaggaugcuguagccgcaauguccaaggacaaagcuaauaugcaacauagauauguggaacuguuucucaacucaacugccggcgcgagcggaggcgccuacgagcacagguacgucgaauuauuccugaauaguaccgcaggggcuucuggaggugccuauggcucccagaugaugggaggaaugggccuuagcaaccagucgucuuacggugggccagcuucccagcaauugucaggcggauauggcgggggauacggcggucagaguagcauguccggguaugaucaggugcugcaagagaacucuagcgacuuucagucaaauauagccuga

SEQ ID NO: 57311 - RNA, 1350 nt, Artificial Sequence
  derived and/or modified sequence opt3 from HNRNPH2__Homo_sapiens__NP_001027565
augaugcugagcaccgagggcagagagggguucguggucaagguuaggggacuccccugguccugcucugccgacgaggugaugcgguuuuucucagauuguaaaauccagaacgguacaaguggcauucgcuuuauauacacucgagaagggcguccuagcggagaggcuuucguagaacuugaguccgaggaagaggugaagcuggcauugaaaaaggacagagaaacgaugggccacagguaugucgagguguuuaaaucuaauucgguugagauggauuggguguuaaagcauaccgguccaaacucaccggacacagccaaugauggguucguccggcugcgcggacuacccuuuggcugcagcaaggaagagaucgugcaauucuuuaguggccucgaaauuguaccuaacgggaugacucugccaguugacuuccagggaagauccaccggugaggcguuugugcaguucgcuucucaggaaaucgccgagaaagcacuuaagaaacacaaggagaggauuggccaucgguacaucgaaauauuuaaaagcucccgcgccgagguccgaacacacuaugaucccccuagaaagcugauggcuaugcaaaggccagggcccuacgaccggccuggagcaggccgugguuauaauucaaucgggcgcggagccggcuucgaaagaaugaggcggggcgcuuacgggggagguuauggcggguacgaugacuacggaggcuauaacgaugguuacggguucggcagugaccgauuuggacgcgauuugaauuauuguuucagcggcaugucugaccauagauacggggacggagguuccucauuucagagcaccacuggccacugcgugcacaugagggggcucccauaucgggccacagagaacgauauuuacaauuucuuuaguccgcugaaccccaugcgcgugcauaucgaaauuggaccugacggcagagucaccggugaggcggauguugaguucgcaacgcacgaagacgccguggcugccauggcaaaggauaaagcuaauaugcagcauagguauguagagcuguuucucaacucuacugccgggaccuccggcggagcguacgaccacagcuacguggaauuauuccuuaauucgacagccggcgcaucugggggagcuuaugguucccagaugaugggcgggaugggacugucaaaccaaaguagcuacggcgguccagccucccagcaguugucugggggcuauggaggcggguacggaggccagagcucaaugagugguuaugaucaaguccugcaggaaaauuccagcgacuaccagucuaaccuagcuuga

SEQ ID NO: 57312 - RNA, 1395 nt, Artificial Sequence
  derived and/or modified sequence opt3 from HNRNPK__Homo_sapiens__NP_112553
auggagaccgaacagcccgaggaaacauucccuaacacugagacgaauggcgaauuugggaagagaccagccgaggacauggaggaggaacaggcuuucaaaaggagccggaacaccgaugaaaugguggagcugcgcauccuccuucaguccaagaaugcaggagccgucauugguaaaggcgggaagaacauaaaagcgcugcgaacagacuacaaugcuucuguuucagugccggauaguagcggacccgagcguaucuuguccauuucugccgacaucgaaacuauuggcgagaucuuaaagaagauaaucccuacccuggaagagggucuacagcucccaucgcccacagcaaccucacagcugccucuugaaagcgaugccguagagugccugaacuaucaacacuacaaagggagugacuuugauugugaguugagacuccugauucaucagucccuggcuggaggcaucauuggcgugaagggggcaaaaaucaaggaacucagggagaauacucagacaaccauaaaauuauuccaggaaugcuguccacacucuacggaccgggucgugcugauuggagguaagcccgaucgcguuguggagugcaucaagauuauccuugacuugaucagcgaauccccuauuaaaggcagagcccaaccauaugauccgaacuuuuacgacgagacuuaugauuacgggggauucaccaugauguuugacgacaggcggggccgccccgucgguuucccuaugcgagggagaggaggcuuugauaggaugccacccggccgugggggacggccuaugccacccucacgcagagacuaugaugacaugaguccgaggcgggguccucccccaccucccccaggccgagggggacgcggcgguagcagagcuaggaaucugccccuaccuccaccgcccccuccacgcgggggcgaucucauggccuacgaccggagaggaaggcccggcgaucguuacgacgggauggugggauucucugcggaugagacaugggacuccgcaauagauacuuggucaccuagcgaauggcagauggccuaugagccacaggguggcaguggguacgacuauucuuacgcuggaggccgggguuccuauggggaccugggcggacccaucauuaccacacagguaaccaucccgaaggaucuugccggcagcauaauugggaaaggaggucaacgaaucaagcagaucagacaugaaucgggcgcaucuauuaaaaucgacgagccucuggaaggguccgaggauaggauuauaacgaucacuggaacacaggaccaaauucagaacgcucaguacuugcuccaaaauucaguuaagcaauaugccgauguggagggcuuuuga

SEQ ID NO: 57313 - RNA, 1770 nt, Artificial Sequence
  derived and/or modified sequence opt3 from HNRNPL__Homo_sapiens__NP_001524
augagcagaaggcugcucccccgggccgagaagcgccgacguagacuugaacagaggcaacagccugacgagcagcggcgcagauccggcgcuauggugaaaauggcagccgccgggggagguggcgggggaggcagguacuauggugggggaucugaaggcggccgggcuccaaagcgccugaaaaccgauaacgccggggaccagcacggagguggcgggggaggcggugggggagcaggcgccgcuggcgggggagguggcggggagaauuacgaugacccgcauaagacacccgcaucaccugucguucacauccgaggauugauugauggcgugguagaagccgacuuaguggaggcucugcaagaguucgguccaauaaguuaugucgugguuaugcccaaaaagagacaggcccuaguggaauuugaggauguccucggggcgugcaacgcagugaauuacgccgcugacaaccagaucuauauugccggccauccugcauucguaaauuacagcacuucccagaagaucucuaggccaggagauucggacgauucacggagcguuaacagugugcugcuuuuuacgauucugaaucccaucuauuccauaaccacagacgucuuguacacuaucuguaacccuugcggcccagugcaacguauugugaucuuccgcaaaaaugggguccaggcuaugguugaauuugauucugugcagagcgcccagagagcgaaggccucccucaacggagcagacauuuacucagguuguugcacccugaaaaucgaguaugcuaagccgacaaggcugaauguauucaaaaacgaccaagauaccugggacuacacuaaucccaaccucaguggccagggggauccuggaagcaauccaaacaagcggcagcgacaacccccuuuacugggcgaccacccagccgaguauggugggccccauggcggauaccacucucacuaucaugaugaaggcuacgggccgccucccccacacuaugagggacgcagaauggguccucccgugggcgggcauaggcggggaccaucccgcuacggcccccaguacggucacccuccaccgcccccuccacccccugaauaugggccacacgcugacucacccguccuuaugguguacggcuuggaucagagcaagaugaacugugacagaguuuuuaauguguucugccuguauggaaacgucgagaaagugaaguuuaugaaaaguaagccgggcgccgcaaugguagaaauggccgauggguacgcuguugacagggcgauaacacaucuaaauaacaauuucauguuuggacagaaacucaacgugugugucucuaagcaaccugcaauuaugccaggccaguccuauggucuggaggaugggagcugcucguacaaagacuucucugagucccguaauaaccgguuuucaacccccgaacaggccgcuaagaaucgaauccagcacccuaguaacgugcuucauuucuucaaugcgccccuggaggucacggaagagaacuuuuucgaaauuugugacgaguugggagugaagagaccaagcuccguuaaaguguuuucuggcaagagcgagaggucaaguuccggucuccuggaaugggagagcaaaucugaugcauuagaaacucugggcuuccucaaucacuaucaaaugaagaacccuaaugggcccuacccauacacccuuaaacugugcuuuucaacagcccagcaugcuaguuga

SEQ ID NO: 57314 - RNA, 2193 nt, Artificial Sequence
  derived and/or modified sequence opt3 from HNRNPM__Homo_sapiens__NP_005959
auggccgcuggcguggaggcagccgcggaagucgcugccaccgagaucaagauggaagaggaaagcggggcacccggaguuccuuccgguaacggcgccccagggccgaaaggagagggcgagagacccgcucagaaugaaaagaggaaagagaagaacauuaaacggggugggaaucgcuucgaaccuuacgcaaacccaacaaagcgauaucgugccuuuauaacuaauauccccuucgacgugaaguggcaaucucugaaagaucucguaaaggagaaagugggagaggucacguacguggaacuucugauggacgcugagggcaagucaagaggcugcgccguuguggaauuuaaaauggaggaaaguaugaagaaggcggcagaggucuugaacaaacacagcuuauccgggaggccucugaaggugaaagaggauccagacggagaacaugcccggcgcgcuaugcagaagguaauggccaccacagguggcauggggaugggacccggcgguccugggaugauuacuaucccaccgucuauucuaaauaaccccaauaucccuaacgagauaauccacgcacuccaggcuggaagacugggcucgaccguuuucguggccaaucuugauuauaaagucggcuggaagaaacugaaggaaguguuuucaauggcggggguggucguuagggccgacauuuuggaggauaaggacggaaaaagccgggguaucggcacagugaccuucgaacagaguauugaggcaguacaagcuaucuccauguuuaacgggcagcuccuguucgaucgcccaaugcaugugaagauggacgagcgagcccugcccaaaggagacuuuuucccuccagaaagaccccagcagcucccgcacggcuuaggugggauaggcaugggacugggcccugggggacaacccauugaugcuaaucaucuuaacaaggguaucggcauggggaauauuggaccagccggcauggguauggaggggaucggcuuuggaaucaacaaaaugggcgggauggaaggaccuuucgguggcgggauggagaacaugggaagguuuggcucugguaugaauauggggcggauuaacgaaauauugagcaaugcacugaagcguggcgagaucauugccaagcagggaggcgggggaggcgguggguccguccccggaaucgagcgcaugggcccagguauagauagacuaggcggggcuggaauggaaaggaugggcgcggggcucggacacggcauggaccggguggguucagagauugaacgaauggggcugguuauggaccgcaugggaaguguggagagaaugggcagcgguaucgagaggaugggcccccuugggcuggaucacauggcaucuuccaucgaacggaugggacagacuauggagcgcauuggcucaggggucgaaagaaugggagccggcauggguuucggguuggagaggauggcugccccuaucgaccgugugggacagacaauugaacggaugggcagcgguguagagcgaaugggcccagcaauagagagaauggggcucaguauggaaaggaugguuccggccggaaugggcgcugggcuggagcgcaugggacccgugauggaucggauggccaccggcuuagaaagaaugggugcaaacaaucuggagaggauggggcucgaacgcaugggagcgaacucucuugagcgaaugggccuggagcggaugggcgcuaauuccuuggaacguauggggccugccaugggaccagcacuaggugccggcaucgagagaauggggcuggcuaugggaggcggugggggagccagcuucgacagggcaauugaaauggagcgcggcaacuuuggcgggucguucgcuggaucuuuugguggcgccgggggacaugcgcccggcgucgcccggaaggcuugucaaaucuucgugagaaaucucccuuuugauuucacguggaaaaugcugaaagacaaguuuaacgaaugcggucacguccuuuacgcagauaucaaaauggagaaugggaaguccaagggauguggcgugguuaaauucgagucaccagaaguggccgagagggcuugccgaaugaugaacggcaugaagcugagugggcgcgaaauugacguacggauagauagaaaugccuga

SEQ ID NO: 57315 - RNA, 1788 nt, Artificial Sequence
  derived and/or modified sequence opt3 from HNRNPR__Homo_sapiens__NP_001284549
auggccaaccaggugaauggcaacgcuguccaacugaaggaggaagaggaacccauggacaccagcuccguuacacacacugagcauuacaaaacgcucaucgaagcagggcuuccucagaagguggccgagagacuggaugagauuuuccagaccggauugguagcguauguggacuuagaugaaagggcuauagacgcccugcgggaguuuaaugaagagggugcacuaucuguccuccagcaauucaaagagucagaucugagucacgugcagaacaagagcgccuuucuuugcggcguuaugaaaacauaccgccagcgagaaaagcagggguccaaggugcaagagucuacuaaaggaccagacgaagcuaagaucaaagucuucgugggcaagauuccgcgugaucuguaugaggacgaauugguaccccucuuugagaaagcagguccuaucugggaucugagacugaugauggacccacucucggggcagaauaggggauacgccuucauuaccuuuuguggcaaggaggcugcccaggaagcgguuaaguuaugcgauucauaugagauccggcccggcaaacaucuggggguguguauaagcgucgcaaacaaucgccuuuucgugggaaguaucccuaagaacaaaacaaaggaaaauauuuuggaggaauuuuccaaagugaccgagggucuggucgacguuauccuauaccaccagccagaugacaagaaaaagaacagaggcuucugcuuucucgaguaugaagaccauaagucugccgcucaagccaggcggcgccugaugagcgggaaagugaagguauggggaaauguggucacuguggagugggcagaucccguugaagaaccugacccagaagugauggcuaaagucaaggugcuuuucguacgaaaccuggccacaaccguuacggaggagauuuuggaaaaauccuuuucagaguucggcaagcucgaaagagugaagaaacugaaggauuacgcguucguccacuuugaggacaggggugccgcagugaaagcuauggaugagaugaaugggaaggaaaucgagggagaagagauagaaauugucuuagccaaaccgcccgacaagaagcggaaagagcgucaggcugcccgccaggcaaguagaagcacugccuacgaggauuauuacuaucacccuccacccaggaugccuccacccauccggggccgaggccgcgggggagguagaggcggguacggauauccgccugacuacuauggcuacgaagauuacuaugacgauuacuaugguuacgacuaucaugacuacaggggcggguaugaggaucccuacuacggauaugacgauggcuacgcugugcgggggcgcggagguggcagagggggaaggggcgcgccaccucccccacguggucgaggggcacccccuccacggggcagagccggauauucucaaaggggcgcuccgcuggggcccccucgcggaucccgggguggcagagggggaccagcccagcagcagaggggccgcgguucacgagggagccggggcaaccguggaggcaauguugggggaaagagaaaagcagacggcuacaaccaacccgauaguaagaggcgccagaccaacaaucagcagaacugggguucucaaccuauugcccagcagccacuccagcaagggggagacuauuccggcaauuacgguuauaacaaugauaaccaggaguucuaccaggacacauacggccagcaauggaaauga

SEQ ID NO: 57316 - RNA, 2421 nt, Artificial Sequence
  derived and/or modified sequence opt3 from HNRNPU__Homo_sapiens__NP_004492
augagcuccucucccgugaacgucaagaaacugaagguuucagaacucaaagaggaacuuaagaaaagaaggcugagugacaagggcuugaaggccgaauuaauggagcggcugcaggcugcacuagaugacgaagaggccgggggacgcccugcgauggagccagguaauggcagccucgaucuugggggagacuccgcuggccgaucuggugccgggcuggaacaagaggcagccgcuggaggcgaugaagaggaggaagaggaagaggaagaggaggaaggcaucucggcacuggacggggaucagauggaguugggagaagagaacggugccgcuggcgccgcggacucagggccgauggaagaggaggaagcagccagcgaggaugaaaauggagacgaucagggcuuccaggagggugaagacgagcucggggaugaggaagagggagcuggcgacgaaaacggccacggggagcaacagccccagccuccagccacccagcaacagcagccccagcaacagcguggagcagcuaaagaggccgcggguaagaguuccggcccuacaucucuguuugccgugacuguagcaccacccggggcuagacagggacaacagcaggccggcggugacgggaaaacggaacagaagggcggagauaaaaagaggggcgugaagcggccucgcgaggaccaugggagaggauacuucgaauauauugaggaaaauaaauacagcagggcuaaguccccacaaccgcccgucgaggaggaagaugagcacuuugacgauaccgugguuugccuggacacauauaacugugaucuccauuucaaaauaucacgggaccgcuuaagugccagcucucugacuauggaauccuuugcauuccuuugggccgguggccgagcuucauacggggugagcaagggaaaagucugcuuugagaugaaggugaccgagaaaaucccuguaagacacuuguauacaaaggauauugacauccaugaaguuaggauuggcuggagucugaccacuucugguaugcuacucggggaggaagaguucuccuacggcuauagccugaagggaaucaaaacauguaauugcgaaaccgaggauuacggcgaaaaguuugacgagaacgacgugauaacguguuucgcgaauuuugagucggaugaagucgagcuuucuuacgccaaaaacgggcaggaccugggaguggcauucaagaucuccaaagaaguguuggcuggucggccacucuuuccccacguccugugccacaauugugccguugaguucaacuucggccagaaggagaagccuuauuuuccaauucccgaagaguacacuuucauccagaaugugccguuagaagaucguguacgcgggccuaaaggacccgaggaaaagaaagacugcgagguggucaugaugauuggccugccaggugcagggaagaccacaugggugacuaaacaugccgcugagaacccuggcaaguauaauauccucggaaccaacacaauaauggauaagaugaugguugccggcuuuaaaaagcaaauggcagacaccgggaaacuuaacacgcuguugcagagagcgccccagugucuaggaaaguucauugaaaucgcugccaggaaaaagcggaauuuuauucuggaucagacuaacgugucagcagccgcucaacgacgcaagaugugccucuucgccggcuuucagagaaaagcagucgugguauguccaaaggacgaggauuacaaacagaggacacagaagaaagcugaaguugaggguaaggaccugcccgaacacgccgugcuuaaaaugaaggggaauuucacccugccugaggucgcggagugcuuugaugaaaucacuuauguggaguugcaaaaggaagaggcccagaaacuccuggaacaguacaaggaggagaguaaaaaggcuuuaccaccggagaaaaagcaaaacacaggaagcaagaaauccaauaagaacaaaucuggcaagaaucaguucaaccgggguggcgggcaucgcggaagaggcggguuuaauaugaggggaggcaacuuccgugguggggcacccggaaaucggggcgguuauaaccgaagaggcaauaugccucagcgcgggggaggcgggggaggcagcggugggaucggauacccauaccccagggccccugucuuuccaggccgggguucauauaguaacagaggcaauuacaaccgcgggggaaugcccaacaggggcaauuauaaccagaauuuccgagggcggggaaacaaucguggcuacaaaaaccaaucccaggguuauaaucaguggcagcaagggcaguucuggggacagaagccguggagccagcacuaccaccaaggcuauuacuga

SEQ ID NO: 57317 - RNA, 2571 nt, Artificial Sequence
  derived and/or modified sequence opt3 from HNRNPUL1__Homo_sapiens__NP_008971
auggacgugagaaggcugaaggucaacgagcuccgggaggaacuucagcgccgaggccuggauacccguggguugaaagccgaauuagcugagagacugcaagcagcccuagaagcggaggagcccgacgaugaaagggagcucgacgcugaugacgaaccuggacggccaggucacaucaaugaggagguugaaacagagggcgggagcgaacuggagggaacugcccagccgcccccuccaggccuucagccccaugcagaaccugguggguacuccggaccagauggccacuaugccauggacaacauuacgcgccagaaucaauucuacgauacccaggugauaaagcaggagaacgagucuggcuaugaaagaaggccccuggagauggaacagcaacaggcuuaccggccugagaugaaaacagaaaugaagcagggggcaccaacuucauuuuugccgcccgaggccagucagcucaaaccugaccgccaacaguuccagagccgaaagagaccauaugaggaaaauaggggacgggguuacuuugagcaucgugaagaucgcagaggcaggucuccccaaccuccagcugaggaagacgaggaugacuucgacgauacccugguagccaucgacacauauaacugcgaucugcacuuuaagguggcgcgggaccgauccucgggguacccccucaccauugagggauucgcauacuuauggucaggcgcccgcgcuagcuauggugucagaagggggcggguguguuuugaaaugaaaaucaaugaggaaauuaguguuaagcaucugccguccacugagccugauccccacgugguccgcaucggauggucucuugacagcugcuccacacaguugggcgaggaaccauucucauacggcuaugggggaaccgguaaaaagaguacgaacagcagauuugagaauuacggcgauaaauucgccgaaaacgacgugauaggguguuuugcagauuucgagugcggaaaugacguagaacugucuuuuacuaagaacggcaaguggauggguaucgcuuucaggauucagaaagaggcccuagggggccaggcgcucuauccucacguucuggugaagaauugugccgucgaguucaacuuuggacaacgugcagaacccuacugcuccgugcuuccaggcuucaccuuuauccagcaucugcccuugucagagcggauucgagggacagugggaccuaaaagcaaggcugaaugugagauccucaugauggucggucugccagccgcuggcaaaacuaccugggccauaaagcacgcagccaguaauccgucuaaaaaguauaacauuuuagggacaaacgcuaucauggauaagaugagaguuaugggacugaggcgccagcggaauuacgcgggcagaugggacgugcucauucagcaagcaacccagugccuuaacaggcugauccagaucgccgcucgcaaaaagcgaaauuacauuuuggaccagacgaacguauaugguuccgcccaacggcguaaaaugagacccuucgaaggguuucagaggaaggcaauagugaucuguccuacugaugaggaccuaaaagaucgcacaauuaagcggaccgacgaggaaggcaaggaugucccagaccaugccgugcuggagaugaaagcuaauuucacucuccccgauguuggagacuuucuggaugaagugcuuuucaucgagcugcagagagaagaggccgacaaguuggucaggcaguacaacgaggaaggccgaaaagcagggccuccacccgagaagcgcuuugauaaucggggagguggcggguucagaggaaggggcggugggggcggauuucaacguuaugaaaaccgcggcccgccugggggaaaucggggcgguuuccagaacagagggggaggcagcgguggcgggggaaauuacaggggcggguuuaaccgaucgggaggcgguggguauucucagaaucgguggggaaacaauaaccgcgacaacaauaacuccaauaacagaggcucauacaauagggcgccacaacagcagcccccuccccagcaaccaccucccccacagccgccuccccagcagccacccccuccacccaguuauagcccugcucggaacccgccaggugccuccacauacaauaaaaacucuaauauacccggcagcucagcaaacaccaguacgccuaccguguccagcuacucuccaccccaaccuucauauagucagccgcccuacaaucaagggggauauagccagggcuacacagccccaccucccccaccucccccaccgccugcuuauaacuacggguccuauggaggcuacaaucccgccccauacacucccccuccacccccuaccgcacagacauauccgcagccaucuuacaaccaguaucaacaguacgcucagcaguggaaucaauauuaccagaaccagggucaguggcccccuuauuacgggaacuacgauuauggaucguacagcggcaauacucaagguggcaccuccacacaguga

SEQ ID NO: 57318 - RNA, 495 nt, Artificial Sequence
  derived and/or modified sequence opt3 from HOGA1__Homo_sapiens__NP_001128142
augcugggcccccagguguggagcuccgucagacaagggcucucuaggucacuuagucggaacguuggagugugggccagcggugagggcaagaaaguagacaucgcugggauuuacccuccagugaccacaccguucacugcaacggccgaagucgauuauggaaagcuggaggaaaauuugcacaaauuaggcaccuuucccuuccgcggugcgguugggggagugugcgcucuggccaacgugcuaggcgcacaggucugucagcucgagcgacugugcuguacaggccagugggaagacgcccaaaaacuucagcaucgucugauagagccuaaugcugcagugacuagaagguuugggaucccaggauugaagaagauuauggauugguucgguuacuauggcgggcccugccgggccccucuccaggagcuguccccagcugaagaggaagcccugcgcauggacuuuaccucuaacggauggcucuga

SEQ ID NO: 57319 - RNA, 675 nt, Artificial Sequence
  derived and/or modified sequence opt3 from HOMER1__Homo_sapiens__NP_001264006
augggcgagcagcccaucuucagcaccagagcccacguguuucaaauugacccuaacacaaagaaaaauugggucccaacuuccaagcaugcuguuacggugucuuacuucuaugauucaaccaggaacguauaccggauaaucagucuggacgggagcaaagcaauuaucaauuccacaauuacuccgaacaugaccuuuacaaagaccucucagaaauucggacagugggccgauucgcgcgcgaauacuguguauggucucggcuuuucaagcgaacaccaucuuaguaaggucacagagcuggaaugcguguccucucaggcuaacgccguucacacccauaagacggaguugaaucaaacuauccaggaauuagaggagacccugaaacuaaaggaagaggaaauagagcgacucaaacaggagaucgacaacgcacgugaacugcaggagcaaagagauagccuuacacagaagcugcaggaaguggagauuaggaauaaagacuuggaagggcagcucuccgaucuggagcaacggcuggagaagucacagaacgaacaggaggccuuccgcaauaaccucaagacuuuacuggaaauccuugacggaaaaauuuuugaguugaccgaacugagagauaaucuagcuaagcuccuggaguguaguuga

SEQ ID NO: 57320 - RNA, 1032 nt, Artificial Sequence
  derived and/or modified sequence opt3 from HOMER2__Homo_sapiens__NP_004830
augggcgagcagcccaucuucaccacaagagcccacguguuucaaauugacccuaacacuaagaaaaauuggaugccagcuagcaagcaggcagucacgguuuccuacuucuaugaugugaccaggaacucuuaccggauaaucucaguagacggggccaaagugauuaucaauaguacaauuacuccgaacaugaccuuuacaaagaccagccagaaauucggacagugggcggauucccgcgcuaauacugucuuuggucugggcuucucuucggaacaacagcucacaaaguuugccgagaaguuccaggaagugaaagaggcagccaagaucgcuaaagacaagacccaggagaaaauagaaacgucaagcaaccauagucaagcauccucuguuaaugggacugaugacgagaaggccagccacgcuggacccgccaacacccaucuuaaguccgaaaaugauaaacugaagaucgcguugacacagucagcagccaacgugaaaaagugggagauugaauuacagacucugcgagagaguaaugcucgucuaaccacagcccuccaggagagcgcagcuucugucgaacaauggaaaagacaguuuuccaucugcagggacgagaacgaucggcugcgcaauaagauugacgaacuugaggaacaguguucagagaucaacagagagaaagaaaagaauacccaacugaagaggcggauagaggaauuggaggccgaacuccgcgagaaagagacggaacugaaggaucugcgaaaacagagcgagauuaucccucagcucaugagugaaugcgaguaugugucugaaaaguuagaggcggccgagagagacaaccagaaccuggaagauaaaguaaggucccuuaagacugacauugaggaaagcaaguaccggcaacgucacuugaaaguugagcugaagucguuccuagaggugcucgacggcaaaaucgaugaccugcaugauuuucgcagaggucuuucuaagcuggggacagacaauuga

SEQ ID NO: 57321 - RNA, 1077 nt, Artificial Sequence
  derived and/or modified sequence opt3 from HOMER3__Homo_sapiens__NP_001139193
augagcaccgccagagagcagcccaucuucuccacaagggcucacguguuucaaauugacccugcaacuaagcggaacuggauaccagccggcaaacaugcgcugacggucucuuacuucuaugaugcuacccgcaauguuuaccgaaucauuucaaucgggggagccaaggcaauuaucaacaguacagugacuccgaauaugaccuuuacaaaaaccagccagaaguucggucagugggccgacucccgugcuaacacuguauauggccucggguuugcaucugaacagcaccuuacacaauucgccgagaaauuucaggaagugaaggaggcugccagacuggcgagggaaaagucgcaggauggaggcgaguugaccucacccgcauuaggucuggccagccaucaggucccuccaaguccccuaguguccgcuaaugggccuggagaggaaaaacucuuccggucucaaagcgccgacgcaccaggccccacggagcgcgaaagacugaagaaaaugcuuuccgagggcucaguuggggaggugcagugggaagcugaguuuuucgcccugcaggauaguaacaauaaguuggcgggagcccucagggaagcaaacgcugccgcugcccaguggcggcaacagcuggaggcacagcgcgccgaagcugagcgacugagacaaagggucgcggagcucgaagcacaggccgcuagcgaggugacuccuaccggugaaaaagagggcuuagggcagggacagucucuggaacaacuugaggccuugguacagacaaaggaccaggagauacagacucugaagucccaaaccggcgguccacgggaagcacuagaggccgcugaacgugaggaaacacagcagaaaguucagacccgcaaugccgagcucgagcaccaacugagagcaauggaaaggucacuugaggaagcgcgggcugagcgagagcgcgccagagcagaaguggggagggccgcucagcuguuggaugucagccucuuugagcugagugaauuacgggagggacuggcccgccucgcagaagcugccccguga

SEQ ID NO: 57322 - RNA, 1653 nt, Artificial Sequence
  derived and/or modified sequence opt3 from HOMEZ__Homo_sapiens__NP_065885
auggugagaggcugggagcccccuccagggcuggacugcgccaucagcgaaggacacaaguccgaggguaccaugccgcccaacaaagaggcuucuggccucucaaguagcccugcagggcuuauuugucugccacccauauccgaggaauugcaguuagucuggacacaagccgcgcagacuucugagcuggauucgaaugagcaucuacucaagacguucucauacuuuccuuauccaagccuggcugacaucgcccuucugugcuugagguacggacuccagauggaaaaaguuaagaccugguucauggcacagcggcugcgcuguggcauuaguugguccucugaggaaaucgaggagacacgagcccgugugguauauagaagggaucaacugcacuuuaaaagccucuuauccuucacucaucacgcuggucggcccccugaagaggugccaccgcccccugucccagcacccgaacagguggggauuggaaucggcccuccaacccugucaaagcccacacagaccaagggccuuaaaguugagccggaagaaccuagucagaugcccccauugccucaaagccaucagaagcugaaagagucucuaaugacucccggguccggagccuuuccauaccagucagacuucuggcagcaccuccaaagcaguggucugucuaaggaacaggcuggccgcgggcccaaccagucccacggaauaggcacagccagcuggaaucauucgaccacggugccucaaccacaggcgagagauaaaccgcccccuaucgcacuuauugccucuuccugcaaggaggaaucagcuaguagcgucacuccauccucuagcucaaccaguuccagcuuucaggugcuggccaacggugcaacagcugccucuaagcccuugcagccucucggguguguaccacaaucaguuagucccagcgagcaggcgcugccgccucacuuagaaccagccuggccccagggacugaggcauaauuccgugccuggccgggucggccccacugaguaucucucuccagacaugcagcgccaacgaaaaaccaagagaaaaacaaaggagcagcuugcaauccugaaaucguucuuuuugcagugccagugggcuaggcgggaagauuaccaaaagcuagagcagauuaccgggcugccucgucccgaaaucauacagugguucggagacacgcgcuaugcccucaaacacggucagcugaagugguuuagagauaacgcugugccaggcgccccgagcuuccaagacccugcaauucccacuccacccccuuccacaaggucacuuaaugagcgggccgaaaccccaccccugccuaucccgccacccccuccagauauucagcccuuggagcgauacugggcugcgcaccagcaacuccgcgagacugacaucccucagcugagucaggcaucuagauuaagcacacagcaagugcuggauugguuugacuccaggcuaccgcagcccgccgaagucguugugugucucgacgaggaagaggaggaagaggaagaggaacugccagaggaugacgaggaagaggaagaggaagaggaggaagaugacgaugacgaugacgaugacguaaucauucaggauuga

SEQ ID NO: 57323 - RNA, 2154 nt, Artificial Sequence
  derived and/or modified sequence opt3 from HOOK2__Homo_sapiens__NP_001093646
augagcguggacaaggccgagcugugcggcucccuccuuaccuggcugcagacauuccacguccccucuccuugugcuucaccacaagauuugaguagcggguuagcaguugccuacgugcugaaccagaucgacccguccugguuuaaugaagcguggcuacagggaauuucugaggaucccgguccuaacuggaaacucaagguaucgaaucugaaaauggugcuuagaucacuggucgaauauagccaggacguguuggcucauccaguuagugaggaacaccuccccgaugugucccugauaggcgaguucucugacccugccgagcuggggaagcucuuacaacugguccuuggaugcgcaaucagcugugagaaaaagcaggaucauauucagaggaucaugacuuuggaggaauccgugcagcacguaguuauggaggccauucaagagcugaugacgaaggacaccccagauucacuaagucccgaaacauacggcaacuuugacagccagucucggcgcuauuacuuccucuccgaggaagcugaggaaggugaugagcugcagcagcgaugccuugaccuggagcgucaauugaugcuccugucagaagagaaacagagcuuagcacaggaaaaugccgggcugagagagaggaugggacggccugaaggcgagggcacuccagggcucaccgcuaagaaacuucuguugcuacaaagucagcuggagcagcuccaggaagagaacuuucgccuggaaucuggaagagaggaugaaaggcuucggugugccgagcuggagcgcgaaguggcggaguugcaacaucgaaaucaggcacucacaucccuggcccaggaagcucaggccuuaaaggacgagauggacgagcugagacaaagcucggaaagggcaggucagcuagaggcuacccucacuucuugccggcgucgccugggcgaacuuagagaguugaggcggcagguccgacagcuggaagaacgcaacgccgggcacgcggagagaacaaggcaacucgaagaugagcugcggcgcgccggaucccuuagagcacagcuggaagcucagaggcgucaggugcaagaguugcagggccagcggcaagaagaggccaugaaagcugagaaguggcuguucgaaugucgaaaucucgaggaaaaguaugagucagugaccaaagaaaaggagagauuacuggccgagagggacagucuacgcgaagcaaacgaggaacuccggugcgcccagcugcagccgagaggucuuacgcaggcugaucccagcuuggacccuacuuccaccccagucgauaaucuggcggcagagauccuccccgccgagcugagggaaacauuacugcgccuucaauuggagaacaaacgacucugucggcaggaagcugccgaccgugagagacaggaggaacugcagaggcaccuagaggaugcaaaucgcgcccggcaugggcuggaaacucaacacagacucaaccagcagcagcugucugagcuuagggcucaaguugaagacuugcagaaggcccugcaggagcaaggaggcaaaaccgaagauagcauauuacucaagcgaaaacuggaggagcaucuucagaagcugcacgaagcagacuuggagcuccagcgcaagcgggaauacaucgaggaacuggagccuccaacagauucaaguaccgcgagaaggauugaggaacuacagcacaaucugcagaaaaaggacgcugaccuccgugccauggaggaacgcuaucggagauacguggauaaagcaaggaugguaaugcaaacgauggagcccaagcagcgaccggccgcuggcgccccucccgagcugcauucccuucggacucaguugcgcgaaagagacgugaggauccggcaccuggagauggauuuugagaaaagccgaucucaaagagaacaggaagagaaguuacucauuucagcaugguacaacauggggauggcucugcagcagcgcgccggagaggaaagggcgccagcccaugcucaaaguuuccuugcacagcagcgucuggccacaaacagccggagagguccucuaggcaggcucgcuucccugaauuugcgccccaccgacaagcacuga

SEQ ID NO: 57324 - RNA, 2157 nt, Artificial Sequence
  derived and/or modified sequence opt3 from HOOK3__Homo_sapiens__NP_115786
auguucagcguggagucccuggaaagagccgagcucugcgaaucucuucugaccuggauccagacauuuaacgucgacgcucccugucaaacuguugaggauuugacgaauggcgugguaauggcacagguguuacagaagauugacccugccuacuucgaugaaaacuggcugaauaggauaaaaaccgaggucggggacaacuggcggcuaaagaucucaaaucucaaaaagauucugaaaggaauccuugauuauaaccacgagauucugggucagcaaaucaaugacuuuacauugccagaugugaaccucauaggcgaacauagugacgcggcugagcuggggcgcaugcugcagcucaucuuaggaugcgccguuaauugugaacagaagcaggaguacauucaagcaaucaugaugauggaggaaagcgugcagcacgucgugaugacugccauucaggagcugauguccaaggaaucuccgguaucggcuggcaacgaugcauauguugaccuugaucgacaguugaaaaagaccacagaggaacugaaugaggcccuaucagcuaaagaggaaaucgcccaacguugccaugagcucgacaugcaaguggcggcacugcaggaagaaaagagcagucuucuggccgaaaaccaggucuugauggagagacucaaucaguccgauucuauagaggaccccaacagcccugcugguaggcggcaucugcaguuacagacccaacuggaacagcuccaggaggaaacuuuccgccuugaggccgcaaaagacgauuacagaauuaggugugaggagcuggagaaggaaaucuccgaguugcggcagcaaaaugacgaacuaacaacccuggcugaugaggcccagucacucaaggacgagauugaugugcugcgccacaguagcgacaaagugucuaaacuugaagggcaggucgaguccuauaaaaagaaacuggaagauuugggagaccuccgaagacagguuaagcuguuagaggaaaagaacacgauguacaugcaaaacacugugucacuggaggaggaacuaaggaaggcgaaugccgcacggagccagcucgagaccuauaagcgucagguaguggaacugcagaaccgccuuagugaggaaucuaaaaaggcugauaaauuggacuuugaguacaagagacugaaagagaaggucgauucccuccaaaaggaaaaagacaggcugcggacagagcgagacagccuuaaggaaacuaucgaggaacugcgcugcgugcaggcccaggagggccaauugaccacacagggccucaugccacuggggucgcaggagucuuccgauucauuagcugccgaaaucguuacccccgagauuagagaaaaacugauaaggcuacagcacgagaauaagaugcucaaacugaaccaagagggaagugacaaugaaaagaucgcacuuuugcagagccugcucgaugacgccaaccugcggaagaaugaguuagaaacggagaaccgccuggugaaucagagacuuuuggaaguccagucccaaguggaggagcuccagaaaucucugcaggaucaggguagcaaggcugaagacucaguacuacugaaaaagaaacucgaggaacaccuggagaaacuucaugaagcgaacaaugaguugcaaaagaagagggcaauuaucgaggaucuggaaccucguuucaacaauaguuccuuaaagauagaggaacuccaggaggcccugcggaaaaaggaagaggagaugaaacagauggaggaacgauacaagaaauaucuugaaaaggcuaagagcguuauuagaacucuggacccaaaacaaaaccagggcgccgcacccgagauccaggccuugaagaaucagcuccaagagagggaucgccuguuucacucucuagaaaaagaguacgaaaagacaaaaucacagcgggagauggaagagaaguauaucgugagugcuugguacaacauggggaugacccugcauaagaaagccgcagaggacagacucgcgagcacuggauccggccagucuuuccuggcuaggcagcgccaagccacaucgagccgacgguccuauccuggucacguccagccagcaaccgcccguuga

SEQ ID NO: 57325 - RNA, 222 nt, Artificial Sequence
  derived and/or modified sequence opt3 from HOPX__Homo_sapiens__NP_001138931
augagcgccgagaccgcuuccggccccacagaagaccagguggagauccuggaauacaacuucaauaaggucgauaaacacccugacucuacuacgcucugccuuauugcagccgaggcggggcugucagaagaggagacccaaaagugguuuaaacagagauuggcuaaguggaggcggagugaaggauuaccaagcgagugucgcuccguuacagauuga

SEQ ID NO: 57326 - RNA, 924 nt, Artificial Sequence
  derived and/or modified sequence opt3 from HORMAD2__Homo_sapiens__NP_689723
auggccaccgcucagcugagccacugcaucacaauucauaaggcauccaaagagacuguguuccccucucaaauaacgaacgaacacgagucacucaagauggucaaaaagcuguuugccaccaguaucagcuguauuacauaccuuagaggcuuguucccugaauccucuuauggggagaggcauuuagacgaucugucgcuaaaaauccuccgggaagacaagaagugcccaggaucacugcacauuauccgcuggauacaggguuguuuugaugcgcuugagaaacgauaccugcguauggcuguuuugacucucuauaccgacccgaugggcagcgagaaggugacagaaauguaccaguucaaauuuaaguauaccaaagagggggccacuauggauuucgacagucauuccucuagcacauccuuugaaucaggaaccaauaacgaggauaucaagaaggcaaguguacugcugauuagaaaacucuacaucuuaaugcaggaccuggagccccuuccuaauaacguggucuugacgaugaagcugcacuauuacaaugccgugacuccacacgauuaccaaccccuaggcuucaaagaagguguuaacagccauuuucuccuguucgacaaggagccuauuaaugugcaggucggguuugugucuaccggauuccacuccaugaaaguaaagguuaugacagaagcuacuaaagugaucgaucuugagaacaaucuguuuagggaaaacucaaccacagagauagcacaucagggcuuggacugcgaugaggaagaggaauguaaugaccacauucagcggaugaacuucgucugcagccaacagaguucugaguguucccgcaagaagagaaaagugagcgaaccagugaaggucuucauccccaauaggaaauga

SEQ ID NO: 57327 - RNA, 1233 nt, Artificial Sequence
  derived and/or modified sequence opt3 from HOXA10__Homo_sapiens__NP_061824
augagcgccagaaagggcuaccugcuccccuccccuaacuauccaaccacaaugucuugcucagagaguccggcugcaaauagcuuccuuguggacucccugaucucuucggggaggggagaagccgguggcgggggaggcggugcgggcggaggcggcgggggagguuacuaugcucacggcggggucuacuugcccccugccgcagauuuaccauauggacugcagucauguggccuauuucccacucucggugggaaacggaacgaggccgcuagcccuggaaguggcggcgggggagguggccuggggccaggagcacauggcuacggucccuccccuauugaccuuuggcuggaugccccacgcucuugccgaauggaaccgcccgacgggccuccacccccuccacaacagcagcccccgccucccccacagccuccccaaccagcuccccaggccacgagcuguuccuucgcgcagaauauaaaggaggaaucaaguuauugcuuguacgauagcgcagacaaauguccuaagguuucugccaccgcugccgagcucgcaccauuuccgcgugggcccccuccagauggaugcgcucugggcacauccucaggggugcccguaccuggauacuucagacugagccaggccuaugguacugcgaaaggcuacgggaguggaggcgguggggcccaacagcucggcgcaggaccauuucccgcucagccgccuggcaggggguucgacuuaccacccgcccuggcuucuggauccgccgaugcagcccggaaggagcgcgcucuugacagcccucccccaccuaccuuggcgugugguucgggcgggggaucucagggcgaugaagaggcacacgccuccucaagugcugccgaagaguuaagccccgcaccauccgagucuagcaaggccucaccggaaaaagacagucuagguaacuccaagggggagaaugcugccaacuggcucacagcaaaaagcggcagaaagaaaaggugcccuuauaccaagcaucaaacucuggaacuugagaaggaauuucuguucaauauguacuugacacgggagcgccgacucgagaucucuagaucagugcaccugaccgauaggcaggucaaaauuugguuucagaaccggcguaugaagcugaaaaagaugaaucgcgaaaacagaaucagggagcugacggcgaauuucaacuuuaguuga

SEQ ID NO: 57328 - RNA, 942 nt, Artificial Sequence
  derived and/or modified sequence opt3 from HOXA11__Homo_sapiens__NP_005514
auggacuucgaugagagaggccccugcagcuccaacauguaccugccuucuuguaccuauuacgugucagggccagacuuuaguagccucccguccuuccuuccccagacaccuucuucgaggccaaugacuuauucauacagcaguaaucugccccaaguccagccuguucgggaagugacguuucgcgaguaugccaucgaaccagcuaccaaguggcacccccgaggaaacuuggcacauugcuacuccgccgaggaauuaguacaccgugauugucugcaggcgccuucugcugccggugugccaggcgacguccuagcaaaaagcuccgccaauguguaucaucacccgacacccgcuguuucaaguaacuucuacagcacuguggggagaaauggaguccucccucaggcauuugaucaauucuuugagaccgccuacggcacaccagagaaccuggcuucuuccgacuaucccggugauaagucagccgaaaaagggccuccagcggcaaccgccacuagcgcugccgcagcugccgcggccacaggagcacccgcuaccaguucuuccgacagcggcggcgggggagguugcagggagacggccgcugccgcagaagagaaggagcggcgcagaaggccggaaucgucuuccucaccugagaguagcuccggccauacugaagauaaagccgggggaucuagcggccagcggacccgcaagaagcgaugucccuacacaaaauaucagauuagagagcuugaaagggaguucuuuuucucaguguacauaaauaaggagaaacggcugcaguugagucguaugcucaaccugacugaccgccaaguaaagaucugguuucagaauagaaggaugaaagaaaagaagauuaaccgggaucgacugcaguauuacuccgcuaauccacucuuauga

SEQ ID NO: 57329 - RNA, 1167 nt, Artificial Sequence
  derived and/or modified sequence opt3 from HOXA13__Homo_sapiens__XP_011513646
augaccgccagcgugcugcuccaccccagauggaucgagccuacagucauguuccuuuacgacaacggcgggggacugguugcugaugaauugaauaagaacauggagggugcagccgcggcugccgcagccgcugcagccgcugccgcggcaggcgccgggggaggcgguuuuccacauccggcugccgcagcugccgggggaaauuucuccguggcggccgcagcugccgcugccgcagccgcugcggcaaaccagugcaggaauuuaauggcccaccccgcuccucuggccccaggcgcagccucugcuuauucaagugcccccggcgaagcaccuccaagcgcggcugccgcagccgcugccgcagcugccgcggccgcugcagccgcugccgcauccucuucagggggacccgguccugcgggcccagccggggcugaggccgcaaaacaauguucgccgugcagcgcugccgcacagaguuccucuggacccgccgcucuaccuuacggcuauuuugguagcggguacuauccaugugcgcggaugggaccccauccuaacgccauuaaguccugcgcacagccagcuucagccgccgcugcagccgcguucgcugacaaauacauggauacugccggccccgcagccgaagaguuuaguagccgcgcuaaggaguucgcauuuuaucaccagggcuacgccgcggggccguaccaucaccaccaaccuaugcccggauaucucgacaugccaguagugccuggucugggcgggcccggagaaucucgacaugagccacuuggccugcccauggaauccuaccagccuugggcuuugccaaaugguuggaacgggcagauguauuguccgaaagagcaggcccaacccccucaccucuggaagucaacgcugccagaugucgugagccaucccagugacgcaucuuccuaccguagaggcaggaagaaacggguuccuuauaccaaggugcagcugaaagagcucgaacgcgaguacgccacaaauaaguucauaacuaaagauaagagaaggcggaucagcgcuaccacaaacuuaucggaacgccaggucaccauuugguuucagaaucgaagagugaaggagaaaaagguaaucaacaaacugaagacuacaucuuga

SEQ ID NO: 57330 - RNA, 1008 nt, Artificial Sequence
  derived and/or modified sequence opt3 from HOXA1__Homo_sapiens__NP_005513
auggacaacgccagaaugaauagcuuccuggaguaccccauccucuccucuggcgauucagggaccugcagugcuagggcauauccuagcgaccaccggauuacaacuuuucaguccugugccgugucugcgaacucgugcggaggugaugaccgcuuccuugucggccgagggguucaaauaggaucaccacaucaccaucaccaucaccaccaucaccauccgcagcccgcuacguaccagaccagcggcaaucugggugugaguuauucccacucuagcugugggccuuccuacggaucacagaacuuuagugccccauauagccccuacgcauugaaucaagaagccgauguaucuggcggcuauccucagugcgcuccagcaguguacuccgggaacuuaucaagccccaugguccagcaccaucaccaucaccagggauacgccgguggcgcuguggggaguccucaauauauccaucacucuuacggacaggagcaccagucccuggcccuagcgacauauaauaacagccucucgccacugcaugcaucucaccaggaagccugucguuccccggcuucagagaccaguagccccgcccaaaccuucgacuggaugaagguuaaaagaaauccuccaaagacaggcaaagugggugaauacggguaucuuggacagcccaacgcagucaggaccaauuuuacuacaaagcagcugaccgaguuggagaaagaguuccauuuuaacaaguaccucacgcgggcucgcagaguggaaauugccgcgucccugcaacugaaugaaacucagguaaagaucugguuccagaacaggcggaugaaacagaagaaacgcgagaaggagggccucuuaccuauuucuccagccacucccccgggcaaugaugaaaaagcagaggaaagcucagagaagaguuccagcucuccuugcguucccucaccagggaguagcacauccgacacucugaccacaucucacuga

SEQ ID NO: 57331 - RNA, 1131 nt, Artificial Sequence
  derived and/or modified sequence opt3 from HOXA2__Homo_sapiens__NP_006726
augaacuacgaguucgaaagagagaucggcuuuauuaauagccagcccucccuggccgaaugccucaccucuuucccuccaguggcugacacauuucaaucaaguagcauaaagacuuccacgcuuucucacucgacccugaucccgcccccuuucgagcagacaauuccaucauugaaccccgggagccauccuaggcacggagccgguggccggccaaaacccaguccugcagggucccgcggaucuccagucccggcgggcgcuuuacagcccccugaauauccauggaugaaggagaaaaaggccgccaaaaagacugcacugcuacccgcugcagccgcugccgcgaccgcagccgcuacagguccugccugucucagccauaaggagucccuggaaaucgcagaugggucaggaggcggcagucgacgucuuagaaccgcuuacacuaauacacagcuguuggagcucgaaaaagaguuucacuucaacaaguaucugugcaggccacggcgcguugagauugccgcgcugcucgacuuaaccgaaagacaagugaaaguaugguuucagaauaggcggaugaagcauaaacgccagacgcaguguaaggagaaccaaaauagcgaagggaagugcaaaucucuggaggauuccgaaaagguggaggaggacgaagaggagaaaacucuuuucgaacaggccuugucagucagcggagcacugcuagaacgagaggguuacaccuuucagcagaacgcucucagucaacagcaggcccccaauggccacaacggggauucucaauccuucccggugagcccucugacaucgaaugagaagaaccuuaaacacuuucagcaucagucucccacuguuccaaauugucuguccaccaugggacagaacugcggcgcugguuugaauaacgacucaccugaagcccucgaggugcccagucugcaagauuucagcgucuuuuccacagacucuuguuuacagcugagcgaugcagugucaccaagucuccccgggucccuugacagcccuguagauaucucugccgacucacuggauuucuucaccgacacguugacuacaauagaccuacagcaccugaacuauuga

SEQ ID NO: 57332 - RNA, 1332 nt, Artificial Sequence
  derived and/or modified sequence opt3 from HOXA3__Homo_sapiens__XP_005249788
augcagaaggccaccuacuaugacagcuccgcuaucuacggcggguaucccuaccaagcagccaacggauucgcguauaaugcuaaccagcagccuuacccagccucugcagcccugggugcugauggcgaguaucacagaccggcaugcucacuccagagucccagcuccgccgggggacauccuaaagcucacgaacuuucugaggccugucugaggacauugucggcgccacccucacaaccucccagcuuaggcgaaccaccucugcauccaccgcccccucaggcagccccacccgcuccucagccaccccagccggccccucaacccccagcaccuacucccgcugccccacccccuccaaguuccgcgucuccgccccagaaugccagcaacaauccuacgccagcaaacgcugccaagagcccccuacucaauucaccuaccguggcuaaacagauuuuuccauggaugaaggagagucggcagaacacaaaacaaaagacuuccucuuccucaagcggugaaaguugcgccggggacaagucucccccgggacaggcauccagcaaacgcgcccgaaccgcuuacacaucggcgcagcuggucgagcuugagaaggaguuccacuuuaaucguuaccuguguagaccuaggcggguugaaauggcaaacuugcucaaucugaccgaacgccaaauaaaaaucugguuccagaacagaaggaugaaguauaaaaaggaucagaagggcaaaggcaugcugacuucuuccgggggacagucaccaagucggagccccgugccucccggugccggcggguaccucaauuccaugcauucuuuaguaaacagcgugccauaugagccucaaucacccccaccguuuaguaagccuccccagggaacauacggccugccacccgcuuccuauccugccagccuuccaucuugcgcacccccuccgccaccccagaaacgcuacaccgccgcuggugccggggcaggaggcacgccugacuaugauccacacgcgcacggcuugcaggggaauggaucauacgguacuccccauauucaaggcaguccugucuucguugggggaagcuacguggagccgauguccaacucuggccccgcucuguuuggucuaacccaccucccacaugccgcaucgggggccauggacuauggcggagcuggcccucuggggagcggacaccaccauggucccggcccaggggaaccucaccccacauacacugaucuuaccggacaucacccaucccagggccgaauccaggaggccccgaagcugacacauuuguga

SEQ ID NO: 57333 - RNA, 963 nt, Artificial Sequence
  derived and/or modified sequence opt3 from HOXA4__Homo_sapiens__NP_002132
augaccaugagcuccuuccugaucaacucuaauuacauugagcccaaguuuccuccauucgaagaguaugcccagcacucaggcagugggggagcugacgguggcccugggggaggccccgguuaccaacagccuccagcacccccuacacagcaucucccacuucagcaaccccagcugccucacgccgggggaggcagagaaccaacugcgagcuauuacgcuccgaggacggcccgggagcccgcauauccugccgcugcauuguacccagcccauggcgcugccgauaccgcguaucccuacggguaccgcggaggugcauccccuggccgaccaccccagccggaacagccucccgcccaagcuaaagggccagcccacggauuacaugcaucucacgugcugcagccucagcuacccccaccccuccagccucgugcugucccaccggccgcgcccagaaggugcgaggccgcaccggcuacaccaggcguucccgccggugggucggcuccugccuguccacugcuucuggcagacaagucacccuugggacucaaaggcaaggagccggugguauauccuuggaugaaaaagauacacgugagcgccgucaacccaaguuacaauggcggggaacccaagcggucccgcacugcuuauaccagacaacaggugcuggagcuggaaaaagaguuucauuucaacagguaccucacacggcgccgaagaaucgagauugcgcacaccuuaugccugucugaaaggcagguuaagaucugguuucaaaaucggcguaugaaauggaagaaagaucauaaacuuccuaacacuaagaugcgcagcuccaauucagcaagugccagcgcuggacccccagguaaggcccagacacagucuccucacuugcacccccauccacacccguccaccucaacgccugugcccagcaguauuuga

SEQ ID NO: 57334 - RNA, 813 nt, Artificial Sequence
  derived and/or modified sequence opt3 from HOXA5__Homo_sapiens__NP_061975
augagcuccuacuucgugaacucuuuuugcggcagauaucccaaugggccugacuaccagcugcacaacuauggagaucauucaagugucagcgagcaauucagggacuccgccucuaugcacucgggucgguacggcuauggguacaauggaauggaucucucaguuggccgcagcgguagugggcauuuuggauccggcgaacgagcucguucuuaugcagccagcgcguccgcugccccagcagagccgagauacucacagcccgccaccaguacacacagcccucagccagacccccuuccuuguucugcuguggcaccaucccccggcucagauagccaucacgggggaaagaacagucugucuaauuccagcggugccucggcugacgccggcucuacucacaucuccucaagggaagggguaggaacggcgaguggcgcagaggaagaugccccugcuagcuccgagcaggccucugcacaaagcgagccaucaccggcucccccugcccagccacagauuuaccccuggaugcggaaauugcauauaagucacgacaacaucggugggccugaaggaaagcgcgcgagaaccgccuauacaagguaccagacuuuagagcuggaaaaagaguuccauuuuaaucgguaucuaacccgccgaagaaggauugagaucgcacacgcucucugccuguccgaacggcaaauuaagaucugguuccagaaccgucgcaugaaauggaagaaggauaauaaacuuaagagcaugucuauggccgcugccggcggcgcauuuagaccauga

SEQ ID NO: 57335 - RNA, 702 nt, Artificial Sequence
  derived and/or modified sequence opt3 from HOXA6__Homo_sapiens__NP_076919
augagcuccuacuucgugaaccccaccuuuccuggcucucugccaucagggcaggacaguuuccucggacaacuuccgcuguaucaggccgguuacgaugcuuugagacccuuuccugcaagcuauggcgccuccucuuuaccagacaagacauacacuucgcccugcuucuaucagcagucaaauagcguccuggcguguaacagggcuaguuacgaguauggggccuccugcuuuuacucugauaaagaccuaagcggagcauccccuucaggcagugguaagcaacgggggccaggagauuaccuccacuucagccccgaacagcaguauaaaccugacucuuccucaggccagggcaaggcccugcaugaugagggggcugaccgcaaauacacgagcccaguuuauccguggaugcaacgaaugaauaguugugcaggagccguguacgguucucacggccguagagggaggcagaccuauacacgguaccagacucuugaacuggagaaggaauuucauuucaaccgcuauuugaccagaaggcggcgcaucgagauugcuaaugcccucugccugacagagcgacagauaaagaucugguuucaaaacagaaggaugaaauggaagaaagaaaauaagcugauuaacuccacccagcccagcggagaggauucggaagcgaaagcaggcgaguga

SEQ ID NO: 57336 - RNA, 693 nt, Artificial Sequence
  derived and/or modified sequence opt3 from HOXA7__Homo_sapiens__NP_008827
augagcuccucuuacuaugugaacgcccuguucucaaaguacaccgcuggcgcaagucucuuucagaaugccgagcccacaagcugcuccuucgcgccuaacucucaaagaucgggguauggagcuggugccggcgcauuugccucaacugucccagggcuuuacaauguuaacagcccgcuguaucagagucccuucgcuuccggauacggcuugggugcagacgccuaugggaauuuaccuugugcuucuuacgaucagaacaucccaggacugugcagcgaccuagccaaaggcgcgugugauaagacggacgaaggcgcacuccacggggccgcugaggccaauuuuaggauuuaccccuggaugcgguccucaggaccugaucgcaaacgaggucgucagaccuauacaagauaccaaacucuggaacuugagaaggaguuccauuuuaacagguaucugacccggcgcagaaggauagaaaucgcacacgcuuugugccucacagagcggcagauuaaaaucugguuccagaaucgccgaaugaaguggaagaaagaacauaaggacgagggcccaaccgccgcggccgcacccgaaggggcugugccuagugccgcugccacugcagccgcugauaaagcggacgaggaggaugacgaugaagaggaagaggacgaagaggaguga

SEQ ID NO: 57337 - RNA, 819 nt, Artificial Sequence
  derived and/or modified sequence opt3 from HOXA9__Homo_sapiens__NP_689952
auggccaccacaggcgcucuggggaacuacuauguggacagcuuccuccuuggagcagaugccgcggacgagcuguccgucgguagauacgcucccggcacuuuggggcagccuccaaggcaagccgcaacguuagccgaacacccggauuuuucucccugcucauuccagaguaaggcuaccguuuuuggagcaagcuggaauccugugcaugccgcuggcgccaacgcgguaccagcagccguguaucaccaucaccaucaccaccccuacguccauccucaggcuccaguggccgcagcugcccccgacggucgguauaugcgcuccuggcuggagccuacaccaggggcgcuaucuuucgccggacucccgucgucacgacccuacggcaucaaaccugaaccacugagcgcacguagaggcgauugucccacucuugacacccacacacugaguuugaccgauuaugcuugcggguccccuccaguugacagggagaagcagcccucugaaggagccuuuagcgagaauaacgcugagaaugaauccgguggcgauaaaccgccuauugaccccaacaauccagccgcaaacuggcuccaugcccggucaacucgcaagaaaagauguccuuacacaaagcaccaaacccuggagcuggaaaaggaguuccucuuuaauauguacuuaacgagggaucggcgcuaugagguggcucgacugcuuaacuugacugaaagacaggucaaaauaugguuccagaauaggcggaugaagaugaaaaagaucaacaaagaccgugcgaaggaugaguga

SEQ ID NO: 57338 - RNA, 855 nt, Artificial Sequence
  derived and/or modified sequence opt3 from HOXB13__Homo_sapiens__NP_006352
auggaacccggcaacuacgccacccuggacggggcuaaggauaucgaaggacuccuuggugcaggcgggggaagaaaucugguggcccacagcccuuugacaucccauccagcggcuccgacuuuaaugcccgccgucaacuaugcaccucuggaccuaccaggcucugccgagcccccuaaacagugccacccaugucccgguguuccucaagggacgucaccagcuccggugcccuacggauauuucggcggcggguacuauaguugcaggguaagccgguccucucucaagccuugugcacaggccgcuacccuggccgcguacccagcagaaacacccacugccggagaggaauauccuucgcgcccaaccgaguuugcuuucuaccccgguuacccgggcacauaucagccuauggccucauaccuugaugugagcgucgugcagacccugggggcacccggagagccacgacaugacaguuugcucccuguugauuccuaucaaucuugggcucuggccggcgguuggaauagccagaugugcugucagggggaacagaaucccccaggacccuuuuggaaagcggccuucgcagacuccucaggccaacacccuccagaugcuugcgccuuucguagaggcaggaagaaacggauuccguacaguaaggggcagcugcgcgagcucgaaagagaguaugcugccaacaaguucauaacuaaagacaagaggcggaaaaucagcgcagccacaucuuuauccgagcgccagauuaccaucugguuucagaaccgaagagugaaggagaaaaagguccuggcuaaggugaaaaauucagcgacgcccuga

SEQ ID NO: 57339 - RNA, 906 nt, Artificial Sequence
  derived and/or modified sequence opt3 from HOXB1__Homo_sapiens__NP_002135
auggacuacaacagaaugaauagcuuccuggaguauccccucugcaacaggggcccuuccgccuacucugcucacucagcaccaaccaguuuuccgcccagcuccgcccaggcgguggauucuuaugcuucggaagggcgguacggagguggccuuucaagcccugccuuccaacagaauaguggguauccagcacagcagcccccuuccacacugggagucccauuucccucuagcgccccuuccggcuacgcuccagcagccuguucaccgaguuauggucccagccaauacuacccuuuggggcagucugagggagacggcggcuauuuccauccauccucauacggggcucaguuaggaggucugagcgauggcuauggggccggaggcgcgggucccgggccuuacccaccccagcacccgccuuauggaaacgaacaaacugcaaguuuugcccccgcuuacgccgaccuacucucugaggauaaggaaacgccaugcccuuccgagcccaauaccccaacagcacgcacuuucgacuggaugaaaguuaagcgaaaucccccuaaaaccgcuaaggugagcgagccaggccugggcucgccgucugggcuucguacaaacuuuaccacuagacagcugacagaauuggagaaagaguuccauuuuaacaaguaucucuccagggcccggcgcguagaaaucgcggccacccuggagcugaaugaaacgcaggucaagauuugguuccagaacagaaggaugaaacaaaagaaacgggagcgcgaagagggacgagugcccccugcaccacccgguuguccuaaggaagcugccggcgaugcuucagaccagaguacuugcaccagcccagaggccucccccucuagcgugacaucauga

SEQ ID NO: 57340 - RNA, 1071 nt, Artificial Sequence
  derived and/or modified sequence opt3 from HOXB2__Homo_sapiens__NP_002136
augaacuucgaguuugaaagagagaucggcuucauuaauagccagcccucccuggccgaaugccucaccucuuuuccugcugugcuugagacauuccaaacuucaaguauaaaggaaagcacgcugaucccaccgcccccuccauuugagcagaccuuccccuccuugcagccuggggcaucuacauuacagaggccacggucgcaaaaacgcgccgaggacggacccgcgcugccuccaccgcccccuccaccccuaccugcugccccacccgcaccggaauuuccuuggaugaaggagaaaaagucagccaaaaagcccagccagagugcuacuuccccaucuccugcagccagcgcuguccccgccuccgguguuggcucaccagcggaugggcucggacugcccgaagcaggcggugggggagcccgacgucuuagaaccgcuuacacaaacacccagcuguuggagcucgagaaggaauuucacuuuaauaaauaucuguguaggccucggcgcguggagauugccgcacugcucgacuuaacugaaagacagguaaaggugugguuccaaaacaggcggaugaaacauaagcgccagacacagcaccgagagccaccggauggcgaacccgcuugcccuggcgcccuggaggacaucugugauccagcggaggaacccgccgcaaguccugggggaccaagcgcuucuagagccgcuugggaggccugcugucaucccccggaagucgugccuggugcacuuuccgccgacccaaggcccuuggcuguucggcuggagggcgcgggggcaucaagcccuggaugcgcccuacguggcgcuggugggcucgaacccggaccacugccugaggauguguuuaguggccgccaggacucucccuuccuuccagaucugaauuucuucgccgcagacuccuguuugcaacucagcggcgggcugucgccgucuuuacagggaucccuggauucaccuguccccuucagugaggaggaacucgacuuuuucaccagcacgcuuugcgccauugaucugcaguuuccauga

SEQ ID NO: 57341 - RNA, 900 nt, Artificial Sequence
  derived and/or modified sequence opt3 from HOXB3__Homo_sapiens__XP_005257339
augaaggagagcagacagaccuccaaacugaagaacaauucucccggcacagccgaagggugcggagguggcgggggaggcggugggggaggcggcucagggggaagugguggcgggggaggcggugggggaggcggcgacaaaagcccuccaggguccgcugcaucuaagagggcccggacugcguacacgucggcucaacucguggagcuugaaaaagaguuccacuuuaaccgcuaucugugucgaccgcguagagucgaaauggccaauuuguuaaaccugucagagaggcagaucaagauuugguuccagaaucggcgcaugaaguacaaaaaggaucagaaagcaaagggacuagccagcaguuccgguggccccucuccugcugggagcccaccccaaccuaugcaguccaccgcaggauuuaugaacgcccuccauucaaugacaccaaguuaugagagccccucuccuccagcuuucggcaaagcccaccagaaugcguacgcacugccguccaacuaucagcccccucuuaaggguugcggggccccacaaaaguaucccccuacuccagcucccgaauacgagccgcauguucugcaggccaauggcggagcauacggcaccccuacaaugcaggggucacccguguacguaggagguggcggguaugcugacccauugccucccccagccggacccagccucuacggccugaaccaccugagucaucacccuucugguaaucucgauuauaacggggcgccaccgauggcccccucccagcaccauggcccuugugaaccacaccccaccuacacugacuuaagcucgcaucacgcaccuccaccccaaggaagaauacaggaggcuccgaaacugacacaccuuuga

SEQ ID NO: 57342 - RNA, 756 nt, Artificial Sequence
  derived and/or modified sequence opt3 from HOXB4__Homo_sapiens__NP_076920
auggccaugagcuccuuccugaucaacucuaauuacguggaccccaaguuuccuccaugcgaggaauauucacagagugauuaccucccgagcgaccacucccccggcuauuacgcugggggacaaagaagggagucuucguuccagccugaagcagguuuuggccggcgcgccgcguguaccguccagcgauaugcugccugccgugauccagggcccccuccacccccuccaccgcccccuccacccccuccacccccgggacuuucaccuagagcacccgccccaccucccgcuggcgcacuguugccagagcccggucagaggugugaagccguuagcaguuccccuccaccgcccccuugcgcucaaaacccauuacaucccucuccuagccacuccgccuguaaagagccagugguauaccccuggaugcggaaggugcaugucucaacagugaauccgaacuaugcagggggagagccuaaacgcaguagaacugcguacacgaggcagcagguucuggaacuagagaaggaguuccacuacaaucgguaucucacccgccgaagaaggguggaaauugcccaugcucugugccuuagcgagcggcagauaaaaaucugguuucaaaaccgucgcaugaaguggaagaaagaccacaagcugccaaauacaaaaauuagaucuggcggcgccgcaggguccgcuggaggucccccuggcaggcccaacgggggaccacgggccuuguga

SEQ ID NO: 57343 - RNA, 810 nt, Artificial Sequence
  derived and/or modified sequence opt3 from HOXB5__Homo_sapiens__NP_002138
augagcuccuacuucgugaacucuuuuucaggcagauaucccaaugggccugacuaccagcugcugaacuauggaagugguagcucccuuucuggcucguacagggauccagccgcuaugcacaccgggucauauggauacaauuauaacggcauggaccugagcgucaaucggaguuccgcaucuagcucccauuucggugccguuggggagucaagucgcgcguuuccggcucccgcccaagaaccucgauuccgucaggcagccagcucuugcuccuugucaagcccagagaguuuacccuguacaaacggagauucucacggcgcuaagccuuccgcaagcucgccaucugaccaggccacuuccgcuucaaguagcgccaauuuuacggaaaucgaugaggcguccgcaucuagcgaacccgaggaggccgcuucacagcugaguuccccuagccuagccagagcacaaccagaaccgauggcuaccucuacagccgcgcccgagggccagacuccucagauuuucccauggaugaggaaacuccauauaucacacgacaugaccgggcccgauggaaagcgggcccgcacagcauacaccagauaccagacucuggaacuugagaaagaguuucauuucaacagguaucugacacggcgccgaagaaucgaaauugcucacgccuugugccucagugagaggcaaaucaagauuugguuucagaaucggcguaugaaauggaagaaggacaacaaacucaagagcaugucccuggcuaccgccgguucugcauuccagccuuga

SEQ ID NO: 57344 - RNA, 675 nt, Artificial Sequence
  derived and/or modified sequence opt3 from HOXB6__Homo_sapiens__XP_005257340
augagcuccuacuucgugaacucuaccuuucccgucacacuggccucaggccaggagaguuuccucgggcaacuuccucuguauagcuccggauacgcugacccauugagacacuauccggcacccuacgguccuggcccagggcaggauaagggauuugccacuucuucguauuacccuccugcgggcgguggguauggaagggcugccccaugcgacuacggccccgcacccgccuucuaccgggaaaaagagucagcuugugcauuaagcggcgccgaugaacagccaccguuucaucccgagccucgcaagagugacugcgcucaggauaaauccguuuucggggaaacggaggagcaaaaguguucuaccccaguguaucccuggaugcagcgaaugaauagcugcaacuccucaaguuuuggaccuagcggucguagaggcaggcagacauacacucgguaucagacccuggaacuagagaaagaguuccacuacaaucgcuaucucacaagaaggcggcgcaucgaaauugcccaugcgcugugucuuaccgagcgacaaauaaagaucugguuucagaacagaaggaugaaguggaaaaaggaaucuaaacuguuguccgcaucacagcucagcgccgaggaagaggaagagaagcaggcugaguga

SEQ ID NO: 57345 - RNA, 654 nt, Artificial Sequence
  derived and/or modified sequence opt3 from HOXB7__Homo_sapiens__NP_004493
augagcucccuguacuaugccaacacccucuucucuaaguaccccgcuucaaguagcguguuugcaacaggcgccuucccugagcagacuuccugcgcguuugcuucuaauccacaaagaccgggguauggagccgguucgggcgcaucauucgccgcuagcaugcaggggcuuuaccccggaggcggugggauggcaggacagagugccgcuggcgucuaugccgcgggcuacgggcuggaaccuuccucuuuuaacaugcacugugcaccauucgagcagaauuugagcggaguuugccccggugacuccgccaaagcugccggcgcaaaggaacaaagggauucagacuuagcugccgagaguaacuuucggaucuauccuuggaugcgcagcucugggacggaucgaaaacguggaagacagaccuacacaagguaccagacucuggaacuagagaaggaguuccauuauaaucgguaccucacccgcagaaggcggauugaaauagcgcacacacugugucuuaccgagcgccagaucaaaauuugguuucaaaaccgaagaaugaaguggaagaaagaaaauaagacugccggcccagguacaaccgggcaggacagggcagaggcugaggaagaggaagaggaauga

SEQ ID NO: 57346 - RNA, 732 nt, Artificial Sequence
  derived and/or modified sequence opt3 from HOXB8__Homo_sapiens__NP_076921
augagcuccuacuucgugaacucucuguuuucaaaguauaaaaccggcgagagucucagacccaauuacuaugacugcggguucgcccaggaucuuggagguaggccuacagucguuuacggcccaagcuccgggggaucuuuucaacacccgucgcagauccaggaguucuaucauggccccucaagccugaguacugcuccuuaccagcaaaacccaugugcaguggccugccacggugaccccgggaauuuuuauggauacgauccuuugcagcggcaguccuuauucggcgcgcaggacccagaucugguacaauacgcugacuguaagcuagccgcagccucuggccucggggaggaagcugagggaagcgaacagucccccucaccuacgcagcuguuuccauggaugcgcccgcaggcagccgcuggucgacguagaggcaggcaaaccuauagucgguaccagacacuugagcuggagaaagaguucuuguuuaaccccuaucucacucgcaagagaaggauugaagugagccaugcccuggggcugaccgaacggcaggucaaaauaugguuccaaaaucgccgaaugaaguggaagaaagagaacaauaaggauaaauuuccuucuuccaagugcgagcaggaagaacucgaaaaacagaaguuagagagagcgccagaagcagccgacgagggagaugcucagaagggcgacaaaaaguga

SEQ ID NO: 57347 - RNA, 753 nt, Artificial Sequence
  derived and/or modified sequence opt3 from HOXB9__Homo_sapiens__NP_076922
augagcaucuccggcacccugucuucauacuauguggacaguauuauaagccacgaguccgaagaugcucccccugccaaguucccaucugggcaguacgcaucgucaagacaaccgggacaugccgagcaccucgaauuucccagcugcaguuuccagccuaaagcgccagucuuuggugcuuccugggcaccccuuucuccucaugccagcggcucccugccaucaguuuaucaccccuacauccagccucagggggugccaccggccgagaguagguauuugcggacaugguuagaacccgcuccucgcggagaggcagccccaggccaaggucaggcugccguaaaggcggagccccugcuaggggcaccuggagaacuccugaaacagggcacuccagaguacagccuugaaacgucugccggccgagaggcugugcuguccaaccagcgucccggguauggagacaauaagauuugugaggguucagaagauaaagagagaccggaccaaaccaacccuagcgccaauugguugcaugcaaggaguucucggaagaagcgcugccccuacacaaaauaccagacucucgaacuggagaaggaguuccuguuuaacauguaucucaccagagauaggcggcacgaagucgcucgcuuacugaaucuuuccgagcgacaggugaaaaucugguuccagaacagaaggaugaagaugaaaaagaugaauaaggaacaaggcaaagaguga

SEQ ID NO: 57348 - RNA, 1029 nt, Artificial Sequence
  derived and/or modified sequence opt3 from HOXC10__Homo_sapiens__NP_059105
augaccugccccagaaacgugacaccuaauagcuacgccgagccacuggcugcaccgggcgggggagaaagguauucccggucugccgguauguacaugcagucaggcagugacuucaacuguggggucaugcgcggaugcggccucgcgcccagccuuuccaagcgagaugaggguucuucgccuucacuggcuuugaauacuuauccaagcuacuuaagucaacuggacuccuggggagaucccaaagccgcauaucgucuagaacagccuguugggagaccacucucuagcuguuccuaucccccuucagugaaggaggaaaacguaugcuguauguacagugccgagaaaagggcuaagagcggcccagaggcagcccuguacucucacccgcuucccgaauccugccugggcgagcaugaagugccugucccaucauacuaucgggcuagccccaguuacucugccuuggacaaaacgccucacuguuccggggcgaaugauuuugaggcaccauucgagcagcgcgccagccucaaccccagagcugaacaucuggagucgccgcagcugggagguaaggugucuuuuccugaaacccccaaguccgacucacaaacaccaaguccuaaugagaucaaaacugaacagagccucgccggccccaagggguccccaucugagagcgagaaagaaagggcaaaggcugccgauucaagucccgacaccuccgauaacgaggcgaaagaagagauuaaggccgaaaauacaaccggaaacugguuaacugcaaagagcggccggaaaaagcgcugcccuuauacaaaacaccagacccuggagcuugagaaggaguucuuguuuaauauguaccugacgcgagaaagaaggcuagaaauaucuaaaacuaucaaccucaccgaccggcagguuaagauuugguuccaaaaucgucgcaugaaacugaagaagaugaacagagagaauaggauccgggaacuuacaucaaacuuuaacuucacuuga

SEQ ID NO: 57349 - RNA, 915 nt, Artificial Sequence
  derived and/or modified sequence opt3 from HOXC11__Homo_sapiens__NP_055027
auguucaacagcgugaaucugggcaacuuuugcucccccucuagaaaggaaagaggggccgacuucggagaacgggguucaugugcuaguaaucucuaccuuccuagcugcaccuauuacaugccagaguuuuccacagucucuucguuccugccgcaggcacccucacgccaaaucagcuauccuuacagugcccagguuccacccgugcgagaaguauccuauggcuuggagccuucugggaaauggcaccaucguaacagcuacuccucauguuaugcggcugccgaugaauuaaugcacagagagugccugccacccaguacugugacggagauucuaaugaagaaugaaggaagcuacggcggucaucaccauccuucugcaccacacgccaccccggcuggguuuuacuccucagucaacaaaaauagcgugcucccccaggcauucgacagguuuuucgauaacgccuauuguggaggcggcgacccuccagcugagcccccuugcagugggaagggagaagccaaaggugagccagaggcgcccccggcaucuggccuggccucccgggcugaagccggggcagaggcugaagccgaggaagagaauacaaacccuagcucgucuggauccgcgcacucaguugccaaggagcccgcaaagggcgcugccccaaaugcuccucgcacuaggaaaaagaggugucccuacaguaaauuucagauacgggaacuugagcgcgaguucuuuuucaacguguauaucaauaaggaaaaacgacugcaauugagcagaaugcucaaccugaccgauaggcaggucaagauuugguuucagaaucggcguaugaaggagaaaaagcugucccgcgacagacuccaguacuucucugguaacccauuacuguga

SEQ ID NO: 57350 - RNA, 849 nt, Artificial Sequence
  derived and/or modified sequence opt3 from HOXC12__Homo_sapiens__NP_776272
augggcgagcacaaccugcucaaucccggguucgugggaccucuugucaacauccauaccggugacacauuuuacuucccaaauuuuagagccagcggcgcucagcugccgggguugcccuccuuaucuuauccuaggcgggauaacguuugcucacugaguuggccaagcgcagaacccuguaauggauacccucaaccauaucuaggcucccccgugucucucaacccuccauucggucgcacuugcgagcuggcccgaguagaagacgggaagggauacuaucgugagccgugugcggaaggcggcgggggaggucuuaaaagagaggagaggggccgggaucccggggcuggaccuggcgccgcacuguugccacucgaacccucggguccuccagcccugggguuuaaguacgacuaugcugcaggaggcggcgggggagaugguggcgggggagccggucccccgcacgacccucccucaugccagagccuggagagugauuccucuagcucccucuuaaaugaaggcaacaaaggggcuggcgccggagacccaggcucacuggugaguccucuuaaucccgggggagguuugagcgcgucuggcgcaccaugguaccccauuaacucccgcucaagaaagaaaaggaagccuuacagcaagcugcagcuagccgagcucgagggggaguuccuggucaaugaauuuauaacgcggcagcgccgaagagaacuuagugauaggcugaacuugucugaccaacaggugaaaaucugguuccagaaucggcguaugaagaaaaagcgccuccuguuaagagagcaggcucuguccuuuuucuga

SEQ ID NO: 57351 - RNA, 993 nt, Artificial Sequence
  derived and/or modified sequence opt3 from HOXC13__Homo_sapiens__NP_059106
augaccacaagccugcuccuucaccccagauggccugaaucccugauguacguguaugaagacucugccgcugagucaggcaucgggggagguggcgggggaggcggugggggaacuggcggcgcagggggagguugcaguggcgccagcccagggaaggcgccguccauggauggauugggcagcucgugucccgcuucacauugcagggacuuacugccucacccaguccuaggucggcccccugccccacucggggcaccccagggagccguuuacacggauauuccugcuccagaagcagcccgccaaugugcuccgcccccugccccacccaccagcaguuccgcgacacugggcuauggcuacccuuucgggggaucuuauuacgguugccgacuuagccauaacgugaaucugcagcagaaaccaugugcauaucaccccggcgacaaguacccggagccuuccggggccuugcccggagaugaccucucaagucgugcuaaagaauuugccuucuacccaucuuuugcaucuuccuaucaggcuaugccuggcuaccuggauguaucagugguccccgguauaagcgggcauccagagcccagacacgacgcccugaucccuguggagggcuaucaacacugggcgcucaguaacggaugggauucucagguuuacugcuccaaggaacagagccagucggcccauuuauggaaaucuccauucccggacguggucccccugcaaccugagguguccucauauaggcggggccgcaagaagagaguaccauacacuaaaguucagcuuaaggaauuggagaaagaguaugcagcuaguaaguuuauuaccaaagaaaagaggcggcgcaucagcgccacaaccaaucuguccgagcgacaggugacuauuugguuccagaacagaagggucaaggagaaaaagguggugucuaaaagcaaggcuccccaccuacauucaacauga

SEQ ID NO: 57352 - RNA, 795 nt, Artificial Sequence
  derived and/or modified sequence opt3 from HOXC4__Homo_sapiens__NP_705897
augaucaugagcuccuaccugauggacucuaacuauauugaucccaaguucccuccaugcgaggaauacucacagaauaguuauauaccggagcacagccccgaauacuauggcagaaccagggaguccggguuucaacaucaccaucaggaacucuacccuccacccccuccacggcccucuuauccugagcgccaguacucguguacaucacuucagggaccagguaacagccgaggccacgggccggcccaagcuggacaucaccaccccgagaaaagucagucccugugcgaaccugcaccauugucuggcgccagcgcgucccccaguccugcuccacccgccuguucacagccggcaccugaccaucccagcucugccgcuuccaagcagccaaucguguacccuuggaugaaaaagauucacgucucaacuguuaaucccaacuauaaugguggggagccaaaacguagcagaacggcauacaccaggcaacagguguuagaacuggagaaggaguuccauuauaaccgguaccuaacacgcagaaggcggaucgaaauugcccacagucucugccugucugagcgccagaucaagauaugguuucagaaucgaagaaugaaauggaagaaagaucacaggcuucccaacacuaagguacgguccgcuccuccagccggagcggcaccgagcacccugucggccgcuacacccggcaccucugaagaccauucccaaucagccacuccuccagagcagcagcgugcagaagauaucacacgcuuguga

SEQ ID NO: 57353 - RNA, 669 nt, Artificial Sequence
  derived and/or modified sequence opt3 from HOXC5__Homo_sapiens__NP_061826
augagcuccuacguggccaacucuuucuauaagcagucacccaauaucccugcuuacaacaugcaaaccugcggcaauuaugggagugcaagcgagguccaggccuccagauacuguuauggaggucuggaccucucuauuacauuuccaccgcccgcgccuucgaacucacuucacggcguugauauggcugccaauccaagggcacaucccgaccggccugccugcagcgcugcagccgcuccagggcacgcccccggacgcgaugaagcggcaccucugaacccaggcauguacagucagaaagccgcucgaccggccuuggaggaacgugcaaaguccucuggugagauaaaagaagaacaggcucaaacugggcagcccgccggauuaagccagccuccagcgcccccucagaucuauccauggaugacgaagcugcauaugucccacgagaccgacggcaaaagaucaaggacaaguuacacucgguaccaaacccuagaacucgagaaggaguuccauuuuaaucgcuaucugacaagaaggcggcgcauugagaucgccaacaaucuuugucugaacgagcgacagauuaagaucugguuccagaauagaaggaugaaauggaagaaagauagcaagaugaaaucuaaggaagcauuguga

SEQ ID NO: 57354 - RNA, 708 nt, Artificial Sequence
  derived and/or modified sequence opt3 from HOXC6__Homo_sapiens__NP_004494
augaacagcuacuucaccaaucccucccugucuugccaccucgccggcgggcaggacgugcuuccuaacgucgcucugaacucaacagcauaugauccaguuagacauuuuaguacuuacggagccgcgguggcucaaaauaggaucuauagcacgccguucuacucuccccaggagaauguaguguuuuccucgucacgggguccuuaugacuacggcagcaacaguuucuaucaggaaaaggauauguuguccaauugucgccagaacaccuuagggcacaauacacaaacuucuauugcccaggacuuuagcuccgagcagggacgaaccgcaccacaggaucaaaaagccucaauacagaucuaccccuggaugcagcguaugaacagucauagcggcgucgguuacggggcugacagaaggcggggacgccagauuuauucuagauaccaaacacuggaacuagagaaggaguuccacuuuaauagguaucucacccggcgccgaagaaucgaaauugcaaacgcccugugccuuacugagaggcagaucaaaauaugguuccagaaucggcguaugaaguggaaaaaggaauccaaccugacaucaaccuugagcggcggcgggggaggugcuacggccgauagucucggcgggaaggaggaaaaacgcgaggagacugaagaggaaaagcaaaaagaguga

SEQ ID NO: 57355 - RNA, 729 nt, Artificial Sequence
  derived and/or modified sequence opt3 from HOXC8__Homo_sapiens__NP_073149
augagcuccuacuucgugaacccccuguuuucuaaguauaaagccggcgagucacucgaaccugcuuacuaugacugcagauucccacagagugucgggaggagccacgcacuuguuuacggaccggguggcuccgcccccggguuucaacaugcgucucaccaugugcaggauuucuuucaccauggaaccucgggcaucucaaauagcgguuaucagcagaacccuuguagucuguccugccacggggacgcuucuaaguucuacggauaugaggccuugccacggcagagcuuauacggcgcacaacaggaagccuccguagugcaguaccccgauuguaaaucaagugcuaauacaaacagcucugagggccaagggcaccugaaucagaacuccucaccuagccuaauguuuccauggaugcgcccccaugcaccuggacgacguagugguagacagacuuauucuagguaccagacgcucgaacuggagaaggaguuccuuuuuaauccauaucugacccggaaacgcagaauugaagucucccacgccuugggccucacagagaggcaagugaagauaugguuccagaaccggcgcaugaaguggaaaaaggaaaauaacaaagacaagcugccgggggcucgagaugaggagaaaguugaagaggaaggaaaugaggaagaggagaaggaagaggaagagaaggaagagaacaaagacuga

SEQ ID NO: 57356 - RNA, 783 nt, Artificial Sequence
  derived and/or modified sequence opt3 from HOXC9__Homo_sapiens__NP_008828
augagcgccaccggccccaucuccaacuacuauguggacucucugauuucacacgauaaugaggaccuccuugcuaguagauucccugcaacaggggcccauccagcggcugccaggccgagcggacugguccccgauugcuccgacuuuccuucuuguucguucgcaccaaagcccgccguguuuucaacuagcugggcuccuguuccaagucaguccucuguaguguaccaccccuaugguccucaaccacauuugggcgcagauacgcgguacaugcgcaccugguuagaaccgcugagcggggccgucuccuuccccucauuuccugcuggaggccgacacuaugcccuaaaaccagacgcguaccccggucguagagcagauugcgggccuggagagggcaggaguuauccagacuacauguacggcagccccggggaacuccgggaucgcgccccgcagacacugccuucucccgaggcugacgcccuugcaggauccaagcauaaagaagagaaggcugaucuggacccaucaaacccuguggccaauuggauacacgcgagaagcacuaggaaaaagcggugucccuauaccaaguaccagacauuggagcucgaaaaagaguuccuguuuaacauguaucugacccgcgaucgaagauacgaaguugccagggugcucaauuuaacugagcggcaggucaagaucugguuccaaaaccgucgcaugaaaaugaagaaaaugaauaaggagaagacagacaaagaacagaguuga

SEQ ID NO: 57357 - RNA, 1023 nt, Artificial Sequence
  derived and/or modified sequence opt3 from HOXD10__Homo_sapiens__NP_002139
augagcuuccccaacuccucuccugccgcuaauaccuuucugguggacucacucaucagugcaugcagaagcgauuccuucuacucuucgucagccagcauguauaugccaccgcccagugcggacaugggcacauacgggaugcagacuuguggacuucugccuuccuuggcuaagagggaggucaaccaccaaaauauggguaugaacguucauccauauauuccccagguggauucuuggacggacccuaaucggagcugccgcauagaacagccaguaacccagcaagugcccacauguuccuuuacuaccaacaucaaagaggaaucaaauugcuguauguacagugauaagcgaaacaaauuaauuagcgccgaggucccuucuuaucagcgucuggugccagaauccugcccgguugagaaucccgaggugccugucccaggcuacuucagacuaucacagacauaugcaaccgggaagacucaggaauacaacaauagccccgagggaaguucuacagugaugcuccaacugaacccuaggggcgccgcuaaaccacagcuuuccgcagcccagcugcagauggaaaagaagaugaaugagcccguaagcggucaagagccgaccaaaguuucucagguggaaucgccugaggcuaaagggggauugcccgaggaacgguccugucucgccgaagucucagugaguagcccagaggugcaggagaaggaauccaaggaggaaaucaaaucugacacgccuacuagcaacuggcugaccgcgaagucaggccgcaagaaaagaugccccuacacaaagcaccaaacucuggagcucgaaaaagaguuuuuauucaauauguaucugaccagggagcggcgccuugaaauuaguaaguccgucaacuugacagaucgacagguuaaaaucugguuucagaacagaaggaugaagcugaaaaagaugagccgggagaaucguauacgcgaacuaaccgcaaaccucacguucucuuga

SEQ ID NO: 57358 - RNA, 1017 nt, Artificial Sequence
  derived and/or modified sequence opt3 from HOXD11__Homo_sapiens__NP_067015
augaacgacuucgaugagugcggccagagcgccgcuuccauguaccugcccgggugugcauauuacguggccccuucugacuuugcgucaaagccaaguuuccucagccaaccguccucuugccagaugaccuuucccuauucgucaaaucuugcuccucacguccagccaguuagagaaguggccuucagggauuacggacuggagcgggcaaaauggcccuaucgcgguggcgggggaggcgguagcgccgggggaggcaguuccggcgggggaccugguggcgggggaggcggugcugggggauacgcaccauauuacgccgcugccgcggcagccgcugccgcagcugccgcggccgaagaggcagcuaugcagcgagaauuguuacccccugccggccguagaccagacguacuguuuaaggcuccggagcccgugugugccgcaccuggcccaccccaugggccugccggagcugcgucuaacuucuacagcgcagucgguaggaauggcauccuaccacaaggguuugaucaguucuaugaggccgcucccggaccgccuuuugccggcccccagccaccucccccacccgcaccuccacagccggaaggugccgcugacaaaggggauccccggacaggcgccggaggcgggggagguuccccuugcacuaaggcaacgccaggcucagagcccaaaggggcggcugaaggaaguggcggugacggggagggcccuccaggagaggccggcgcagaaaagucuagcuccgccguggcuccccaacgcucaagaaagaaaagguguccguacaccaaguaucagauucgggagcucgaacgcgaguucuuuuucaacguuuacauaaauaaagaaaagcgacugcagcuuagcagaaugcugaacuugacagauaggcaagugaaaaucugguuucagaaucggcguaugaaggagaagaaacucaaccgcgacagacugcaguauuucacugggaauccucuguucuga

SEQ ID NO: 57359 - RNA, 813 nt, Artificial Sequence
  derived and/or modified sequence opt3 from HOXD12__Homo_sapiens__NP_067016
augugcgagagaagccuguacagggccggcuauguggggucccuccuuaaccugcagucucccgacucauucuacuuuaguaauuugcggccuaacggaggucaauuagcugcacugccaccgaucagcuauccccgcggcgcccuaccuugggcggcuaccccagccuccugugcacccgcccagccugcuggggcaacagccuucggaggcuuuucucagccauaccucgcugguucggggccccugggacuucagccuccaacugccaaggauggcccggaagaacaagcgaaauucuaugcacccgaagccgcugccggcccugaggaacgagggcguacgagaccaucauuugcacccgagagcagucuggcuccugccgucgcggccuugaaggcagcuaaauacgacuaugccggaguugguagggcuaccccaggcuccacaacucuccugcagggggcccccugcgcaccgggauucaaggaugacaccaaaggcccucugaaucucaacaugacagugcaggccgcugguguagcgucuuguuuacggcccagccugccagaugggcuuccuuggggagcagcccccggccgcgcuagaaagaagaggaaaccauacaccaagcagcaaauugccgaguuggaaaaugaguuucuggugaacgaguucauaaaucggcagaaacgcaaggagcuauccaaccgacucaaucugucagaccagcaggucaaaaucugguuucaaaacagaaggaugaagaagaaacgggugguucuucgugagcaggcacuggccuuguacuga

SEQ ID NO: 57360 - RNA, 1032 nt, Artificial Sequence
  derived and/or modified sequence opt3 from HOXD13__Homo_sapiens__NP_000514
augagcagagccggcuccugggacauggaugggcugagggcugacggagguggcgcagggggagcccccgcgucuucaaguagcuccucuguggcugccgcagccgcuucgggccagugccgggguuuccucucagcaccugucuuugccgggacccacagcggacgcgcugccgcggcagccgcugccgcagcugccgcggccgcagcugccaguggcuucgcuuacccaggcacauccgagcgaacugggucuagcuccucaaguucuagcuccgccguuguggcagcccguccggaagcucccccugcgaaggaguguccagcacccacgccugccgcugccgcagccgcuccacccucagccccugcacuuggauaugguuaccauuuuggcaacggguauuacagcugcagaaugagucacggaguaggccugcagcagaaugcguugaaaucuuccccacaugcuagcuuagguggguucccgguggaaaaguauauggaugucucgggacuggccucuuccucagugcccgcaaacgagguuccugccagggcuaaagaagugaguuuuuaccagggcuauaccagcccauaccagcacguccccggcuacaucgacaugguguccacauucgggucuggagagccucggcaugaggccuauauuagcauggaagguuaccaaucauggacucuagcaaauggcuggaacagucagguauauuguaccaaggaucagccacaggggucccacuuuuggaaaagcucuuuccccggagacguugcucucaaucaaccggauaugugcguguaccgcagaggcaggaagaagcgggucccuuauacaaaacugcagcuuaaggagcuggaaaacgaguacgccauaaauaaauuuaucaacaaggacaaacgccgaagaauuucagcggccaccaauuugagugagaggcaagugacuaucugguuccagaaccggcgugugaaggauaagaaaauugucagcaagcucaaagacacaguuuccuga

SEQ ID NO: 57361 - RNA, 987 nt, Artificial Sequence
  derived and/or modified sequence opt3 from HOXD1__Homo_sapiens__NP_078777
augagcuccuaccuggaguaugugucuugcucaaguagcggcggggucggaggugacguucucucccuugcccccaaguucuguagaucugaugcuaggccuguggcacugcagccagccuuuccguugggcaacggggacggagcguucguaucgugcuuaccccuggcugccgcacggccuucaccaagucccccugccgcuccagcacgccccagcgugccuccaccggccgcuccccaauacgcccaguguacccuagaaggcgcguaugagccuggugcagccccagcugccgcagcugggggagccgauuacggcuuucucggcuccgggcccgcguaugacuucccuggaguccugggucgagccgcagaugacggcgggucucacgugcauuacgcuacaagcgccguguuuuccggaggcgguucauuccuucugagugggcagguugauuaugcugccuuuggagaaccaggccccuucccggcaugcuugaaagccagcgcugacggccacccuggggcguuucagacugcaucucccgccccaggaacguacccuaaguccgucucacccgcuagcggucucccagccgcauucaguaccuuugaguggaugaaagugaagcguaaugccucuaaaaagggcaagcuggcugaauacggggccgcaucccccagcucggcgaucagaacaaacuucucuacuaaacaacugaccgagcucgagaaggaauuucauuucaauaaauauuuaacaagggcucggcgcauugagauagccaacugucugcaccuuaaugauacccagguaaagaucugguuccagaacagaaggaugaaacagaagaagcgggaacgcgagggauugcuggcaacugccauuccuguugcuccacuacaacucccgcuguccggcacaacccccacgaaauuuaucaagaauccugguucaccaagucagagccaggagcccuccuga

SEQ ID NO: 57362 - RNA, 1299 nt, Artificial Sequence
  derived and/or modified sequence opt3 from HOXD3__Homo_sapiens__XP_006712540
augcuguucgagcagggccaacaggcccucgaacuucccgagugcaccaugcagaaggcugcauacuaugaaaacccugggcuguuuggagguuacggcuauagcaaaacaacugacacguacggguauuccaccccacaccagccguacccuccuccagccgcggcuucuucauuggauacagacuaucccggaagugccuguagcauccaauccucugcaccuuuaagagccccagcucauaagggcgcagagcugaaugguucgugcaugaggcccgggacuggaaacucacagggcggcgggggagguagccagccuccaggccuaaauagugaacagcaaccgccccagccuccacccccuccacccacccucccgccuuccucucccacaaacccagggggaggcgugccugccaaaaagcccaaaggugggccaaaugcuagcuccucaagugccaccauuagcaagcagauauuccccuggaugaaggagucucggcagaacuccaaacaaaagaacucaugugcgacugcaggagagagcugcgaagauaaaaguccuccaggcccggccucuaagcgcguccgaacagcuuacaccuccgcccagcugguugagcuugaaaaagaguuucacuucaaucguuaccuguguagacccaggcggguggagauggcaaauuugcucaaccugacggaacgccagaucaagauuugguuucaaaauagaaggaugaaguauaaaaaggaccagaaagcuaagggcauccugcauagcccugccucgcagucuccagagcggucacccccucucgggggagcggccggucacguagcauacuccggccaguuaccacccgugccggggcuggcuuaugaugccccuaguccacccgcuuucgccaaaagccaaccuaacauguacggacuugcagccuauacugcucccuuguccucuugccugccacagcagaagcgcuacgcggcaccugaauuugagccccauccaauggccagcaauggcgguggguucgcuucagccaaccuacagggcaguccggucuaugugggaggcaauuuuguugaauccauggcacccgccagcgggcccguguucaaccucggacaccugucucacccaucaagugcuagcgucgacuacuccugugccgcacaaauucccgguaaccaucaccauggcccuugcgauccacaccccaccuacacagaccuuucugcgcaccauucgagccaggggcgacugccugaggcuccgaaauugacucaccucuga

SEQ ID NO: 57363 - RNA, 768 nt, Artificial Sequence
  derived and/or modified sequence opt3 from HOXD4__Homo_sapiens__NP_055436
auggugaugagcuccuacauggucaacucuaaguauguugaccccaaauucccuccaugcgaggaauaccugcagggcggguaucucggagagcaaggugccgauuacuauggcgggggagcucagggcgcagacuuucagccgcccggucuuuacccuagaccagauuucggggaacagcccuuuggaggcucaggcccugggccaggaagugcccugcccgcgaggggucacggccaagagccugggggaccaggcggucauuaugcugccccgggggaacccuguccugcaccacccgccccuccacccgcuccguugccuggagcacgggccuacagccaguccgaccccaagcagccaccuucuggcaccgcuuuaaaacagcccgccgugguauacccauggaugaagaaagugcacgucaauucggugaaccccaauuauacaggcggggagccuaagcgcucacgaacugcguacacgcgucaacagguucuggagcuagaaaaggaguuccauuuuaacagauaucucaccaggcggcgcagaaucgaaauugcacacacacugugccuuagcgagaggcagauaaaaaucugguuccagaaucggcgcaugaaguggaaaaaggaucauaaacugccaaacacuaagggacgaaguuccucuagcuccucaaguagcucuuguuccucaagcguggccccgagucaacacuugcagcccauggcuaaggaccaccauaccgaucucacaacccuguga

SEQ ID NO: 57364 - RNA, 870 nt, Artificial Sequence
  derived and/or modified sequence opt3 from HOXD8__Homo_sapiens__NP_001186675
augagcuccuacuucgugaacccccuguauucuaaguacaaagccgcugcagccgcggcugccgcagccggcgaggcuaucaauccuaccuauuacgacugccacuuugcaccagaagucgggggaagacaugccgcugccgcggcagcccuccagcuuuaugguaacucagcugccggcuucccgcacgcacccccucaagcucaugcccacccacaucccaguccuccacccagcgggacaggauguggcgguagggaggggcggggacaggaauacuuucacccuggcggcggguccccagcggccgcauaucaggcugccccgcccccuccaccccacccuccacccccgccucccccaccucccugcggagguauugcuugucauggcgagccagccaaguucuacggguacgauaaucugcagcgccaacccauauuuacuacgcagcaggaagcagaguugguucaguauccugacugcaaaucuucgucaggaaacaucggcgaggauccagaccacuuaaaucaaagcaguuccccgucucagauguuccccuggaugcgaccucaggccccaggucguagaagggggcggcagaccuacagccgcuuucaaacacuggaacuagagaaggaguuccucuuuaaccccuaucugacuagaaaaaggcggauugaagugucccaugcucuugcgcugaccgagcgccagguaaagaucugguuccagaaucgaagaaugaaguggaaaaaggaaaacaauaaagauaaguuuccugugucaaggcaagaggucaaagacggagaaacaaagaaggaggcacaggaauuggaggaggaucgggccgaaggccucaccaacuga

SEQ ID NO: 57365 - RNA, 1059 nt, Artificial Sequence
  derived and/or modified sequence opt3 from HOXD9__Homo_sapiens__NP_055028
augcugggcgggagcgccggaagacucaagauguccucuucagguacccuuaguaacuacuauguggacagccugaucggccacgagggggaugaagucuucgcugcaagguuuggacccccuggcccaggugcccaggggcggccggcgggaguugcugacggccccgccgcaacagccgcugaguucgcauccugcucuuuugccccucgcucggcuguguucucagccagcuggagugcgguaccaucccaacccccugcagccgcugccaugucuggcuuguaccauccauaugugcccccuccaccguuagcagcuagcgccuccgaacccgggcgauacguccguucauggauggagccucugccaggauuucccgguggcgccgggggaggcggugggggaggcggcgggggaccugguagaggcccaagucccgggccgagcggaccugcgaauggcaggcacuaugguauuaaacccgaaacucgggcagcuccagccccugcuacggccgcaucuaccacauccucaagcaguacuucucuauccagcucgucuaagcgcaccgaguguuccguggccagagagucacaggggaguagcggccccgaguucuccugcaacucuuuucuccaggaaaaagcugcggcagccacaggaggcaccgggccaggagcugguauaggcgccgcaacugggacaggaggcagcucagaacccagugccuguuccgaucauccuaucccagguugcagccugaaggaggaggaaaaacagcacucucaaccgcagcagcagcaacuugaccccaauaacccugcugccaauuggauucaugcaaggucaacccggaagaagcgcuguccauacacgaaauaucagacucuggaguuggaaaaggaguuccucuuuaacauguaccugacccgagauagaagguacgaaguugcgcggauccugaaucucacagagcgucaggugaaaauuugguuccagaaccgcagaaugaagaugaaaaagaugaguaaggagaaaugccccaagggggacuga

SEQ ID NO: 57366 - RNA, 1548 nt, Artificial Sequence
  derived and/or modified sequence opt3 from HP1BP3__Homo_sapiens__XP_011539836
augcccaucagaaggaccgugaacagcacacgggagacuccuccaaaguccaaacuggccgaaggcgaggaagagaagccggaacccgacauuucuucagaggagagugucagcacgguugaagaacaggaaaaugagaccccuccagcuacauccucugaggcagaacaacccaaaggggagccugaaaacgaggaaaaggaggagaauaaaucgucagaagagacuaagaaggaugaaaaagaccagagcaaggagaaagaaaagaaagugaagaagaccauaccaaguugggccacacucuccgcgucucagcuugcucgcgcccagaaacaaacccccauggcaagcuccccucgaccaaagauggaugccauccugacugaggcuauuaaagcaugcuuccagaagucaggagccaguguaguggcuauccguaaauacauuauccacaaguauccgagcuuggaguuagaaagaagggguuaccugcuaaaacaggcccucaagcgggagcugaaccgcggcgucauaaaacaggugaaagggaagggagcgucuggcuccuuuguugugguccaaaaaucaagaaagacaccccagaaaagcaggaaucggaagaaccgcaguucugcaguggacccugaaccacagguaaaacuugaggauguucugcccuuggccuucacccgacucugugaaccuaaagaggcuuccuauagccugaucagaaaguacgugucgcaguauuacccaaaacugagggucgacauucggccccaacucuuaaagaaugcccugcagcgugcaguggagcgcggucagcuugaacaaaucacggggaaaggagcuucuggcacuuuucaguugaagaaguccggcgagaaaccgcugcuagggggaucacucauggaauaugccauucugagugcgaucgccgcaaugaacgagccuaagaccugcagcacaacugcucuuaaaaaguacgugcuggagaaucaucccgguaccaacuccaauuaccagaugcacuugcucaaaaagacacugcagaagugugagaaaaacggcuggauggagcaaauaucugggaagggauucagcggcaccuuucaguuaugcuucccauauuacccuucacccgguguccuguuuccaaagaaggaacccgaugacaguagagaugaggacgaagaugaggacgaguccagcgaagaggauucugaagacgaggaaccuccaccgaaaaggcggcuccagaagaaaacgcccgccaagucaccugggaaggcugccaguguuaaacagcgaggaagcaagccagcacccaaaguguccgccgcucaacgcggcaaggcgagaccucuuccaaagaaggcacccccgaaggccaaaacuccugcuaagaaaacaaggccaucuucgaccguaauuaagaaacccagcggcggguccucaaagaagccugccacaagugcacggaaagaggugaagcugcccggaaaagguaagucuacuaugaaaaagagcuuccgcgucaagaaauga

SEQ ID NO: 57367 - RNA, 582 nt, Artificial Sequence
  derived and/or modified sequence opt3 from HPCAL1__Homo_sapiens__XP_011508650
augggcaagcagaacagcaaacugagacccgaagugcuccaagaccuuagggaaaauaccgaguucacagaucacgaacugcaggagugguacaagggguuuuugaaagacugcccuacuggacauuuaacggucgaugaguucaagaaaaucuaugccaacuuuuucccauacggugacgcuuccaaguuugcagaacacguuuuccggaccuuugauacaaauggcgacgggacuauugauuuccgcgaguuuauaaucgcccugucugugaccucacgaggaaagcuagaacagaaacucaagugggcguucaguauguaugaccuggauggcaacgguuacauuagccguuccgagaugcuugaaaucguacaggcuauuuauaaaauggugucuucggucaugaagaugccggaggacgagucaacacccgagaaaagaaccgauaagaucuuuaggcaaauggacacuaauaacgaugggaagcugagcuuggaagaguucauacggggagccaaaagugacccuuccaucgugcgccuccugcagugugacccaucuagcgcaucccaguuuuga

SEQ ID NO: 57368 - RNA, 1065 nt, Artificial Sequence
  derived and/or modified sequence opt3 from HPD__Homo_sapiens__NP_001165464
augggcuucgagccccuggccuacagagggcucgaaaccggaagcagggagguggucucccacguuaucaagcaggguaaaauuguguuuguacuuucuucagcucugaacccuuggaauaaggaaaugggcgaccauuuggugaaacacggggauggagucaaggacauagcauucgagguggaagauugcgacuauaucguucaaaaagcccgggagcgcggcgcgaagauuaugcgagagccauggguggaacaggauaaguuugguaaagucaaguucgcuguguuacagacauacggggacacuacgcauacccugguagagaaaaugaacuauaucggacaguuucuaccgggcuacgaagcccccgcauucauggauccucuccugccaaaacuucccaaauguagucuggagaugauugaccacaucguuggcaaucaaccugaucaggagauggugagcgccuccgaaugguauuugaagaaccuccaguuucaucguuucuggucugucgacgauacacaggugcacacugaguacucgucacugagaagcauaguggucgcuaauuaugaagagaguaucaagaugccaauuaacgaacccgcaccugggaaaaagaaaucccaaauccaggaguacguugacuacaauggaggugccggcgugcagcacauugcucugaagaccgaggauaucauaacagccauuaggcaucuccgggaacgcggguuagaguuucugucuguaccaagcaccuauuacaaacagcuuagagaaaaguugaaaacugcgaagaucaaggugaaagagaacauugacgcacuggaagaacuaaagauccucgucgacuaugaugagaaaggauaccugcuucaaaucuucacaaagccggugcaggacaggcccacccuguuuuuggaaguuauucagcggcacaaucaucaaggcuucggugccgggaacuuuaauucccucuucaaggcuuucgaggaggagcagaaccugcgcggaaauuuaacgaacauggaaacuaauggcguggucccuggcauguga

SEQ ID NO: 57369 - RNA, 801 nt, Artificial Sequence
  derived and/or modified sequence opt3 from HPGD__Homo_sapiens__NP_000851
augcacgugaacggcaaggucgcccugguuaccggggcugcacagggaaucgguagagccuucgcggaggcucuccuucugaaaggcgccaagguggcauugguagacuggaauuuagaagccggggugcaaugcaaagcugcacuggaugagcaguuugaaccccagaagacacuauucauucagugugacgucgccgaucaacagcagcucagggacacuuuucggaaagugguugaucauuucggacgccuggacauacuugugaacaaugcuggcgucaacaaugagaagaacugggaaaagacgcugcagaucaauuuggugagcguaauuuccgguaccuaccucgggcuggauuauaugucuaaacaaaacggaggcgagggcgggaucauuaucaauaugucaagucuggccggacucaugccuguugcgcagcagccaguguacugcgcaagcaagcacgguauagucggcuuuacacgauccgccgcuuuagccgcaaaccugaugaacucuggggugcgucuuaaugcuaucuguccgggauucgugaauacugccauuuuggagucgaucgaaaaagaggaaaacaugggccaguauauugaguacaaggaccauaucaaagauaugauaaaguauuacgguauucuggaucccccucuaaucgcgaaugggcucauuacccugaucgaggacgacgcccuuaacggagcaaucaugaagauuacaaccucaaaaggcauacacuuucaagauuaugacacuacaccauuccaggcuaagacccaguga

SEQ ID NO: 57370 - RNA, 600 nt, Artificial Sequence
  derived and/or modified sequence opt3 from HPGDS__Homo_sapiens__NP_055300
augcccaacuacaagcugaccuauuucaauaugagaggcagggccgagaucauucgguacauauuugcuuaucucgacauccaguacgaagaucaccgcauugagcaagcagacuggccugaaaucaaaagcacacuuccauucgggaagauuccgauccuggagguggauggauugacuuuacaucagucccuggccauagcgcgauaucuaacgaaaaacaccgaccucgcugguaauacagaaauggagcagugccacgucgaugccaucguugacacucuggaugacuuuaugucuuguuuccccugggcagagaagaaacaggaugugaaggaacaaauguuuaacgagcuucugaccuacaaugccccucauuugaugcaggaccucgauacauaucugggcgggcgugaauggcugauuggaaacucaguaaccugggcugacuucuacugggagaucugcaguacuacacucuuaguguuuaagccagaucugcuugacaaucaccccagauuggucacccugaggaaaaaggugcaggcaauuccugccguugcuaacuggaucaaacggcgcccacagacgaagcuauga

SEQ ID NO: 57371 - RNA, 1044 nt, Artificial Sequence
  derived and/or modified sequence opt3 from HP__Homo_sapiens__NP_001119574
augagcgcccugggcgcugugaucgcacuccuucugugggggcaguuguucgccgucgacuccggaaacgauguuaccgacauugcggaugacgguugccccaagccuccagagauagcucacggcuacguggaacauucuguaagauaucaauguaaaaauuacuauaaguuaaggacagagggggauggaguguacacucugaacaaugaaaaacaguggaucaacaaggccgucggcgacaaacuaccggagugcgaagcagugugugguaagcccaagaauccugccaacccaguucagcggauucucgggggacaccuggaugcuaaaggcucauuucccuggcaggcaaagauggugagucaucacaaucuuacgaccggcgccacacugaucaacgagcaaugguugcucacuaccgcuaaaaaucuguuccugaaccauagcgagaaugccacagcgaaggacauugcaccuacccucacuuuauaugucgggaaaaagcagcugguggaaaucgagaagguaguucuucacccaaacuacucccagguggauauaggauugaucaaacugaagcagaaagucucugugaaugaacgcgugaugcccauuugccuaccuucgaaggacuaugccgaggucggucgaguuggcuacgugucaggguggggacguaacgcuaauuuuaaauucacagaucaccucaaguacguaaugcugccaguggccgaccaagaucaguguaucagacauuaugagggcagcaccgucccggagaaaaagacgcccaagaguccuguggguguucagccaauucuuaacgaacacacuuuuugcgcagggauguccaaauaccaggaagacaccuguuauggagacgcuggcucugccuucgcggugcaugaucuggaggaagacacaugguacgccacuggcaucuugagcuuugauaaguccugcgcagucgcugaguaugggguguacguaaaaguuaccucaauacaagacugggugcagaagacaauugccgagaacuga

SEQ ID NO: 57372 - RNA, 1254 nt, Artificial Sequence
  derived and/or modified sequence opt3 from HPN__Homo_sapiens__NP_892028
auggcccagaaggagggcgggagaaccgugcccugcuguagcaggccuaaagucgcugcacugacagccggaacucuccuucuguugacggcgaucggugcugccuccugggcaauuguugccguguuacugcggucugaccaagaaccacuauacccgguacaggugucaagugcugaugcacgccucauggucuucgacaagaccgagggcacauggcgacugcuuugcagcucccguucuaacgccagaguggcugggcugucgugugaagagaugggauuuuugagggcccucacucacucagaacuggauguucggaccgcgggcgcaaaugguacaagcggguucuuuugcguggacgagggacgccugccccauacccagagacucuuagaggucauaagugugugugauugcccuaggggccgguuccuggccgcuaucugucaggacugcggccgccgaaaacuuccaguagauagaauuguugggggaagggacacuuccuugggucgguggcccuggcaagugucucugcguuaugauggcgcccaccuaugugggggaagccuccuguccggcgacuggguccuuacagcagcucauugcuuuccugaacgcaacagagugcugucaagguggcggguguucgccggugcggucgcccaggcaaguccacacggguugcagcucggaguucaggcugugguauaccauggcggcuaucugcccuuucgagauccuaauagcgaggaaaacucuaaugacaucgccuuagugcaccuguccucaccacucccgcuuaccgaguacauucaacccgucugucugccugcugccgggcaggcauugguggauggaaagaucugcacgguuacugguuggggcaacacccaguauuacgggcagcaagccggagugcuacaggaggcucgcgucccaauaaucagcaaugacgugugcaacggcgcggacuucuaugguaaucagauuaaacccaagauguuuugugcaggguacccugaaggcggaaucgaugccugccaaggcgacagugggggaccauucguaugugaggauucuauuuccagaacacccagguggcggcugugcgguaucguuagcuggggcacugggugugcucucgcccagaagccgggaguguacaccaaagucucggacuuucgcgaauggauauuccaggcaauuaagacacacucugaggccuccggcauggugacccagcuguga

SEQ ID NO: 57373 - RNA, 1047 nt, Artificial Sequence
  derived and/or modified sequence opt3 from HPR__Homo_sapiens__NP_066275
augagcgaccugggcgccgugaucucccuccuucugugggggagacaguuguucgcuuuauacucuggaaacgaugucaccgacauuucagaugacagguuucccaagccuccagagauagcaaaugguuauguugaacaccuguuccgguaccaaugcaaaaacuauuaccgccuacgaacagagggcgaugggguguauacucucaaugacaagaaacaguggaucaacaaggccguaggagauaaacugccggaaugugaggcggugugcggcaagcccaagaauccugcuaacccaguccagcguauucuuggugggcaucuggacgccaaaggaaguuuucccuggcaggcaaagauggugagccaccauaauuugacgaccggcgccacacucaucaacgaacaauggcugcugacuaccgcuaaaaaucucuucuuaaaccacuccgagaaugcaacagccaaggauauugcuccuacccugacucuuuacguuggcaaaaagcaguugguggagaucgaaaaggucgugcugcauccaaacuaucaccagguagacauagggcuaaucaaacucaagcagaaaguucuggugaaugagagagucaugcccauuugucuuccuucuaagaacuacgccgaagugggaaggguggguuacgucucgggcugggggcaaucagauaauuuuaaacugacagaccacuugaaguauguuaugcucccaguggcggaucaguacgacugcaucacccauuaugagggaagcacguguccgaaauggaaggcacccaagaguccuguaggcgugcagccaauucugaacgagcacacuuucugcgucgguauguccaaauaccaggaagacaccuguuauggggaugccggaucugcuuuugccgugcaugacuuagaggaagauacaugguacgcagcuggcauccugagcuucgacaaguccugcgccguugcggaguauggcguguacgucaaagugacuucaauacaacacuggguacagaagaccauugccgaaaacuga

SEQ ID NO: 57374 - RNA, 657 nt, Artificial Sequence
  derived and/or modified sequence opt3 from HPRT1__Homo_sapiens__NP_000185
auggccaccagaagccccggcguggucaucuccgacgaugagccuggguacgaccuggaucucuucugcauuccaaaccacuaugcugaagaccuugagaggguuuuuauaccgcauggacugaucauggaucggacagaacgcuuggcacgagacgugaugaaagagauggguggccaccauauuguagccuuaugugugcugaaagggggauacaaguucuuugcggaucuacucgacuauaucaaagcucugaaucguaacucugauagaucaauucccaugacugucgacuucaucaggcuuaagaguuacugcaaugaucagagcacgggcgacauaaaagugaucgguggggaugaccuguccaccuugacaggaaagaacguucucauuguggaagacaucauugauacuggcaagaccaugcaaacacugcugucucucguccggcaguauaauccuaaaauggugaagguagccucguuacugguuaaacgcaccccaagaucagugggcuacaagcccgacuuugucggguucgagaucccugauaaauuuguggugggauaugcacuugacuacaacgaguacuucagggauuugaaucacgucuguguuauaagcgaaacugguaaggccaaguauaaggcuuga

SEQ ID NO: 57375 - RNA, 2103 nt, Artificial Sequence
  derived and/or modified sequence opt3 from HPS1__Homo_sapiens__NP_000186
augaagugcgugcuggucgccaccgagggcgcugaaguucucuucuacuggacagaccaggaguuugaagagagccuuagacugaaauucgggcaauccgaaaacgaggaggaagaguugcccgcauuagaagaucagcugucuacucuacucgccccugugaucauuucaaguaugacgaugcuggagaaacuuagcgacaccuauacauguuuuuccacugagaauggaaacuuccuguacguauugcaccucuuuggugaaugccuguucauagcgaucaauggcgaucauaccgagucugaaggggaccugagacggaagcucuauguguuaaaguaccuguuugagguccacuucggacuugugacaguugauggccauuugauucgcaaagaacugcgaccaccggaccuagcucagcgugugcagcucugggagcacuuucaaucgcugcuuuggaccuauucaagacugagggagcaggaacaguguuucgccgucgaggcauuggaacggcucauccauccccagcugugcgaguuauguauugaagcccuggagcgccacgugauccaagcuguaaacacuagcccugagagagguggggaagaggcacuccacgccuuucuucugguucauaguaaguugcuagcuuucuacuccucucacagcgccuccucacugaggccagcggaucuccuggcacuuauacuguuggugcaggaccucuaucccagugaaagcacagccgaggaugacauccagccuucuccacggcgcgcucgauccucacagaauauucccguccaacaggccuggagcccucauaguaccggaccaacgggcgggucuuccgcagaaacugagaccgauagcuuuucgcugccggaggaauacuucacacccgcuccuucuccaggcgaccaguccucaggaaguacuaucugguuagaggguggcacacccccuauggaugcccugcaaauugcggaagacacccuacagacccucgugccacacugccccgugccgagcgggccuagaaggaucuuccuggacgccaacgucaaggaguccuacuguccccuuguuccacacacgauguauugcuugccucuguggcagggaauaaaucucgugcugcuuacucggucucccagcgcaccacuggcuuugguacucucacagcugauggauggcuuuaguauguuagagaaaaagcugaaagaaggucccgagccuggggccucccuacguagccaaccacucgugggagaccugcgccagagaauggauaaguucgucaaaaacaggggcgcucaggaaauucagucuacauggcuugaguuuaaggccaaggcauucucaaaaagugaaccgggcagcuccugggaguugcugcaagccugugggaagcucaaacggcagcugugcgcuaucuaccgauuaaauuuucugaccacugcgcccucucgcggagguccucaucuuccacagcacuugcaggaccaagugcagagacucaugagggagaagcugacagauuggaaagacuuccuacugguuaagucgcggcgcaacauuaccauggugagcuaucucgaagauuuucccggccugguccauuucaucuacguggacagaacgaccgggcagaugguagcaccuucccuuaauuguucacagaaaacaaguucugaguugggaaagggcccacuggccgcuuuuguuaagacuaaaguguggagcuuaauccaacucgccaggcguuaucugcagaaggguuacaccacacuucuguuccaggaaggggauuuuuauugcuccuacuucuugugguuugagaacgacaugggcuacaaacuccaaaugauugaaguccccgugcugucagaugacagcgucccgauaggaaugcuaggcggggacuauuaccggaagcugcuccgauauuacucuaaaaauagaccuacugaggcagugaggugcuaugagcugcuugccuugcaccuguccguuaucccaaccgauuuacucgugcagcaggcuggacagcuggcccgccggcuuugggaagcaaguaggauuccccugcuauga

SEQ ID NO: 57376 - RNA, 3015 nt, Artificial Sequence
  derived and/or modified sequence opt3 from HPS3__Homo_sapiens__NP_115759
auggugcagcuguacaaccuccaccccuucggcagccaacaggucguuccuugcaaacuugagccagacagauuuugugggggagguagggaugcccuguucguggcugcaggcugcaaaguagaagccuuugcgguggcugggcaggaguugugucagccgcggugcgccuucuccaccuuaggacgcguccugcgacuagcauauucugaagccggcgacuaccucguggcuaucgaggaaaagaauaaagcaacauuucugcgugccuauguuaacuggagaaauaagaggacugagaacucacggguguguauucgcaugauaggucauaaugucgaggggcccuucaguaaggcuuuuagagaucaaauguacaucauugaaaugccucuuagcgaggccccacugugcaucuccuguugccccgugaagggagacuugcucguaggcuguacgaacaagcugguucuguucucucucaaauaucagauuaucaaugaagaguuuucguuacuggauuucgagaggucacuuauaauccacauugacaacaucaccccuguggaagucagcuuuugcgugggcuacguggcggucaugagugauuuggagguucugauugugaagcuagaauccgggccaaagaauggagagcggguacaucaccauccccacaagacaaacaaucgcauccgaagaacugaagaggguauaucuaacgagauuagccagcucgaauccgacgauuucgugaucugucagaaaccucuggagcuucugggcgaaaagucagagcaaaguggguugagcgucacccucgaaucuacaggacuggcagacgagaagaggaaauauucccacuuucagcauuuacuguaccggcguuucgccccagauauuucaagcuacgugcucagugacgauaucaaacuucacucucugcaguugcuaccgaucuaucagaccggcucccugacuagcgacgguaaaaaucucucgcaagagaaggaacugcuuucucuguucugcuuuuucuccuugccccauguuggguaccucuauaugguggucaaaucaguggagcugaugaguguauaccaguauccugaaaagagccagcaagcuguuuuaacaccacaguuucugcacgugauuaccuccaacaaucuacagugcuucacgguccgcuguucugccgcagcugccagagaggaagaccccuacauggauacuacccucaaagcgugcccuccagugagcauggacgucugugcccugaggauacagcuuuuuaucggauugaaggcaauuugccacuucaagaaccauaucauacugcucacaaaagcugagcccgaggccauuccggaacggcgacaaucaccuaagcgccugcuuaguagaaaagauacuuccgugaagaucaaaauucccccaguugcugaggccggcuggaaccuguauaucgugaauaccaucagcccuguacaguuguacaaggaaauggucgacuacucuaacacauauaagaccgugaaaacgcagucauguauucaccuccugagugaggcacauuuacugguuagggccgcucuaauggaugcgagccagcucgagcccggcgaaaaggcagagcugcuugaagccuuuaaagaguccugcgggcacuugggagacuguuacucucggcuggauucgcaacauagccaccucacucugccauauuacaagauguccgguuuaucaauggcugaagugcuggcccgcacagacuggaccgucgaggauggccuucagaaauaugagagaggguugauauucuacaucaaucacagucucuaugaaaaccuggacgaggaacuaaaugaggaacuggcagccaaggugguacagauguuuuacguggcugagcccaagcagguuccucauauucucugcucuccaagcaugaaaaacaucaauccgcugacugccauguccuaccuuaggaaguuggauacaucaggauucagcucuauccuggucaccuuaacgaaagcagcgguggcucucaagaugggcgaccuggacaugcaccguaacgagaugaaaucccauagugaaaugaaacuugugugugguuuuauucuggagccccgguugcucauacaacagcgaaaggggcagaucgucccuaccgaacuggcccuacaccugaaggagacacagccaggccuccugguugcaagcgugcuuggauugcaaaagaauaacaaaauuggcaucgaagaggccgauucuuucuuuaaggugcugugcgcuaaagacgaggauacuauuccccaguuacucguagacuucugggaagcccagcuggucgcaugucuuccugaugugguucugcaagagcuauucuuuaagcucaccucccaguauaucuggagacugucaaaaaggcagccacccgacacaacuccguugcgcaccagugaagaucugauaaaugcuugcagccacuacggguuaaucuauccuugggugcaugucgugauuucguccgacucucucgccgauaagaacuacacagaggaccugagcaaacuucagucacugaucugcggaccaaguuucgauauugcguccaucauacccuuuuuggagccucucucugaagacaccauugccggucugagcguucacgugcuaugucggacuagacugaaggaguaugaacaaugcaucgauauucuucucgagaggugucccgaagcuguaaucccauacgcaaaucaugagcugaaggaggaaaaccgcacguugugguggaaaaagcuguuaccugagcucugccagcgaauaaaauguggcggggaaaaguaucagcuguaccuuuccucacugaaggagacauugagcaucgucgccguggaacucgagcugaaagacuucaugaaugugcuacccgaggacggaaccgcuaccuuuuuccugccauaccuucucuauugcagucggaagaaaccgcugacuuga

SEQ ID NO: 57377 - RNA, 2127 nt, Artificial Sequence
  derived and/or modified sequence opt3 from HPS4__Homo_sapiens__NP_071364
auggccaccagcacauccacugaggcuaagucugcaucaugguggaacuacuucuuucuguaugacggcaguaaagugaaggaagagggggaucccacgagagccggaaucugcuacuucuauccuagccagacccuccuugaccaacaggaacuguuguguggucagauugcgggcgucguuaggugcguguccgauauaucugacucgccaccgacauuaguacggcugcgcaaacuaaaguuugcuaucaaaguggauggggacuaccucuggguccugggaugugccguggagcuucccgauguuucaugcaagcgauuccuggaccaguuggugggcuuuuucaauuuuuauaacgguccugucagccucgcauacgaaaauuguagucaagaggagcuguccacugaaugggauaccuucauugagcagauccugaagaacacaucugaccuccacaaaauuuuuaauagcuuauggaaccuggaucagaccaagguggaaccacuuuugcugcuaaaagccgcucguauccuccagacuugccaaagaaguccccauauacuggcaggguguauccuuuauaagggacugauuguaucaacacaguugccuccaagucucaccgccaaaguucuguuacacaggacggcuccccaggagcagcggcugccuacuggcgaggacgccccacaagaacauggcgcggcacucccgcccaaugugcagaucauuccugucuucgugaccaaggaggaagccaucagccuucacgaguuuccaguggaacagaugacacgcucucuggcuucccccgccggguugcaagauggaucagcacagcaucacccuaaggguggcagcacuuccgcucuaaaagagaacgccaccgggcacgucgagucuauggcguggacaaccccagaccccacguccccggacgaagccugcccugauggaagaaaggagaauggcugucugagcggucaugaccucgaaucgauaaggcccgcagggcugcacaacucugcucggggagagguucuuggccuguccucaaguuugggcaaagaacucguguuccugcaggaggaguuagaucugagcgaaauucauaucccagaggcccaggaaguagagauggcuuccgggcacuuugccuuccuacacgugccuguccccgacggacgcgcaccauacugcaaggccucucucagcgcuucaaguucccuggaacccacuccuccagaggauacagcgauuagcucucuucgaccgcccucagcaccugagauguugacccaacauggugcccaggaacagcuggaggaccacccaggccauaguagccaggcucccaucccuagagccgauccacuccccaggcggacucgucgcccgcugcuucugccuagauuggacccagggcaaaggggaaauaaacuccccacaggcgaacagggucuggaugaggacguggaugggguuugugagucccacgcagccccuggcuuagaaugcucaucgggaagcgcuaacugccagggcgccgggcccuccgcagacggaaucucaagucggcugaccccagcggagucuuguaugggucuagugcgaaugaaucucuacacgcauugcgucaagggccuggugcuuagcuugcuggcugaagaaccucuccugggggacuccgccgcaauugaagagguauaucacucuagcuuagccucucugaacggacuugagguucacuugaaagaaacccucccccgcgaugaggcugccuccacaaguagcacuuacaauuucacccauuaugacagaauacagucucugcuaauggcaaaccugccacaaguggcuacaccgcaggauaggcgguuucuccaggccgucucccugaugcacucagaguucgcgcagcuuccugccuuguacgagaugacugugcgcaacgcuaguaccgcagucuaugccuguugcaaucccauccaagaaacauacuuucagcagcuggcuccagccgcaagaagcucgggcuuccccaacccucaagacggugcguuuuccuuaucugggaaggccaagcagaaacuccugaagcauggcgugaaucuucuguga

SEQ ID NO: 57378 - RNA, 3390 nt, Artificial Sequence
  derived and/or modified sequence opt3 from HPS5__Homo_sapiens__NP_852608
auggccuucgugcccgucaucccugagagcuacucccacguucuggcugaauuugagucucucgacccacuucugucagcauugagauuagauaguagcaggcugaagugcaccuccauugccgugucucggaaauggcuagcgcucggcucgucagggggaggucugcaucuuauacagaaggaaggcuggaaacaccgccuguucuugagccaucgagagggggcuaucagucaaguagccuguugccuccacgacgaugacuauguggcagucgccacaucccagggacuggugguugugugggaacugaaccaggagcguagaggcaagccggagcagauguacgucucuagcgaacauaaagguaggcgggugacugcucucuguugggauacggcaauuuuacgcguauuuguuggggaccacgccggaaagguguccgcuaucaagcugaauaccucaaaacaagccaaggcggcagccgcuuucgucauguuucccgugcagacaauuacuaccguggauaguugcgucguucagcuugacuauuuggauggcagacugcuaaucagcucucucacaagguccuuccugugugacaccgagcgggaaaaauuuuggaagauaggcaacaaagagcgcgauggggaguacggagccugcuucuuuccuggucgauguucaggcgggcagcaaccacuuaucuauugcgcaagacccggaagcaggaugugggaagugaauuucgacggcgagguaauuaguacucaccaguuuaagaagcuguugucucucccuccacugcccgugaucacauuacgguccgaaccucaguacgaucauaccgcugguagcucgcagucucuguccuucccaaaacuccuucaccugucagagcauugugucuugacguggacugaacgugggauuuauaucuuuauaccgcaaaacgugcagguucuacuguggagugaggugaaggacauucaggacgucgccgugugccgcaaugagcuuuucugucugcaccuuaacggaaaaguaagccaccuguccuugaucucuguugaaagaugcguggagaggcuccugcggcgaggcuuauggaaucuggcggccagaaccugcugucuauuccaaaacagcgucauugcaucacgcgcuaggaagacacucacugccgauaaacuggaacaucuuaagagucaguuggaccacggcaccuacaaugaucugaucucccagcucgaggaacugauccuuaaauuugagccccuggacagcgcuuguucuucacggcgcaguagcauuuccucucaugagucguucagcauauuggauuccgggaucuacagaauuaucucaaguaggcguggaucucagagcgacgaagauuccugcucacuccacagccaaacacugucugaggacgaacgguuuaaggaguucaccucccagcaggaagaggauuuaccugaccagugcugugguagucauggcaacgaggauaaugugagccacgccccagucauguuugaaacggacaagaacgagacuuuccugcccuuugggauaccucuaccauuccgaucucccuccccgcucgugucacugcaagcaguuaaagaaagugugagcucguuuguaagaaagacaaccgagaaaauuggaacucuucacacauccccugacuugaaggucaggcccgagcugcgcggcgaugaacagucuugcgaggaagacgugagcucagauaccuguccaaaagaggaagacacggaggaggaaaaggagguuaccaguccucccccagaagaggaucgguuccaggaacucaagguggccacagcugaggcgaugacuaaacugcaggaccccuuaguccuguuugaguccgaaucucuuagaaugguguugcaagaguggcucagccaucuggaaaagaccuucgcaaugaaagauuuuuccgguguaucagacacagauaauagcaguaugaagcuaaaccaggacgugcugcucguuaaugagucuaaaaaggggauccuggaugaagacaacgagaaggagaaaagggauucccuuggcaacgaagagagcgucgacaagacugccugcgaaugugugcgcucgccucgagagucauuggacgaucuguuccagaucugcucuccaugugcuauugccaguggauuacggaaugaccucgcagagcugaccacacuuugccuggaauugaacgugcucaauuccaaaaucaagagcaccucuggccacgucgaucauacucugcagcaauauagcccggagauucuagccugccaguuccugaaaaaguacuuuuuccuccugaaccuuaagcgugcuaaagaauccauaaaguugucauauaguaauagccccucuguuugggacacguuuaucgaggggcugaaagaaauggccuccucaaacccuguguacauggagauggagaagggagauuuaccaacaagacucaaacugcuugacgaugaagugcccuucgacaguccucugcuaguagucuaugcaaccaggcucuacgagaaguuuggugaaagcgcgcugcgcuccuugauuaaauucuuuccaucuauccugcccucggauaucauucaguuaugucaccaccauccggcugaguuccucgccuaucuggacagccuugugaagucacggccugaagaucaaagauccaguuuucuggagucuuugcuccagccagagagccugaggcuagacuggcugcuucucgcaguuucccuggaugcucccccuucaacuucuaccauggacgacgaaggcuacccccgaccacacagccauuugcugaguuggggguacucccaguuaauacuccaccugaucaagcucccugccgauuucauuacaaaagagaagaugaccgacaucugccgcagcuguggauuuuggcccggcuaucugauuuugugccucgaacuggagcggagaagggaagccuucacuaauaucguguaccuaaacgauaugucucugauggagggugacaauggguggauaccagagacagucgaagaguggaaacuucuccugcauuugauccagucaaaguccacgcguccggcaccucaagaaaguuuaaacggcagccugucggauggacccucuccaauuaauguggagaacguugcucuccugcuugccaaagcgaugggccccgaccgcgccuggucccuguugcaggagugugggcuagcucuggaacucagcgagaaguuuacccggacuugcgauauccugagaauugcagaaaagaggcagcgagcccuuauccagucaauguuagagaaaugugaccgguuccuguggagucaacaggcuuga

SEQ ID NO: 57379 - RNA, 2328 nt, Artificial Sequence
  derived and/or modified sequence opt3 from HPS6__Homo_sapiens__NP_079023
augaagagaagcggcacccugaggcuccuuuccgaccugucugccuucgggggagcugcacgguugcgcgaguuaguggccggugauucagcgguccgaguucguggcagucccgacgggagacaccuccuacuccugaggccuccaggagcuguggccccgcagcuucugguagcaagccggggccccggugccgaauuggagcgcgcuuggccugcagggcaaccaucuccccucgaugccuuuuuccugccuuggccagcuagacccgcccuggugcucgucugggaauccggauuagcggagguguggggcgcaggcguugggccuggauggaggccacugcagucgacagaacuuugcccggguggcggggcccggguggucgcuguggccgcauugcgcggacgacugguauggugugaggagagacaggcuagggccgaaggccccucagguagcccugcggccgcauuuagucacugcguuugugugcggacucuagagccauccggggaggcuucuacgagccucggacguacccacguccugcuucaucacugccccgccuucggccuguuggcuuccugucgccagcucuuucuggugccuacagccacuaccuggccaggcguggcacaugucuuacugaucuggucacccgggaaaggaaagguuaugguggccgcuccgagacucggucuuaguuacagcaaaucucugaacccuggcaggggagacacaugggauuuccggaccuugcuacgagggcugcccggccuccuguccccacgcgaaccucuugcgguacacacuugggcacccacaccacaaggucuguugcuccuggacuuugggggcaccgugucauuacugcagagccacggaggcacgagagccgucgggacucuacaggaggcucccgugggaccuugggguagugccgcacucggcaccuuccaggggacacuggccugcguucuuggaucuacuuuggaacugcucgauaugggcuccggucaacugcuugagaggaaggugcugagcaccgaccggguccauuugcucgaaccaccggcucccgggauggaggaugaagaggagcuggaaacacgcggcaauuuaagacugcuaucggcccucggacuguuuugugugggcugggaggcaccucaggggguagaacuuccaucugcgaaagacuugguuuucgaggaagccugcggauauuaccagaggcguucccugcggggugcucagcucacccccgaggagcugcgacacucaaguacguuuagagcaccucaagccuuagcuagcauucugcagggccaucuuccacccuccgccuugcucacuaugcugaggacagaacuacgcgauuaucgggggcuggagcagcucaaggcacaacugguggcuggagacgaugaagaggccggcuggaccgaacuugcggagcaggaggucgccagauugcugaggacugaauuaauaggugaccagcucgcucagcugaacacaguguuccaagcacuuccgaccgccgcuuggggcgccacgcugcgcgcauugcagcuccagcuggacgggaauggaaagcuacgaucucaggcgccuccagaugucuggaaaaaggugcugggcgggaucaccgccggaaaagagcccccuaacggcauucugcccccauuugaacugcuuugucaaugcuugugucagcuggagccucggugguuacccccauucguugagcucgcucagcagcaaggugggccgggauggggcgccgguggcccugggcugccccuuuaccguagagcacuggcugugcuaggagaagagggcacaaggccagaagcccucgagcuggaauugcuguuaagcucagggcgccccaaggcaguacuccaggccgucggacagcuggugcagaaagagcaaugggaccgggcucuugaugcgggccuggccuuggguccuaguuccccacuccugagaagcgagaucuucaagcuacugcuugcagaauuugcucagcacaggcgacucgacgcccaucugcccuugcugugccgcuuaugcccuccggagcucgccccagcugaacugcuucuguugcuccggacuuaucugcccgaugagguugggccuccaacccccuucccugaaccgggagcagagcccccacuaacagugggccugcuuaaggcccuccuggagcagacuggugcgcaaggcugguugucugggccugucuuaucacccuacgaagacauucugugggauccaaguaccccucccccaacaccgccuagagaccucuga

SEQ ID NO: 57380 - RNA, 1605 nt, Artificial Sequence
  derived and/or modified sequence opt3 from HPSE2__Homo_sapiens__NP_001159716
augagagugcugugcgccuuccccgaggcuaugccuagcuccaacucuaggccaccggcaugucucgcccccggcgcgcuuuaccuggcuuuguuacugcaccuaucacucaguagccaggccggggaccggcgcccucugccagucgaucgagcagccggacuuaaggagaaaacccugaucuugcucgacguuuccacaaagaaucccgugcguacuguaaacgaaaauuuucugucucugcaacucgauccuucgauuauacaugacgguugguuagauuuccugucaagcaaaagacuugugacguuggcuaggggccugaguccagcauuucuacgguucgggggaaagcgcaccgacuuucuccaguuccagaaccugagaaaucccgccaaauccaggggcgguccugggccagauuauuaccuuaagaacuaugaagacgauaucguccggucugacguggcucuggauaagcagaaaggaugcaagauugcccaacacccggacguuauguuggagcuccagcgcgaaaaagcggcacagaugcaucugguguuacugaaggagcaguuuagcaauacauacuccaaccucauccuuacugagcccaauaacuaucgaaccaugcacggcagagccgucaauggcucacaacuggggaaagauuacauucaguugaagagucuacugcagccuaucaggauauauagccgggcuucucucuacggaccaaacaucggucguccccgcaagaaugugauugcccugcuugacggcuucaugaaaguagcaggguccacaguugacgcugugaccuggcagcauuguuacaucgauggaagagucgugaaggugauggacuuucugaaaacuagguugcucgauacacugucagaccaaauucggaagauccagaaagucguuaacaccuauacgccuggcaagaaaauaugguuagaaggugugguaacuaccagcgccgggggaacaaauaaccugagugauucuuacgcggccggcuuccuauggcucaacacucugggcaugcuugcaaaucaggggauugacguggucauccgacacuccuuuuucgaucacggauauaaccauuugguggaccaaaauuuuaacccacugcccgauuacuggcucagccugcuuuauaagcgccugauugguccgaagguuuuggcugugcacgucgccggccuccagagaaaaccuaggcccgggcgggugauccgcgacaagcugagaaucuacgcucauugcaccaaucaccacaaccauaauuauguaaggggaucgauuacauuauucauaaucaaccugcaccguucucggaaaaagauuaaacuagccggcacccuccgagauaagcugguucaucaguaccuuuugcagccauacggucaagaggggcugaaguccaaaucagugcagcucaauggccagccucuggucaugguggacgacggaacguuacccgaacugaagccaagaccccuuagggcaggccgcacuuuggucaucccuccagugacaaugggguucuauguugugaaaaacguaaaugcccucgcuugucgguacagauga

SEQ ID NO: 57381 - RNA, 1632 nt, Artificial Sequence
  derived and/or modified sequence opt3 from HPSE__Homo_sapiens__NP_001092010
augcugcucagaagcaagcccgcccuuccuccaccgcugauguuguuacugcuaggcccccucgggccucuguccccaggagcccuucccaggccugcacaggcccaagacguggucgaucuggacuucuuuacccaggagccauugcaccucguuucucccucauuccugagugugacaaucgaugcgaaccuggcuacugacccucgguuucucauuuuacuggguagcccaaaacuucgcacguuggcccgaggccuguccccggcauaccuacguuucgggggaaccaagacagauuuucucauauucgaccccaaaaaggaaucuacuuuugaggaaagaucguauuggcagucacagguaaaucaagauaucugcaaauacggcagcauuccuccagacguggaggaaaagcugaggcuugaguggcccuaucaggagcagcuguugcuccgggaacauuaccagaagaaauucaagaacaguaccuauucccgcucuagcgucgaugugcuguacacauuugccaauuguuccgguuuagaccugaucuucgggcucaacgcacuucugagaaccgcugauuugcaauggaacucaaguaaugcccagcuacugcucgacuauugcagcucuaaaggauacaauauuuccugggagcugggcaacgaaccuaauucauuucuuaagaaagcugauaucuucauaaacggcagccagcugggggaggacuuuauccaguugcacaagcuccugaggaagaguacuuucaaaaaugccaaguuauacggaccagacguuggucaaccccggcgcaaaacagcgaagaugcugaaaucuuuccuaaaggcaggcggggaggugauugauuccgucaccuggcaucacuauuaccucaacggacgaacggccacuaaagaagacuuucugaauccggaugugcuugacaucuucauuagcucgguacagaagguuuuucagguggucgagucuaccagaccuggcaagaaagugugguugggugaaacauccucagcuuaugggggaggcgcuccccugcucagugauacuuucgcagcuggcuuuauguggcuggacaaacuugggcugagcgccaggaugggaaucgagguggucaugcggcaaguuuucuuuggugcgggcaacuaccauuugguggaugaaaauuucgacccacucccugauuauuggcuguccuuacuguuuaagaagcuaguagggaccaaagugcucauggccucuguccagggaagcaagcgucgcaagcugagaguguaccuucacuguacaaacaccgacaaccccagguauaaagagggcgauuugacgcuguacgcaauaaaucuccacaacguuacuaaguaccugcgguuaccauaucccuucucaaauaaacagguggacaaguaccugcuucgaccuuuggguccacaugggcuccugaguaaauccguccagcuaaacggccugacacucaagaugguggacgaucaaacccugccgccccuuauggagaagccuuugcgcccaggaagcucucugggcuuacccgcuuuuucauauaguuucuuuguaauuagaaaugccaaaguugcugccugcaucuga

SEQ ID NO: 57382 - RNA, 1389 nt, Artificial Sequence
  derived and/or modified sequence opt3 from HPX__Homo_sapiens__XP_005252940
auggccagagugcugggcgcucccgucgcacucgggcuuuggagccugugcugguccuuggccaucgcgaccccuuuaccaccgacaucugcucacggaaacguugccgagggugaaacuaagcccgacccugaugugacggagagguguucagacggcuggaguuucgaugcaaccacacuggacgauaaugggacuaugcuauuuuucaaaggagaauuuguauggaagucucauaaaugggaccgggagcucauuuccgaacgcuggaagaacuucccaucucccguggaugccgcuuuucgacagggccacaauucggucuuccugauaaaaggugacaagguguggguuuacccuccagagaagaaagagaagggguaucccaaacuucugcaagaugaauuuccuggaaucccaucaccguuggacgcagccguggagugccaucguggcgaaugucaggcugagggcguccucuucuuucagggggauagagagugguucugggaccuggccaccggaacaaugaaggaaaggagcuggcccgcgguggguaacugcaguuccgcacugcgguggcucggccgcuacuauuguuuucaggggaaucaauucuuaagauuugauccuguaaggggagagguuccaccccgguacccucgcgacgugcgagacuauuucaugccaugccccggcagaggucacgggcauaggaacggaaccggccacggcaauucuacucaccaugggccggaauacaugcgguguagcccucaccugguccuuuccgccuugacaucagauaaccauggagcuaccuaugccuucagugguacgcacuacuggcgucuggacacuagccgcgauggcuggcacucuuggcccauugcacaucaguggccacaggggccuuccgcuguggacgccgcguuuucaugggaggaaaaacuauaccucgugcagggaacccaagucuauguuuuccugacaaagggcgguuacacucuugugagcggguaucccaagagacuggagaaagagguaggcaccccacacggaaucauuuuggauaguguggacgccgcauuuaucugccccggcagcuccaggcuccauauaauggcugggcggcgacuguggugguuagaucugaagucuggagcccaggcuacauggaccgaacucccuuggccacacgagaaagucgacggugcccuuuguauggaaaagucgcugggcccgaauagcugcuccgcaaacgggcccggauuguaccuaauccauggcccuaaucuguauuguuacucagauguggagaaacucaacgccgcuaaggcgcugccacagccccagaauguuacgagucuucuggguugcacucacuga

SEQ ID NO: 57383 - RNA, 570 nt, Artificial Sequence
  derived and/or modified sequence opt3 from HRAS__Homo_sapiens__NP_001123914
augaccgaguacaagcugguggucguuggcgccgggggaguggguaaaagcgcucucacaauccagcuuauucaaaaccacuucguagacgaauaugaucccacuauagaggacuccuacagaaaacagguggucaucgauggcgaaacgugccuguuggacauuuuagauaccgcagggcaggaggaauauucugccaugagggaccaguacaugcggacaggagagggcuuucuguguguguucgcgaucaauaacacuaagucauuugaggauauucaucaauaucgcgaacagaucaagcgaguuaaagacagugaugacgugccuaugguccuaguggguaauaagugcgaucucgcugcccguaccguagagagcagacaggcacaggaccuggccagguccuacgggauaccauauaucgaaacaucugcuaagacccggcaaggaguugaggaugcauucuacacucuugugcgcgagauuagacagcacaaacugaggaaguugaacccgcccgacgaaucgggcccuggcuguaugucaugcaaauguguccucagcuga

SEQ ID NO: 57384 - RNA, 822 nt, Artificial Sequence
  derived and/or modified sequence opt3 from HRASLS__Homo_sapiens__NP_065119
auggugagagccagcugcaggcugggcuccgcucggacccccucuccugcacgccgaccaccggggguccgugccucacagaguagaggaggugcggcuggcacaguuagcgccuggaggcggugguguuggcgcuggcccuggagaacugcaccuuccgacggguggaggcucccacccggaugccuuccuggcacggauggugugguaccacggcccccugccgcucgcucugcagccgcucgaccaagagagaccccggggcacacacaacugcccccuggagccaggcggcguccacgcuuggaaucggagauggcguucaacgacuguuuuucauuaaauuaccccggcaacccuugcccaggcgaucugaucgaaguguucagacccggguaucagcauugggcacuauaccucggagacgguuaugucauuaauauagccccgguggauggcaucccugcuagcuuuaccagugccaaguccguuuucucuagcaaagcacuggugaagaugcagcuucugaaagacgucguggggaacgauacuuacaggauuaauaacaaguaugacgagacauaucccccauugccuguagaagagaucauuaaacgguccgaguuuguuaucggacaggaaguggcuuacaaucuccuggucaacaauugugagcacuucgugacccugcuccgauacggcgaaggugugucagagcaagccaaccgcgcgauaaguacugucgaguuuguuacagccgcaguggggguauucagcuuuuuaggacuguuccccaagggccagagagcuaaguacuauuga

SEQ ID NO: 57385 - RNA, 2100 nt, Artificial Sequence
  derived and/or modified sequence opt3 from HRC__Homo_sapiens__NP_002143
augggccaccauagacccuggcugcacgccagcgugcucugggcuggggucgcaucccuucuguugccuccagccaugacccagcaauuaaggggagacggucugggcuuccggaaccgcaauaacucuacagggguugcgggacuaucagaggaagcuagugccgagcuccgacaucaucugcacagcccgcgugaucaccccgacgaaaauaaggauguguccacugagaacggccaccauuuuuggucucacccugacagagaaaaagaggaugaggacguaucgaaggaauacggucaucuucugccagggcacaggucacaggaucacaaagugggagacgagggcgucagcggcgaagagguguucgcagagcaugggggacaggcccggggucaccgcggccaugggagugaagauacggaggacuccgcugaacacagacaucacuugcccucucacaggagccauucccaccaggaugaggacgaagaugagguugugucaagugagcaucaccaccauauccuccggcacggacaucgcggccacgacggugaagacgaugagggggaagaggaagaggaggaagaggaagaggaagaggaggcaagcaccgaauauggacaucaagcccaccgacacagaggccauggcucugaggaagacgaggaugucuccgacgggcaccaucaccauggaccuucacacaggcaccagggucaugaggaagaugacgaugacgaugacgaugacgacgaugacgaugacgaugacgaugugagcauugaguaccggcaccaggcucaucgucaccagggccacgggauagaagaggacgaagauguaagugacggacaucaccaucgcgauccaucucacagacauaggucccacgaggaggacgauaaugacgacgaugacguuagcacagaauauggccaccaagcccaucggcaccaggaucaucgaaaggaggaaguggaggcggucucgggugaacaccaccaucacgugcccgaccaucgccaccaggggcauagagaugaggaggaagacgaggaugugucuacugaaagguggcaccagggcccucaacacguccaucacggacugguugacgaggaagaggaggaagaggaaaucaccgugcaguuuggccauuacguagcaucccaccagccacgggggcacaaaucagaugaggaggacuuccaagaugaauauaagacagaggugccgcaucaccaucaccaucgcguccccagagaagaggacgaagaggugagugccgagcugggacaccaggcuccuagccacaggcagucccaucaggaugaagagaccggucacggccaacgugggucuauuaaggaaaugagccaucacccacccggacauacuguugugaaagaccggucacaccuccgaaaggacgauagugaggaagagaaagagaaggaagaggacccuggcucccacgaagaggaugacgaaagcucugagcagggugagaaagggacacaucacggcucaagagaucaggaagacgaggaagaugaggaggaaggacauggcuuaagucugaaccaggaggaagaggaagaggaggacaaggaagaggaagaggaagaggaggaugaagagaggcgcgaggaacgggccgaagucggggcaccacuuagccccgaccacuccgaggaggaagaggaagaggaggaaggauuggaggaagaugagccgagauuuaccaucauuccuaauccccuggacaggcgcgaagaggcugguggcgccucuucggaggaagagagcggggaagacacgggaccacaagaugcgcaggaguacggcaacuaucagccugguucccuaugcggguacuguucauucugcaaucgauguacugaaugcgagaguugucacugcgacgaggaaaacaugggcgagcauugugaucagugccaacacugucaguuuugcuaccucuguccccuggugugcgaaaccguaugcgccccaggaucuuauguugacuacuucagcuccucacuuuaucaggcacuggcugauauguuggagacacccgaaccuuga

SEQ ID NO: 57386 - RNA, 1578 nt, Artificial Sequence
  derived and/or modified sequence opt3 from HRG__Homo_sapiens__NP_000403
augaaggcccugaucgcugcacuccuucugauuaccuugcaguacagcugcgccgugucccccacagacuguucugcggucgagccugaagcugagaaagccuuagaucugauaaacaagagaaggcgggacggcuaucuauuccaacuccugcgcaucgcagaugcccaccuugaccgaguugaaaauacuacgguguacuaucugguauuggaugugcaggagucagacugcaguguccucagccguaaauacuggaacgauugugaaccaccggacuccagaaggcccucugagauugugaucgggcagugcaagguuauugcuacccggcauucgcacgagucacaggaucugcgcgugaucgacuuuaauuguacaacuagcagugucuccucugcacuggccaacaccaaagauagcccugugcucauagacuucuuugaagauacagagagauauaggaagcaagcuaauaaggccuuagaaaaauacaaggaggagaacgacgacuucgcguccuuucggguagaucgcaucgaacgaguugcaagagugaggggaggugagggcaccggguauuucgucgacuuuucagugcggaauugcccacgucaucacuucccccgccauccuaacguguuuggauucuguagagccgaucuguuuuacgacgucgaagcucuugauuuggagagucccaaaaaucugguuauuaacugcgaaguguucgacccccaggagcacgagaauaucaacggcguaccuccacaccuaggucauccguuucacuggggagggcaugaaaggagcucuacuacaaagcccccuuucaaaccacacggcucccgggaucaccaucacccccauaagccucacgagcauggcccacccccgccucccgacgaacgagaucacucacacgggccaccucucccccagggaccacccccucugcuuccaaugagcuguaguucuugccagcaugccaccuucgguacgaauggcgcacaacgccacucccauaacaauaacagcucggaccugcacccgcacaagcaucacucucaugagcagcacccccaugggcaccacccucaugcucaccauccacacgaacaugauacucacagacagcacccccauggacaccauccucacggccaccauccacacggucaucacccccaugggcaccacccgcauggacaccauccucacugucacgacuuucaggacuacggcccaugcgaucccccuccccauaaccaaggccacugcugucaugggcacggaccaccucccggucauuugaggcggcgcggcccagggaaaggaccgagaccuuuccacugcaggcagauuggcuccguguaucgucucccaccacugcggaagggugaggucuuaccccugccugaggccaauuuuccaucauucccccucccucaccauaaacacccgcuuaagccagacaaccagcccuuuccucaaagugugagcgaauccuguccagggaaauucaagucuggcuuuccccagguuagcauguucuuuacccauacauucccuaaauga

SEQ ID NO: 57387 - RNA, 1464 nt, Artificial Sequence
  derived and/or modified sequence opt3 from HRH1__Homo_sapiens__NP_001091683
augagccugcccaacuccucuugccuccuugaggacaagaugugugaaggcaauaaaaccacaauggccucaccucagcugaugccauugguggucguuuuaaguacuaucugccuggugacgguagggcuaaaccuccuggugcuuuacgcugucagaagcgagaggaagcugcacaccgugggaaauuuguauauuguuucccucucuguggcagaucugauagucggugccgugguaaugccgaugaacauccuguaccucuuaaugucgaaauggucacugggccggccccuuuguuuguucuggcugagcauggacuauguugcgaguacagcuuccaucuuuucuguguucauucuaugcauugaucgcuaccgaagcguccaacagccucuccguuaucugaaguacagaacuaaaaccagggccuccgcaacaauccuuggggccugguuucugucauucuugugggugauaccaauccucggauggaaucauuuuaugcagcagaccagugugcggcgcgaagacaagugugagacugauuucuaugacgucacaugguuuaagguuaugaccgcuauuaucaacuucuaccugcccacguuacugaugcucugguuuuacgcaaaaauuuauaaggccgugagacaacacugccagcauagggaacuuaucaaucggagccugccuucuuucuccgagauaaaauugcgcccagagaaccccaagggcgaugcuaaaaagccugguaaggaaucaccaugggagguacuaaaacgaaagccgaaagacgccgggggaggcagcgugcugaagagucccucucagacuccuaaagaaaugaaguccccagucguguuuagccaggaggaugacagagagguugauaaacucuacuguuucccccuggacauugugcacaugcaagcggcagccgaaggcucgucuagggauuaugucgcugugaaucggucccaugggcagcuuaagaccgacgagcagggacugaacacacacggugccucagaaaucagugaggaccagauguugggcgauagccaauccuuuucucguacugacagcgauaccacaaccgaaacggcaccugggaagggaaaacuccgcucaggcaguaauacuggucuggacuacauuaaguucacauggaaaagauuaaggucccacagccggcaguauguaucugggcugcauaugaaccgagagcgcaaggcugccaaacagcuaggauucaucauggcggccuuuauccucugcuggauuccauacuucauauuuuucaugguuaucgcauuuuguaagaauugcuguaacgagcaucugcacauguucaccauuuggcuuggcuauaucaauucaacuuugaacccccugauauacccgcucugcaacgaaaauuuuaagaaaacauucaagaggauucugcacaucagaaguuga

SEQ ID NO: 57388 - RNA, 1194 nt, Artificial Sequence
  derived and/or modified sequence opt3 from HRH2__Homo_sapiens__NP_001124527
auggcccccaacggcaccgcuagcuccuucugccuggacucuacagcauguaagaucacuauuacggugguccucgccguucuuauacugaucaccguggcggggaauguaguggucugcuuggcugugggauuaaacagaaggcugcggaaucuaacaaacuguuuuauuguuucacucgccaucacugaucugcuucuggguuugcucgugcugccuuucagugcaauuuaccagcugagcugcaaaugguccuuuggcaaggucuucuguaauaucuauaccucucucgacgugauguuaugcacagccucgauacugaaccuuuuuaugaucucauuggaucgcuacugugcuguaauggacccacugcgauauccgguucuagugacccccguccguguggcaauuagccucgugcugaucugggucauuaguaucacucuuuccuuccugucuauacacuugggguggaauagcagaaacgagacauccaaaggaaaucauaccacgucaaagugcaaaguucaagugaacgaaguauacggccucguggauggucuggucacuuuuuauuuaccucugcucauuauguguaucaccuacuauaggauuuucaagguggcccgggaccaggcuaagcgcaucaaucacaucaguagcuggaaagccgcgacaauuagagagcauaaggcaacuguuacccuugccgcugugaugggggccuuuauaaucugcugguucccauacuuuacagcauucgucuacaggggacugcggggcgaugacgcuauuaacgaaguguuggaggccaucguacuauggcugggcuaugccaauucugcccucaaccccauacuguacgcagcucuuaaucgcgauuuucgaaccggguaucagcagcuguucuguugcagauuggccaacaggaacucccacaaaacgucacuccggagcaaugcuagucaacugucucguacucagucccgcgaaccuagacagcaggaggagaagccauuaaaacugcaaguuuggagcggaacagaagugaccgcgccccagggugcaacugacaggccuuggcuaugccucccagaguguuggucggucgaacugacacauucuuucauucaccuuuuuauccacuccuucgccaacauccauccgauucccaccacgugccaggaguuguga

SEQ ID NO: 57389 - RNA, 1338 nt, Artificial Sequence
  derived and/or modified sequence opt3 from HRH3__Homo_sapiens__NP_009163
auggagagagcacccccugacggcccacugaacgcuagcggggcacucgccggagaagcggcugccgccgguggcgccaggggguucuccgcugcauggaccgccgugcuugcugcccugauggcguuguuaaucgucgcaacaguucugggaaaugcccuagugaugcucgcuuuuguagccgauucuucacugcggacucagaacaauuucuuucuucugaacuuggcaauuagugacuuccucgugggcgcuuuuugcauaccgcuguacguccccuaugugcugacgggucgcuggaccuucgggcgaggacucuguaaguuauggcugguuguggauuaccuuuugugcacaagcuccgccuuuaauaucguccugauuucuuaugaccguuuccuaucggugacuagagcgguaucauacagggcccaacagggcgauacccggcgcgcaguuagaaaaaugcuccugguguggguccuugcuuuucuguuguauggcccugccauccucagcugggaguaccugagugggggauccucuauuccagaaggucacuguuaugcugaguucuuuuacaacugguacuucuuaaucacagccagcacccuggaauuuuucacucccuuccucuccgugacauuuuucaaucuuucaauauaucugaacauccagaggcggacccgcuugcgacuagacggcgcaagagaggccgcugggccugagccacccccugaagcgcagccaaguccgcccccuccacccggaugcuggggcuguuggcaaaagggucauggggaggcaaugccucugcacagguacggagugggcgaagccgcugucggcgccgaggcaggggaggccacgcucggagguggcgggggaggcgguagcguugcuucuccaacuuccucaagcgggaguucuucccggggcaccgaacguccccgcagccugaaaagaggaucgaagccgucugccuccucagcaagucuugagaaaaggaugaagauggugagccaguccuuuacacagcgguuccgacugucucgcgauagaaagguagcgaaaagccuugcugugauugucucaaucuuuggccucugcugggccccuuauacucuguuaaugauuaucagggcagccugucaugggcacugcgugcccgacuacugguaugaaaccaguuucuggcugcuaugggcuaauuccgccguuaacccagugcucuacccucugugucaucacagcuuucggcgcgcauucacaaaguuguugugcccccagaaacugaagauacaaccacacucuucacucgagcauuguuggaaauga

SEQ ID NO: 57390 - RNA, 909 nt, Artificial Sequence
  derived and/or modified sequence opt3 from HRH4__Homo_sapiens__NP_001137300
augcccgacaccaacagcacaaucaaucugucccucucuacuagagugacgcuugccuucuuuaugucacuggucgcuuucgcaauuauguugggcaacgccuuaguuauacuggcguuugugguagauaagaaucuaaggcaccggaguagcuacuucuuucucaaccuggcuaucuccgacuucuuuguggucucugagucguggaaagaugaagggucagagugcgaaccuggauucuuuagcgagugguauauucuugccaucaccaguuuccuggaauuugugauuccaguuaucuugguggcauacuucaauaugaacauauauuggucccucuggaagcgcgaccaucugucucgaugucagagccacccgggucugacagccgucuccucaaauaucugcggccauaguuuucgugggagacucagcucuaggcgguccuuaucagcuagcacugaggugcccgcaaguuuccacucugagcgccaaagaaggaaauccagccugauguucucgucucggaccaagaugaacuccaauacaauugccucaaaaaugggaaguuuuagccaguccgauucuguagcgcuucaucagcgcgaacacguugaguugcugcgagccagaaggcuagcuaagagccucgcaauccugcuuggcguguucgccgucuguugggcuccuuacucacuguuuaccauuguguugaguuucuauuccagcgccacugguccaaagucugugugguaccggaucgcauuuuggcuccagugguucaacucauuugucaauccccuguuauauccucugugccacaaacguuuccaaaaggcuuuucucaaaauauucuguauuaagaaacagccacuucccagucagcauagccgcuccguuucuucguga

SEQ ID NO: 57391 - RNA, 3570 nt, Artificial Sequence
  derived and/or modified sequence opt3 from HR__Homo_sapiens__NP_005135
auggagagcacccccuccuuccugaagggcacaccuacuugggagaaaacggccccagaaaacgggaucgugagacaggaaccgggaucucccccuagggacggucuccaccauggcccacuuugccugggggagcccgcuccuuuuuggcggggagucuugucaaccccagauaguugguuacccccuggcuucccacaagguccgaaggacaugcugccccuaguugaaggggagggaccucagaauggcgagcgcaaagugaacuggcucggcagcaaggaagggcugcgauggaaagaggcaaugcuuacacacccacuggccuuuuguggacccgcgugcccuccacguuguggucccuugaugccggaacauuccggcgggcaccucaagucugauccuguagcuuucagacccuggcauugcccauuucugcuggagacuaagauucucgagagggccccuuucugggugcccaccuguuuaccacccuaccuggucucgggacuuccuccagaacacccgugcgacuggcccuugacaccucacccauggguguauucaggcggucagcccaaaguuccuagcgcauuuagucugggguccaagggauucuacuauaaagauccaucuauaccccggcuagccaaggagccgcucgcugcagccgaaccuggccuguuuggccuuaauagcgggggacaucugcagcgcgcuggugaggccgaaagaccauccuugcaccaaagggacggcgagaugggggcgggacggcagcagaaccccuguccucucuuccugggccagcccgauaccgugccauggacuucauggccugcaugucccccagguuuaguccauacacuggggaaugugugggccggcccgggagacggcaaccucggguaccaacuuggaccucccgcuaccccacgcugccccaguccugagccacccguaacgcagcgagguugcuguagcucuuauccuccgacuaaaggcgggggacugggcccaugcgguaagugccaggaaggguuggagggcggagccuccggcgcaucagaacccagcgaggaaguuaauaaggcuagugggccuagagccuguccacccucucaccacaccaaacuaaagaaaacauggcugacuaggcauuccgagcaguuugagugcccucggggauguccggaaguggaggaacgucccgucgcgcgccucagagcccugaagagggcagguagcccagaggugcaaggcgcuauggggucgccugcccccaaacggccaccugaucccuucccaggaaccgcugaacagggcgccgguggguggcaggaggugcgagacacaucuaucggcaacaaggaugucgacuccggacaacacgaugagcagaaaggcccgcaggacgggcaggcaucacuucaagacccuggacugcaggauauucccugcuuggcccucccagcuaagcuggcgcagugucagaguugcgcacaagccgcuggcgaaggugggggacaugccugucacagccagcagguucgcagaucccccuuaggcggugagcugcagcaagaagaggacaccgcaacuaauucuagcucagaggaaggcccugggaguggaccagauuccaggcuaagcacgggccucgccaagcaucugcuuucuggguugggagaccggcugugccgccuccugagaagggagcgugaagcucuugccugggcacagcgggagggccagggucccgcggugacagaagauucaccugggaucccgcgauguugcaguagaugucaccacggacuguuuaacacccauuggaggugcccacgcugcagccaccgguuguguguagcuugcggcagaguggccgguacuggcagggcacgcgagaaagccggguuccaggagcaauccgcugaagaguguacacaggaagccggacaugcagcuugcucucucaugcugacccaguucgucucgagccaagccuuagcggagcuguccacggccaugcaccagguguggguuaaguuugacauucgaggccacugucccugccaggcugaugcacgggugugggccccuggggacgcuggacagcaaaaagaaucaacccagaagacacccccaacuccucagcccaguuguaauggcgauacccaucguacaaaaucuaucaaggaggagacuccagacagcgccgaaaccccugcagaggauagagcggguagggggccgcuacccugcccaucccucugugaacugcuugccucaacagcugucaaguugugccugggacacgagcgcauacauauggccuucgcaccugugacccccgcucucccaagcgacgaccggaucacuaacauucuggauucuaucauugcccagguaguugaaagaaaaauccaagagaaggcauuaggcccuggucugagggccggccccgggcuucgaaaaggauugggccucccgcuguccccagugcgcccucggcuacccccacccggggcucugcucuggcugcaggagccucagccgugucccagaaggggauuucaccuuuuccaggaacauuggcgucaaggccagccagucuuggugagugguauacagcgcacgcugcaagggaauuuauggggaacagaggcgcucggcgcccugggcgggcagguccaggcacuuagcccucugggacccccucagccaucuuccuuggguucaaccacuuuuugggaaggcuucaguuggcccgagcuccggccuaagagcgacgaggggucggugcugcuacugcacagagcucucggagaugaagacaccuccaggguugagaaccuggccgccucucuuccauugcccgaauacugcgcucugcacggcaaauuaaaucucgcaagcuaucugccgccuggucuugcccugcgaccacuagagccccaacucugggcggcuuacggggugucaccucaucggggacaccugggcacaaagaacuugugcguagaagucgccgaucuggugaguauuuuaguucaugcagacaccccacuccccgccuggcaccgcgcucagaaggauuuucuguccggccuugacggggagggacuguggucuccggguagccagguguccacugucuggcauguguucagagcacaggaugcccaaaggauccggcgauuuuugcagaugguauguccugcgggcgcuggggcccucgagcccggagcaccaggcucaugcuaccuggacgccggucuaagacgcaggcugcgugaagaguggggagugagcuguuggacacuucuccaggcuccuggggaagccguucugguccccgcaggcgcuccacaccaggugcaaggcuuggugaguacggucucuguuacccagcacuuccugucccccgagacuagcgccuuaucggcgcagcucugccaucaggggccuucacugccaccggauugucaccuucuguaugcccaaauggacugggcaguguuucaggcugugaaaguagccgucggaacauugcaggaagcuaaguga

SEQ ID NO: 57392 - RNA, 276 nt, Artificial Sequence
  derived and/or modified sequence opt3 from HRK__Homo_sapiens__NP_003797
augugccccuguccucugcacagaggcagggggccaccggccgugugcgcuuguagcgcaggacggcucggucuucgcuccucugccgcgcagcugaccgcugcccgauugaaggcauuaggcgacgagcugcaucaacguacaauguggagaaggcgggcccgcucaagaagggcucccgcaccuggggcccuaccaacuuacuggcccuggcucugcgcugccgcgcaggucgcagcccuggcugccuggcuucugggacggcgcaacuuguga

SEQ ID NO: 57393 - RNA, 8553 nt, Artificial Sequence
  derived and/or modified sequence opt3 from HRNR__Homo_sapiens__NP_001009931
augcccaagcugcuccagggcgugaucaccgucauugacguuuucuaccaauaugccacacagcacggggaguacgauacucuuaacaaagcugaacugaaggaguuguuagaaaaugaguuucaucagauacugaaaaacccuaaugacccagauacgguggacaucauucuacagagccucgaucgcgaccacaacaagaaaguagauuucaccgaauaucugcuuaugaucuuuaagcuggugcaagcaaggaauaagauuaucggaaaagacuacugccaggucuccgguucuaaguugcgggaugacacacaucagcaccaggaggagcaagaagagacugaaaaagaggagaacaagcgccaggaaagcucauucagccauuccucuuggucggccggcgagaaugauucauauagccgaaacgugcgugggagccucaaaccgggaaccgaauccauaucuagaaggcugagcuuucagcgggacuucuccggccagcacaauucauacagcggucaaaguucuuccuauggggagcagaacucagauagccaccagagcucuggacgcggccaauguggcuccgggagcggacagucgcccaauuacggucagcauggcucuggguccggacagucaagcagcaacgacacacacggcuccgguucugggcaaagcucaggauuuagucagcauaaguccagcucuggccagucaaguggcuacagccagcacggguccggaucuggucacucgagcggcuaugggcaacauggauccagaucaggccagaguucuaggggugaacggcaccgcagcuccucagggaguucuuccaguuacggccagcauggaagcggcucucgacagucccuggggcacggaagacaagguucaggcaguaggcagagcccuucgcauguucggcacggguccggaucuggccacagcucaagucauggucagcacggguccggcucuagcuauuccuacucacguggacauuaugagagcggcagugggcagaccucuggauucggucaacacgaguccggcagcgggcagucgucaggauacucuaagcacggcagugguuccgggcauagcucuagccagggccaacacggauccacuucaggccaggcgaguagcucugggcagcauggauccucaagucgccagagcuccucuuauggccaacacgaaucggcuagcagacauucauccgguagggggcagcacaguucuggaagcggccaguccccaggucacggccagcgggggucaggaucuggccaaagccccaguuccgggcagcauggaacaggcuuuggucgaaguucuucauccgggccuuacgugaguggaagcggcuacucgucugguuucggccaccaugaguccagcucagaacacaguucuggguauacccagcauggauccggcagcgggcacucaaguggacacggccagcaugguagccgcuccgggcaaucuagcagaggagagaggcagggcuccucagccgguucuaguucgagcuacggccagcacggguccggaucucggcaaucacucggccauagccgccacggguccggaaguggccagucuccaagccccucaagagguaggcacgaauccgggagucgucagaguucuuccuauggaccucauggcuacggcucagggcggagcucgucucgaggaccauaugagagugguuccggccacagcucaggguuaggacaucaggaguccagaucuggccaaagcagugguuacgggcagcacggauccagcucuggccauucaaguacgcacggccagcacggguccacuagcggacagucuucgucaugcggucaacauggcgcaaccagcgggcaguccaguucucacggacagcauggcagcgguuccucacagaguucuagguaugggcaacagggaagcggcuccggccagucaccgagccgcgggcggcacggaucugacuuuggucacuccaguagcuacggccagcaugggucgggauccggcuggucuucaagcaaugguccccacgggagugucuccggacaaucuagcggcuucggccauaaaucaggguccggacagaguagcgguuacucucagcacggcucaggguccagccauucuaguggauauagaaagcacggcucgagguccggucaaagcucacgcucugaacagcacgggagcuccaguggacugucaucuagcuacggccagcauggcuccgggagucaccagagcuccggacauggucgacaaggcucugggucaggacacagcccuucgcgggugcgucacggcuccaguucuggucauagcucaucccacgggcagcauggcucuggaacaaguuguagcuccucaugcggccacuaugagagcgggucuggacaggccagugguuuuggccagcaugaauccgggagcggacaaggcuacucacagcacgguucugcuuccgggcacuucucgagccagggcagacauggaaguacuucuggccaguccagcucaagugggcaacacgauuccagcucuggacagucaagcuccuauggucagcaugagucugcaagucaccaugccucgggcagggggcgccacggaagcggcuccggucaaucaccagggcacggccagcggggaucuggcagcgggcagagucccuccuacggaagacauggcucagguucugggaggagcuccaguagcggacgacacggcucugguucaggccaguccagcggguucggacauaaaaguucuuccggccaaucgagcggguauacccagcacggaucaggcuccggucacucuaguagcuacgaacagcaugggucacgcuccggacagagcucucggagugagcaacacggcuccagcucagguucuucgagcuccuacggccagcaugggaguggaucuagacagucacuuggccacgggcagcauggaagcggcuccggucaaaguccuucuccaagcagggggcgucacggauccggcucaggccagaguucuuccuaugggcccuaccgcaguggaucagguuggagcucgucccggggcccguaugagucugggaguggacacagcucaggcuugggucauagagaauccaggucugggcagagcaguggauacggccagcacggcuccagcucugggcauucauccacacacggacaacacgguagcaccaguggccagucuucauccugugggcagcauggagcuagcucgggccaaucuaguucccacggucagcaugggagcggaucaucucagagcuccggcuauggccgacaggggaguggaucaggucaaagcccuggccacgggcagcggggauccggcucucgccagagucccagcuacgguagacauggguccggaucaggcaggucuucgagcuccggccagcacgggaguggacugggugagucuagcggcuuugggcaccaugaaucauccagcggacaaucuaguuccuauucacagcacggcagcgguucugggcauucguccggauacggccagcacggcagucggagcgggcagucaucucgaggagagagacaugguuccagcaguggcucauccagccacuacgggcaacacggaucuggcagucgccagagcuccggucaugggaggcagggaucuggcucaggccacagcccaucccgugggcggcauggaucgggucuaggccacucuaguagccacgggcaacauggaucaggcuccgguagaucuagcuccagggggccuuaugagagucgcucaggccacagcucuguauucggacagcaugaauccggcagugggcacagcucagccuacucucagcauggauccgguucgggccacuuuugcagccaggggcaacacggaaguacguccggccagucuucaacuuucgaccaggaggguagcuccacagggcagucuagcaguuauggccaucgaggaucaggcuccagccaaucuaguggguacggaagacacggugcgggcuccgggcagagccccucacggggaaggcauggcucggguucuggccacagcuccaguuaugggcagcacggaucaggcucuggguggagcuccaguagcggacgccauggcucugguuccgggcagucaagcggauuuggccaccaugaaucguccucuuggcaaaguucagguuguacccagcacggcagcggguccggacauucuagcaguuacgagcagcacggcucacguuccgggcaaagcucuagaggagaacggcacggcuccaguagcgguucaucuuccagcuaugggcagcauggaucgggcaguaggcagucucucggucacggccagcaugggucaggauccggccaaagcccaucucccagccgcgggcgacacggauccggcaguggucagucaagcuccuacucuccuuacgggaguggaucaggcuggagcuccucuagaggcccauaugagucggggagcucccacaguucaggacugggucaucgggagucuaggagcggccaguccaguggguacggacagcacggcucuagcucaggucauuccagcacucacgggcaacauggaucuacaucaggccagaguuccagcugcggccagcacggggcaucgucuggacaguccagcucacacggucaacauggcagugggucuucccagagcucaggauauggccgccaggguaguggguccggacagagcccgggccacggccaaagagggucuggaucgaggcagagccccuccuacggucggcauggcucagggucuggacguaguagcuccucuggccagcacgguucagggcuuggagaaagcaguggcuucggccaucacgaguccucuagcgggcaauccucaaguuauagccagcacggaucugguuccggccauucgagcggguacggacagcacggcucacgcaguggucaguccucucgaggggaaagacauggaagcucauccaggucuagcagucgguauggccaacacggcuccgggagccgccagucuucaggacacgguagacagggcaguggguccggacagagcccuucuaggggccggcaugguucggggcugggccacucaagcucccauggacaacacggcagugggucuggacgaagcuccucaagagguccauacgagagucgcagcggccauucuuccguuuuugggcagcacgaaagcggaucaggccacucuuccgccuacagucagcaugguagcgggucgggccacuucuguucccagggacaacauggcucuaccucagggcagagcaguacguuugaucaggagggauccucuaccggucaaagcucaagucacggccagcacggguccggaagcucucaguccucaagcuauggccagcaagguagugggucuggccagucgcccuccaggggacggcauggcagcgggucaggacacucuaguagcuacggucagcauggcuccgggucaggauggagcuccucuaguggccgucacgguagcggcuccgggcagucuucaggauucggccaucacgagucgagcaguuggcaauccucuggguauacacagcacggaagcggcucaggucauuccaguucuuacgaacagcacgggagcagauccggacagucaagcaggggcgagcaacaugguucuaguuccggcagcucgucuucauaugggcagcacggauccggcagccgccagaguuuggggcauggacagcacggcucugguuccgggcaaagcccuucaccaagucggggacgacacggcuccgguagcggccagucuucaagcuacgggcccuauggauccggcaguggguggucuucgagcagaggaccguacgaauccggcucaggucauucuagugggcucggacacagggagagccgcuccggccagucaucuggcuacgggcaacauggaagcuccaguggucacagcucuacucacggccagcauggguccgcuucaggacagagcaguucgugcggccagcacggugccucuuccgggcaaagcucaagucauggacagcacggcuccggcucuagccagucauccggguauggacggcaggguagcggcucugggcaaaguccuggacauggccagagagguuccgggagccgucagucaccaucuuacggaaggcacggcucgggcagugggcggagcuccucuucaggacagcacggucccggccugggggaaagcuccggauuuggccaucacgagaguucuagcggucaauccucaagcuauagucagcaugggucuggauccggccacucgagcggcuacgggcagcacggaucacgcuccggucaaucuagucgaggcgagagacaugggagcuccucaggaucuagcaguagguauggccagcacgguuccgggagccggcagucuucaggacauggccgccagggcuccgggaguggacacagcccuucuagagguaggcauggcucgggguccggacacucaagcagucacggccaacaugguucuggguccggccgaagcucaucucggggacccuacgaaagccguuccggccacaguucaguguucgggcagcaugagagcggauccggucacucuagugcauauagccagcauggcuccgggucgggacacuuuuguucucagggccaacacgguucaaccagcgggcaguccaguacauucgaccaggaaggcucuagcacuggacagucauccagccauggccaacacgggaguggaucuucccagucaagcucuuacggucagcaaggcucgggguccggacagaguccaagcagaggccgccaugguucagggucuggccacuccagcaguuacggacagcacggcuccgggagcggauggucuucaaguuccggcaggcaugguagcgggucuggacagucaucgggcuucggucaccaugagagcuccaguuggcaaucuagcggcuauacccagcacggguccggaucaggccauucuagcaguuacgagcagcacgggucccggucaggacagagcucuagaggcgaacgccacgguuccaguagcgggucgucaucuuccuauggacaacauggcagcgguaguaggcaguccuuaggccacgggcagcauggaucuggcagcgggcagucaccuucccccagucgaggacggcacggcagcgguucugggcaaucauccagcuacucuccauauggaaguggcucggguugguccagcucaagaggcccguacgagucugggagcggacacuccaguggccuggggcauagggaaucacgcucuggacagagcuccggcuauggucagcacgggaguagcucuggacauuccucaacacacggccagcauggcagcaccucggggcaauccucuaguugcggacagcacggugcuagcucaggccaguccucuagccacgggcaacauggaaguggcuccucacagagcucugguuacgggcgucagggaaguggcuccggccagagcccugggcacggacaacgggguucaggcucuagacagucccccagcuacgggaggcauggaucgggcagugguagaucuucauccagcgggcagcacggaaguggccucggcgagucuagcggguuuggacaccaugaauccucaagcggucaguccucuaguuauucacaacacggcagcggguccggacauucuucgggcuacggucagcacgggagccgaaguggacaguccucacggggcgagagacauggcucuagcuccgggaguagcucucacuauggacagcacgguucaggcuccaggcaaagcucugggcauggacgccagggcagugguuccgggcagucaccaagcagaggacggcacggcucgggccuugggcauucuuccagccacggacaacaugguaguggcucagggagguccucuagccguggacccuacgagagucgacugggccacucauccgucuucggucagcacgaaagcgggucuggccauucgagcgccuauucccagcacggaaguggcucugggcauuuuugcucacagggacaacacgguagcacuuccggccagucuaguacguucgaucaggaggggagcucaacaggacaguccagcucuuacggccaccgcgguuccgggaguucacaaagcucuggcuauggaagacauggcgcgggguccggacagucguugagccacggucggcauggcagugggucaggacaguccucuagcuacggccagcacgguaguggguccggccaaucaagcggauacucucagcauggcuccgggagcggacaggacggcuauucuuacuguaagggugggaguaaccacgauggaggcucauccgguagcuauuuucuaucguucccuucuaguaccagcccauacgaauaugugcaggagcaaaggugcuacuuuuaucaguga

SEQ ID NO: 57394 - RNA, 414 nt, Artificial Sequence
  derived and/or modified sequence opt3 from HRSP12__Homo_sapiens__NP_005827
augagcucccugaucagaagggugauuucuaccgccaaggcucccggcgcaauagggccuuacucacaggccguccucguugaccggacaaucuauauuaguggacaaaucgguauggauccaagcuccggccagcuugugucugggggaguagcggaggaagcuaaacaggcccugaagaacaugggcgagauuuugaaagcagccgguugcgacuucacuaauguggucaagacgaccguguuacuggcugauaucaacgacuuuaauacaguuaacgaaauauacaaacaguauuucaagucgaauuuuccggcacgcgccgcuuaccaaguggccgcgcuacccaaggggucacgaaucgagauugaagcagucgccauccagggaccucucacuaccgcuagccuguga

SEQ ID NO: 57395 - RNA, 1179 nt, Artificial Sequence
  derived and/or modified sequence opt3 from HS1BP3__Homo_sapiens__NP_071905
augcagagccccgccgugcuggucaccuccagaaggcuccaaaacgcucacacaggccuugaccugacuguuccucagcaucaggaggugcgggggaagaugaugucuggacacguagaauaccagaucuugguggucacgcgcuuagcagccuucaaaucagcgaagcaucgaccagaggaugugguucaauuucuggugaguaaaaaguauagcgaaauugaggaguucuaccagaaacuauccucucguuaugcugccgcaucgcucccgccccugccuagaaagguccuuuuugugggugaaucagacauaagggagcggcgcgccguauucaaugaaauccugagaugcguuagcaaggaugcugaguuggcaggcaguccagaacuccuggaguuucuggggaccaggucccccggagccgcuggccucacaucucgggacagcuccguguuagaugguacugacucacagaccgggaacgaugaggaagccuucgacuuuuucgaggaacaggaucaagucgcggaggaaggaccuccagugcagagucugaaaggcgaggacgcagaggaaagccuugaggaagaggaagccuuggauccccugggcauuaugcgcucuaagaaaccuaagaaacacccaaagguggcugucaaggccaaaccguccccucgacuaacaaucuuugacgaggagguugaucccgacgaaggacucuucgggccagguagaaagcugucaccccaggacccuagcgaggaugugaguucuguagacccacuuaaacuguuugaugaccccgauuugggcggggcaauuccgcucggagacucccuguuacugccugcugccugugaaagcggcggucccaccccaucgcucucucauagggaugcguccaaggagcuuuuccggguggaagaggaccuggaucagaucuugaaucuaggggccgagccuaaacccaagccacaacugaaacccaagccuccagucgcagcuaagccggugauaccccguaaaccugccguuccacccaaggcuggaccugccgaagcaguggccggccagcagaaaccacaagagcagauccaggcuauggacgaaauggauauucuccaguacauccaagaccacgacacucccgcgcaggcagccccgucacuguuuuga

SEQ ID NO: 57396 - RNA, 924 nt, Artificial Sequence
  derived and/or modified sequence opt3 from HS3ST1__Homo_sapiens__NP_005105
auggccgcucugcuccuuggcgcagugcuguuggucgcccagccccaauuaguuccuagcagaccagcggagcuggggcagcaggaacuacucaggaaggcuggaacccugcaggacgaugugcgggacgguguagccccgaacggcuccgcacaacagcuuccccagacaaucauuauaggggugcgcaaaggaggcacucgagcccuguuggagaugcucucucugcacccugaugucgcugcagccgaaaaugaggugcauuucuuugacugggaggaacacuacucacauggucuggggugguaucucagucagaugccauucagcuggccccaccaauuaacgguugagaagaccccugcuuacuuuacauccccaaaagugcccgaacgugucuauucuaugaacccuucgaucagacugcuuuugauucugagggauccaucagagcgggugcuaagcgacuacacucagguauucuauaaucauaugcagaagcacaaaccguaccccaguaucgaagaguuucucguucgcgauggaagacugaacguggacuauaaggcccuuaauaggucccuguaccacguccauaugcagaacugguugcgguucuuuccucuccgccacauucauaucguggauggcgaccgacugauaagagauccauuccccgagauccaaaagguggaaagguuuuuaaaacugucuccucagauuaaugcgagcaacuucuacuuuaauaagaccaaaggcuucuauugccuccgggacuccgggcgugaucgcugucuucacgagucaaaggguagagcacacccacaggucgaccccaaacuguugaacaagcuacaugaauacuuucacgagccgaauaagaaauucuucgaacugguuggaaggacauuugacuggcauuga

SEQ ID NO: 57397 - RNA, 1104 nt, Artificial Sequence
  derived and/or modified sequence opt3 from HS3ST2__Homo_sapiens__NP_006034
auggccuacagagugcugggcagggcugggcccccucagccacggcgcgcacgacgucuccuuuucgccuuuacccugagcuuguccugcacauauuuauguuacucuuuccugugcuguugcgacgaucuaggaagaucaaggcuccugggugcgccgcggugucuucgcggccccagugcugggggacaaaagcuguugcagaaaagcagaccuugcgacccauccggccccacuccuucugagccaucggcccccucagccccugcagcugcagucccagccccgaggcucagcgguaguaaccacuccgggucucccaagcugggaacgaaacggcugccucaggcucucaucguuggcgugaagaaaggcgggacccgcgccguauuagaauuuauucgagugcauccagaugucagagcgcugggaacagagccccacuucuuugacaggaauuauggucggggccuugauugguaccguagcuugaugccucgcacucuggaaucccagauaacccuagagaagacaccaucauauuucgugacccaagaagcacccagaaggaucuuuaacaugagucgggacacuaagcucauuguugugguccgaaauccggugacacgcgccaucagcgauuacacccagacgcugucuaaaaagccugacauucccacuuucgaggggcuuuccuuuagaaacaggacccugggauugguagauguuucauggaaugcuauccggauaggcauguaugugcuccaucuggagagcugguuacaguacuucccacuggcccagauccacuuugucaguggugaacgccucauuacagacccugcaggggagaugggaagagugcaagauuuccuuggcaucaaaagguuuauuacugacaagcauuucuacuucaacaaaaccaagggcuuucccugucugaagaaaacagaaucuuccuugcuaccacguugccugggaaagagcaaagggcggacccacgugcagaucgaucccgaggucauagaccagcuccgagaguucuauagaccuuacaauauuaaguuuuaugaaacgguuggucaggacuucaggugggaguga

SEQ ID NO: 57398 - RNA, 1221 nt, Artificial Sequence
  derived and/or modified sequence opt3 from HS3ST3A1__Homo_sapiens__NP_006033
auggcucccccuggcccagccagcgcacuguccaccucugccgagccgcucucaagaaguaucuucaggaaguuucuucugauguugugcagcuuacugacaucccuauacguguucuauugucucgcggaacggugccagacucugucugggcccgucguuggacuuucggguggcggggaggaagcuggagccccuggcgguggggugcuggcaggaggcccacgcgaguuggccguauggcccgcugcagcccaacgaaaacgucuccugcagcugccucaguggagaaggcggcgcccacccgcuccuagagacgauggcgaagaggccgcgugggaggaagagucaccagggcucagcggagguccgggcgggaguggagcaggcuccacgguggccgaagcucccccugguaccuuagcccugcuuuuggacgaggggucuaagcagcugccacaagcaauuauaaucggagucaaaaagggcggcacaagggcucuacucgaguuucugcgggugcaccccgauguucgcgccgugggggcggaaccucauuucuuugaccgaagcuacgauaaaggacuugccugguauagagaccugaugccaaggacuuuggauggucagauuaccauggagaagacacccuccuacuucgucacccgggaagcaccggcucguaucucagccaugaguaaggacacuaaacucauugugguaguucgcgauccugugacaagagcuaucagcgacuauacccagacgcugucuaagaggcccgauauaccaacuuuugaguccuuaaccuucaaaaaccggacagccggccugaucgacacuucauggagcgcaauucagaucgggauuuacgccaagcaccucgaacauuggcuucgacacuuuccuauccgccaaaugcuguucgucaguggagagagauugauaucugaucccgcuggcgagcuagguagggugcaggacuuucuggggcucaaacggauuaucaccgacaagcauuucuauuuuaauaagacaaaaggcuucccaugucugaagaaagcggaaggauccagccgcccccacugccuuggcaagaccaaagggagaacgcacccugagauugauagggaagugguccgucggcugcgagaguucuacagaccauuuaacuugaaguucuaccagaugacuggacaugacuuugguugggauggcuga

SEQ ID NO: 57399 - RNA, 1173 nt, Artificial Sequence
  derived and/or modified sequence opt3 from HS3ST3B1__Homo_sapiens__NP_006032
augggccagagacugagcgggggaagguccugccucgacgugcccggucggcuucugccucaaccaccgcccccuccacccccuguccgccgaaaguuggccuuacuguucgcuaugcuauguguuuggcucuacauguuucuguauucuugcgcaggcucaugugccgcggcuccagggcuucuguugcucggaaguggcagccgugccgcacacgaucccccugcccuggcuaccgcaccagacgguacaccgcccagacugccuuucagggccccacccgcuacuccucucgccuccgggaaagagauggcggaaggagcagccucuccagaggaacagucgcccgaggugccggauucaccuagccccaucaguuccuuuuucucuggcagcggcuccaagcaguuaccacaggcuauuauaaucggggugaaaaagggagguacgcgggcccugcuugaauuuuugcgcguacauccugacgucagagcagugggcgcugagccccacuucuuugauaggucauacgacaaagggcuggccugguaucgggaucuaaugccacgcacccucgacggacaaauuacaauggagaagacucccaguuacuucguuacccgagaagcgccugccagaaucagcgcaaugucuaaggauacaaaacugauuguggucgugagggacccaguaacccgggcuaucuccgauuauacucagacacuuucaaagcguccggacauacccaccuuugagagccugacguucaaaaaccgcacugccggcuugaucgauaccaguuggucugcuauucagaucgguauuuacgccaagcaucucgaacacuggcugagacauuuuccuaucaggcagauguuauucguuuccggggagcggcugauaagcgacccagcaggagagcucggccgagugcaagacuuucuuggccugaaacgcauuaucacagauaagcacuucuauuucaauaagacuaaaggguuucccugcuugaagaaagccgaaggaucgucuagaccucacugucuagguaagaccaaaggcaggacacauccagagauugaccgggaagucgugcgcagacugagggaguucuaccgucccuuuaaccucaaguucuaccagaugaccgggcacgauuuuggaugggacuga

SEQ ID NO: 57400 - RNA, 1371 nt, Artificial Sequence
  derived and/or modified sequence opt3 from HS3ST4__Homo_sapiens__NP_006031
auggccagauggcccgcuccuccaccgcccccuccacccccuccaccccuggcagccccuccaccgcccggcgcgagcgcuaaggggccuccagccaggaaacuccuuuucaugugcacccuguccuugucugugacauacuuauguuauucacugcuaggagguaguggcagccuccaguuuccccuggcacuucaagaguccccuggggccgcugcagaaccacccccgucuccucccccaccuucgcuguugcccacuccaguccggcucggagcccccucacagccuccagcuccgcccccucuggacaacgccagccacggcgagccacccgaaccuccagagcagcccgcggcaccggguacggauggguggggacugccuaguggcggcgggggagcccaggacgcuuggcuccgcaccccauuagcccccuccgaaaugaucacagcacaaucugcucugccugagcgagaggcccaggaaagcuccacuaccgaugaggaccuugcgggucguagagccgcaaauggcucaagugaaaggggaggggcuguuagcacacccgauuacggcgagaagaaauugccacaggcccugauuauaggugugaagaaagggggaacccgggcucuacucgaggccauccgcguacauccugacgugagagcagucggcguggaaccccacuucuuugauaggaacuaugagaagggccuggaaugguaccggaauguuaugccaaagacucuugacgggcagauuacaauggagaaaaccccgucuuauuucgugacgaacgaagccccuaagcgcauccauuccauggcuaaagauauuaagcugaucgucgugguacgaaaucccguuacuagagcgauaucagacuacacccaaacauugagcaaaaagccagagauccccacuuuugaggugcucgcauucaagaacaggacccugggauuaauugaugccaguuggucugcuauccggauugguaucuaugcccugcaccucgaaaauuggcuucaguacuuuccucugucccagauauuguucgucagcggcgagcgucuaauuguggacccagcaggggaaauggccaaagugcaggauuuucugggacucaagcgcgucguuacagagaaacauuucuacuuuaacaagaccaaaggcuuccccugccugaagaaaccugaagacucgucugcuccgagaugucuugguaaguccaaggggaggacgcacccacggaucgaccccgaugugauucaccgacugcgcaaauuuuauaagccuuucaauuugauguucuaccaaaugacuggccaggacuuucagugggagcaagaggaaggagauaaauga

SEQ ID NO: 57401 - RNA, 1041 nt, Artificial Sequence
  derived and/or modified sequence opt3 from HS3ST5__Homo_sapiens__NP_705840
augcuguucaagcagcaagccuggcucagacagaaacuucugguguugggcagcuuagcugucgggucccugcuauaccucguugcaagggugggaucucuggaccggcuucagcccaucugcccuauugagggucgccugggcggggcccgaacccaggcggaauuuccauugcgugcucuccaauucaagagaggacugcugcacgaguuuaggaaaggcaacgccucaaaggaacagguacggcuccaugauuuagugcagcagcugccgaaagcaauaaucauugguguccgcaaagggggaacaagagcccuuuuggagaugcugaaucuacaccccgcugugguuaaggcaagucaagaaauccauuucuuugacaacgaugagaauuauggcaaaggcauugagugguacaggaagaaaaugccuuucagcuauccacagcagaucacuauagaaaagucccccgccuacuuuaucacggaggaagugccugagcggauuuauaaaaugaacucuucgaucaagcuccugauuaucguccgcgagccaaccacacgagcuauaucagacuacacucaggugcuugaagggaaggagagaaagaauaagaccuauuacaaauucgaaaagcuggccauugaucccaacacaugugagguaaauaccaaauacaaggcgguuaggacuagcaucuauacaaaacacuuggaacgguggcucaaguacuuuccuauugagcaauuccauguggucgacggagaucgucugaucaccgagccauuaccggaacugcagcucguggagaaguuucuuaaccugcccccucgcaucagucaguauaauuuguacuucaacgcaacgagagguuuuuauugccuaagguucaauauuauauucaacaaaugucuggccggcuccaaggggcggauccacccagaaguggaccccucugucauuacuaaacuccgaaaguuuuuccacccuuuuaaucaaaaauucuaccagaucaccggacgcacacugaacuggccauga

SEQ ID NO: 57402 - RNA, 1029 nt, Artificial Sequence
  derived and/or modified sequence opt3 from HS3ST6__Homo_sapiens__NP_001009606
auggccggcagcgggggacuggguggcggggcuggaggcggucagggggcaggagccggccaaggcgcggcucucagagccuccagggcacccaugcuucugguggccuuggucuuaggggcuuacugccugugugcacuaccuggacggugcccaccggccgcucgcgcccccgcgccugcaccagcccccucugaaccuucaaguagcguucaccgaccaggugcucccggccucccucuggccuccgggccaggacguagaagguucccgcaggcacuuaucgugggcguaaagaaaggugggacccgggcucuguuggaauuucuccgccugcaucccgacgugagagcccugggaucugagccucacuucuuugauagguguuaugaacggggccucgcgugguaccgcucguuaaugccacgaacacuggacggccagauuacuauggagaagacgcccucauauuucgucaccagagaagccccuaggcggauacaugcaaugagcccagauacaaaacuuaucgugguugugcguaaccccgucacucgcgcuauuagugacuacgcccagaccuuguccaagacaccggggcugccuucuuuuagagcucuagccuucaggcacggacucggucccguggauaccgcauggagcgccguacggaucggccuguaugcucaacaucuugaccacuggcugcgauacuuuccauugucccacuuccucuuuguuucaggggagcgccuggugagugauccugcgggagaggucggcagagugcaggacuucuuaggucugaaaaggguggucacugauaagcauuuuuauuucaaugcaacaaagggguuucccugccucaaaaaggcccagggcggaagccggccacgcugucuuggcaaaucuaaggggagaccccacccuaggguuccacaggcucuggugcgucgguugcaagaguucuaccgaccguucaacagaagguuuuaccagaugaccggacaggacuucgguuggggcuga

SEQ ID NO: 57403 - RNA, 1236 nt, Artificial Sequence
  derived and/or modified sequence opt3 from HS6ST1__Homo_sapiens__NP_004798
augagaaggcggcgcgccggcgggcgaaccaugguggagcgugcuagcaaguucguccugguuguggcaggauccguaugcuuuaugcucauccuuuaccaguaugccggucccggccugucuuugggggcgccuggaggcagagcuccaccggacgauuuagaccuguuccccacaccugauccacacuacgagaaaaaguauuacuuucccgugagggagcuagaacggucacuccgcuucgacaugaaaggugaugacgucauuguguuucugcauauacaaaagacugggggaacgaccuucggcagacaccuuguucagaacgugaggcuggaggucccuugugauugccggccaggccagaaaaaguguacaugcuaucgccccaaucgaagagaaacuugguuguuuaguagguucagcaccgggugguccuguggacuccaugccgacuggacagagcugaccaacugcgugccugguguacuggaucggcgugacucugcagcccuccgcacuccaagaaaguuuuacuauaucacauuacugagggauccgguuucgcgguaccuuucagaguggcgacacgugcagcgcggcgcuaccuggaaaacgagcuugcauaugugugacgggagaacucccaccccugaagaacugccacccugcuacgaaggaacagauuggaguggcuguacucuacaagaguucauggacugcccuuauaaucucgcaaacaauaggcagguccggaugcuggccgaccuuucccugguggguuguuacaacuugucuuuuauuccagaggggaagcgcgcucagcuccuguuagaaagcgccaaaaagaaucugagaggaauggcguucuuuggccucaccgaguuccagaggaaaacacaauaucuuuucgaacguaccuuuaaccugaaguucauccggcccuuuaugcaguacaauuccacgcgagcaggcgggguggaggucgaugaagacacuauuagaaggaucgaggaguugaacgaucuagacaugcagcuguaugauuacgccaaggaccucuuccagcaacgcuaucaguacaaacggcagcuggaaagaagggagcaacgccuucgaucacgggaggaacgucuguugcacagagcuaaggaagcccucccgagggaggaugcagacgagccuggacgcguucccacagaagauuacaugagucacauaaucgagaaaugguga

SEQ ID NO: 57404 - RNA, 1938 nt, Artificial Sequence
  derived and/or modified sequence opt3 from HS6ST2__Homo_sapiens__NP_001070656
auggcccugcccgcuugcgcagugagagaguucgaaccuccaaggcagccggagcggggcgcccccguccgcaccacauguccucgacgucacagcagaguugaagcggagcucgcugccuccaggccagggucuguggcagccucaguacgggcuggacccccucgcggugugagucauggcuuucacacuagaccacuucuggacaagcccaggaaagcaagcuccucuuuggccggggcugccugcgcgccuuuauucgcacugcuaucgcggggacgccgaagaaggaugcauguccuccggcgucgcugggaucugggcucacuuuguagagcccuguugacgaggggucucgcugcccuggggcacagccugaagcaugugcucggagcaaucuuuaguaaaauuuucggcccaauggcuuccguuggcaacauggacgaaaagucuaauaaauuacugcuugccuuggugaugcuguuucuauucgcggucauagugcuccaauacguaugcccggggaccgagugucagcugcuucggcugcaggccuuuagcucccccguuccugauccauaucgaucagaggacgaaaguagcgcacgcuucgugcccagauacaacuuuacaaggggagauuugcuccggaaggucgacuucgauaucaagggugacgaucugauuguguuuuuacacauccagaaaacuggcgggaccacauucggacgccaccuggugagaaauauucaacucgagcagccuugcgaauguagggucggccagaagaaaugcaccugucaucguccagguaagcgggagacuuggcuguuuucucgauucuccacaggguggucaugcggacuucacgcugacuggaccgaguugacgagcuguguucccagugugguagauggcaaaagagacgccaggcuacgcccgucucgguggagaaucuuccagauacuggaugcugccuccaaggacaagaggggcagcccuaacacuaaugcaggggccaacucgcccucuuccaccaaaacacgcaauacuucaaagagugguaaaaacuuucauuauaucaccauucuccgagacccagugagccgguaccuguccgaauggcgucacguccaaagaggagcuacauggaaggcgucucuucacgugugcgauggcaggccucccaccagcgaggaacugccaucaugcuauacgggggacgauuggaguggaugucccuugaaagaguucauggacugcccuuacaaucucgcaaacaaucgccagguucggaugcuguccgauuuaacucuggugggcuguuauaaccuaagcgucaugccagaaaagcagagaaauaaagugcuccuggagucugccaagucaaaccuuaagcauauggccuuuuucgguuugacagaguuucagaggaaaacccaauaccuguucgaaaagacuuuuaauaugaacuucaucaguccguuuacacaguacaacaccacgcgagcuagcuccguagagauuaaugaagagauccagaaacgcauagaagggcucaacuuccuggacauggagcuuuauucuuacgcaaaggaucuguuuuugcaacgguaucaguucaugagacagaaagagcaccaggaagccaggcguaagcgccaagagcagcggaaguuucucaaaggcagacuguuacagacccauuuccagucgcaaggacagggccagagccagaaucccaaccaaaaucagucccagaacccuaauccaaacgcuaaucagaaccugacacaaaaucuaaugcagaaccucacucagucacugagucaaaaggaaaauagggagucucccaaacagaacagcgggaaggaacagaaugacaacaccuccaacggaacaaaugauuacauugguucaguugagaaauggcgauga

SEQ ID NO: 57405 - RNA, 1416 nt, Artificial Sequence
  derived and/or modified sequence opt3 from HS6ST3__Homo_sapiens__NP_703157
auggacgagagauucaacaaguggcugcucacccccgugcuuacacuguuguuugucguuaucauguaccaguaugugagcccuuccugcacuucuucauguacgaauuucggcgaacaaccaagggccggggaggcuggaccgcccgcaguaccugguccagcccggcgcgcgcaggcucccccugaagagugggaacgacguccacaguuacccccuccaccgagagggcccccugagggcccaaggggagccgcagcccccgaggaagaggaugaagaaccuggcgacccacgggagggugaagaggaagaggaagaggaugagcccgacccggaagcuccugagaacgggagucugccccgcuuugugccaagauucaauuuuagccuaaaagaucucaccagguucgucgacuuuaacauuaagggacgggaugugauaguuuuccugcacauccagaaaacaggcggcacuaccuuugggcgccaucuugugaagaauauucgacuggaacaaccuugcuccuguaaagcaggacagaagaagugcacaugucacagacccgguaaaaaggagaccugguuguucucuagguuuucgacuggcuggucaugcgggcuccaugccgacuggacagaacugaccaacugugucccagcuaucauggagaaaaaggauugcccccggaaucacagccauacgcguaacuucuacuauauuacuaugcugcgcgacccugugaguagauaccucuccgaguggaaacacguacagaggggagccaccuggaagacaucuuuacacaugugugauggccggagcccaacuccggacgaacugccuaccugcuaucccggugaugacugguccgggguuucacuucgagaguuuauggacuguacauacaauuuggcgaacaaucgccaggugagaaugcuggcagaucuaagucucgucggaugcuauaaccugaccuucaugaaugaaagcgagaggaacacgauccuucugcaaucugccaagaauaacuugaaaaacauggcuuucuuuggccucacugaguuccagcggaagacacaguuucuguucgagcgcaccuuuaauuuaaaauucauauccccauuuacucaguucaacaucacaagagccucaaauguggagauuaacgaaggcgcaaggcaacguaucgaggaccugaauuuucucgauaugcagcuuuacgaauacgcuaaggaccuguuccagcaacgguaucaucacaccaaacaguuggagcaucagcgagauagacagaagaggcgcgaggaacggagacuacaaagggagcaccgcgaccaccaguggcccaaagaagauggggccgcggagggaacggugaccgaagacuacaacagccaggucguucgaugguga

SEQ ID NO: 57406 - RNA, 231 nt, Artificial Sequence
  derived and/or modified sequence opt3 from HSBP1__Homo_sapiens__NP_001528
auggccgagaccgaccccaagacagugcaggaucugacuagcgucguucagacgcuccuucagcagaugcaggacaaauuccaaaccauguccgaucagaucauuggcagaauagacgauaugucuucaaggaucgacgaucuggaaaagaacauugcugacuugaugacacaggcagggguggaggaauuagagagugaaaauaaaaucccugccacucaaaagagcuga

SEQ ID NO: 57407 - RNA, 879 nt, Artificial Sequence
  derived and/or modified sequence opt3 from HSD11B1__Homo_sapiens__NP_001193670
auggccuucaugaagaaauaccugcuccccauccuuggccuguuuauggcuuauuacuauuacagcgcaaacgaggaguucagaccugaaauguugcaggggaagaaagugauugucaccggagccuccaaggguauaggcagggaaauggcguaucacuuagcuaaaaugggggcccauguugugguaacagcacggucuaaggagacucugcaaaagguggucucacacugccuagaacucggagccgcuagugcacauuacaucgccggcacgauggaggacaugaccuuugcugagcaguucguggcccaggcggguaaacugaugggagggcuugauaugcugauuuugaaucacaucacaaacacuagccucaaucuguuucaugacgauauucaccacguucgcaaguccauggaagugaacuuccugucuuaugucgugcucaccguagcagccuuaccaaugcugaaacagucgaauggcucaaucguuguggucagcagucuugcuggcaagguggccuacccgaugguggcagcuuacuccgccucuaaauuugcguuggacggguucuuuagcuccauacgaaaggaguauucagucagucguguuaacgugagcaucacacuguguguacuaggacucauugauaccgaaacugccaugaaggcagugucugguaucguccauaugcaagcugcccccaaagaggagugcgcucuggaaauuaucaagggcggggcccuuagacaggaggaaguguacuaugacuccucacuguggacaaccuugcucauaaggaauccuugucggaaaauucuggaguucuuauacagcacgaguuauaacauggaucgcuuuaucaauaaguga

SEQ ID NO: 57408 - RNA, 1002 nt, Artificial Sequence
  derived and/or modified sequence opt3 from HSD11B1L__Homo_sapiens__NP_001254797
auggccaaccugggcacccuccagcuucugcccccuagauucaagagguuuagcugcuuguccuuaccaaauaucuggauuacagggaugccggugcccgcuacuucugucccuuguccaucagcaggaccccaccggacgaugaaaguucugcuacucaccggucugggcgcccuuuucuuugcguacuauugggacgauaacuucgacccugcuagucugcaaggggcccgcguguugcucacaggagcaaaugccggcguaggugaggaacuggcuuaccauuaugcacgacuggggagccaccucguguuaacugcccauaccgaggcucugcuucagaaggucgugggaaacugccguaaauugggcgccccaaagguguuuuacauagcggcagauauggccucccccgaagcuccugagucuguuguccaguucgcccuggacaaacuaggcgggcucgauuaucuggugcuuaaucacaucggaggugcaccagcuggcacaagagccaggucgccgcaggcgacccgguggcugaugcaaguaaacuuuguuucauacgugcaguugacuagccgcgcccuccccagucugacagacuccaaggggucuuuagucguggugagcucccugcucggaagagucccuaccucauucaguacgccauauagcgcagcuaaguuugcccuugauggcuucuuugguucucugaggcgggaauuggacguucaggaugugaauguagcuauuacuaugugugugcuagggcugcgcgaccgagccuccgcagccgaggcugucagaggagugaccaggguuaaagcggcacccggcccuaaggccgcucucgccgugauccggggcggggcaacacgugccgcuggagucuucuacccauggcgcuuuagacugcuuugccuguugaggcgguggcucccccgaccgcgcgccugguucauuagacaggagcugaacgugacugcagcggcugccuga

SEQ ID NO: 57409 - RNA, 1218 nt, Artificial Sequence
  derived and/or modified sequence opt3 from HSD11B2__Homo_sapiens__NP_000187
auggagagauggcccuggccuagcggcggggccuggcugcucguggcugcaagggcccuucugcaguuguuacgguccgaccugcgccuaggacgaccacuccuggcggcucuugcccuguuggcagcccucgauuggcugugccaacgucugcucccgcccccugcugcauuagccguccuggcugccgcggguuggaucgcacuuucuagauuggccaggccacagcggcugcccguugcuacccgcgccgugcuaauuaccggcugugacucaggguucggaaaggaaacugcuaaaaagcucgauaguaugggcuuuacgguacuggcaaccgugcuugagcugaacagcccuggugccauagaauugagaacaugcuguuccccaaggcuccggcuguuacagauggaccugacuaaacccggggauaucucucgcguccucgaguucaccaaggcgcacacaaccucgacuggacuuuggggccuggugaauaacgccggccauaaugaaguuguggcagacgcugaguugucaccugucgccacauuucgaagcugcauggaggugaacuucuuuggggcucuagaacugaccaaaggacuccugccacuucugagaaguuccaggggucggauuguaacgguuggcucuccggccggggauaugcccuacccuuguuugggagcauauggcacuagcaaggccgcuguggcgcuccugauggacaccuucuccugcgaguuacugccauggggugucaaggugucaaucauucagcccggguguuuuaaaacagaaagugugcguaaugucggacaaugggagaagcgcaaacagcuacuccuggcaaaccuuccucaggaguugcugcaggccuacggcaaggauuauaucgaacaccuccauggccaauuccugcacagccuuagacuggcuaugucugacuugacuccaguuguggaugccauaaccgacgcacuccuggccgcuaggccccggcgacgcuacuauccggggcagggauuaggucugauguacuuuauccauuauuaccuaccugagggccucagaaggcgguuccugcaggccuuuuucauuucccacugccuuccccgcgcauugcagccagggcaaccuggaacaacacccccacaggaugcggcucaggaccccaaucugucaccuggcccaagcccggccguagcaagauga

SEQ ID NO: 57410 - RNA, 759 nt, Artificial Sequence
  derived and/or modified sequence opt3 from HSD17B10__Homo_sapiens__NP_001032900
auggccgcugcaugcagaagcgugaagggccuggucgccguuaucaccgggggagcguccggucucggccuugcuacagccgagaggcugguggggcagggagcaucugccguauuguuagaccugcccaacucaggcggugaagcucaagcaaagaaacuagggaauaacuguguguucgccccugcugaugucacgagugagaaagacgugcagacugcccucgcgcuggcaaagggaaaauuuggccggguugauguggccgucaauugcgcuggcauugccguggcaagcaagaccuacaaccuuaagaaagggcagacacacacucuggaagacuuccagcgcguauuggauguuaaucucaugggaaccuuuaacgugauacgacuggucgcuggugagaugggccaaaaugaaccagaccaagggggacagcguggcgugaucauuaacacagccuccguggcggccuucgagggucaggucgggcaggcagcuuauucugccucgaagggaggcaucguuggcaugacccugccgauugcuagagaucucgcccccaucggguuauuuggaacuccucugcuuacaucauugccagagaaaguguguaauuuccuggcaagccagguacccuuuccuaguaggcuaggugacccagccgaauacgcucaucucgugcaggcgauaaucgagaaccccuuccugaauggcgaagucauucggcuugauggggcaauccgcaugcagccuuga

SEQ ID NO: 57411 - RNA, 903 nt, Artificial Sequence
  derived and/or modified sequence opt3 from HSD17B11__Homo_sapiens__NP_057329
augaaguuccugcucgacauccuucuguuguuaccccugcuaauugugugcagccucgaguccuuugucaaacuguucauaccuaagagaaggaaaucuguuaccggcgaaaucgugcuuauuacaggggccggacacgguaucggccggcugacugcuuacgaguuugcaaaguugaaaucaaagcucguacugugggauauuaacaagcaugggcuggaagagacggccgcgaaauguaagggacucggcgcuaaagugcacaccuucgucguggacugcaguaaucgcgaagauaucuauagcuccgccaagaaaguuaaggcagagauaggugacgugucuaucuuagucaacaaugccggggugguauacacaucggaucuguuugcuacucaggacccacaaauugagaagaccuucgaaguuaacgugcuugcacauuuuuggacaaccaaagccuucuugccggcuaugacuaagaauaaccacggacauaucgucacaguggccucagcggcaggccacgugagcguccccuuucugcuagccuauuguaguuccaaauucgcugccguuggcuuucacaagacccucacggaugagcuggcagcccuucagauuacuggggugaaaaccacaugccuguguccuaauuucguaaacacuggauuuaucaagaauccaucuaccagcuugggucccacacucgaaccugaggagguggucaaccgacugaugcauggcauauuaaccgaacagaaaaugauuuucaucccauccucaauugcuuuccugacgacucucgagcguauccuucccgaaagauuucuggcgguguugaagaggaagaucaguguuaaauucgacgccgugauuggguacaagaugaaagcacaguga

SEQ ID NO: 57412 - RNA, 939 nt, Artificial Sequence
  derived and/or modified sequence opt3 from HSD17B12__Homo_sapiens__NP_057226
auggagagcgcccugcccgcugcaggcuuccucuacugggugggggccggaaccgucgcguaucuugcucugagaaucuccuacucuuuguuuacagccuuaaggguuuggggugugggcaacgaagcagggguaggaccuggccugggugagugggccguggucacugggucaacggacggaauuggcaagaguuaugcugaggaacuagcaaaacacggcaugaaggugguucucauaagccgguccaaagauaagcuggaccaggugucuucggaaaucaaagagaaguucaaggucgagacccgcacaauugccguggauuuugcuucagaagacaucuacgauaaaauuaagacugggcuugccggacuggagaucgguauauugguaaauaacguuggcaugagcuaugaauacccagaguauuuccucgacgugccggaucuggacaaugucaucaaaaagaugauuaacaucaauauucugagugugugcaaaaugacccaacucguguuacccgggauggucgagcgauccaagggagcgauccugaacauaucuagcggcuccgguaugcuuccuguuccauugcugacaauuuacucagcaaccaagacuuuuguggauuucuuuagucagugucuacaugaagaguaccguagcaaagggguauucgugcagucuguccuccccuauuuuguggccacaaagcuggcuaaaaucagaaagccuacccuugacaaaccaucccccgaaacguucguuaagucagccauuaaaacugugggacugcagagcaggaccaauggcuacuugauccacgcacucaugggcaguaucauuucuaaccugccuuccuggauauauuuaaagaucgucaugaauaugaacaagagcacacgggcucauuaccugaaaaagacuaaaaagaauuga

SEQ ID NO: 57413 - RNA, 795 nt, Artificial Sequence
  derived and/or modified sequence opt3 from HSD17B13__Homo_sapiens__NP_001129702
augaacaucauucuggagauacuccuucuguugaucaccauuaucuacagcuauuuagaaucccuggugaaguucuuuauuccccagagaaggaaaucugucgccggcgagaucguucuaauaacaggggcuggacacgguaucggccggcaaacuacguacgaguucgcaaagcgccagucaauucucgugcugugggacaucaauaaaguaaagaaagaagugggggaugucaccauugugguuaacaaugccggaacaguguauccugcggaccuucugaguacuaaggaugaagagaucaccaagacauuugaggucaacauauugggccauuucuggauuaccaaagcucuccugccaagcaugauggaacgaaaucacggucauaucgugacuguagccuccguuugcgggcacgagggcauuccguaccugauccccuauuguucuucgaaguuugcagccgugggauuccaucguggccucacaucagaauuacaggcucuggggaaaaccggaaucaagacgagcugccuuuguccugucuuugugaacacugguuucaccaaaaauccaaguacaagauuguggcccgugcuggagacugacgaggucguuaggucccuaauugauggcauacucaccaacaagaagaugaucuuugugccuucuuacauuaauaucuuccugcggcuucagaaauuucugccagaacgcgcaagcgccauauugaacagaaugcaaaauauucaguucgaggcuguaguggggcacaagaucaaaaugaaguga

SEQ ID NO: 57414 - RNA, 813 nt, Artificial Sequence
  derived and/or modified sequence opt3 from HSD17B14__Homo_sapiens__NP_057330
auggccaccggcacaagauacgcugggaagguggucguugugacuggagguggcagggggaucggagcaggcauuguacgggccuucgugaacagcggugcgcgcgucgugauaugcgacaaagaugaguccgggggacgagcucuggaacaggagcuccccggcgccguuuuuauccuuugugacgugacgcaagaagaugacgucaagacccuggugucugagacaauucguagauucggcagguuggauugcguaguuaauaacgcagggcaccauccuccaccgcagcggcccgaagagacuucagcccagggauuucgccaguuacuggagcuaaaucuccuggguaccuauacacuuaccaaacuggcuuugccuuaccucagaaagagucaaggcaacgugaucaauauuagcucccuggucggggcaaucggacaggcccaggcugugccauauguggccacuaaaggcgcggucacagcaaugaccaaggcccuggcucucgacgaaucucccuacgguguuagggugaacuguauaucgccugggaauaucuggacgccauuaugggaggaacuggccgcacuuaugcccgauccucgggcuacuauucgcgagggaauguuggcccagccacugggccgaaugggccaaccggcggagguaggggccgcagcuguguuccuagccucagaagcuaacuuuugcaccggaaucgagcuccuggucacagguggcgccgaacuuggguauggauguaaggcaagcagaaguacucccguggacgccccugauauuccauccuga

SEQ ID NO: 57415 - RNA, 987 nt, Artificial Sequence
  derived and/or modified sequence opt3 from HSD17B1__Homo_sapiens__NP_000404
auggccagaaccgugguccugaucacaggcugcagcuccgggauuggacuccaccuugcuguuaggcuggcaucugaccccucacagaguuucaagguguacgccacuuugcgggauuuaaaaacgcaaggucgccugugggaggcggcucgagcccuagcauguccuccaggcagccucgaaacccugcagcuugacguacgugauuccaagucuguggccgcugcaagagagagggucacagaagggcggguggacguucuggugugcaacgccggauugggccuccuggguccgcuggaggcucucggggaagaugccgucgcgucgguguuagacguaaauguugugggaacuguccgcaugcugcaggcauuucuucccgauaugaaaagaaggggcucaggccggguguuggugaccgggagcgucggaggucugaugggccuaccuuucaacgacguuuauugugccaguaaguuugcucucgaggggcugugcgagucccuugccgugcuguugcucccauucggaguacaucugucuuuaauagaauguggccccgugcacacagcauuuauggagaaaguccuggguagcccugaagaggugcucgaucgcaccgacauccauacuuuccaccgauuuuaccaguaucuugcucauuccaagcaaguuuucagagaggccgcgcagaauccagaagagguggccgaagucuuucugacagcauugagggcucccaagccuacccuacgguacuucacgacugagcguuuucugccacuccugcgcaugagacuugaugacccgucagggaguaacuaugugaccgccaugcacagggaaguauucggagauguucccgcuaaagccgaggcaggcgccgaggcuggcgggggagcggguccuggcgcagaagacgaggccgggcggggagcugugggcgacccagaacugggugaucccccugccgcaccacaguga

SEQ ID NO: 57416 - RNA, 1164 nt, Artificial Sequence
  derived and/or modified sequence opt3 from HSD17B2__Homo_sapiens__NP_002144
augagcaccuucuuuuccgacacagccuggaucugccuggcugugcccacuguccucuguggcacgguuuucugcaaguacaaaaagucuucagggcagcuuuggaguuggauggugugucuggcaggauugugcgccguauguuuacugauucuaagcccuuuuuggggucucauacuguucuccgugucuugcuuucuuauguauaccuaccugucgggccaagaguugcucccagucgaucagaaagcggugcugguuacagggggagacuguggccugggucacgcucucugcaaguauuuagaugaacugggguucacuguguuugccggaguccuuaacgagaauggcccgggcgcagaagaguugagaaggaccuguucaccccggcugagcgugcuacagauggacaucacaaaaccuguacagauuaaggaugccuacaguaagguugcugcaaugcuccaagaccgcgggcugugggccgugaucaacaaugcuggaguccuugguuucccaaccgauggcgaacuguugcucaugacugacuauaaacagugcauggccgugaacuuuuucgggacaguggaggucaccaagacguuucugcccuuacugcgaaaauccaagggacgucucguuaaugugucuagcaugggcgguggggcgccuauggagagacuugcauccuacggaucaaguaaagccgcuguaacuauguucagcucugugaugaggcuggaauuguccaaguggggcauuaaggucgccucaauccagccaggcggguuucuaaccaacauagcaggaacaagcgauaaaugggagaagcuggaaaaagacauccucgaucaucugcccgcugaggugcaggaggacuauggucaagauuacauucuugcccagcggaauuuccuguugcucaucaacagucuggcgucuaaggacuucuccccuguuuuacgcgacauucagcacgccauccuggcaaaaagcccauuugcuuacuauacuccgggcaagggggccuaccuauggauaugucucgcucauuaucugcccauuggaaucuacgauuauuucgccaaaagacacuuuggccaggacaagccuaugccaagggcacuucggaugcccaauuacaagaaaaaggccaccuga

SEQ ID NO: 57417 - RNA, 933 nt, Artificial Sequence
  derived and/or modified sequence opt3 from HSD17B3__Homo_sapiens__NP_000188
augggcgacgugcuggagcaguucuuuauccucaccgggcuucuggucugcuuggccuguuuagcuaagugcguuagauucuccaggugugugcugcuaaacuacuggaaaguacuccccaagagcuuucugcggucuaugggacaaugggcagugauuacaggugccggcgaugggauaggaaaagcguauucauucgaacuugcuaagcgcggccugaaugucguguugaucagucgaacucucgagaaacuggaagccauugcaacggagaucgaacguaccacagguagaagcguuaagauuauccaggccgacuuuacuaaggaugacauauacgagcacaucaaagagaagcuggcugggcucgaaauuggaaucuuagugaacaaugucggcaugcugccuaaccuuuugccaucccauuuccugaaugcaccggaugagauucagucucuaauccacugcaacauaaccucggugguaaaaaugacacagcucauucugaagcauauggaaucaaggcaaaaaggccuuauccugaauauuagcagugggaucgccuuguuucccuggccucucuauuccauguacucugcuagcaaggccuucguuugugcguuuuccaaggcacugcaggaggaguauaaagccaaggaagugaucauucaggucuuaaccccauacgcugugucaacugccaugacaaaauaucugaacaccaaugugauaacgaagacugcagacgaguucgucaaagaaagucucaacuacguuaccaucggaggugagacaugcggcugucuugcucacgaaauucuggccggguuuuugagccuaauccccgcgugggccuucuacucuggagcauuucagcggcugcuccugacucauuauguggcuuaccuuaagcugaauaccaaaguacgcuga

SEQ ID NO: 57418 - RNA, 2211 nt, Artificial Sequence
  derived and/or modified sequence opt3 from HSD17B4__Homo_sapiens__NP_000405
augggcagcccccugagauucgacgggagggugguccucguuaccggagccggugcuggccuugggcgggcauacgcccuggcguuugcugagcgcggagccuuggugguagugaacgauuuaggcggugacuucaagggggucggaaaaggcucccuggcagccgauaaggugguugaagagauccgacguagaggcgggaaagcuguggcaaauuaugacucugucgaagagggagaaaaggugguaaaaacagcccuagaugcuuuugguaggauugacguuguggucaacaaugccggcauacuccgggaucgcucauucgcgagaaucagugacgaggauugggacauuauccacagggugcaucugcgggggagcuuucaggugacucgcgcagccugggagcacaugaagaagcaaaaauacggacgaauuaucaugacguccucugcuucgggcauauaugguaacuucgggcaggccaauuacucagcagcuaaacuuggacuguugggccucgccaacagccuggcgaucgaaggcagaaagaguaauauucauugcaacaccaucgccccuaaugcaggguccaggaugacacagacugucaugccagaggaucugguugaagcucucaagccggaguauguggcccccuuaguacuguggcuuugucacgagucuugcgaagagaacggagguuuguuugaagugggcgcuggguggauuggaaaacugcggugggagcguacccuaggcgccaucguccgccagaagaaucauccuaugacaccagaagcagugaaggccaacuggaaaaagauaugugacuucgagaaugcuagcaaaccccaauccauucaggagucaaccgguaguaucauugaaguucucagcaagaucgauucugaagggggcguguccgcgaaccacacuucaagagcaacaagcaccgccacgaguggauuugcuggcgccaucgggcagaaacugccuccauucucuuacgcauauacugagcuugaggccauuauguacgcucugggagucggugccuccauaaaggaccccaaagacuugaaguuuaucuacgaaggcagcucggauuucucuugccucccuaccuuuggggugauuaucggacagaaguccaugaugggcggugggcuggcagagauaccaggcuuaucaauuaauuucgcgaaaguacugcacggagagcaauaucucgaacuuuacaagccgcugcccagggcuggcaaauugaagugugaggccguuguggcagacguccuagauaaagggaguggaguggucaucaucauggacguguauagcuacuccgaaaaggagcugauuugccauaaccaguucucucucuuucugguugguagcggcggguucggaggcaagcggacaucagauaaagugaagguagccgucgcuaucccuaaccgaccacccgacgccgugcuuacugauaccacaagucugaaucaggcagcuuuguaucgccucuccggugacuggaacccucugcacauugauccaaauuuugccagcuuagcgggguucgacaaacccauacugcauggccuauguaccuuuggauucucugccagaaggguucuccagcaauuugcugauaacgacgugucacgguucaaggcaaucaaagcccgcuuugcuaagccggucuacccuggccagacgcugcagacugaaauguggaaggaggggaauaggauucacuuccaaacaaaagugcaggagaccggagacaucguaaucaguaacgccuauguggaucuugcacccacuagcggcacauccgcgaagaccccaucugaaggugggaaauugcagucgacguuuguuuucgaggaaauuggaagacgucugaaggacauaggcccugaggucgugaaaaaggugaaugccgucuuugaguggcacaucaccaaggguggcaacauuggggcuaaauggacaaucgaucucaagagcggauccggcaaaguuuaccaggggcccgccaagggagcagcugacacuaccauuauccugucagaugaagacuucauggagguggugcuuggcaaacuggauccacaaaaggccuucuuuaguggucgguugaaagcacgagggaauauaaugcucucucagaagcugcagaugaucuuaaaggacuacgccaaacuguga

SEQ ID NO: 57419 - RNA, 954 nt, Artificial Sequence
  derived and/or modified sequence opt3 from HSD17B6__Homo_sapiens__XP_006719735
auguggcuguaccucgccgcuuucgugggccuuuauuaccuguugcacugguauagagagaggcaggucguuagccauuuacaagacaaguacguguuuaucaccgggugcgauuccggauucgguaaccugcuagcacggcagcucgacgcccgcggccugcgaguacuugcggcuugucugacagaaaaaggggccgagcaguugcguggacagacuucugauagacucgaaacggugacccuggacgucacaaagauggagucaauugcagccgcuacucaaugggugaaagaacacguuggcgauaggggucugugggggcucgugaauaacgcaggaauauuaacccccaucacacugugcgaguggcuuaauaccgaggacaguaugaacauguugaaggucaaucugauuggcgugauccagguaacucuaagcaugcucccucugguucggcgcgccagaggcaggauugugaacgucuccucuauccuugggcggguggcuuucuuugugggagguuauugugucucgaaauacggcguugaagccuuuucagauauacugcgccgagagauccagcauuucggggugaagauuagcaucguagaaccaggauauuuuagaacaggcaugaccaauaugacgcagaguuuggagaggaugaagcaauccuggaaagaggcgccgaagcacauuaaagaaacuuacggucagcaguacuucgacgcacucuauaacaucaugaaggaggggcuguuaaauugcucuaccaaccugaaucucgugacagauuguauggaacaugcccuuacuagcguccacccccggacccguuacuccgcuggaugggacgccaaauuuuucuuuauaccucugucauauuugccaacaagucuagcagauuacauucugacccgcagcuggcccaagccugcucaggccguguga

SEQ ID NO: 57420 - RNA, 468 nt, Artificial Sequence
  derived and/or modified sequence opt3 from HSD17B7__Homo_sapiens__NP_001291441
augagaaaggugguccugaucaccggcgccagcuccgggauuggacucgcucuuugcaaaaggcuguuggcagaggacgaugaauuacaccugugucuagccugccggaacaugucuaaggcggaggcuguuugugccgcacuccuggccucacaucccacagcugaagugacuauaguacagguggacgucaguaaucuucaaagcguguuccgcgcauccaaagagcugaagcagcgauuucagcguuuggauugcaucuaccucaacgccgguauuaugccuaauccacagcugaacaucaaagcucuguucuuuggccucuucucuagaaagguuauucacauguuuucgacggccgaaggguuacugacccaaggagacaagaucacagcggauggccuucaggagguguucgagacuaaugucuuuggucauuucauauuggugaaaaagcugugggcauga

SEQ ID NO: 57421 - RNA, 786 nt, Artificial Sequence
  derived and/or modified sequence opt3 from HSD17B8__Homo_sapiens__NP_055049
auggccagccagcugcaaaacagacucagguccgcucuugcacuggugaccggcgccgggucuggaaucggucgggcggucucaguucgcuuggcuggcgagggggccacaguggcagccugcgacuuagaucgagcugcagcccaggaaacuguacgucugcuaggaggccccgguaguaaggaggggccuccaagaggaaaucacgcugccuuccaggcggacgugagcgaagcaagggccgcucggugucuccuggagcagguccaagccugcuuuucccgcccgcccucugugguugugucgugugcaggcauuacgcaggaugaguuccuucugcauaugucagaagacgauugggacaaagucauagcugugaacuugaagggcaccuuucucguaacacaggccgcggcccaggcacugguuagcaaugggugcagaggaaguaucauuaacaucuccucuauuguggguaaagucggcaauguggggcaaacuaacuacgcugccagcaaggcuggagugaucggccugacccagacagccgcaagggagcucggucggcacgggauacgcuguaauuccgucuuaccuggauucaucgccaccccaaugacucagaaaguuccccagaaggugguagauaagauuacagaaaugaucccuaugggccaucugggcgacccagaggauguggcugacgucguggcguuucuugcaucagaagauaguggguauauuaccggaacgagcguugaggugacugguggcuuguucauguga

SEQ ID NO: 57422 - RNA, 1128 nt, Artificial Sequence
  derived and/or modified sequence opt3 from HSD3B1__Homo_sapiens__XP_011539616
auggccaugaccggcuggagcugccuggugacaggggcuggagguuuccucggccagagaaucauuaggcuucuggucaaggagaaagaauugaaggagauacggguuuuagacaaagcauuugggcccgaacugcgcgaggaguucuccaagcuacaaaacaaaacuaagcucacggugcuggagggagauauccuugacgagccuuuucugaagcgagccugucaggauguaucugugauuauccacaccgcgugcauuaucgacgucuucggcgugacacaucgugaaucaauaaugaauguuaacgugaaagguacucaguugcuccuggaggcuuguguccaggccagugugccaguauuuaucuacaccagcuccauugaaguugcagggcccaauucuuauaaggagaucauucaaaacggacacgaggaagaaccgcuggaaaauacauggccugccccauacccccauucgaaaaagcucgcugagaaagcaguguuagccgcuaacggcuggaaucugaagaacggcgggacccuuuauacuugcgccuugagaccuauguacaucuauggagaagguucaagguuccugagcgcgaguauaaaugaggcacuaaacaauaacggcauucucuccucugucgggaaguuuagcacagugaauccaguguacgucggaaacguugccugggcucacauccuggcccuucgggcacugcaggaucccaaaaaggcuccuuccauucgcggccaguucuauuacaucucagacgauaccccacaucagaguuacgacaauuugaacuauacgcucagcaaagaguuuggucugagauuagauucuaggugguccuucccgcugucacucauguacuggaucggguuucuucuggaaauugugagcuucuugcuacggcccauauauacuuaccgcccuccauuuaaccgacacaucguaacccugaguaauucuguguucacauucuccuauaagaaagcccaaagagaccucgcguacaagccccuguauagcugggaggaagccaaacagaagacugucgagugggugggaucgcuuguugauaggcacaaggaaacccugaaaucuaagacacaguga

SEQ ID NO: 57423 - RNA, 591 nt, Artificial Sequence
  derived and/or modified sequence opt3 from HSD3B7__Homo_sapiens__NP_001136250
auggccgacagcgcucaggcacaaaagcugguguaccucgucaccggcgggugcggauuccuuggugagcacguugugagaaugcuguugcagagggaaccccgguuaggcgagcugcgcguauuugaucagcaucuagggccuuggcucgaggaacugaaaacaggaccagugcgagucacugccauccagggcgacgugacgcaagcgcacgaaguugcugccgcaguggccggugcucaugucgugauucacaccgcagggcuuguagauguuuucggacgugccuccccgaagacaauacaugaggugaacguccagggcacuagaaaugugaucgaggcuugugugcagaccggcacaagguuucuggucuauaccucuucaauggaaguuguggggcccaacacuaaaggacacccuuucuaccgggguaaugaggacacaccauaugaagccguacaccgccaucccuacccuugcaguaaggcguuggcagaguggcucgugcuggaggccaacggcagaaaagcuaugcugccaggguguaccugcuggcagcccggaagcugguccucuggccaaccuuga

SEQ ID NO: 57424 - RNA, 828 nt, Artificial Sequence
  derived and/or modified sequence opt3 from HSDL1__Homo_sapiens__NP_001139523
auggccgcuguggacagcuucuaccugcucuauagagagaucgcaagguccugcaacuguuacauggaagcccuugcgcuggucggggcuugguauaccgcccggaagucuauuacaguuauaugcgauuuuuacucauugauccgcuuacacuucauuccccgacuggggagucgugcagaccuaaucaaacaguauggaagaugggccgugguaagcggugcuacugauggcauugggaaggcauacgccgaggaacucgcuuccaggggacugaauaucauacuuaucucucggaacgaggaaaaacugcaauauuuuacgcaguugucggaggacaagcucugggauauuaucaaugugaacauugccgcggcaucacugaugguccaugugguucugccuggcaugguggagcgcaaaaagggugccaucgucaccauaagcaguggguccuguugcaagccaacaccgcagcucgcugccuucucugcaagcaaggcuuacuuagaccacuuuuccagagcccugcaguacgaauaugcgucaaaaggaauuuucgugcaaagucuuauccccuuuuacguagccacuagcaugaccgcaccuucuaauuucuugcauagguguuccuggcugguuccaucacccaaaguguaugcucaccaugccgucagcacacuaggcauuaguaagcggaccacuggcuacuggucucacuccauccaguuucucuucgcucaguauaugccugaguggcuguggguguggggcgccaacauccuuaaucgcagccugcgaaaagaagcauugucgugcacagccuga

SEQ ID NO: 57425 - RNA, 1038 nt, Artificial Sequence
  derived and/or modified sequence opt3 from HSDL2__Homo_sapiens__NP_001182751
augcugcccaacaccggcagacucgccgggugcacaguguucaucacuggagcuagcagggguauuggcaaggcaauagcccuuaaagcggcuaaggacggggccaauaucgucauugcagccaaaacggcucagccucacccaaagcuguugggaaccaucuacacagcagccgaggaaauugaggcuguuggcgguaaagccuuaccguguaucguggauguacgggacgaacaacagauauccgcggcaguggagaaggccaucaagaaauuuggggcuuauacuauugccaaguacggaaugucuauguauguccugggcauggcagaagaguucaaaggcgagaucgcugugaacgcccuauggcccaagaccgcgauucauacagccgcaauggauaugcucgggggaccugguaucgaaucacagugccgcaaaguugacauaauugcugaugccgcuuacaguaucuuucagaagccaaagagcuucaccggcaauuuugugauugacgagaacauccugaaagaagaggggaucgagaauuucgaugucuaugccauuaagcccggacacccucuucaaccagacuuuuuccuggaugaauaccccgaggcaguguccaaaaagguagaaucuacuggcgccguuccugaguuuaaagaagagaaguugcagcuccagccaaaaccgcgaucgggugcuguggaggaaacauuccguauagucaaggacucacugagcgaugacguggugaaggcgacccaggcaaucuaucuguuugagcucaguggggaagauggaggcacgugguucuuagaccugaaauccaagggcgggaacgucggauacggugagcccucugaccaagccgauguugugaugagcaugacuaccgacgauuuuguaaaaauguucuccggcaaacuuaagccuacaauggcuuucaugucagggaaguugaagauuaaaggaaauauggcccuggcaaucaagcuagaaaaacucaugaaccagaugaaugccagacuguga

SEQ ID NO: 57426 - RNA, 1590 nt, Artificial Sequence
  derived and/or modified sequence opt3 from HSF1__Homo_sapiens__NP_005517
auggaccugcccgugggcccuggggccgcuggaccaagcaacgucccggcauuccucaccaaacuuuggacacugguuuccgaucccgacacugaugccuugaucugcuggucuccuucagguaauaguuuucacguguucgaccagggccaauuugcgaaggagguauuaccaaaguacuucaaacauaacaauauggcuagcuuugugagacagcugaacauguauggguucaggaaggucgugcacauugaacagggaggccuaguuaaacccgagcgggaugacacggaauuucagcauccuuguuuccuccgcggucaagagcagcugcuugaaaauauaaagcgaaaggugaccuccgucucuacacugaaaucggaggauaucaagauucgucaggacucagugacuaaauugcucaccgauguacagcugaugaaggggaaacaagagugcauggacagcaagcugcucgccaugaagcacgaaaacgaggcauuauggagagaaguugccagucugaggcagaaacaugcucagcagcaaaagguggucaauaaacuuauccaguuuuugauuucccuggugcagucuaaccggauccuaggagugaagcgcaaaauaccacucaugcugaaugauagcggcuccgcacacucaaugcccaaguacaguagacaauucagccuugagcacguccauggcucugggccuuauuccgccccaucaccggcuuacagcaguucuucccuguaugcccccgacgcgguugcaagcucgggaccuaucauuucugauaucacagaguuggccccagcuucccccauggccucaccugguggcaguauugacgaaaggccacucagcuccucuccccuggugcggguaaaagaggaaccgccuucucccccacagucaccucgcguggaggaagcaagucccgggcgaccauccagcgucgacaccuuacugucucccacugcucucaucgauucaauacuuagagagagugagccugccccagcgagcgugacagcccugaccgacgcaaggggacacacggauacugaaggccggccgcccuccccuccacccaccucuacaccugagaaguguuugucgguugcuugccuagacaagaacgaacugagcgaucaucucgacgccauggauuccaaucuggacaaccuucagacuaugcugucaagucacgguuuuucuguggauaccagcgcuuugcucgaccuguucuccccaucagucacagugcccgauaugagcuuaccggaccuggacucuucccuagccaguauucaggagcuccugagcccucaagaaccaccccguccucccgaggcagagaauagcuccccagauucagggaaacagcuuguacacuacaccgcccagccuuuguuucugcucgaccccggaaguguugauacgggcagcaacgaccugccagugcuuuucgaacugggcgaggggucguauuucuccgaaggagaugguuuugcugaggacccgacuaucucuuugcucacaggcagcgaaccucccaaggcgaaagauccaaccgucucauga

SEQ ID NO: 57427 - RNA, 1557 nt, Artificial Sequence
  derived and/or modified sequence opt3 from HSF2__Homo_sapiens__NP_001129036
augaagcagagcuccaacgugcccgccuuccugucuaaacucuggacgcuugucgaggaaacacacacuaaugaguuuaucacguggucacaaaacggccagaguuuccugguuuuggacgaacagagauuugcuaaggagauuuuaccuaaauacuucaagcauaauaacauggccagcuuugugaggcagcugaauauguauggguuccggaaaguagugcacauagauuccggaaucgucaagcaagaacgcgacgguccaguggaguuucagcauccguacuucaagcagggccaggaugaccuacucgagaacauuaaacgaaagguuucuucgucaaaacccgaagagaauaagauccgucaagaagaucugaccaaaauuaucagcagugcacagaaggugcagauaaagcaggagacaaucgaguccagacuuucugaacugaaaagcgagaacgaauccuuguggaaggaggucucagaacucagggcgaaacacgcucaacagcagcaagugauucggaagaucguacaguuuauuguuacucuggugcagaauaaccagcuggucagucucaaacgcaagagaccuuuacugcuuaauaccaacggggcccaaaagaagaauuuguuccagcauaucgugaaggagccaacagacaaccaccaccauaaagugccccacagcaggaccgagggacugaagccucgggaacgcauaucugaugacauuaucauuuaugaugucacugacgauaaugcagacgaggaaaacaucccaguuauccccgagacaaacgaagaugugauuuccgacccuucaaauugcagccaguacccagacauaguaaucguggaggaugacaacgaggaugaauaugccccggucauucagaguggcgagcaaaaugaacccgcucgagagucucuauccagcgguucggacgggucuuccccucucaugucaagugcagugcagcugaacggaagcuccucucuuaccagcgaagauccaguuacgaugauggacucaauccugaaugauaacauaaauuugcucggcaaaguggagcuguuagacuaccuggauaguauugacuguucccucgaggauuuucaggccaugcuuagcggcagacaguucucuaucgaccccgaccuguuggucgauucagaaaacaaggggcuagagacuaccaaaaauaacgugguacaaccuguuagugaagagggaaggaaaagcaaguccaaaccagacaagcagcugauccaguauacagcuuuuccccuccuggccuuccuugaugguaauccggcgucuucgguggagcaggcaagcacuaccgccuccucagaaguccugaguucuguggacaaaccuauugaggucgaugaauugcucgacagcucccuggaucccgagccaacacaaucaaaguuagugcggcuggaaccucuaaccgaggcugaggccagcgaagcaacccucuucuaccugugcgagcuugcucccgccccauuggacucugauaugccccugcucgacuccuga

SEQ ID NO: 57428 - RNA, 1479 nt, Artificial Sequence
  derived and/or modified sequence opt3 from HSF4__Homo_sapiens__NP_001035757
augcaggaggcccccgcugcacugccuaccgaaccaggcccgagccccgugccugccuuccucgggaagcugugggcgcuggucggagacccagguacagaucacuugaucagauggucccccucuggcacuucauuuuuaguuagugaccaaagcagguucgcuaaagaggugcugccucaguacuuuaagcauuccaacauggccucuuucguacggcagcuaaauauguauggguuucgcaaaguggucucgauugaacagggaggccuccugcgaccagagcgugaucacguggaguuccaacaucccucauuuguuagagguagggagcagcuucuggagcgggugcgcagaaaggucccugcauugaggggagacgaugggcgguggcgcccagaagaccucggccgacugcugggcgaggugcaggcccucagagggguacaggaaagcacggaggcuagguuacgggagcugcgucaacagaacgaaauacuuuggcgcgagguugugaccuugagacagagucacggacagcaacauagggucaucgguaaacugauucagugccuauucggcccgcuccaggcagggcccuccaaugccggaggcaagcggaagcugucucuuaugcuggaugaagguagcuccuguccuacaccagcuaaauuuaacacuugccccuugccuggggcccuccugcaagacccauacuucauccagucacccuuaccggagaccaaucugggacucaguccucaccgagcgcgcggccccauuaucagcgauauaccagaagacucuccuucccccgagggcacaagacuuucaccaagcagugaugggaggcgggagaagggacuggcauugcuaaaagaagaacccgccucuccugguggcgacggggaagcuggacuggcccucgcaccaaacgagugugauuuuugcgugaccgcuccgcccccucugccaguggccgucguucaggcgauccuugaaggcaaggguuccuucagccccgaggggccucgcaaugcccagcaaccagagcccggcgacccgagagaaauuccugacaggggaccacugggcuuggagucgggggaucguucucccgaaucccuccugccucccauguuacugcagccaccucaggagucaguggaacccgcaggaccacuagacguacucgguccgagucugcagggccgggaguggacucuuauggauuuggacauggagcugagccucaugcaaccucuggugcccgaacgaggggagccagaacuugcugucaaaggacugaacucccccucuccuggcaaggauccaacauugggugcuccccuccuguuagacgugcaggccgcccuugggggcccugcacuaggacucccgggcgcccugaccaucuauagcacgccagagucaagaacugcuaguuaccuugggcccgaggcguccccuagcccauga

SEQ ID NO: 57429 - RNA, 1791 nt, Artificial Sequence
  derived and/or modified sequence opt3 from HSF5__Homo_sapiens__NP_001073908
auggaggcccugcucagcacccccaucaacccuaauaacuucccagcuaaacuuuggagacuggucaauuccccgagguaccggucuauucgcugggacggccgaggggaaggauuguuaauagaucagccccuguuugaggcagaacuacucucaccuccaggucccggcgggggaggcgguacagccggggcgggagcugagccugaacuguucaagacuacgaguuuuaccagcuucauccgucaacuuaaccuguauggcuuuagaaaggugguuuugggcgggccaggagguggcaaacccgccgggaauggaccucuccaccauuuccacaacccacauuuuaggcgggaccagccgcagcugcuggugcaccucaagcgcuuaacauccgcaaauaaagccaagcuggcugcaggccuugagguacccugcagaccuccaaacagguuccagcgguugcugauuacuucugccucggcugccaccgcgccccuacaacaucagcagccuccacccccggcagguccucgccccgagccacacgggccuguggccgucggacaguuucaccgaucauucagaagggauagccucagucccuacuccugugugucuacaccaagccaugaccacuccaccuauccccugaagggccuugaucggacuccuguuccacaucguaucuggcaaaauucacugggcaugcacccgggucagguggaaacaagucccaccuuuagcgacaaaggagucccuuucccaguguugcagcgcuuucccacggagguaacuuacacccuccagccuucuacaacuuccguucacgugcaacaggguccacagaccauggucucaagcagucaaaaguauucuaacuacacacccuccgcucaguauagccaggccuacuacccgaccgcagugcugcagugcuguucgccuacgcauauggaugcuuuaucuuccugcgugacuccaacagccucaaguuaugcgcacuguaauuacuuccaaaaccccagcaugcaguccucuuauccugucgaguuccugcccagcaauuggccaugcucaaccacugacgaaaacacaaaaaccgagguuaaucucgaagccguguuucagauuguagaugagcuucauaguuccccuaagcuggaaauggugaaagucgagcccguggaaaaccaguguccaacgagcccgucuuacagaggccaacacaucuuggcaaacucaaauaacaguaauccuugcagcgcuucccaggccucucagcuagagccccugaccccaguugggucggacauaaugagcuucguggucggaacagagcaggcuguggccuguucccucccccaaucaccugaauauaucuacacuauucauaccgcacagccaguagagaacaguacaauccaggaaucugccgcuauucagcaagcgcacguuaagcugaaggagcaccuuaaucauaaccccagcccuuccucaguggucuuugugcaggaaggcccgccauucagcacucaccaggucgaugcaaauaucaaaugccaaaccucuuccagggagaacauacugcccagugagcagaugggguuuuugauuagcgaaauggggccugccucuaagccauccgaggacacaggccucgcuacccccgcccgguaucgagaacaucgcucaaauagucagcagggaaaaagcccugaucugcacuuacugguggacguugcauguaagcaagagagauucccgaaagaagaggagcuaaaggaauga

SEQ ID NO: 57430 - RNA, 612 nt, Artificial Sequence
  derived and/or modified sequence opt3 from HSFY2__Homo_sapiens__NP_001001877
auggcccacgugagcuccgagacccaggacgucucucccaaggaugaacugacagcuucagaggcaaguacuagaagcccucucugcgaacauacguucccaggcgacuccgaucuuaggucuaugaucgaggaacacgccuuucaaguucugucgcaggggucauuguuagagagcccgaguuacaccguguguguauccgagcccgacaaagaugacgauuuccugucucuaaacuuuccucggaagcucuggaaaauuguggaaagcgaccaguucaaguccauaucaugggaugagaauggaacaugcaucgucauuaacgaggaacuguuuaaaaaggagauccuugaaacuaaggcgccauaucgcauuuuccagaccgacgcuaucaaaaguuuugugcgacaacugaauuuguacgguuucagcaagauacagcagaacuuucagcguucugccuuccucgcaacauuucuguccgaggaaaaagagucaagcguucugaguaagaucagauucaccaaaaugaagcucucuagguccagcacuuaugaaaaucgguacuuauguugcaaccugcaucuuaaggaugagucgaauuauucuuga

SEQ ID NO: 57431 - RNA, 888 nt, Artificial Sequence
  derived and/or modified sequence opt3 from HSH2D__Homo_sapiens__NP_001278203
augagaggcagcaggaugucccagcccccucaaugccugcggcgcgcccagucuucauguugccacuucauggugaagcuccuugacgaugggaccuuuaugaucccaggagagaaagucgcucauacaagucuggacgcauugguuacuuuccaccagcagaagccgauugaaccccgacgugaguuacugacgcaaccuuguagacagaaagauccagccaacguggacuacgaagaucuauuucucuauagcaaugcgguagcugaggaagccgcaugccccguguccgccccugaggaggcuucuccaaagcccguccugugucaucagucgaaagaaaggaagccuucagcagagaugaaccggauaaccacaaaggaagccacuagcaguugcccaccgaaaagcccccuuggugagacccgccagaagcuguggagaucuuugaaaaugcucccugagaggggccaacgggugcgccagcagcugaagucccaccuggcuacaguuaaucucuccucauuacuggacgugcgaagaaguaccgucaucagcgggccaggaacuggcaaagguucucaggaucauuccggggaccccacaucaggagauaggggcuacaccgacccuuguguggccacgagccuuaagaguccaucucaaccccaggcgccgaaggaucggaaaguaccuacucguaaggcagaacgcuccguuagcugcauugaggugacccccggcgacagaucguggcaccagauggucgugagggccuugucuucccaagaaucaaaaccagagcaccaggggcuggcugaaccugagaacgaucagcuacccgaggaauaucagcaaccacccccuuucgccccaggauacuguuga

SEQ ID NO: 57432 - RNA, 2565 nt, Artificial Sequence
  derived and/or modified sequence opt3 from HSP90AA1__Homo_sapiens__NP_001017963
augcccccuugcagcggcggggacggauccaccccaccgggucccucucugagagauagggacuguccugcccagucagcugaguacccacgggaucgccucgacccccgaccuggcaguccaagcgaagcauccucucccccuuuccuucguucgagagccccagugaacugguaucaagagaaggcgcaggucuuucuguggcacuugaugguuucagggagcacaacuuuacugugccuauggaaacagccguuccaugugagugcuuuucccguaacggccucccucgcauucaggcagucucaaggagccggccagcaccuguacaaggaucuucagccuuuuauccuguugcggcuccugaugccagaagagacccagacacaagaccagcccauggaagaggaggaaguggagacuuucgcuuuucaggcagaaauugcccagcugaugagccucauaaucaauaccuucuauuccaacaaagagauuuuucugcgcgagcugaucucaaauaguagcgaugcucuugacaagauuagauacgaaucuuugacagauccuuccaaacuggacucagguaaggagcuacauaucaaccucauaccaaauaagcaagauaggacccugacuaucgucgacacagggauuggaaugaccaaagccgaucuuaucaacaaucugggcacgauugcaaagagcggcacuaaagcguucauggaagccuugcaggcuggggccgacaucaguaugauaggacaguuuggugugggcuucuauucugcauaccucguugcugagaaggugaccgucauuacaaaacacaacgacgaugaacaauaugccugggaguccagcgccgggggaucguuuacugugcggaccgacacaggcgagcccaugggucgcgggaccaagguaauccugcauuuaaaggaagaucagacggaguaccuggaggaacgaagaauuaaagaaaucguuaagaaacacucucaguucaucggauacccgauuacucucuucguggagaaggagagggacaaagaagucuccgaugacgaggcggaagagaaggaagauaaagaggaggaaaaggagaaggaagagaaagagucagaagacaagccugagauagaagaugugggcagugacgaggaagaggagaaaaaggauggcgacaaaaagaagaaaaagaaaaucaaggaaaaauauauugaccaggaggaacuuaauaagacaaagcccaucuggacccggaacccagaugacauaacuaaugaggaauacggggaguuuuauaaaagccugacaaacgauugggaggaccacuuggcagugaagcauuucuccgucgaaggacaacuagaguuucgugcuuuacucuucguuccucgcagagcccccuuugaucuguucgaaaauaggaaaaagaaaaacaauauuaaacuuuacgugcggcgaguauuuaucauggacaacugugaggaacugaucccagaguauuugaacuucauucgcgguguggucgauucugaggaccucccccugaauaucagcagagaaauguuacagcagucaaagauucugaaagugauaaggaagaaccuaguuaaaaagugccucgagcuguuuaccgaacuugcugaggauaaagagaauuacaagaaauucuaugaacaguuuaguaagaacaucaaguugggcauucacgaggacucccaaaaucggaaaaagcugagcgaacuccugcgcuacuacacgucugccucaggggaugagauggugagucuuaaagacuauuguaccagaaugaaggaaaaccagaaacauaucuacuauaucacaggagagacuaaggaucaggucgcaaauagcgccuucguggagaggcugcguaagcacggcuuggaaguaauuuacaugauagagccuaucgacgaauauugcguucagcaacucaaagaguuugaagguaagacccugguguccgucacaaaagagggguuagagcugccagaagacgaggaagagaagaaaaagcaggaagagaagaaaacuaaguucgagaaccuauguaaaauuaugaaggauauccucgaaaagaagguggagaaggucgugguuucuaaucggcuggugaccucgccgugcuguauuguaacaagcaccuacggcuggacugcuaacauggaacgaaucaugaaagcgcaggcacuuagagacaauuccacgaugggauauauggccgcuaagaaacacuuggagauaaaccccgaucauucaaucauugagacacugaggcagaaggccgaagcagacaaaaaugauaagagugucaaagaccucgugauccuguuauacgagaccgcccugcuuucuagcggcuucuccuuggaagauccucaaacucacgcuaaccgcauuuaccggaugaucaagcucgggcugggaauagacgaggaugacccaaccgccgaugacacaucagcagcgguuaccgaagagaugcccccucuagagggugaugacgacacuagcagaauggaagagguggauuga

SEQ ID NO: 57433 - RNA, 2175 nt, Artificial Sequence
  derived and/or modified sequence opt3 from HSP90AB1__Homo_sapiens__NP_001258898
augcccgaggaagugcaccauggcgaggaagaggucgaaaccuucgccuuucaggcugagaucgcacaacugaugagccucauuauaaacacauucuacuccaauaaggagaucuuucuuagagaacugauuucuaacgccucagacgcguuggauaaaaucagguaugagaguuuaacugacccuagcaagcuggauuccgggaaagaacuaaagauugacaucauaccaaauccgcaggagcggacgcucacccugguugauacaggaaucgguaugacuaaagcugaccuuauuaacaaucugggcaccaucgccaagucugggacaaaggcauucauggaggccuugcaggcuggagcagauauuucgaugaucggccaguuuggugugggguucuacucagccuaucucguagcugaaaaaguggucgugauaaccaagcacaacgacgaugagcaauacgccugggaaagcagugcgggaggcuccuuuacuguucgcgcagaccauggcgagcccauugggcgaggaacaaaagugauccugcaccugaaggaagaucagaccgaguaucucgaggaacguagagucaaagaggugguaaagaagcauucucaguucauugguuacccuaucacguuauaucuggaaaaagagagggaaaaggagaucagcgacgaugaggccgaagaggaaaaaggcgagaaggaagaggaggacaaagacgaugaagagaagccaaaaauugaagacguuggguccgaugaggaggacgauucaggaaaggacaagaaaaagaaaacuaagaaaauaaaggaaaaguacaucgaucaggaggaacuuaauaaaaccaagcccauuuggacacggaacccugacgauaucacucaagaggaauacggcgaguuuuauaaaaguuugaccaaugacugggaggaucaccuggcugugaagcacuucagcgucgaaggucagcuagaguuucgcgcccuccuguucauaccaagaagggcacccuuugaccuuuucgaaaacaaaaagaagaaaaauaacauuaagcuguacgugcggcgcguguucaucauggacucuugcgaugaguugaucccugaauaucucaauuuuauucgaggggucguugacuccgaggaucugccauuaaacaucucaagagagaugcugcagcagagcaaaauucucaaggugauaaggaaaaauaucguaaagaagugucuugaacuguucagugaguuggcugaagacaaagagaacuacaagaaauuuuaugaagccuucucuaagaaccuaaaacugggcauucaugaggauuccacaaaucggcgucgccucagcgagcugcuuagauaccacaccucgcaaucuggagacgaaaugacgucccugucagaguaugugaguaggaugaaggaaacucagaaaagcaucuacuacaucacaggcgaguccaaggagcaggucgcgaacucugccuuuguggaacggguucgaaagcgcggguucgagguggucuauaugaccgaaccgauugaugaguacugcgugcaacaguugaaagaauuugacggaaagagccucguaucaguuacuaaagagggucuggaguuacccgaagaugaggaagagaagaaaaagauggaagagaguaaggcaaaauucgagaaucuguguaagcuaaugaaagaaauacucgacaagaaaguggagaaggucacaaucuccaacagacuggugagcucuccuugcuguauugucaccucaacguauggcuggaccgcuaauauggaaaggaucaugaaggcccaggcccuucgggauaacaguacaaugggguacaugauggcuaaaaagcauuuggagauuaauccagaccaccccaucguggaaacucugcgccagaaagcagaggccgauaagaacgacaaagcuguuaaggaccucgugguacugcuuuuugagaccgcgcuguugagcuccggauucucucucgaagauccucaaacacacucgaauagaauauauaggaugaucaagcugggcuuagguauugacgaggaugaagucgcagccgaggagccaaacgcugccgugcccgacgaaaucccgccucuggagggggaugaagacgcaagccguauggaggaaguugauuga

SEQ ID NO: 57434 - RNA, 2412 nt, Artificial Sequence
  derived and/or modified sequence opt3 from HSP90B1__Homo_sapiens__NP_003290
augagagcccugugggugcucggccuuugcuguguccuguugaccuucgggagcguuagggcugacgaugagguggacguagauggaacaguggaagaggacuuagguaagucccgggaaggcucucgcacugaugacgaggucgugcagcgagaagaggaggcaauccaacuggaugggcuaaacgccucacagauucgugaacucagagagaaaagugaaaaguuugcguuccaggcugagguuaauaggaugaugaaacugauaaucaacagccuuuacaagaauaaagagauuuuucugcgggaauugaucuccaacgccucugacgcacucgauaagauucgccugaucucgcugacggacgagaaugcccucucaggaaacgaagaguuaaccgugaagauaaaaugcgauaaggagaaaaaucugcuucacgucacagacacuggcguggguaugaccagagaggaguugguaaagaaccuggggacaaucgcuaaaagcggaaccagugaguuccuaaauaagaugacugaagcacaggaagauggccaauccacaucugagcucauuggccaguuugggguuggauucuauagcgccuuucugguggcugacaaggucaucgugaccuccaaacauaacaaugacacgcagcacauuugggaaucagauaguaacgaguucagcgugaucgccgaccccagggguaauacucuuggccgggggaccacaauaacucuggucuugaaggaggaagcgucugauuaccucgagcuggacaccauuaaaaacuuaguuaagaaauauucccaguuuaucaauuucccuauuuacguguggucaagcaagacagaaaccguagaggaaccaauggaggaggaagaggcagccaaagaagagaaggaggaaagugaugacgaggcugccguggaagaggaagaggaggaaaagaaaccgaagacgaaaaaggucgagaaaacugugugggauugggaacugaugaacgacaucaagcccaucuggcaacgcccuucuaaggagguugaagaggaugaguauaaagcauuuuacaaguccuucagcaaagaaucggacgauccaauggcuuauauucauuuuacagccgagggagaagugaccuucaagucuauacucuucguccccacuuccgcgccucgaggccuuuuugacgaguacgguaguaaaaagucagacuacaucaagcuguaugugagaaggguauucauuacagaugacuuucacgauaugaugccaaaauacuugaacuucguuaaggggguggucgacagcgaugaccuaccccugaaugugucccgggaaacccuccagcagcauaaacugcuuaaggucauccguaaaaagcuggugcgcaagacguuggauaugauuaaaaagauagccgacgauaaauauaacgacaccuuuuggaaggaguucggaacaaauaucaaacucggcguuaucgaggaucacucuaacagaacuaggcuggcaaaguuacugcgguuucagagcucacaccauccuaccgacauuacaagucuagaucaauacguggaacgaaugaaagagaagcaggacaagaucuauuucauggcuggcuccagccgcaaagaagccgagucuucaccauuuguagagagacuccugaagaaaggguacgaagucauuuaucuuacugagccgguggacgaauacuguauacaggcuuugcccgaguucgauggaaagagguuucaaaauguugccaaagaaggugugaaguucgacgagagugagaagaccaaagaaagccgggaggcagucgaaaaggaguuugaaccucugcucaacuggaugaaagauaaggcccugaaagacaagaucgagaaggcugugguaucccagcgccuuacagagucuccaugcgcgcugguggcaucgcaguacggcuggagcgggaauauggaaagaauuaugaaagcccaggcuuaucaaaccggaaaggauaucuccacuaacuacuaugccucacagaaaaagacguucgagaucaaucccaggcacccuuugauucgugacaugcuccggcgaauaaaagaagaugaggacgauaagacaguucuggacuuagcagucgugcuguucgaaaccgccacucuaagaaguggcuaccuccugccagauaccaaggcuuauggugacaggaucgagcgcaugcuucgguugucucugaacauugaucccgacgccaaaguggaggaagaaccggaagaggagccugaagagacagcagaagacaccacugaggauacagaacaggacgaggaugaggaaauggacgucgggacggaugaggaagaggaaaccgcgaaggagagcacugcugagaaagacgaacucuga

SEQ ID NO: 57435 - RNA, 2028 nt, Artificial Sequence
  derived and/or modified sequence opt3 from HSPA12A__Homo_sapiens__NP_079291
auggccgacaaggaggcuggcgggagcgauggacccagagaaaccgcaccuacauccgccuacucuucaccagcgaggagucugggugacacuggcaucacgccgcucagccccucccacauugugaacgauaccgacucuaaugucucggagcagcaaucauuccuuguugugguagcuguggauuuugggacaacuagcaguggauaugccuacuccuucaccaaagaaccugagugcauacaugucaugcggcgcugggaaggcggugacccaggggugucuaaccagaagacacccaccacuauccuguugacaccugagcgaaaauuucacagcuucggauaugcagcccgugauuuuuaccaugacuuagauccaaaugaggcuaagcaguggcuguaucuagaaaaauucaagaugaagcuccacaccacgggcgaccugacuauggauaccgaccuuacagcagccaacggcaaaaagguuaaagcucuggagauuuuugccuacgcguugcaguauuucaaggaacaagcacucaaagagcuguccgaucaggccgggucagaguuugaaaauagugacgugagaugggucaucacugugcccgcuauuuggaagcagccugccaagcaguucaugaggcaagcagcuuaccaggccggacuggcgagcccagagaacucugaacagcucaucauagccuuagagccggaagcagcuuccaucuacugucggaaacugcgccuucaucagaugauugaguugucaagcaaggccgcuguaaaugguuauaguggcucugacaccguuggggccggauuuacacaagcaaaagagcacaucagaaggaaccggcagucccgcaccuuccugguggaaaaugucauuggcgagaucuggagcgaacuagaggaaggugauaaguacgugguggucgacuccgggggaggcacgguugaucucacugugcaccagauacgacugcccgagggccaucuuaaagagcuguauaaggccacagggggaccuuacgguucuuugggcguagacuaugaauuugagaaacuccuguacaagauuuucggggaagauuucaucgagcaauuuaagauuaaaagaccagcugcguggguggacuuaaugaucgcauucgaauccaggaagcgggccgcugcccccgaucguaccaacccucugaauaucacucucccauuuucauucauugacuauuacaaaaaguuucgcggacacagugucgagcaugcacuuagaaaaagcaacguggauuucguuaagugguccucucagggcaugcugaggaugagccccgacgccaugaaugcuuuguuuaagccgacaauagauucaaucauugagcaccuacgggaccuguuccagaaaccugaagugaguaccgucaaguuucucuuccugguggguggguuugccgaggcaccccuucugcagcaagcgguacaggcugccuucggcgaccagugccgaaucauaauuccacaggauguuggauugacgauccucaaaggcgcagugcuguuuggguuagacccugccgucaucaaggugcgcagaucgccccugaccuacggagucggugugcuaaacagguauguugaaggcaaacacccacccgagaagcuccuggugaaggaugggacacggugguguacugacguauucgauaaauucauuagcgcugaccaaucugucgcccuuggagaguuggugaagcgcucauacaccccugcaaaaccaagucagcugguuaucgugauuaauauauauagcuccgaacaugauaacgucucuuuuaucacagacccgggcgugaagaaaugcgguacucucagacuggaucuuaccgggacaucgggcaccgcuguacccgccaggcgugagauucagacucugaugcaguucggagacacggaaaucaaggcgacagccaucgauauugcuaccagcaaguccgugaaaguuggcauagacuuuuugaacuacuga

SEQ ID NO: 57436 - RNA, 2061 nt, Artificial Sequence
  derived and/or modified sequence opt3 from HSPA12B__Homo_sapiens__NP_443202
augcuggccgugcccgagaugggccuccaggggcuuuacaucggaagcuccccugaaagaucuccagucccgucacccccugguaguccaaggacccaagagagcugcggcauugcuccccugacaccuucccagucuccaaagcccgaaguucgggcaccucagcaggccucguucucagugguaguggcgauagacuuugggacuacgagcaguggauaugcuuucuccuuugccucugauccagaggcaauccacaugaugcgcaaaugggaaggcggugacccgggggucgcccaccaaaagacccccacauguuuguuacugacuccugagggagcuuuccacagcuuuggcuacaccgcacgagauuauuaccaugaccuagauccagaggaagcccgugacuggcucuauuucgagaaauuuaagaugaaaauucacuccgcuacagaucugacccuuaagacucagcuggaagccgugaacggcaagacaaugcccgcguuggagguuuucgcacaugcccucagauuuuucagggagcacgcucugcaggaacugcgggagcagucaccuagucucccagaaaaagacaccgugcgcugggucuuaacggugcccgccaucuggaagcaaccggcaaaacaguuuaugagagaggcugccuaccuggcggggcuuguaagcagggaaaaugccgagcaguugcugauugcacuagagccugaagcugccucuguuuauugccggaagcuccgccugcaccagcuucuggauuuguccggacgagcucccgguggcgggagacucggagagaggcggucaaucgacagcaguuuccgucaagcccgcgaacagcugagaaggucucggcauucccgaaccuuuuuaguggagagcggcgucggugaacugugggcagagaugcaggccggggaucgcuacgugguggcugacuguggaggcggcacugucgaucucacaguucaccaacuugagcagccacaugggacucugaaagaauuguacaaggcgucgggagguccuuauggcgcaguggggguagaccuagccuucgagcagcugcucugcagaauauucggagaagacuuuaucgcuaccuucaagaggcagcggcccgccgcauggguggaucugacaauugccuuugaggcucgcaaaagaaccgccggcccacacagggcgggugcacuuaacaucucucugcccuucuccuuuauugacuucuaccguaagcaacgggggcacaaugucgaaacggcuuugcgaagaucaagugugaacuuuguuaaauggagcucccagggcaugcucaggaugucuugugaggccaugaaugagcuguuccagccuacugugagcggaaucauacagcauauugaagcauuacuggcccgcccagagguccaaggcgugaagcuacucuuucugguagggggauucgcugaaucagccguucuucagcacgcagugcaggcugccuugggugcgcggggccugagagucguggucccgcaugauguggggcucacaauccugaaaggagccguucuuuuuggccaggcucccggugugguaaggguccgccgaaguccucugaccuauggggugggcguuuugaaccgguucgugccaggacgucaucccccugagaagcuccuggucagagacggcaggcgcuggugcacugauguguuugagcgguucguagcagccgaacaauccguggcuuuaggggaggaaguuagaaggagcuacuguccagcccgacccggacagcgccggguccugauuaaucuauauugcugugcagcggaggacgccagauucaucacagauccgggugugaggaaaugcggcgcucucucucuggaacuugagccugccgacugugggcaggauaccgcaggagcuccacccggccgucgcgagauccgggccgcaaugcaguuuggugacacggaaauuaaggugaccgccgucgauguuucaacaaacagaagugugagggcuagcauagacuucuuguccaauuga

SEQ ID NO: 57437 - RNA, 1416 nt, Artificial Sequence
  derived and/or modified sequence opt3 from HSPA13__Homo_sapiens__NP_008879
auggcccgggagaugaccauccugggcagcgcugugcucacacuucuguuggcaggguacuuagcccagcaauaucugccccuaccuacuccaaaggucauuggaauagaccucgguacgaccuacugcuccguuggcguguucuuuccggggacaggaaaaguaaaggugauccccgaugaaaacggccacauuucuaucccuucaauggucaguuucacugacaaugauguguauguugguuacgagagcguggaacuggcggacuccaacccacagaauaccauuuaugaugcuaaaagguuuaucgggaagauauucacagccgaggaacuugaggcagagaucggacgguaccccuuuaaaguccugaacaagaauggcaugguggaguucucuguaaccucgaacgaaacuauuacaguuucaccugaauaugugggcagccgcuugcuccugaagcugaaagagauggccgaggcuuaccucgggaugccagucgcaaaugccgugaucagugugcccgcugaauuugacuuaaagcagcgaaacuccaccauugaggccgcgaaucuggcaggacuuaaaaucuugcgugucauaaacgaaccuacggccgcugccauggcauacggucugcauaaggcugauguuuuccacgugcuaguaauugaccucggcgggggaacucuggaugugucucuucugaauaaacagggcgguauguuuuugaccagagccaugagcgggaacaauaagcucggaggccaagacuucaaccagaggcuguuacaguaucuguacaagcagaucuaucaaacauacggcuuugucccaucccggaaagaggaaauucaucgccucagacaggcgguggagaugguuaaguugaaucugacuuugcaccagucagcccagcuaagugugcugcucaccgucgaggaacaagauaggaaagagccgcauagcucugacacagaacugcccaaggauaaacuuuccucagcagacgaccaccgggugaacagcggguucggacgcggucugagugauaagaaaucuggcgagucccagguauuguuugaaaccgagaucagccgaaaacucuucgacacgcugaacgaggauuuauuccagaagauccugguuccuauucaacaggugcuaaaggaagggcaccucgagaagacugaaauagacgaggucgugcuggucggaggcucgacaagaaucccaaggauuagacaggugauccaggaauuuuucgguaaagaucccaauaccucuguugacccugaucuugcugugguaacuggggucgccauacaagcuggcauugacggaggcuccuggccacuucaggugucagcccuggagauccccaacaagcaucuccagaaaacaaauuuuaacuga

SEQ ID NO: 57438 - RNA, 432 nt, Artificial Sequence
  derived and/or modified sequence opt3 from HSPA14__Homo_sapiens__NP_001265134
auggccgcuaucggcgugcaccuggggugcaccagcgcaugugucgccguuuacaaggacgggagagcgggugugguagcuaacgaugccggcgacagggugacacccgcagucguggccuauuccgagaaugaagagauuguugggcucgcugcaaaacagucucggauacgcaacaucucaaauacugugaugaaggucaaacaaauucuuggacgacgugugcugaguagagauccucaguugcagcaguuaccacaaccguuccagaggugcagcuguucccugucugaacagccccauggccagacggguugcguacggggagcccaaccucuacaccagcaucagccacagcacucguggggaucacuccauaccgcugacagcagucugcuuuuugaguccugguucuguuuuugguggggcuga

SEQ ID NO: 57439 - RNA, 1926 nt, Artificial Sequence
  derived and/or modified sequence opt3 from HSPA1A__Homo_sapiens__NP_005336
auggccaaggcugcagccaucggcauugaccuggggaccacauacagcugcgugggagucuuccagcacgguaaaguugagauaaucgcgaacgaucaaggcaauagaacuacgcccuccuauguggcuuuuaccgacacagaaaggcucauuggggaugccgcaaagaaccagguagcccuuaauccucagaacacuguguucgacgcuaaacggcugaucggacgcaaguuuggcgauccagucgugcagucugacaugaaacauuggccguuccaaguuauuaaugauggugacaagcccaaggugcaggucucauacaaaggggagaccaaggcauuuuauccugaagagaucaguagcaugguguugacaaaaaugaaggaaauagccgaggcuuacuuaggauauccaguaaccaacgccguuaucacugugcccgcguacuucaaugauucccagcgacaggcaacaaaagacgccggcgucauugcuggccugaacgugcuacguaucauuaaugagccuaccgccgcagcuaucgccuaugggcucgauagaacgggaaagggugaaaggaacgugcugauauuugaccuuggcgggggaacuuucgaugucucuauucugaccaucgacgacggcauuuuugagguuaaggcgacagccggugauacucaccuugggggagaagacuucgauaaucggcucgugaaccauuuuguagaggaguucaaacgcaagcacaaaaaggacaucucgcaaaauaaaagagcagugaggcggcugcgcaccgcuugugaacgagccaagagaacacugucaagcaguacccaggcuucccucgagaucgauucuuuauuugaaggcauugacuucuacacgagcauaacuagggcccgguucgaggaacugugcuccgaucuuuuucguucaacauuggagccagucgagaaagcacugcgcgacgccaagcuagauaaggcucagauccaugaccucgugcugguuggcgggaguacccggauucccaaagugcagaaguugcugcaagauuucuuuaacggaagggacuugaauaaaagcaucaacccugacgaagcggucgcauacggugccgcugugcaggccgcaauacucaugggcgauaagucugagaacguacaggaccuguuacugcucgauguugccccacuuucccugggguuggaaacugcuggaggcgugaugacagcccuaauuaaaagaaauucaaccaucccgacgaagcaaacccagaucuucacaacuuauagcgacaaccagcccgguguccugauucagguguacgagggggaacgagcaaugaccaaggauaauaaccuccugggccgcuuugagcuuaguggaaucccuccagcgcccagaggcgucccucaaauugaggugacauucgacauagaugcuaaugggauccugaacguuacugccaccgacaaaucuacaggaaaggcaaauaaaauuaccaucacuaacgauaaggguagguuguccaaagaagagaucgaacggauggugcaggaggccgaaaaguauaaggcugaggacgagguacagcgcgaaagagucagcgccaaaaaugcacucgagucguacgcuuuuaacaugaagucugccguggaagaugagggccugaaagggaagauuuccgaggcggacaaaaagaagguuuuagauaaaugucaggaagugauaucauggcuggacgccaauacgcuagcugagaaggacgaguucgaacacaaaaggaaggaacucgagcaagucugcaacccaaucauuaguggacuguaucagggcgccggugggcccggcccgggaggcuuuggggcacagggaccuaaagguggcagcggguccggacccacaaucgaggaaguggauuga

SEQ ID NO: 57440 - RNA, 1926 nt, Artificial Sequence
  derived and/or modified sequence opt3 from HSPA1L__Homo_sapiens__NP_005518
auggccaccgcuaagggcaucgcaauugggauagaccugggaacaacuuacagcugcgugggugucuuccagcacggcaaaguugagaucauugccaacgaucaagggaauagaacgacccccuccuauguggcguuuacagacacugaaaggcucaucggagaugcugccaagaaccagguagcaaugaauccucagaacaccguguucgacgccaaacggcuuauuggccgcaaguuuaaugauccagucgugcaggcugacaugaaacuguggccguuccaaguuaucaacgagggugggaagcccaagguguuggucucuuacaaaggagaaaauaaggcauuuuauccugaggaaauaucaaguaugguguuaacaaaacugaaggagaccgccgaggcuuuccuaggccauccaguaacuaacgccguuaucacagugcccgcguacuuuaaugauagccagcgacaggcaaccaaagacgccggcgucauugcugggcucaacgugcugcguaucauuaaugaaccuacggccgcagcuaucgccuauggacuugauaaggguggccagggggagagacacgugcugauauucgacuugggaggcgguacuuuugaugucuccauucucaccaucgacgaugggauuuucgaaguuaaggcgacagccggagacacucaucugggcggcgaggacuuugauaacaggcuggugucucacuucguagaggaauuuaaacggaagcauaaaaaggacaucucgcaaaauaaacgcgcagugagaaggcuccggaccgcuugugagcgcgccaagcgaacauuaucaagcaguacccaggcuaaccuggaaaucgauucccuuuacgaggggauugacuucuauacgucuauaacuagagccagguucgaagaguugugcgcagaucuguuucggggaacacuagagccagucgaaaaagcccuccgugacgcuaagauggauaaggcgaaaauccacgacauugugcugguugguggcagcacccgcauccccaaggugcagagacuucugcaggauuacuucaaugggagggacuugaacaaauccauaaacccugaugaggcagucgccuacggagcugccgugcaagcagccauucucaugggcgacaagucagaaaaaguacaggaccuguuacugcucgauguugcuccacuuagucuggguuuggagacugccgggggcgugaugacagcacuaaucaagcggaauagcaccaucccgacgaagcagacccaaauuuuuacaacuuauucugacaaccagcccggaguccugauccagguguacgaaggcgagcgagcgaugaccaaagauaauaaccuccuggggcgcuucgaccuuacagggauuccuccagcucccagaggugucccucagauagaggugacuuuugauaucgacgccaauggcauucugaacguuaccgcaacagauaaguccaccgggaaagugaauaagaucacuaucacgaacgacaaaggaagguugucaaaggaagagauugaacggaugguacucgaugccgagaaguauaaagcugaagacgagguccaacgcgagaagauagccgcuaaaaaugcacuggaaagcuacgccuucaacaugaagagugugguuucugaugagggcuuaaaagguaagaucuccgaaagcgacaagaauaaaauucuggauaaguguaacgagcuacucucguggcuggaggugaaucagcuugcggaaaaagacgaguuugaccacaagagaaaagaauuggagcagaugugcaacccaaucauuacaaagcuguaucagggaggcuguaccggacccgccugcggcacuggguacgucccgggaaggccugcuaccggucccacaaucgaagagguggauuga

SEQ ID NO: 57441 - RNA, 1920 nt, Artificial Sequence
  derived and/or modified sequence opt3 from HSPA2__Homo_sapiens__NP_068814
augagcgccagaggccccgcuaucgggauugaccugggaaccacauacuccugcgugggugucuuccagcacggcaagguugagauaaucgcaaacgaucaagggaauaggacuacgccuucuuauguggccuuuaccgacacagaacggcucauuggagaugcggcuaaaaaccagguagccaugaauccaacuaacaccaucuucgacgcaaagcgccuuauuggccgaaaauuugaggaugccacagugcagucagacaugaagcauuggccguuccgugucgugagugaaggugggaaacccaagguucagguggaguacaagggagaaaccaaaacauuuuucccugaggagaucagcuccaugguccugacuaagaugaaagaaauagcugaggcauauuugggcggcaaggugcacucugccguaaucaccguuccagcuuacuuuaaugauucgcaaagacaggccacgaaagacgcggggacuauuaccggauuaaacgugcugaggaucauuaaugaacccacagcagccgcuaucgccuauggucuagauaagaagggcugugcagggggagagaaaaacguccucauauucgaccugggcggugggacuuuugaugugucaauucuuaccaucgaggacggaauuuucgaagucaagagcacagcuggcgauacccaucugggcggggaggacuuugacaaucggauggugagucacuuggccgaagaguucaaacgcaagcauaaaaaggauaucggaccuaacaaaagagcgguuaggcggcuccgcacggccugcgaacgagcaaagagaacucuguccucuagcacacaggcuuccaucgagauugacucacuguacgaggguguggauuuuuauaccaguauaacuagggcccgguucgaggaacucaaugcugacuuauuccguggcacacuggaaccaguagagaaggcccuucgcgaugcaaaauuggacaaggggcagauccaagaaauugugcuggucggaggcagcaccagaauccccaaaauacagaagcuacuccaggacuuuuucaacgguaaagagcugaauaagucuauuaacccugaugaggccguggcuuacggggcggcaguucaggccgcuauccuuaucggcgauaaguccgaaaaugugcaagaccuguugcuccuggaugucacgccauuaucacugggaauugagaccgccggcggggugaugacaccgcucaucaaaaggaacacuaccauucccacaaagcagacucagaccuuuacaaccuacagcgacaaccaaaguucuguacuuguucagguguaugaaggagagcgggcaaugacuaaagacaauaaccuguuggguaaguucgaucuaacgggcauaccuccagcuccccgaggggucccucagaucgaagugacauuugacauugaugccaauggaauccugaacgucaccgccgcagacaaauccacuggcaaggagaauaagaucaccauuacaaacgauaaaggucgccucagcaaggacgauauagacagaauggugcaggaggcggaaagguacaaaucggaggaugaagcuaaucgggaccgcguugccgcaaagaacgcccuggagucuuauaccuacaauaucaaacaaacuguggaggaugaaaaacuuagagggaagauuuccgagcaggacaagaacaagauccuggauaaaugucaggaaguaauuaauugguuggacaggaaccagauggcugagaaggacgaauaugagcacaaacaaaaggagcucgaacgugucugcaauccaaucauaucaaaacuguaccagggcggacccggcgggggaagugguggcgggggaagcggcgccuccggugggccgacaaucgaggaaguggauuga

SEQ ID NO: 57442 - RNA, 2523 nt, Artificial Sequence
  derived and/or modified sequence opt3 from HSPA4__Homo_sapiens__NP_002145
augagcguggucggcaucgaccugggguuccaguccugcuacguugccguggcuagagcaggagguauugagaccauagccaacgaauauucugauagguguacacccgcgugcaucucauuuggcccuaagaaucggaguauuggggcugccgcaaaaagccaaguaaucuccaacgccaagaauacugugcagggauucaaacgcuuucacggccgagcuuucucugacccauuugucgaggcagaaaagucgaaccucgccuacgauauugugcagcuuccgacgggucugaccgggaucaaaguuacauauauggaggaagaacguaauuucacuaccgaacaggugacagcuauguuguuaucaaagcugaaggaaaccgccgagagcguccucaaaaagcccgugguagacuguguugugagugucccuugcuuuuacacugaugcggaaagaagguccgugauggacgcaacacaaauagccggacuaaacugucugcggcuuaugaaugagaccacggcuguggcccuggcauauggcaucuacaaacaggauuugccagcucucgaggaaaagccccgcaacgucguuuucguggacaugggccauucugccuaucagguaagcgugugcgcguuuaauagagggaaacugaagguccuggccacugcauucgauaccacacucggagguaggaaguuugacgagguguuaguuaaccacuucugugaagaguuuggcaaaaaguacaaacuggauauuaaguccaaaauccgggcucuuuugcgccugucacaggaaugcgagaagcucaaaaagcuaaugagugccaaugcuagcgaccugccucuuucuauugaguguuucaugaacgauguggacgucuccgggacuaugaaucgaggaaaguuccuggaaaugugcaacgacuugcucgccagaguggagccaccccugaggucaguauuagaacaaaccaaacugaagaaagaggauaucuacgcaguugaaauagugggcggugccacacggauuccugcugucaaggagaaaaucagcaaguuuuucgggaaggagcucaguaccacgcuuaaugcggacgaagcagugacucguggaugugcccugcagugcgcuauuuugucuccagccuuuaaaguccgcgaguucuccaucacagaugugguuccguaucccaucagccuaagauggaacucgccugcagaagaggggucuuccgacugcgaaguguuuucaaagaaccaugccgcuccauucaguaaaguacugaccuuuuacaggaaggagcccuucacucucgaggccuauuacagcuccccucaggaucugccauaucccgacccggcaauugcgcaguuuucuguccaaaaagugacaccucagagcgauggcucaaguuccaagguuaaggugaaaguccgggugaauguacacggcauauucagcgugucuucagcuagucuuguugaaguccauaagagcgaggaaaacgaggagcccauggaaaccgaccagaaugccaaagaggaagagaagaugcaaguggaucaggaggagccacacguggaggaacagcagcaacagacgccugcagagaacaaagccgaauccgaggaaauggagaccucucaggcuggaucgaaggacaagaaaauggaucagcccccacaagccaagaaagcaaaggucaaaacaagcacuguugaccugcccaucgagaaucaguugcucuggcagauugaccgagaaaugcugaacuuauacaucgagaaugaagguaagaugauaaugcaggauaaacuggagaaggaacgcaacgacgcuaagaaugccguggaggaguauguguacgaaaugagagauaaacuauccggcgaguacgaaaaguuuguaucagaggacgauaggaacaguuucacccucaaacuggaggacacagaaaauuggcuuuaugaggauggggaagaccaaccuaagcaggucuacguggauaaauuggcggagcugaagaaccucggacagccaauuaagauccgguuucaggaaucugaggagcgcccgaaacuguucgaggagcuuggcaagcaaauccagcaguauaugaaaauuaucagcuccuucaagaauaaagaagaccaauacgaucaccuggacgccgcugauaugacuaagguugagaagucaaccaacgaagcaauggaguggaugaauaacaaauugaaccuccagaauaagcagagccugacaauggaccccguggucaaaucuaaggagauugaagccaaaauaaaggaguuaaccuccacuuguaguccuaucauuagcaagccaaaacccaagguggaaccuccaaaagaggaacagaagaacgcugagcaaaauggucccguugacgggcagggcgauaacccgggaccucaggccgcagagcagggcacggacacagcggugccaucugauuccgacaaaaagcugcccgaaauggauaucgacuga

SEQ ID NO: 57443 - RNA, 2520 nt, Artificial Sequence
  derived and/or modified sequence opt3 from HSPA4L__Homo_sapiens__NP_055093
augagcguggucggcaucgaccugggguuccucaacugcuacauugccguugcuagauccggagguauagagaccaucgcaaaugaauauucugauagguguacacccgccugcauuucacuuggcagucggacucgcgcgaucgggaacgcugccaagagccagauugugacgaauguacgaaacaccauccacggauuuaaaaagcugcauggccguuccuucgacgauccuauagugcaaacagagagaaucagguugccauacgaauuacagaaaaugccgaaugguucugcaggggucaaggugcgguaucuggaggaagagagacccuuugccauugagcagguuacuggaaugcuacucgcuaaacugaaggaaaccucggagaacgcacuuaagaaaccuguggccgacugugucaucucaauucccagcuucuuuacagaugcugaaagaaggagugugauggccgcggcacagguagccggccugaauugcuugcggcucaugaacgagaccacugcuguugcccuggcauacggcaucuauaagcaagaccugccaccucucgaugagaaaccacgcaauguggucuucauagacauggggcacuccgcuuaccagguguuagugugugccuuuaacaagggaaaacugaagguccuugcgacaaccuucgaucccuauuuggguggccgaaauuuugacgaagcccugguugauuacuucugcgacgaguuuaagacgaaauacaagauuaacgugaaagaaaauucuagagcacuacucaggcuguaucaggagugugaaaaacuuaagaagcugaugagcgcuaacgccuccgauuugccucucaauaucgagugcuucaugaacgaccuggacguaucaaguaaaaugaaccgggcucaguuugagcaauuaugugccagccugcucgcacguguggaaccaccgcuuaaggccgucauggagcaggcuaaucugcagcgcgaagauauuucuuccaucgagaucguugggggagcgacucgcauucccgcagugaaggaacagauaaccaaauucuucuugaaggacaucucaacaacucuaaacgccgaugaggcuguggccaggggcugcgcacugcaaugugccauucucagcccugcuuuuaaaguccgggaguucaguaucaccgaccuggugccauacucuauaacacuucgauggaagaccuccuuugaagaugguagcggggagugcgaaguauucugcaaaaaucaucccgccccuuuuucgaagguuauuacguuccacaagaaagagccauuugaacuggaggcauucuauacuaacuugcaugaggugcccuacccggacgcgcgcaucggaucuuuuacaauccagaaugucuucccucaguccgauggcgacucaaguaaggugaaagucaaggugagaguuaacauucacggcaucuuuagcguggcuuccgccucuguaauugaaaaacaaaaucucgagggggaucacagcgacgcacccauggaaaccgagacuucauucaagaacgagaauaaggauaacauggacaaaaugcaggucgaccaggaagagggacaucagaagugucacgccgaacauacaccagaggaagagauagaucacaccggugcuaaaacgaagagugccguguccgacaaacaagauaggcugaaucagaccuuaaagaagggcaaaguuaagagcaucgaccugccuauucagucuucacuaugccggcagcucgggcaagaucugcuuaacaguuauaucgagaaugaaggaaaaaugaucaugcaggacaaguuggagaaagaacgcaacgaugcaaagaaugcuguggaggaauacgucuaugacuuuagagauaggcugggcacaguguacgagaaauucauuacucccgaggaccucagcaagcuguccgccguacuugaagauaccgagaacuggcuguacgaagacggugaggaucagccaaaacagguguauguugacaaguugcaagaacucaagaaauacgggcagcccauacagaugaaguauauggagcacgaggaacguccuaaagcgcugaacgacuuaggcaagaagauccagcuggucaugaaagugauugaggccuaccggaauaaggaugaacgauaugaccaucuagauccaacagagauggagaaaguggaaaaguguaucucugacgcuaugucguggcucaacagcaaaaugaaugcacaaaacaagcugucccuuacucaggauccggucguuaaggugucagagauuguggccaaaaguaaggaauuggacaauuucugcaaccccaucauauacaaaccuaagccaaaagcugagguacccgaagauaagccuaaggccaauucugagcacaacggaccaauggacggccagagcgggaccgagacaaaauccgauucaaccaaggacagcucucaacauacuaaauccaguggagaaauggaggucgauuga

SEQ ID NO: 57444 - RNA, 1965 nt, Artificial Sequence
  derived and/or modified sequence opt3 from HSPA5__Homo_sapiens__NP_005338
augaagcugagccucguggccgcuaugcuucuguuguuauccgcagccagagcggaggaagaggacaaaaaggaagaugucggcaccguuguggggaucgaccugggaacaacuuacucuugcguagguguguucaaaaacggcagggucgagauuauagcuaaugaucaggggaaccggaucacgcccucauauguggccuuuaccccugaaggagagcgccuaauuggcgacgcagccaagaaucaacucacaaguaacccagagaauacuguuuucgaugcuaaacgacugaucggucguaccuggaacgacccgagcgugcagcaggauauuaaguuucuucccuucaaggucguggaaaagaagacaaaaccuuacauccagguagacauagggggaggccaaaccaagacuuuugcaccagaggaaaucuccgccaugguucugacaaaaaugaaggagaccgcugaggccuauuugggcaagaaagugacgcacgcggucgugacugugcccgcauacuucaaugaugcccagagacaggcuaccaaggacgccgggacaauugcaggacucaacgucaugaggaucauuaaugaaccuacugcugccgcgaucgccuauggucuggauaaacgggagggcgaaaagaacauacugguuuuugaccucgggggaggcaccuucgaugugucuuuacugacaauugacaaugguguauuugagguggucgcaaccaacggggacacgcaucuuggaggcgaagauuucgaccagcgcgugauggagcacuuuaucaaauuguacaagaaaaagacuggcaaggauguuagaaaagacaauagggcugugcaaaagcugcggcgcgaggucgaaaaagccaagcgagcucuaucgucacagcaucaggccagaauugagaucgaaucuuucuaugagggggaagauuuuagugagacacucaccagggcaaaauucgaggaacugaacauggaccuuuuccgguccacuaugaagccagugcagaagguacuggaggauucugacuugaaaaagagcgauaucgacgaaauuguucucgugggagguuccacacguauacccaaaauccaacagcuggucaaggaguuuuucaauggcaaagaaccuucacgcgggauuaacccagaugaggccguggcuuacggagcggcaguccaggccggcguguuaaguggugaccaagacaccggggaucugguucuccuugacguguguccgcugacguugggcaucgagaccguaggaggcgucaugacaaagcuaauacccagaaacacugugguuccuaccaagaaaagccagauuuuuagcacagcuuccgauaaucagccaacugugaccaucaaggucuacgaaggggagaggccccugacaaaagacaaccaccuccugggaaccuucgaucuuacugguaucccuccagcaccccggggcgugccgcagauugaaguaacguuugagaucgacgugaaugggauucugcgaguuacagccgaggauaagggaaccggcaacaaaaauaagauaacuaucaccaacgaccaaaaucgcuugacaccugaagagauugaaagaauggucaacgaugccgagaaguucgcugaagaggacaaaaagcucaaagagaggaucgauacccggaaugaacuggagucauaugccuacagcuuaaagaaccagaucggugacaaagaaaagcuagggggcaaacugaguucugaggauaaggaaacuauggagaaggcaguggaggagaaaauugaauggcucgaaucccaucaggacgcggacauagaggauuuuaaggcuaaaaagaaagaacuggaggagaucgugcagcccauuaucagcaaacuuuauggaucggccggcccaccucccacaggggaagaggacacggcagaaaaggaugaguuguga

SEQ ID NO: 57445 - RNA, 1932 nt, Artificial Sequence
  derived and/or modified sequence opt3 from HSPA6__Homo_sapiens__NP_002146
augcaggcccccagagagcuggcugugggcaucgaccucgggaccacauacagcugcgucggaguuuuccaacaggguaggguggaaauucuugcaaacgaucagggcaaucggacuacgccuuccuauguagccuuuaccgacacagagcgccuggugggggaugcggcuaagucucaggccgcauugaacccacacaauacugucuucgacgccaaacgauuaauaggacguaaguuugcugauaccacagugcaaucagacaugaaacauuggccguucagaguugugagugaaggcgguaagcccaaagucaggguguguuaccgcggggaggauaagaccuuuuauccugaagagaucagcuccaugguacugucuaagaugaaagagacugcagaagccuaccuaggacagccaguuaagcacgcugugauuacaguccccgccuauuucaacgacucgcagcggcaggcgaccaaagaugcaggcgccaucgcuggccucaaugugcugagaauuaucaacgagccuacggccgcagcuauagccuacgggcuugacaggcggggagcgggugaacgcaaugugcugaucuuugauuugggcgggggaacuuucgacgucucaguucucagcauugaugccggcguguuugagguaaaggcaaccgcuggugacacacaucucgggggagaggacuucgauaaccgacuggugaaucacuuuauggaagaguucagaaggaaacauggcaaggaccugaguggcaacaagcgggccuuacgucgccugagaacugcuugcgaaagggccaaacggacccuuuccucuagcacacaagcaaccuuggagaucgauucccuguuugaaggggucgacuucuauacgucaauuacucgagcccgcuucgaggagcuauguagugaucucuuuagaagcacacuggaaccaguggagaaggcucuuagggacgcgaaacuggauaaggcacagauccacgacguuguguuggucggagguucuacccggauacccaaagugcagaagcuccugcaggauuucuuuaauggcaaagaauuaaacaaguccauuaauccugacgaggccguagcuuacggggccgcaguucaagccgcugugcugaugggagauaagugcgaaaaaguccaggaccuccuucuguuggacguggccccacuaucacugggccucgagacugccgguggggucaugacaacccugauccagcgcaacgcgacgauuccgaccaagcaaacacagacuuucaccacauacagcgauaaucagcccggcguguuuauccagguuuaugagggagaaagagcuaugacuaaagacaacaaccuucugggcagguucgaguugagugggaucccuccagcaccccguggagugccucaaauugaaguaaccuuugauauagacgcaaaugguauccucucugucacagccaccgaucgguccacuggcaaggcuaacaaaauuacgaucacaaaugacaaggggcgacugagcaaggaggaaguggagagaaugguucacgaggccgaacaguacaaagcagaggaugaagcucagagggaccgcguggccgcgaagaacucguuagaggcccaugucuuccacgugaaaggaucucugcaggaggaaucccuacgggauaagauaccagaggaagacagaaggaaaaugcaagauaagugucgcgagguacucgcuuggcuggaacauaaucagcuugcagagaaggaggaauaugagcaccagaaacgagaauuggagcagauuugccggcccaucuuuucacgucuguacggcgguccgggggugccuggcggaaguagcuguggcacccaagccagacagggggaccccuccacuggaccaaucauugaagagguugauuga

SEQ ID NO: 57446 - RNA, 1941 nt, Artificial Sequence
  derived and/or modified sequence opt3 from HSPA8__Homo_sapiens__NP_006588
augagcaagggccccgccguggggaucgaccugggaaccacauacuccugcgucgguguuuuccagcacggcaaaguggagauuauagcuaacgaucaagggaauagaacuacgccuucuuauguagcauuuaccgacacagaaaggcucaucggagaugccgcgaagaaccagguggcuaugaauccaacuaacaccgucuucgacgccaaacggcuuauuggccgccgauuugaugacgcagugguucagucagauaugaagcauuggccguucaugguggucaaugacgccggucgucccaaagugcagguagaguacaagggggaaacaaagaguuuuuauccugaggaaguuagcuccauggugcugaccaaaaugaaggagaucgcugaggcauacuugggaaaaacugucacaaacgccguggugaccgucccagcuuauuucaaugauucucaaagacaggccacgaaggacgcgggcacuauugcaggcuuaaacguucugaggaucauaaaugaacccaccgccgcugccaucgcauacgggcuagauaaaaaggugggagcugagcggaacguacucauuuuugaccuggguggcgggacauucgaugugucgauccuuacuauugaagacggaaucuuugaggucaagucaaccgccggcgacacacaccuggguggggaggauuucgacaaucgcauggugaaccauuuuauagcggaauuuaaaagaaagcacaaaaaggauauuagcgagaauaaaagggccguucggcgcuugcgaaccgcaugugaaagagcuaagaggacgcucaguuccucuacucaggccagcaucgagauugacucccuguaugaaggaaucgauuuuuacacaucaaucacccgggcucguuucgaggagcugaacgccgaccucuuccgcggcacuuuagauccuguggaaaaagcacugagagacgccaaacuugauaagagucagauucaugacauagucuuggugggcgggagcacaaggaucccaaagauucaaaagcugcuacaggauuucuucaauggaaaagagcucaacaagucuaucaaccccgacgaagcuguagcguacggugcagccguucaggcugccauacuguccggcgacaaaucagagaaugugcaggaucuucuguugcucgacgucaccccucugagcuuagggauugaaacggcaggaggcgugaugaccguccugaucaagcggaacacaacuaucccaaccaagcaaacacagacuuuuaccacauauagugauaaucagccgggugugcucauucaaguuuacgagggggagcgagccaugaccaaagacaacaaucuucugggcaaguucgaauugacuggaaucccucccgcuccacgcggcgugccccagauugagguaacguuugauauagacgccaacgggauccuaaaugucucugcaguggauaaauccacaggaaaggaaaacaaaauuaccaucacuaaugacaaggguagacugagcaaggaggauaucgaaaggaugguucaggaggcggagaaauauaaggcugaagacgagaaacagcgggauaaggugucgucuaaaaacucccucgaaucauacgccuucaauaugaaggcaaccgucgaggacgagaagcugcaaggcaaaauuaacgaugaagacaagcagaaaauacuugacaagugcaaugagaucauuaacuggcuggauaaaaaucagacagccgaaaaggaggaauuugagcaccagcaaaaagaguuggaaaagguguguaacccuaucauuaccaagcucuaucagagugcugggggaaugccaggcgguaugcccgggggcuucccgggaggcggggccccucccagcggaggugcauccucuggcccaacuaucgaggaaguagacuga

SEQ ID NO: 57447 - RNA, 2040 nt, Artificial Sequence
  derived and/or modified sequence opt3 from HSPA9__Homo_sapiens__NP_004125
augaucagcgccuccagagcugcagccgcgaggcuggugggcgcugccgcaucucgggggcccaccgccgcucgccaccaggacucauggaacggacucagucaugaggcauuccgacuugucagccguagagauuacgccuccgaagcuauuaagggugccguugugggcauagaccuggggacaacuaauucuugcguagcggugauggagggaaaacaagcaaaggucuuggaaaacgccgagggcgcuaggacgaccccuucggugguugccuuuacagcagauggugaacgguuaguggggaugccagcuaaacgccaggccgucacuaauccgaacaauaccuucuaugcgacaaagagacugaucggaaggcgguacgacgaucccgaggugcagaaagacauuaagaacguaccuuuuaagaucguucgcgccucaaauggcgaugcauggguggaggcucacggcaaacuauauagcccaagucagauuggggccuucguccucaugaagaugaaagaaaccgcugagaacuaccugggacauacugccaagaaugcagugaucacagugcccgccuauuuuaacgacucccaacgacaggcuaccaaagaugcgggucagauaucuggccuuaauguccugagaguuaucaacgaaccuacggcagccgcuuuggccuacgggcucgacaagagcgaggauaaggugauugcaguauaugaccugggaggcgguacuuucgauaucuccauucuggagauccagaaagggguguuugaagucaagucaaccaauggagacacauuccucggcggcgaggacuuugaucaagccuuacugaggcacauagugaaagaguucaagcgggaaacugggguugaccuuaccaaagauaacauggcuuugcagcgugugcgcgaagccgcagagaaggcgaaaugugagcugaguagcucuguccagacagacauuaaucuaccauaccucaccauggauuccucaggacccaagcaucugaacaugaaguugacgagagcucaguuugaagguaucgugacugaccugauuaggcggacaaucgccccuugccaaaaagcaaugcaggaugccgagguaagcaagagugacaucggcgaaguuauuuuggucgggggaaugacccgaaugccaaaagugcagcaaacugugcaggaucucuucggccgcgcuccgucuaaggccgucaaccccgacgaggcaguggcuauaggugccgcgauccaagggggcguucuggccggagaugugacagacguauuacugcucgacgucaccccucuuucccugggcauugaaacgcuugggggaguguuuaccaaacuaaucaauagaaacacaacuauaccaaccaaaaagagccagguuuucucgacagcugcagauggucagacucagguggagauuaaggucugucagggcgagagggaaauggccggggacaauaagcugcucggacaguucacccugaucggcauucccccugcuccacggggugugccccaaaucgagguaacauuugauaucgacgccaacgggauugugcacguuucugcaaaagauaagggcaccggacgcgaacagcagauagucauccaguccucaggcgggcuuaguaaagacgauauugagaauauggugaagaacgcggaaaaguacgccgaggaggacagaaggaaaaaggaacguguggaggcugucaauauggccgaaggaaucauccacgauacugagacgaaaauggaggaguucaaggaccaacugccggcagaugaaugcaacaaauugaaggaagagauuagcaagaugcgggaacuccuggcucgaaaagacuccgagacaggugagaauauaagacaggccgcaucuagcuuacagcaggccucacugaagcuauuugaaauggcuuauaaaaagauggcgagugagagggaaggcuccgggagcucuggaaccggcgagcaaaaagaagaucagaaggaggagaaacaguga

SEQ ID NO: 57448 - RNA, 618 nt, Artificial Sequence
  derived and/or modified sequence opt3 from HSPB1__Homo_sapiens__NP_001531
augaccgagagaagggugcccuucagccugcuccggggcccuuccugggacccauuucgcgauugguacccgcacucucgacuuuucgaccaggccuuugggcugccccguuugccugaagaguggucacaaugguuaggagguaguagcuggccaggcuaugucagaccccugccuccagcugcaaucgaaucccccgccguugcggcuccugccuacucuagggcacuaucgcggcagcucucaagcggggugagugagauucgccauacagccgauagauggaggguaucccuggacgugaaccacuucgcuccagaugaacuuacugucaagacgaaagacggagugguugagauaaccggcaagcaugaggaacggcaggaugagcacgguuauaucucucgcugcuuuacacgaaaauacacucugccgcccgggguggacccuacccaggucagcuccucauugaguccagaaggaacacucaccguggaggcacccaugccuaagcuggccacucaaagcaaugagauuacaaucccaguaaccuucgaaucuagagcucagcugggcggccccgaggccgcgaaauccgaugaaacggcagccaaguga

SEQ ID NO: 57449 - RNA, 549 nt, Artificial Sequence
  derived and/or modified sequence opt3 from HSPB2__Homo_sapiens__NP_001532
augagcggcagauccgugccccacgcccauccugcuaccgcagaguacgaguucgccaacccaucuaggcugggggaacagcgguuuggagaaggucuccuuccggaggaaauccugacacccacuuuguaucacggcuacuauguccgcccucgagcggcuccagccggggagggaucacgugcaggcgccagugaguuaagacugagcgaagguaaguuccaggcuuuucuagacguuucccauuucacgcccgaugaggugaccguaaggacaguggacaaucuccuggaagucucugcacggcacccucaacgccuugauagacauggguuugugucgagggaguucugccggacuuacguucugccagccgacguggaucccuggcgcguccgagcugccuugucacacgacggcauucucaaccuggaggcgccuagaggaggcaggcaccuggauaccgaagugaaugagguauauauaagccucuuaccagcaccgcccgacccugaagaggaagaggaggccgcuaucguugaaccauga

SEQ ID NO: 57450 - RNA, 453 nt, Artificial Sequence
  derived and/or modified sequence opt3 from HSPB3__Homo_sapiens__NP_006299
auggccaagaucauucugagacaccucauagagauccccgugagguaccaggaagaguucgaagcucggggccuugaggacugccgccuggaucaugcauuguaugccuuaccugggccaaccauugucgaccugcgaaaaacacgugcggcucaaagcccgcccguugauuccgccgcagaaacuccuccaagagagggaaagucucacuuucagauccuacucgacgugguacaguuccugcccgaggauauuaucauacagacguuugaagguuggcuucugaucaaagcccaacauggcaccaggauggacgagcacggguucauuucacggaguuuuacacgccaguacaaguugccugauggaguggaaaucaaagaccucagcgcuguccugugucaugauggcauucuggugguugaggugaaggacccagucgguacuaaguga

SEQ ID NO: 57451 - RNA, 483 nt, Artificial Sequence
  derived and/or modified sequence opt3 from HSPB6__Homo_sapiens__NP_653218
auggagauccccgugccuguccagccaagcuggcugagaagggccuccgcuccgcuccccggccuuucugcaccugggcggcuguucgaccaacgcuuuggagaagguuuguuagaggccgaacuggcggcucuaugcccaaccacacucgcccccuacuaucugcgagcaccuucaguugcccuuccaguggcucagguacccacugauccuggccacuucagugugcuguuggacgucaagcauuuuagcccagaggaaauugcagugaaaguugugggggagcacgucgaggugcaugcccgucacgaagagagaccggaugaacauggauucguagcuagggaguuucaccggcgcuacagacugcccccuggcguugacccagccgcggugacguccgcacucucucccgaggguguccugucgauacaggccgcuccugccucagcacaggcuccacccccggccgcggccaaguga

SEQ ID NO: 57452 - RNA, 792 nt, Artificial Sequence
  derived and/or modified sequence opt3 from HSPB7__Homo_sapiens__XP_011539551
augagcggcugcgagcugagcccccucgggcuuagagugggacugucugccgguccugcucacggcaggcgguucccagcaccgucagggcccuggcgcggauugaacuuagccagucgacagggcgcggguccuaagccacgugacagcagacccuacaaagcugccgcagucggggccuggcaugcuaggccugaagcaugugcccacacccuguccugcccagcucuagcccggcucggacgcgcgagaaggcggcccuggaugucucaucgcacaucgucaacuuuucgagcagagagauccuuccacaguuccucuagcuccucaaguagcucuacguccucaagcgccaguagggcucugccugcccaagauccaccgauggaaaaggcacuuucuauguuuuccgacgauuucggcagcuuuaugcggccccauucggagccucuggcuuucccagccgcgcaccccaccgcccguccuggcggggcaggaaauaucaaaacauugggugacgcuuaugaauuugccguugaugugcgcgacuucucuccagaggauauuauaguaacuaccuccaacaaucacaucgaggugagagcugaaaagcucgccgcagacggcacagucaugaacaccuuugcccauaaaugucagcugcccgaggauguggacccgacuucaguuacaagugcucugagggaagaugggagccucaccauucgggcgcgacgccacccucauacggagcacgugcagcagacuuucagaaccgagaucaagauuuga

SEQ ID NO: 57453 - RNA, 591 nt, Artificial Sequence
  derived and/or modified sequence opt3 from HSPB8__Homo_sapiens__NP_055180
auggccgacggccagaugcccuucagcugccacuacccuuccagacugaggcgggauccauuucgcgacucuccgcucucaagucgacuucuggaugacggguucggaauggaucccuuuccugacgauuugaccgcuagcuggccagacugggcauuaccccgucuguccucugccuggccugguacacuaagaucgggcauggugccaagggggcccacugcgacggcucgguucggagucccugccgagggccgcaccccaccgcccuuuccuggugaaccauggaagguuugugugaacguacauucauucaaacccgaggaacucauggugaagacaaaagauggguaugucgaggugagcggaaagcacgaagagaaacaacaggagggcggcaucguuaguaagaauuuuacuaagaaaauucagcugccugcagaaguggacccagucaccguguucgccucccuuucucccgaggggcuguugauaaucgaagcuccgcagguaccucccuacagcacauuuggagaguccucauucaacaaugagcucccacaagauagucaggaaguuaccugcacuuga

SEQ ID NO: 57454 - RNA, 480 nt, Artificial Sequence
  derived and/or modified sequence opt3 from HSPB9__Homo_sapiens__NP_149971
augcagagagugggcaacaccuucagcaaugaguccagggucgccucucggugccccucaguugggcuggcugaacgcaaccgaguggcaacaaugccuguacgucuccuuagagacaguccagccgcgcaagaggauaaugaccacgcuagggauggauuucagaugaaacuggacgcccaugguuucgcaccggaagaguuggugguccagguggauggccagugguuaaugguuacugggcaacagcagcuggacgugcgggaucccgaacgcgucagcuacagaaugucccagaaagugcacaggaagaugcuaccuucuaaccucucgccaacggccaugaccuguugccugacacccucaggacaacuuuggguacggggccaguguguugcucuggcauugccugaggcccagacugguccaagcccccgccucgggagucugggauccaaggcuucuaaucugacccgauga

SEQ ID NO: 57455 - RNA, 1467 nt, Artificial Sequence
  derived and/or modified sequence opt3 from HSPBAP1__Homo_sapiens__NP_078886
auggccgcuggcagcgaggcaaccacacccgugaucgucgccgcgggggcuggaggugaagagggcgaacacguuaagccuuucaaaccagagaaggccaaagaaauuauaaugucccugcagcaaccggcaaucuuuugcaacaugguguucgacuggcccgccagacauuggaaugcuaaguaccucucucagguacuucacgggaaacagauuagguuucggaugggaaugaagucaaugaguacugugccucaguucgagacgaccuguaacuaugucgaggcaacacuggaagaguuuuugacuuggaauugcgaucaaagcuccaucucuggcccauuccgcgacuacgaucauucgaaguuuugggccuaugcugacuacaaauauuucgugucauuauuugaagauaagaccgaccuguuccaggauguuaaauggagcgacuuugguuuccccgggcgaaacggacaggagaguacacuauggauuggcucccucggcgcccacaccccuugucaucuggauucuuacgggugcaaucuuguguuucagguccaaggacguaagagauggcaccuguucccacccgaggacacuccuuucuuguauccaacaaggaucccguacgaagagagcuccguguuuucaaaaauaaacguaguuaaucccgaucucaagcgguucccucaguuucgcaaggcgcagagacacgcagugacccugaguccaggucagguccuguucgugcccaggcauugguggcacuacguggaaagcaucgacccugucacgguuucuauuaacuccuggaucgagcucgaagaggaucauuuagcccggguggaggaagcuauuacucgcaugcugguaugugcccuuaaaaccgcagagaauccacaaaacacacgagcuugguugaaucccacugaaguggaggaaaccucacacgccgucaacugcuguuaucugaaugcggccgugagcgcauuuuucgacagaugcaggacaagugagguuguggagauccaggcucuacggaccgacggcgaacacaugaagaaagaggaacucaacgucuguaaucauauggagguggggcagacgggaucucaaaaccugacuacaggcaccgauaagccggaagccgcuuccccuuuuggucccgaccuuguaccaguugcccagcguagcgaggagccucccucggaacgcgggggaauauucggcucugauggcaaagacuuuguggauaaggacggggagcacuucggaaaacugcauugcgcaaagagacagcagauuauguccaacucagaaaaugccaucgaggagcaaauugcuaguaacacuacaaccacgccacagaccuuuaucagcacagaugacuugcucgauugucuggucaauccccaggugacuaggaucgucgcgcaguuacugauucaaggucggucccucuga

SEQ ID NO: 57456 - RNA, 1080 nt, Artificial Sequence
  derived and/or modified sequence opt3 from HSPBP1__Homo_sapiens__NP_001123578
augagcgacgagggcuccagagggucuaggcugccccucgcccuuccuccagcuucacagggaugcaguagcgguggcgggggaggcgguuccucugcagggggaucgggcaacucacggccgccccgcaaucugcaaggcuuguuacagauggccaucaccgcggggagcgaggaaccugauccacccccugaaccaaugagugaggaacgacgucaguggcugcaggaggcuauguccgccgcauucagaggacaaagggaggaaguggagcagaugaagucuugucuacggguccucagccagcccaugccuccaacagccggugaagcugagcaggcagccgaccaacaggagcgcgaaggcgcucuggagcuucuggccgauuugugcgaaaacauggacaaugcggcagauuuuugucagcucuccgggaugcaucugcugguuggaagauaccucgaggccggcgcugccgguuuaagguggcgggcagcucagcugauugggacuugcucacaaaacguggccgcgauacaggaacagguacuuggauugggcgcccugcgcaaacuacuccgacugcuugacagagaugcaugugacacggugagggucaaggcucuguucgccaucaguugcuuggugcgggagcaagaggcuggccuccugcaguuuuuacgucuggauggguucagcguucucaugcgcgccaugcagcagcaagugcagaaacuuaaggucaaaucugcauuucuguugcagaaucuacuggugggacacccggaacacaaggguacccucuguuccaugggcaugguacagcaacugguugcccuugugagaacagagcauucacccuuccacgaacauguccugggggcuuugugcagccucgugacugacuuuccucagggagugagggagugucgggaaccagagcugggcuuagaggaacugcuacgacaccgcugccagcuccugcagcaacacgaggaauaucaggaggaacuugaguucugugagaaguugcugcagaccugcuuuaguucucccgcggaugacuccauggauagauga

SEQ ID NO: 57457 - RNA, 1722 nt, Artificial Sequence
  derived and/or modified sequence opt3 from HSPD1__Homo_sapiens__NP_002147
augcugagacuccccaccguguucaggcagaugcggccugucagccgcguucuugccccacaccugacacgagcuuacgcaaaggacgugaaauuuggcgccgaugcgcgugcuuugauguuacaagggguagaccugcuagccgaugcaguggccgucacuaugggaccgaaggguagaacggugaucauugagcaguccuggggcucucccaaaguuaccaaggacggggugacagucgcuaaaucaauagaucucaaggacaaguauaaaaacaucggagcaaagcuggugcaggauguagccaauaacacuaaugaagaggcuggcgacgguaccacaaccgccacuguucuugcgaggaguauugcaaaagaaggguucgagaagaucagcaaaggagccaacccuguggaaauucggcgcggcgucaugcuggcuguggaugccgugaucgcagaguugaagaagcaguccaaaccagucacaacccccgaggaaauagcucaaguugccacgaucucugcgaauggcgacaaggagauugggaacaucauuucggaugccaugaaaaaggugggaagaaaagguguaaucacugugaaggacggcaaaacccucaaugaugaacuggagauaauugaggggaugaaguuugacaggggauacaucucaccuuauuucauuaacacaagcaagggccagaaaugcgaauuucaggacgcauacguccugcucagugagaagaaaaucuccucuauccagagcauugugccagcuuuagaaauagccaaugcucaucggaagccccugguuaucauugccgaggauguggacggugaagcacuuuccacuuugguccugaaccgccuaaaaguggggcuccaaguaguugccgugaaggcuccuggauucggcgauaaucgaaagaaccagcugaaagacauggcgaucgcaaccggcggggccgucuuuggagaggagggucuuacacugaauuuggaagaugugcagccacacgaccucggcaaggucggggaggugauaguuaccaaagaugacgcuaugcuguuaaagggaaaaggcgauaaggcccagauugaaaagagaauccaagagaucauugaacagcuggacgugacgacuucagaguaugagaaagaaaagcucaacgagaggcuugcaaaacugagugaugguguagccgucuugaagguugggggcacaagcgacguggaagugaaugagaaaaaggaccgggucaccgaugcucuaaacgccacucgugcagcgguggaagagggaaucguacugggcgggggaugugcucuccugcgcugcauuccggcccuugacucucugacacccgcaaacgaggaucagaagauagguaucgaaauuaucaaaagaaccuugaagaucccugccaugacgauugcuaaaaaugccggcguggaggggucccucauaguugaaaagaucaugcaaucaagcagugaggucggauacgacgcaauggcuggcgauuucgugaacaugguggagaaagguauuaucgacccaaccaaggucguuaggacagcccuguuagaugcggccgggguggcuucucugcuaacuaccgcagaagugguagucacagagauucccaaagaagagaaggacccuggcaugggagccaugggcgggaugggagguggcaugggagggggcauguuuuga

SEQ ID NO: 57458 - RNA, 309 nt, Artificial Sequence
  derived and/or modified sequence opt3 from HSPE1__Homo_sapiens__NP_002148
auggccggccaggcuuucagaaaguuucugccccucuucgacagggugcuugucgagcggagcgcagccgaaaccguuacaaaagggggaaucaugcugccugagaagucccaagguaaaguguugcaggcgacuguaguggcugucggcucugggucaaagggaaaaggcggugaaauucagccagugaguguuaaggugggggauaaggucuuacugccggaguacggaggcacgaaagugguacuagacgauaaggacuauuuucucuuccgcgauggcgacauacuggggaaauacguugauuga

SEQ ID NO: 57459 - RNA, 13179 nt, Artificial Sequence
  derived and/or modified sequence opt3 from HSPG2__Homo_sapiens__NP_001278789
augggcuggcgcgccgcuggggcccugcuccuugcccuguuguuacacggaaggcugcuggcggugacccauggucuccgggcuuacgacggccugagccuucccgaagauaucgaaacugucacugccucccagaugcgcuggacgcacucuuaccugucagacgaugaagacauguuggccgauaguauuagcggggacgaucucggauccggcgaccuggguucuggggauuuccaaaugguuuacuuucgagcccuggugaacuucacccguucgauagaauauucaccucagcucgaagacgcuggaagcagggaauuuagggaagugagugaggccguggucgauaccuuagaauccgaguaccugaagaucccaggcgaccaggugguuucuguggucuucauuaaggaacuugauggcuggguguuuguagaguuggacguugggagcgagggaaaugccgacggugcucagauccaagaaaugcugcugcgggugauuuccucaggcagugucgccagcuaugugacuucuccgcagggguuccaguuucgccggcucggaaccgugccccaguucccuagggcgugcacagaggcggaauuugccugucauuccuacaacgagugcgucgcucuggaauaucggugugaucgccgaccagacugcagagauaugucagacgagcuuaauugugaggaacccguucugggcaucagcccuaccuucaguuugcucguggagacuacaucucugccacccaggccugaaaccacgauaaugcggcaaccaccgguaacucacgcaccccaaccuuuacugccagguuccgugcguccccucccuugcgggccacaggaggcagcuugucgcaacggacauugcauccccagagauuaccuuugugacggccaggaagauugcgaggacggcagcgaugagcuggacugugggccgccucccccaugcgaaccuaaugaguuucccugcggaaacggucacugugccuugaagcuguggaggugcgauggcgacuucgacugugaagaucggaccgacgaggcgaauugcccaacaaaacgacccgaagaggucugugggccuacucaauuucgcugcgugucgaccaacauguguauuccagccucuuuccacugcgaugaggaauccgacuguccggauagaucagacgaguucggaugcaugcccccucagguugugacaccacccagggaaaguauccaggcaagccggggccaaaccgucacguuuacuuguguggcuauugguguaccuacaccaaucauaaauuggcgccugaacugggggcauauucccucccacccgagaguuaccgugacuucugagggcggaaggggcacacucaucauucgugaugucaaggagagcgaccagggggccuauaccugcgaagcuaugaaugcccggggaaugguguucgguaucccugauggcguccuggagcuugugccacagcgagcagggcccugcccugacggacauuuuuaucuggaacacucagccgcuuguuugcccugcuucuguuuuggcaucacgaguguuugccaguccaccagaagguuccgcgaucaaauucggcucagauuugaccagccagaugacuucaaaggugugaacguaacaaugccugcgcagcccgggacuccaccgcugagcucuacccaguuacaaauagacccuucacugcacgaguuucagcuagucgaucucaguaggcgcuuccuggugcaugacagcuuuugggcacuucccgaacaguucuugggcaauaagguugauuccuacggaggcucucugcgauauaacgugcgguacgagcucgcccgugggaugcuggagccaguccagagacccgacgugguacuuaugggagcugguuauaggcuguugucgcgcggccacacaccuacucaaccaggggcccucaaucagagacaggugcaguuuagcgaagaacacuggguucacgaauccggaagacccguccaaagggcagagcuguuacaggugcugcagucacuagaagccgugcucauccaaaccgucuacaacacaaagauggcuaguguuggccugucugauauugccauggacaccacugugacgcaugcaacaagccacggucgagcgcacuccguggaggagugucgcugcccuaucggguauucaggccuuagcugugaaucuugcgaugcucauuucacccggguaccgggaggcccauacuuggggacuuguuccggaugcaacuguaauggccacgccaguagcugcgaccccgucuacggucauugccugaacugucagcacaauaccgaggggccucagugcaacaaauguaaggcaggauucuuuggcgaugccaugaaagcuacagccaccucuugcagaccaugucccugcccuuauauagacgcauccaggcguuucucagauacuuguuuucucgacacagauggucaggcuacgugcgacgccugugcgccgggcuacaccgggcgccggugcgaaaguugugcccccggauaugagggcaauccaauucaaccugggggaaagugcagacccgugaaccaggaaaucguuaggugcgacgagcgaggcagcauggguacuucgggggaggcuugucggugcaaaaauaacguggucggacgccuguguaaugaaugcgcagauggcuccuuccacuuaucuacaagaaacccagacgguugucugaagugcuuuuguaugggcgugagcaggcauugcaccucaaguuccuggucucgggcccagcuucacggggcuagcgaggaaccuggacauuucuccuugacaaaugccgcaucaacucacaccacgaacgagggcaucuuuagccccaccccaggggagcucggauucaguucuuuucaucgacugcuauccggcccguacuucuggagccugccuucgagauuucucggugauaagguuacaucauaugggggagaacugcgcuucacugugacccagaggucucaacccggcaguacaccacuucacggucagcccuugguaguccugcagggcaauaacauuaucuuagagcaccauguggcgcaggaaccuuccccagggcaacccagcacuuuuauugugccuuuccgugagcaggccuggcagcggccggacggacaaccagcuaccagagaacaccuccugauggcccuugcaggcauagauacgcuguugaucagggcuucuuacgcccagcagcccgcagagagccgcgucuccgggauuucaauggacguugccgugccugaggaaacaggacaggaucccgcucucgagguagaacaauguaguugcccaccuggcuaucgaggucccagcugucaggacugcgauaccggguacacuagaacaccaucuggacuguaccuaggaaccugcgagcgguguuccugccauggccacucagaagcgugugagccugagacuggggccugccagggaugucagcaucacaccgaagguccgaggugcgagcaaugucagcccggcuauuacggggacgcacagcgcggaacaccacaggauugccaacuguguccuugcuauggcgaccccgcugccggucaggccgcucacacguguuuccucgacaccgaugggcauccaacuugcgacgcaugcaguccuggacacagcggccgucauugugaaagaugcgcccccggcuacuaugggaauccgucccagggacagccaugucaacgggauucucaggugccuggucccaucggcugcaacugugacccacaggggucggucagcucacaaugcgaugcggcuggacagugucagugcaaagcccagguggagggccugacauguucccacugcaggccccaccauuuucaccuuagugcaucuaacccugacgguuguuugccgugcuucuguauggggaucacccaacagugcgccagcuccgcuuacacacgccaucugauuucaacucacuuugcacccggagauuuccagggcuuugccuuaguuaauccacagcgaaacucuagacucaccggcgaguucacgguggagccuguccccgagggggcgcaacugagcuuuggaaauuucgcucagcuuggucaugaaaguuuuuauuggcagcugccugagacauaccagggcgacaagguggccgcauacgggggaaaacuacgguauacccucuccuacacugccggcccacaagguagcccccugucugauccugacguucagauaaccgggaacaauaucauguugguggcuucacagccagcccugcaaggacccgaaaggcgcuccuaugagauuauguucagagaggaauuuuggaggcggccggauggccagccugcaacacgugagcacuuacucauggcucuggccgaccuugaugaacuguugauccgcgcgacuuucaguagcgucccacucgccgcaucgauuucugcuguaucccuggagguggcccagcccggcccuagcaaccgaccaagagcucuagaaguugaggaguguaggugucccccgggguacaucggacugucaugccaggacugcgcaccugguuauacccggacaggcagugggcuuuaccucggacacugcgaacugugugagugcaauggccauucugacuugugucaccccgaaacgggugccugcucccaaugucagcauaacgccgcuggggaguucugcgaacugugugcgccaggauauuacggcgaugcaaccgccggcacuccugaggacugccagcccugcgcuuguccauuaacaaaucccgagaacauguuuagcagaaccugcgaaucacucggggccggagguuacagauguacugcaugcgagccuggcuauacagggcaguacugugaacaaugcggaccaggcuauguggguaauccgaguguccaagggggccagugucugcccgagaccaaccaggccccucuugugguagaagugcacccagcuaggagcauagucccccaaggaggcucccacucucugcggugccagguuagcggguccccuccacauuacuucuauuggucacgagaggauggaagacccgugccuucugguacgcagcagcgccaccaaggcagugaguugcauuuuccgucggugcagccaagcgacgcgggggucuacaucuguacuugcaggaaucuccaccaguccaacaccucucgggccgaacugcuagugacagaggcacccucaaagccuauuaccguuacuguagaagaacagcguagccaguccgugagacccggagcugaugucacauucaucuguaccgccaaaaguaagucuccagcauauacacugguguggacuaggcuucauaauggcaaacucccuacccgcgccauggacuuuaacgguauucugacgauccggaacguucaguugagcgaugcugggacauacgugugcaccggcucaaauauguucgccauggaccagggaacugcgaccuuacacguccaagcauccggcacacugagugcccccgugguaagcauacacccaccgcagcucacuguccagccugggcagcuggcugaguuucgaugcucugccaccggaucccccacgccaacacuugaauggaccgguggccccgggggacaacugccugcuaaggcacagauucauggcgguaucuugagacuaccagccguggagcccacugaucaggcucaguaccuguguagggcccacucaagcgcagggcaacagguugcgcgcgccgugcuccauguccacggcggaggcgggccucgggugcagguuucgccggaaagaacacaagugcacgcuggacguaccgucaggcuguauugccgggccgcaggcgugccaucugcuacuauuacauggcgcaaggagggugggagucuucccccucaggcccgauccgaaagaaccgacaucgcaacguuacugauaccagccaucacuaccgcugaugcgggauucuaccucuguguagccacaagccccgcaggcaccgcucaggccaggauucaggugguugucuugucagccuccgacgcaucuccucccccagugaaaaucgagagcaguuccccgagcgugacagagggucaaacucuggaucucaacugcgucguagcuggcucugcccaugcacaggugaccugguaucggcgcgggggaucacugccuccccacacgcagguucauggcaguagacuuaggcugccacagguguccccugcugacagcggggaauacgucugucgaguggagaauggaucuggccccaaggaagccucgauuacaguuucaguguugcacgguacucauagcgggccauccuauaccccuguccccggaaguacacggccgauccguauagagccaucuagcucccacguggcagaaggccaaacccuagaccugaacugcguagugccuggucaggcccacgcucagguuacuuggcauaaaagaggcgggucacuccccgcacgccaccagacccauggaaguuuacugaggcuucaccaagucacaccagccgauucuggcgaguacgugugucauguggucgggacgagcggaccccuggaggcguccguucucgugacuauugaggcuucaguaaucccuggcccgaucccacccgugcggauugagagcagcuccaguaccgucgccgaaggucagacauuggaccugagcugcgugguugcagggcaggcccacgcucaagugaccugguauaagagaggaggcucgcucccugcccgccaccaggucaggggcucccgacuguacaucuuucaggcaucucccgcugaugccgggcaguacguaugucgggcgucaaauggaauggaggccagcauuacugugacaguuaccgguacgcaaggcgcaaaccuugcuuauccagccgggaguacucagccuauaagaaucgaacccuccucuagccagguggcagagggacagacacuagaccugaauugcgucgugccaggccaaucacaugcucaggucaccuggcacaaaagggguggguccuugccugugcgccaucagacccacggaaguuuacugcgucucuaccaggccagcccggccgauucuggcgaguauguuugucgggugcugggcucauccguaccccuugaagcgagcgugcuggucacuauugagccagcugggucuguuccugcacucggagugacacccaccgucagaaucgaaaguucguccagccaaguggccgagggucagacauuggaccugaacugccuaguagcuggccaggcccacgcacaggugacuuggcauaagagagggggcucacugccagcccgccaccaaguucauggcucucgacuccggcuucuacaggugacgccugcugauagcggugaguacgucugcagaguggucggguccaguggaacccaggaagcgucaguguuaguuacaauucaacagagguugucuggcagccacucccagggcguagccuaucccgugcgcaucgagaguagcuccgcaucucuggcuaaugggcauacucucgaccugaacugucuugucgccucacaggcaccgcacaccauaacaugguacaagagaggagguagccugccaucgcggcaccaaaucgugggcuccaggcuccguauuccucagguuacccccgccgauaguggggaauaugugugccaugucucuaauggagcuggcagccgagagacuucauugaucgugacgauucaggguuccgggucuagucacguaccaagcgugucucccccuauccgcauagaaucaagcucucccaccguugucgagggacagacacuggacuuaaacugugugguggccagacaaccacaggcgauuaucacuugguacaaacggggcggcagucuaccuuccaggcaucagacccacgggagccaucugcgccuccaucagaugucagucgcagauucuggagaguacguuugcagagccaauaacaauaucgacgcucuugaagccuccauugugauaucgguaagcccgagugcagguucucccuccgcuccaggcagcucaaugccuauccggauugagaguuccagcucucacguggccgaaggggagacacuggacuugaacugugucgugcccggacaagcucaugcccagguuaccuggcacaagaggggcgguucacugccaagccaucaccagacucgagggucccgucucagacugcaccaugugucuccugcagauaguggagaauaugucugccgcgugaugggcucgagcggcccccuugaggcguccguacucguuacaaucgaggccucagggucuagcgcugugcacgucccggccccuggaggugcaccacccauucggaucgaaccuaguuccucaaggguggcugagggccaaacgcuggacuugaaauguguggucccagggcaggcccaugcacagguuaccuggcacaagagaggaggcaaccugcccgcccgccaucaggugcacgguccuuuacuacggcugaaucaaguaucuccagcggauagcggggaauacuccugccaggugacuggaaguagcggcacacucgaggcuucuguccuugugaccauagaacccucauccccgggcccuauccccgccccagggcuggcacagcccauuuauaucgaggccagcaguucucacguuaccgagggacagacauuggaccugaacuguguggucccuggucaagcucaugcccaggugacuugguacaaaaggggcgggucccucccagcacgacaccagacgcauggaucgcagcugagacuucacuuaguaagccccgcugauucaggcgaauauguuugccgggccgcguccgguccugggccagagcaagaggcuucuuucaccgugacagucccgcccagugagggcagcucauacaggcugcgcuccccugugauuagcaucgacccacccucuaguacuguucagcagggacaggaugccuccuuuaagugucucauacacgacggcgcagccccuauuagcuuggaguggaagacccguaaucaagaacuggaggauaacgugcauaucucaccaaaugggucuaucauuacaaucgucggaaccagacccucgaaccacgguacuuaucgaugcguggcuagcaaugcauacggcguagcccaguccguggucaaccuaaguguucaugggccgccuacggugucuguccugccagaaggacccguguggguaaaagugggcaaggcgguuacacucgagugcgugucagccggugaaccuaggagcuccgcucgguggacccgcauaaguucuacucccgcaaaacuugagcagagaaccuacgggcugauggacagccacgccgucuugcaaauuuccucagcuaagccaagcgaugccggcacauaugugugucuggcacagaaugcucucggaacugcccagaaacagguugaggucaucguggacaccggcgcgauggccccgggggcaccucaagugcaggcugaagaggccgaacugacaguagaggcaggacauacggccaccuuaaggugcucugcuacugguucccccgccccaacaauucacuggaguaaacuucggucaccccugccuuggcagcaccgccucgaaggcgauacccuaaucauaccaagagucgcgcagcaagacagcgggcaguacauuuguaacgcuacuucgcccgcaggacaugccgaggcuacaaucauccugcacguggaguccccuccauaugccaccacgguuccggaacaugcaucugugcaggccggcgagaccguccaguugcaaugccuggcucacgguacacccccucucacuuuccaguggagucgagugggcagcucacuuccagggagggcgaccgcccggaaugaacuguugcacuuugagcgugcagcccccgaagacuccggacgcuacagauguaggguuacaaacaaggugggcucugcugaggcauucgcccagcugcucguacaagggccuccaggauccuuacccgcuacaaguauuccugccggcuccaccccgacaguccaggugacaccccagcuggagacuaaaagcaucggugcgucuguggaguuccauugcgcaguuccaucagaucgggggacgcagcuuagaugguuuaaggagggaggccaacugccucccggucacuccguccaggacggcgugcuacgcauucagaaucucgaucagagcugucaagggacauauauaugccaggcccauggaccauggggcaaagcucaggccagugcacagcugguaauccaggcuuugccuucugugcugauuaacauccgaaccucaguccagacugugguuguggggcacgccgucgaguucgagugucucgcgcuuggagaccccaagccacaggugaccugguccaaaguuggcggucaucugaggccggggaucgugcaaagcggaggcguaguccggauugcccacguggaguuagcugaugcaggucaguacagaugcacagccacgaaugcugcaggcaccacucagucgcacguucuguugcucgugcaggcccugccucaaauaucuaugccccaggaaguccgugugccagcugggagugccgcaguauuucccuguaucgccuccggauauccuacaccagacauuagcuggucaaagcuagauggcucucuucccccugacagccgccuggagaacaauaugcucaugcugccguccgugaggccccaggaugcggggaccuacgucugcacugcuacaaaccggcagggaaaaguuaaggccuucgcacauuugcaagugccagaaagaguggucccuuacuuuacccagacacccuauaguuuccugccacucccuacuaucaaggacgccuaccgaaaauuugagauuaagaucaccuucaggcccgauucagcugacggcaugcuucuguauaacggucagaaacgcgugccagggagcccgacgaauuuagccaaccggcagccugacuuuauauccuucggacugguuggcggcagacccgaauuuagguucgaugcagggucuggaauggcuaccauccgccacccaacaccuuuggcccucggucauuuucacacuguaacccugcuacguagucuuacacaaggcagccugauugugggggaccucgcgcccgucaauggaacuucccagggcaaguuccagggucuggauuugaacgaggaguuauaccuagggggauauccagacuacggcgcaaucccuaaagccggccucucaucuggguucauuggaugcgugcgggaacuuagaauccagggugaggaaauaguuuuucacgaucugaaucuaaccgcucauggcauuucgcacugucccacgugccgagacaggccgugucaaaacgggggacagugccaugauagcgaguccaguucuuaugugugugucugcccagccggcuucacagguagccgcugugaacacucacaggcucugcauugccaccccgaggcaugugggccugacgcaaccugcgugaaucggccagauggaagaggcuacacuuguaggugccaccucggccgcuccggguugagaugcgaggaaggaguaacagugaccacucccagccugucuggugcgggcaguuaccuugcccugccugcucucaccaacacacaucacgaguuacggcuggacgucgaauuuaagccguuggcacccgaugggguucuacucuucuccggaggcaagucagguccaguggaggacuuugucagccuugccaugguagggggacaucuggaguuccgauaugagcuaggcucuggccuggcuguucucaggucggccgagccuuuggcacuggggcguuggcacagaguguccgccgaacggcuuaauaaagauggaagucugcgcguaaacgguggcaggcccguguuacgaagcucaccagggaagucucaaggacucaaucugcauacguugcuguaccucggcggugucgagccuuccgugccccuuagcccagcuaccaacaugagugcgcacuuuagaggguguguuggagaagucucagugaauggcaaacggcuggaccuaacuuauuccuuccugggcagccaggggaucggacagugcuacgacucuaguccuugugagcgccagcccugccaacacggugccacauguaugccggcaggcgaguaugaauuucagugccucuguagggauggguucaagggagacuugugcgagcaugaagagaacccuugucagcugagagaaccaugcuuacacggcgguaccugucaggggacucggugccuuugccugcccggcuuuagcggaccucguugucaacagggcuccgggcauggaauugcugagucugauuggcaccucgaggguucaggcgggaaugacgccccaggacaguacggcgcauauuuccacgaugacgguuuucuggccuuccccgggcauguguucagccgcuccuugccggaaguaccugagacaaucgaacuggaggucaggaccucgacggcuucuggccuccuucuguggcagggaguggaaguuggcgaggcggggcaaggaaaagauuuuauaagucuaggucugcaggacggccacuuaguguuccgauaccagcucgggagcggagaggccagacuggucucagaagaucccaucaacgacggcgaguggcaucgggugacagcauugagggaaggucgcagaggguccauucaaguugauggcgaggaacuugugucuggacggagcccaggccccaacgucgcugugaaugccaagggguccguauacaucggaggugccccugacguggcuacccugacuggcgggagguuuaguucaggaauuaccggcugcguuaagaaccucguccugcacagcgcacgcccaggugcacccccuccacagccguuggaucugcagcaucgagcucaggcgggcgccaauacaagacccuguccuucuuga

SEQ ID NO: 57460 - RNA, 2445 nt, Artificial Sequence
  derived and/or modified sequence opt3 from HSPH1__Homo_sapiens__NP_001273432
augagcguggucggccuggacguugggucccagucuugcuacaucgccguggcuagagcaggagguauugagaccauagccaacgaguucucagauagguguacacccaguguaaucagcuuuggcuccaagaaucggacuauugggguggcggcuaaaaaccaacagaucacgcacgccaauaacaccgucucuaauuucaagcgcuuucauggacgagcauucaacgacccuuuuauucagaaagagaaggaaaaucucucguaugaucuugugccacugaaaaacggcgguguugggaucaaggugauguacaugggagaggaacacuuguucucagucgagcagauaacagccauguuacugacuaagcuaaaagagaccgcugaaaauagccucaagaaaccggugacagacugcguaaucaguguucccuccuuuuucaccgaugcagagcguagaucugugcuggacgccgcucaaauugucggccuuaacugucugagguugaugaaugauaugacugccguggcgcucaacuauggcaucuacaagcaggaccugccuagccuggaugaaaaaccacggauuguggucuuuguugacauggggcauuccgcauuccaggugucagccugcgcuuuuaauaagggaaagcucaaaguauuagguacagccuucgaucccuuucugggcgggaagaacuucgacgagaaacuuguggagcacuucugugcagaauuuaagaccaaauauaaguuggaugcuaaaaguaagauccgcgcccugcuaagacucuaccaggagugcgaaaagcugaaaaagcugaugagcucuaauuccacggaccuuccuuugaacauagaguguuucaugaacgacaaagaugucucaggaaagaugaauaggagccaauuugaagaacucugcgcggagcuguuacagaaaauugaagugccacuguauagucuccuugagcagacucaucugaagguugaagacgugucugccgucgagaucgugggcggugcaacccggauucccgcuguaaaggaacgcaucgccaaauucuuugggaaggauaucuccacaacuuugaacgcugacgaggccguugcacgaggaugugcccuacagugcgcuauucugagcccugcguucaaagugagagaguuuucggucaccgaugcagugccauucccgauaucucucaucuggaaucacgacuccgaagauacagagggcguccacgaaguguuuucaaggaaccaugccgcucccuucaguaagguucugaccuuucuucggcguggcccuuucgagcuggaagccuuuuacagcgacccacaaggggugcccuacccugaggcaaaaauuggacgcuucguaguccagaauguguccgcccagaaggauggugagaagucuagaguuaaagugaaggucagggugaacacgcacggcaucuucacuauaagcacagcuucaaugguagaaaaagugccaaccgaggaaaaugagaugaguuccgaggccgacauggaauguuugaaccaacggcccccggagaauccugauacugacgcaaacgaaaagaaaguugaccagcccccagaggcgaagaagccuaaaauuaaggucgugaauguggaacuccccaucgaggcuaaccuggucuggcaguuagggaaagaucugcuaaauauguauaucgagacagaaggaaagaugauuaugcaggacaaacucgagaaggaacgaaacgaugccaaaaaugcaguugaggaauacguguaugaguuucgcgacaagcugugcggcccauacgagaaguucaucugcgaacaagaucaucagaacuuucuuagauugcugaccgagacggaagacuggcucuaugaggaaggugaggaucaggccaaacaggcuuacguggacaagcuggaggaacuuaugaaaauugggacccccguaaaggucagguuccaagaggccgaggaacggccuaaaauguuugaggaacugggccagcgcuugcagcacuaugcaaagauagcugccgauuucagaaacaaggacgagaaauacaaucacaucgaugaaagcgagaugaagaaaguggaaaagucuguuaacgaggugauggaguggaugaauaacgucaugaaugcgcaggccaaaaagucacucgaccaagauccagugguuagggcucaggaaauuaagacaaaaaucaaggagcugaacaauacuugugaaccggugguaacccagcccaaaccuaagaucgagaguccaaaauuagaacguacacccaacggaccuaauauugacaagaaggaggaggaccuggaagauaaaaacaauuuuggcgcagagccaccccaucagaacggggaaugcuacccgaaugagaagaacagcgucaauauggaccuagauuga

SEQ ID NO: 57461 - RNA, 831 nt, Artificial Sequence
  derived and/or modified sequence opt3 from HTATIP2__Homo_sapiens__NP_001091990
auggccggccccgcugcacugagcgccgcggcugccgcagcccucgcugcagcccuucuguuguuaagaagggaggacccugggccaggagcugguccguccauggccgaaaccgaggcgcugucuaagcuacgggaagauuuccgcaugcagaacaaaucaguguuuauccucggcgcaaguggggagacaggacgaguccugcuuaaggaaauucuggagcaaggcuuguucagcaaaguuacucucauaggucguagaaagcugacguuugacgaggaagccuacaaaaaugugaaccaggagguaguggauuucgaaaagcuggacgauuaugcuuccgccuuucaggggcacgacgucggauucugcugucucggcaccacaaggggcaaggcaggggcugagggauuugugcggguugaucgcgacuacguguuaaaaucugccgagcuggcgaaggccgguggcugcaaacauuucaaucuuuugucgucaaagggggcagauaaaagcaguaacuuucuguaucuacaggucaagggagaaguggaggcuaagguagaggaacucaaauucgacagauacuccguuuuuaggcccggcgugcugcuuugugaucggcaagaaucucgcccuggugaguggcugguccgaaaguucuuugggagcuugccagacuccugggccucaggacacagugugcccguggucacuguugugagagcuaugcucaauaacguagugaggccucgggauaaacagauggagcuguuagaaaauaaggccauccaugaccugggcaaagcacacggcagccucaagccauga

SEQ ID NO: 57462 - RNA, 174 nt, Artificial Sequence
  derived and/or modified sequence opt3 from HTN1__Homo_sapiens__NP_002150
augaaguucuuuguguucgcccugguccucgcucuuaugaucagcaugauuuccgcagacucucacgagaaaagacaucacggcuacaggcggaaguuucaugaaaaacaccauucacaccgcgaguuccccuuuuauggggauuacggaaguaacuaucuguacgacaauuga

SEQ ID NO: 57463 - RNA, 156 nt, Artificial Sequence
  derived and/or modified sequence opt3 from HTN3__Homo_sapiens__NP_000191
augaaguucuuuguguucgcccugauccucgcucuuaugcugagcaugaccggcgcagacucccacgccaaaagacaucacggguacaagaggaaauuucaugagaagcaccauucucaccggggauaucgcucaaacuacuuguaugauaauuga

SEQ ID NO: 57464 - RNA, 1269 nt, Artificial Sequence
  derived and/or modified sequence opt3 from HTR1A__Homo_sapiens__NP_000515
auggacgugcugagccccggccaggggaacaauaccacauccccuccagccccguucgagacuggagguaacacgaccggcaucucugaugucacaguuucauaccaagugauuaccagucuccuucuggggacuuugauauuuugcgcuguauuaggaaaugcauguguggucgccgcgaucgcucuggaaagaagccuacagaacguggccaauuaucucauuggcucccuggcaguuacagaccuuauggugucuguccugguguugcccauggccgcucucuaccagguacugaacaaguggacccugggucagguuacuugcgaucucuucaucgcauuagacgugcuguguugcacaucgucaauucuucacuugugugccaucgcucuggauagguauugggccauaaccgacccuaucgauuacgucaauaaacggacgccacgccgagcggcagcccuaauuagccucacuuggcugaucggguuucuuauuaguauacccccuaugcugggauggcguaccccagaggacagauccgaucccgacgcuugcacaaucucuaaggaucauggcuauacuauuuacagcaccuucggcgccuuuuauaucccuuugcuccugauguuagugcuguacgggaggauuuuccgggcagcucgcuuuagaaucaggaaaacagugaagaaagucgaaaagaccggagccgacacgcggcacggugcguccccagccccgcaacccaagaaaucaguuaacggcgagagugggagccgcaauuggcgacucggaguggaaucuaaggcaggcggugcucuuugugccaacggggcuguaagacagggagaugacggcgccgcacuggaggugaucgagguccauagggugggcaauuccaaagaacacuugccucuaccaucagaggccgggcccacuccuugcgcuccagcgagcuucgaacggaagaacgagcguaaugcagaggccaaacgcaagauggcucuggccagagaaaggaagacaguuaaaacccucggaauuauaauggguacuuuuauccuguguuggcuucccuucuuuauuguggcacuggucuugccguucugcgagaguucuugucauaugccuacacuccugggcgccaucauaaacugguuaggguacuccaauagccugcuaaaccccgugauuuaugcuuacuuuaacaaggacuuccagaaugccuucaaaaagaucaucaaaugcaaguuuugccggcaguga

SEQ ID NO: 57465 - RNA, 1173 nt, Artificial Sequence
  derived and/or modified sequence opt3 from HTR1B__Homo_sapiens__NP_000854
auggaggaacccggcgcccagugcgcuccuccaccgcccgcagggagcgagaccugggugccucaagccaaccuguccucugcgccaucacagaauuguagugcuaaggacuacaucuaucaggauagcauuucccuccccuggaaaguccuucugguuauguuguuagcccugauaacacuagcaacuacgcucucuaacgccuucgugaucgcuaccguauacagaacaaggaagcugcacacuccugcaaauuaucuuauugccucgcuggcugugaccgacuugcucgucucaauccuggugaugccaauuagcacaauguacaccguuacuggacgguggacacugggucagguggucugcgauuuuuggcucaguuccgacaucaccuguugcacggccucuauauuacaucugugugugaucgcgcuugaucgcuauugggcaauuacugacgccguagaauacagcgcuaaacgaacccccaagcgugccgcaguuaugaucgcuuuggugugggucuucuccauuucaaucagucugccuccauuuuucuggagacaagccaaagcggaggaagaggugagcgagugcguggucaacacagaucacauacuauauacuguuuacucuaccgugggcgccuuuuacuucccgacacuccugcuuauugcacuguaugggaggaucuacguagaagcucggucccgcauuuugaagcagacccccaauagaacgggaaagaggcucacucgggcccagcugaucacagacucaccuggcagcaccaguucugugacuuccaucaacagccgcgucccagaugugcccucggagucugguuccccuguuuaugugaaucaggucaaagugcgaguaucagacgcuuuacuggaaaagaaaaagcucauggccgcaagagagaggaaagccacaaagacccuugggauuauacugggagcuuuuaucguuuguugguugccauucuuuauuaucagucuagugaugcccauaugcaaggaugcguguugguuccaucuggcaauuuuugacuucuuuacguggcucggcuaccugaacagccuuaucaauccgaucauuuauaccauguccaacgaggauuucaaacaagccuuccacaagcugauccgguuuaaaugcacaucuuga

SEQ ID NO: 57466 - RNA, 1098 nt, Artificial Sequence
  derived and/or modified sequence opt3 from HTR1E__Homo_sapiens__XP_011534092
augaacaucaccaauugcacaacugaggccagcauggcuauuagacccaagacgauaaccgagaaaaugcugaucuguaugacacucguggucauuacuacccuuacaacccuguugaacuuagcaguuaucauggccauuggcacuacaaagaaacugcaccagccugcgaauuaccuaaucugcucccucgcugugaccgaccugcuuguagccgugcuggucaugccauugucuauaaucuauauugugauggauagguggaagcucggguacuuccugugugaaguuuggcugucaguggacaugacgugcuguacuugcaguauccuccauuuaugugucauugcacuggaucgguauugggccaucaccaacgcuauagaauacgcacgcaaacgaacagccaagcgugcugcccuuaugauuuugacuguguggaccaucagcauuuuuaucuccaugccgccccuguucuggagaucucacaggcggcuaucgccuccacccucacaaugcacaauccagcaugaccacguaauuuauaccauauacagcacgcucggagcguuuuauaucccucugacucuuauucugaucuuguacuaccgcauauaucaugcagccaagagucucuaccagaaaagagguuccucuaggcaccugagcaaucgguccacagauucacagaacaguuucgcuagcuguaaguuaacccaaacuuuuugcguuucugacuucuccacaucagauccaaccacggaguuugaaaaauuccacgccagcauucgcauucccccuuuugacaaugaucuggaccauccaggcgagcgacagcagaucaguucuaccagagagaggaaggcagcucggauccucgggcuuauccugggagccuucauuuuguccuggcuaccguuuuucauaaaagaacugaucgugggccucagcauuuauacagucucgucugagguggcggauuuucugacuuggcuugguuacgugaacucccugaucaaucccuugcucuauaccucauucaacgaagacuucaagcuggccuuuaagaaauuaauccguugucgcgagcacacauga

SEQ ID NO: 57467 - RNA, 1101 nt, Artificial Sequence
  derived and/or modified sequence opt3 from HTR1F__Homo_sapiens__NP_000857
auggacuuccugaacagcuccgaucagaaucucaccucugaggaacuucugaacagaaugcccucaaagaucuuggugaguuuaacacugagcggccuagcccucaugacuacgaccauuaauucccuggucauagcugcaaucauuguuacaaggaaacuucaccauccugccaacuaccugaucugcucuuuggcggugacugacuuucucguagcugugcuggucaugccauucucgauuguguauaucguucgggagucauggauaauggggcaaguggucugugauaucuggcugagcguggacauuaccugcuguacaugcaguauccuccacuuauccgccauugcacuggaucgcuaccgagccaucaccgacgcuguagaauaugcacguaagagaacuccgaaacaugccggaauaaugauuacaaucguuuggauuaucucuguguuuaucagcaugcccccucuuuucuggaggcaccaggguaccucccgggaugacgaguguauuauaaagcaugaucacaucgucucaacgauuuacaguacuuuuggcgcuuucuauaucccauuggcccugauacuaauucucuacuauaaaaucuaccgcgcggcaaagacccuguaccacaagagacaggccagcaggaucgcuaaagaagaggugaauggacaggugcuucuggagucuggggaaaaguccacaaaaucagucagcaccaguuauguuuuggagaagucucucuccgaccccagcacugauuuugacaaaauucauucgacagugcggucucugcgcuccgaguucaagcacgaaaagucauggcgaagacaaaagaucaguggcaccagggagcggaaggccgcaacgacuuuaggucugauucucggggcuuuuguaauaugcuggcuuccuuucuuugugaaagaacuggucgugaacguuugugauaagugcaaaaucagcgaggaaauguccaauuucuuggccuggcuaggauaccugaacucucucauuaauccacugaucuauacaaucuuuaacgaggacuucaagaaagcguuccagaaacuugugcguugucgcugcuga

SEQ ID NO: 57468 - RNA, 1416 nt, Artificial Sequence
  derived and/or modified sequence opt3 from HTR2A__Homo_sapiens__NP_000612
auggacauccugugcgaggaaaacaccagccucuccucuacaacuaauucacuuaugcagcugaacgaugacacgagauuguacaguaaugauuucaacagcggcgaggccaauaccuccgacgcuuuuaacuggacaguggauucugaaaauaggacuaacuuaucgugugaggggugccugucacccagcugucuaagucuccugcaccuucaagaaaagaauugguccgcacuguugaccgccgucguuauuauacucacaaucgcgggaaacauucuggugaucauggcuguaucucuggagaaaaagcuccagaaugccaccaacuauuucuuaaugagccuggcaauugccgacaugcuuuuggguuuucuggugaugccugucuccaugcuaacuauccucuacggcuaucgguggccacugccgucaaaacuuugcgcuguguggauauaccuggauguuuuguucaguacagcaagcaucaugcaucucugugccauuucucuggaccgcuauguggcuauccagaaucccauucaccauucccgauuuaacucacguaccaaggccuucuuaaaaaucauagcggucuggacgauuagcguggggaucaguaugccuauuccaguauuuggacugcaggaugacucuaagguuuucaaggagggcuccugccuccuugcagaugacaauuuugugcugaucgguagcuucgucucguuuuucauccccuugacuauuauggugauaaccuacuuucuaacaaucaaaucucugcaaaaggaagccacucucuguguguccgaucuggggaccagagcuaaacuugccucauucaguuuccugccucagagcuccuugucuagcgagaagcucuuucagaggucaauucaccgggaaccaggaaguuauacaggccgcagaaccaugcaguccaucagcaacgagcaaaaagcaugcaagguccugggcauaguuuucuuuuuauucgugguaauguggugucccuuuuucauuacgaacaucauggcugugaucugcaaggagucuuguaaugaagacgucauuggggcccugcuaaacguguuuguuuggaucggauaccucucaagugcggugaauccucuggucuacacucuuuucaacaaaacauauaggagcgccuuuucccgguacauucagugccaguauaaggagaauaaaaagccauugcagcugauacucgugaacaccaucccggcacuggcuuacaaaucuucgcaacuucagaugggucagaagaaaaauagcaagcaagacgccaagacuacagauaacgacugcuccaugguagcucugggcaaacagcauucagaagaggccaguaaggauaauucugacgggguuaacgaaaaagugagcugugucuga

SEQ ID NO: 57469 - RNA, 1446 nt, Artificial Sequence
  derived and/or modified sequence opt3 from HTR2B__Homo_sapiens__NP_000858
auggcccugagcuacagaguguccgagcuccagucuaccauccccgaacacauucuucaaucaacauucguccauguuauaaguagcaacugguccggccugcagacugagucuaucccugaagagaugaagcagauuguggaggaacaggggaauaaauugcacugggcugcauuacugauccuaaugguaauuaucccaacgauaggagguaacacccucgugauccuggccgucucgcuugagaagaaacugcaauaugcgacaaauuacuuuuugaugucacucgcuguggccgaccugcugguuggccucuucgugaugccgauugcauuacugacuaucauguuugaagccauguggccccuuccuuugguccugugcccagcuuggcuauuccucgaugugcuguuuagcaccgcaaguauuaugcaucuuugugccaucuccguagacagguauauagcuauuaagaaacccauccaggccaaccaguacaauucucgggcgacagcauucauuaagaucaccguuguguggcugaucagcauugggauagccaucccugucccaauuaagggaaucgagacugauguggacaaccccaauaacauaacaugcguguugaccaaagaacgcuuuggcgauuucaugcucuuugguucccuggcugccuucuuuacgccuuuagcaauuaugaucgucacuuauuuccugaccauccacgcucuccagaagaaagccuaccuuguuaagaauaaaccaccgcaacgacugacaugguugacugugucaaccguauuucagcgugacgagacacccuguaguagcccugagaagguggcgaugcuagaugggucuagaaaggacaaagcccugccaaacuccggagaugaaacccucaugaggcggacgucaacuauuggcaagaaaagcguccagacaaucaguaaugagcagcgcgcaucuaaggugcugggcauuguuuucuuccuuuuucuguugauguggugccccuucuuuauaaccaacaucacucucgugcugugugacuccugcaaucaaacaaccuuacagaugcugcuagaaauuuucgucuggaucggguaugugagcucgggaguaaacccucucguuuacacgcuguuuaauaaaaccuucagagaugcuuuugguagguacaucacauguaacuaucgggccacuaagucugugaaaacccuucgcaagcgauccucaaagauuuacuucagaaacccaauggcugagaauaguaaauuuuucaagaaacauggcauaaggaacgggaucaaucccgccauguaucagagcccgaugcgguugcguuccucuacaauucaaagcucaaguaucauucugcucgacacucugcuucugaccgaaaacgagggagauaagacagaggaacaggucuccuacguguga

SEQ ID NO: 57470 - RNA, 1377 nt, Artificial Sequence
  derived and/or modified sequence opt3 from HTR2C__Homo_sapiens__NP_001243689
auggugaaccugagaaaugccguccacagcuuccucguucaucuuaucggccuguugguguggcagugcgacauuuccguaucucccguggcugcaauagucaccgauaucuuuaacacaucagacgggggaagguucaaguuuccugauggugugcaaaauuggccagccuuaaguauuguuaucauuaucauaaugacuaucggcgggaacauucuggugaucauggcggucagcauggagaaaaagcuacacaaugcuacgaacuacuuccucaugucccuggccauugcagacaugcuugugggacuguugguaaugccgcucucucugcuggccauccucuaugauuacguuuggcccuuaccucgguaucuguguccaguguggauaucgcuugacgucuuguuuucaaccgcuagcauuaugcaucugugcgcaaucagucuagaucgcuacguggccauucgaaaucccaucgaacacucccguuucaacucuagaacaaaagcuaucaugaagauugccauagugugggcgaucagcauuggcgucuccguuccuaucccagugauaggucucagggacgaggaaaaaguauuugugaauaacacuaccuguguccugaaugaucccaacuucgugcuuauugggucauuuguugcauucuuuaucccucugacaaucauggugauuaccuauugcuugacuaucuacguccuccggcgccaggcccugauguuacugcauggacacacagaggaaccaccgggccucagucuugacuuccugaaguguugcaagagaaauaccgcugaggaggaaaacagcgccaaucccaaccaggaucagaacgcaaggcggcgcaaaaagaaagagcgaagaccuaggggcacgaugcaagcuauuaauaacgaacggaaggccucuaaaguguuggggauaguauuuuucguuuuccuaaucaugugguguccauuuuucauuacuaauauccuguccgugcucugcgagaagucauguaaccagaagcugauggagaaacuucugaaugucuuuguguggaucggauaugucugcagcgguauuaaccccuugguguacacccucuucaauaagauauaccgucgcgcguuuaguaacuaucugagauguaauuacaaaguugaaaagaaaccuccagugaggcagaucccccggguagccgcaacagcuuuaucuggccgagagcugaacgucaauauuuaucgccacacuaacgaaccggugaucgagaaggccuccgacaaugaaccugggauugagaugcagguugagaaccuagaacuccccgugaauccaagcucggucgugucugagagaaucuccucaguauga

SEQ ID NO: 57471 - RNA, 1455 nt, Artificial Sequence
  derived and/or modified sequence opt3 from HTR3A__Homo_sapiens__NP_000860
augcugggcaagcucgccaugcuucugugggugcagcaggcuuuguuagcacugcuacuccccacccugcuugcccaaggggaggcgagaaggagccggaacacaacucgcccugcucuguugcgacucuccgacuaccugcugacgaauuaucguaaaggagucagaccaguuagggauuggcggaagccgaccacagugucuaucgacguaauuguguacgccauacucaacgucgaugaaaagaaucagguguuaacuaccuauaucugguaccgccaguauuggacagacgaguuccugcaauggaaccccgaagauuuugacaauauuaccaaacuuucaaucccuacugauaguauuuggguuccagacaucuugauaaacgaguucguggaugucgguaaaagccccaauaucccuuacguguauauuagacaccagggcgaaguacagaacuacaagccacugcagguugugacagcaugcucccuagacaucuacaauuuucccuucgauguccaaaacuguucucucaccuuuacgucguggcugcauacuauucaggacaucaauauaucacuuuggaggcugccugagaaggugaaaagcgaucggaguguguucaugaaccagggggagugggaauugcucggaguccugccauauuuucgcgaguucuccauggaaucuagcaauuacuaugccgagaugaaguuuuacguugugauucgaagaaggccguuauucuauguagugucccugcuccuucccucaaucuuucugauggucauggacauugugggcuucuacuugccuccaaacaguggugagcggguuagcuuuaaaaucacccuacugcucggguauucuguguuccugaucauugucuccgacacacuucccgcuacugcaauaggaaccccucugaucggcguguacuucguaguuugcauggccuugcucgugauuucacuggcugaaacaaucuuuauaguccguuuagugcacaagcaggaucugcaacagccaguccccgccuggcuacgccaucucgugcuggagagaauugcguggcuuuugugucugagggaacagagcaccagucaacggccgccugcaacgucucaggccacuaaaacagacgauugcuccgcuaugggcaaucacuguagccauaugggagggccccaggacuucgagaagucgccacgagaucgcugcucuccucccccacccccuagagaagccucccucgcaguuuguggucugcuucaggagcugucaaguaucaggcaauuuuuggagaagcgggacgaaauccgcgagguggcuagagauuggcucaggguaggcagcguccuggacaaauuacuguuccacauuuaccuacucgccgugcuggcguauuccaucacccuuguuauguuguggucuauuuggcaguacgccuga

SEQ ID NO: 57472 - RNA, 1326 nt, Artificial Sequence
  derived and/or modified sequence opt3 from HTR3B__Homo_sapiens__NP_006019
augcugagcuccgugauggcuccccucugggccugcauccuugucgcagccggcauucuggcgaccgacacacaccauccucaggauucugcuuuguaccacuuaucaaagcaacugcuacagaaauaucauaaggagguuagaccaguguacaacuggacuaaagccacgaccguauaucucgaccuguucgugcacgcaauacuugaugucgacgccgaaaaucagauccugaagacaagugugugguaccaggagguuuggaacgaugaauuuuugagcuggaacuccucuauguucgacgagauuagggaaaucucgcucccgcugucagcuauuugggcacccgauaucauaaucaaugaguuuguggacauugagcgguauccugaucugccauacgucuaugugaauagcagugggacuaucgaaaacuacaaacccauucaaguaguuuccgccuguucucucgagaccuacgcuuucccuuuugacgugcagaauugcagcuuaacauucaaguccauccugcauaccgucgaagauguggaccuugccuuuuugcgcucaccagaggauauacagcacgacaagaaagcguuccugaacgacagugagugggaacuacucagcgugucuuccacuuauucaauucugcagagcagugcaggagguuuugcccaaauccaguucaaugucguuaugcgacgucacccccuuguguacguagugucucuguugauuccuuccaucuuucucaugcuggucgauuuaggcagcuucuaucugccaccgaacuguagagcuaggaucguguuuaagacaucgguucucgugggguacaccgucuuccgggugaauaugucuaaccagguaccccgcuccguuggaucaacgccucuuauuggccauuucuuuacuauaugcauggccuuccugguguugagucuagcaaaaagcaucguccuggugaaguuucuccacgacgagcagagaggugggcaagaacagccauuccugugucuuaggggagauaccgacgcugaucggccccgcgucgagccucgagcccagagagcggugguuacagaauccucucuguauggcgagcauuuggcccaaccaggcacucucaaagagguguggagccagcugcagucaauuaguaauuacuuacagacccaagaccagacagaucagcaggaagcagaguggcugguacuacucuccagguuugaccggcugcuuuuccaaagcuauuuguuuaugcuggggaucuacaccauaacgcucugcucucugugggcucuuuggggaggugucuga

SEQ ID NO: 57473 - RNA, 1344 nt, Artificial Sequence
  derived and/or modified sequence opt3 from HTR3C__Homo_sapiens__NP_570126
auggagggcggguggcccgccagacagagcgcucugcucugccuuaccgugucccuguuguuacaaggaaggggugacgcauucacaaucaacuguucuggcuuugaucagcacggggucgacccugccguuuuccaggcgguguuugaucggaaggcuuuccgcccauuuacuaauuacucaauuccgacgcgaguaaacauaaguuucacccugagcgccauccuaggaguggacgcacagcuccaacugcuuacauccuuucuguggauggauuuggucugggacaaucccuucauuaacuggaauccuaaagaaugcgugggcaucaacaagcucacuguucuggccgagaaucuguggcucccagauauuuuuaucguggaaucuauggacgucgaucagacccccucggguuuaacagcuuauauaucaagcgaggggcguaucaaauacgacaagccuaugagagugaccaguauuuguaaccuggauaucuucuauuuuccauucgaccagcagaauugcacuuuuacauucuccucuuuccuuuacaccguagauagcauguugcugggaauggacaaagaaguuugggagauuacggacacuuccaggaaggugauccaaacccagggcgagugggaacuacucggcauaaacaaggcaacacccaaaaugucaauggggaauaaccuguaugaucagauuauguuuuacgucgccauccggcgcagaccuagucuuuauauuaucaaucuguuggugccaagcucuuuccucguggcuaucgacgcccuguccuuuuacuuaccggcggagucagaaaacagggcacccuucaagauuacucugcuccuuggauacaaugucuuucuguugaugaugaacgaucuacugccugccagcgguaccccacucauaaguguuuauuucgcucugugucuuucucugauggugguauccuugcucgagacaguguuuaucaccuaccuguuacaugucgccacgacucagcccccuccaaugccccgguggcugcacagccuacuccugcauugcacaucgccgggccgcuguugcccuaccgcaccccaaaaagggaacaagggacuuggcuugacucugacacaccucccagguccuaaagagcccggggaacuggcuggaaagaaacuuggcccacgagagaccgaacccgacggcgggucuggauggacgaagacccagcugauggaguugugggugcaguucucccaugccauggauacacuccuguuuagauuauaucugcuauucauggcgucaaguauucucacuguuaucgugcuguggaauaccuga

SEQ ID NO: 57474 - RNA, 1215 nt, Artificial Sequence
  derived and/or modified sequence opt3 from HTR3D__Homo_sapiens__NP_001138615
auggagagaggcugguuccacgggaagggauuucugcucgguuucauccuucaucuguuguuacaggacagccaccuacaacuggugaccuccuuucucuggcugaacauguggaaucccgaugaaugcggcgggauuaaaaagucuggaauggccacagagaaccuuuggcugucagacgucuucauagaagagaguguugaucagacuccugcuggcuugauggcaagcauguccaucgugaaagccacgucuaauaccauuucgcagugugguuggucagcgagcgcuaacuggacaccaaguaucuccccgucuauggacagaggggaacggagccccuccgcccucucaccuacucagguaacccgcgcauggcgacguaugaguaggagcuuucaaauucaucacaggacaucuuuccggacccgcagagagugggugcugcugggaauccagaagaggacuauaaaagucacaguggccaccaaucaguacgagcaggcuaucuuucauguugcaauucggcgccgaugcagaccaucccccuauguggucaacuuccucgugccuucaggcaucuuaauugccaucgaugcucugagcuuuuaccuuccauuggaaaguggcaauugugcccccuucaagaugacgguacugcuaggguauucuguuuuucuccugaugaugaacgaccuucugccugcgacuuccaccagcucgcacgcaucuuuggugaggccacacccgucccgggaucaaaagcguggagucuacuucgcccucugccugucauuaaugguggguagucugcucgagacaauauuuauuacucaucuucugcacguggcuaccacacagcccuugccucuaccacgcuggcugcauagccuccugcuucacuguaccggccaggggagaugcugucccacggccccucagaaaggaaauaagggcccaggucugacucccacacacuugccgggggucaaagaaccugagguuuccgcaggacaaaugcccggcccaggcgaggcugaacucaccgggggaucugaguggacuagggcccagcgggaacaugaggcgcagaagcaacacagcguggaacuguggguacaguucucacaugccauggacgcauuacuguuccgacuauaucuccuguuuauggcuaguuccaucauuacagugaucugccuuuggaacaccuga

SEQ ID NO: 57475 - RNA, 1371 nt, Artificial Sequence
  derived and/or modified sequence opt3 from HTR3E__Homo_sapiens__NP_001243542
auggagggcagcugguuccacagaaagagguuuuccuucuaccugcuccuuggguuucuguugcagggacggggugugaccuucacaaucaacugcucuggcuuugggcaacauggagccgaccccacugcuuuaaauucagucuucaaccgcaaaccuuuucgaccaguuacgaauauuagugugccgacccagguaaacaucagcuucgcaauguccgccauacuggaugugaaugaacagcuacaccuccugucuucguuucuuuggcuggagauggucugggacaaccccuucauuucauggaauccugaagagugugaaggcaucacaaagaugagcauggcggcuaaaaacuuguggcucccagauauuuuuaucauagagcugauggacguggauaagacucccaaaggucugaccgccuauguuaguaaugaggggcguaucagauacaagaagccuaugaaaguggacuccauuugcaaccucgauaucuucuauuuuccauucgaccagcaaaauuguacauuaaccuucucuagcuuucuguacacugucgauuccaugcuuuuggacauggaaaaggaggugugggaaauuacagaugcaucaaggaacauccugcagacccauggagagugggagcuacucggccugaguaaagccacggcuaagcucagccggggcgggaaucuguaugaccagauaguauucuacguugcaauucgcagaaggcccucuuuguaugugaucaaccuccuggucccuuccggauuuuuaguggccauugaugcucugucauucuaccucccagugaaaagcgguaaucgggucccguuuaagaucacucuucuguugggcuacaacguuuuccuacugaugaugagugaccuccugcccaccucugggacaccucuuaucggaguguauuuugcccugugcuugucccucaugguaggcagccuguuagaaacuauuuucauaacccaucugcuacacguggcgacaacccagccacccccucucccacgcuggcugcacucgcuuuugcugcacuguaacucucccggucgaugcuguccgacggcaccucaaaaggagaauaaagggcccggacucacuccaacacaucugccuggcgucaaggaacccgagguguccgccggccagaugccagggcccgcugaagccgagcuuaccggagguucagaguggacuagagcacagagggaacacgaggcucagaaacaacauaguguugaacugugguugcaguuuagccacgccauggacgcgaugcuuuuccggcuguacuuacuguuuauggccuccucuaucauuacagugaucugccuauggaacaccuga

SEQ ID NO: 57476 - RNA, 1167 nt, Artificial Sequence
  derived and/or modified sequence opt3 from HTR4__Homo_sapiens__NP_000861
auggacaagcuggaugccaacgugagcuccgaggaaggcuucgggucugucgagaaaguugugcuccuuaccuuucugucaacaguaaucuugauggcuauuuuaggaaaucugcuagugauggucgcagugugcugggacagacagcucaggaagauaaaaacuaacuacuucaucguuagucuggccuuugcggaucuucuggugagcgucuuggugaugcccuucggugcuauugaacucguacaagacaucuggauuuauggcgagguguuuugucugguucggacgucccuggauguccucuuaaccacagccucuaucuuccaccugugcuguauaucgcuugaccgcuacuaugcaaucugcugucagccuuugguguaccgaaauaagaugacuccacugcguauugcccuaaugcucgggggaugcugggugaucccgaccuuuauuucauuccugcccaucaugcagggcuggaacaauauagguauuaucgaucuuauugagaaaagaaaguuuaaccagaauagcaacaguacauauugugucuucaugguuaauaagccuuacgcuauuaccugcuccgugguagcauuuuauaucccauuccuguugauggugcucgccuacuacaggaucuaugucacugcuaaagaacaugcccaccaaauacagaugcugcagcgggcgggggcaucuagcgagucccgcccccagucagccgaccaacauaguacacacagaaugaggaccgaaacgaaggcugccaaaacuuuauguaucauuaugggaugcuuuugucugugcugggcaccuuucuucgugaccaacaucguugauccauuuauagacuacacagugcccggccaggucuggacugcuuuccucuggcuuggcuauauuaauagcgggcugaaccccuuuuuguacgccuuccuaaauaagucuuuucggcgcgcguuccugaucauccucugcugugaugacgagcgauauagaaggccauccauucugggacagaccgugccgugcucaacaaccacgaucaacgguagcacucauguacuucgggaugccguugaauguggcgggcagugggagagucaaugccacccuccugcaacaucuccacugguggcugcccagcccuccgacaccuga

SEQ ID NO: 57477 - RNA, 1074 nt, Artificial Sequence
  derived and/or modified sequence opt3 from HTR5A__Homo_sapiens__NP_076917
auggaccugcccgugaaccucaccagcuucucccuuucuacaccuucaccacuggagacuaaucacaguuugggcaaggaugacuuaagaccgagcaguccccugcuaucugucuuugggguucucauccugacgcuucugggauucuugguggccgcuaccuuugcauggaaccuccugguacuggccacaauucucagggugcggacuuuccaucgcgucccucacaauuuaguggcgucgauggcuguuucagaugugcuggucgccgcacuugugaugccauugagccugguacaugaacuaaguggucgacguuggcagcucggcagaaggcugugccaacuuuggauagccugugacguucugugcuguaccgcuuccaucuggaacgugacagcaauugccuuggaucgguacuggucuaucacccgccacauggaguauacucucagaacaaggaaaugcgucagcaaugugaugauugcucugaccugggccuuauccgcggugaucucacuggcaccccuccuuuuuggguggggagaaacguacagugagggcagcgaagagugucaggucucucgggagccuuccuaugccguuuucucaacugugggugcuuuuuaccugccauugugcguagugcuauucgucuauuggaagauauacaaagccgcaaaguuucgcguggggagccgaaaaaccaacaguguuucucccaucuccgaagcuguggaggucaaggacagcgccaagcagccucagaugguguucacaguaagacaugcgacuguuaccuuucaaccagaaggagauacauggagggagcagaaagagcagcgggccgcacugauggugggcauucucaucggcgucuucgugcuguguuggauuccguuuuuccuuaccgaacugaucucgcccuugugcucuugugacauaccugcuauuuggaaguccaucuuccucuggcugggguauucaaauuccuuuuucaacccauuaauuuacacggccuuuaauaaaaacuacaauagcgcuuucaagaacuuuuucucccgucagcacuga

SEQ ID NO: 57478 - RNA, 1338 nt, Artificial Sequence
  derived and/or modified sequence opt3 from HTR7__Homo_sapiens__NP_000863
augauggacgugaacagcuccggcagacccgaucuguacgggcaccucaggucuuuccuucugccugaggucggacgggguuugccagacuuaucaccggauggcggggccgaccccguugcuggaaguugggcaccucaucugcuaagcgaagugaccgccuccccagcgcccacaugggaugcuccuccagacaaugccucuggcugcggugagcagaucaacuaugggcgcguagaaaagguggucauuggaucgauacucacucugaucacgcuucugaccauugcaggcaauuguuuggugguuaucucagugugcuuugucaaaaagcuccgacaacccagcaacuaccugauugugagucuggcccucgcugauuuauccguagcaguugccgugaugccuuucgucucugugacagaccugaucggcgggaaauggauauuuggacacuucuuuuguaauguguucaucgcuauggaugucaugugcuguacugccagcauuaugacccuuugcguuaucuccauugaccguuauuuggguaucacaagaccacugaccuacccggugaggcagaacggcaaguguauggcgaaaaugauacuaucaguauggcuccugagugcaagcauuacucuucccccucuguuugggugggcccagaaugugaacgaugacaaggucugcuugaucucucaggauuucggauauacaauuuacuccaccgcuguggccuuuuauaucccaaugucaguuaugcuguucauguacuaccaaaucuauaaggcagcucggaaaagcgccgcgaagcauaaauuucccggcuucccucgcguggagccagacagugucauugcccucaaugguauagugaaguuacagaaagaaguagaggagugugcaaaccugucuagacuccuuaagcacgaaaggaagaauaucuccauuuuuaaacgggagcagaaggcugccacgacucuggggaucauaguuggagcuuucaccgugugcugguugcccuucuuucuacugagcacagcccgcccguucauuuguggcacuucgugcucuugcaucccucucugggucgaacgaaccuuucuguggcuuggcuacgcaaacucccugaucaaucccuucauuuaugccuuuuucaacagagacuugaggacaaccuaccggucacuccugcagugucaauaucguaauaucaaccgcaaauuaagugcugcggggaugcaugaggcacugaagcuagccgagagaccagaaaggccugaguuugugcuccagaacgcugauuacugccggaaaaagggacacgacagcuga

SEQ ID NO: 57479 - RNA, 1443 nt, Artificial Sequence
  derived and/or modified sequence opt3 from HTRA1__Homo_sapiens__NP_002766
augcagauccccagagccgcucugcucccucuucuguuguuacugcuagcagccccagcgagcgcucaacucuccagggccggccggucugcaccgcuggccgcugggugccccgaccgcugugagccugcacgaugcccaccccagccugaacacugugagggaggucgugccagagaugcuugcggcuguugcgaaguguguggggccccagagggagcggcaugcggccuucaggaaggucccuguggggagggacugcagugcgucguuccuuucggcgugccagccucagcuaccguaaggcggcgcgcccaagcaggcuugugugugugcgcuaguagcgagccggucugcggguccgacgccaacacauacgcgaaucucugucagcugagagccgcaucuaggcggucggaacgccugcaucgacccccugugauuguucuccagagaggagcuugcggucagggccaagaggauccaaacucauuaaggcacaaguauaauuuuauagccgacguggucgaaaagaucgcucccgccgugguacauauugagcuguuccggaaacuuccuuuuagcaaacgugagguuccaguggcaaguggguccggauucaucgucucugaagauggcuugauugugacuaacgcccacguggucacgaauaagcaucgcguuaaaguggagcugaagaacggugcuaccuacgaagcgaagaucaaagacguagaugagaaggcagacauagcccuaaucaaaauugaucaccaggggaagcuccccgugcugcuucugggaagaagcuccgaauugaggccgggcgaguuugucguggcuaucggcucaccuuucagucuccagaauacaguuacuaccgggauugugagcacaacccagcggggagguaaagagcugggcuuacgaaacucugacauggauuauauccaaacugacgccauaauuaauuacgggaacuccggaggcccccuggucaaucucgauggugaagugaucgggauuaacacacuuaagguaaccgcaggcaucucauuugccaucccaagcgacaagauuaaaaaguuccugacggagagucacgaccgccaggcuaaaggaaaggccauaacuaaaaagaaauauaucggcauuagaaugaugucuuugaccuccagcaaggcaaaggaacuaaaagauaggcaucgggacuuuccugauguuaucucgggggcguacauaauugaggugauccccgacacaccagcugaagccggaggucugaaggagaaugaugucaucauuucuaucaacggccaguccguggucucagcaaaugacgugagugauguuauuaaacgcgagagcacucucaacauggugguaagaagggggaacgaagacauaaugaucaccgucauucccgaggaaaucgauccuuga

SEQ ID NO: 57480 - RNA, 1377 nt, Artificial Sequence
  derived and/or modified sequence opt3 from HTRA2__Homo_sapiens__NP_037379
auggccgcucccagagcaggcaggggagccggguggagccugcgggcguggcgcgcucucgguggcauccgaugggggcguagaccuaggcuuaccccagaccugcgggccuuguuaacauccggaacuucugauccgcgcgcaagagugacguacggcacccccucacugugggccaggcuaagugucgguguuacagagccucgggcuugccucacuagcgggaccccaggaccccgcgcacagcugacagccgugaccccugacacucgaacaagagaggcuuccgaaaacucuggcaccaggucgcgggccuggcuugcgguagcacugggcgccgggggagcuguguugcuccugcugugggguggcgggcguggaccacccgccguccucgcagcugugccuucaccaccgcccgccagcccucgcagucaauauaauuucauugcggauguuguggaaaagacggccccagcagucguguacauagagaucuuagacagacaccccuuucugggcagggaaguaccuauuuccaacgguucuggguucguuguggcugccgauggacuuaucgucacuaaugcucaugugguggccgaccggcgacgcgucagaguuagguugcugagcggcgauaccuaugaggcagugguaacagccguggacccagucgcugauauugcgacucuacggauccagaccaaagagccccucccgacacugccucuuggccgcuccgcagacgugagacagggggaauuuguuguggccaugggaucacccuucgcucugcagaacaccauaacgagugguaucgucagcucugcccaaaggccagcacgugauuugggccucccucagacuaauguggaguacauucagacagacgccgcuaucgauuuugggaacuccggaggcccccugguaaauuuagacggugaaguuauuggggugaacaccaugaaggucacugccggcaucucauucgcaauaccaagcgaccggcugcgagaguuucuccacagaggagagaaaaagaauaguucuuccggcauuagcgggucgcagaggcgcuauaucggagugaugaugcuuacacugucucccuccauuuuggcggaacuacaacugcgggagccuucauucccagauguccagcauggugugcucauccacaaaguuauccugggcaguccggcucauagagccgggcuuaggcccggagacgugauucuggcaauaggcgaacagaugguacagaacgccgaggaugucuacgaagcugugcgcacccaaagccaguuggccguucagauccgacggggucgugagacgcucacccuguaugugacaccugaggucacugaauga

SEQ ID NO: 57481 - RNA, 1074 nt, Artificial Sequence
  derived and/or modified sequence opt3 from HTRA3__Homo_sapiens__NP_001284488
augcaggccagagcucugcuccuugcagcccuggcggcuuuggccuuagcaagggagcccccugccgcuccaugcccggcacggugugacgugagccgcugccccuccccucgauguccaggcggguacguccccgaucugugcaacuguugccuaguuugugccgcuucugaaggagagccuugcgguggcccacucgacucacccuguggggaaagucuggagugcgugcguggacuuuguagauguagguggagccacgccguaugcggcaccgauggucauacauaugcgaaugugugcgcacugcaagccgcuucccggcgcgccuugcagcucucugggacuccugucagacagcugcagaagggagcaugcccacugggccuccaccaauuaucgucaccgagguacaaauucaacuuuaucgcugacgugguugaaaagauugcccccgcggugguccauauagagcuguuccuucggcacccuuuguuuggccgcaaugugccacugagcaguggguccggauucaucaugucugaggccggucuaauuaucacgaacgcacauguaguuagcuccaauucagcugcccccggccgacagcagcucaaagugcagcugcaaaacggggauaguuaugaagcuaccauuaaggacaucgauaaaaagagcgacauagccacaaucaagauucacccuaaaaagaaacuuccaguccuguugcucggacacucugcagaucugagacccggcgaguuugugguggccaucgguuccccguucgcuuuacagaauacugucaccacagggauuguuucaaccgcgcagagggaaggacgggagcugggccuccgugacagcgauauggacuacauccagacugaugcaauaauuaacuauggcaauagugggggaccucuugugaaccuggacggugagguaaucggcauuaauacauugaaggugaccgccgggaucucuuuugcuauccccuccgaccgcauuacgagauuccuaacugaauuucaagauaaacagauaaaggccccaagccuggcaguccauuga

SEQ ID NO: 57482 - RNA, 1431 nt, Artificial Sequence
  derived and/or modified sequence opt3 from HTRA4__Homo_sapiens__NP_710159
augaucagaccccagcugaggaccgccggccucgggcggugccuucugccuggauuguuacugcuacucgugccaguccugugggcuggugcagagaaacuucacacacaaccgagcugucccgccguuugccagccuacucgcuguccagcgcugcccacgugcgcuuugggcaccacaccuguguucgaccucugucgaugcugucguguaugcccagccgcagaaagagaggugugugggggagcccagggccagcccugcgcuccuggucugcaaugucugcagccacucaggccgggguuucccuccacuugcggaugcccuaccuuaggcggcgcagucugugggucugaucggcgcacauacccaucaaugugcgcccugagagcugaaaacagggccgcgcggcgccuuggaaaggugcccgcaguuccugugcagugggguaauuguggcgacaccgggacucgaagugccggaccauugagaaggaacuauaauuucauugcugccgucguggagaagguagcacccagcguugugcauguccagcuguggggccggcuacuccacgguucccgucuggugccgguguacucugggucgggauuuauagucucagaagauggccuuaucauuacaaacgcucauguugugcgcaaucaacaguggaucgagguagugcugcagaacggcgccagauaugaggcggucgugaaagacauugauuugaagcucgaccuggccguuaucaaaauagaaagcaaugcagaguuaccugugcugaugcucgggaggaguuccgaucuucgggcuggagaguucgucguggcccuggguucucccuuuagcuugcagaacaccgcuacggccggcaucguauccacuaagcaacgagggggaaaggaacuaggcaugaaagacucagauauggacuacguucagauugaugcaaccaucaauuaugguaacagugggggcccacuggugaaucucgacggagaugucauuggcgugaacagccugcgcgucacagacgggaucucuuucgccauaccuuccgacagagugaggcaguuucuugcugaguaccacgaacaucaaaugaagggaaaagcguucucaaauaagaaauaucuggguuugcagaugcucagccugacuguucccuuaagugaggaacugaagaugcacuacccagauuuucccgacgugucuuccggcguauacgucugcaaggugguugaggggaccgcagcccagagcucgggacuacgggaucacgacgugauugucaacaucaauggcaaaccuauuacaaccacgacugaugugguaaaggcucucgacucugauucccugucaauggccgugcuucgcgguaaagacaacuugcugcucacaguuaucccagaaaccaucaacuga

SEQ ID NO: 57483 - RNA, 9435 nt, Artificial Sequence
  derived and/or modified sequence opt3 from HTT__Homo_sapiens__NP_002102
auggccacacuggagaagcucaugaaggcuuucgaaagccuuaaguccuuucagcaacagcagcagcaacagcagcagcaacagcagcagcaacagcagcaacagcagcagcaacagcagccaccuccaccgccaccuccacccccuccaccccagcugccucaaccaccgccccaggcacagccuuuguuaccacagccccaaccuccacccccgccucccccaccucccccaggccccgccguggcggaggaaccucugcaccgacccaagaaagagcuaucugcuaccaaaaaggacagggucaaccacugccucacuaucugugaaaauauuguugcccagucagugcggaacaguccggaguuccagaagcugcuugggauagcaauggagcuguuuuugcucugcagcgaugacgccgaauccgauguacgcaugguggcugacgagugucugaauaaagucaucaaggcacugauggauucuaaccucccccgauuacagcuggaacuuuacaaagagauuaagaaaaauggggccccucguucguugagagcugcccuguggagguucgcggagcuagcacaccucgugcggccacaaaagugccgccccuaucugguuaaccuucugccuuguuugacgagaaccucaaagaggccagaagagagcgugcaggaaacacucgccgcugccguccccaaaaucauggcaaguuuugguaauuucgcuaacgacaaugagauuaaggugcuguuaaaagccuuuaucgcgaaccugaaguccucuagcccgacuauacggcgcaccgccgcaggcuccgcuguaucaaucugccagcacagucgaagaacacaauacuucuauagcuggcuccuuaauguucuguuggggcuacuggugccugucgaagaugagcacucuacccuccugauucuuggagugcuguugacucucagguaccuggugccauuacugcagcagcaggucaaagacacaucccuaaagggcucauuugguguuacccggaaagagauggaagugagccccagugccgagcaacucguacagguguaugaacugacgcuucaucacacucagcaccaggaucauaacgucgugaccggggcuuuggagcugcuccaacagcuguuccguacaccucccccagaacuucugcagacuuugaccgccguuggaggcaucggccagcucacagcagccaaggaggagucugggggacgcuccagaagcgguucgauuguggaacugaucgcuggcgggggaucuuccuguucaccugucuuaaguaggaagcaaaaaggcaaggugcugcuaggugaggaagaggcgcucgaagacgauagcgagucccggucugacguaagcucaagugcacugaccgccuccguuaaagaugagauaagcggggaacuugcugccucuucaggagugaguacgcccggcagcgcaggccacgacauuaucacugagcagccacgaucccagcauacauugcaagccgacucugucgaucuggcuucgugcgaccucaccagcuccgccacugauggggacgaagaggauauucugucacacaguucuagccagguguccgcagucccgucagacccugcgauggauuuaaaugacggaacacaggcuagcucucccaucuccgauaguagccagaccacgaccgaggguccagacucugccgugacacccuccgauucaagugaaaucguucuggacggcacugacaaccaauaccuuggguugcagauuggacagccucaggaugaggacgaagaggcaaccggcauacucccagaugaagccagcgaggcuuuucgcaauucguccauggcccugcaacaggcacaccuacugaagaacaugucucauuguagacagcccagcgacucaaguguggauaaauucguacucagggacgaggcuacagaaccuggugaucaggagaacaagccgugccggaucaagggggacauuggccaauccacugaugacgauucugccccacugguccacugugugcgccuuuugagcgcguccuuucuguuaaccggaggcaaaaauguucucgugcccgacagagaugucagggugucaguaaaggcccuggcucuuagcugcgugggggcagccguugcucugcauccugaaaguuucuucucuaaauuguauaaggucccacucgacacaaccgaguaccccgaagaacaauacguguccgacauccugaacuauauagaucacggagacccucaggugcguggugccacugcaauucuaugcggcacgcugaucuguagcauccucucgcggucacgauuucaugucggggauuggaugggaacaauuagaacccugacuggcaauaccuucucucuugcggacugcaucccguugcugaggaaaacauuaaaggaugagaguuccguuaccuguaagcucgccugcacugcugugcgcaacugugugaugagccugugcucuagcuccuacucagaacuuggucugcagcuaauuauagacguacucacacugcggaauaguagcuauugguuggucagaacggagcuguuagaaacccucgccgagaucgauuuuaggcuggugucuuuccuugaagcaaaagcugagaaccugcaccgcggggcccaccauuacacuggcuugcucaagcugcaagagcgaguucuaaauaacguggucauucaucugcuuggagacgaagauccccgggugcgucauguugcagccgcuucccucaucagacuggugccaaaauuguuuuauaagugugaccagggccaggcggauccuguagucgccguggcaagggaccaaucaaguguguaccugaaauuacucaugcacgagacacagcccccaagccacuucuccgucucuaccaucacacgcauuuaucggggguacaaucugcuuccuucgauaacugauguuaccauggaaaacaaucugagcagagugaucgcugccguaucacaugaguugauuacguccaccacaagggcccucacuuuuggaugcugugaggcucugugccuacugaguaccgcauuccccguguguaucuggucucuugguuggcacugcggcgucccaccgcucagcgccuccgacgaaucacgaaagucuugcacaguggggauggcgacuaugauucugaccuuguuaagcagugcuugguuuccucuggaccucuccgcccaucaggaugcacugauccuugccggaaaccuguuggcugcaagcgcccccaagucucuacgcucauccugggcgagugaggaagaggcuaauccagccgcaacgaaacaggaagagguuuggcccgcccugggcgaccgggcucucgugccuauggucgagcaacuguucagccaccuuuuaaaggugauaaacaucugugcccauguucuggaugacguggcaccaggucccgcuauuaaagccgcgcucccuucguugacaaauccgccaucucugucccccaucagaaggaaggggaaagaaaaggagccuggcgaacaggccagcgucccccucucacccaaaaagggaagugaggcaucugcugccucccgucagagcgauaccucaggcccuguaacuacaaguaagagcuccucucuggggagcuuuuaccaccuucccuccuaucugaaauugcacgacgugcuaaaggcuacccaugcaaacuacaaaguuacucuggaucuccagaacucaaccgaaaaguucggaggcuuuuuacgcucugcccuggacgugcuuagucaaauucuggagcucgccacauugcaggauaucgguaaaugcgucgaggaaauacugggguaucucaagucguguuucagccgggagccaaugauggcuacggugugcguacagcagcugcuuaagacccuauucggaacuaaucuggcgucccaauuugacggcuugucuucaaacccuagcaaaucccaggguagagcacagagguuaggcaguucuagcgugcgaccggggcuguaccacuauuguuucauggcccccuacacacauuuuacccaagcucucgccgaugcaucacugcggaauaugguccaggccgaacaggagaacgacacauccggaugguucgacguucuucagaaggugaguacucaacugaaaaccaaucucacgagcgugacaaagaaccgcgcugauaaaaaugcgauucacaaccauaucagauuguuugaaccacuggucauuaaggcccuaaagcaguauaccacuaccacaugcgugcagcugcagaaacaaguucucgaccuucuggcacaguuaguacaguugagggugaauuacugucugcucgauucugaccaggucuucaucggcuuugugcugaagcaauucgaguacauagagguugggcaguuucgggaauccgaggcuaucauuccuaacaucuucuuuuuccuugugcugcucucauaugaacgauaccacagcaaacagauuaucggaauacccaagauuauccaguugugcgauggcaucauggccucggguagaaaagcagucacucacgccauuccagcucugcaaccuaucgugcaugacuuauuuguacuacgcgggaccaauaaggccgaugcgggaaaggagcuggagacacagaaagaagucgugguuucuaugcuccuuaggcugauucaguaucaccaaguguuggagauguucauacugguccuccagcagugucauaaggaaaacgaggacaaauggaagcgucugagucggcagaucgcagauauuauccuucccaugcucgccaaacaacagaugcacauugacucccacgaagcucugggcguguugaauacgcuguucgagaucuuagccccgagcucacuaagaccaguugauaugcugcucagguccauguuugugaccccuaacacuauggcuucugucagcacagugcagcuuuggauaagugguauccuggcaauuuugcgcguacugaucucccagagcaccgaggacauugugcucucucgaauccaagaacugucauucagucccuaccuuauauccugcacuguuauuaauagauuacgggauggcgacagcacaucuacccuggaggaacauucggaggggaagcagaucaaaaaccucccagaagagacguuuucaagguucuugcugcagcuagucggaauccugcucgaggacauugugacuaagcagcuuaagguggaaaugagcgagcaacagcacaccuuuuauugucaggaacugggcacauugcugaugugccucauacauaucuucaaauccgggauguuucgccguauuaccgccgcugccacuagacuguuccggagugauggaugcggcgguucuuuuuacacauuagacagccuuaaccugagggcacgcuccaugaucaccacacaccccgcgcucguccuacuguggugucaaauuuugcugcucguaaaucauacugauuaucgauggugggccgaggugcagcagaccccuaagagacacucacuuaguucuacgaaacuguugagcccgcagauguccggggaagaggaggacucagaucuggcugccaagcucggaaugugcaaccgggaaaucguuaggcgcggcgcauuaauacuguucugugacuacgugugccaaaaucuucacgauagcgagcaucugacauggcuaaucgucaaccacauucaggaccucaucucucugucccaugaacccccagugcaggauuuuauuagugcuguucacagaaauagcgccgcaucggguuuguucauccaggccauacaauccaggugugagaaccugucuaccccuacuaugcucaaaaagacccuucagugccuggagggcauucacuuaucacagagcggggcugugcugacauuguacgucgaccggcuccuguguacucccuuccgugugcuagcgcgcaugguagauauccuugccugccgaagaguggaaaugcugcucgcagcuaaucugcagaguuccauggcccaauugccuauggaggaacugaacaggauccaggaguaucuccagucuagcggacuugcccaacggcaucagcgccuguacucauuacuggacagauuuagguuguccaccaugcaggauagucucagcccaucucccccuguuucaucccacccacuggacggcgacgggcaugucagccuagaaacggugucucccgauaaggacugguaugugcaccuugucaaaagucaguguuggacacggucggauuccgcacugcucgagggagcugagcugguuaaucgcauuccggccgaagacaugaacgcguucaugaugaauagcgaguuuaacuugucauuacuggcuccuugccucucucuuggcaugagcgaaaucuccggugggcaaaagagugcccuguucgaggcagccagagaagugacccuagcuagaguaucaggaacugugcagcagcugccagcaguccaucacguguuucagcccgagcucccugccgagccagcggcuuacuggucuaaauugaaugaucuguucggcgacgccgcacuuuaucaaagccugcccacacucgccagggcuuuagcccaguaccugguuguggucuccaaguugccgagucaucugcaccucccucccgaaaaagagaaggauauaguaaaguuugugguugcaacccuugaagcucugagcuggcaccuaauucaugagcagaucccacugucccucgacuugcaggccggccuggauuguugcugccuugcgcugcaauuaccugggcucuggucuguggucucaagcacugaguucgugacacacgccuguucgcugauuuauugcguccacuuuaucuuggaggcaguggcuguucagcccggagagcagcugcucuccccagaacggcguaccaacacgcccaaagccauaagugaggaagaggaggaaguggacccuaauacucagaacccaaaguacauuaccgcagcuugugagaugguagccgaaaugguggagucucuucaaagcguccuggcccuaggucauaaaagaaacucaggcguuccggcguuccugacaccccucuugaggaauaucaucauuucccuggcucgcuuaccucuugugaacucuuacacccgggucccaccccugguguggaagcucggguggaguccuaaaccaggaggcgauuuugguacagcauuccccgaaaucccuguagaguuucugcaggagaaggaaguguucaaggaguucauuuaucgaauaaauacuuugggguggaccagcagaacgcaguuugaagagacaugggccacucugcucggaguucuugugacccaaccgcuggucauggaacaggaggaguccccacccgaagaggacacagaaaggacccagaucaacgugcuagcuguccaggccauuacuucacugguguuaagcgcaaugaccguuccuguagccggcaaucccgcugugucuugccucgagcaacagccacgcaacaaaccucugaaggcguuggacacacgguucggcagaaaacuuaguaucauccgugggauugucgaacaggagauacaggccaugguguccaagagggagaauaucgcaacgcaccaucuguaccaggcuugggaucccguuccaagccucucaccggccacuaccggagcacugauuucucacgaaaaauugcugcuacagaucaacccugagcgggaacucgguuccaugucguauaaacuuggccaggugagcauucauagugucuggcugggaaauucuaucacacccuuacgcgaggaggaaugggacgaggaagaggaagaggaggccgaugcuccagcccccuccagcccuccaaccucacccgugaacagucgaaagcacagagcgggaguagacauacacuccuguagccaguuucugcucgaacuguacucuagguggaucuugccuucaagcuccgcacggcgcacuccggccauucuuaucucugaggugguuagaagucugcucgucgugucggaucuguucacagaaaggaaucaauuugagcuaauguaugugaccuugacggaacugcgacggguccauccaagcgaggacgagauucucgcucaguaccuuguucccgccacuugcaaagcagcugccgugcugggcauggauaaggcuguagccgaaccugugucccguuuacuggagucaacacucagaucuagccaucugccaagucgcgucggugcauugcauggggugcuuuauguucuggaaugugaccuccuggaugacaccgcgaaacagcuaauccccgugauauccgauuacuuacugucaaacuugaagggaauugcccacugcgucaauauccauucucaacagcacgugcucguaaugugugcuaccgccuucuaccugauugagaacuauccucuugacguuggccccgaauuuagcgcauccaucauacagaugugcggcgugaugcugagugggagcgaggagucuacuccaucaaucauuuaccacugugcucucaggggacuggaacgguugcuucuguccgagcagcuaagcagacucgaugccgaaagucuggucaaauuaucuguggaccgcgugaauguccauuccccgcacagggcaauggccgcgcuggguuugaugcucacaugcauguauaccggcaaggagaaaguuucgccugggcgaacaagcgaccccaacccagcugccccugauucagaguccgugaucguagcaauggaacgggugucuguccuguucgacagaauuaggaagggauuucccugcgaggcccgcgugguugcucguauccuuccacaauuccuggaugacuuuuucccuccccaggauauaaugaauaaggugauuggcgaauuucucaguaaccagcagccguacccacaauucauggccacugucguguauaaaguauuccagacguugcauagcaccggucagucauccaugguucgggacugggugaugcugagccuuucuaacuuuacacagagagcaccugucgcuauggccacuuggagucuguccuguuucuuugugagcgcgucaaccucucccuggguugcugccaucuuaccacacgugaucucgaggauggggaagcuagagcaagucgaugugaaucucuucugccugguagcaacagacuuuuaccgccaccagauugaagaggagcuggaucgacgggccuuccagagcguguuggaagucguugcugcacccggauccccuuaucauagacuccugaccugucuuaggaacgugcacaaagucacuacgugcuga

SEQ ID NO: 57484 - RNA, 2145 nt, Artificial Sequence
  derived and/or modified sequence opt3 from HUNK__Homo_sapiens__NP_055401
augcccgccgcugcaggcgacgggcugcucggagagccugccgcgccagguggcgggggaggcgcugaagaugccgcaagaccggccgcugcaugcgaggguagcuuccuucccgccuggguguccggggucccuagggaacggcugcgcgacuuucagcaccauaagcgaguuggaaacuacuugaucggcucucguaaauuaggcgaggggucauucgcuaaggugagagaaggacugcacguacuaaccggugagaaaguggccauuaaggucauagauaaaaagagggcgaagaaagacacauaugugacuaagaaucuccggcgcgagggccaaauccagcagaugauuagacauccaaacaucacgcagcugcuugauauucuggaaaccgagaauaguuacuauuugguuauggaacucugucccgggggaaaccugaugcacaaaaucuacgagaagaaaaggcuggaggaaagcgaggcacggcgcuauauacgacaacucaucuccgccguggaacauuuacacagagcuggcgucgugcacagggaccugaagauugagaaucuuuugcuggaugaagacaacaauaucaagcuaauugauuuuggucucucuaacugcgccgggauccugggauacucggacccuuucucaacacaguguggcagcccagcauaugcugcccccgagcuucuggcgcggaaaaaguacggcccuaaaauagauguauggaguauugggguuaauauguacgccauguugacuggaacccucccauuuacaguggagccguucucccugcgugcauuauaucagaagauggucgacaaagaaaugaacccccugccuacccagcucucuacuggugcuaucagcuuucuucgcucccuguuggagccagaucccgugaagagaccuaauauucaacaggcccuagcuaacagguggcugaaugaaaacuacacaggcaaagugccaugcaaugucaccuaucccaaccggaucucacucgaggaccugaguccgagcguugugcuucauaugacggaaaagcugggguacaagaacucugacguaaucaauacuguguuguccaaccgagccugucacauucucgcaauauauuuccuguuaaauaaaaagcuggagcgcuaccuaucaggaaaaagcgauauccaggacagucucugcuauaagaccagacuguaccagauugagaaauacagggccccuaaggaaucuuaugaggcuucccuugauacauggacucgggacuuggaauuucaugcgguccaagauaagaaacccaaggagcaggaaaaacgcggcgacuuccugcacagaccauuuagcaagaaacucgauaagaaccugccuucgcacaagcagcccucugguucccuuaugacccaaauccagaauacaaaagcacuguugaaggacaggaaagccucaaagaguagcuucccagauaaagacuccuuugggugucguaacauauuccggaagaccucugauagcaauugcguggcuucaaguuccauggaguucauucccguuccuccaccgcgaacgcccagaaucgugaagaaaccugagccacaucagcccggcccuggaagcacuggcaucccacacaaggaagacccccucaugcuggacauggucaggucuuuugagucaguggaucgcgacgaucauguagaaguuuuaaguccgagccaccauuaccggauucugaacuccccugugucucuagccagacgcaauucgagcgagaggacacucuccccagggcugcccucaggaaguaugucuccucuucacacccccuugcacccaacucuggucagcuucgcacaugaggacaaaaacuccccucccaaggaagagggucucuguugcccaccgccugugcccucaaauggcccaaugcagccccuggggagcccuaacugugucaaaucucgaggacgguuuccaaugaugggcaucggucaaauguuacguaagagacaccagucccugcagcccagugccgauaggccucuugaagcuagcuugccgccacuccagccccuggccccugugaaucuagcauucgacauggcggaugggguuaaaacacaaugcuga

SEQ ID NO: 57485 - RNA, 837 nt, Artificial Sequence
  derived and/or modified sequence opt3 from HUS1B__Homo_sapiens__NP_683762
augaaguucagagccaaaaucaccggcaaggggugccuggagcucuuuauucacgugagcggaacagucgcuaggcuugcaaaaguuugugugcugcggguacgccccgacuccuugugcuucgguccugccggcucugggggauuacaugaagcgcgacuguggugugaggugcgucagggcgcuuuucaacaguucagaauggaaggugucucagaggaucuagacgaaauacaccucgagcugacugccgagcaucuuaguagggcagcccggagcgcugcaggggccuccucucugaaguugcagcucacgcacaaacgcagaccaucgcugaccguggcuguugaacuggugucaagccucggaagggcccggagugucgugcaugauuuaccgguacgcguucugccccgaagaguguggagggacugccuuccuccauccuugcgggcgucugaugcaagcauccgucugccccgcuggagaacacuaagguccauugucgagcggauggccaacgugggcucacacgugcucgucgaagcuaaucugaguggccgaaugacucuuagcaucgagaccgagguugugucuauucaguccuacuuuaagaaccuggggaauccuccacaaucagccguaggagugcccgaaaaccgcgacuuggagagcaugguccaggugagaguugauaauaggaagcuccugcaguucuuagaaggucagcaaauccacccuacaaccgcacuguguaacauaugggacaauacucuccuucagcugguguugguccaggaggaugugagucuacaguauuuuaucccagcucuguga

SEQ ID NO: 57486 - RNA, 843 nt, Artificial Sequence
  derived and/or modified sequence opt3 from HUS1__Homo_sapiens__NP_004498
augaaguucagagccaaaaucguggacggcgcuugccugaaccacuuuaccaggauuagcaauaugauagcaaagcucgccaaaacauguacucuucggaucucccccgauaagcugaacuucauuuugugcgacaaauuagcgaaugggggagucucuauguggugugagcuggaacaggagaacuuuuucaaugaauuucaaauggaggguguuucagcugaaaacaaugagaucuaccuagagcucacgagugaaaaccugagccgcgcccuuaagaccgcacagaaugcccgagcucugaagauuaaauugacaaacaagcauuucccuugccucacuguguccguagagcugcugucuaugucgucaagcagucguaucgugacccacgauauaccaaucaaagucauuccgagaaagcucuggaaagacuuacaggaacccgugguuccugauccagacguguccaucuaucugcccguccuuaagacaaugaagucugugguagagaaaaugaagaauauuagcaaccauuugguuaucgaggcaaaucuggauggcgaacuaaaccucaaaauagagaccgaacuggugugugucacuacacacuuuaaggaccuugggaauccuccacuggccuccgagucaacccaugaagauaggaacguggagcacauggcugaggugcacauugacauccggaaauugcuccaguuccuggccggacaacaggucaaccccacgaaggcguuaugcaauauuguuaacaauaaaauggugcauuuugaucugcuccacgaagacguaagucuucaguacuucaucccugcacugagcuga

SEQ ID NO: 57487 - RNA, 13125 nt, Artificial Sequence
  derived and/or modified sequence opt3 from HUWE1__Homo_sapiens__XP_005262022
augaagguggacagaaccaagcugaagaaaacacccacugaggccccugcugauugcagggcucucaucgacaaacuuaaagucuguaacgaugaacagcuguuguuagagcugcagcagauuaagacguggaauauaggaaagugcgaacuauaccacuggguugaccuccuggaucgguucgacgggauccuugccgaugcgggacagaccguggagaacaugagcuggaugcuggugugugaccgcccagaacgagagcaguugaaaaugcuccugcuggcugugcucaauuuuacagccuuacugauugaguauuccuucucucgucaccuuuacucaaguaucgaacacuugacuacccugcuagcgagcuccgauaugcaagucgugcucgccguucugaaccuucuguauguguuuucuaagagaucgaauuacauuacaagguuggguucagacaaacggaccccgcuccugacucgcuuacagcaucuggcugagagcuggggcgggaaggaaaacggauucggccucgcagagugcuguagagaucuucacaugaugaaauaucccccuagugccacaacccugcauuuugaguucuacgcugacccaggugccgaagucaagaucgagaagaggacgacuuccaauaccuugcacuauauacacaucgaacagcuagauaaaauuucugagagccccuccgaaaucauggagucacugacaaagauguacaguauuccuaaagacaagcagaugcuccuguuuacucauauccggcuugcgcacggguucagcaaccaucgcaaacgacugcaagcagugcaggccagauugcacgcuauaucuauucucguauacuccaaugcccugcaggagucagcaaacagcaucuuauauaauggacugauugaagaacucguugacgugcuacagaucaccgauaagcaacugauggaaaucaaagcugccagucuuaggacauugaccucuauuguccaccuggagcggacgccaaagcucuccagcauaaucgacugcacuggcacagcgucguaccauggcuuucugcccgugcuugugcguaacuguauucaggccaugaucgauccuucuauggacccauauccgcaccaguucgcaaccgcucuguuuuccuucuuguaccaucucgccucauaugaugcugggggagaagcccuggucaguugcgguaugauggaggcauuacugaagguuauaaaauuucuaggcgacgagcaagaucagauuacuuucgugacacgcgccguaagaguggucgaccucaucaccaaucuggauauggcugcguuccagagccacuccgggcuuucuaucuuuauuuacagguuggaacaugagguggaccugugucggaaggaaugccccuucguuaucaaaccuaagauucagcgaccaaacacgacccaagagggagaagagauggagacagauauggacggcgugcaguguauaccccagcgcgcagcccuccugaaaagcauguuaaauuuucugaagaaggcuauccaggacccugccuucucagaugguauuagacacgucauggacgggagucuuccaacuuccuugaaacacaucaucagcaacgcagaauauuacggacccucucucuuucugcuagccaccgaggugguaacaguuuucguguuucaagaaccgucacugcucaguagccugcaggauaacggccuuacugacgucauguugcaugcucuguuaauuaaggaugugccugccaccagggagguccucggcucccugcccaauguguucucugcacuuugccugaacgcgcggggguugcagucguuuguucagugccaaccauucgagcgccucuuuaaagugcugcuaagcccugacuaccugcccgcuaugagaaggcgucgguccucagauccacucggagacacagccaguaaucuggguucugcaguagaugaacuuaugcgacaccagcccaccuugaagacugacgccacgacagcuauaaucaaacuguuagaggaaauuuguaaccucggcagagauccuaaguauaucugccagaagccaagcauucagaaagccgacgggaccgcaacugcuccgcccccuagguccaaucaugccgcggaggaagccucaagcgaggaugaggaagaggaagagguccaagcuaugcagucuuucaacuccacccagcaaaaugaaacagagccaaaccaacaggugguuggaaccgaggaacgcauccccauaccucugauggacuacauccuuaaugugaugaaguuugucgagaguauucugagcaacaauacuacagacgaucacugucaggaguucgugaaccaaaaaggccuacucccacugguaacgaucuugggucugcccaauuuaccgauugacuucccuaccucugcagccugccaggcuguggccgggguuuguaaguccauccucacucugucacacgagccaaaaguccuucaggaaggccuguugcagcucgauaguauacugagcucgcuagagccccugcaucggccuauugagucccccggaggcucugugcuucucagagaacuggcaugcgcggggaacguggccgacgcuacauugagcgcccaagcaaccccacuguuacacgcucucacagccgcacaugccuauaucaugauguuuguccacacuuguaggguuggacagucagagauucgcaguaucuccgugaaucagugggguucucagcugggccuuagcgugcuguccaaguugucacaacucuacugcagccugguaugggaaaguaccguccuacugucucuuuguacgccuaacucccuccccagcgggugcgaguucggacaggcugauaugcagaagcuggugccaaaagacgagaaggcgggcaccacacaaggugggaaacgaucggauggcgaacaggacggagccgcaggcucaauggaugcuucuacucagggguuguuagagggaauaggucuggacggcgauacccucgccccgauggaaacagacgagccuacugccagugauuccaaggggaaaagcaagaucacccccgcuauggcagcccggauuaaacagaucaagccacugcuuucugcgagcucccgucuggggcgcgcuuuggccgaacuauuuggccugcucguuaagcuguguguggguucacccgucaggcaacgccggagucaucacgcagccagcacgacaaccgcuccuacuccagcagccagaucuacagcguccgcucuuaccaaauuacugacuaaggggcucucauggcagcccccuccguauaccccaacacccagguuccgauugacguuuuucauuugcagugugggcuuuaccagcccuaugcuguucgacgagcgcaaauacccauaucaccucaugcugcagaaguuucuuugcuccggaggccauaacgcccuguucgagacuuuuaauugggcauugucuaugggagggaaaguucccgugucggaaggccuagagcacagcgaccugccugaugguacaggggaguuccucgacgccugguuaaugcugguagagaagauggucaacccgaccacagugcuugaaucaccccauucccugccagcuaagcucccuggaggcgugcagaauuuuccccaauucagugccuugcgguuccuggucguuacucagaaagcagcuuuuaccuguaucaagaaccucuggaauagaaaaccacugaagguguacgguggcaggauggccgagucuaugcuugcgauacuaugccacauucugcguggggagccuguaauccgcgaacgguugagcaaagagaaggaaggauccagaggcgaggaagauacggggcaggaggagggaggcucaaggcgagaaccccaggugaaccaacagcaguuacagcaacugauggacauggguuucacacgggagcaugccauggaagcacuccugaauaccucuacuauggagcaggcuaccgaguaccuucugacacacccaccgccuaucaugggaggggucgugcgcgaucucagcaugagugaagaggaccagaugaugagagccauugcuauguccuugggccaagauauccccauggaccagagggcagaaagcccagaggaaguugccugucggaaggaggaggaagaacgaaaagccagagaaaagcaggaggaagaggaggcuaaaugccuggaaaaguuucaggaugcggacccccuagagcaagaugaacugcacacuuucaccgacacaaugcucccugguuguuuucaucuucuggacgaguuaccagauacgguguaucgcgucugcgacuugauuaugaccgcaauaaaaaggaacggcgccgauuaccgugacaugauccugaaacaggugguuaaucaggugugggaagcugccgauguccucauuaaggcagcccugccccuuacuacaucugacaccaaaacuguaucagaguggaucucccagauggcuacacugccucaagcgaguaaccucgccacccggauuuugcuguuaacgcuacuguucgaggaacucaaacuuccgugugcaugggugguugagagcucggggauccugaauguguugauaaaacugcucgaagucgugcagccaugccugcaggcugccaaggagcagaaagagguacaaacucccaaguggaucaccccugugcuucuccugauugauuuuuaugagaagacagcaaucucuuccaagagaagggcccagaugaccaaguacuugcagagcaacucaaauaacuggcgcugguucgacgaucgaaguggaagaugguguucuuauuccgcuagcaauaacucaacuauugacagugccuggaaaagcggcgagacauccguccgguuuaccgcggggaggcgccguuacacaguucaauucacuaccaugguacaggugaacgaagagacgggaaauagacggcccgucaugcugacauuacuaagggugccacgccugaacaagaacucuaaaaacagcaauggccaggaacucgagaagacccuugaggaauccaaagagauggauaucaagcgaaaggaaaacaaagguaaugacacuccucuggcauuggagucaaccaacacagaaaaggagacuucucuggaggaaaccaaaauaggggagauucucauccagggacugacggaagauaugguuacaguacuuaucagagccugcgugaguauguuaggcguccccguggacccagacacccugcacgcuacucuccgguugugucugaggcuaacacgcgaucauaaguaugccaugauguuugcugagcugaaaucgaccagaaugauucucaaucuuacucaaagcuccgguuucaacggcuucacaccucugguuaccuugcugcucaggcacauaaucgaagacccgugcacgcugcggcacacuauggagaaggugguccguucugcagccaccucaggggcuggaagcacaaccuccggcgugguaagugggucuuuaggaagccgcgagauuaauuacauccuucgaguccugggccccgccgcaugcagaaacccagauauuuuuacagaaguggcgaauuguugcaucaggauagcccucccugcuccccgggguucagggacugccuccgacgaugaguucgaaaaccuacgcaucaagggaccaaaugcaguucagcuggugaaaaccacgccuuugaagcccaguccgcugccagucauuccugacacaaucaaagaggugauuuacgauaugcucaacgcucuugccgcauaucaugcccccgaggaagcugacaagagcgauccaaaacccggcguuaugacucaggaggugggccagcuguugcaagacaugggggaugacgucuaccagcaguauagaucucugaccaggcaguccucagauuuugacacacaaagcggauucucgaucaacucucagguguuugcggccgacggugcaaguaccgaaacuuccgcuagcggcaccucacagggggaggccuccacaccugaagagucucgggauggaaagaaggacaaagagggcgaucgagccagcgaagaggguaagcagaaagggaagggaaguaaaccgcucaugcccacguccacuauauuaagacugcuugcagaacugguacgcagcuacgugggcauugcuacccuaaucgccaauuauucuuacacaguuggccaaucagagcucaucaaggaagacuguaguguccuggcguucguguuggaucaucugcucccacauacccagaacgcugaggacaaggauacuccugcccuugcaaggcuguuuuuagccucccuggcugcagccgggagcggaacagacgcacagguggcuuuggucaaugagguaaaagccgcacucggucgggcccuggcuauggccgaaucuaccgagaagcacgcacgucuacaagcugugaugugcauuaucucgacgauaauggaaucaugucccagcacuuccaguuucuauucuagcgccacagcgaaaacccagcauaacggcaugaauaacauuaucagacuuuuucugaagaaagggcucguuaaugaucuggccagggugccucacuccuuggaccugucaaguccaaacauggcaaauaccgucaacgcugcccucaagccccuugagacucugucucgcauugugaaucagccuagcuccuuauucggaucaaaaagcgcaucuuccaagaacaagagugaacaggaugcucaaggcgccagccaggacucguccucuaaucagcaggacccaggugagcccggggaggccgaaguucaagaggaagaucacgacgugacacagaccgaggucgcggauggagacaucauggauggcgaggcugaaacagacucagugguaauagcaggccagccggaggugcugagcagucaggaaaugcaaguugagaacgaauuggaggaucucauugacgagcugcuagaacgggaugggggauccgguaauucuacuaucaucgucagccgaucaggcgaggacgaaucccaggaggaugugcuuauggacgaagccccuaguaaccugagccaggcuucuacgcuccaagccaauagagaggauucaaugaacauucuggacccagaggacgaagaggaacauacccaggaggaagauuccagcgggucuaacgaggacgaggaugacagucaggaugaagaggaagaggaggaagaggacgaagaggaugaccaggaagaugacgagggagaggaaggcgaugaggacgacgaugacgaugguucggaaauggaguuggacgaagauuaccccgacaugaaugcauccccuuuagugagguuugagcgcuucgaucgggaggacgaucugaucauugaauuugacaacauguucagcucagccacagauauaccacccucuccggggaauaucccuacuacccacccccucauggucagacaugcugaccacagcucccuuacacugggaaguggcucaucuaccacucgucuaacgcaaggcauugggaggagccagcggacccugcgccagcucacagcgaacacuggacacaccauccauguucacuacccagguaaucgacagccuaaucccccauugauccugcaaagacuucugggccccuccgccgcagcugauauucuccaguuaaguagcucccugccuuugcagucuagggggcgggcccgccugcucgugggaaaugacgacguacauauaaucgcaagaucagaugacgagcuucuggaugacuucuuucacgaucagagcacagccaccucgcaagcuggcacucuauccaguauuccaacagcccugacgagguggaccgaagagugcaaagugcucgacgcggaaucuaugcaugauugugucagcgugguuaaggugucaaucgucaaccacuuggaguuccugcgagacgaggaacuugaggaacggcgugagaaaagacgcaagcagcuggcagaggaagagacuaaaauuacagauaaggguaaggaagacaaagagaauagggaucaguccgcccaaugcaccgcuucuaagaguaacgacagcaccgaacagaauuuauccgaugggacaccgaugcccgacucauauccuacuacgccaagcucuaccgacgccgcaacaagugaguccaaagagacucucggaacccugcagagcucacagcaacagcccacauugccuaccccacccgcucugggcgaaguaccucaggagcuccagucuccggccggcgaagggggauccucgacucaacuucugaugccaguggagcccgaagaacuagguccuacgcggcccagcggcgaggcugaaacaacccagauggagcugaguccagccccuacuaucaccucucucucccccgaaagagcagaggauagcgacgcguugacagccguuucaagucagcuggaaggguccccaauggauacuagcucuuuagcuucauguacccuugaggaggccgugggagacacaagcgcagcuggcuccucugaacagccgcgcgccgguaguucgacgccuggggaugcacccccagccgucgcggaggugcaaggcaggagcgacggauccggcgaaucagcucagcccccugaggauucuagcccacccgccaguuccgagucaucuagcacccgagacuccgcagucgccauaaguggggcugauagccggggaauccuggaggaaccucucccgucuacuucauccgaagaggaagacccacuggccgguauuagcuugcccgagggcguggauccuaguuuucuggcagcucucccagacgacaucagaagggagguucuucagaaccagcuggggauuagacccccuacacguaccgcccccucuacuaauuccucggcgccagcugugguaggaaacccgggcgugacagaagucagcccugaguuccuagccgcacugcccccagccauccaagaagagguuuuagcucagcagcgggcagaacaacagagaagggagcucgcccagaaugcgucauccgauaccccuauggaccccgugacguuuauacagacccugccaucugauuugcgccgaaguguccuugaggacauggaagauagcgugcuggccguaaugccucccgacauugcugcagaggcccaagcucuccggagagaacaggaggccaggcagcgccagcugaugcacgaaagauuguucggucauucauccacaagcgcacugucugcuauccuacggaguccggccuuuacuuccaggcucagcgggaaccguggcgugcaauacacccgacuugcgguucagcgcggaggcacauuccagaugggaggaucaucuucgcacaacagaccaagcgguuccaauguggauacucuguuacggcugaggggccgccuccuguuggaccaugaggcccuuaguugccugcucguccugcuauuuguggaugagccuaaguugaacaccucuagacugcaccggguccucaggaaucuuuguuaucacgcacagacacgacauugggugauucguucacuguuaagcauccugcaaagauccagugaaucugagcucugcauagaaacccccaaacugacuacgagcgaggagaaggggaagaaauccucaaagagcugcggaucuuccagucacgaaaaccgcccauuggaccuucugcauaaaauggagucaaagagcucgaaucagcucuccuggcugucuguuaguauggaugcugcccuaggcugucggacaaacaucuuccagauucaaaggagcggugggagaaaacacaccgaaaagcaugcaucaggcggauccacuguacacauccacccccaggccgcuccuguggucugccgccauguguuagacacccugauucaguuggccaagguuuuuccgucucacuucacacagcaacggacgaaagagaccaauugugaaagcgauagggagcgaggcaacaaggcgugcaguccauguuccagccagucuucauccagcgggaucugcacugacuuuugggaccuccuggugaaacuugauaauaugaacgucaguagaaagggcaaaaauucugugaagucaguacccguguccgcuggcggugagggggaaacaagcccuuacucgcuggaggcaucuccccucggacagcugaugaacauguugagucauccaguuauacggagguccagccuucugaccgaaaagcuacuccgccuguuaucacugauuucuaucgccuugccugagaauaaggucagcgaagcucaggccaacuccggcaguggugcaucaagcacuacaaccgccacauccacuaccucuacgaccacaacuaccgcugcgaguacaacucccaccccaccuacggccccgacacccgugaccagcgcaccagcccucguggcugcaacugccaucuccacaauugucguugcugccucaaccacugugaccacaccuacgaccgcgacuacaaccguaucuaucucgcccacuacaaagggcagcaaauccccagcaaaggugagugacgggggaucuagcucaaccgauuucaaaauggucuccagcggccugacggagaaucaacuucagcugucuguggagguucucacaagucacuccuguucagaagagggguuggaagacgccgcuaacgugcugcuucagcugagccguggagauucuggcaccagagacacugucuuaaagcuacuccugaacggugcccgacaucugggguauaccuugugcaaacagauaggaacacuccuggcagagcuuagggaauacaaucuggagcaacagcggcgcgcucagugugagacuuuaucgccugauggccuccccgaggaacagccgcaaaccacaaagcugaaggguaaaaugcaguccagauucgacauggccgaaaacgugguaauuguugcgagucagaagaggccauugggcgggcgggagcuucaacugccuagcaugucaaugcuaacgucuaaaacuuccacccagaaguuuuuccuccgcgugcugcaggucaucauucagcugagagaugacacacgaagggccaauaaaaaggcuaagcaaaccggacgguugggcagcagugggcucggaucagcauccagcauccaggccgcugugcgucagcuggaggcagaagccgaugcuauaauccagauggugcgcgagggccaaagagccaggcggcagcagcaggcagccacuucugaaaguagccaauccgaggcgucugucagacgcgaagagucacccauggacguugaucagccaagccccuccgcucaggacacacaaucgauugccucugacgguaccccucagggggagaaagaaaaggaggaacgacccccagagcuuccucuguuaagugaacagcucagccuggaugagcuaugggacauguugggagagugccugaaagaacuugaggaaucacacgaucagcacgcagugcucguacugcaaccggccguggaggcauuuuuccugguccaugccacggaaagggaguccaagcccccagugcgggacacuagagagucucaguuggcacacaucaaagaugaaccucccccacuuagcccugcuccccucaccccggccacaccuuccagucuggacccauuuuucucacgugagcccagcucuaugcauauuuccaguagcuuaccuccagauacccagaaguuucugcgcuucgcggaaacucacaggacaguucuaaaccagauccuccggcaaucaaccacacaccuggcagacggccccuuugccguguuggucgauuauauuagagugcuggacuucgauguaaagcgaaaauacuuuaggcaggagcuugagcgccucgacgaaggccugcggaaggaggacauggcuguucaugugagaagggaucacgucuucgaagacucuuaccgcgaguuacaucguaaauccccugaagagaugaagaaucggcuguauaucguguuugagggggaagagggacaggaugccgguggcuugcucagagaaugguacaugauaauuucgcgagagauguucaacccaauguaugcucuguucaggacuagccccggggaccgcguuaccuacacgaucaauccgaguucccacuguaacccuaaucaucuuucuuauuuuaaauucgugggacggaucgucgcaaaggccguguacgauaacagacugcuagaaugcuauuuuacaaggucauucuacaaacacauucucggcaagagcguacgcuacaccgacauggaguccgaggauuaucacuuuuaccagggucugguguauuugcuggaaaaugacgucucuacucuuggguacgaucucaccuucagcacagagguucaagaauuuggagugugcgaggucagagaccugaagcccaacggcgcgaauauauuagugacugaagagaacaaaaaggaguauguacaucuggugugucagaugcggaugacgggcgccauccgaaaacaguuggcugcauuccucgaaggguuuuacgagauuaucccaaagaggcugauuaguaucuucaccgaacaagagcuugagcugcuaauaucaggacuccccacaaucgauauugacgaucugaaauccaauaccgaauaucacaaguaccagagcaacucuauccagauucagugguuuuggcgugccuugagaaguuucgaccaagcugaccgggccaaguuucugcaguucguuacugguacauccaaagugccucuucagggcuucgcagccuuagaggggaugaacggaauccagaaguuucaaauacaucgcgaugacaggagcaccgaucgacugccaucagcucacacuugcuucaaucagcucgaccugcccgcguacgaaucguuugagaaacuaagacacauguugcugcucgccauucaggaauguucugagggcuucggucuugcauga

SEQ ID NO: 57488 - RNA, 822 nt, Artificial Sequence
  derived and/or modified sequence opt3 from HVCN1__Homo_sapiens__XP_011537150
auggccaccugggacgagaaggcugugacaagaagggcaaaagucgcccccgcggaacggaugagcaaguuccugcgccacuuuacuguugugggcgaugacuaccaugcuuggaacaucaauuauaaaaagugggagaacgaagaggaagaggaggaagaggaacagccuccaccgacgcccguauccggggaggagggacgagccgcagccccugauguggcuccagcacccgguccugccccacgugcuccccucgacuucagaggcaugcuuaggaaacuguuuucuucacaccgguuccaagucauuauaaucugcuuggugguuuuagaugcccugcuagugcucgcggaacugauucuugaccugaagaucauucagccugauaagaauaacuacgcagccauggucuuucauuauaugaguaucaccauauugguguucuuuaugauggagaucauuuucaaacucuuuguauuccgccuggaauuuuuccaccauaaguuugagauccuggacgcuguuguggucguggugagcuucauucucgauaucgucuuacuguuccaggaacaccaguuugaggcccuuggguugcugauacuacucagacuguggaggguugcacggauuaucaauggaauuaucaucuccgugaaaacacgcucugagcgacaacuucugagauugaagcagaugaacguacagcucgcugccaaaauucagcaccuggaguucucguguucagaaaaggaacaagagauagaaagguuaaauaagcugcuccggcagcauggccuucugggugaggugaacuga

SEQ ID NO: 57489 - RNA, 1308 nt, Artificial Sequence
  derived and/or modified sequence opt3 from HYAL1__Homo_sapiens__NP_149349
auggccgcucaucugcuccccaucugcgcacuuuuccugaccuuguuagacauggcccagggcuuuagagggccucugcuaccaaacaggccguucacaacuguguggaaugcgaacacgcaauggugucucgagcggcauggagucgauguugacgugagcguauuugauguggucgcuaaucccggucagaccuuccgcggcccugacaugacaauuuucuacuccucucagcuggggacuuauccauacuauacccccacaggagaaccuguguucggcggucuuccacagaacgccucacugauagcacacuuggcccgaaccuuucaagauauccucgcugcaauucccgccccugacuucagugggcuggcuguuaucgauugggaggccuggcguccaagaugggcguuuaauugggacacuaaggauauuuacaggcagcggagccgcgcacuggugcaggcccagcauccggacuggcccgcuccucaagucgaagccguggcacaggaucaguuccagggagcugccagagcguggauggccggcacacuccaauuaggcagggcacugcggccacgcgggcuuuggggauuuuaugguuuccccgacugcuacaacuaugacuuuuuguccccuaauuacaccggccaguguccaucugggauccgagcucagaacgaucaacugggauggcuauggggccagucgagagcccucuaccccucaauauauaugccggcuguacuggaggguacggggaaaagccagauguacguucagcacaggguggccgaagcauuccgggucgccguggcugcgggagacccuaaucuucccgugcugccauauguccaaaucuucuacgauacuaccaaccacuuuuugccucucgacgagcuggagcacaguuuaggcgaauccgcagcccagggcgcugccgggguugugcuguggguaucuugggagaauacacguacuaaggaaagcugccaggcaauuaaagaguauauggauaccacacucggacccuucauccuuaacgugaccuccggugcccuguuguguucacaggcucuaugcaguggccacgggcgcugugucagaaggacgagccauccaaaggcccugcuccugcuuaaucccgcaucuuuuuccauucaacugacuccuggaggcgguccauugucacuccgaggggcgcugagcuuagaggaccaggcucagauggccguggaauuuaaaugccgguguuacccgggcuggcaggcacccuggugcgagcgcaagaguaugugguga

SEQ ID NO: 57490 - RNA, 1422 nt, Artificial Sequence
  derived and/or modified sequence opt3 from HYAL2__Homo_sapiens__XP_005265582
augagagccggccccgggccuaccgugacacuggcucucguccuugcaguuagcugggccauggagcugaagccaacugcgccgcccaucuucacgggaaggccuuuugugguagcuugggacgugccaacccaggauugcgguccccgguugaaagucccuuuagaccugaacgccuucgaugugcaagcauccccaaaugaaggcuuuguuaaccagaauauuacaauauucuaccgcgaccgacuagggcucuauccccguuuugauucugccggaagaucagugcacggcggugucccucagaacgugagucugugggcucauaggaagaugcuucagaaacggguagagcacuacauccgcacucaagaaagcgcagggcuggccguuauugacugggaggauuggagaccagugugggucaggaauuggcaggacaaggauguguaucggcgcuugucccgacagcucguggcuucuagacauccggacuggcccccugauaggaucgucaaacaggcccaauacgaguucgaauuugcggcacagcaguucaugcuggagacccugcgguauguuaaggccgugcguccacgccaccucuggggauuuuacuuauuccccgacuguuauaaccaugauuacguacagaauugggaaucguacacaggcagaugcccugacguggaggucgcuaggaacgaccaacuggccuggcuuugggcagaaucaaccgcuuuguuuccaagcguguaucuggaugagacucuagccaguucccggcacggccgaaauuucguuucuuuucgcgugcaggaggcgcucagagucgccaggacacaccaugcaaaccacgcucugcccguguacguauucacccggccgacguauagccgcagacuuacugggcuguccgaaauggacuugauuucaaccaucggagagagugccgcucucggugccgcaggcguuauacuguggggagaugccggguacacaacuagcaccgaaacaugucaguauuuaaaggacuaccugaccaggcuccuugugccuuaugucgugaaugucucuugggcuacgcaauacugcucccgugcgcagugucauggccacggucggugcgugcgaagaaaccccucagcaagcacuuuccugcacuugaguacaaauucuuuuaggcuaguuccagggcaugccccuggagagccccagcugcgcccagugggcgaacucuccugggcugauaucgaccaucugcagacccacuuccggugucaaugcuaccuuggcuggagcggggagcagugucagugggaucacagacaggccgcaggaggugccucggaggcuugggccggcucucaucugacuuccuugcucgcacuggcggcuuuagccuuuacauggacccuguga

SEQ ID NO: 57491 - RNA, 1164 nt, Artificial Sequence
  derived and/or modified sequence opt3 from HYAL3__Homo_sapiens__NP_001186959
augaccacacagcugggccccgcccucgugcuuggggucgcucugugcuugggauguggucaaccuuuaccacagguuccggagagacccuucagcgugcuguggaacguaccuuccgcacacugcgaagccagguuuggcgugcaucuaccacucaaugcgcuggggaucauugcuaaccggggacagcacuuccauggccagaauaugacuauauuuuacaagaaccaacuuggucuguaucccuacuucgggccucgcggaacggcccacaauggcggcaucccacaggcauugccccucgaccgacaucuggcccuggcugcauaucagauucaccacucucuccguccuggguuugccggaccagcugucuuagauugggaggaaugguguccgcugugggccgguaacuggggcagaaggcgggcguaccaggcagccucaugggcuugggcccaacagguguuccccgaccuugauccucaggagcaguuguauaaagcauacaccggguuugaacaagcugcccgcgcgcugauggaggacacacuaagaguugcccaggcacucaggccacauggacuguggggcuucuaucacuaccccgcuugcgguaauggguggcauaguauggccagcaacuacacuggacggugucacgcugccacccuugcacgcaauacacagcugcacugguugugggccgcuuccucugcgcucuuuccuucgaucuaucugccaccccgauuaccgccugcacaucaccaagccuucgugagacauaggcuggaggaggcuuuucgggucgcccucgugggccaccgucauccccuuccaguacuggcauacguucgcuugacccacagaaggucaggccgguuccuaagccaggaagaaugcuggcaucugcacgauuaucucguggacacucuggggccuuacgucauuaacgugacacgagccgcuauggccuguagucaccagcgcugccauggacacgguagaugugcaaggcgggaucccggccagauggaggcguuucuucaccuguggccagacggguccuugggagauuggaagucuuucagcugccauuguuauuggggcugggcugguccuaccugccaagagccccgcccagggccgaaagaagccguguga

SEQ ID NO: 57492 - RNA, 1446 nt, Artificial Sequence
  derived and/or modified sequence opt3 from HYAL4__Homo_sapiens__XP_011514292
augaaggugcugagcgagggccagcucaaacuuugcgucguucaacccgugcaccugaccuccugguuguuaaucuucuuuauucugaagucuauaucaugucuaaaaccugccagacucccaaucuaccagaggaagccguucauugcugcauggaacgcccccacagaccagugccugaucaaauauaaucuucggcugaacuugaagauguuuccuguaauugggaguccacucgcgaaggcucgcggacagaaugugacuaucuucuacgucaaccgacuggguuauuaccccugguauacgagccaaggcgugccuauaaaugggggacugccacagaacaucucccuccagguucauuuagaaaaagccgaucaggacauuaauuacuauauccccgcagaggauuuuucuggccuggccgugauugacugggaauacuggcguccucaaugggcuagaaacuggaacucgaaggaugucuacaggcagaaaucacggaaacuuaucagcgacauggguaagaaugugagugcaaccgauauagaguauuuggccaagguaacauucgaagaguccgcuaaggccuuuaugaaagagacuauuaagcuggggaucaaaucucgcccaaagggacuauggggcuacuaucucuacccggacugucacaauuauaacguuuacgcgcccaauuauagcggcuccugcccugaagaugaggugcugagaaacaaugaacuuucauggcuguggaacaguagcgcagccuuguacccaucuauuggggucuggaaaucccucggagacucagagaacauccugagguucagcaaguuucgggugcaugagaguaugcgcaucucuaccaugacaucccacgauuacgcuuuacccguguucgucuauacccgacuggguuacagagacgaaccucucuuuuuccuuagcaaacaggaucugguuucgacuauuggcgagucugccgcauugggggcugccggaauagugaucuggggcgacaugaaucuaacagcguccaaggccaacuguaccaagguaaaacaguuugugucaagugaccuggguagcuauauugcaaaugucacgagggcugccgaagugugcucccuccaucugugucggaacaaugggcguugcauccgcaagauguggaacgcuccaucuuaccuucaccugaaucccgccagcuaucacauagaggcaucagaagauggagaguucacuguuaaaggcaaggccagugacaccgauuuggcugugauggcggacacauucuccugucauugcuaccaaggcuaugagggggcagauuguagagaaauuaaaacugccgacggaugcagcggugucucuccgucaccuggcagucucaugacccugugcuuacugcuacucgcuagcuacagguccauccagcuguga

SEQ ID NO: 57493 - RNA, 2853 nt, Artificial Sequence
  derived and/or modified sequence opt3 from HYDIN__Homo_sapiens__NP_001185471
auggagagcgccggcggguucaagcugggaauggaaccccucuccgguggcggggugugcgagaaaaagaaacuucugaagaugaccucuagaagguuggaagagucaaugggagcuguccagaugggcuuaguuaacauguuuaaagguuuccaaaguaaggugcugccuccacuaagcccgaagguagugacagaagaggaggucaaucggaugcucacucccuccgaauuucugaaagagaugucucuuacgaccgaacagcgccuggcaaagacacgauugaugugucguccucagaucauugagcuccuggacaugggggagacuacccaccagaaauucucgggaauagaucuggaccaagcccucuuucagccauuccccucagaaaucauuuuucagaacuacacaccuugcgagguguaugaaguuccauuaauccugagaaauaacgauaagauucccaggcuugugaaagucguggaggaaagcaguccuuacuucaagguaaucuccccaaaggacauaggccauaaaguugcgccgggcgugcccucuaucuuucggauuuuguucaccccugaggagaauaaggauuaugcucacacucugacaugugucaccgaacgcgagaaauuuaucgugccaauuaaggccagaggggcaagggccauccuagacuuccccgauaaacucaacuuuagcacgugcccugugaaguacuccacucagaaaauacugcuuguccggaauauuggaaacaagaaugcuguuuuccauaucaagaccugucgcccauucucaauugaacccgcaaucgguacacugaacgugggcgagaguaugcaauuggaaguagaguuugagccgcagagcgugggggaccacucuggacgacucaucgucugcuaugauacuggcgaaaaaguguucguuucccuguacggugccgcuauugacaugaauauaagauuagauaagaacucacugaccaucgagaaaacauauauuagccucgccaaucagaggaccaucacgauacauaaccggaguaauauuaucgcgcacuuucuuuggaagguguucgcaacucagcaagaagaggaccgugaaaaauaccgcgccugugaugaccugaucaaggaggagaaggacgaaacagaugaguuuuucgaagagugcauuaccgacccuuugcuaagagagcaccugucuguccucuccaggacuuuugcuaaccagcggcgacuggugcagggggauagcaaacuuuucuuuaacaauguauucacaguugaaccccuggagggagacguguggccaaacucgucugccgaaaucaccgucuacuuuaauccuuuggaggcaaagcucuaucaacagacgauuuacugugauauacugggccgcgaaaucagauuaccccugaggauuaaaggcgaggggaugggaccaaagauccauuucaacuuugagcuacucgacaucgguaaaguguucaccggcuccgcucacugcuaugaagccauucuguacaauaaggggucaauagaugcgcuuuucaacaugacacccccuaccagugccuugggagcauguuuugucuucagcccaaaggagggcaucauugaaccguccggugugcaggcuauccagauuucuuuuagcucaacuauccuggggaauuucgaggaagaguuucucguuaacgugaauggcagucccgagccuguaaaacugacaauacggggaugcgucaucggcccaacuuuccauuuuaacgugcccgcccuucacuucggggacguuuccuuuggauucccucacacccugauuugcagcuugaauaacacaucucucaucccaaugaccuauaagcugcgcauucccggugauggcuuagggcauaaaucaaucaguuacugugaacaacacguggacuauaagagaccgagcuggacuaaagaggaaauauccucuaugaagccuaaggaguuuacgauuucgccagauugcggaacaaucaggccccagggcuucgcugccauucgugucacccuguguagcaauacugugcagaaauacgaacuagcacucguaguggacguugaggguaucggggaggaaguccuggcccuuuugauaaccgcucggugcguggugccugcgcugcaucucgucaacacagagguugacuuuggccacuguuuccugaaguaccccuaugagaaaaccuuacagcuggcaaaucaagaugaccuuccaggauucuacgaagugcagccucaggugugcgaggaaguacccacugucuuguuuuccucaccaacaccgaguggcgugaucucuccuagcuccacgauucauaucccccucguucuggagacccaggugacuggggaacaccgaucaacagucuauauuagcaucuucggaucucaagauccaccccuagugugucaccugaaguccgccggugagggcccuguuauauacgugcauccaaaccagguagacuuugggaacauuuauguccucaaagauaguagcagaauccugaaucuuugcaaccagucuuucauccccgccuuuuuccaggcucacauggcacauaagaaauccuuguggaccauugaaccuaaugagggaauggugccgccagagacagacgugcaacuggccuuaacugcuaaccucaaugauacccugacguuuaaggacugugucauccuugauauugaaaacucaaguaccuacaggauacccguucaggccagcggcacagguucgacuaucguguccgacaagccuuucgcaccagagcugaauuugggggcgcacuuucgcuga

SEQ ID NO: 57494 - RNA, 1122 nt, Artificial Sequence
  derived and/or modified sequence opt3 from HYKK__Homo_sapiens__NP_001013641
augagcuccggcaacuaccagcaaucugaggcccugucaaagcccaccuucagugaggaacaggcuagcgcacucguggaauccgucuuugggcuuaaaguuucuaaggugagaccucugccaucguaugacgaucagaauuuccacguauacgugucaaaaacaaaggacggaccgacugaguaugucuugaaaaucagcaacacgaaggccaguaagaaucccgauuuaauugaagugcagaaccauauaaucauguuucugaaagcggcugguuucccuaccgccuccguuugccacacaaagggcgacaauacugcaucucuagugagcgucgauuccgggucagagauuaaaaguuaccucgugaggcugcuuaccuaucugccaggacggcccaucgccgaguugccuguaagcccacaacuccuguacgaaauuggcaagcuggcugcaaaacucgacaagacauuacagcgcuuucaucaccccaagcugucuucccuucaucgagagaacuucaucuggaauuugaaaaacguuccucugcuagaaaaguaucucuacgcccugggucagaaucguaacagagagauaguggagcacgucauccaccuuuuuaaagaagaggugaugaccaagcugucacauuucagggaauguauuaaucacggggauuugaacgaccauaauauccucauugagagcaguaaaucugcuuccggaaacgccgaauaccaggugagcggcauccuggauuuuggcgacaugucguauggguacuaugucuucgagguugcgauaacuauuauguacaugaugaucgagucuaaguccccaauucaagugggaggucacguauuagcaggcuuugaaucaaucacaccgcugaccgccguggagaaaggggcucucuuccuucuggucugcagucgguuuugucagagcuuggugauggccgcauauuccugccagcuauaccccgaaaauaaggauuaucugaugguuacggcuaagacuggauggaaacaccuccagcaaauguucgacaugggccagaaggccguggaggaaaucugguucgagaccgcgaaaucuuacgagagcgguauuucaauguga

SEQ ID NO: 57495 - RNA, 900 nt, Artificial Sequence
  derived and/or modified sequence opt3 from HYLS1__Homo_sapiens__NP_659451
auggaggaacugcuccccgacggccagaucugggccaacauggauccugaggaaagaaugcuugcugcagccaccgcguucacacacauuugcgcugggcaaggagagggugacgugaggcgggaagcccagagcauacaguacgauccauauuccaaggcaucugucgccccgggcaaacgccccgcucugccuguucaguugcaauacccacauguggagucaaauguacccagugagacugugagcgaagcaucccagcgauuacguaagccugucaugaaaagaaaggugcugaggcggaaaccagacggggagguucuagugacggaugaaucuaucauuucggagucagagagcggaaccgaaaacgaccaggaucucugggaccugcgccagagacuuaugaauguccaauuucaggaggauaaggaaaguuccuucgacgugucucagaaguuuaaccugccccacgaguaucagggcaucagccaagaucaguugauuuguucccuccagagggaagguauggggagcccugccuacgagcaagaccugaucguagcuagucggccaaaaucauucauacugccgaagcucgaucaguuaucucgcaaucgaggaaaaacagacagaguugccagguauuuugaguacaagcgggacugggauuccauccgucugcccggcgaagaccaucgcaaagagcuuagauggggcgugagggaacagauguugugccgggcggagccucagucaaagccacaacacauuuauguccccaacaauuaccuggugccuacugaaaagaaacgaagcgcacuacgcuggggagugagaugugaucucgccaacggggucaucccaaggaagcugcccuucccgcuuaguccuucuuga

SEQ ID NO: 57496 - RNA, 3000 nt, Artificial Sequence
  derived and/or modified sequence opt3 from HYOU1__Homo_sapiens__NP_001124463
auggccgacaaggugagaaggcagcggccccgccgacgugucugcugggcucugguugcagugcuccuugccgaucuguuggcguuaagcgacacccuggcuguaauguccguggaucuaggcucugagucaaugaaagucgccaucgugaagccugggguuccaauggaaauugugcucaacaaagagaguagaaggaagacaccggucauagugacucugaaagaaaaugagcgguucuuuggagacagcgcagccuccauggcuaucaagaaccccaaggcaacgcuucgcuacuuccaacaccuguuggguaaacaggccgauaauccucauguagcucucuaucaggccagauuuccagaacacgagcugaccuucgacccccagaggcaaacaguucauuuucagauuucuucgcagcugcaguucucaccugaggaagugcucggcauggucuuaaacuacagccggagucuggcggaggauuuugcagaacaaccaaucaaggacgccgugauuacugugcccgucuucuuuaaucaggcugagcgccgagccguucuucaggcagcuagaauggccggguugaaagugcugcagcuaaucaacgauaauaccgcgacagcccucuccuauggaguauucaggcggaaggacauaaacaccacugcacaaaauaucauguuuuacgauaugggcucugguagcacaguguguaccauugucacguaucagauggugaaaacuaaggaggcugggaugcagccucaacugcagauccguggaguuggcuucgaccgcacccuuggcgggcuggaaauggaguugagacucagggaacggcuggccggauuauuuaacgagcagcgaaagggucagcgcgcuaaagaugugagagaaaauccaagggccauggcaaagcugcuccgggaggccaaccgccuuaaaacaguccuguccgcuaaugcggaccacauggcacaaauugagggcuugauggacgauguggacuucaaggccaaaguaacuagaguugaguucgaggaacuaugcgcugaucuguuugagagggugccggggcccguccagcaggcccuccagucagcagaaaugagucuggacgagaucgagcaagugauacuugucggaggcgccacccgugugccucggguucaggaagugcuguugaaggcuguagguaaagaggaacucgggaagaacauuaaugccgaugaggcagcggcuaugggagccgucuaccaggcagccgcucugagcaaggccuucaaagugaagccauuuguugugcgagacgcagucguguaucccaucuuaguagaguucacaagagagguggaggaagaaccuggcauucauucucugaaacacaacaagaggguucuauuuucccgcaugggcccauacccccagcggaaagucaucaccuucaacagauacucacacgauuuuaauuuccauaucaacuauggggaccucggauuucuggguccggaagaucuuaggguguucggcagccaaaauuugacgacugugaagcugaagggggucggagacaguuuuaaaaaguacccugauuaugagucuaaaggcauuaaggcucacuucaaccucgacgaguccgguguucugagccuugaccgcguggaaucgguguuugagacacugguagaagauucugccgaggaagaguccaccuugacuaaacucgggaauacaauaucaagucuguucggcggaggcaccacgcccgacgcgaaggagaacgggaccgauacaguccaggaagaggaagagagcccagccgaaggauccaaggacgagccuggugaacagguggaauuaaaagaggaagcugaggcacccguugaagauggcucucagccacccccuccagagccgaagggggacgccacucccgagggagaaaaagcuaccgagaaggaaaauggcgauaaaagcgaggcccaaaagccuucagagaaggcagaagcggguccagaggggguggcccccgcuccugaaggcgagaaaaagcagaaaccagcccgaaagcggcguauggucgaagagaucggaguggagcugguugugcuagaccuccccgaucugccggaagacaaacuugcacagaguguacaaaaguugcaggaucugacacucagagaccuggagaaacaggaaagggagaaggcugccaacuccuuagaagcauucauuuuugagacucaggauaagcuguaccaaccugaguaucaggaagucagcaccgaggaacagcgcgaggaaaucucuggcaaacuuucagccgcuaguacaugguuggaggacgagggggugggagcgaccacugugaugcucaaggaaaaacuggccgagcuacggaagcugugucagggucucuucuuuagagucgaagagaggaaaaaguggccagagcgacugagcgcacuugacaauuugcugaaccauuccucuauguucuuaaagggcgcucgccucauacccgaaauggaucaaauuuuuacggagguugaaaugacaacccuggagaaagugaucaaugaaacuugggccuggaagaacgccacccuugcugagcaggcaaaacugccugccacagagaagcccguauugcucucgaaagacaucgaagcgaagaugauggcucuggaucgggaggugcaguaccuacugaauaaggccaaauucaccaagccaagaccuaggcccaaagacaagaacgggacucgugcagaaccaccgcucaaugccagcgcuuccgaucagggagagaaagucauuccucccgcaggccaaacagaagacgccgagccaaucucagagcccgaaaagguggagacggguagugaaccuggggauaccgagccacuggaacuuggcggacccggcgcggagccugagcagaaggaacagucuacugggcaaaaacgcccguugaagaacgacgagcuguga

SEQ ID NO: 57497 - RNA, 354 nt, Artificial Sequence
  derived and/or modified sequence opt3 from HYPM__Homo_sapiens__NP_036406
augagcgagaagaaaaacugcaagaacuccucuaccaauaauaaccagacacaagaccccucaagaaaugaacuccaggugccuaggaguuucgucgaucggguugugcaggacgagcgcgauguacagagccaauccucuucgacuaucaacacgcugcuuacccuguuggacuguuuagccgauuacauuauggaacgagugggccuggaggcuucaaauaacgggagcaugcguaauacaagucaggacagagaaagggaggucgauaacaaucgggagccacacuccgcagaaucugacgugacucgcuuucuauucgaugagaugccgaaaagcagaaagaacgacuga

SEQ ID NO: 57498 - RNA, 270 nt, Artificial Sequence
  derived and/or modified sequence opt3 from IAPP__Homo_sapiens__NP_000406
augggcauccugaagcuccagguguuccuuauuguccugagcguugccuugaaccacuuaaaagcuacccccauagagucccaucaaguggaaaagagaaaaugcaauacagcaacuugugccacgcagaggcuggcgaacuuucuaguacacucuucaaauaacuucggggcuauccucaguagcaccaaugugggauccaacacauacgguaagcggaaugccgucgaggugcugaaacgcgaaccucuuaacuaucugccauuguga

SEQ ID NO: 57499 - RNA, 3039 nt, Artificial Sequence
  derived and/or modified sequence opt3 from IARS2__Homo_sapiens__NP_060530
augagauggggccugaggccccgggggccuggagccgcugcacucgccaccgcgcgcagccuuugggguacaccacgacugccgugcucccccggcuggcagggggcuacuaagcguuuguuagugagaucugucucaggagccaguaaccaccaaccuaauagcaacuccggcagguaccgggacacgguucugcuaccacagaccucuuuccccaugaaacuccugggucgccagcagccugauacagagcuugaaauccaacagaaguguggguuuucggagcuguauucauggcagagagaaaggaaagugaagacugaguucugcuugcaugacggaccacccuacgcaaauggcgauccucacguaggccaugcccucaacaaaauucugaaggacauagcuaaucgguuucacaugaugaacgggagcaagauccauuucgugccaggaugggauugucacggucugccgauugaaaucaaaguccucagugaguuaggccgcgaggcacagaaucuguccgccauggaaauucgaaagaaagcuagaucuuuugccaaggcggcaaucgagaaacaaaagagcgccuucauaaggugggggaucauggcugacuggaacaauugcuauuacaccuuugauggaaaguaugaagccaaacagcuucggacauucuaccagauguaugacaagggcuugguguaccguuccuacaaacccguguuuuggucaccuaguagccgcaccgcacuggcugaggccgagcuagaauauaacccagagcacguuucuagauccauuuacgucaaguucccccuccugaaaccuucaccaaagcuggcgagccugaucgaugguaguucucccguguccauuuugguauggacuacacagccguggaccaucccugccaaugaagcaguuuguuauaugcccgagagcaaauacgcuguggucaagugcucgaagucuggggaccucuaugugcuggccgcugauaaaguggccuccgucgcaucaacguuagaaacuaccuuugagacaauaaguacucugagcggaguugaccucgagaacggcaccuguucccauccacuuauuccugauaaggccucuccccuguugccagcuaaucacgugacaauggcgaaaggcaccgggcuaguacauacggcacccgcccacggaauggaagacuacgguguggcuagccaacacaaccugccuauggacugccucgucgaugaggacggcguguucacugauguugccgggccagaacugcagaauaaggcagugcuugaggaaggaacagacgucgugaucaaaaugcugcagaccgccaagaacuugcucaaggaggagaaacugguacauucauauccguacgauuggaggacuaagaaacccguugugauucgggcuaguaagcaaugguuuaucaacaucacagacauuaaaaccgccgcaaaggaauuacugaagaaagucaaguucauaccuggcuccgcgcuaaaugguaugguggagaugauggaucgacgcccauacugguguaucagcagacagagggucuggggcgugcccauuccuguuuuccaccauaaaacgaaggacgaauaucucaucaacucucagaccacagagcacauagugaaacugguagaacagcaugggucagauauuugguggacucuuccacccgagcaauugcugccgaaggagguccucagugaagugggaggcccugacgcucuggaguacguuccagggcaggauauccuugacaucugguuugacagcggaaccuccuggucuuaugugcugcccgguccugaucagcgggccgacuuguaccucgaaggcaaggaucagcuugggggaugguuccaaucgagcuuacugacauccgucgcagcccgcaaaagagcucccuauaagacugugauuguacacggcuuuacccuaggugagaaaggggagaagaugucaaaaagucucggcaaugugauccacccagacguugucgugaacggaggccaggaucagucuaaggaaccucccuacggggccgacgugcugagguggugggucgcagauagcaauguuuucacagagguggcuauuggaccauccgugcuuaacgccgcgcgugacgauauaucaaaauugcggaauacccugcgauuucuccuggguaacguagccgacuucaauccggaaacugauagcaucccugucaacgacauguaugugauugaucaguacauguuacaucugcuucaagacuuggcuaauaagaucacggagcucuacaagcaguaugacuuuggcaaaguugugagacugcuaaggacauucuacacccgcgaacugucuaacuuuuauuucuccaucauuaaggaucggcucuacugcgagaaagagaaugaccccaagagaaggaguugucagacugcacuggucgaaauacuugaugugaucguucgcagcuuugccccaauuuugccccaccuggcugaggaaguguuccagcauaucccuuauauuaaagagccaaagucuguauuucgaaccggguggaucuccacaucaaguauauggaagaaacccggauuagaagaggccgucgagagcgcaugcgcgaugcgggacucguuccucggcuccaucccugguaagaacgccgcugaauacaaagugauuaccgugaucgagccggggcugcuuuucgaaauuaucgagaugcugcaaucugaagagacuagcucaacaagucaguugaaugagcucaugauggccuccgaaucuacgcugcuagcacaggagccacgugaaaugaccgcugaugucauagagcugaagggcaaauuucucauuaaccuggagggaggcgacaucagagaagagagcuccuauaagguuauugugaugcccacuacaaaggaaaaaugcccuagguguuggaaguacaccgccgagucaagcgauacacuuugcccacgcugugcagaaguagugagugggaaauga

SEQ ID NO: 57500 - RNA, 3789 nt, Artificial Sequence
  derived and/or modified sequence opt3 from IARS__Homo_sapiens__NP_038203
augcugcagcaagugcccgagaacaucaauuucccugccgaagaggaaaagauucucgaguuuuggaccgaauuuaacugcuuccaggagugucuuaaacagagcaagcacaaaccaaaguucacauuuuacgacggcccgcccuucgcuacugggcugccucauuauggacacauauuggcagguacgaucaaagauauugucaccagauacgcccaucaguccggcuuucacguugacaggcgguucgggugggauugccauggauuaccaguggaguaugaaaucgacaagacacugggcauucgcggucccgaggauguagcgaagauggggaucacugaauacaauaaccaaugucgagcuauagugaugcguuauucugccgaguggaaaucaaccgucaguagacuaggaagguggaucgacuuugauaaugacuacaagacacucuauccucaguucauggagagcgugugguggguuuuuaaacagcuguacgauaagggccuuguguaccggggcgucaaagugaugccauucuccaccgcaugcaacacuccccugucuaauuuugaaucgcaccagaacuauaaggacguacaagauccuucaguuuucgugacauucccauuggaggaagacgagaccgucagccucguggccuggacgacuaccccguggacacugcccaguaaucuggcugugugugucaacccugaaaugcaguacguuaagauuaaagauguggcacgcgggagacucuuaauccugauggaggccaggcuuuccgcuuuguauaagcuggagucugacuacgaaauucuagagcgguuuccaggagccuaucucaaagguaagaaauaccgcccccuguucgacuauuuucuuaagugcaaagaaaauggcgcguucacuguacugguggauaacuacgucaaggaggaagaggggaccggagugguucaccaggcaccuuacuuuggcgccgaggacuaucgaguguguauggauuucaauaucauaagaaaggacagcuugccagucugccccguggaugcuuccgguuguuuuacaaccgaaguaacggacuucgccgggcaguacguuaaagaugcagacaagucaauuaucaggacucucaaagagcaaggacggcuguuaguggcuacaaccuuuacucauaguuauccguucugcuggcguagcgauacaccucugauuuacaaggccguccccucuugguuugugcgcgucgaaaacaugguggaccagcuccuuagaaauaacgaucuguguuauuggguuccagaguuggugagggaaaaacgguucggcaacuggcuaaaggacgcgcgagacuggaccaucucccgcaauagauacuggggcacgccuaucccccuguggguaucagaugacuuugaggaggucgugugcauugggagcguugccgaacucgaggaacugaguggagcaaagauaucugaucuucacagggaguccguggaccaucugaccaucccaagccggugcgguaaaggcucguugcaccgcauuucugaggucuucgauuguugguucgaauccgggucaaugcccuaugcucaggugcacuacccuuuugagaacaagagagaauuugaggacgccuucccagcugauuucaucgccgaaggaauagaccaaacaaggggcugguuuuacacucuccugguauuagcaaccgcccuguucggucagccgcccuuuaaaaaugugauuguuaacgggcuaguccucgcuagugauggccagaagaugagcaaacguaagaagaauuauccugacccaguguccaucauccagaaauacggagcggaugcacugcggcuuuauuugauuaacucucccgugguccgagccgagaaucugagauucaaggaggaaggcguuagggacgugcucaaagaugugcugcuuccuugguacaacgcuuaucgcuuucugauccaaaauguauugcggcuccagaaggaggaagagauugaauuucuguacaacgagaauacagucagagagagcccaaacauaacugacagguggaucuuaucauucaugcagagucugauuggguucuuugaaaccgagauggccgcauaucgccuauacacagugguuccccgacucgugaaauucgucgacauccugaccaauugguacgugcggaugaaccguagaaggcuuaagggagaaaaugguauggaggauugcguuauggccuuggaaacucuguucuccgugcuccugagcuuaugucgccugauggcuccguauacgccuuuucuuacagaguugauguaccagaaccucaagguacugaucgacccagucucugugcaagauaaagacacccuaucaauucauuaucugaugcucccccgggugagagaggaacugauagauaagaaaacugagagugccgucagccagaugcaguccguuaucgaacuuggcagggugauucgagaccgcaagaccaucccuauuaaauaccccuugaaggagaucguagugauacaccaggauccagaggcacugaaagacaucaagucuuuagaaaaguauauuaucgaggaacucaacguccggaaagugacacugucgaccgauaagaauaaauacgggauuagacuuagggcggagccugaccauaugguucugggaaagcguuugaaaggcgcuuucaaggccgugaugacuagcaucaagcaacucuccucagaagaacuggagcaguuucagaaaacagguacgauagucguggaagggcacgagcuacaugaugaagacauucgccugauguauaccuucgaucaggcaacuggcggaacagcccaauuugaggcucacagugacgcccaggcacucguucugcuugacgugacccccgaucagucuauggucgacgaaggcauggcucgggagguaaucaacagaauccaaaaguugaggaaaaagugcaaucuggugccaacagaugagauuacuguuuacuacaaagccaagagcgaagggaccuauuuaaacuccgugauagagucacacacggaguucaucuuuaccacaauuaaggcgccgcucaaaccuuaccccgucagcccaucugacaaggugcugauccaggagaaaacucagcuuaagggauccgaacuggagauuacccuaacacgagguaguagccuccccggcccugccugugcuuauguaaaucugaacaucugcgcaaaugggucugagcagggaggcguguugcuguuagaaaacccaaaaggugauaaucggcucgaccugcuuaagcugaaguccgucguuacuucaauauucggggugaaaaacaccgaguuggccguguuucaugaugaaacggagauucaaaaucagacagaccuccugagucuaagcggcaagacccugugugucacugcuggaucggcccccucccuuaucaacucuagcucaacacuccugugccaguacaucaauuugcagcuguuaaacgcaaaaccucaagagugucucaugggcaccguggggacucugcuucuggaaaauccguugggacagaacggccucacccaccagggucugcuauaugaggcggccaagguuuucgggcugcgcaguagaaaacuuaagcucuuucugaacgaaacacagacgcaagagauuaccgaagauaucccaguaaaaacuuugaauaugaagacaguguacgucuccguguuacccaccacagcugacuucuga

SEQ ID NO: 57501 - RNA, 1071 nt, Artificial Sequence
  derived and/or modified sequence opt3 from IBA57__Homo_sapiens__NP_001010867
auggccaccgcugcacugcucagaggcgccacacccgggaggggagguccuguguggcgguggcgccuucgagcggcuccacguugcagacuggcccacagcuccuguucuccgggcggggaccccacugcaggagccgcuugggcaugcuucagguuggauggccggacguuacugcgcgucagagguccugacgccgcuccauuucuacucgggcugcuuaccaacgagcugcccuugccuucaccagccgcggcaggagcucccccugccgccagggcaggcuacgcucauuuccucaauguucagggccggacacuguaugaugugauccuguacgggcuccaagaacacagugagguaagcggauuuuuacuggaaugugacuccucugugcagggugcccuucagaagcauuuggcgcuguaucgcauucgaagaaaagucacuguggagccacacccggaacuaaggguuugggccgugcuccccucgucaccugaggcaugcggcgcugccagccugcaggagcgggcuggggccgcagccauacuuauccgugauccacgcaccgcuagaaugggauggaggcuguugacacaagacgaaggccccgcgcucgucccuggugggcggcugggagauuuaugggacuaccaucagcaccgauaucugcagggcgugccagagggcguacgcgaucuucccccggggguugcacucccucuggaaaguaacuuggccuucaugaauggaguguccuuuaccaaggguuguuacauuggccaggagcuaacugcuagaacacaccauaugggggucaucaggaaacggcuguuccccgugcgcuuucucgacccacugccuaccucuggaauuacgcccggcgccacugugcuuaccgcaagcggucaaacagucgggaaguucagagccggccagggaaacguuggccuggcuuugcucugguccgagaaaaucaaggggccacugcacauaagggccucagaaggagcacagguggcguuagcugccaguguacccgauugguggccuacugugagcaaguga

SEQ ID NO: 57502 - RNA, 954 nt, Artificial Sequence
  derived and/or modified sequence opt3 from IBSP__Homo_sapiens__NP_004958
augaagaccgcccugauccuccuuagcauucugggcauggcuugcgcauucuccaugaaaaacuugcacagaagggugaagauagaggacucugaagagaauggggucuuuaaauaccggccccgcuauuacuuauauaagcaugccuacuucuauccucaccugaaacgauuuccaguucagggaucaagugauagcuccgaagagaacggugacgauucuucggaagaggaggaagaggaagaggagacaucaaaugaaggcgagaacaaugaagagagcaacgaagacgaggauagugaggcggaaaauacuacgcuauccgcuaccacacucggguacggagaggacgccacuccgggcaccgguuauacagggcuggcagccauccaacuucccaagaaggcuggagauauuaccaacaaagcaacuaaggaaaaagagucugacgaagaggaggaagaggaagaggaaggcaaugagaacgaggaaagcgaggccgaaguggaugagaaugagcagggcaucaacgggacauccaccaauucaacggaagcugagaacggaaaugguaguagcggcggggacaacggagaagagggcgaagaggagucuguaacuggugccaacgcggaagauaccacagagacugggcgucagggaaagggcaccuccaaaacaaccacgucaccuaauggcggguucgaaccaacuacacccccucagguguacagaaccacuagcccacccuuuggaaagacaaccacggucgaguacgaaggugaguaugaguacaccggcgcaaacgaauaugacaauggguacgagauuuaugaaagugagaacggagaaccuaggggcgauaauuaccgggccuaugaggacgaguacucuuacuucaagggucaaggguaugacggcuacgauggacagaacuauuaccaucaccaguga

SEQ ID NO: 57503 - RNA, 4062 nt, Artificial Sequence
  derived and/or modified sequence opt3 from IBTK__Homo_sapiens__NP_056340
augagcucccccaugccugacugcaccucuaaguguagaucacugaaacacgcccucgaugugcuuagugucguuacaaagggcagcgagaaccagaucaaggcuuuccuguccucucauugcuacaaugcagccacuauuaaagacguguuugggaggaacgcguugcacuuaguaucgucaugugggaaaaagggugugcuggauuggcuaauacaaaagggcgucgaccuccuggugaaagauaaggaaagcggguggacggcacuucaucggaguaucuucuauggacacauugacugcguuuggucccuguugaaacauggcgugucucucuacauccaggauaaggagggucugagcgcccuggaccucgucaugaaagaucgcccaacccacgugguauuuaagaauacagacccgacugauguuuauaccuggggagacaacacaaauuucaccuuaggacacggcucccagaacucaaagcaucaccccgaacugguggaucuuuuuagucgaagcggcauuuacaucaaacaggucguguuguguaaguuccauucuguguuucugucccaaaaagggcaggucuauacuugcggacacgguccuggcgggcgucuaggacacggcgacgagcagacaugucucguuccaagacugguggaaggucuuaaugggcauaacugcucacagguagcagccgcuaaggaccacaccgugguccugacggaggauggauguguguacacuuucggcuugaauauauuucaucaacucggcaucauucccccuccaagcaguugcaacguucccaggcagauccaggcaaaauaucugaaggggcggaccauuaucggaguggccgcuggucgcuuccacacagucuuauggacuagagaggccguguacaccaugggccugaaugggggacagcucggcugucuucuggacccuaacggugaaaaaugcguaacagcgccaaggcaaguuucugcauugcaucacaaggauauagcccuaucccugguggcugccagcgacggggcaaccgucugcgugacgacucggggcgauauuuaccuccuggcugacuaucaguguaagaaaauggccucgaagcagcuuaaucugaaaaaggucuuggugucuggaggccacauggaguacaaaguugauccggaacaucucaaggagaacgggggacaaaagaucugcauucuggcgauggacggugccggccgcguguuuuguuggcgauccguaaauucaaguuuaaaacagugcagaugggcauaucccaggcaggucuucaucagcgauaucgcucugaaccggaacgagauucuauuugugacacaggacggggaaggauuccguggccgcugguucgaggaaaagagaaaauccucugagaagaaagaaauacucagcaaucugcacaacucaaguuccgauguuagcuacgugucugacaucaauucagucuaugagaggauucggcuugagaaguugaccuuugcccaucgagcugugaguguaagcacugacccuuccgguuguaacuucgccauccugcaaucugauccaaagacaucgcucuacgaaauacccgcagugagcuccucaaguuucuuugaggaauuugggaaacugcuucgcgaggccgacgaaauggauucuauucacgacguuaccuuccaggucggcaauagacuguuuccugcucacaaguauaucuuggcggugcauagcgauuucuuucagaaacucuuccuguccgacggaaacacgucagaguuuaccgauaucuaccagaaggacgaggauagcgcaggcugccacuuauucguggucgaaaaaguucauccagacauguuugaguaccugcuacaauucauuuauacagauacuugugacuuccucacccacggguuuaagcccaggauccaucugaauaagaacccggaagaguaccagggaacacuuaauucucacuugaacaaagugaauuuccacgaagaugacaaccagaaguccgccuuugagguguauaaaaguaaucaggcucaaacuguaagcgagcggcagaagucuaaaccuaaguccugcaaaaaggguaagaacauucgcgaagacgaucccgucagaaugcugcagaccguggccaaaaaguucgacuuuucaaaucucaguagcaggcuggauggcguucguuucgagaacgagaaaauaaacgugaucgcaaagaauacagggaacaaauuaaagcugucgcagaagaaauguuccuuucuuugcgacgucaccaugaagucuguggauggaaaagaguucccaugucauaagugcguuuugugcgcccggcucgaauacuuucacagcaugcugucaaguuccuggauugaggcuucuagcugugccgcacuagaaaugccuauccauuccgacauccugaaagugauucucgauuaucuguacacugacgaagcgguagucauaaaggagucacaaaauguggauuucaucugcagcgugcuugucguugcugaccaguugcugauuacgcgauuaaaggaaaucugugagguggcccucacagagaaacugacccuuaagaacgcagccaugcuguuggaauuugcugccauguauagugcaaaacagcucaagcugucuugccuacaauucauuggccugaauauggcugcccuccuggaggcgagaucccuugauguauugagcgacggugugcugaaagauuuaucggaauuuuacaggaagaugauccccgccauggaccgccgggucauaacuccauaccaggacgggcccgauaucucauaucucgagguggaagacggcgauauuuuccugaaggaggagaucaacauggaacagaaucacucugagaccauguucaaaaaggcuaaaacaaaggcuaaaaagaaaccuagaaagaggagugacuccagcggaggcuacaaccuuucugauauuauccagagcccauccucaaccgggcugcuaaagaguggaaaaacuaauagcguugaaucucucccggagcuguugacauccgacucagaaggcaguuaugccgguguggggagcccccgcgaucugcaauccccugacuuuacgaccggauuccauucugauaagauagaggcuaaagucaagccauacgugaacggcacuucgcccguuuauagccgagaggacuuaaaaccuugggaaaagucaccaauucucaagaucuccgcaccccagccgauuccuaguaaucggaucgauacaaccucuagcgccuccuggguggcggguucauuuucuccagucagucccccuguaguggaccugcguacaauaauggagaucgaagagagcagacagaaauguggcgccacucccaagucccaccuugggaaaaccguuagccacggagugaagcugucucagaaacaaaggaagaugauugcuuugacgaccaaggagaacaauucaggcaugaacuccauggaaacaguccucuucacuccaaguaaagccccuaagcccgugaaugcaugggcuagcucgcugcauucuguauccagcaaaucauuucgcgacuuccuacuggaggaaaagaaaagugugaccucucacuccagcggggaucaugucaagaagguuucauuuaaaggaaucgagaacagucaggccccaaagauugugcggugcagcacacacggcacuccggguccugaagggaaccacaucuccgaccuuccccuccuggauucuccaaaucccugguugagcuccucagugaccgcaccuucuauggucgccccagugacguucgcuaguauaguugaggaggaacugcagcaggaggcggccuuaauuagaucgagggaaaaaccccucgcacugauccaaaucgaggaacaugcuauucaggaccuucugguauuuuacgaggccuucggaaacccugaggaauuugugaucgucgagcgaacaccgcagggcccauuggccgugcccauguggaauaagcacgguuguuga

SEQ ID NO: 57504 - RNA, 1449 nt, Artificial Sequence
  derived and/or modified sequence opt3 from ICA1__Homo_sapiens__NP_001263407
augagcggccacaagugcuaccccugggaccugcaggauagauaugcccaagacaaauccguggucaacaagaugcagcagaaauacugggagaccaagcaggcuuucaucaaagcaacagggaagaaggaagaugagcauguuguggccucugacgcggaucucgacgcuaaacuugaacuguuucacucaauucaaaggacuuguuuggauuuaaguaaggccauaguacuguaucagaaacggaucugcuuccuaagccaggaggaaaaugagcucggaaaguuucugcgcucccaggguuuccaagacaaaacgcgagcaggcaagaugaugcaggccaccgggaaggcucuuuguuuuucuucgcagcagcgucuggcauugagaaacccucucugcagguuccaucaagagguggaaacauuucggcaccgcgccauuucagauacuuggcugaccgucaauagaauggagcaguguaggacagaauaccggggagcucugcucuggaugaaagacgugagccaggaguuagauccagaccuguauaagcaaauggagaaauuccgcaagguucagacccaggugcgacuugccaaaaagaacuuugauaaauugaagauggacgucugccagaagguggaccugcuaggcgcgaguagauguaaucuccugucccauaugcuugcaacuuaccaaacaacccuguugcacuucugggaaaagacgucucacacuauggccgcuauccaugagagcuuuaaggguuaucagccguacgaguucaccacacucaaaucccugcaggaucccaugaagaaauuaguagaaaaggaagagaagaaaaagauuaaccagcaagagucaacugacgccgcaguucaggaaccuagucagcugaucagccucgaggaagagaaucagaggaaagaaucuuccucauuuaagaccgaggaugggaaaagcauacuuagugcucuggacaagggaucuacacacaccgccugcuccggcccaaucgaugaguugcuagacaugaaaagcgaagagggcgcgugucuggggcccguggccggaacgccugaaccagagggugcagauaaagacgaucuccugcuucugucggaaauuuucaacgcuucuuccuuggaggagggcgaguucucaaaggaaugggccgcugucuuuggggacggacaagugaaagaacccgugccuacuauggcccucggcgagccagauccgaaggcacagacagguaguggguuccugcccagccaguuacuggaccagaauaugaaagaccuacaagccucccuccaggagccugcuaaggcggcaucugaucugaccgccugguuuagccuuuucgcugacuuggauccacugucaaaccccgacgccgucggaaagacugauaaagaacaugagcuccugaaugcauga

SEQ ID NO: 57505 - RNA, 1599 nt, Artificial Sequence
  derived and/or modified sequence opt3 from ICAM1__Homo_sapiens__NP_000192
auggcccccagcuccccuagaccagcucugccggcacuccuugugcuguugggcgccuuauuccccgggccuggaaacgcgcagaccucugucucaccaaguaagguuauccugcccagggguggcagcgugcuaguaacaugcuccacuucuugugaccaaccuaaacuccuggggauugagacgccacuucccaagaaagaacuguugcucccuggaaauaaccggaagguguacgagcugucgaauguccaggaagauucacagccaaugugcuauagcaacuguccggacggccagaguaccgcuaaaacauuucugacuguguacuggacccccgagcgcguugaacucgccccuuuaccauccuggcaacccguggguaagaaucugacacuucgaugccaggucgaagggggagcaccucgugccaacuugaccgugguacugcuaagaggcgagaaggagcucaaaagggagccagcuguuggcgaacccgcagaggugacuacaaccguccuggugcggcgcgaucaccauggggccaauuucucuuguagaacggagcuugaccugaggccgcagggauuggaacucuuugagaacacuagcgcuccuuaucagcugcaaaccuucguguuacccgccacaccaccucagcuggucucaccccggguucucgaaguggauacucaggguaccguagugugcucccuugacggccuguuuccagucagugaggcacaggugcacuuggcgcuaggggaucaacgccugaaucccacaguuaccuacggaaacgacagcuucucugccaaggcuuccgugucagucacggccgaagaugagggcacucagcgacucacaugugcagugauacuggguaaucagagccaagagacccuucagacuguaacaaucuauaguuuuccugcuccaaacguuauucugaccaaaccggaagugucugaggggacggaagucaccgugaagugcgaggcccaucccagagcgaaagucacauugaauggagugccugcccagccacucggccccagggcacagcuguuacugaaggcuacuccugaagacaacggccgguccuucagcuguucggccacccuagagguugcugggcaacucauccacaagaaucagacacgugagcugcgcgugcuuuacggaccaagauuggaugaaagggacugccccgguaacuggacuuggccggagaacucucagcagaccccuaugugucaagccuggggcaauccacugcccgaacucaaaugccugaaggaugggacauuuccucuucccauuggagaguccguaaccgucacucgggaccuggaaggcacguauuugugccgagcacgcucaacacagggugaggugaccagaaaaguuacugugaacguccucaguccaagguacgagaucgugauaaucaccguaguggccgcugcgguuauuauggggacagcaggccugagcaccuacuuauauaaucggcagcgcaagaucaaaaaguacagacugcagcaagcccagaaaggaacuccuaugaagcccaacacacaggcuacgccaccguga

SEQ ID NO: 57506 - RNA, 828 nt, Artificial Sequence
  derived and/or modified sequence opt3 from ICAM2__Homo_sapiens__NP_001093259
augagcuccuucggcuacagaacccugacaguggcccucuuuacucuuaucugcugucccgggucugacgagaaggucuucgaaguucacgugaggccuaaaaagcuggcuguagagccaaaaggaucauuggaagugaacugcaguacgaccuguaaucagccggaggucgguggcuuagaaacaagccuggauaagauucuacucgacgagcaagcacaguggaaacauuaucugguguccaacauaucucacgauacuguucuucagugccauuuuaccuguucggggaagcaggagucaaugaauagcaacgugagugucuaccaacccccucgccaggugauccugacauugcagccaacccucguagccguuggaaaguccuucacuauugaaugccgggugcccacagucgagccucuggacucucugacccucuuuuuauuccgaggcaaugaaacgcugcacuaugagacuuuugguaaagcggcuccagcaccccaggaggccaccgccacauucaacagcacugcugaucgugaagacgggcauagaaauuuuuccugucuugcaguguuggaucugaugucaaggggaggcaacaucuuccacaagcacagugccccuaaaaugcuagagauuuacgaaccagugagcgacucucaaauggucaucauaguuaccgugguauccgugcuccugucacuuuuugucacaagcgugcuguugugcuucaucuuuggccagcaucuccggcagcagcgcauggggaccuauggaguuagagcugccuggaggcggcugccgcaagcguuccgccccuga

SEQ ID NO: 57507 - RNA, 1644 nt, Artificial Sequence
  derived and/or modified sequence opt3 from ICAM3__Homo_sapiens__NP_002153
auggccaccauggugcccagcguccuguggccuagagcuugcuggacacuccuuguuuguugccuguugacuccaggcgugcaggggcaagaguucuuacugaggguagaaccgcagaaccccgugcuauccgcaggagguucucucuuugucaauuguucaacggacugcccuaguagcgagaagaucgcccuggaaaccucccuuucuaaagagcugguggcgucgggcauggggugggcugccuucaacuugucaaauguuacaggaaacagccggauucucuguaguguguacugcaauggcucccagauaacugguucuagcaacaucaccgucuaucgccugccagaacgaguggagcuggcaccccucccuccauggcagcccguagggcaaaauuuuacauuacguugucagguugaggauggauccccuagaaccucacugacugugguccuuuugaggugggaagaggaacugagucggcagccagccguggaggagccggcugaagugacagcaaccguccuagccagccgcgacgaucacggcgcucccuucucuugcagaacggagcucgacaugcagccucaaggccuggggcuuuuuguuaacacuuccgccccaaggcagcugcggaccuucguguugcccguaacaccuccacgccucguggcgccccgauuucuggaagucgagacuucauggccgguggauuguaccuuagacggacuguucccugcaagcgaagcccagguuuaccucgcucuuggugaucagaugcugaaugccacagugaugaaccauggcgacaccuugacggcaacugcuacagccaccgcgagagccgaucaagagggggcaagggagauugucugcaaugugacucuaggaggcgaacggcgugaggcucgcgaaaaccugacaguauuuaguuuccucggucccaucguuaaucugucugagccaaccgcccacgaaggguccacggugaccgucagcuguauggcuggagccagagugcaggucacacuugacggcgugccugcagccgcucccggccagccagcgcaacugcaguugaacgcaacugagucggaugacgggagguccuuuuucugcucugccacccucgagguugauggagaauuucugcaucgaaauucaagugugcaguuacggguacuguauggucccaagauugaccgcgcuacaugcccucagcaccuaaaauggaaggacaaaacuagacauguccuccaaugucaggccaggggcaacccauacccggagcugcggugccuuaaggaagggagcucccgcgaggugcccguuggaaucccuuucuucgugaacgucacccacaauggcacauaucagugucaggcaucuagcucaagagguaaguacaccuuggugguagugauggauauagaagccgggaguucccacuuuguuccagucuucguggcugugcugcucacucugggcgucguuacgaucgugcuugcccugauguauguguuuagggagcaucaacguagcggaucuuaccacguacgggaggaaucaacauacuugccccucaccaguaugcagccuacugaggcaaugggcgaggaaccaagccgagcggaguga

SEQ ID NO: 57508 - RNA, 819 nt, Artificial Sequence
  derived and/or modified sequence opt3 from ICAM4__Homo_sapiens__NP_001034221
augggcagccuguucccccucucccuucuguuuuucuuggccgcugcauacccuggggugggaucugccuuagguagaaggaccaagcgggcgcagucaccaaaaggcaguccgcuggcucccagcgggacauccgucccuuuuuggguucgcaugucuccagaguucguggccguacaacccggaaagucggugcagcuaaacugcucaaauagcuguccucagccacagaacaguucccuccgaacuccccugcgucaaggcaaaacgcuuagagguccugggugggucucuuaucagcuguuggacgugagggcauggagcucccucgcccacugccugguuaccugugcuggaaagacacggugggcaacuucacgcaucaccgccuacagugugccaggcggccugcucgggggagauccggaggcuuggaaacccggucauuuauuuagaaagccuggcgcccugcacaggccagggagcggacagcgggaccuugauuugcgcgucugcuguuggacaccccgacugcuagcggcaagagaccucccuagggccccacagucucggcgucccggcgguccgcaacagcuggggacccauuauacugaugcucgccuugaaccuagagcccacuccuucggacugagguuucaucggugccccugucgagacccaccucacugcggccgcugugugcccaugcagguaccaucauacgaaguucccggcgugaagggggaugucuugugcagacucagcgagaaaaagaggaauaugaaacagaguggagaaauggcaauucacgguggcuga

SEQ ID NO: 57509 - RNA, 2775 nt, Artificial Sequence
  derived and/or modified sequence opt3 from ICAM5__Homo_sapiens__NP_003250
augcccggcccuagcccagggcugagaagggcccuccuuggacugugggcugcauuggguuuaggccuguucgggcuauccgccgugucucaggagccguuuugggcggaccuccaaccccgggucgcuuucguugaacgcggaggcucacuguggcuuaacugcaguaccaauuguccucgaccagagcguggugggcuggaaacuagcuugagaaggaacggaacacagcggggccuccgcuggcuggccagacagcugguggauaucagggagcccgaaacgcagccuguaugcuuuuuccggugugcacgccgaacccuccaagccagaggcuuaauuaggacauuucagcggccagaccguguggagcugaugccccuuccuccauggcagccggucggggagaauuucacuuuguccugccgcgugcccggagcugguccuagagcaucucugacccuaacacuccugaggggcgcccaggaacuuauacggcgaucguuugcuggggagccaccccgcgccagaggagcgguucugaccgcaacuguguuggccaggcgggaagaucacggcgcuaacuucucaugucgcgccgagcucgaccugagaccucaugguuuagggcuguuugagaauagcagugcaccaagggaacuccguacauucucccuuucucccgaugcuccgcggcuggccgcgccucgauugcuagaggucggaagcgaaagacccguguccugcacccuggacggccucuuuccagccucagaggcaaggguauaccuggcucuuggcgaucaaaaccugaguccugacguuacguuggaaggggaugccuucguggcuacugccaccgcaacagccagcgcugagcaggagggagcgcgccagcucgucuguaaugugacucuggguggcgaaaaccgggagaccagagaaaaugugacaaucuauucuuuucccgcaccauuacugacccuauccgagcccucagucagcgaagggcagaugguuacggugacuugcgccgcuggagcccaagcacucguaacacuggagggcgugccugccgcugucccaggucagccggcccagcuucaauugaacgcaaccgagaaugacgauaggcgcaguuucuucugugacgcgacucuggauguggacggggaaacacucauuaagaaccgaucugcugagcugcggguucuuuacgcaccccgucuggacgauuccgacugcccuagaagcuggaccuggccagaaggccccgagcagacguugaggugugaagcccgcggaaauccugagccaucggugcacugcgcccggucugauggcggggcuguccucgcccugggauuacugggucccgugaccagagcacuauccggcacauauaggugcaaagcugccaacgaccagggggaggcgguaaaggauguuacucucaccguggaauacgccccggcucuggacucagucggauguccugagcgaaucacauggcuugaaggcacugaggcaaguuugagcugcguggcccauggugucccacccccugaugugauuuguguucgcuccggggagcugggcgcugugaucgaaggacuccugcggguagccagagagcacgcaggcaccuauaggugcgaagcgacaaauccccgugggucugccgcuaaaaacgucgccgugaccguugaguacggaccacgcuuugaggaaccuagcugucccucaaacuggacuuggguggaggguaguggccgguuauucuccugcgaagucgacgggaagccacagccgagcgugaaauguguaggaucuggcggugcaacggagggggugcugcuuccuuuggcucccccagaucccucaccuagagccccaaggauaccccgaguucucgcaccuggcaucuaugucugcaaugccacaaaccggcauggaaguguggcuaagaccguggucguuagcgcggaauccccgccagagauggacgaaucuacuugucccucgcaccaaaccuggcuggagggcgccgaggcaagcgcucuagccugcgccgcucgcgggagaccuuccccaggagugagguguucacgggaaggcauucccuggccugagcagcagcgagugaguagagaagaugcagguacauaccacugcguagccaccaaugcgcaugggacugacucucgcacagucacggugggaguugaguacaggccgguggucgcugaacuggccgcaucacccccaggcggugugcguccuggcgggaacuuuacccucacuugccgggccgaggcuuggcccccagcacagaucuccuggagagccccucccggagcgcugaauauuggccuuucaagcaacaauucuacauuguccguugcuggggccaugggaagucacggcggugaguaugaaugugcagccaccaacgcucaugggaggcacgcccgccgaaucacagugagaguagcaggaccauggcugugggucgcugugggcggugccgcgggcggggccgcauuacucgcugccggagcuggccuggcauucuacgugcaaagcacugccugcaagaaaggggaguauaauguccaggaagccgagucuuccggagaggcuguuugucuuaacggcgcgggugggggagcaggcggugccgcuggcgccgaagggggaccggaggcagccggcggggcugcggaaagcccugccgagggagaaguguuugcaauacagcugaccagugcuuga

SEQ ID NO: 57510 - RNA, 6801 nt, Artificial Sequence
  derived and/or modified sequence opt3 from ICE1__Homo_sapiens__NP_056140
augaugcccggcgaaacccacagcgccgcuccugggacagcagccgaccugucccgaugccagggaugugcgucucuccaacagaaccuuaaugaauacguggaagcucugaucacuuugaagcagaaaauuauaaacacggauaauuuacugaccgaauaucagaagaaaugcgacgagcuacaauucgccaggcgggaaaacucaaaucuccaucaccaggucgaggagaugcugcagaagaucagcccacuucagaaaugucaagaagaacuggguagcuugaaggcagaacucgaggagaagaaauccucucugaagcuguaccaggauacacaucaggaauaugcccgcguuaaagaggaaugccucaagucggacgcucagaaaaagaaguuagaggcaaaagugaagaaacugcaagaagccgcuguaaagcagacucaggauuuuaaacaacuucgaaacgagaagaaaauuuuggagaaggaguucaagaaaacccaggagcgucuggacgaauuuucaaagcagaaaaaugagaaggaacuaagacacaucggcacacagauuagcagcgauuccuacgggucuaucgacaaaaggaaggugaagcuccugcuuaaagagcugugguugugugucaacaccacucaucggcucccgggagagggcagccgcugcgugcccgaaaagccugccaaagcgauaacauccucaagaguuccaggugaggaugggacccugcccccuacgcaaggaaguccauuaaggacuagcaaugugcagaccugucugacaaagcucucuauggaaaucaaagaggacuuccuuugccagaacgucgaaaagcaguccucaagcggcacuaauuguaguucugaucacguguuuaacgagaauggcaaccuggagguauugguucaaucccaccgggacgggggaagcaccgaguucguggaucaugaccacuuuuucgacgaggaucuacaggcagccauugacuuuuucaagcugcccccuccacuccugucgccgguccccucuccuccacccauguccucaccucauccagguagucuucccagcuccuuugcuccggaaacauauuucggcgaguacaccgauucuagcgacaaugauucagugcagcugcgcaacagugccgagugcguguccgaagacgauacgacugagagccagaacuauuuugggucuuugagaaagaauaagggaucaggcacaugggaagagaaaccuaagagucacgaagcaauccaagcucucaacaccugggaggucaauaaaguuacuacaagcggucuggagaccuucacggccaccuuaagagaauccucugcgacacacucgcuggugggggagaagcauuggacuaccgccagcagguccaugucagaccggaagcgugauauucuacacgaaacaaaaacucagauggagguacgcgaaauggacaagagugugcagaccgagaaaacaauccauaagcucaccagaggacuguguauagagaggcuuucugcaagccccgcucaggaaaaagaggccgcuccaggcaaguccgaauugugcucaagcccucugggcaaacggccccucaacgagcugauggaaucugaggggaagacuguccuuuccaagaugaugggaaguccaaaaagcgaguucacgaaguggacacgaauuaaugaaaucaccucugagcccgaucgcauuacuguguccggucacuuucauagacugucaagggaauuggagaaagagaaggaagacacccaaggcuucacacucggggagaguccugaaagcgaggacgaugacucgggagauggcauggacguugccggucuggauaucgaaaccuccuuuucuagcucaaguacuuuaguggcacuguccgucgggucuaacccacagagcuccucaggccuagacugcggaaaugauacagacaucacgaccaaaguguucagcacugagccgcaccacagugagcauaagcuccagacaaagacccugaacacacuucacuugcaaucugaacccccugaguguuccauuggcgggaauaaccuggaaaauagccucugcgcccugucgccagaguuaggagcuucaaacuuuaaugaucagaaaucuagugguauagaauacacuaagguaguuaaaggccugaccaagauccauucccuuccccggagcguguucaugaaagcgacgaaggacgggcagugugagucucaggauccucgcauugaguugacccucaacaagccagacuuuacaagccugaucggaucccaagcagcccuaauaaaaucaggccuggguuucgucaagaguacuagcuggcaccacucugaucuccugagaaaagggggcgaagagucccuuagggcuaagucagaacaugagcagaaaaccagucaccaguugcagaaggccaugcccuuucugcaaaaucguggaccgacaccuaagccagacuuacuccgggaaaacaacaaucccguggaguucaaaacuaccgcaagcguccugccuaaccagguguccguuauuacgaagcagacacgacccgagaaagugcagucugccaaacuugaacaucugagaccacacaggguagagccuaccuuggucacugaaaauucgggcaacaaaacagggaugagcaccguggcuaagugcgacggagagcgcgaugacacuacccaaaauaucacagagguugccgcagugaaaucaaucucccccgaagucagugcgucucggagaaagcucgauuuuaacagcccagguggcuccucaccgguggaaaauucugacuguagcacgaacaguaggcuguccuucagcccugagaauauucuaauccagaaccaggauauuguacgcgaggcugccgugcaaggggacggacagaagcagcgacagccccaagcaaccgaucuggacucuucaggcacucaugguuccgaaaugcucccagccacagagguuaccgucagugggggcuuuagcguggaggaaacaucgugcggagauacuggccggucugggggagaggcucuggccguggcaaaugacuccaccagcacgccccagaacgcuaauggccuuuggaaauugaagucaacaaccccugguggggcccugccagaauguuucggaacuaccgauacaacuuucaguucugcguuuugccguaaacacggcgagacccaggacacaucccagagcucauuacccgguacgcuccacuguuacaccggcauaagagaagggggagaugacacugaggucgagagugaagccuucagcugcuccgagggcucugaacaacaggacgcuccugaugacagccagaagaaccugggggauacagacgcagccguugcugaggugaggccgucccuugaagugggauaucugaccucagcccuacaggauuuuaauaucucuacuuucagugagcucgaccgccugucgacaagcgagguagucauguuuuuggaauccugucaacugggcgauuacucuucaggugacagcguguccgagugcaguucuaaagggaccuuaagcaaggaaaugaacaaggagcucaaagcaucagagauuggagaaaaguaucggaaacagccaugcgaggaagagacgcugggcacuugugaagaguggaucgaguccgaagaggaugacuacagucuuaagaacaccagccagcugacacagugcucuuuggaaacccucuccgagguucugacuaaaaucagacaagaacuacagacaaauucagaggauuguaacgguaaggacaccggcagccugcuucuccugaaugugaacaauaacaugacaacugagaauuugaaggaaaaaucgcccuucagggagaccacggggucuaguucccaugcgagcgaaccuacaccacaggccgcugcccuggacaccgagggaucaucccccauuucuggcaugccucaaaacgaaaauccgcagagccgacccgaggcacgcagugaugcugggcggcagacugacggaggcgaggaagauuuaccagagccugucgaacccuccgcccucugcagcgacucugugauggagccaucaauagagcagaguuccaacugugaagcagagaccacauuucaaugccagaucgccacuguuaccagcgaagugauuaauguacugaucaacaaggaucagaaucuugucauugagaaaggugacaacuggacgaucauaucugggguggcugugcugccucacgucgaucagguuacauugugugacauccccggagauauuccaaucucgcaagaccagggcgaacucgaggcggguugcauuccggugaccucagccgaaaagagcccugaagcaucccauacuggccccgcuuuccaggaggccccaugugggaauaaccugaguugcccccaggaagauguaucuagcuccggacaaucaacaaacuuugacaaaaguagacuaaggaaucguccugugaagccaucuaucuggauaagcucccagauuuaugaucagaacuucgagacccaaaucgucgccucagaccacacuuacuauaauagcaagcuggaacccucuggcaaaaacaagaaucgcuccaaaauuaguaacaaggaccagagcaauaaaccugugaagacaucggcuuccucucggguugagacccaucagucagagguggcacagagcuuuaguggggaaaaggccaacacgaaaacucaaagaucccagacccagacaauccuugcgaaugcugauaccucuacaccgacugacuguagcccagauacccucucaaagauaaggcaggaggucggacccccucugcccccauuguuagccccucugaucgcaacgcccccacgaacaucccaaccucucaguccgcugauuaguucuucaucccccagcucuccagccaguccugugggccagguuucgcccuuccgggaaacuccagugccucccgcuauguccccguggccagaggacccucgcagagcaagucccccagaucccucaccuucuccgagcgccgcguccgcuagugaaagggucguacccucaccacuucaguuuugcgccgcaaccccuaaacacgcccugcccgugccuggucgguugccacccugcgcuucugggcacgccgcaguuggaggcccucaggagaacagcgugaagauccuagacacaauguacccagagcuguccgcucgagccagaacccucaauauucugaaaggcaacauccaacuuacucgcgggcccccggcggauuguaagaauuuaccuggaccagccagugcaaugauagguuucaaaaccauuacaagcgcugccacggcuuucgucaagacuggcuccucuucagggggagacugcaaccaggauaagagcagggaccugggcacccagcaggauucguccgguaaacguacacucaguaccucuacuuugcggagcgcaaagagacugaggcucgacacagggucacccgaaccugagacccgcggagugacggccgaaggcauccauaaaaaucugccaggcaaccuucccccggccgagguagcuacuacaaaugaggaacgauccuguucuaguccugcggugagcgcagucucccaacugcccuugucaccaaaggagaccguugaaagccacgauaaagccaucgcuaacgcccuaaagaagauugcagaguuuucuuucgaccugcucccugugaucagaagucauguguacgucgggaacauuuccaaaaagcccgugaugcgggaccaggaaaaagagguuguauaugaguuuagcaccacuaagaaacacuuagccgaaugccugcuucacucaauacugucugagcucaagauccagaagauuuccauggaucauaauuacauccacgcuuuguguaggguguaugucggaauuugccgccaacugggugaccucgaacgugcgagacuguucuguuacucgcuucuaaaagaggauuuuccagaaagcgagaagcugacauuguucaucgccaacauguggcaugacauauuuuuaagucagucugugaucaauaaagcaaugcagcugguugcucggcagagggccaagggcgaggugcucaacugccugcgcgcauuccuuaauugggagaaaaacgcccccgucgaugugggguuuaugguauccaagcugcucuugaccauucaacuguguccuaagacagaguuccagccaagcgaaaaauuuggagaggaccuaucagauaauacuugggaauauaucuucgcuauugaccugcucugcugucaccagaaguggaucuggacgcaugauaacauaauuaguaaagagcuuuggccggucauggacaaguggaucaaauaccgaaagggccacgccaauaucgcguauacccccgauauuauaaucgcauccauucugagauuaaucggucgguuggggcagcugggacucaaagagggcuucccuagcgccgugaagaacauuucuucaguuaucggcauguuuauacaacacgcucaugacgaagacaucccaugggggauucagcuggccgcuguguacgcacuuugcgaucugagccccuccaauccugccgagaucucuaagauucucgaggcuuggaggcgcgaggccaguaaaucggucccaagcgcaaucguguccugcuuggaggaaguuucagcgcugucuacagaggaauuaggauga

SEQ ID NO: 57511 - RNA, 1152 nt, Artificial Sequence
  derived and/or modified sequence opt3 from ICE2__Homo_sapiens__NP_001263314
augagcuccaagauggugaucucugagcccggccugaacugggacauuucaccuaaaaaugggcucaagaccuucuuuaguagagaaaacuacaaagaucacagcauggccccaucccuuaaggagcugagggucuugucuaaucggcgcauaggagaaaacuuaaaugcuucggcaucaagcguugagaacgaaccggccgugaguuccgcgacacaggcuaaagagaagguaaagacuacgaucgguauggugcugcuacccaaaccucgagucccauauccccguuucucuagauuuagccaaagggagcagcgguccuacguggaccuccugguuaaguaugccaaaauuccugcaaauucaaaggccgugggcaucaacaaaaaugauuaccuucaguaucuggacaugaagaagcaugucaacgaagaggugaccgaguucuugaaauuucuccagaauagugcuaagaaaugcgcacaagauuacaacaugcugagcgacgaugcccgccuguucacagaaaagauucucagagcuuguaucgagcagguuaaaaaguauucugaauuuuacacuuuacacgagguaaccucccugaugggguucuuuccauucaggguggaaaugggacuuaaauuggagaagacacugcuagcccucggcucagucaaguacgugaaaaccguguuucccagcaugccuauaaagcugcagcuuaguaaagacgauaucgcgacuauugaaacaucugagcagaccgcagaggccaugcauuaugacaucuccaaggauccaaaugcugaaaaacuggucagccgguaccacccgcaaauugccuugacgucgcagucucucuucacucuguuaaacaaucauggucccaccuauaaggagcagugggaaaucccuguuugcauacaggugauuccaguagcaggguccaagcccgugaaagucaucuacauuaacucaccucugccacaaaagaaaaugacaaugcgcgagcgaaaccagaucuuucacgaagugccccucaaguucaugaugaguaaaaauacuagcguuccgguguccgcugucuucauggacaagccugaggaguuuaucucugaaauggauguguguaacgccuucuuuuuccccuga

SEQ ID NO: 57512 - RNA, 1899 nt, Artificial Sequence
  derived and/or modified sequence opt3 from ICK__Homo_sapiens__NP_057597
augaacagauacaccacaaucaggcagcugggcgacgggacuuauggaagcgugcuccuuggucgguccauugagucuggcgaacugauagccaucaagaaaaugaagcgcaaauucuacucaugggaggaaugcaugaauuugcgagaggucaagagucugaaaaagcugaaccacgcuaauguugugaagcuaaaagaaguaauucgugagaacgaucaucucuauuuuaucuucgaguacaugaaggaaaaucuguaucaacuuauuaaagagagaaacaagcuguuucccgaaagcgcaaucaggaauauaauguaccagaucuugcaggggcucgccuucauucacaaacauggauuuuuccaccgggaccugaagccugagaaccugcucuguaugggcccagaguuagugaagaucgcggauuuuggucuggcucgcgaaauuagauccaaaccgcccuauacggacuacgucucuaccaggugguaccgggccccugaggugcuuuugcgcucgacaaauuauucaagcccaaucgauguuugggcaguggggugcauaauggccgaagucuacacucugcgaccccuauucccuggagcuagugagauugacaccaucuuuaagauuugucaggugcucggcacacccaaaaagaccgauuggcccgaaggcuaucaacuguccucugcaaugaacuucagauggccucagugcguaccaaauaaccuuaaaacucugaucccgaaugccagcuccgaggcuguucaguugcucagggacaugcugcagugggaucccaagaaacggccuacagccucacaagcguuacguuacccauauuuucagguggggcauccccugggaaguaccacgcagaaccuccaggacagcgagaagccucaaaaggguauccuugaaaaagcaggcccacccccguacauuaagccugucccaccagcccagccucccgcuaaaccacacacucgcauaucuuccagacagcaccaagccucacagcccccucugcauuugaccuauccauacaaggcagaggugagcaggacagaucacccgagucaucuacaggaagacaaacccucuccuuuacucuucccaucccugcacaauaagcacccccagagcaagaucacugcugggcuugagcauaaaaacggagaaauuaagccuaaaucgcggcgacgcuggggccugaucucuagauccaccaaggauucagacgacugggccgauuuggacgaucucgacuuuaguccaagccuguccaggauagaucugaaaaacaagaagcggcaaucugacgauacauuaugucgcuucgagagcgugcuagaccucaaacccucagagccggucgguaccgggaauagugcgccuacgcagacuuccuaccagagaagggauacaccaacccugcguagcgccgcaaagcagcacuaucuuaaacauucucgguacuugcccggaauuucaauccgaaacggcauccugaguaauccuggcaaggaguucauucccccaaacccuuggagcuccucugggcucucgggaaaaagcuccgguacuaugucaguuaucaguaaggugaauagcguaggcagcuccucaacaucuucuuccgggcugaccggaaacuaugugcccaguuuucuuaagaaagaaauuggcagcgcuaugcaaagaguccaccuggccccaauaccggacccuucucccgguuacuccucauugaaggcuaugaggccacaucccgggcgcccuuucuuucacacgcagccacggaguacccccggccucaucccuagaccgccagccgcacagcccgugcacggaaggacagauugggccagcaaauaugcuucgcgccgauga

SEQ ID NO: 57513 - RNA, 567 nt, Artificial Sequence
  derived and/or modified sequence opt3 from ICMT__Homo_sapiens__XP_011539442
augugcagccugucccucuuccauuacucugaguaucuugugaccgccgucaacaaucccaagucacugaguuuggacagcuuuuuacugaaccauucccuagaauacacaguugcugcacucucuucguggcuggaguucacucuugaaaauaucuuuuggccugagcugaaacagauuacgugguugucagugaccggccuccugaugguaguguucggggaaugucugagaaaggccgcgauguuuacagcuggaagcaacuucaaucacgucgugcaaaacgagaaaagugauacucauacccucguuacauccgguguguaugccugguuuaggcacccaucuuacgucggcugguucuauuggagcauagggacccaggugauguuaugcaauccgaucuguggaguauccuacgcacugacuguuuggcgguuuuuccgcgaccgaacagaggaagaggaaauuucacuuauccacuuuuucggcgaggaguauuuggaauacaagaaacgugugcccaccggucugccuuuuauuaagggggucaagguggaucuauga

SEQ ID NO: 57514 - RNA, 600 nt, Artificial Sequence
  derived and/or modified sequence opt3 from ICOS__Homo_sapiens__NP_036224
augaaaagcggccugugguacuucuuucucuucugccuuagaaucaaggugcugaccggggagauuaacggauccgccaauuaugaaauguuuauauuccacaacgguggcguccagaucuuguguaaguaccccgacauuguucaacaguuuaaaaugcaguuacugaaagggggacagauccuaugcgaucucacaaagacuaagggcucugguaauacggugucaauuaagagucugaaauucugucauagccaacuuuccaacaauucuguaucguuuuuccuguauaacuuggaccacucacaugcuaauuacuauuuuugcaaccucagcaucuucgauccuccaccguuuaaggugacccugacagggggauaccugcacauauaugagagucagcucuguugccaguuaaaauucuggcugcccaucggcugugcagccuuugucgugguuugcauucuuggcuguaucuugauuugcuggcugacuaagaaaaaguacuccucuagcgugcaugacccuaauggggaauacauguucaugagggcggucaacaccgcuaagaaaucccggcuaacagaugugacccucuga

SEQ ID NO: 57515 - RNA, 930 nt, Artificial Sequence
  derived and/or modified sequence opt3 from ICOSLG__Homo_sapiens__NP_001269979
augagacugggcagccccgggcuccuuuuccuguuguuuuccucuuuaagggccgacacccaggagaaggaagugcgggcuauggucggaucagauguugagcugaguugcgcauguccugaagguagccgcuucgaccuaaacgauguguacguauauuggcaaacauccgagucuaaaacuguggucacguaccacaucccacaaaauucgucacucgaaaacguggacagccgauaucguaauagagcccugaugaguccggcgggcaugcuuaggggugauuuuucccugcgguuguucaacguuacaccccaggacgagcagaaguuucauugccucgugcugucucagagccugggauuccaggagguccucuccguggaaguaaccuuacacguugcugccaauuuuucagugccugucgugagugcaccacauagccccucucaggaugagcugacuuucaccuguacauccauuaacggcuacccucgcccaaauguguauuggauaaacaaaaccgacaauucacuuuuggaucaggcccugcaaaacgacacugucuuucuaaauaugagaggucucuacgauguugugagcguacugaggaucgcucggacacccagugugaacauugggugcuguaucgaaaauguccuucugcagcagaacuugaccgugggaucucagacgggcaaugacauuggcgagcgcgauaagaucacugagaacccuguuuccaccggggagaaaaacgcagccacauggagcauacucgcugugcugugcuuacuggucgugguagccguugcgaucggaugggugugucgagacagaugccuccaacacucguaugcaggggccugggcugucucuccagaaacugaacuuaccgaguccuggaaucuguugcuacugcucucauga

SEQ ID NO: 57516 - RNA, 468 nt, Artificial Sequence
  derived and/or modified sequence opt3 from ID1__Homo_sapiens__NP_002156
augaagguggccagcggcuccaccgcuacagcagccgcggggcccucuugcgcucugaaagccggaaagacugcaucaggugccggcgaggucguuagaugucucagugaacagagcguggcuaucuccaggugcgcagggggagccggcgcucggcuuccugcccuguuggacgagcaacagguaaacguguuacuguacgauaugaaugguuguuauucucgccuaaaagaacucgucccaacgcugccgcagaaccgaaaggugucgaaaguugagauucuucagcacgugauagacuacauccgugaucugcaauuggaacucaauucagagagcgaggucgggacccccggaggcagaggccugccugugagggcgccacugaguacacucaacggggaaauuuccgcauuaacugccgaggcugccugcguacccgcagacgaucggauccugugucgcuga

SEQ ID NO: 57517 - RNA, 405 nt, Artificial Sequence
  derived and/or modified sequence opt3 from ID2__Homo_sapiens__NP_002157
augaaggccuucagccccgugagauccgucaggaaaaacucucugucagaccacagucucggcaucagccgguccaagaccccuguugaugacccaaugucucuucuguacaauaugaacgauugcuauucgaaauugaaggaguuagugccgucaauuccccagaauaaaaagguaagcaagauggaaauacugcaacaugugaucgacuacauucuagaucuccagaucgcucuggacagucacccuacaauugucucccuucaucaccagcgcccagggcagaaccaagcaucucgaacuccccugacgaccuugaauacagauaucagcauacucucccugcaggccucagaguuuccuagugaacugaugagcaacgacucuaaagcgcucuguggauga

SEQ ID NO: 57518 - RNA, 486 nt, Artificial Sequence
  derived and/or modified sequence opt3 from ID4__Homo_sapiens__NP_001537
augaaggccgugagccccgucagaccuuccggcaggaaagcuccaucugggugcggagguggcgagcuggcacuccggugucuugccgaacacgggcauucacugggaggcagugcggcugccgcagccgcugcagccgcugcccgcugcaaggcggcagaggccgcugccgacgaaccggcauuguguuuacagugcgauaugaacgacuguuacagccgacugcguaggcuaguucccaccaucccuccaaauaaaaagguguccaaaguagagauucuccaacacgugauagauuauauccuggaccuucagcuggcuuuggaaacacaucccgcccuccugagacagccuccacccccugcgccaccgcaccaucccgccgguacuugcccugcagcuccaccccggacgccucugaccgcccucaacacagauccagcuggggccgucaauaagcagggagacucuauuuuaugucgcuga

SEQ ID NO: 57519 - RNA, 1395 nt, Artificial Sequence
  derived and/or modified sequence opt3 from IDE__Homo_sapiens__NP_001159418
augagcaagcugugguucaaacaggacgauaaguuuuuccuccccaaagccugccuuaacuuugaguucuuuuccccuuucgcuuacguggacccacugcacuguaauauggcauauuuguacuuagaacugcuaaaggauucucucaacgaguaugccuacgcggcugaacuggccggccuuucauaugaccugcaaaauaccaucuacgggauguauuugagugucaaaggauacaacgauaagcagccgauucuccugaagaaaauaaucgagaagauggcaacauuugaaauugacgagaaaagauucgagaucauuaaggaagccuacaugaggagccugaauaacuuucgggcugagcagccccaucagcacgcaauguauuaccuccgcuuacugaugacugaaguugccuggacgaaagaugagcuuaaggaggcuuuggacgaugugacccugccucgacuaaaggccuucaucccacaacuccugucccgucuucauauagaagcgcuguugcacgguaauaucacaaaacaggcagcccucggcauuaugcagaugguagaggacacucugaucgaacaugcucacaccaagcccuuacugccuucucagcucgugagauauagggagguccaacuuccagaucgggggugguuuguguaccagcagcgcaacgaaguucacaauaacugcggaauugagaucuauuaccagacagacaugcaaucgaccucagagaauauguuccuggaauuguuuugucagauaauuagcgagcccugcuucaacacucuaagaacaaaagaacagcugggcuauaucguguucagugguccuaggcgggccaaugggauucaaggacuccgcuuuaucauccaguccgagaagccaccgcauuaccuggaaucucgagucgaggcauuccuuauuaccauggagaaaagcauagaagauaugacggaggaagcauuucagaagcacauccaggcccuggcgauuagaagguuggacaaacccaagaagcucuccgccgagugugcaaaauacuggggcgaaaucauaucacaacaguauaacuucgaccgggauaauacugagguggcuuaccugaagaccuuaacaaaagaggacauuaucaaguuuuauaaagaaaugcuggccguagaugcuccucgucgccauaagguuagugugcacguccuagccagagagauggacagcugcccaguggugggcgaguuccccugucagaacgauaucaaccucucucaggcuccugcccugccacaacccgaagucauucagaauaugacugaguuuaagagggggcuuccguuguucccucugguuaaaccccacaucaacuuuauggcugcgaagcucuga

SEQ ID NO: 57520 - RNA, 1245 nt, Artificial Sequence
  derived and/or modified sequence opt3 from IDH1__Homo_sapiens__NP_001269315
augagcaagaaaaucuccggcgggucuguggucgagaugcagggagacgaaaugaccagaauuauaugggagcugaucaaggaaaaacucauuuuccccuacguugagcuugaucugcacucauaugacuuggguaucgaaaacagggaugccacaaaugaccaagugacuaaggaugcugcagaggccauuaaaaagcauaacguaggcgugaagugcgcgacgaucaccccugacgagaaacgggucgaagaguuuaaguuaaaacagauguggaagaguccaaaugggacaauacgcaacauccugggaggcacuguguuccgagaagcuauuaucuguaaaaauauuccgcgucuaguuagcgguugggugaagcccaucauaauugggagacacgccuacggagaucaguauagggcaaccgacuuugucgugccuggcccaggcaagguagagaucacauacacccccuccgaugggacucagaaaguuacauaucucgugcauaacuucgaggaaggagguggcgucgccauggggauguacaaucaagacaagucuauugaggauuuugcucacucgucauuccagauggcacugagcaaaggauggccucuuuaucugaguaccaagaacacgaucuugaaaaaguacgacggccgguuuaaagauaucuuccaggaaauuuacgacaagcaguauaagucccaauuugaggcccagaaaauaugguacgaacaucgccucaucgacgauaugguggcucaggccaugaagucugaggguggguucauuugggcgugcaaaaauuaugacggagaugugcagagcgacuccgucgcacaaggcuacggcucacuggggaugaugaccaguguucugguguguccagauggaaagacuguagaggccgaagcugcccacgguacagugacuagacacuauaggauguaccagaaaggccaggagaccagcacaaaccccaucgcaucuauauuugcuuggacccgggggcucgcccaucgcgcgaaguuagacaauaacaaggaacuggccuucuuugcaaaugcucuugaggaagucuccauugagacgaucgaggccggauucaugacuaaagauuuggcugccugcaucaagggccugccuaacgugcaacgaucagacuaucuaaauacauucgaauuuauggauaaacucggugagaaccugaagauuaaacuugcacaggccaagcuguga

SEQ ID NO: 57521 - RNA, 1203 nt, Artificial Sequence
  derived and/or modified sequence opt3 from IDH2__Homo_sapiens__NP_001276839
auggacggcgaugagaugaccagaaucauuuggcaguucauaaaggaaaaacugauccucccccacguggacauucaacuuaaguacuuugaucugggguugccuaacagggaccagacagaugaccaggucacuaucgauagcgccuuagcuacgcagaaauauuccguugcagugaagugcgccaccauuacaccagacgaggcgcggguagaagaguucaaacugaagaagauguggaaaucuccgaauggaacuauccgcaacauacuagguggcaccguguuucgagaacccaucauuuguaagaauaucccucgucucgucccaggguggacaaaacccauuaccaucggaagacaugcucacggcgaucaauacaaggccacugacuucguggcagauagggccgguacauuuaaaaugguuuucaccccuaaggacgggucaggagugaaggagugggaggucuauaacuuuccagcuggcggcguggggaugggaauguacaauacggaugaaaguauaagcgguuucgcacauuccugcuuucaguaugccauucagaaaaaguggccccuguacaugucuacuaaaaacaccauccuuaaggcuuaugacggccgguucaaagacauuuuucaggagaucuucgauaagcacuacaaaacagacuuugauaagaauaagaucugguacgaacaucgccugauugacgauaugguagcccaaguuuugaaaucgucagggggauucgugugggcguguaagaacuaugacggcgauguccagagcgacauacucgcacaggguuucgggagucugggacugaugacuuccgugcucgugugcccugauggcaaaaccaucgaggccgaggcugcccacggcacagucaccagacacuacagggaacaucagaaggggcggccaacgucuacuaauccgauugcaagcaucuuugcuuggacacgcggauuagagcaccgagguaaacuggacggcaaccaagaucuuauaagauucgcccagauguuggaaaagguuuguguggagaccguagaauccggggcgaugacuaaggaccuggccggaugcauucauggccuaucaaaugugaaacucaacgagcacuuucugaauacaaccgacuuccuugauacgaucaagaguaaccuggacagggcauugggucggcaguga

SEQ ID NO: 57522 - RNA, 1131 nt, Artificial Sequence
  derived and/or modified sequence opt3 from IDH3B__Homo_sapiens__NP_001245313
auggccgcucugagcggcgugagauggcucaccagggcacuugucuccgccgggaaccccggagcguggcggggucugucuacaucagcugccgcacacgccgcuagucgcagccaggcagaggacguucgaguggaaggcuccuucccuguaacuauguugccaggggauggagugggcccggaguuaaugcaugccgucaaggaaguguuuaaagcugccgcgguucccguggaguuccaagaacaccaucugucugagguccagaauauggcaucggaggaaaagcuagaacaggugcucucaagcaugaaagagaacaagguagccaucauugguaaaauacacacgccuauggaguacaagggggagcuggcuaguuaugacaugcgucuuagaaggaagcuggauuuguuugccaauguugugcaugucaaaucccucccaggauacaugacccggcacaacaaucuggaccuggugaucauucgcgaacagacagagggcgaauauucuagccucgagcacgaauccgcaagaggcgugaucgagugcuuaaagauugucacuagggcuaaaucacaacggaucgccaaguucgcguuugauuacgccaccaaaaaggggcgcggaaagguuacagcagugcauaaagcuaacauaaugaagcugggugacggccuuuucuugcaguguugcgaggaaguagccgagcuguaucccaaaaucaaguuugaaaccaugauuaucgauaauuguugcaugcagcuagugcagaacccuuaccaauucgacguccucgugaugccaaaucuguaugggaacauuaucgauaaucuugcugccggacugguuggcggugcaggggugguccccggagagaguuacagcgccgaauacgcuguguuugagacuggcgcgcgacacccuuucgcacaggccguaggcagaaacauagcuaauccaacagccauguugcucucugcauccaacaugcugaggcauuuaaaucuggaguaucacucaagcaugauugccgacgcuguuaaaaaggugaucaaagucgggaagauuccgagugccgugcccucuuuucuccuucacccucugccauucuccugggcaaucuga

SEQ ID NO: 57523 - RNA, 564 nt, Artificial Sequence
  derived and/or modified sequence opt3 from IDNK__Homo_sapiens__NP_001001551
auggccgcucccggcgcacugcucgugaugggggucagcggauccgguaagucuaccguuggcgcccuucuggcgucagaguugggguggaaauucuacgacgcugaugacuaucacccugaagagaacagaaggaagaugggaaaaggcaucccauuaaaugaucaggaccggauuccguggcugugcaaccuacaugauauacuccugcgcgacguggccaguggucaacgaguagugcuugcauguagcgcccugaagaaaacauaccgugauaucuugacucaggggaaggacggagucgcucucaagugcgaagaguccggcaaagaagcaaagcaggccgagaugcagcugcuggugguucaccucucuggcucguuugaggugauuucagggagauuacugaaaagggaaggacauuucaugcccccugagcuuuugcaaagccaguuugaaacgcuggagccacccgcugccccugagaauuucauccagauuagugucgauaagaacguguccgaaaucauagcgaccaucauggagacacuaaaaaugaaguga

SEQ ID NO: 57524 - RNA, 1212 nt, Artificial Sequence
  derived and/or modified sequence opt3 from IDO1__Homo_sapiens__NP_002155
auggcccacgcuauggagaacagcuggaccaucuccaaggaauaccauauugacgaggaagugggcuucgcacugcccaauccucaggagaaccucccagauuuuuauaaugacuggauguucauagccaaacaccuuccggaucugaucgaaucugggcaauugagagagagggucgagaaguuaaacaugcugucaauugaccaucuaacagaucacaaaagucagcggcucgcgcgccugguucuuggaugcaucacuauggcuuacgugugggguaagggccauggggacguacgaaaagugcugccccguaauauugccgucccuuauugucaguugagcaagaagcucgaacugccacccauccugguguacgcagauugcguucucgccaacuggaaaaagaaagacccuaauaagccauuaacguaugagaacauggaugugcuguuuuccuucagagacggagauuguucuaaaggcuuuuuccuugucucguugcugguggaaauagcugcagccucagcuaucaagguaauucccaccguuuuuaaggccaugcagaugcaagagagggacacacuacucaaagcgcugcuugagaucgcaagcugccuggaaaaggccuugcaaguguuccaccagauucacgaucaugucaauccuaaagccuuuuucagugugcuccggaucuaccuguccgguuggaaggggaacccacaguuaucugacggacugguguaugagggcuuuugggaagacccgaaagaguucgcuggcgggagcgcaggacaguccucagucuuucaguguuucgauguucuccuugguauacagcagacugcuggcgggggacacgccgcgcaauuccugcaggacaugcgcagauacaugcccccugcccauaggaauuuucugugcagucuagaaagcaacccaucugugcgggaguucguacuguccaagggcgaugcaggucuccgcgaggcuuacgacgccugugugaaagcucuggucucacuucgaagcuaucacuugcagauugugaccaaguacaucuugauucccgccagucaacagccuaaggaaaauaaaacaucugaggauccauccaagcucgaagcaaaagggaccggaggcacugaccugaugaacuuuuuaaagacaguuagaagcaccacggagaaaucgcugcuaaaggaaggcuga

SEQ ID NO: 57525 - RNA, 1263 nt, Artificial Sequence
  derived and/or modified sequence opt3 from IDO2__Homo_sapiens__NP_919270
augcugcacuuccauuacuaugacaccagcaacaagaucauggagccccacagaccuaaugugaaaacagccgucccacucucccuugaaucuuaccauauuucagaggaauauggcuuucuguugccggauaguuuaaaggagcugcccgaccacuacaggccuuggauggaaauagcuaacaaacuaccacagcucaucgaugcacaucaacugcaggcccacguugacaagaugccccuucugagcugccaguucuugaaagggcaccgggagcagcgccucgcgcaucuggugcuguccuuucucacuaugggauauguauggcaagagggugaagcucagccugccgagguguuaccacgaaaucuggcacuucccuucgucgaagugucucguaacuugggccugccuccaauucuaguucacucggaucucgugcugacgaauuggaccaagaaggacccggauggguuucuugagaucggaaaccuggagacaauuaucucauuccccggcggugaaagccugcauggguuuauacucgucacugcccugguggagaaagaagcuguaccuggaaucaaggcauuaguucaggccaccaaugcuauucugcagccaaaccaagaggcccuccuucaggcgcugcagagauugaggcuaaguauccaggacauuacaaaaacccugggccaaaugcacgauuacguggaccccgauaucuucuaugcaggcauacggauuuuucucuccggguggaaggacaauccugccaugccagcuggacugauguacgaaggugucucucaggagccccuuaaauacagcggcggguccgccgcacagucaacugugcugcacgcuuucgaugaguuuuugggaauccgccauaguaaggaaagcggcgacuuccucuauagaaugagggacuacaugccgccuucucacaaggccuuuauugaggauauccauuccgcgcccucacugcgggacuauaucuuaagcaguggucaagaucacuugcuaacagccuacaaccagugugugcaggcacucgcugaacugcgcucuuaucauauuaccauggucacgaaauaccuuauaacugccgcugccaaggcaaaacacgggaagccaaaucacuugccuggacccccacaggcccugaaagaccgaggcaccggcgggacagcuguuauguccuuccucaagagcgugagagauaaaacucuggagucgauccuucaucccaggggauga

SEQ ID NO: 57526 - RNA, 1653 nt, Artificial Sequence
  derived and/or modified sequence opt3 from IDS__Homo_sapiens__NP_000193
augcccccuccaagaaccggcagggggcugcucuggcuuggacugguguugagcuccgucugcguugccuuagguucugagacacaggcuaacucaacuacggacgcacugaaugugcuacucaucauuguagaugaccugcggccgagucuuggcuguuacggggauaagcuggugcgcagccccaacauagaccaauuggccucccacucucuccuguuccagaaugcguuugcucagcaggccgucugcgcaccuucgcgagugucauuccugaccggacguagaccagauacaacuaggcucuaugacuuuaacagcuacuggcggguucaugccggcaauuucaguaccaucccccaauauuuuaaagaaaacgguuacgugacaauguccgucgggaagguguuccacccuggaauuucuagcaaucauaccgaugacuccccauauucauggaguuuucccccuuaccacccaagcucugagaaauaugaaaacacuaagacaugucgcggcccggauggcgaguuacaugcuaaucugcuuugccccguagacguuuuggaugugccugaagggacccugccagacaaacaguccacggagcaggcaauccagcuacucgagaagaugaagacuucagccagccccuucuuucuggcugucggauaccacaaaccucacauuccauucagauaccccaaggaauuucaaaaacuuuauccgcuggagaacaucaccuuggccccugaucccgaagugccagacggucucccucccguggcguacaauccauggauggacauaaggcagcgggaggauguccaggcacugaacaucaguguucccuauggcccuauuccaguggacuuccagcgcaagauccgacaaucuuacuuugccuccguaagcuauuuagauacacagguggggagacugcucucggcucuugacgaucugcaguuggccaauucuacuauuaucgcauucaccuccgaccauggaugggcucuaggcgagcacggugaaugggccaaauacucaaacuucgaugucgcgacacaugugccgcugauauuuuauguucccgggaggaccgccagucucccugaggcaggagaaaagcuguucccauaccuugaccccuuugauagcgcuucccaacugauggagccuggccggcagucuauggacuugguggaacucgucagccuguucccaacguuagccggccuggcugggcuacaggugcccccgcguuguccuguaccaucauuucacguugagcucugccgcgagggaaagaaucugcuuaaacacuucagauuuagggauuuggaagaggaccccuaccugccugguaacccccgggaacucauugccuauagucaguacccacgaccuuccgacaucccccaauggaacagcgauaagccaucucugaaagacauuaagaucaugggcuauucaauccgcacuauugauuacagauauacagugugggucggguucaauccggacgaguuucuugcaaacuucagugauauacaugccggagaacuguacuuuguggacagcgauccuuugcaggaccacaauauguauaacgauucccagggcggugaccucuuccagcuguuaaugcccuga

SEQ ID NO: 57527 - RNA, 1962 nt, Artificial Sequence
  derived and/or modified sequence opt3 from IDUA__Homo_sapiens__NP_000194
augagaccccugaggccucgggccgcucuccuugcacuguuggccagcuuacuggcggcuccaccgguggcccccgcagaggccccucaccuaguccauguugacgcugcacgcgcccucuggccacugcgacguuucuggagauccaccggcuuuugucccccucuuccacacucucaggcugaucaauacgugcugucaugggaccagcaguugaaccucgccuauguaggggcggugccccauaggggaaucaagcagguccggacacacuggcugcuggaacucgugacuacgcgcgguaguaccggcagaggguuaagcuacaauuucacacaucuggauggauaucuugacuugcugagggagaaccaacuacucccuggcuuugaacugauggguuccgcaucugggcacuucacugauuuugaggacaaacagcagguuuucgaauggaaggaucuugugucgucacuggcccggcgcuacauuggacgauauggcuuggcucacgucagcaaauggaauuuugagaccuggaacgagccagaccaucacgauuucgacaaugugaguaugacaaugcagggcuuucucaacuacuaugaugccugcuccgaagggcugagagcagcuucuccggccuuaaggcugggaggucccggcgacagcuuccauaccccuccacggucaccccucuccugggggcuucugcgucacugccacgauggaacuaacuuuuucacaggcgaggcggguguacgcuuggacuacauaagucuacauagaaagggggccaggagcucuaucuccauucuggaacaagagaaaguuguggcacagcagauccggcagcucuuuccuaaguucgcugacaccccaauuuacaaugaugaggccgacccccuggucggauggucacuuccgcaaccuuggcgagcugaugugacguaugccgcaaugguggucaagguuaucgcccagcaccagaaucuguugcucgcuaacacuaccagcgcguuccccuacgcacuguuaaguaaugacaacgccuuucugucuuaucauccacacccuuucgcucaacgcacacuaacugccagauuucaggugaauaacaccaggcccccacauguacagcuccugcggaaacccgugcuuacagcaaugggcuugcuggcccuccuggaugaggaacagcuuugggcugaagucucccaagccggcaccgugcuggacagcaaucacacgguugggguguuggcaucggcgcaccgcccucagggaccagcugaugccuggagagcagccguccucauauacgcuucugacgauacuagggcccauccgaaccguuccguggcaguaacacugcgguuacgagguguucccccuggcccagggcugguguaugucaccagauaccuagacaacggacucuguucacccgauggcgaguggaggcgccugggucggccuguguucccaacugcugaacaguuuagaaggaugcgcgccgcggaggaccccgucgccgcugcaccgcgaccucuuccagccgggggccgguugacacugcgucccgcucucagacugccuaguuuacugcuugugcacguuugcgccaggcccgagaagccaccuggacaggugacccgcuugcgggcacucccccugacgcaaggccagcuaguacuggucuggagcgacgaacaugugggguccaaaugucucuggaccuaugagauccaguucucucaggauggaaaggcguacacaccaguuagcagaaaaccgucaacuuuuaaucuguucguguuuaguccugacaccggugccgucuccggcagcuacagggugcgagcucuugauuauugggcccgccccgggccauucucugaccccguaccuuacuuggaagugccaguuccccggggaccuccgucaccaggcaaccccuga

SEQ ID NO: 57528 - RNA, 672 nt, Artificial Sequence
  derived and/or modified sequence opt3 from IER2__Homo_sapiens__NP_004898
auggaggugcagaaggaagcccaaagaaucaugacccugagcgucuggaaaauguaccacuccaggaugcagcggggcgggcuccgccuucaucgaucucugcaguugucauuaguuaugcguagugcuagagagcuguaucuaagcgcaaagguggaagcccucgagcccgaaguaucccugccugcggcccuuccaucugacccgaggcugcaucccccucgggaggcugagucgacagcagaaacugccacgccagauggagagcaccccuucccugaaccaauggacacccaggaggcucccacagcagaggaaacuucagccugcugugcuccucgcccagccaaagugagcagaaagaggcggaguuccucuuugagcgaugguggcgacgcggggcucgucccguccaaaaaggcacgccuggaggaaaaggaggaagaggagggagccucaagugaaguggcugaucgacugcaacccccuccagcccaggcagagggcgcuuuucccaaccucgccagaguuuuacagaggcgguucagcggucugcuuaauugcucuccugcggccccacccaccgcaccgccugcuugugaagccaaacccgcuugccguccagccgacuccauguugaacgugcugguccgcgcagugguagccuuuuga

SEQ ID NO: 57529 - RNA, 471 nt, Artificial Sequence
  derived and/or modified sequence opt3 from IER3__Homo_sapiens__NP_003888
augugccacagcagauccugucaucccaccaugacaauccugcaggccccuacuccagcuccgucuacgauucccggcccuaggcgggggucaggaccagagauauucaccuuugacccccucccugaaccagcagccgcgcccgcuggucgcccuagugccagccgaggccaccguaagagauccaggcgggugcuuuacccacgcgucguuagaaggcaacugccgguggaggaacccaacccugcaaaacgguuguuauuccugcuacucacaaucguauuuugccagauucugauggccgaggaaggggugccagcuccccuuccuccagaggaugcacccaaugccgcuucucuggccccgacuccugucucggcgguguuggagcccuucaaccucaccucagaaccaagcgacuaugcacuggaucugaguacauuucuccagcagcauccugccgcuuucuga

SEQ ID NO: 57530 - RNA, 249 nt, Artificial Sequence
  derived and/or modified sequence opt3 from IER3IP1__Homo_sapiens__NP_057181
auggccuucacccuguacagccuccuucaggcugcacuguugugcgugaacgccaucgcggucuuacacgaggaaagauuucugaagaauauuggcugggggacagaccaaggaauagguggcuucggggaggaacccggaaucaaaucccagcuaaugaaccucauuaggucuguucggacugugaugcgcguaccucugaucauugucaauucaaucgcuauagugcuucuguugcucuuuggcuga

SEQ ID NO: 57531 - RNA, 984 nt, Artificial Sequence
  derived and/or modified sequence opt3 from IER5__Homo_sapiens__NP_057629
auggaguucaagcuggaagcccacagaaucgugagcauuucccucggcaaaauauacaacucuaggguccagcgcgggggaaucaaacuucauaagaaucuguugguuucauuagugcugcggagugcucgacaaguauaucuaagcgaccccugcccuggucucuaccuggcaggcccagccgggaccccggcgcccccuccacagcagcagcccggagagccugcugccggcccacccgcagguuggggagaaccuccaccgcccgccgcucgugcauccuggccugagacagaaccacaacccgagagaucuucggugucagaugccccuagggucggggacgaggugccaguugcuacugugacgggcgucggcgauguguuucaagggggagaagccgacgcgaccgaggcagccuggagccggguagaagguccccgccaggcugccgcaagagaggcugagggcacagccgggggauggggcguuuucccggaagugaguagggcggcccggcgcccuugugguugcccccuugggggagaggauccaccuggcacucccgcagcuaccccacgagccgcuuguugcugugcaccccagccugccgaagacgagccaccggcucccccugccgucugcccaagaaagaggugugcggcaggcgucgggggaggucccgccggcugcccugcuccaggguccacaccccugaaaaagccgcggcguaacuuggaacagccuccaucuggaggcgaggaugacgaugccgaggaaauggagaccgguaauguggcaaaccucauuagcaucuuuggguccucauucaguggccugcugcgcaagagccccggaggcgggagagaagaggaagagggagaggaaucugguccugaggccgcugaacccggccagauuuguugcgacaaaccagugcucagggauaugaauccuugguccacugccaucguugcauuuuga

SEQ ID NO: 57532 - RNA, 1692 nt, Artificial Sequence
  derived and/or modified sequence opt3 from IFFO1__Homo_sapiens__NP_001034759
augaacccccuguucggcccuaaucucuuucuucugcagcaagagcagcagggguuggccggaccauuaggugacagccugggcggggaucacuucgcuggaggcggugaccuaccgcccgcaccucucuccccagccgggcccgcggcuuacucuccuccaggacccggcccugccccaccggcagccauggcucugagaaacgaucuuggcucaaauaucaacgugcugaagaccuugaaucucagguuucggugcuuccuggcaaaaguccaugaacuggagcgccgaaaccgucucuuagaaaagcagcugcaacaggcccuugaggaagggaaacagggaagaagggguuugggccggcgcgaccaggcuguucaaacaggguuugugagucccauuagaccucugggacuacagcucggcgccaggccagcggcaguauguagccccuccgcccgggugcuggguucuccugcucgcucgccagccgggccccuugcaccgucagcugccagccugaguuccucuagcacuuccacgucaaccacauauaguagcucugcgcgauucaugccuggaacuauaugguccuuuucacacgccagaagguugggccccggccucgagccaacccugguccaggggccuggauuaagcugggugcaucccgaugguguuggcgugcagaucgacacaauuaccccagagauccgggcacuguacaauguccucgcuaaggugaaacgugaacgcgaugaguauaagagaaggugggaagaggaguacacuguacggauucaacuucaggaccgaguuaacgaacugcaggaggaagcccaagaggcugaugccugccaggaagaguuggcacuaaagguggagcagcugaaagccgaacucgucguguucaaggggcugaugaguaauaaccuuucugagcuggacacaaaaauccaggaaaaggcuaugaaaguggauauggacauaugucgcagaaucgauauuaccgcgaaguugugcgacgucgcacaacagaggaauugugaggacaugauccagauguuucagaagaaacucguucccuccaugggaggccggaagcgcgaaagaaaagccgcuguggaggaggauacgagccugucggaaucugaggguccuaggcaaccagacggggaugaagaggaauccacugccuuaucaauuaacgaggagaugcagcguaugcugaaucagcuacgggaauaugacuucgaggaugacugcgauagucucaccugggaagagacagaggaaacucugcuuuugugggaggacuuuagcggcuacgcaauggccgcugccgaagcacagggagagcaacaggaagauucccuggagaagguaaucaaagacaccgagucucucuucaagacacgagaaaaagaguaucaggaaaccauagaucagauugagcuggaacuugcgacggcuaagaacgacaugaauagacaucugcacgaguacauggagauguguagcaugaagaggggcuuggacgugcaaauggaaacuugccgccggcucaucacacagucaggggauagaaaaaguccggccuuuaccgcagucccccuguccgacccuccacccccuccaagcgaggccgaagauucugacagggaugugucaagugacagcuccaugcgcuga

SEQ ID NO: 57533 - RNA, 1413 nt, Artificial Sequence
  derived and/or modified sequence opt3 from IFFO2__Homo_sapiens__XP_011538932
auggugaacagccuccuguucggcgagauggcccuugcuuuugggugucccccuggagguggcgggggaggcugcccaggugggggaggcggcgggggaggugcaggcccggggcccuccccugucaccgccgcgcugagagacgauuugggaucuaauauccacuuacugaagggccuaaacguuagguuccggugcuuucucgcuaaagugcaugaacuggagcgccgaaaucgucuucuggaaaagcaguuggagcaacagcagucagaaagagagaggcggcuccgcuacaaaacauucaguagagagcaggccguacaaacugguccagaacugcugaggcccccugcaccagggggaggccacggccucagcuccggggccgcugcaggagccaacgcuaaugccguggcguuagguggccugcccccugggggaggcucucauccacagcacuauggucggcuuccggggacgauuuggucguacacccagguccgccgaacaggcggaggcgggguggagacuguucagggacccggugugucauggguccauccugacggcguggggguacaaauagauaccaucacaccagaaauuagagcauuguauaacguucuggccaaggugaaaagggagcgggacgaguacaagcgucgcugggaagaggaacuagcuaagagaaugaaucuccagaccauggucgauacucugcaggaggccgcacaggaagcugacgccauccaagaggagaugaacgagaaaauugaaaggcuuaaggcggaacuggugguguuuaaaggauugaugagcgaugucguucccaagaaaaaggagcggaagguggccagugacgaugacaucuccgaacaggauggcgagguaaaucgauucucugacgaugagguggguagcaugaacauaacagacgaaaugaaacgcauguuuaaucagcucagagagaccuucgacuuugaugacgauugugacucccugacgugggaagagaacgaagauacuuuacugcucugggaggacuucaccaauugcaacccuacaaucgaucuucaaggggagcaggaagagaaucugggcaacuugauucacgaaacugagucauuuuucaagaccagggacaaagaguaucaggaaacaaucggacagauugagcuagaacuggcaaccgcuaagagugauaugaaccggcaccuccaugaguacauggaaauguguagcaugaaacgcggccuggacguccaaauggagacgugcagaaggcuuaucaaggggucugccgaucguaauuccccaucacccagcaguguggcuucuuccgacagcggaucgacugacgagauacaggaugaauuugagcgggaagccgacguugagccgauggugucuuga

SEQ ID NO: 57534 - RNA, 2190 nt, Artificial Sequence
  derived and/or modified sequence opt3 from IFI16__Homo_sapiens__NP_001193496
augggcaagaaauacaagaacaucgugcugcucaaagggcuugaggucauuaaugauuaucacuucagaaugguuaagagccuguuguccaacgauuuaaaacugaaucuaaagaugagggaagaguacgacaagauacagaucgccgaucucauggaagagaaauuucggggagacgcuggucugggcaaacuuauuaaaaucuucgaagauauucccacccuggaggacuuggcagagacacucaagaaagaaaagcugaaggugaaagggccugcccugucucgcaagcgaaagaaggagguagaugcgacuucaccagcuccgaguacgagcuccaccgugaaaacagaaggagccgaggcaacucccggcgcccaaaacccuaagaccgucgcuaaaugccaggugacaccacguagaaauguucuccagaagaggcccgugaucgucaagguguuaucuaccacuaaaccuuuugaguaugaaacaccagagauggaaaagaaaauaauguuccaugcaaccguagccacgcagacucaauuuuuccacguuaaggugcugaacaccucgcuuaaagagaaguuuaaugguaagaaaaucauuaucauuucagacuacuuggaauaugauagccugcuagaggucaacgaggaaaguacaguguccgaggcugggcccaaucagacuuucgaagugccuaacaagaucauaaaucgggccaaagagacccucaagauugacauccugcauaaacaggcgucuggaaacauugucuacggcguuuuuaugcuucacaagaagacagugaaucagaaaaccacgaucuaugaaauccaagaugaccgcggcaagauggauguaguggggacuggacagugucauaacauuccaugcgaggagggugacaaacugcaguuguucuguuuuagacucaggaagaaaaaucagaugagcaagcugauauccgaaaugcacucauucauccaaauuaagaaaaagacaaacccgcggaacaaugaccccaaaaguaugaaguuaccucaggagcagcgccaacugccauaccccagcgaagcaucuaccacuuuuccugagucccaccuccgaacaccacagaugcccccgaccacgccuucaagcaguuucuucaccaaaaagucugaagauacaaucuccaaaaugaacgacuuuaugagaaugcagauacuuaaggagggcagccauuuccccgggccauuuaugacuucgauuggaccugccgagucucacccccauaccccacagaugcccccuuccacaccaucaaguagcuuccugacuaccaaguccgaagauacaaucucuaaaaugaaugacuuuaugaggaugcaaaucuugaaggagggcagccacuucccgggucccuuuaugaccucaauugggccugcugaaagucacccacauacuccccagaugccuccauccacgcccucuagcucauuccuaacaacccugaaaccgcggcucaagacugagccugaggaagucaguaucgaggauagcgcccaguccgaccugaaagaagugaugguucuuaacgcaaccgagucuuuuguguacgaaccaaaggagcagaagaaaauguuccacgcuacagucgccaccgagaaugaaguguuucguguaaagguuuucaacauugaucugaaagagaaguuuacucccaaaaagauaaucgcgauugccaauuaugugugccgcaacggauucuuggaagucuacccuuucacacucguggcagacgucaaugcugauagaaacauggagauccccaagggccugaucaggucggccagcgugacgccaaaaauuaaucaauuauguucccagaccaagggcucauuuguuaacgggguguucgaaguacauaaaaagaauguccggggagaguuuacuuauuacgagauacaggacaacacagguaaaauggaagugguugugcacggccgacugaccacaaucaauugcgaggaaggggauaagcuaaagcucacuuguuucgagcuggcuccuaaaaguggaaacaccggcgaacuucgcucugucauucauagccacaucaaggugauuaaaacgagaaagaacaaaaaggacaucuugaaucccgacuccucaauggagaccagcccagacuuuuucuuuuga

SEQ ID NO: 57535 - RNA, 369 nt, Artificial Sequence
  derived and/or modified sequence opt3 from IFI27__Homo_sapiens__NP_001275885
auggaggccagcgcucugaccuccucugcagugacaucagucgccaagguugugagaguagcgaguggcagcgcugugguccucccccuugccaggaucgcaacugugguuauugggggaguggucgccauggcugcagugccuaugguacuguccgccauggguuucacggcugccggcauagcgucuucgucaaucgcagccaaaaugaugagcgcugccgcaauugcuaacgggggaggcguugccagugguuccuugguggcgaccuuacagucucugggggccacaggacuaagcggccucacuaaguuuauccugggcuccauugggucagcaaucgcugccgucauagcucgguucuacuga

SEQ ID NO: 57536 - RNA, 753 nt, Artificial Sequence
  derived and/or modified sequence opt3 from IFI30__Homo_sapiens__NP_006323
augacccugagcccccuccuucuguucuugccuccauuacugcuacuccuggacgugccgacagccgcuguccaggcaucccccuugcaagcccuggacuuuuucggcaacgggccuccaguuaauuacaagacuggaaacuuguaucucagagguccccugaaaaagucuaaugcgccucuggugaacguaacgcucuacuaugaggcuuuaugcggcggguguagggccuuucugauccgggaacuuuucccaaccugguugcuggugauggagauucuaaaugucacacucgugcccuacggaaacgcacaggaacagaauguuucaggccgcugggaguuuaaaugccagcacggugaagaggaguguaaguucaacaaaguggaagccugcguccuggaugagcuugauauggaacuggcuuuucuuacuauaguguguauggaggaguucgaagacauggagcgaagucucccucugugcuuacaacuguaugcaccagggcucagcccggauaccaucauggaaugugccaugggagaccguggcaugcagcuuaugcaugcuaaugcccagagaacagaugcgcugcagcccccucacgaguacguaccauggguuaccgugaacggcaagcccuuggaagaccaaacucagcuacugacacucgucugccagcuguaucaggggaagaaaccugauguguguccauccucuaccucgucacuuaggagcgugugcuuuaaguga

SEQ ID NO: 57537 - RNA, 867 nt, Artificial Sequence
  derived and/or modified sequence opt3 from IFI35__Homo_sapiens__NP_005524
augagcgcuccccuggacgccgcacuccacgcccuucaggaggaacaagcgagacugaagaugagguugugggauuuacagcagcugcggaaagagcuaggcgacuccccuaaggauaaagugccauucucugucccgaagaucccccucguuuuucgcgggcauacccagcaagacccugaagugccaaaaucacugguaaguaaccuucggauucacugcccccuguuggcuggaagcgcccucauaacauucgaugacccuaagguggcagagcagguccugcagcagaaggaacauacuaucaauauggaggagugucgucugagagugcaaguucagccacucgaauuacccauggugacgaccauucaggucaugauguccucucagcugucggguaggcgggugcuuguaacaggcuuuccugccucauugcgccugagcgaggaggaacuacucgauaaacuggagaucuucuuugggaagacuagaaacggaggcggugacguugaugugagggaacuucugccagggagugucauguugggauucgcucgggacggcguggcacaacgccucugccagauuggccaguuuaccgugccguuagggggacaacaggucccccugcgaguuuccccuuacgugaauggugagauccagaaagccgaaauaagaucucagccaguacccaggagcgugcugguccucaacaucccugauauucuugacggcccagagcugcacgauguguuggaaauccauuuccaaaagcccacacgagggggaggcgagguugaggcucuaaccguggucccgcagggucagcaggggcuggccguguuuacuuccgaaucaggauga

SEQ ID NO: 57538 - RNA, 1374 nt, Artificial Sequence
  derived and/or modified sequence opt3 from IFI44__Homo_sapiens__XP_011538818
auggccgugaccacaagacugacuuggcuccacgagaagauccuucagaaccauuucggcgggaaaaggcugagcuuguuauacaagggauccguccacgguuuucggaauggcguucugcuagaccgcugcuguaaccaagggcccacgcucaccgugauuuauucugaagaucauauaaucggagcuuacgcagaggaaucauaucaggagggcaaauacgccaguauuauccuguucgcgcuucaggacacaaagauuagcgaauggaaacuggguuugugcacuccugagacccucuuuuguugcgauguaacaaaguauaauuccccaaccaacuuccagaucgacgggcgaaaucguaaggugauaauggaucugaaaacuauggagaaccugggacucgcucaaaauuguacaaucucuauucaggacuacgaagucuuuagaugcgaggauucguuagacgaaaggaagaucaaaggcgugauugagcugcggaagucacuuuugagcgcccugcgcaccuaugagccguacggcagucuaguucagcagaucagaauacuccugcuugggcccauuggagcagguaaauccucuuucuuuaacagcgugagguccgucuuccaaggccacgugacgcaucaggcccugguagggacuaauaccacaggaaucucagaaaaguaccggacuuauaguauucgcgauggcaaggacgguaaauacuugccuuuuauccucugugauagccugggguuaucugagaaggaaggaggccugugccgagacgauaucuucuauauucucaacggcaauauaagagacagguaccaguuuaacccaauggaguccaucaaacuuaaucaccacgacuauauugauucacccagccugaaggaccggauccauuguguugcuuucguguuugaugcaaguucuauacaguacuucuccagccaaaugauugucaaaaucaagcguauccgcagagaauuggugaacgccggggugguccacguugcucuacugacccauguggacucgauggaucucauuacaaaaggagaccugaucgagauugagaggugcgaaccuguacggucuaaacuugaggaagugcagcgaaagcuggguuucgccuuguccgauauaucagucgugaguaauuauagcuccgagugggaacucgacccaguuaaggaugugcugaucuuaucugcgcugcgcagaaugcuaugggcagccgacgauuuucucgaggaccugcccuucgagcagauugggaggugguuuggcggagucgaggcuuggaagcggagcggcaaccuucgcgaagaaaucaucaacugugcccaagguaaaaaguga

SEQ ID NO: 57539 - RNA, 3078 nt, Artificial Sequence
  derived and/or modified sequence opt3 from IFIH1__Homo_sapiens__NP_071451
augagcaacggcuacuccaccgacgagaauuucagauaucugaucucuugcuuuagggcccgggugaagauguacauucaggucgaacccguucucgauuaucuuacauuccugccugcugaggugaaagaacaaauacagcgcacuguagcaacgucagggaacaugcaggccguggaguuguuacugaguacccuagaaaagggagucuggcaccucgguuggacacgagaguuuguggaggcgcugcguagaacuggcagcccacuugcugccagguacaugaauccggaacugaccgacuugcccuccccuucuuucgagaacgcacaugaugaauaucuccagcugcugaaucucuuacaaccaacacugguugacaaacuuuuggugcgggauguccuggacaaguguauggaggaggaacuacucaccaucgaggaucgcaacagaauugccgcugcagaaaauaacgggaaugagucgggagugagggaacugcuuaaacggaucguacagaaggagaacugguuuucagccuuccugaauguuuugcgccagacuggcaacaaugagcucgugcaggaacugacagguagcgacugcagugaguccaacgcugaaauugagaauuuaucucaagucgaugggccccagguggaagaacagcugcucagcaccacggugcagccuaaccuugagaaggaagucuggggaauggagaacaauuccucagaaaguagcuuugccgacucuuccguugugucagagagcgauaccagucuggcggaaggcucuguauccuguuuggacgagagccuaggccacaacucgaauauggggucugauuccggaacuauggguucagacagugacgaggaaaacguggcagcccgagcuagcccagagcccgaacugcaacucagaccuuaccagauggaggucgcccagccagcacuggagggcaaaaauaucauaaucugccuuccgacaggguccggaaagacuaggguggcuguuuauauugccaaagaucaucuggacaagaaaaagaaggcgucugaacccggcaaagugaucgucuuggugaacaagguacuccugguugagcaauuauuccggaaagaauuucagccuuuccugaagaaaugguaccgugugauuggucuaagcggggauacccagcucaagaucucauuuccagaggucgugaaaaguugugacauaauuaucuccacagcccagauucuggaaaauagccuuuugaaccuggagaauggagaggaugcaggcguccaacucucugacuucucacugaucaucauugaugaaugccaccauaccaacaaggaggcuguguacaauaacauaaugcgccacuaucuuaugcagaagcugaaaaauaacagauugaagaaagaaaauaagcccguuaucccucucccacagauucugggcuuaacggccagucccggggugggaggugcuacuaaacaggccaaggcagaggaacacauccugaagcuaugugccaaccucgacgcuuuuacaauaaaaaccguaaaggagaaccuggaucaacuuaaaaaucagauucaggagccgugcaagaaauucgcgaucgcagacgccacuagggaagauccuuucaaggagaaguugcuggaaaucaugacacggauucagaccuacugucaaaugagccccauguccgacuuuggcacgcagccauaugagcagugggcuauccagauggagaaaaaggccgcaaaagaggggaaccgaaaggagcgcgucugcgccgaacaucucagaaaauacaaugaggcucugcaaauuaacgacaccauaaggaugaucgaugccuauacacacuuagaaacuuucuacaaugaggagaaggacaagaaauuugcagugauugaagaugacucugaugagggaggcgacgaugaauauugugacggugaugaggacgaagaugaccugaagaaaccucuuaaguuggaugagaccgaccgguuccucaugacacuguuuuucgagaacaauaaaaugcuaaagcgccuggcggaaaaccccgaguacgaaaaugagaaacucacuaagcugagaaacaccaucauggaacaguacacaaggaccgaggagucggcucgugggaucauuuuuacuaagacgcggcagagcgccuaugcacuuucccaauggauaacagaaaaugagaaauucgccgaaguuggcgugaaggcucaucacuugaucggagccggccacucaagugaguuuaaaccaaugacccagaacgaacagaaggaggucauuucuaaauuccgaacugggaagaucaaucuguuaauugcaaccacaguggcugaggaaggacucgacaucaaggagugcaacauaguaaucagauacggucuggugaccaaugaaauugccaugguucaggcgaggggccgcgcccgggcugaugagagcacuuauguccuuguggcacauuccgggucaggagugaucgagcacgaaacagucaacgacuuuagagagaaaaugauguacaaggccauucauugcguucaaaacaugaaacccgaagaguaugcucacaagauccuggaauugcagaugcagagcauaauggagaaaaagaugaagacgaaaaggaauauugccaagcauuacaaaaacaauccuucucucaucaccuuccuguguaagaacugcuccgugcuagcauguaguggcgaggauauucacgugaucgagaaaaugcaccauguaaauaugacuccagaauuuaaggaacuguauauaguccgcgagaacaaggcgcuccagaaaaagugcgccgacuaccaaaucaauggugaaauuaucuguaaaugcgggcaggcuuggggcacaaugauggugcacaagggacuggaucuuccguguuugaaaauucgaaacuucguuguggucuucaagaauaacagcaccaaaaagcaguacaagaaauggguggagcugcccaucacauuuccuaauuuagacuauucugagugcugucucuucuccgaugaagacuga

SEQ ID NO: 57540 - RNA, 1344 nt, Artificial Sequence
  derived and/or modified sequence opt3 from IFIT1__Homo_sapiens__NP_001257858
augcccgaccuggagaacagagugcucgaucagaucgaguuccuugacaccaaguacagcgucggcauucacaaucuguuggccuauguuaaacauuuaaaggggcaaaacgaggaagcucugaaaucccuaaaggaggcagaaaaucucaugcaggaggagcacgauaaccaggccaaugugaggucucugguaacauggggaaacuuugcguggauguacuaucauaugggucggcuugcugaagcccagacuuaccuggacaaaguggagaauauaugcaagaaguugucaaacccuuuccgcuaucgaauggaauguccagagaucgauugcgaggaaggcugggcacuccugaaaugugggggaaagaauuacgagcgugccaaggcuugcuuugaaaagguccuggagguggacccggaaaaccccgagaguagcgcaggcuaugccauuuccgcuuacagacucgaugguuucaaauuagccacgaagaaucacaagccuuuuucucugcuuccauugaggcaagcgguucggcugaaccccgacaauggguacaucaaagugcuacucgcacugaaacuucaggaugagggacaggaagccgagggcgaaaaauauauugaggaagcucuggccaacaugucgucacagaccuacgucuuccgcuaugcagcuaaguuuuacagaaggaaaggcagcguggacaaggccuuggagcuccugaaaaaggcguuacaagagacaccuaccaguguacugcuccaucaccagaucgggcuuuguuauaaggcccagaugauacagaucaaagaagcaacuaagggacaaccacggggucagaaucgcgagaaacuggauaagaugauucgauccgcuaucuuccacuuugaaucugccguugagaaaaagcccacauucgaaguggcucauuuggaccuagccagaauguacauugaggcaggcaaccacaggaaggccgaggaaaacuuucagaaacugcucugcaugaagccugucguggaggaaaccaugcaagauauccauuuccacuaugggcgguuucaggaguuccagaaaaagagcgacgugaaugcuauaauucacuaccugaaagcgaucaagauugagcaggcaucccuuacucgugacaagucaaucaacagucugaaaaaguugguccuccgcaaacugagaaggaaggccuuagaucuggaaagccuaucucuccugggauucguuuacaaacuugagggcaauaugaacgaggcuuuggaauauuacgaacgggcccugcgacucgcagccgacuuugaaaauuccgugcgccaagguccauga

SEQ ID NO: 57541 - RNA, 1419 nt, Artificial Sequence
  derived and/or modified sequence opt3 from IFIT2__Homo_sapiens__NP_001538
augagcgagaacaauaagaacucccuggaaucuucacucagacagcuuaaaugccacuucaccuggaaucugauggagggcgaaaacaguuuggacgauuuugaggacaagguguucuacaggacagaauuucaaaaucgggaguucaaagccacuauguguaacuuacuggcuuaucuaaagcaucucaaagggcagaaugaggcagcccuggaaugccuucgcaaggcggaggaacugauccagcaggagcacgcugaucaagccgagauucguagcuuggucacguggggaaacuacgcauggguuuauuaccauaugggucgacucuccgacgugcagauauauguagauaaggugaaacacgucugugaaaaguuuucuucgcccuacagaaucgagucaccugaacuggacugcgaggaaggcuggaccaggcugaaaugugggggaaaucagaacgagcgggccaaggugugcuucgagaaagcucucgaaaagaagccgaaaaauccagaguuuacaagcggcuuagcaauugccaguuaucgccuggauaacuggcccccuucccagaaugcuaucgacccacuuagacaagccauuagguugaaccccgauaaucaguaccugaagguucuacucgcgcugaaacuucauaagaugcgggaagagggugaagaggagggggaaggagagaaacugguggaagaggcauuggaaaaggccccuggcgucacugacgugcuccgcucugcugccaaauucuaccgaagaaaggaugagccagacaaggcaaucgagcugcugaaaaaggcuuuagaauauauacccaacaacgccuaccuccacugucagaucggcugcuguuauagggcgaaaguauuucagguuaugaaucuucgggagaacgggauguacggaaagcguaaacuguuggaacuaauuggucacgccguggcacaucugaagaaggcugaugaggccaaugacaaccucuuccgcgucugcagcauccuggcuucccuucacgcccuggcagaccaauaugaggaugccgaauacuauuuucagaaagaguucucaaaggaauugaccccuguggcuaaacagcuccugcauuuaagauacggcaauuuucaacuguaccagaugaagugugaggacaaagcgauucaccacuucaucgaaggggugaagauaaaccagaagaguagggagaaagagaagaugaaagauaagcuacagaaaauugcaaagaugcggcucagcaagaauggagccgacucugaagcucugcauguccuugccuucuugcaagagcugaacgagaaaaugcagcaggcagaugaagacuccgaacgaggccucgagucagguagccugaucccaagugccucuuccuggaauggggaguga

SEQ ID NO: 57542 - RNA, 1317 nt, Artificial Sequence
  derived and/or modified sequence opt3 from IFIT3__Homo_sapiens__NP_001276687
auguacaaccugcucgccuauaucaagcaccuugacggcaauaacgaggcugcacuggaaugcuugagacaggccgaggaauuaauucaacaggagcaugcggaucaggcugaaauaaggagccuggugaccugggggaauuacgccugggucuauuaccaccuaggacggcucuccgacgcacagaucuauguugauaaagugaagcaaacauguaaaaaguucucuaaccccuacucaauugaguauagugagcuggacugcgaagaggguuggacucagcuuaaauguggccgcaaugaacgagccaagguaugcuuugagaaggcucuggaggaaaaaccuaacaauccagaguucagcuccggguuggcaaucgccauguaccaucucgauaaccacccggaaaagcaguuuucuacggacgugcugaaacaggcuauugagcugucgcccgauaaucaauacgucaaggugcucuuaggacugaaacuucagaagaugaacaaggaagccgagggcgagcaguucguugaagaggcguuggaaaaaucaccuugucagaccgacgugcugcguagcgcagccaaguuuuauagaaggaaaggugaucuagacaaggcuaucgaacucuuccaacggguccuggagaguacaccaaauaacggguaccuuuaucaucagauaggaugcuguuacaaagccaaggugcgccagaugcaaaauacuggcgaguccgaggcaucuggcaacaaagaaaugaucgaggcucugaagcaguaugccauggauuacagcaauaaggcguuggaaaaagggcucaacccccugaacgccuauuccgacuuagcagaguuucuggaaaccgagugcuaccagacaccuuucaauaaggagguaccagaugcugaaaaacagcaaucacaccagagauacuguaaccuccagaaguauaauggaaaaagugaggacaccgccguucagcacggucuugaaggccugagcauuucuaagaaguccacugacaaagaggagaucaaggaucaaccccagaacgugucagaaaauuugcuaccucagaacgcuccaaauuacugguaucugcaggggcucauucauaaacaaaacggagaccugcuucaggccgcaaagugcuacgagaaagaacugggcagguugcuccgggaugccccgagcgguaucgggaguauauuucugucugcuuccgaguuagaagacggaagcgaggagaugggccagggcgcggucucgucuucaccccgcgaacugcuauccaauagugagcagcucaacuga

SEQ ID NO: 57543 - RNA, 1449 nt, Artificial Sequence
  derived and/or modified sequence opt3 from IFIT5__Homo_sapiens__NP_036552
augagcgagaucagaaaggacacccugaaagccauucuccuugaacuggagugccacuucacauggaacuuguuaaaggaagauauagaccuguuugagguggaagauacuaucggccagcaacuagaguuccucacgaccaaauccaggcuggcucuuuacaaucuguuggcauaugucaagcaucucaaagggcagaacaaggacgcccuggagugucuggaacaggcggaggaaauuauccagcaagagcacucugauaaggaggaaguucggucacucgugacauggggaaauuacgcuuggguauauuaccauauggaccaguuagaggaagcccagaaauauacugguaagauuggcaacgugugcaaaaagcugaguagccccuccaauuacaaacuugaguguccugaaaccgauugcgagaaggggugggcauugcugaaguuuggaggcaaauauuaccagaaggccaaagcugcauucgagaaggcccuagaagucgagccagacaacccggaauuuaauaucgguuacgcuauaacaguguaucgccucgaugacucugaucgagaggggucgguuaaaucauucagccugggaccccuucguaaggccgugacccugaacccugacaauaguuacaucaaagucuuuuuggcgcucaagcugcaagaugugcacgcagaagccgagggcgagaaguauauugaagagaucuuagaccagauuuccucucagccauacguacugagauaugcugccaaauucuacaggcggaagaacagcuggaauaaagcacucgaacuucugaagaaagcucuagagguuacucccacauccucauuucuacaucaccagaugggccuguguuaucgcgcccaaaugauccagauaaagaaggcgacccacaacagaccuaaagggaaggacaaacucaagguggaugaacugauuaguagcgccaucuuccauuuuaaagcagcuauggagagggacucuauguucgccuuugcuuacacggaucuugccaauauguacgcagagggaggucaguauuccaacgccgaagacauuuuccggaaggcucugcgcuuggagaauaucacugaugaccacaagcaucaaauccacuaccacuauggccgauuccaggaauuucauagaaaaucagagaacaccgcgauucaccauuaccucgaggcacugaaggucaaagauaggagcccauuacggacaaagcugaccagugccuugaaaaagcucucuacuaagcgucugugccacaacgcucuugacgugcaguccuugagcgcccugggguucguguauaaacucgaaggagagaagcgccaggcagccgaauacuaugagaaagcucaaaagauagaucccgaaaaugccgaguuucugacagcacuuugugagcugagauugucgaucuga

SEQ ID NO: 57544 - RNA, 378 nt, Artificial Sequence
  derived and/or modified sequence opt3 from IFITM1__Homo_sapiens__NP_003632
augcacaaggaggaacaugagguggccguccugggcgcucccccuagcaccauccucccaagauccacaguuauuaacauacacucugaaacuucagugccggaccauguaguguggagucuuuucaauacgcuguuuuugaacuggugcuguuuaggguucaucgcauuugccuacagcgucaaauccagggaucggaagauggugggagacguuaccggugcgcaggcuuaugccucuacagcaaaaugccugaauauuugggcccuaauccucggcauucugaugacuaucggguucauacuucuguugguguuuggaucggucaccguguaccacaucaugcuccaaauuauccaggagaagcgcggcuauuga

SEQ ID NO: 57545 - RNA, 399 nt, Artificial Sequence
  derived and/or modified sequence opt3 from IFITM2__Homo_sapiens__NP_006426
augaaccacaucgugcagaccuucagccccgucaauuccggccaaccuccaaacuacgagaugcugaaggaggaacaggaaguugccaugcucggggugccgcauaaucccgcuccuccaaugucuacaguaauucacauaagaucagagacgagugugcccgaccaugucguguggagccuuuuuaacacucuguucaugaauaccugcuguuugggauuuaucgcauucgccuauuccguuaaaucuagggaucggaagauggugggugacgucacaggcgcgcaggcuuacgccucgacugcaaaaugcuuaaacauuugggcccugauccuagggauuuuuaugaccauccuccugauaaucauuccugugcuuguaguucaggcucaacgcuga

SEQ ID NO: 57546 - RNA, 402 nt, Artificial Sequence
  derived and/or modified sequence opt3 from IFITM3__Homo_sapiens__NP_066362
augaaccacaccgugcagacauucuuuagccccgucaauuccggccaaccuccaaacuacgagaugcugaaggaggaacaugaaguugccgugcucggggcuccgcacaaucccgcaccuccaacuucuacgguaauccauauuagaucagagaccagugugcccgaccacgucguguggagccuuuucaacacacuguuuaugaauccuugcuguuugggauucauagccuuugcguauuccguuaaaucuagggaucggaagauggugggugacgucacuggcgcucaggccuacgcaucgaccgccaaaugcuuaaacaucugggcucugauucuagggauccucaugacaauucugcuuaucgugauaccaguacugaucuuccaggcauauggauga

SEQ ID NO: 57547 - RNA, 399 nt, Artificial Sequence
  derived and/or modified sequence opt3 from IFITM5__Homo_sapiens__NP_001020466
auggacaccgccuaccccagagaggauacaagggcuccuacuccaagcaaggcaggcgcccacacggcgcugacccucggggcuccgcaucccccuccacgggaccaccuuaucugguccguguucucuacacuguauuugaacuuaugcugucugggauuucuagcccucgcauacucaauuaaagcccgcgaucagaaggucguuggugaccuggaagcugcacgacguuucggcaguaaagccaagugcuauaauauacuugcugccauguggacucuggugcccccuuugcuccugcuggggcucguagugaccggagcguuacaucuggcaagacuugccaaagauagcgcugccuuuuucuccacaaaguuugacgaugcagacuacgauuga

SEQ ID NO: 57548 - RNA, 570 nt, Artificial Sequence
  derived and/or modified sequence opt3 from IFNA10__Homo_sapiens__NP_002162
auggcccugagcuucucccuccuuauggcugugcuggucuugucuuacaagucaaucugcaguuuaggcugugaccugccccagacccacagccuagggaacagaagggcacucauucugcuuggacaaaugggucggauauccccuuuuucuugccugaaagaucgccaugacuuccgaaucccacaggaggaauuugauggcaaucaguuccagaaggcccaagcgauuucgguuuugcacgagaugauccagcagacauuuaaccucuucucaacugaagacagcagugcugccugggagcagucccugcuggaaaaauuuucuacggagcucuaucaacaguuaaaugaucuggaggcaugugugauucaggaaguagggguggaggaaaccccgcuuaugaacgaggacagcaucuuggccguccguaaguacuuccagagaauaacacuguaucuaaucgagaggaaauacucccccugcgcuugggaagugguucgggcagagauuaugcgcucacucaguuuuagcacuaaucugcaaaagagacuuaggcggaaggauuga

SEQ ID NO: 57549 - RNA, 573 nt, Artificial Sequence
  derived and/or modified sequence opt3 from IFNA13__Homo_sapiens__NP_008831
augauggccagccccuucgcucugcucauggcacuugugguccuguccugcaagucuucauguaguuugggcugcgacuuaccugagacccacagccuggauaacagaaggacacuaaugcuccuggcccagaugucccggaucucuccaucgucaugucuuauggaccgccaugauuuuggguucccgcaagaagaguuugacggaaaucaguuccagaaagcgcccgcuauuagcguucugcacgaauugauacagcaaaucuuuaaccucuucacuacgaaggauaguuccgccgcaugggacgaggaucugcuggacaaauuuugcaccgaacucuaccagcaguuaaaugaucuggaggccugugugaugcaggaggaacgaguaggugagacaccucuuaugaacgcugacucuauuuuggcagugaagaaauauuuccguagaaucacucuguaccuaaccgaaaagaaguauagcccaugcgccugggaggucgugagggcugagauuaugcggucccucucacugaguacaaaucuucaagaacgccugagaaggaaagaguga

SEQ ID NO: 57550 - RNA, 570 nt, Artificial Sequence
  derived and/or modified sequence opt3 from IFNA14__Homo_sapiens__NP_002163
auggcccugcccuucgcucucaugauggcacuugugguccugagcugcaaguccucuuguucauugggcugcaacuuaagucagacccacagccugaauaacagaaggacacuaaugcucauggcccaaaugcggcgcaucuccccuuuuucuugucugaaagaccgacaugauuucgaguuuccacaggaagaguucgacgggaaucaguuucagaaggcgcaagcuauuucgguucuucacgaaaugaugcagcagacuuucaaccuguuuucaacgaaaaauagcagugccgcaugggaugagaccuugcucgaaaaguucuacauagagcuguuucagcaaaugaacgaccuggaggccugcgugauccaggaaguaggaguggaggaaacaccgcucaugaaugaggauuccauuuuagcugucaaaaaguauuuccagcguaucacucuguaccuuauggagaagaaauauucucccugugcaugggaagugguuagagccgagauuaugaggagcuuguccuuuucaaccaaccugcagaagcggcuacgcagaaaagacuga

SEQ ID NO: 57551 - RNA, 570 nt, Artificial Sequence
  derived and/or modified sequence opt3 from IFNA16__Homo_sapiens__NP_002164
auggcccugagcuucucccuccuuauggcugugcuggucuugucuuacaagucaaucugcaguuuaggcugugaccugccccagacccacagccuagggaacagaagggcacucauucugcuugcccaaaugggacggauaucccauuuuucuugccugaaagaucgcuaugacuucgguuuuccucaggagguuuucgauggcaaucaguuucagaaggcgcaagcuaucucggccuuccacgaaaugauucagcagacauuuaacuuguucucaacuaaagacagcagugcagccugggaugagacgcuccuggacaaguuuuacaucgaacuguuccagcaacucaaugauuuagaggcuugugugacccaggaaguagggguggaggagauugcacugaugaacgaagacuccauccuugccguccgaaaauauuuucagcguauaacauuguaccugaugggaaagaaguauucuccaugcgcuugggaggugguuagagccgaaaucaugaggagcuucuccuuuucaacuaaucuacagaaaggccuccggcgcaaggauuga

SEQ ID NO: 57552 - RNA, 570 nt, Artificial Sequence
  derived and/or modified sequence opt3 from IFNA17__Homo_sapiens__NP_067091
auggcccugagcuucucccuccuuauggcugugcuggucuugucuuacaagucaaucugcaguuuaggcugugaccugccccagacccacagccuagggaacagaagggcacucauucugcuugcccaaaugggacggauauccccuuuuucuugccugaaagaucgccaugacuucgguuugccacaggaggaauuugauggcaaucaguuccagaagacacaagcgaucucgguucuccacgagaugauucagcagacuuuuaaccuguucucaacggaagacagcagugcugccugggagcagucccugcucgaaaaauuuucuaccgaguuauaucaacagcugaauaaccuugaggcaugugugauccaggaaguagggauggaggaaacaccguugaugaaugaggauagcauucuggccgugcgaaaguacuuccagcguaucacucuauaucucaccgagaaaaaguacucccccugcgcuugggaagucgugagagcagagauaaugaggucacugaguuuuagcacaaaccuucaaaagauccugcggcgcaaagacuga

SEQ ID NO: 57553 - RNA, 570 nt, Artificial Sequence
  derived and/or modified sequence opt3 from IFNA1__Homo_sapiens__NP_076918
auggccagccccuucgcucugcucauggugcuugucguucuguccugcaagucuucauguaguuugggcugcgacuuaccugagacccacagccuggauaacagaaggacacuaaugcuccuggcacagaugucccggaucucuccaucgucaugucuuauggaccgccaugauuuuggguucccgcaagaagaguuugacggaaaucaguuccagaaagcccccgcgauuagcgugcugcacgaauugauacagcaaaucuuuaaccucuucacuacgaaggauaguuccgcugccugggacgaggaucugcuggacaaauuuugcaccgaacucuaccagcaguuaaaugaucuggaggcauguguaaugcaggaggaacgagugggugagacaccucuuaugaacgccgacucuauuuuggcugucaagaaauauuuccguagaaucacucuguaccuaaccgaaaagaaguauagcccaugcgcaugggaggugguuagggccgagauuaugcggucccucucacugaguacaaaucuucaagaacgccugagaaggaaagaguga

SEQ ID NO: 57554 - RNA, 570 nt, Artificial Sequence
  derived and/or modified sequence opt3 from IFNA21__Homo_sapiens__NP_002166
auggcccugagcuucucccuccuuauggcugugcuggucuugucuuacaagucaaucugcaguuuaggcugugaccugccccagacccacagccuagggaacagaagggcacucauucugcuugcccaaaugggacggauauccccuuuuucuugccugaaagaucgccaugacuucgguuuuccacaggaggaguucgauggcaaucaguuucagaaggcgcaagcuaucucgguuuugcacgaaaugauucagcagacauucaaccucuuuucaacuaaagacagcagugccacgugggaacagucccugcuggagaaguucucuaccgaacucaaucaacaguuaaacgaucuggaggcaugugugauccaggagguagggguggaagagacaccgcuuaugaaugucgacagcauuuuggccgugaaaaaguauuuucagcgaaucacucuguaccuaaccgaaaagaaauauucccccugcgcuugggagguugugcgugcagagauaaugagaucauucagucucagcaagaucuuucaagaaaggcugcggcgcaaagaguga

SEQ ID NO: 57555 - RNA, 567 nt, Artificial Sequence
  derived and/or modified sequence opt3 from IFNA2__Homo_sapiens__NP_000596
auggcccugaccuucgcucuccuuguggcacuguuggucuuaagcugcaaguccucuuguucaguuggcugcgaccugccccagacacacagucuagggagcagaaggacucucaugcugcuugcccaaaugcggcgcaucucccuguuuucuuguuugaaagaucgacaugacuucggauuuccucaggaggaguucgguaaccaguuucagaaggcggaaacgauuccagugcuccacgaaaugauacaacagaucuucaaucuguuuucgaccaaagauucaagcgcugccugggacgagacacugcucgauaaguucuacacugaauuauaucagcagcugaacgaccuugaggcaugcguaauucaaggcgugggggucaccgagacaccguugaugaaagaagauaguauccuggccgugcguaaguacuuucagagaauuacccuauaucucaaggagaaaaaguacucccccugugcuugggaaguugugagggcagagaucaugcggucuuucagccuguccacuaaucuucaggagucacugcgcaguaaagaauga

SEQ ID NO: 57556 - RNA, 570 nt, Artificial Sequence
  derived and/or modified sequence opt3 from IFNA4__Homo_sapiens__NP_066546
auggcccugagcuucucccuccuuauggcugugcuggucuugucuuacaagucaaucugcaguuuaggcugugaccugccccagacccacagccuagggaacagaagggcacucauucugcuugcccaaaugggacggauaucccauuuuucuugccugaaagaucgccacgacuucgguuuuccugaggaagaguucgauggccaucaguuucagaaggcgcaggcuaucucgguuuugcacgaaaugauucaacagacauucaaucucuuuucaacugaggacagcagugccgcaugggaacagucccugcuggagaaauucucuacggagcucuaucagcaauuaaacgaucuggaagccugugugauccaggagguagggguggaagagaccccacuuaugaaugaggacagcauuuuggcuguccgaaaguacuuucagcguaucacacuguaucuaacugagaaaaaguacuccccgugcgcaugggaagugguuagagccgaaauaaugaggucacucaguuucagcaccaaccugcagaagcggcuucgcagaaaagauuga

SEQ ID NO: 57557 - RNA, 570 nt, Artificial Sequence
  derived and/or modified sequence opt3 from IFNA5__Homo_sapiens__NP_002160
auggcccugcccuucgugcuccuuauggcucuggucguuuugaacugcaagagcaucuguuccuuaggcugcgaccugccucagacccacucucuaucaaauagaaggacacucaugauuauggcacaaauggggcggauaaguccauuuagcugucugaaagaucgccaugacuucggauuuccgcaggaggaguucgaugguaaccaguuucagaaggcccaagcgaucuccgugcuucacgaaaugauucagcagacuuucaaucuguuuucuacgaaagacucgucagcuaccugggaugaaacauugcucgacaaguucuacacugagcuguaucagcaacugaacgaucucgaagccugcaugaugcaggagguaggcguggaggacacccccuuaaugaaugucgauagcauccugacagugcgaaaauacuuucagcguauuacccuuuauuugacugaaaagaaguacaguccuugugcaugggagguugugagagccgaaaucaugagguccuucucucugagcgcuaaccuacaggagcggcuccgcagaaaagaguga

SEQ ID NO: 57558 - RNA, 570 nt, Artificial Sequence
  derived and/or modified sequence opt3 from IFNA6__Homo_sapiens__NP_066282
auggcccugcccuucgcucuccuuauggcacugguggucuugagcugcaaguccucuuguucauuagacugcgaucugccucagacccacagucuaggccauagaaggacaaugaugcuccuggcccaaaugcggcgcaucagccuuuucuccugucugaaagaccgacacgauuuccguuuuccacaggaggaauuugacgggaaccaguuucagaaggcggaggcuauuucuguuuugcaugaagugauacaacagacuuucaaucucuuuucgacgaaagauucaagcguagccugggacgagagacugcuggauaagcucuacaccgaauuauaucagcagcugaacgaccuugaggcaugcgugaugcaagaggucugggugggagguacaccguugaugaaugaagauaguauccuggccguuaggaaauacuuccagcggauuacucuauaucucaccgagaagaaguacucccccugugcuugggaagugguccgcgcagagaucaugagaucuuuuagcuccucaaggaaccugcaggagcggcuucgccgaaaagaauga

SEQ ID NO: 57559 - RNA, 570 nt, Artificial Sequence
  derived and/or modified sequence opt3 from IFNA7__Homo_sapiens__NP_066401
auggccaggagcuucucccugcucauggugguccuuguucugucuuacaagucaaucugcaguuugggcugugacuuaccccagacccacagccugagaaaccggcgcgcucuaauucuccuggcacaaauggggcgaauauccccuuuuucuugccuuaaagaucgucaugaguucagauuuccagaagaggaguucgacggacaccaguuucagaagacacaggccaucucggugcugcaugaaaugauucaacagacuuucaauuuguuuucaacggaagauagcagugcggcuugggagcagucccuccuggagaaauucucuaccgaacuguaucagcaacucaacgacuuagaggccuguguaauccaggaagugggugucgaggagacaccgcugaugaaugaagauuuuauucuugcagugaggaaguacuuccagcggaucacuuuguaucugauggagaaaaaguacagccccugcgccugggaaguugugcgcgcugagauaaugagauccuuuucauucaguaccaaccuaaagaaaggccucaggcggaaggacuga

SEQ ID NO: 57560 - RNA, 570 nt, Artificial Sequence
  derived and/or modified sequence opt3 from IFNA8__Homo_sapiens__NP_002161
auggcccugaccuucuaccuccuuguggcucuggucguuuugagcuauaaguccuuuucuucauuaggcugcgaccugccccagacacacagucuagggaacagaagggcacucauccugcuugcccaaaugcggcgcauuagcccuuucuccugucugaaagaucgacaugacuuugaguucccacaggaagaguuugaugacaagcaguuccagaaagcgcaagcuauaucuguguugcacgaaaugauccagcagacuuuuaaucucuucucgacgaaggauucaagcgccgcacuggacgagacccugcucgaugaauuuuacauugaguuagaccagcaacugaacgaucuugagaguugcguaaugcaggaagugggagucaucgaguccccguugauguaugaagacucuauucuggccgugcguaaauacuuccagagaaucacacuauaucucacugagaagaaguacagcuccugugcuugggagguugugagggcagaaauaaugcggucauuuagucugagcaucaaucuucagaaacgccugaagucuaaagaguga

SEQ ID NO: 57561 - RNA, 1674 nt, Artificial Sequence
  derived and/or modified sequence opt3 from IFNAR1__Homo_sapiens__NP_000620
augauggugguccugcucggcgccaccacacuuguucugguggcuguagcacccuggguguugagcgccgcggcugggggaaagaacuuaaaauccccucagaaggucgagguggacaucauugaugacaauuucauacugagauggaacaggucugaugaaucaguugguaaugugacuuuuaguuucgacuaccaaaagacgggcauggauaacuggaucaagcuaagcgggugccagaauauuaccuccacaaaauguaacuuuucuucgcucaagcugaaugucuaugaggaaaucaaacuucggauucgcgccgagaaagaaaacacuucaagcugguacgagguggacaguuucaccccauuucgaaaggcacagaucggaccgcccgagguacaccuggaagccgaggauaaagcuauaguuauccauauuuccccuggcacaaaggacucugugaugugggcauuggauggucucagcuucaccuauucccuggucaucuggaaaaauucaagugggguggaggaacguauugagaacaucuacagcagacacaagauauauaagcugucuccagaaacuacauacugccucaaagugaaggccgcuuuacugaccuccuggaaaauuggagucuauucacccguucauuguaucaagacgacuguggagaaugaacuuccuccacccgagaacauugaaguaagcgugcagaaucaaaacuacgucuugaaaugggacuacaccuaugccaauaugacauuucaggugcaguggcugcacgcguuccuaaagaggaacccuggcaaccaucucuacaaauggaagcagaucccagauugcgagaauguuaagacuacccaauguguguuuccgcagaacgucuuccagaaaggcaucuaucugcuucgggugcaggcaagugacgggaauaacacaucuuuuugguccgaggaaauuaaguucgauaccgagauacaagccuuucuguugcccccuguauucaauauccgcagccucucggacucuuuccacauuuacaucggagcuccaaaacaguccgguaacacgcccguuauacaggacuauccucugauuuacgaaaucaucuuuugggagaauacuucaaacgccgaaagaaagauuaucgagaaaaagacagaugugaccgucccaaauuuaaagccccugacuguguauugcgucaaagcaagggcucacacaauggacgagaagcucaacaaaaguagcguguucuccgaugccguuugugaaaagaccaaaccgggcaauacgucuaagauuuggcuuauaguggggaucugcauugcgcuguuugccuugccuuucguaaucuacgcagcuaaggucuuucuacgguguaucaacuacguguucuuucccagccugaaaccaucaaguuccauugacgaguauuucagcgaacaaccucucaagaaucugcuucugucuaccucagaggaacagauagagaaaugcuuuaucauugagaacaucaguacaauugccacuguugaagagaccaaucagacagaugaagaccauaagaaauacagcucccagacuucucaagauucgggaaacuauagcaacgaggacgaguccgaaucaaagaccagugaggaauugcagcaggauuucguguga

SEQ ID NO: 57562 - RNA, 996 nt, Artificial Sequence
  derived and/or modified sequence opt3 from IFNAR2__Homo_sapiens__NP_997467
augcugcucagccagaacgccuucaucuuuagaucccuuaaucugguguugauggucuacauuucuuuaguuuucggcauaucauaugacagucccgauuacaccgacgagagcugcacauuuaagaucucccugaggaacuuccggucuauucuaucgugggaacucaaaaaucacucaaucgugccuacucauuauacgcugcuuuacaccauuaugagcaagccagaggaucugaaaguagugaagaacugugcuaauacaacucgcaguuuuugcgacuugaccgaugaauggcgauccacacacgaggcauaugucaccgugcucgaaggguucucuggaaacacuacacuguuuagcuguucccauaauuucuggcuggccaucgacaugucauuugagccgcccgaguucgaaauaguugguuuuaccaaccacaucaaugugauggucaaauucccuaguauuguggaggaggaacuccaauuugauuuaagccugguaaucgaggaacagucugagggcauuguuaagaagcauaaaccagaaaucaaggggaacauguccggaaauuucacguacauaauugacaaacuuauccccaacacuaauuauugcgugucagucuacuuggagcacagcgaugaacaggcggugauuaagaguccucugaaauguacccuacucccacccggccaggagucugaguccgcugaaagcgccaagaucggugggaucauuacaguguuccugauagcacuuguccugacuucgaccaucguuacauugaaguggauuggauacaucugccuccguaacucucugccuaaaguguuaagacaaggccuggccaagggcuggaaugcuguagcaauacacagguguucccauaacgcccuccagucagagaccccagaacuuaaacagaguagcugccuguccuuuccgucuagcugggacuauaagcgggcuucauugugucccagugauuga

SEQ ID NO: 57563 - RNA, 564 nt, Artificial Sequence
  derived and/or modified sequence opt3 from IFNB1__Homo_sapiens__NP_002167
augaccaacaagugccugcuccagaucgcccuucuguuguguuucagcacaacugcuuuauccaugucuuacaaucugcuaggcuuucuccaaagaucaaguaacuuccagugccagaaacugcuuuggcagcugaaugggagguuggaguauugucucaaggaccggaugaacuuugauauucccgaagagauaaaacaacugcagcaguuccagaaggaagacgcagcccugacgaucuacgagaugcuccaaaauauuuuugcgaucuuccgccaggauagcuccucuaccggauggaacgaaacaauuguggagaauuuacuggcuaacgucuaucaccagaucaaucaucuuaaaacuguuuuggaggaaaagcuggagaaggaagacuuuacccgagguaaacuaaugucgucacuccaccugaagcguuacuauggcagaauacuucauuaccugaaagccaaggaguauagccacugcgcauggacaaucgugaggguagagauuuugcggaacuucuacuuuaucaaucgccucaccggguaccugagaaacuga

SEQ ID NO: 57564 - RNA, 627 nt, Artificial Sequence
  derived and/or modified sequence opt3 from IFNE__Homo_sapiens__NP_795372
augaucauuaagcacuucuuuggcaccgugcugguccuccuugccagcacaacuauauucucccuggacuugaaauuaaucauuuuucagcaaagacagguuaaccaggaaucucugaagcuacucaauaaacugcagacgcuuucaauccaacagugccugccccauaggaagaacuucuugcucccucagaaaagucugagcccacagcaauaccagaaggggcacacccuggcuauucuccaugaaauguuacagcagaucuuuucccuguuccgggcaaauauaucucuugauggaugggaggaaaaccacacagagaaguuuuugauccaacugcaucagcagcuagaauaucucgaggcccugaugggucuugaggcggaaaaacugucgggcacuuuggggucagacaaucuccgccugcaagugaagauguacuuccgacguauucacgauuauuuagagaaccaggacuacagcaccugugcuugggccaucguacagguggaaauuaguagaugccuguuuuucgucuuuucccucacagagaaacuuucuaagcagggaaggccgcugaaugauaugaaacaagaguugaccacugaguuccggagcccccgcuga

SEQ ID NO: 57565 - RNA, 501 nt, Artificial Sequence
  derived and/or modified sequence opt3 from IFNG__Homo_sapiens__NP_000610
augaaguacaccagcuauauccucgccuuccagcucugcauugugcuuggcucccugggguguuacugccaagaccccuaugucaaagaggcugaaaacuugaagaaauacuuuaaugcaggacacucugauguugccgacaacgguacauuauuccugggcauacuaaagaauuggaaagaggaaucagauagaaagaucaugcagagucagauugugagcuuuuauuucaagcucuuuaaaaacuucaaggacgaucaguccauccaaaaaucuguagagacuauuaaggaagacaugaaugugaaauuuuucaacucgaauaagaagaaaagggaugacuuugagaagcugacgaacuacucagucaccgaucuuaaugugcagcggaaagcgauccaugagcugauacagguuauggcugaauugagcccugccgcaaagacagggaaacgcaagcgaagucagaugcuguuccguggaagaagggccucccaauga

SEQ ID NO: 57566 - RNA, 1470 nt, Artificial Sequence
  derived and/or modified sequence opt3 from IFNGR1__Homo_sapiens__NP_000407
auggcccuccuguuccuucugcccuuggugaugcagggcgucagcagagcugagauggggaccgcagacuuaggaccuuccucuguuccaacaccgacuaacgugacgaucgaaucauacaauaugaaccccauuguauauugggaguaccaaauaaugccucaggugccagucuuuaccguggaaguuaagaauuauggugugaaaaacagugaguggaucgaugccugcauuaauaucagccaccauuacuguaacauuuccgaccacgucggcgaucccucuaauucgcugugggugaggguaaaggcgcggguugggcagaaagaaucagcuuaugccaagagcgaggaguucgcagugugccgcgacggaaaaaucggcccuccaaagcuagauauacgaaaggaagagaaacagaucaugauugacaucuuucaucccagugucuucgugaacggugaugaacaagagguggacuacgauccugagacaacuuguuauauucgugucuacaauguuuacgugagaaugaacggguccgaaauccaguauaagauacucacccagaaagaggacgauugcgacgaaauucagugucaacuggccaucccaguaucuagccuuaauucccaguacugcgugucagcugagggaguccugcacguguggggcguuacaaccgaaaagaguaaagagguguguauuacuaucuuuaacagcucuaucaagggcuccuuguggauuccggucguggcagcccuccugcuguuccucguauuaucacugguuuuuauaugcuucuauaucaagaaaauuaauccccuuaaggagaaaagcaucauauugccuaagagucugauuucuguggucagguccgcuacacuagaaaccaaaccagagagcaaguacgugucgcucaucacgucuuaucagcccuuuucccuggaaaaagaggucgugugugaggaaccucuuucaccagccacuguucccgggaugcauaccgaggauaacccgggaaagguggaacacacagaggaacugaguagcaucacugagguagucaccacagaagagaauauuccugacgugguucccgguucccacuugaccccaaucgagcgggaaucuagcucaccucucaguuccaaccagagcgagcccggcucuauugcgcugaacucauaccauagucgcaauugcagcgaauccgaccacucuagaaacggguucgauacggacucgagcuguuuagagucccauucaagucugucugauagcgaguuuccacccaauaacaagggagaaauaaaaacugagggccaagaacucaucacagugauuaaggcaccuaccuccuucgguuaugacaaaccacacguccuuguggaucuguugguagacgauucagggaaggagagccuaaucggauacaggccgacugaagacucuaaagaguuuuccuga

SEQ ID NO: 57567 - RNA, 1014 nt, Artificial Sequence
  derived and/or modified sequence opt3 from IFNGR2__Homo_sapiens__NP_005525
augagacccacccugcucuggagccuucuguuguuacugggcguguucgccgcugcagccgcggcuccuccagacccgcuaucccagcuccccgccccucaacacccaaagaucaggcuguacaacgcagagcagguccuuucuugggaacccguugcccugucaaauaguacacggccugugguauaucaggugcaguuuaaauacacugauagcaagugguucacggcugacauuauguccauaggggucaacugcacccaaaucacagcaacugagugugauuuuaccgccgcuucuccaucggccggauuccccauggacuuuaaugugacauugcgccuccgagcggaacugggugcacugcauucagccuggguuaccaugccuugguuccagcacuaucguaacgugacugucggcccaccggagaauauugaagugacacccggggagggaagccucaucauuagauuuaguuccccuuucgauaucgcugacaccucuacggccuuuuucugcuacuauguacauuacugggagaaaggcgguauacagcagguuaaggggccauuuaggagcaacuccaucucauuagauaaucugaaacccagucggguguauugucuucaaguccaggcacaguugcuguggaacaagagcaauauuuuccgcgugggacaccuaucuaacaucuccugcuacgaaacuauggcugacgccucaaccgagcuccagcaagugauucugaucagcgucggcacauuuagucuucugucuguuuuggcgggcgccuguuucuuccucgugcugaaguacagaggguuaauaaaauauugguuucauacuccuccauccauuccccugcagaucgaagaguaccucaaggauccgacccagccuauucuugaggcacuggacaaagauagcucgcccaaggacgauguaugggacucuguguccaucaucucauucccagaaaaagagcaagaagacgucuugcagacacuauga

SEQ ID NO: 57568 - RNA, 624 nt, Artificial Sequence
  derived and/or modified sequence opt3 from IFNK__Homo_sapiens__NP_064509
augagcaccaagcccgacaugauccagaaaugccuguggcucgagauucuuaugggcauauucaucgccgggacacuguccuuggauuguaacuuacugaaugugcaccuaagaagggucacuuggcaaaaccuccggcaucugucuucaaugaguaauagcuuuccuguugaaugccuucgcgagaacauugcuuucgaacugccacaggaguuuuugcaguacacgcagccgaugaagcgagacaucaaaaaggcauucuaugaaaugucccuccaagccuuuaauauuuucucucagcacaccuuuaaauacuggaaggagcgucaucugaagcagauccagauaggacuggaucaacaggcggaguaucucaaccaguguuuagaagaggacaaaaaugaaaacgaggauaugaaggagaugaaagaaaaugagaugaagcccucggaagcuagagugccucagcugucaagccuugaguugaggcgguacuuccaccgcaucgacaacuuucugaaagaaaagaaguauagugauugcgccugggagauuguaagaguggagaucaggcggugucuauacuauuucuacaaauuuacagcacucuuccgccgaaaguga

SEQ ID NO: 57569 - RNA, 603 nt, Artificial Sequence
  derived and/or modified sequence opt3 from IFNL1__Homo_sapiens__NP_742152
auggccgcugcauggaccgugguccugguuacacucgugcuuggccuggccguagcggggcccgugccuacuagcaagccaacgaccacaggaaaagguugccacaucggcagauucaaguccuugucuccgcaggaguuagcuucauuuaaaaaggccagggacgcacuggaagagagucuaaaacucaagaacuggagcuguuccucucccgucuucccugggaauugggaucugcggcuucugcaagugcgcgaacgaccaguugccuuggaggcugaacucgcacugacucugaaggugcucgaggccgcugccggacccgcguuagaggacguccuggaucagccucuucauaccuugcaccauauucugucgcagcuacaggcaugcauacaaccacagcccacagccggcccucguccaagagguaggcuccaccauuggcugcaccggcuucaggaagcuccgaaaaaggagucagccgggugucuggaagcaagcgugaccuuuaacuuguuccgccuccugacuagagacuuaaaauacguagcugauggaaaucugugccucaggacaaguacccaccccgaguccacguga

SEQ ID NO: 57570 - RNA, 603 nt, Artificial Sequence
  derived and/or modified sequence opt3 from IFNL2__Homo_sapiens__XP_011525058
augaagcuggacaugaccggcgauugcacacccgugcucguccuuauggccgcuguucugacugugacgggggcaguaccuguggccagauugcacggagcguuaccagacgcuagggguugucauaucgcccaguucaaaagccuguccccgcaagagcuacaggcauuuaagcgggccaaagaugcucucgaagagucucugcuucugaaggacugccgcugucacucacgauuguucccccguaccugggaucucagacagcugcaggucagggaacggccuauggcacuggaggccgaacucgcuuuaacacugaaagugcuugaggccacugcggacaccgauccagcauugguugacgugcuggaucaaccccuacauacacuccaccauauucugagucaguuucgcgccugcauacagccucagccaaccgcuggccccagaacuagggggcggcuucaccacuggcuguaccgcuugcaagaggccccuaagaaggaaagcccaggaugucucgaggcauccgucacauucaaccuguuucgauuacugaccagagaccucaauugcguggcuucuggcgaucuuuguguauga

SEQ ID NO: 57571 - RNA, 591 nt, Artificial Sequence
  derived and/or modified sequence opt3 from IFNL3__Homo_sapiens__NP_742151
augaccggcgacugcaugcccgugcugguccucauggccgcuguucuuacagugacuggggcaguaccuguggccagacugaggggagcguugccagaugcucgggguugucacaucgcccaguucaagagcuuauccccgcaagagcugcaggcauuuaaacgcgccaaggacgcucuagaagagucucuccugcuuaaagauugcaagugucgaucacgucuguuccccagaacgugggacuugaggcagcuccagguccgggaacgcccuguggcacuggaggccgaacuggcucucaccuuaaaaguucuggaggccacagcggauacugacccagcacuuggcgauguguuggaccaaccccugcauacccuacaccauauucucagucagcugagagccugcauacagccucagccaacagcugggcccaggacccggggacgccuucaccauuggcugcaccgauugcaagaggccccuaagaaggaaagcccaggcugucucgaggcauccgucacuuuuaaccuguucagauuacugacaagggaucucaauugcguggcuucuggugaccuuuguguauga

SEQ ID NO: 57572 - RNA, 588 nt, Artificial Sequence
  derived and/or modified sequence opt3 from IFNW1__Homo_sapiens__NP_002168
auggcccuccuguucccccuucuggcugcauuggugaugaccagcuacuccccugucggcucuuuagggugcgaccugccacagaaccacggacuacucucaagaaauacacugguucuucugcaucaaaugaggcggaucaguccguuuuugugucucaaggaucgccgagacuuccguuuuccccaggagauggugaaggguagccagcugcagaaggcccacguaauguccgugcugcaugaaaugcuccaacagauuuucucuuuauuucacacugagagaucgucagcggcuuggaacaugacgcugcuugaucaguugcauaccggccugcaccagcaacuacagcaccucgaaacaugccugcuucaggucgugggggagggagaaagcgccggcgcaauaaguuccccugcccugacuuugaggcgguauuuccaggguauccgcguuuaccucaaagagaagaaauauucugacugugcuugggagguggucagaauggaaauuaugaaaagccuguuuuuauccaccaauaugcaagagaggcugcggucaaaggaucgcgaccucgggaguagcuga

SEQ ID NO: 57573 - RNA, 1356 nt, Artificial Sequence
  derived and/or modified sequence opt3 from IFRD1__Homo_sapiens__NP_001007246
augcccaagaacaaaaagagaaauaccccucacaggggcagcuccgccgggggagguggcucuggggcugcagccgcgacagcugccacugcaggaggccagcaucggaacgugcaaccauucucagacgaggaugccaguaucgaaacgaugagccacugcuccgguuacucugacccgucgucauuugcugaggaugggcccgaaguccuggacgaggaaggaacccaggaggaucucgaguauaaacuuaagggccugauugacuugacauuagauaaaagcgcaaagacucgccaggccgcucuggaaggcauaaagaaugcccuagcgaguaaaaugcucuacgaguucauccuggaacgacguaugacccuuacagacuccauugagagaugucugaagaaagggaagucugaugagcagagggcagccgcugccuuggcaagcguucucugcauccaacugggaccugguauugaauccgaggaaauccugaaaacccucggcccaauauuaaagaagaucauuugugacgggucagcuaguaugcaggcccggcagacuugcgcgacauguuuuggagugugcuguuucaucgccaccgaugacauuacggagcuguauagcacucuugaaugcuuggagaacaucuuuaccaaaucuuaccugaaggagaaagauacaacuguaauauguuccacccccaauacagugcuacauauuucaagccuccuggcauggacccuucuguugacgaucugcccuauuaacgaagucaagaaaaagcucgagaugcacuuccauaaacugccaaguuuacugucuugugacgacgugaauaugcgcaucgcugccggcgaaucccucgcccuucuguuugaguuggcuagagguaucgaaagcgauuucuuuuaugaggacauggagucgcuaacucagaugcugagggcacucgccacagaugggaacaagcaccgggcuaagguugacaaacgcaagcaacgaucuguguucagagauguccugagggcgguggaggaacgggacuuucccaccgaaacuauuaaauucggaccugagcguauguacauagauugcuggguaaagaaacacacauaugacaccuuuaaggaaguucuuggcuccggcaugcaguaccaucugcagucaaaugaguucuugcgcaacguguucgagcucgggccaccggucaugcuggaugcagccacguuaaagaccaugaaaaucaguagauuugaaaggcaccuguacaauagcgcugccuucaaggcacggacaaaagcccgauccaagugccgcgacaaaagagcugaugugggagaguuuuucuga

SEQ ID NO: 57574 - RNA, 3099 nt, Artificial Sequence
  derived and/or modified sequence opt3 from IFT122__Homo_sapiens__NP_001267475
auguucaacggcaucauuagcauaagaaauaagaacggggaggaaaaagugaagaucgagaggcccggagguucccugucuccuauuuggucaaucugcuggaauccaagucgggaggaacgcaacgacauucucgccgucgcugauuggggccagaaaguuagcuuuuaccaacuuuccgggaagcagaucggaaaagaccgagcacugaauuucgauccguguugcauaucuuauuuuaccaagggcgaauacaucuuguuaggugggucggacaaacaggugucacuguucacaaaagauggaguacgucuaggcacugugggcgagcagaacagcugggucuggacgugucaagccaagcccgacaguaauuaugugguuguggggugccaggauggaaccauuuccuuuuaccagcucaucuucucuacaguccacggucuguauaaagacagauacgcguauagggauagcaugacugacgugauuguacagcaucuuaucaccgagcaaaagguucggauaaaauguaaggaacuggugaagaaaauugcuaucuaccgcaacagauuggccauucagcucccugagaagauccugaucuacgaacuguauuccgaggaucucucagacaugcacuacagggucaaagagaagauuauaaagaaguuugaaugcaauuuacugguggugugugcaaaccauaucauucuuugccaggagaaacgguugcagugucugaguuucagcggcgucaaggaacgcgaguggcaaauggaaucucuaauccgauauauaaagguuauugggggaccacccggcagagagggucuccugguggggcuuaaaaauggacagauccugaagaucuuuguagauaacuuguucgccauugugcuccugaaacaggcuacagcagucaggugcuuagacauguccgccucacggaagaaacuggcugugguugacgagaaugauaccugucucguguacgacaucgauacuaaggaacuucuguuucaagagccuaacgccaauagcgucgcguggaacacacagugcgaagacauguugugcuucaguggcggcggguaucuaaacauuaaggcaucuaccuuuccagugcaccgucagaaacugcagggauucguaguugguuacaauggcuccaagauauucugucuccauguguuuagcaucucggccgucgaggugccccaaucugcuccuauguaucaguaccuggaucgcaaacuuuucaaggaagccuaccagauugcaugccugggggucacggacacugauuggagagaguuggcuauggaggcccucgaaggacuggacuuugagaccgcgaaaaaggccuucaucagggugcaggauuuacgguaucuggaacuaaucuccucaauugaggaacgaaagaaacgcggcgagacaaacaaugaccucuuucuggcagauguuuucaguuaccaagguaaguuucacgaggcugccaaacuuuauaagagaagcgggcacgaaaacuuggcucuggagauguacacugaccucuguauguucgaauaugccaaagacuuucugggcuccggagauccaaaggagaccaagaugcuuauaacaaaacaggcagacugggccaggaauaucaaggagccgaaagcugcgguggaaauguacauuucugcaggcgagcauguaaaggccaucgaaauuugcggggaucacggaugggucgacaugcugaucgauauagcucggaaauuggacaaggccgagcgcgaaccccuccuguuaugugcaaccuaucugaaaaagcuagauagcccugguuacgccgcugagacguaccucaagaugggcgaccugaaaucacuugugcaguugcauguugagacucagagaugggaugaagccuucgcacugggggagaagcacccagaauuuaaagacgauaucuauaugcccuacgcgcaauggcucgcugagaacgacagguucgaagaggcccagaaggcauuucacaaagccggacgucagcgggaggcugugcagguccuggaacaauuaacaaauaacgccguggcagagagucgauucaaugaugcugccuauuacuauuggaugcuguccaugcagugccuugacauugcgcaggacccugcccaaaaggauaccauguugggcaaguucuaccauuuucagagacucgcugaacuguaucacgguuaccaugcaauccacaggcauacugaggacccauucagcguacaccgccccgaaacacuauuuaacauuucucgguuccugcuccacucacugccgaaagauaccccuagugggaucagcaaggugaaaauacuuuuuacguuggccaagcaguccaaagcucugggcgccuacagauuagcaaggcaugcguaugacaagcuccgcggacuguacauucccgcccgauuccagaagucuaucgagcuuggcacccugacaauucgggcuaaaccauuucacgauucggaggaauugguuccucucuguuaucguugcagcacuaauaacccccugcuaaauaaccuggggaaugucuguaucaacugcagacaaccauucauauuuuccgccucaaguuacgacgugcuccaucugguggaguucuaucuugaagagggaaucaccgaugaggaagcaauuucuuugaucgaccuggaggucuuaaggcccaagcgcgaugaccggcagcucgaaauugcuaacaauagcucccagauccugagacuuguugagacaaaagauucaauaggugacgaagauccuuuuacugccaagcugagcuucgagcagggcgggucugaguuugugccagugguagucuccaggcuagugcuccgaaguaugagccgccgggacguucugauuaaaagauggccgcccccuuugagguggcaauacuuccguucucuguuaccagacgcauccaucaccaugugucccucaugcuuccagauguuucacagugaagauuaugagcuccuggugcuucagcacggaugcuguccuuacugccgccgguguaaggacgauccaggccccuga

SEQ ID NO: 57575 - RNA, 4389 nt, Artificial Sequence
  derived and/or modified sequence opt3 from IFT140__Homo_sapiens__NP_055529
auggcccuguacuaugaccaccagaucgaggcucccgaugcagccggcagcccuuccuucauuucuuggcauccagugcacccguuucucgcggucgcuuacauaucaaccacaaguacugggagcguugacaucuaucuugaacaaggagagugcgugcccgauacgcauguagaaagaccuuucaggguggccucccuguguuggcacccaacccgguuggucuuagcaguggguugggagacaggcgaaguuacuguguuuaacaagcaggacaaagagcagcauaccaugccccugacacacaccgccgauauuacuguccuacgcuggucuccuucggggaauugccuccugucaggagaccgacuuggcgugcuguugcucuggcgucuggaucagagagguaggguacaagggacaccacugcucaagcacgaguacggaaaacauuuaacccacuguaucuuccggcugcccccuccaggcgaagaccuuguucaguuggcuaaggcagccgugagcggcgaugagaaagcucuggacauguuuaacuggaagaagaguuccucugggagccuacucaaaaugggaucccaugaaggucugcuuuucuuugucucacugauggauggcacggugcacuauguggacgagaaggggaaaacuacccaggucguuagugccgauagcacaauucagauguuguucuacauggagaagcgcgaagcgcucgugguagugacugagaaucugagauuaucucuguauaccgucccgcccgaaggaaaagcagaggaagugaugaagguuaagcucuccggcaaaacagguaggcgggccgacaucgcucuuauagaggggucacuguuggugauggccgucggagaggcagcucuacgcuuuugggacaucgaacgaggcgagaacuacauucugagcccugaugaaaaguucggcuuugagaaaggggaaaauaugaacugcguguguuacugcaagguaaaaggacuccuggccgcggguaccgacagaggcaggguugccauguggcggaaggugccagauuuccuugggagucccggagcagagggcaaagaccguugggcucugcaaacgccuacugaguugcaggguaauaucacacagauucagugggggucucgcaagaaccuccuggccgucaauuccgugaucagcgucgcuauauuaucggaaagagccaugucuucccacuuucaucaacagguggcagccaugcagguuucaccaagucugcuaaacguguguuuccucagcaccggcguagcucacucccugaggacugauaugcauauuucuggagucuucgcgacaaaggacgcaguggccguuuggaauggccggcaaguggcuaucuuugagcuuagcggggccgcaauucgaucagccggaaccuucuugugcgaaacgcccguccuggcuaugcacgaggaaaacguguauaccguagagaguaaucgcgugcagguuagaacauggcaggguacugucaaacagcuccugcuuuuuagugagaccgaaggcaacccguguuuccuggauaucugcgggaacuuuuugguggugggaacagaccucgcccauuucaagagcuuugaucugucuaggcgggaggcaaaagcgcacuguucaugccgcaguuuagcugaacuggucccuggcguuggugggaucgccagccuaagaugcuccucuucgggcagcacuauuuccauacuccccucaaaggcagacaauaguccagauucuaaaaucuguuucuacgacguggagauggacaccgugacaguauuugauuucaagaccggacaaauugacaggcgugagacucugagcuuuaacgaacaggagacgaauaagucccaccuuuucgucgaugaaggcuugaaaaacuaugugccuguuaaucauuuuugggaccagucagagccccggcuguucgugugcgaagccguccaggagacaccacgaagccaaccccagucugcuaacgggcagccucaggaugguagagccggaccagcagcugacgugcucauccuguccuucuuuauaagugaggaacacggcuucuuacugcaugagagcuuuccgaggcccgccaccucucacucccuuuuggggauggaaguuccuuacuauuacuucacucgcaagccagaggaagcggaucgggaggacgagguggaacccggaugucaccauauuccucaaaugguaucaagaaggccacuccgcgauuuugucggccuggaggacugcgauaaagccacccgagacgcuaugcuacacuucuccuuuuucgugacaaucggugauauggacgaagcauuuaagagcaucaaacugauuaagucggaggccgugugggaaaauauggcucggaugugugucaagacccagcgucucgacguugccaaagugugccuggggaacaugggccaugcaagaggagcgagggcccuucgcgaggcugagcaggaacccgaguuggaagcccggguagcagugcuggcuacucaguuaggcaugcucgaggaugccgagcaacuguauagaaaguguaaaaggcacgaccuucugaauaaguucuaccaggcagccgggcgauggcaggaagcguugcaagucgcggagcaucacgaucgcgugcaccuccgguccacauaccauagauaugccggacaccuggaagcaucugcugacugcagcagggcccuaucauacuaugagaaaagugauacgcaucguuuugaaguuccgcgcaugcuguccgaggaccucccuucucuggagcuuuacgugaacaagaugaaggauaaaaccuuguggcgguggugggcccaguaucuggaaagccagggcgagauggacgcugcauuacacuacuaugaacucgccagagaucauuucucccuggucaggauccacuguuuucaggguaaugugcaaaaggcggcucagauugccaacgagacugggaaucuugcagccucauaccaccuggcucgacaguacgaaagccaggaggagguuggacaagcagugcauuucuauacacgggcccaggcguucaaaaacgcuauacgccuaugcaaggaaaauggccucgacgaucagcugaugaacuuggcccuguuaaguucuccagaggacaugaucgaagcagccagauacuaugaggaaaaagguguccagauggauagggcuguaaugcucuaccacaaggccggccauuuuuccaaagcacuggagcuugcuuucgccacccaacaguuuguggcgcugcaguugauugccgaggaccucgacgaaacaagcgaucccgcacugcuagcucgguguucggacuucuuuaucgagcacucacaauaugaacgagccguugagcugcuucucgcugcaagaaaguaccaggaggcccugcaguugugccuggggcagaauaugucuaucacugaagagauggccgaaaagaugaccguggcuaaagauaguuccgacuuaccugaggaaagccgcagggagcuccuggagcaaauugcggauugcuguaugcgucagggaucuuaucaccuugcaacgaagaaauacacccaggccggcaacaagcugaaagcuaugcgggccuugcucaagagcggggacacagaaaagauaacuuucuuugcauccgucucaagacagaaagagaucuacauuauggccgcuaacuaucugcaaagucuagauuggaggaaggaacccgagaucaugaaaaauauuaucggauucuacaccaagggccgcgcgcuggaccuucucgccgguuuuuaugaugcaugcgcucagguggaaauagacgaguaccagaacuaugauaaagcccauggggcacugacagaggccuacaaguguuuggcuaaggccaaagcuaagagcccauuagaccaggaaacucgacuggcacaacuccagucuagaauggcccugguaaaacgguucauccaggcuaggcgcaccuauacggaggacccuaaggaauccauuaaacagugcgagcuucuguuggaggaacccgaucuagacucaacaauccguauuggagauguguacggcuuucuggucgagcacuacguuagaaaggaagaguaucaaaccgccuaccgguuccucgaagagaugaggcgccgacugccacuugcuaauaugaguuauuacgugagcccgcaggcaguggacgccguccauagagguuuaggccugccucucccccggacugugccagagcagguuaggcacaacuccauggaagaugcucgcgaguuggacgaagagguaguggaagaggccgaugacgaucccuga

SEQ ID NO: 57576 - RNA, 5250 nt, Artificial Sequence
  derived and/or modified sequence opt3 from IFT172__Homo_sapiens__NP_056477
augcaccugaagcaucucagaacccuucugagcccccaggacggcgccgcuaaagugacaugcauggcauggucccaaaacaaugccaaguucgcggucuguacuguugauagggugguauuguuauacgacgagcacggggaacggcgcgauaaauuuucuacgaagccugcugacaugaaauauggacgaaagucauacauggugaaggguauggccuucaguccagauagcaccaaaaucgcaauuggccagacagacaacauaaucuaugucuacaagauuggggaggauuggggagacaaaaaggugaucugcaauaaauuuauucagacuuccgccguuaccugucugcaguggccggcugaauauaucauaguguucggccuagcagaggguaagguccgucucgccaacacaaagaccaauaaaucuucgacuaucuacgggacagaaucauaugugguaagccugaccacgaacugcaguggaaagggcauucuuuccggccaugcugaugggacuaucguuagauacuuuuucgacgaugagggaucuggugagagccaaggcaaacuggugaaucaccccuguccuccauacgccuuggcgugggcaaccaacuccauugucgccgcugggugcgacaggaagaucguggccuauggaaaagaaggccauaugcuccagacauuugauuacucacgggacccccaggagcgcgaauucacuaccgcagugaguagcccuggugggcagucugucguucugggauccuaugacagacugaggguguuuaauuggauaccacggcgcucaauuugggaggaggcuaagcccaaagaaaucacaaaccucuacaccauuacggccuuagcguggaagcgagauggcagcagacuguguguaggcacucuuugcgggggaguggagcaauucgacuguugcuugaggcggaguaucuauaagaauaaauuugaacugacauacgucgguccuucucaggugaucguuaagaaccuauccagcggcacccgugugguccucaaaucgcacuauggguacgagguggaagagguaaagauucugggaaaagagcgcuaccuuguugcccacacuucugaaacacuguugcucggcgaucugaauaccaacagauuauccgagauagcauggcaggguucagggggcaaugaaaaguauuucuuugagaacgaaaacguguguaugaucuucaaugcuggagagcugacgcucgucgaguacggcaacaaugacacccuugggagugugaggacagaauucaugaacccacaucugauuagcguccggaucaaugagcgaugccagcgcggaacugaagauaacaagaaauuggccuaucuaauagacauuaagaccaucgcuaucguggaucugauugguggcuacaauaucgggacaguuucccacgagucuagaguggacuggcucgaacugaacgagacuggacauaaacuucuguuuagggaucggaaguugcgccuccaccuguaugacauugagagcugcucaaaaaccaugauauuaaauuucuguaguuacaugcaauggguaccgggcuccgauguccugguggcccagaacagaaauagccuaugcguuugguauaacaucgaagcacccgagagggugacaauguuuaccauucguggugacgucaucgggcucgaacggggcggaggcaagacugaggugaugguaauggagggggugacgacaguugccuacacccuggacgaaggacuuaucgaguucgguacugcuauugaugacggcaauuacauacgagcgaccgcauuuuuggaaacacuggagaugaccccugaaacugaggccauguggaagacacucucuaaacuggcucuugaggccagacagcugcacaucgcagaaagguguuucucagccuuggggcaagucgcuaaggcccgcuuucuccaugagacgaacgaaauugcagaucaggugagucgggaguauggaggcgaagguaccgacuucuaccaggugagagcgaggcuggcuauguuagagaaaaauuauaagcuggccgagaugaucuuucuagaacagaacgcagucgaggaagccauggggauguaccaagagcuccaccgcugggaugaaugcauugcuguugccgaggcaaaaggccauccagcucuggagaagcuucgacggagcuauuaccagugguugauggacacucagcaggaagagcgugccggagaacugcaagagucccagggcgaugggcucgcggccaucucucuguauuuaaaggcuggacugcccgcaaaagccgcuagacuuguguugacaagggaggaacuccuggccaacaccgagcuaguggaacacauaacagcagcgcugaucaagggcgagcucuacgaacgcgccggugaccuguucgagaaaauucauaauccucagaaggcucuugaguguuaccggaaagggaacgccuuuaugaaggcaguagaauuggcuagacuggccuucccagucgaggugguuaaauuagaagaggcauggggagaucaccucgugcagcaaaagcagcuggacgccgcuaucaaucacuauauugaagcgaggugcucgaucaaggccauagaggcagcucuuggcgcccgacaguggaaaaaggccauuuacauccuggauuugcaggaccgcaacacugcuagcaaauauuacccccucgucgcacaacauuaugccucccugcaggaguacgaaauugcggaggaacuauauaccaagggugaucggacgaaagacgcuaucgacauguacacccaggccggcagaugggagcaagcacacaagcuggccaugaaguguaugaggccggaagaugugucaguucucuacauaacacaggcucaggagauggagaaacaggggaaguaucgugaagcagagcgccuguacgugacuguacaagaaccugaccuugccaucaccauguauaaaaagcauaaauuguacgaugacaugauucggcuggucggaaagcaccaccccgauuuacucagugacacacaucugcaccuuggcaaggagcuggaggcggaagggagacuacaggaggcugaauaucauuaccucgaggcccaggaauggaaagcaacugugaauauguauagggccucuggacugugggaggaggcuuaccgaguggcccggacccagggcggugcaaacgcucacaagcaugucgccuacuugugggcgaaaagccuggggggagaagccgcaguucgcuuacucaauaagcugggccuucuggaggcugccguggaucacgcugcagacaacugcuccuuugaauucgccuucgaguugucaagacucgcccugaaacacaagacgccagaaguacaucuaaaguaugcuauguuucuggaggaugaggguaaauucgaagaggcggaagcagaguuuaucagggccggcaagccuaaagaagcugugcuuauguucguccacaaucaagacugggaggccgcacagcggguggccgaggcucaugaucccgacagcguugcggaagugcucgucgggcaggcccgaggagcacuggaggaaaaggauuuucagaaagcugagggcuugcuguuaagagcccaacgcccagggcucgcacugaacuacuauaaggaggccggacuuuggucugacgcucugaggauuuguaaagacuacgugcccucccaguuggaagcccuccaggaggaauaugagcgugaagcgacaaagaagggcgcacgggguguugagggguucguggagcaagccagacacugggaacaggcuggagaguacaguagggccgucgauugcuaucugaaaguacgcgacagcggcaauucuggucuagcugaaaaguguuggaugaaagcagccgagcuguccaucaaguuucuuccuccacagcgaaacauggaagugguucucgcugugggcccgcagcugauagggauuggaaaacauucagccgcagcggaguuguacuuaaaucuggaucucgucaaggaggccaucgacgcuuucaucgaaggcgaggaauggaacaaggccaaaagaguggcaaaggagcuggauccccgguacgaagacuauguagaucaacacuacaaagaguuucuuaagaaucaggggaaaguggacagucuggucggaguugaugugauugcugccuuggaccuauauguggagcagggccagugggauaagugcaucgaaaccgcaacuaagcaaaacuacaaaauucugcacaaguaugucgcccucuacgcuacacaucugauaagggaggguagcucggcgcaggcccuugcauuauaugugcagcacggggcuccugccaacccacagaauuucaacaucuacaaacgcauuuuuaccgacaugguuuccucucccggaacuaauugcgccgaagcauaccauagcugggcugaccugcgugauguacucuucaacuugugugagaaucuggugaagucaagugaggccaacuccccugcgcacgaagaguuuaaaaccaugcuccugaucgcucacuauuacgccacaagaucugcagcccaaagcgucaagcagcuugaaacgguggcugcacggcuguccguuucauugcuaaggcauacccagcugcucccaguggacaaggccuucuaugaggcgggcauugcugccaaagcagucggcugggauaauauggccuucaucuuuuuaaaccgcuuccuggaccuuacugaugcuauagaagaggggacacuggacggacucgaucacagcgacuuucaggauaccgacauccccuucgaggugccguugccugccaagcaacauguaccagaagcagagcgagaagaggucagagauugggugcugacaguuaguauggaccagcggcucgaacaggugcugcccagggaugagcgcggugcuuacgaggccucucuugucgcggccuccacuggcgugagagcacuaccuugccugauuaccggguaucccaucuugaggaauaaaauugaauuuaagcggccaggaaaagcugccaacaaggacaauuggaacaaguucuuaauggcaaucaaaacgagccacucgccuguuugucaagacgugcugaaguuuauaucacaguggugcggcggucuccccucuacaaguuucuccuuucaguga

SEQ ID NO: 57577 - RNA, 561 nt, Artificial Sequence
  derived and/or modified sequence opt3 from IFT27__Homo_sapiens__NP_001171172
auggugaagcuggccgcuaaaugcauccucgcaggcgaccccgccgucgggaagaccgcgcuugcucagauuuucagaagcgauggagcccacuuucaaaaauccuacacacugacuacggguauggacuugguugugaagaccguaccugugccagauacaggcgacucugucgaguuauucauauuugauucagcagggaaagaacuguucagugagaugcuagacaagcucugggaaagcccgaacgugcugugucuuguuuaugaugugacuaaugaggaauccuuuaacaauugcucuaaguggcuggagaaagccaggucgcaggcucccggaaucucauugccuggcguccucguggguaacaagaccgaccuggcagggcggcgcgccguagauagcgcugaggcccgagcgugggcacugggacagggccucgaauguuucgagacaaguguuaaagaaauggagaauuuugaggccccauuccauugcuuagcuaagcaguuucaccaacuguaccgugaaaaaguggaggucuucagagcccuugcauga

SEQ ID NO: 57578 - RNA, 627 nt, Artificial Sequence
  derived and/or modified sequence opt3 from IFT43__Homo_sapiens__NP_001096034
auggaggaccugcucgaucuugacgaggaacugagauacagcuuggccaccuccagggcuaagaugggccggcgcgcacagcaagaaucugcccaggcggagaaccacuuaaaugggaaaaacucaagucugacacuaacuggagaaacgagcuccgcuaagcucccccgaugccgucaggguggcugggccggggauucugugaaagcaucgaaguucagaaggaaagccucagaggagaucgaagacuuucggcugcgcccucagagccuuaauggaagugauuauggcggugacauuccaauaaucccggaucuggaggaaguccaagaggaggacuucguucuccagguggcugcacccccuuccauucagaucaagagaguaaugaccuacagggauuuggacaacgaucugaugaaguauucugccauucagacacuggacggggaaaucgaucucaaauuacugacuaaggugcuugcuccagagcaugaaguccgggaggacgacgugggaugggauugggaccacuuguuuaccgaaguuagcuccgaggugcugacagagugggauccccuacaaaccgaaaaagaggacccugccggccaggcgcgccauacuuga

SEQ ID NO: 57579 - RNA, 1290 nt, Artificial Sequence
  derived and/or modified sequence opt3 from IFT57__Homo_sapiens__NP_060480
augaccgccgcucuggcaguggucacaacuagcggccucgaggacgggguucccagauccaggggagaagguacgggcgaggugguacuugaacgggggccuggagccgcguaccacauguucguggucauggaggaucugguggaaaaguugaaauuacugcgcuaugaggaggaauuucuacgaaagucuaaccucaaagcuccaucacgucauuacuucgcccugccgaccaaucccggcgagcaguuuuauauguucugcacacuugcagccuggcugaucaacaaggcugguagaccuuuugaacaaccacaggaguacgacgaucccaaugcaacuauuaguaacauauugagcgagcucagguccuucgggcggaccgccgacuuuccuccaucuaaacugaagucgggauauggcgaacacguuuguuacgugcuggauugcuucgcugaggaagcccucaaguauaucggcuuuacauggaaacgccccauuuacccugucgaggaauuagaggaggaaucaguggcggaggacgaugcagaacugacccuuaauaagguagacgaggaguucguugaggaggaaacugauaacgaggaaaauuuuaucgacuugaacgugcugaaagcccagacauaccaucuagauaugaaugagaccgcuaagcaggaagacauucucgagagcacgacugaugccgcagaguggagucuggaagucgagagagugcuuccacaacugaaagugaccaucaggacagacaacaaggacuggcggauacacgucgaucagaugcaucagcaccgcuccgggaucgaaucugcuuugaaggagacuaaaggauuccucgacaagcugcacaaugagauuacccgaacauuagagaaaaucagcuccagagaaaaguauauuaacaaucagcuggaaaaccucguucaagaguacagggccgcgcaggcccagcuuucagaagcaaaagagcgguaucagcaagguaauggcggggugaccgagcguacgcgccuguugagugaaguaauggaggaacuagagaaggugaaacaggaaauggaggagaagggaagcucuaugacugauggcgcuccgcuggucaagaucaaacagucccucacaaagcugaaacaagaaaccguggagauggacauaagaauugguaucguugaacauacucuucugcagucaaaguugaaagaaaagagcaacaugacaaggaacaugcacgccaccgugauucccgaaccugcuacgggguuuuacuga

SEQ ID NO: 57580 - RNA, 1803 nt, Artificial Sequence
  derived and/or modified sequence opt3 from IFT74__Homo_sapiens__NP_001092693
auggccagcaaccacaaguccucugcugcaagacccgugucaaggggcggggucggacugaccggucggccuccaaguggcauccgcccgcucagcgggaauauucgaguugccacagcgaugcccccuggaacugcucguccaggcuccagagguugccccauagggacgggaggcgugcuuucuucgcagaucaaaguagcccauaggccugugacccaacagggccugacagggaugaagacuggaaccaaagguccacagcggcagauuuuggacaagucauacuauuuaggccugcuacgcagcaaaaucagugagcucacaaccgaagucaacaagcugcaaaaggggauugagauguacaaucaggaaaacuccguguaucuuucuuacgagaaaagagcagaaacucuggccguugagaucaaggaguugcagggacagcucgcugauuauaauaugcugguggacaaacugaacacaaauaccgaaauggaggaagucaugaacgauuacaauaugcucaaggcacaaaacgacagggagacgcagagcuuagaugugauauucacugagcggcaggccaaagaaaagcagauccgcuccguagaggaagagauugaacaagagaagcaggcuaccgacgauaucauuaaaaauaugucauuugagaaccagguuaaguaucuggaaaugaaaacaacuaaugagaaacuuuugcaagaacuggacacccuacagcagcagcucgauagucaaaacaugaaaaaggagagccuggaagccgagaucgcgcacucucaggugaaacaggaggcaguccuucugcaugaaaaguuguacgagcucgaaucccaccgagaccagaugauagccgaggauaagucaauuggcagccccauggaagagagagagaaacuguuaaagcaaaucaaagacgauaaucaggaaauugcuaguauggagaggcagcugacagacaccaaggaaaagaucaaccaguucaucgaggagauucggcaacucgacauggaucuugaagaacaucagggugaaaugaaccagaaguacaaggagcugaaaaagcgugaagaacacauggacacguuuauagagacuuucgaagagaccaaaaaucaggaauugaagcgcaaagcccaaaucgaggcaaacauuguggcucuacuggaacacuguucuagaaauaucaacaggauagagcagauuuccagcaucacaaaucaggagcucaagaugaugcaagaugaccugaacuuuaagucgacugaagugcagaaaucucaguccacagcccagaaucuuaccucagauauccaacggcugcaguuggaccuccagaagauggagcuguuagaaaguaaaaugacggaggaacagcauagccugaaguccaaaauuaagcaaaugaccacagaucuagagaucuauaacgaccucccugcgcugaagucuagcggggaggagaaaauuaagaaacuucaccaggagcgaaugauauugucaacucaucgcaaugccuucaagaaaaucauggaaaagcagaacauugaguacgaggcacugaaaacccagcuccaagaaaaugagacacacagucagcugacuaaccuugaaagaaaguggcagcaccuggagcaaaauaacuuugcuaugaaggaguucaucgccaccaaaucccaggagagcgauuaucagccaaucaagaaaaaugucacaaagcagauugcugaguacaacaaaaccauaguugacgccuugcauucuacuucaggaaacuga

SEQ ID NO: 57581 - RNA, 1923 nt, Artificial Sequence
  derived and/or modified sequence opt3 from IFT80__Homo_sapiens__NP_001177171
augcugagaagcacccucgcccagcaaggcacacccguguacuccgucgcuugggggccugacucugagaagguucuuuauacugcaggaaaacagcugaucauuaagccauugcagccgaacgccaaaguguuacaguggaaggcgcacgaugguauaauccugaaaguagacuggaauagcgugaacgaucuaauucucagugcuggcgaagacugcaaguacaaggucugggauagcuaugggaggccccuguacaauucccaaccucaugagcacccaaucacgucuguggccugggcacccgacggagaacuuuucgccguuggcucguuucauacccugcgguugugugauaaaacagguuggucauaugcucucgagaagccuaacacugggagcauuuucaauaucgcauggaguauagacggaacccagaucgccggcgcuugcggcaacgggcacguggucuuugcccaugugguagaacagcacugggaguggaaaaauuuccagguuacacugaccaagcgccgagcgaugcaagugcguaacguccugaaugaugcaguggaccucuuagaguuuagagauagggugauuaaagccucccugaacuacgcucaccuugucguuucuacuagcuugcaguguuauguguucuccacaaagaauuggaacaccccaaucauuuuugaccugaaggaaggaacgguaucacuaauccuccaggccgagcggcauuuccugcuuguggaugguaguagcauauaccuguacucuuaugaaggccgcuuuauuuccucacccaaauucccugggaugagaacugacaucuugaaugcacagaccgucagccucaguaacgacacaauugcuaucagggauaaggccgacgagaaaaucauuuuucuguucgaggcgucuacuggaaagccauuaggcgaugguaaauuucugucccacaagaaugaaauacucgagaucgcccuugaccaaaaagggcugaccaacgaucggaagauugcauucaucgacaagaaccgcgauuugugcauaacaagcgugaaacgauucggaaaggaggaacagauuaucaaacuaggcaccaugguucauacgcuggcuuggaaugacacuuguaacauccucugcggccugcaggauacaagauuuauugugugguacuauccgaauaccgucuacguggacagggauauccuucccaagacucuguaugaacgggacgccucggaguucucuaaaaacccucacauuguauccuuuguugggaaucaagugacaauacgucgcgcugacggaucauugguccacaucaguauuaccccauaccccgccauccuccaugaguaugugagcuccucuaagugggaagaugcagucagacuguguagguucgugaaggagcagacgaugugggccugcuuagcugcgauggcaguugccaaccgggacaugaccacagcugaaaucgccuacgcagccauuggugagauagauaaagugcaguacaucaauagcauuaagaaccugccuucaaaagaaaguaagauggcucacauccuacucuuuuccggcaauauucaggaggccgagaucguacugcuucaagcaggguuggucuaucaggcgauacagaucaacauuaaucuguacaacugggaacgagcucucgagcuggccgugaaauauaagacucauguugacaccgugcuugcauaccgccagaaguuccuggaaacauuuggaaaacaagagacuaauaagagauauuugcacuacgccgaaggccuccagaucgauugggagaaaauuaaggcuaaaaucgagauggaaauaaccaaggagagggaacagucaucuucaagucagagcuccaagucuauuggucugaaaccauga

SEQ ID NO: 57582 - RNA, 2646 nt, Artificial Sequence
  derived and/or modified sequence opt3 from IFT88__Homo_sapiens__XP_005266603
augaagguggagagcggcaugaaaaucaagguccacaacaaugccgaauccgagaccgcuguuggguuccuggaaguggaccagggaugccccauuuuugguuucccuggcccacauagaaagaagaacugucucgggccgcacaugaaauuuacaaauacuaagguacaaaugaugcagaacgugcaucuugcacccgagacggaugaagacgaucuguacucuggauauaaugacuacaacccuauauaugauaucgaggaguuggaaaaugacgccgcguuccagcaggcugucaggaccucacacggccggcgcccacccauuacagccaagaucaguagcacugcagugacccgaccuauugccacagguuacggguccaaaaccucuuuagcuucgucaaucggacguccaaugacuggcgcaauacaagauggcguuacaagacccaugaccgccgugagggcugccggguuuacgaaggcggcacugcggggaagcgccuucgacccucuaagucagucccgcgguccagcuucuccgcucgaggccaaaaagaaagauagccccgaagagaagaucaagcagcuggagaaagaagucaacgagcuuguggaagaguccugcauugcaaauucauguggcgaccugaaguuggcucucgaaaaagccaaggaugcggggagaaaagagaggguacugguucggcagcgcgagcaagugacuaccccugaaaacaucaaucuggaccucacauauagugucuuauuuaaccuggccagccaguacucugugaaugagauguaugcagaagcucuuaacacuuaccaggugauugucaagaauaaaauguucuccaacgccggaaucuugaagaugaacaugggcaauauauaccugaagcagcgaaacuauucaaaagcuauuaaguuuuacagaauggcccuagaucaaguuccaagcgugaauaaacagaugaggaucaagauuaugcagaacaucgguguaaccuucauccaagcagggcaguauagugacgccauuaauucuuacgagcauauaauguccauggcucccaaccucaaagcgggauauaaucugacaaucugcuacuuugcaauuggcgaccgggaaaagaugaagaaagccuuccagaaacuuaucaccgugccucuggagauagaugaggacaaauauauuagcccaucggaugacccccacacgaacuuggucacugaagcuaucaagaaugaucaccuccgucagauggagcgcgaaagaaaagccauggcagagaaguacaucaugacaucugccaagcugauugcuccggugaucgaaaccuccuuugccgcaggcuacgacugguguguugagguggucaaagcgucacaauauguggaguuagcuaacgaucuggaaauuaauaaggccguaacuuaccucaggcagaaagacuauaaccaggcaguugagauacuuaaggugcuggagaaaaaggauagucgggucaagagcgccgcugccacaaauuuguccgcacuauacuauauggggaaagacuucgcucaggccucuagcuacgcggauaucgccgugaacucagaccgauauaauccugcugcacugaccaacaagggaaacacggucuucgccaauggugacuacgagaaagcugccgaguuuuacaaggaagcacuccgcaacgauaguuccugcaccgaggcgcuguauaauauuggccuuacauacgaaaaacugaacagauuggacgaggcccucgauuguuuccugaaguuacaugcuauccugaggaauagcgccgaagugcuauaucaaaucgcaaacauuuacgagcucauggagaaucccucucaggcuauagaauggcugaugcagguugugucaguaaucccaacugacccucagguccuuaguaaauugggggagcuguaugaucgggaaggagacaagagccaagccuuucaguacuauuacgaguccuaccgcuauuuccccugcaacauugaagugaucgaguggcucggcgcauacuauauugauacccaguuuugggagaaggccauccaguacuucgaaagagcuucucugauacaaccaacacagguuaaauggcagcuuaugguggcgucguguuuuaggcguagcgguaauuaucaaaaggcccuggacacuuacaaagauacccaccggaaguuccccgagaacgucgaaugcuugcgauuucucgugagacuguguacagacuuagggcugaaagaugcacaggaguaugcuaggaagcuaaagcgccucgagaaaaugaaggaaauccgggagcagagaauuaaauccggcagggacggaucaggcgggagucgcggaaagcgagaagguucugccagcggcgauuccgggcagaauuacucagccagcucuaaaggagagcggcuguccgcucgucuuagagcauugccuggcaccaacgaaccauacgagaguagcucuaauaaggagaucgacgccuccuauguagacccgcuggguccccaaauugaaaggccuaagacugcggcuaaaaagcgcaucgaugaggacgauuucgccgacgaagaacucggggaugaccuguuaccagaauga

SEQ ID NO: 57583 - RNA, 1020 nt, Artificial Sequence
  derived and/or modified sequence opt3 from IGBP1__Homo_sapiens__NP_001542
auggccgcugaggacgaacugcagcuccccagacuuccugagcuguucgaaaccggcaggcaauuguuagaugagguggaagucgcaacagagccagccgggagccggaucguucaggagaagguguucaaaggacuggaccuacucgaaaaggcggcugagaugcugucccagcuugaucuguucucucgcaacgaagacuuggaggagauugccucaacugaucucaaauaccugcugguaccggcauuucagggugcccucacgaugaagcaagugaaucccaguaaacgauuagaccaucugcagcgugcuagagaacacuucauaaacuaucuuacccagugccacuguuaccaugucgcagaguuugaauugccuaagacaaugaauaacagcgccgagaaucacacugcuaacuccucuauggccuauccaucgcugguggcgauggcaucacagaggcaagccaagauccagcgguacaaacagaagaaagaacuagagcaucgccucagcgcuaugaagagugccguugaguccggccaggcagaugacgaaagagugagggaguauuaccugcuucaucugcaacgguggauugauaucucuuuggaagagauugaaagcaucgaccaggagauaaaaauccuccgcgagcgagauuccucaagagaagcuaguaccagcaauucuuccaggcaggagcggcccccugucaagccauucauucugacacguaacauggcccaagcgaagguguuuggggccggauaucccucauuaccuaccaugacuguaagcgacugguacgaacagcaccgcaaauacggcgcacugccagaucaggguaucgcuaaggccgcuccggaggaauuuagaaaagccgcacagcaacaggaggagcaggaagagaaggaagaggaggacgacgaacagacacuccacagggcccgggagugggaugacuggaaagauacccacccccgaggguauggaaaucgccaaaacaugggcuga

SEQ ID NO: 57584 - RNA, 2445 nt, Artificial Sequence
  derived and/or modified sequence opt3 from IGDCC3__Homo_sapiens__NP_004875
auggccgugcagagagcugcaagccccaggcggccuccagccccgcuguggccccgccuccuucugccuuuguuacugcuacuccugccagcgcccuccgagggccuugggcacucugcugaacuggccuucgcagucgagccuucagacgauguugccgugccaggacaacccaucguauuggacugccgaguggaagguaccccuccaguccguauuacauggagaaagaacggcguggagcucccggaaaguacucauagcacgcugcuggcuaaugggucccucaugauaaggcacuuccgguuagagcccggaggcucuccuucggaugagggugacuacgaauguguugcacagaaccgcuucgggcugguggucucaagaaaagccaggauccaggcugccaccaugagcgauuuucaugugcacccacaggcgacaguaggagaggaaggcggcguugcacgguuccaaugccagauucaugggcuucccaagccuuugaucacuugggagaaaaaucgcgugccaauugacaccgauaacgagcgauauacacugcuacccaagggaguccuccagaucaccggucugagagccgaagacggcgggauauuucacuguguggcuaguaauaucgccuccauuaggaucucucacggagcacggcuuacugugagcggcuccgguucaggggcuuacaaagagccggccauucuggucggaccugaaaacuugacacucaccguucaucagacggcggugcuggagugcguagccacuggcaauccccguccaaucgugaguuggagccgcuuagauggcagaccuauaggggucgaagguauucaagugcugggaaccggcaaccucaucauuucugacguuacagugcagcacuccggggucuaugugugugcagcuaauaggcccggaacucggguacgacgcaccgcccagggcagacuuguugugcaggcuccagccgaguucguccaacauccccagucaaucagcaggccugcagguacaaccgccauguuuacgugccaggcucaaggggagccaccgccccacgugacuuggcugaagaacggccaggucuugggaccuggcgggcacgugcggcuaaagaauaacaauaguacacugaccaucucuggaauugguccagaagaugaggcgauauaccaguguguugcagaaaacuccgccggcagcucgcaggcuucugcccgccucacugugcugugggcagaggggcuucccggaccuccaagaaauguaagggccgucuccgugucaaguacagaaguucgugugagcugguccgagccccuggcuaacaccaaagagaucauuggcuaugucuugcauauccggaaggccgcagacccgccugaacucgaguaccaagaagcggugucuaaaagcacguuccagcaccugguaucagauuuagagccaaguaccgcuuauuccuuuuacauaaaggccuacacaccccgaggugcaagcucugccucagugccuacucuggcuaguacccuaggggaagcccccgcaccaccuccccucagcguuagaguccugggcuccucuucgcuucaguugcugugggagccauggccgaggcucgcucagcaugagggaggcuucaaacuguuuuaucgcccugccagcaagacauccuucacugggcccauucuucugccaggaaccgugucaaguuacaacuugucucaacucgaccccacagcgguguaugaagucaagcuguuagccuacaaucagcacggugacggcaacgcuaccguucgguuugugagccugagaggggcauccgagaggacugcccuaucaccuccaugcgauugucgcaaagaagaggcugccaaucagacgagcacaaccggaaucgugaucggcauucauaucgguguaacuugcauuauauucuguguccucuuccugcuuuuugggcagcgaggccggguguugcugugcaaggacguugagaaccaacucucucccccucagggaccgcguucccagagagauccaggcauccuggcauuaaauggggcgaggcgcggacagcggggccaacuggguagagacgagaaaaggguggauaugaaggaacuugaacaguuguuucccccugccagugcugccgggcagccagacccccgaccuacccaagauccggcagcucccgccccaugcgaggaaacacagcucagcguccugccucuacagggauguggccugauggaggguaaaaccacugaggcaaagacaacggaagccaccgcucccugcgcgggccucgccgcagcuccaccucccccagacgggggaccgggccugcuuucugaggggcaggccucccgcccugccgcugcacgggugacucaacccgcccacucagaacaguga

SEQ ID NO: 57585 - RNA, 462 nt, Artificial Sequence
  derived and/or modified sequence opt3 from IGF1__Homo_sapiens__NP_000609
augggcaagaucagcucccugcccacccaacucuucaaaugcuguuuuugcgacuuccuuaaggugaaaaugcacacaaugucuucaagucaucuguuuuacuuggccuuaugucugcuaacuuucacgagcuccgcuaccgcagggccugagacacucugcggagccgaacuggucgaugcgcuucaguuuguuuguggugacagaggcuucuauuuuaacaagccaacuggguacggaucuucgucaaggcgggcuccgcagaccggcauuguggaugagugcuguuuccgcagcugcgaccugcgacguuuggaaauguauugugcaccccucaaaccugccaagagugccagauccguaagggcucagcggcacacagauaugccaaagacccagaaagaggugcaucugaagaaugcaucucgcgguagcgccgggaacaaaaauuacagaauguga

SEQ ID NO: 57586 - RNA, 4104 nt, Artificial Sequence
  derived and/or modified sequence opt3 from IGF1R__Homo_sapiens__NP_000866
augaaaagcggcuccgggggagguucucccaccucacuguggggccuccuuuuccugagugccgcuuugagcuuauggccuacauccggggagaucugcggaccaggcauugacauaagaaacgauuaccagcaacugaagaggcuagaaaauuguacugugaucgaggguuaucuccacauucugcuuaucucuaaggcagaagacuaccggucguaucgcuuuccgaaacugacggucauuaccgaguacuugcuccuguuccgaguugccgggcuggaaucacucggagauuuauuucccaaccugacagugauccguggcuggaaacuuuucuauaauuacgcguugguaauauuugagaugacuaaccugaaggacaucggccuauauaaucucagaaacauuacccgcggggcuauccggauugagaagaaugccgaucugugcuaccuuagcacaguggacuggagucugaucuuggaugcagucuccaacaauuacauagugggaaacaagccuccaaaagaauguggugaccucugccccggcaccauggaggaaaagccuaugugugagaaaacuacaauuaauaacgaguauaauuaccgcugcuggaccacgaacagaugucagaagaugugcccaucuacuugugggaaaagggccugcaccgaaaauaacgaguguugccaucccgaaugccugggaagcuguuccgcuccugauaacgacacagcaugcguugccugucggcacuauuacuaugcuggcgugugcgucccagccuguccgcccaauacuuaccgcuucgaggguuggcgaugcguggauagagacuuuugugcgaacaucuuaucagcagaaaguagcgauucugagggguucguaauucaugacggagagugcaugcaggaauguccuuccggcuuuaucaggaauggcucacagagcauguauugcaucccaugugaggggcccugcccuaagguuugcgaagaggaaaagaaaaccaagacaauugacagugugaccucugcccaaaugcugcagggauguacgauauucaaagguaaccuccuuaucaauauucggcguggcaacaauaucgcuuccgagcuggagaacuuuaugggguugauagaagucgugacuggauacgugaagauucgccacagccaugcccuagucucgcugucuuuccucaaaaaucugagacuuauccugggcgaggaacaguuggaggguaacuacuccuuuuauguucucgauaaucagaaccugcaacaguuaugggacugggaucacaggaaucugacaaucaaggcagggaaaauguacuucgcuuucaacccaaagcuaugcgugucagaaauuuaucggauggaggagguaaccggcacuaagggacgacagaguaaaggcgacaucaauacacgcaacaacggggaaagagccagcugugaguccgaugugcuccacuuuaccucuacgaccacaagcaagaauaggauuauaaucacuuggcaucgguacaggcccccggacuauagagaucugauuucauucaccgucuacuauaaagaagcgccuuuuaagaacgugacagaguacgacggacaggaugccugcgguaguaauuccuggaacaugguugacguggaucuucccccaaauaaagacgucgagccuggcaucuugcugcacgggcucaagcccuggacucaauacgcaguguauguaaaggcuguuacccugacaaugguggaaaacgaccauaucaggggagccaaaagcgagauucuuuacauacguaccaaugcuucugucccaucaaucccccuggauguguugagugccagcaacuccucuucgcagcucauugucaaguggaauccuccaagccugccgaacggcaauuuauccuauuacaucgugcgguggcagcgacaaccccaggacgguuaucuguacagacacaacuauuguucaaaagauaagauuccuaucaggaaauacgcagacgggacuauagauaucgaagagguuacggaaaauccaaagacagaggugugcggcggagagaagggccccuguugcgccuguccuaaaaccgaagcugagaagcaggcggaaaaagaggaagcagaguaccgcaagguauucgagaacuuucuacacaauaguauuuucgucccacggcccgaaagaaaaaggcgcgacgugaugcagguugccaacacuaccaugucuagccgaucccggaacacaaccgcugccgauacuuauaauaucacagacccggaggaacucgagacggaauacccauuuuucgagucacguguggauaacaaggagagaaccgucauuagcaaucugaggccuuuuacucuuuaucgcaucgacauacauucuugcaaccacgaagcagagaaguugggguguuccgccaguaauuucguguuugcucggacaaugcccgccgaaggagcagaugacauuccuggucccguaaccugggagccaagaccugagaacagcaucuuccugaaauggcccgaaccagagaauccgaacggccucauucugauguacgaaaucaaguaugggucucaaguggaggaucagagggaaugcguuucccgacaggaguaccgcaaauauggaggcgcgaaguuaaaucggcugaacccugguaauuacacagcuagaauacaggccacuucacuuagugggaacggcagcuggaccgaccccgucuuuuucuacgugcaagcaaaaacgggauaugagaauuucauccauuugauuaucgcccucccaguggcuguccugcuaauuguuggcgggcuggugaucaugcucuacguguuucacaggaagcguaacaauucgcgccugggaaacggcguacuuuaugccuccgucaaccccgaauacuucucugcagcugacguguauguuccugaugagugggaaguggcccgggagaaaauaaccaugagcagagaauugggucaggggucauuuggaauggucuacgagggcguggcgaaggguguugugaaggacgagccagaaacaaggguagccauuaaaacugucaaugaggcugcaaguaugcgagaacggaucgaguuccugaacgaagccuccgugaugaaggaguuuaauugccaucacgugguccgcuuacucggcguugugucucaggggcagcccacccugguaaucauggagcuuaugacaagaggagaucugaaaagcuauuugaggucccuccggccugaaauggagaacaauccggugcuggcuccacccucacuaagcaagaugauucaaauggccggcgaaaucgcagacgggauggcguaccugaacgccaauaaauucguccaccgagaucucgcugccagaaacuguaugguggcagaggacuuuacuguuaagauuggagauuucggcaugacccgcgacauauacgagacggauuauuacaggaagggugggaaaggacugcuuccugugcguuggaugaguccagaaucuuugaaggacggcgucuuuacaaccuauuccgauguguggagcuucgguguugugcugugggagaucgcuacuuuagccgaacagcccuaccagggccucucgaaugagcagguccugcgguuuguaauggaagggggacuucuggacaaaccugauaacugcccggacaugcuauucgagcucaugagaauguguuggcaauauaaucccaagaugaggccaucauuucuggagauuaucucuaguauuaaagaagagauggaaccuggcuuccgcgagguguccuucuacuauagcgaagagaacaaguugcccgagccagaggaacuggacuuagaaccugagaauauggaaucuguuccccucgauccaagcgcauccucaaguagccugccgcuuccugaccgacauucugggcacaaggccgagaacggacccggcccaggugugcuggucuugagagcuuccuuugaugagcggcagcccuacgcgcauaugaaugggggaaggaaaaacgaacgcgcccucccucugccacagucaaguacaugcuga

SEQ ID NO: 57587 - RNA, 1317 nt, Artificial Sequence
  derived and/or modified sequence opt3 from IGF2BP1__Homo_sapiens__NP_001153895
augaacaagcuguacaucggcaaucucaacgagagcgugacccccgccgaccuugaaaaagucuucgcugagcacaagauuuccuauucugggcaguuucugguuaaaucaggauacgcauucguggauugcccugacgaacauugggccaugaaggcgauagagacauuuagugguaaaguagaauugcaaggcaagagauuagagaucgagcacagcgugccaaagaaacagaggucccggaagauucagauccgcaauauuccgccccagcugcgaugggaaguccuagauucucuccuggcucaauaugggacuguggagaacugugaacagguuaauacggagucggagaccgccguggucaacgugacauacucaaaucgugaacagacuagacaggcagacgagguaccucuuaaaauccuggcccauaacaauuucguuggaagguugauaggcaaggaaggucggaaccucaaaaagguggagcaagauaccgaaacaaagaucaccauuagcagucugcaggaccugacucucuauaauccagagcgcacaaucaccgucaaaggggcuauugagaacugcuguagagcagaacaggagaucaugaagaaagugagggaagccuacgagaaugauguggcugccauguccuuacagucucaccugauacccggacuuaacuuggcggcagucggccuguuuccugccagcuccucagcuguuccacccccuccaaguagcgugacgggcgccgcaccguauucuuccuucaugcaagcucccgaacaggagaugguacagguguuuauuccugcccaagcggucggggccaucauuggaaagaaaggucagcauaucaagcagcuaucacgguucgcaagcgcuaguaucaaaauugccccacccgagacuccugacucuaaggugcgcaugguuauaaucaccggcccacccgaagcucaguuuaaggcccaagggcgaauuuacggaaaacucaaggaggaaaauuucuuuggcccgaaagaggaagugaagcuggagacacacaucagagucccugcauccgccgcugguagggugauagggaaaggaggcaagacuguaaacgagcuucagaaccugaccgcggcagaaguuguggucccccgggaucagacaccagacgagaaugaucaggugauugucaagaucaucggccacuucuacgccagccaaauggcucagcguaaaauucgcgacaucuuggcccaggugaagcagcaacaucagaaagggcagucgaaccaggcacaagccagaaggaaguga

SEQ ID NO: 57588 - RNA, 1671 nt, Artificial Sequence
  derived and/or modified sequence opt3 from IGF2BP2__Homo_sapiens__NP_001007226
augaugaacaagcuguacaucggcaaucucagccccgccgugaccgcugacgaucuuagacagcuguucggggacaggaaauugccuuuagcaggacaaguccugcuaaaguccgguuaugccuuuguugauuacccagaccagaacugggcgauucgggcuauagagacacucucuggcaaaguggaacugcaugggaagaucauggagguagauuauucagugaguaaaaagcugcgcagccgaaagauucagauccguaauauuccgccccaucuucagugggaagucuuggacggacuccuggcccaauacggcacuguggagaacguugaacaggugaauacggauaccgagacagcagucgugaacguaacuuaugccaccagagaggaagcuaaaaucgcaauggagaagcuguccggucaccaguucgaaaauuacucuuuuaaaauaucguauaucccugacgaggagguuucaagcccaagucccccucagagggcccaacggggcgaucauuccucucgcgaacagggacacgcuccaggcggcacaagccaggccagacagauugacuucccccucaggaucuuagugccuacccaauuugucggggcgauuaucggaaaggagggucugacuauuaaaaacauaacaaagcagacccagucccggguggauauccaucgcaaggaaaauucaggcgcagccgagaaaccagugacgauucacgcuacuccggaagggaccagugaggccugccgaaugauccuugagaucaugcaaaaggaagcagacgagacaaaauuggcugaagagauuccccugaagauacuagcccacaacggacucgucggcagacugaucgguaaagaagggaggaaucuuaagaaaauugagcaugagacuggaaccaagaucacaauaagcucucugcaggauuuguccauuuacaacccugaacggaccaucacgguuaagggcacuguggaggcgugugccucagcagaaaucgagauuaugaaaaagcuccgugaggcuuucgaaaaugacaugcuggccguaaacacacacagcggcuacuuuaguucuuuauauccacaucaccaguucgggcccuuuccucaccaucacuccuacccagagcaggaaaucgugaaucuguucauucccacccaagcugucggagccauaaucgguaaaaagggcgcacauauuaaacagcucgcccgcuuugcuggggcgagcaucaagaucgcaccggccgagggaccugacgugucggaaagaaugguuauuauaacugggcccccagaggcucaguucaaggcccaggguaggaucuuugggaaacuuaaggaggaaaacuucuucaacccuaaagaggaagugaagcuggaggcacacauucggguccccucuuccacagccggccgagugaucggaaaaggcgggaagaccguaaaugaauugcaaaaccuaacgucagcugagguuauugugccacgcgaucagacccccgacgagaaugaagaggucaucgugagaauaaucggacacuuuuucgccagucagacagcacagaggaagauucgggaaaucguccaacaggugaaacagcaggagcaaaaguauccucaggguguugcgagccagcgcuccaaauga

SEQ ID NO: 57589 - RNA, 1740 nt, Artificial Sequence
  derived and/or modified sequence opt3 from IGF2BP3__Homo_sapiens__NP_006538
augaacaagcuguacaucggcaaucucagcgagaacgccgcucccuccgaccuugaaucuauuuucaaagaugcaaagauaccugugucagggccauuucuggucaaaaccggauaugccuucguugacugcccggaugagaguugggcguugaaggcuaucgaagccuuaagcgguaaaauugagcugcacggcaagcccaucgaaguggagcauuccguaccuaagagacagaggauucggaaacuacaaauccgcaauauaccaccccaccuccagugggaggugcuggacucucuucugguccaguacggggugguugaaucgugugaacaggugaacacagauucagagacugcagucgugaauguaacguauagcaguaaggaccaagcccgacaggcuuuggauaaacucaacggauuucagcuggagaauuucacccugaagguugcauacaucccugacgagauggccgcucagcaaaacccacuccagcagccccguggcagaagggguuuagggcagcggggauccucucgccaaggcagcccuggcuccgugucaaaacagaagccaugcgaucugccgcuuagauugcugguccccacacaguuugugggggccauuaucggaaaggaaggugcgacuauuaggaauaucaccaaacaaacacagaguaagauagacgugcaucggaaagagaacgcaggcgccgcugaaaagagcauuaccauccuaucuacuccugaggggacauccgccgcauguaaaucaauucucgaaaucaugcacaaggaggcucaggauaucaaauucaccgaggaaauuccacugaagauacuugcccauaauaacuuugucggacgccugaucggcaaggagggucgaaauuugaaaaagauugaacaggacacggauacuaaaaucaccauaagcccccuccaagagcugacauuauauaacccugaaagaacuauuaccguuaaggggaauguggagacaugcgcgaaagccgaggaagagaucaugaagaagaucagggaaaguuacgagaacgacauugcaucuaugaaccugcaggcucaccucaucccaggacuuaaucugaacgccuugggccuauuucccccgaccuccggcaugccucccccaacgagcgggccucccucggcuaugacuccacccuauccucaguucgaacagucugagacagagaccguacaccuguucauuccagcccucuccgugggagcaauaaucgguaaacaaggccagcauauuaagcagcugucacgguuugccggggcuaguaucaaaaucgcgccggcagaagcccccgacgcuaagguccguauggugauuauaacuggaccuccagaggcccaguucaaagcacaaggccgcaucuacgguaagauuaaggaagagaauuuuguuagccccaaagaggaagugaaacuugaggcccacaucagagucccuuccuucgcugccgggagggugauuggcaagggaggcaagacaguaaacgaacugcagaauuugucuagcgcagagguuguggucccacgggaucagacccccgacgaaaacgaucagguggucgugaaaaucacggggcauuucuacgcgugucaaguugcucagcgaaagauacaggagauccucacccaagugaagcagcaccagcagcaaaaagcccugcagucaggaccgccucagagucgcagaaaguga

SEQ ID NO: 57590 - RNA, 711 nt, Artificial Sequence
  derived and/or modified sequence opt3 from IGF2__Homo_sapiens__NP_001121070
auggugagccccgacccucagaucauugucguugccccagagaccgaacuggcuuccaugcaagugcagagaacagaggauggcguaacuauaauccagauuuucuggguggggaggaagggagaacuccuucggcgcacgccggucucuucagcaaugcagacccccauggguaucccuaugggcaaaaguaugcugguguuguuaacauuucuggccuucgcgagcugcuguauugcugccuaccgaccauccgagacucuaugcgggggagaacucguugacacccugcaauuuguguguggcgaucgugguuucuauuuuucuagacccgcaucgagggucucacggcgcagcagagggaucguggaggagugcuguuucaggaguugcgaccuugcccuguuggaaacauacugugcuaccccugcaaaguccgagcgggauguaucuacuccacccacaguucucccugacaacuuuccacgcuauccggugggaaaauucuuucaguacgauaccuggaagcagagcacgcagcgacugagaaggggccugcccgcccucuuacgggcucgucgcggccacguccuggccaaagaacuugaggcguucagagaggcaaagaggcaucggccuuugauagcccugccaacucaagaccccgcucacgggggagccccuccagaaauggcauccaaucgaaaguga

SEQ ID NO: 57591 - RNA, 7476 nt, Artificial Sequence
  derived and/or modified sequence opt3 from IGF2R__Homo_sapiens__NP_000867
augggcgccgcugcagggagaagcccccaccugggaccugccccagcgaggcggccgcagcgcucccuccuucuguugcaauuacugcugcucguggcugcccccgguucuacccaggcacaggccgcuccuuucccagagcugugcucauacacuugggaagcagucgacacuaagaacaauguucuuuauaaaaucaacauuugcggcaguguggacauaguacagugcgggcccagcuccgccguguguaugcaugaccugaagacgcgaaccuaccacucugucggagauucgguguugcguucagcuaccagaagccuccuggaauuuaauacuaccguuaguugcgaccaacagggcacaaaccauagggugcaguccucuaucgccuuccugugugguaaaacccucgggacuccugaauuugucacagcgaccgagugcgugcacuauuucgaauggcggacgacugcagccuguaagaaagauauuuuuaaggcuaauaaggagguaccaugcuacguuuucgacgaggaauuacgcaaacaugaucugaacccccuuaucaaguugagcggagccuaucugguggacgauuccgacccugauaccucacuauuuauuaaugucuguagagacaucgauacacucagggacccaggcagucagcugcgggcaugcccgcccggcacugcugccugucuugugcgcgggcaccaagcguucgacgugggacagccucgagauggucugaaauuggucagaaaggacaggcucguucugagcuacgugcgggaggaagccggcaaauuagauuuuugcgacgggcacucuccagcaguaaccauuacauucgugugccccuccgagcgucgcgagggaaccaucccuaagcugacggcuaagucaaacuguagauaugaaauugaguggaucacugaauacgccugccauagggauuaccucgagagcaaaacauguagucuuucuggcgaacagcaggacgucuccauugaucugaccccauuggcucaaagcggugggucgucuuauaucuccgacggaaaggaguaccuauuuuaucugaaugugugcggcgagacugaaauacaguucuguaacaaaaagcaggccgcaguuugccaagugaaaaagucagauacaagucaggucaaagccgcuggccgguaccacaaucagacccuccgauauagcgacggggaucugacgcuuauuuacuuuggaggugacgaguguuccucuggcuuccagcgcaugagcgugaucaacuucgaaugcaauaagaccgcggggaacgacggaaagggcacacccguauuuacuggugagguugauuguaccuauuucuuuacaugggacacugaauacgcaugcgugaaagagaaggaggaucuguuguguggggccaccgacggcaaaaagagauacgaucucucagcucuggucaggcaugccgaaccggagcaaaauugggaagcaguggacggaagucagacagagaccgagaagaagcacuucuuuauuaacaucugccaccgggucuuacaggagggcaaggcccgcgggugcccugaggaugcugccgugugugcaguugacaaaaacggauccaagaaucuggguaaauucaucagcucucccaugaaggaaaaaggcaacauucagcuaucauauagugauggggacgauugcggacauggcaagaagauaaaaacuaauaucacgcucguguguaagccaggugaccuggagagcgcgccuguacuuagaacauccggggaaggcggaugcuuuuacgaguucgaguggcacaccgcugccgcaugugucuugucuaaaacugaaggcgagaacugcaccguguuugauucgcaagccggguucagcuuugaccugagcccccucacaaagaaaaauggagcuuauaagguugaaaccaagaaauacgacuucuauauuaacgugugugguccagucucagugagucccugccagccugauucuggcgccugucagguagcaaagagcgacgagaaaacuuggaaucuggggcuuuccaacgcuaagcugucauacuaugauggaaugauccaguugaauuacaggggcgguacaccauacaacaaugaacgucauacgccgcgggccacccucauaacuuuucugugcgaccgagaugcgggggugggcuuccccgaguaucaagaggaagacaacagcacauacaauuucagaugguauaccucuuacgccuguccugaggaaccauuagagugcguugucacagaucccuccacucuggaacaguaugaccuaaguagccucgcuaaaucugagggaggccuaggcgggaacugguacgcaauggauaauuccggggagcacgugaccuggaggaaguauuacauuaacgugugccgcccucuuaacccaguccccgguuguaaucgguacgccucagcuugccagaugaaauaugaaaaggaccaggggaguuuuacggagguugugagcaucucgaacuugggaauggccaagaccggcccggugguagaagauuccgguucucugcuccuggaguacgucaauggcagcgcauguacaacuucagacgggagacaaaccacauauacuaccaggauccauuuagugugcagucgcggacgacugaacucccacccuauuuucucucuuaauugggaauguguugugagcuuuuuguggaacacggaggcggccugcccaauccagacaaccacugauacagaccaggcuuguuccauucgggaccccaauucaggcuucgucuuuaaccucaauccucugaacagcagucaaggguacaaugugucuggaauaggcaaaaucuucauguuuaacguuugcgguaccaugcccgugugugggacuauucuaggaaagccagccuccggcugcgaggcagaaacccagacagaggaacugaaaaauuggaagccugcucgucccguagguaucgagaaaagccuccagcugucgacggagggcuucaucacccuuacuuauaaggggccauugucagccaagggaacagcagaugccuuuauugucagauucguguguaacgacgauguguacucuggcccgcugaaauuuuuacaccaggacauagauagugggcaaggaaucaggaauaccuauuucgaauuugagacagcucucgcgugcgucccuucccccguugacugccaggugacugaucuggccggcaacgaauacgaccuuaccggucugagcacgguacgcaagccauggacagcaguggauaccucugucgacgggcggaaaagaacuuucuacuugagcguguguaacccccucccuuauauuccaggaugccagggcuccgcuguugguucaugucuggugagugagggcaauagcuggaaccuaggggucgugcagaugucuccccaagccgccgcuaauggaucccugucaaucauguacguuaacggcgauaagugcgggaaucagagguucaguacccgaauuacauuugaaugugcacagaucagcggauccccugccuuccagcuccaagacggcugcgaguauguguuuauauggcgcacugucgaggcguguccgguagugcggguugaaggugacaacugcgaggugaaagauccaagacaugggaaucuguacgaccuuaagcccuugggacugaacgauaccaucgucucugcuggcgaauauacauacuauuucaggguguguggcaaguuaucgagcgacguaugcccuacgucagauaaauccaagguggucaguucuugucaggagaaacgugaaccacagggguuucacaagguugccggacuccugacccaaaaacuuacuuacgagaauggucugcuaaagaugaacuucacaggcggggauaccugccauaagguguaccagcgcagcacugcaauauuuuucuauugcgaucggggaacacagagacccguguuucucaaagagaccuccgacuguucauaccuguucgaauggaggacgcaguaugccugcccuccguuugauuugacugaguguucuuucaaggacggcgcugguaauagcuucgaucugaguuccuuaagccgauacucugacaacugggaagcaaucaccgggacaggagaucccgagcacuaucucauuaaugucugcaaaucacuggccccacaagcgggcaccgaaccuugucccccagaggcugccgcaugccuucugggcggguccaagccugugaacuugggacggguucgcgacgguccccaguggagagacggcaucauaguacucaaauacguggauggggaccuguguccagauggaauuaggaagaaaaguacuacaauccgguuuaccugcagcgagucgcaggucaauucucgaccgauguucauuuccgccguggaagacugugaguauacauuugcuuggccuacugccaccgcaugccccaugaaguccaacgaacacgaugacugucagguuacgaacccaucaacaggccaucuauucgaucugaguucucuuuccgguagagcuggguuuaccgccgcguacagcgagaagggacucguguacaugucaaucugcggcgagaaugaaaacugucccccuggcgucggggccuguuucggacaaacucgcauaaguguggguaaagcaaauaagaggcugcguuauguagaccaggucuugcagcugguguacaaagauggcagcccaugccccuccaagucuggguuaagcuauaaauccguuaucucauuugugugucggccugaggcuggaccgaccaacagaccaaugcucauuucucuggacaagcagacaugcacucuuuucuuuaguuggcacacaccccuggccugugaacaagcuacggagugcucggucaggaauggcagcuccaucguggauuugucuccucucauucaucgcacagguggguacgaagcauaugacgagucagaggaugacgccagcgacaccaaccccgauuucuacaucaauauaugucagccacugaacccuaugcacggaguucccugcccagccggcgcugcgguguguaaggucccuauugacggcccgcccaucgauaucgggcgaguggcaggaccaccuauucuaaaucccaucgccaacgaaauuuaucugaauuuugaguccaguacuccaugccuugcugacaaacauuucaacuacacaucucucauagccuuucacuguaagagagguguaagcaugggcaccccuaaacuguugcggacuucagaaugcgauuucguguucgagugggaaacacccguugucuguccggacgaggugaggauggaugggugcaccuuaacggacgagcagcugcucuacuccuuuaaucugaguagccuuucuacuuccaccuucaaggugacacgcgauucacguaccuauagcgucggaguaugcacauuugcagugggcccagaacaggguggguguaaagacggaggcguuugccuguugucgggcacuaagggggccucuuucggaagacuacaaaguaugaagcuggauuaccggcaccaggacgaggcugugguccucuccuaugugaacggugacagguguccucccgaaaccgaugacggcguuccaugcguguuucccuucaucuuuaaugggaaaagcuacgaggaauguauuaucgagucacgcgcgaagcuguggugcuccacgacagccgauuaugaccgagaucaugaguggggauucuguagacacucuaacagcuaccggacaaguuccauuaucuuuaaaugcgacgaagaugaggacauaggcaggccucaggucuucagcgaagugcgcgguugugauguaaccuuugaguggaagacaaaagugguuugcccgcccaagaaacuugaguguaaauucguccaaaagcauaaaaccuaugacuuaagacugcucucuucauugacugggaguuggucccuggugcacaauggcgugagcuacuacaucaaccucugccagaagauuuauaaaggaccacugggcugcucugaaagggcaucgaucugucggcguaccacaacgggggauguccagguucuuggacuggugcauacucagaaguuggguguaauuggcgacaagguggucgugaccuacucaaaaggguauccuugcggaggcaacaagacagcuagcuccguuaucgagcuaaccuguacuaaaacagugggucgccccgccuuuaagcgauucgauauagacaguugcaccuacuauuucucuugggacagcagagcagccugugcugucaaaccucaagaaguacagauggugaaugggacgauuacuaacccaaucaauggcaaguccuuuucacugggagauaucuacuucaaacucuuuagggccaguggcgacaugcggacaaacggggauaauuauuuauacgagauucagcugucuagcauaaccuccucacgcaaccccgcgugcagcggagcaaauaucugucagguuaagccuaacgaccaacacuucucuagaaagguggguaccuccgauaaaacuaaguacuaucuucaggacggcgaucuggacgucguguuugccaguagcucgaaaugcgggaaggauaaaacaaaguccgucucuucaaccauuuucuuucacugugacccacucguggaagauggaauccccgaguucagccaugagacagcugacugccaguacuuguuuaguugguauacuuccgccguuuguccgcugggcguggguuucgacucugaaaauccuggggaugacggccagaugcacaagggacucagcgagaggucacaagcuguaggcgcagugcugucccuucuacuggucgccuugacgugcugcuuacuggcucuccugcuuuacaaaaaggaacggcgagagaccguuauuaguaaacugacaacuuguugcagacgcagcucuaacgugucauauaaguacuccaaagucaauaaggaagaggagaccgaugaaaacgagacagaauggcucauggaggaaauccaguugccacccccuaggcaggggaaggagggacaagagaauggccauauaaccacuaaaagcgugaaggcccugucuagucuacacggugacgaucaggacucggaagaugagguacugacgaucccagaagugaaaguucacuccgggcggggagcaggcgcggagagcucacaucccgugcguaacgcccagucuaaugcucuccaggagagagaagacgauagggucggucuugugcgcggcgagaaggcccggaaaggaaagagcuccagugcacaacagaagaccgucucaucuacaaaacuggugagcuuucacgacgauuccgacgaagauuuauugcauauuuga

SEQ ID NO: 57592 - RNA, 1932 nt, Artificial Sequence
  derived and/or modified sequence opt3 from IGFALS__Homo_sapiens__NP_001139478
auggcccugagaaaggcuggcgaccucgagccccaguucaccccugaaaggcgguuucgccuuugcugguaccaagcacacagcgggcgagcccuguugggaccaccgccccaggcguccccuccagcugguggcuuagcccuggcacuacuccugcuuucuuggguggcccuggggccccguucauuggagggagcugauccuggcacaccaggugaagcagaggggcccgccuguccugcugccugcgucuguaguuaugacgaugacgcggaugaacucagcguuuucugcuccucuagaaaccugacuaggcugccagacggagugccgggcggcacgcaggcacucugguuagaugggaauaaccugucgucaguacccccugccgcuuuucagaaucuuagcaguuugggauuccugaaccuacaagguggccagcucgggucccuggagccacaggcccuucugggauuggagaaucucugucaucugcacuuagaacggaaccagcugcgcucucucgcacuuggcaccuuugcucauacacccgcccuggcgagcuugggucuauccaauaacagacugucaaggcucgaggacgggcuguucgaaggacuuggcagucugugggauuugaaucucggcuggaacagccuggccguguuaccugacgcagcuuuucgggggcugggaucucuacgcgagcucguccuggccgguaaucgacuugcuuacuugcaaccagcccuguucuccggccucgcagagcugagagaacuugaucugucaaggaacgccuugcgggcuaucaaagcgaauguguuuguucagcucccccgucugcagaaguuauaucuggaccgcaaccuaauugcagccguggcuccgggggccuuccucggacugaaagcacuuagaugguuggaucugagccacaauagggucgccggccuccuggaggacacuuuuccugguuuacuggggcuucggguguugcgacucagucauaacgcuauagccucucugcgccccagaaccuucaaggaccuacacuuucuggaggagcuccagcugggccacaacaggauccggcaacuugcagaacgcuccuucgagggauugggccagcuggagguauuaacacucgaucauaaucagcugcaagaaguuaaagcgggggcuuuccuuggacugaccaacguggccgucaugaauuugagcgguaacugccucagaaaucugccagaacagguguuuaggggccuagggaagcugcacucgcuccaucuggaaggaucuugucuuggccguauucggccucacacuuucacagguuuguccgggcugcgaagauuauuucucaaggacaacggccuggugggaaucgaggaacagucacuuuggggccuggcagagcuacucgagcuggauuugaccaguaaucagcugacgcacuuaccccauagguuguuccaagggcugggaaaacuugaauaccuguugcucagccgcaaccggcuggccgagcuaccagcugacgcccuggguccccuucagagagcauuuuggcucgaugucucccacaauaggcuggaagcucucccuaacucucuguuagccccacucggccgccugcgauaucuuagccugcggaauaacucauugcguacuuucaccccgcagcccccugggcucgagagacuguggcuagaaggaaauccaugggacugcggcuguccccugaaggcgcuuagggauuuugcccuccagaacccuagugcuguuccacgcuucgugcaagcaauuugcgagggugacgauugucagcccccggccuacacauauaauaacaucacuugcgcuuccccuccagagguaguggggcuggacuugcgggauuuaagcgaagcccauuuugcacccugcuga

SEQ ID NO: 57593 - RNA, 780 nt, Artificial Sequence
  derived and/or modified sequence opt3 from IGFBP1__Homo_sapiens__NP_000587
augagcgaggugcccgucgccagaguuuggcuggugcuccuucuguugaccguacaggugggcgucacagcuggggcaccuuggcaaugcgccccauguuccgcggaaaaguuagcucugugcccgcccgugucugccucauguagugagguuacuaggagcgcaggaugcgguuguugcccuaugugugcccuaccacucggcgcugcaugcgggguggccacggcucggugugcccgcggacuguccugccgagcgcuucccggcgaacagcagccucugcacgcauugacccguggucagggggccuguguccaagagucugacgcuucggccccacaugcagcugaagccggaucacccgagagcccugagaguacagaaaucacugaggaggaacuccuggauaacuuccaccugauggcgccauccgaggaagaccauucuauucucugggaugccauaagcaccuacgacggcuccaaagcauuacacgugacaaauaucaagaaauggaaggagccgugcagaauugaacuguauaggguaguugagucacuugcuaaagcccaggaaaccaguggcgaggagaucagcaaguuuuacuugcccaacugcaauaagaacggguucuaucauucucggcagugugaaacuuccauggauggagaggcuggucugugcugguguguguacccuuggaauggcaaacgcauuccagggucacccgaaaucagaggagacccuaacugccagauauauuuuaauguccaaaacuga

SEQ ID NO: 57594 - RNA, 987 nt, Artificial Sequence
  derived and/or modified sequence opt3 from IGFBP2__Homo_sapiens__NP_000588
augcugcccagagugggcugcccugcccucccacuuccgcccccuccacuguugcccuuacugccucuacuccugcuucuguugggggcuagcggagguggcgggggagcaagggccgagguccucuuccgguguccacccugcaccccugaacgccuggcggcuuguggcccaccgcccguugccccuccagcagccguggcugcaguagccgguggggcucgaaugcccugcgccgagcuggugcgugaaccuggauguggcugcuguuccgucugcgcgagacucgagggcgaagcaugugggguguacacaccaaggugcggacaggguuuacgguguuauccccacccgggcucugagcugccucuucaagccuugguuaugggggagggaacuugcgaaaagcgcagagacgcugaguacggcgccucacccgaacagguggcagauaacggugacgaucauagugaagggggacuggucgagaaucacguggacagcacgaugaacaugcuaggcggcgggggauccgcugguaggaaaccacucaagucuggcaugaaagagcuggccguauuucgggagaagguuaccgaacagcaucgccagauggggaaaggaggcaagcaccaucuuggucuggaggaaccuaagaaauugcgacccccacccgcgagaacaccuugccaacaggagcucgaucaggugcuggagaggaucucgacuaugcgguuaccagacgaacgugggccgcuggagcaccucuauucacuucacauucccaauugugauaagcauggccuguacaacuugaaacagugcaagaugagccuaaauggacaacgcggcgaauguuggugcgucaacccuaauaccgggaaacugauacagggagccccaacaaucagaggugaccccgagugucaccucuucuauaacgaacagcaggaggcaaggggcgugcauacccaacggaugcaguga

SEQ ID NO: 57595 - RNA, 876 nt, Artificial Sequence
  derived and/or modified sequence opt3 from IGFBP3__Homo_sapiens__NP_000589
augcagagagccaggcccacccugugggcugcagcccucacacuucugguguuguuacggggcccuccagucgcgcgcgcuggggccagcuccgcaggacuggguccgguugugcgaugcgagcccugugacgcccgugcucuagcacaaugcgccccuccacccgcuguaugugccgaacucgugagagagccuggcugcggguguugccugacuugugcgcuuucugaaggacagccaugcggcaucuacacggagaggugugguucagggcugcggugccagcccaguccugaugaagcacgcccauugcaggcccuccuggacggaagaggccugugugucaacgcuagcgccguguccaggcuccgggcauauuuacugccggcucccccugccccaggcaaugcgucugagucggaggaagaucgcucagccgggagcguugagagucccuccgugucuagcacccaccgagucuccgacccuaaguuccauccacuucacucaaaaauuauaaucauuaagaaaggacaugcaaaggauagucaaagauacaaaguggacuaugaaagccagucuacagauacucagaacuuuuccucagagagcaagagggagaccgaauacggucccugccggcgugagauggaagacacauugaaucaccugaaguuccuaaacguacucaguccgcgcggcguucauaucccuaauugcgauaaaaagggguuuuauaaaaagaaacaguguagacccucuaagggaaggaagcggggcuucugcugguguguggacaaauacggucaaccacugccuggguauaccacuaagggaaaagaggauguccacugcuacuccaugcagagcaaguga

SEQ ID NO: 57596 - RNA, 777 nt, Artificial Sequence
  derived and/or modified sequence opt3 from IGFBP4__Homo_sapiens__NP_001543
augcugccccucugccuuguggccgcucuguuguuagcagccggcccugggccaagccugggagacgaggcgauccacuguccgcccugcuccgaagagaagcuagcuagauguaggccuccagucgguugcgaggaacucguucgggaacccggcugugggugcugugcaaccugcgcccugggacuuggcaugccuugugguguguacacaccacgcugcgggucuggacugcgauguuaucccccucguggcguagagaaaccauugcauacucucaugcacggccagggggugugcauggagcuggccgaaauugaggcuauacaagaaucacugcagccgagugauaaggacgagggagaucaucccaacaauagcuucuccccuugcucugcacacgacagaaggugucuccagaaacauuuugccaagauccgggaucgcucgacgucagguggcaaaaugaaggucaacggggcuccaagagaggacgccaggcccgugccucagggaagcugccaaagugaauuacaccgggcgcuggagcgccuugcagccucccagucucgaacccacgaagauuuguacauuaucccaauucccaauugugacagaaacggcaauuuccauccgaagcagugccacccugcucuggauggucagagggggaaauguuggugcguugaccggaagacaggagugaaacuacccggcggccucgagccaaagggggaacuggauugucaucaacuugccgacagcuuucgugaguga

SEQ ID NO: 57597 - RNA, 819 nt, Artificial Sequence
  derived and/or modified sequence opt3 from IGFBP5__Homo_sapiens__NP_000590
auggugcugcucaccgccguccuucuguuguuagcugcauacgccggccccgcgcagagccugggguccuucguucacugcgagccuugugacgaaaaggcucuaucuaugugcccaccgucaccccucggaugugagcuggugaaagaaccugguugcggcuguugcaugacaugugcccuugcagaggggcaaaguugcggaguauauacugaaagaugugcccagggccugaggugcuugccacggcaggaugaggagaagccccuccaugcucugcugcacggucgcggggugugucucaacgagaaaagcuaccgagaacaggucaagaucgaacgugacuccagagagcaugaggaaccuacgaccucugagauggcagaagagacauauucgccaaaaauuuuuaggcccaagcacacucggauaucagaauuaaaggccgaggcugugaaaaaggaucgcaggaaaaagcugacccaaagcaaauucguuggaggcgccgagaauacagcgcauccuagaaucauuagugcaccagaaaugcggcaggaguccgaacagggcccgugccgccgacacauggaggccucucuucaggaauugaaggcuagccccagaauggugccuagggccgucuaccugccaaacugcgaccggaagggguuuuauaaacguaagcaauguaaacccucccgcggaagaaagagggguaucugcugguguguggauaaauacggcaugaagcuaccugggauggaguauguagacggagauuuccagugccacaccuuugacucaaguaauguugaguga

SEQ ID NO: 57598 - RNA, 723 nt, Artificial Sequence
  derived and/or modified sequence opt3 from IGFBP6__Homo_sapiens__NP_002169
augacaccccacagacugcucccuccacuucuguuguuacuggcccuacuccuggcugcaagcccgggcggggcccuugcgaggugccccggauguggucagggcgugcaagcugggugcccuggaggcugugucgaggaagaggacgguggguccccagccgaaggaugcgcagaggccgaaggcugucugcggcgcgagggccaggagugcgggguuuacacccccaacugugcuccuggauugcagugccauccacccaaggaugacgaagcaccucuccgagcccugcugcucggucguggcagauguuuaccagcuagggccccggcgguggcagaggaaaaucccaaagagucuaagccucaggccgggacugcucggccacaagauguaaaccgcagagaccagcagaggaaucccggaacgucaaccacaccuagucagccaaacagcgccggcgugcaagauacugagaugggucccugccggcgccaccuggacuccguccuucagcaguugcagaccgaaguguaucgaggggcacaaacacuguacguuccgaauugugaucauagaggauucuauaggaaacggcagugccguucuucgcagggccaacgcagaggcccuugcugguguguggacaggauggggaagucacuacccggaagcccagaugguaacggcaguuccucuugcccuaccgggagcuccggauga

SEQ ID NO: 57599 - RNA, 840 nt, Artificial Sequence
  derived and/or modified sequence opt3 from IGFBP7__Homo_sapiens__NP_001240764
auggagagacccagccugagggcccuccuucugggcgcugcaggguuguuacugcuacuccugccucuuuccucuucaaguagcuccgauaccugcggaccaugugaaccggccucuugucccccucugccacccuuggguugccuccugggcgagacacgggacgcgugcggguguugcccuaugugugcucgcggagaaggcgagccaugcggugggggaggcgccggccgaggguacugugcacccggaauggaaugcgugaagucgcguaaaagaaggaaggguaaagccggcgcugcagccgggggaccuggcgucucagguguuugugugugcaagagccgguauccaguaugcgggagugacggaacuacguacccguccggcugucagcugcgcgcugccucucaaagagcggagagcaggggcgagaaagcaaucacccagguguccaaggggacaugcgaacagggacccucaauugucacuccuccaaaggauauauggaacgugaccggugcccagguuuaucucaguugugaggugaucggcauucccacaccugucuuaaucuggaauaaagugaagcgggggcacuacggaguacaacgcaccgaacugcuuccaggcgaccgagauaacuuggcuauucagacuagaggugggcccgagaaacaugagguuacaggcugggugcuggucagcccgcuaucuaaggaagacgccggagaguaugaaugccacgcauccaauucacagggccaggcuagcgccagugcgaaaaucaccgugguggaugcccuccaugagauaccugucaagaaggggacgcaauga

SEQ ID NO: 57600 - RNA, 837 nt, Artificial Sequence
  derived and/or modified sequence opt3 from IGFBPL1__Homo_sapiens__NP_001007564
augcccagacugagccuccuucugccuuuguuacugcuacuccugcuuccacuguugccgccccucuccccuucucugggcaucagggacguggguggacggcgcccaaagugcggucccugucgaccugagggcugcccagcccccgcuccuuguccagcaccggggauuucagcccuggaugaaugcggauguugcgcgcguugucucggcgcugagggugccaguugcgggggaagggcaggcggcagaugugggcccggauuagucugcgccagccaggcugcaggggccgcuccugaaggcaccgggcuguguguuugcgcccaacggggaacagugugcggcuccgacggucgcucuuacccaucgguaugugcgcuuagauugagggcacggcacacuccccgcgcccauccugggcaucugcacaaagcucgagauggaccaugcgaguucgcccccguggucgugguuccgccuagaucagugcacaacgucacgggcgcacaggugggccuaagcugugaaguaagggcuguucccaccccagugauaacauggcggaaggucacuaaaaguccugaggggacccaggcccucgaggaacugcccggagaccaugugaauaucgcggugcagguccgugguggcccauccgaucacgaggccacagcauggauucuuaucaacccccugcgcaaggaagacgaggggguuuaucaaugccacgcugccaauauggugggagaggcugaaucucauagcaccguaacuguguuggaucucuccaaauacagaucauuucacuucccugccccagacgauaggauguga

SEQ ID NO: 57601 - RNA, 333 nt, Artificial Sequence
  derived and/or modified sequence opt3 from IGFL1__Homo_sapiens__NP_940943
auggcccccagaggcugcaucguggcugucuucgcaauauuuuguauuagcaggcugcucugcucccacggggccccuguugcgccaaugaccccguaccuuaugcugugucagccccauaagcggugcggagacaaauucuaugauccuuugcaacacuguugcuacgacgaugcugugguaccauuagcccgcacacagacuugugguaacugcacguuucgaguguguuucgagcagugcugucccuggaccuuuauggucaagcugaucaaucagaacugcgacucugcacguacaucagaugacagacuaugcaggagugugagcuga

SEQ ID NO: 57602 - RNA, 1068 nt, Artificial Sequence
  derived and/or modified sequence opt3 from IGFLR1__Homo_sapiens__NP_078936
augggccccgggagaugccugcucaccgcccuucuguuguuagcucuggcaccuccaccggaggccagccaguacuguggaaggcuagaauauuggaaccccgacaauaagugcuguuccucuugccuccaacgguucgguccuccacccuguccugauuacgaguuucgcgaaaacugcggccugaaugaccacggggauuucgugacaccacccuuucgaaaauguucaaguggacagugcaacccugacggcgcggagcuuuguagcccaugcggugggggagcugucacuccgacgcccgccgcaggcggcgggcguaccccuuggagauguagggaacggccaguucccgccaagggacauugcccucugacaccagguaaucccggcgcuccguccucucaggagcgcucgagcccugcaucaaguaucgccuggagaacucccgagccagugccucagcaggcuuggcccaacuucuugccacucguagugcugguccugcucuuaacccuggccgugauugcgauacuuuuguuuauccugcuauggcaccucugcuggcccaaagaaaaggcagauccuuauccauacccggggcugguuuguggagugcccaauacacauaccccuuccucuagccaccuuuccucaccaggcgcccuggagacuggugacacauggaaagaagcuaguuugcucccccuguuaagcagggagcugucuucccucgccucacaaccucuuagccggcuguuggaugagcuagaaguccuggaggaacucauugugcugcuugacccagagcccgggccgggaggcggcauggcacaugggaccacgcgccaccuggcugcccgauauggauugccugcggccuggaguacuuucgcauacucucucagaccauccaggagcccccugcgggcuuuaaucgaaaugguaguugcccgugagccuucggcuucucugggucagcuaggcacccaccucgcccagcuggggcgcgcagaugcccuuagaguguuguccaagcugggaucaaguggcgucugcugggcuuga

SEQ ID NO: 57603 - RNA, 2982 nt, Artificial Sequence
  derived and/or modified sequence opt3 from IGHMBP2__Homo_sapiens__NP_002171
auggccagcgcugcaguggaguccuucgucaccaagcagcuggaccuccuugaacuggagagagaugccgaaguugaggaaaggcggucuuggcaagagaacaucucauugaaagaguuacagagucgcggcgugugccugcuaaagcuccagguaagcucccagcgaacagggcuguacggacgucuucuggugacuuuugaacccagaagguaugguucugcggcugccuugccuaguaauucauucacgagcggcgacauugucgggcucuacgaugcagccaacgagggaagucaacuggcuaccggcauacugacacgggugacucagaaauccguuaccguggcauuugacgaaucucacgauuuccagcucagcuuagaccgcgaaaauuccuauagacugcuuaaguuggccaacgaugucacauacaggcggcugaaaaaggcucuaaucgcccucaagaaauaucauucagguccagcgaguagccugauugaggugcuuuuugggcgcucugcaccgucccccgccucagaaauccacccucugaccuucuuuaauacuuguuuggacacaagccagaaggaggcuguacucuucgcccugagucaaaaagaauuagcaauuauccauggaccacccggcaccggcaagacgacuaccguuguggagauaauccugcaggcugucaaacaggggcucaaggugcuuugcugugccccuucuaacauugcgguggauaaucuggucgaacgauuggcccuaugcaagcagagaauccugaggcucggacacccagcacggcugcuugaguccauucaacagcauagccuggacgcuguuuuggcccguucggauucugcucagaucguggccgacauacgcaaagauauugaccaaguauuugugaagaacaaaaagacacaggacaaaagagagaaguccaauuucaggaacgaaaucaaacuccugcggaaggaguuaaaggaacgagaggaagcagccaugcuggagucacuaacuucggcuaaugucgugcucgcgaccaacacaggugcaagcgccgauggcccccugaaacuuuugccugaguccuacuuugacguuguggucauugaugaaugugcucaggcccuggaggcaucuugcuggaucccacuccugaaggcccgcaaauguauccuugcuggggaccacaagcagcugccgcccaccacggugagccacaaagccgcauuggcgggacucucacugaguuuaauggaaagacuggcugaggaauauggcgccaggguaguucggacucuaacagugcaauaccgcaugcaucaggcaauuaugagaugggccuccgauaccauguaccucggucagcugacugcucacagcucugucgccaggcaucuuuugcgugaccugccugggguggcagcuacagaggagaccggagucccacuccuguuaguggauacggccggcugcggccuguucgaacuugaggaagaggacgagcagucaaaggggaaucccggagaaguucgguuggugagucuccacauacaagcgcugguagaugccggugucccugcucgagacaucgcagugguuagcccauauaaccuacagguggaucugcucagacagucccugguccacaggcaucccgagcuugaaauuaagucuguggacggcuuucaggggcgcgagaaagaagccguaaucuugucguucgugcggagcaauagaaagggagagguuggcuuccuggcugaggacaggcgcauaaacgucgccgugacccgagcacggcgucacguggcggucauuugugauuccagaacaguuaacaaucaugccuuuuuaaaaacucucguggaauacuucacccaacacggugaggugaggacagcuuuugaauaucuggacgauaucguaccggagaacuacucacaugaaaauagucaggggucuagccacgccgcaacuaagccucagggccccgcuaccuccacacgcaccggaucacagcggcaagagggcgggcaggaggccgcagccccagcuagacagggaaggaaaaagccugcggguaagagccuugccucugaagcacccucccaaccaagucugaacggcgggagccccgagggagucgaaucucaggacggcguggaucacuuccgagcuaugaucguugaguuuauggccuccaaaaagaugcaguuggaguucccuccaucacucaauagucaugaccgccugcgggugcaccagauugccgaggagcauggucuaagacacgauagcucgggggaaggcaaaaggcguuuuaucacugucuccaagcgcgcuccgcggcccagagcagcccugggaccuccagcgggcacagggggacccgcuccucuccaaccagugcccccgacgccugcccagaccgagcagccacccagggaacagcgagguccugaccaacccgaucugcggacucuucacuuggagcgccugcagagaguuaggucugcacagggccagccagccagcaaagagcaacaggcuucagggcagcaaaaguuaccugaaaagaaaaagaaaaaggcaaaaggacaucccgccaccgaccucccaacagaggaagauuucgaggcgcuggugagugcugccguaaaggcagacaauaccugcggcuuugccaaauguacugcuggugucacaacgcuugggcaguucugccagcugugcucccggcgauauugucuaucucaccaucucccggaaauucacggcugcggagagagagcccgcgcacaugcuaggcagcguauaagccgggagggcgugcuguacgccggguccggaaccaagaacggcucauuggauccugcgaagagagcccaacugcagaggcgcuuagacaaaaagcucagcgaacugaguaaccagcgaacuucuagacggaaagagagggguacauga

SEQ ID NO: 57604 - RNA, 480 nt, Artificial Sequence
  derived and/or modified sequence opt3 from IGJ__Homo_sapiens__NP_653247
augaagaaccaccuccuguucuggggcgugcuugccgucuuuaucaaagcuguucaugugaaggcacaggaggacgaaagaauuguacugguggauaauaaaugcaagugugccaggauaaccagccggaucauucgcuccucugaggaccccaacgaagauaucgucgagcgaaauauucguaucauagugccuuugaacaauagagaaaacaucucagacccaacaaguccguuaaggacucgguucguuuaccaccugagcgaucuaugcaaaaagugugaccccacggagguggagcucgauaaucaaauugucaccgcgacacaguccaacaucugcgacgaagauucugcuacugagaccuguuauacauacgaccgcaauaagugcuauaccgccgugguaccucugguuuacgggggagaaacuaaaaugguggagacagcacuuaccccagaugccuguuaucccgacuga

SEQ ID NO: 57605 - RNA, 642 nt, Artificial Sequence
  derived and/or modified sequence opt3 from IGLL1__Homo_sapiens__NP_064455
augagacccggcaccgggcagggaggucuggaggccccuggcgaaccagggccgaaccucaggcaacgguggccccuucuguuguuaggacuggcuguggucacacacggccuacuccgcccuacugcagccagccagucccgagcgcuggguccaggggcucccggagggucuucacguaguagccuuagauccagguggggccgguuccuguugcagcgcggcucuuggacgggaccuagaugcuggccaagggguuuucagucgaagcauaauucaguuacccacguguucggcagcgggacacaacucacuguacugagucagcccaaagccaccccuuccgugacacuguuuccaccgucuagcgaggaacuccaggcaaacaaggccaccuuagucugucugaugaaugacuucuaccccggaauccuuacugugacauggaaagcugauggcaccccuauuacgcaggguguugagaugacuaccccauccaagcaaucaaacaauaaauaugcagccaguagcuacuugucucugacacccgaacaguggcggucccgccgaucauauagcugccaggugaugcaugaggggaguacugucgagaagaccguggcuccugccgaauguucuuga

SEQ ID NO: 57606 - RNA, 7872 nt, Artificial Sequence
  derived and/or modified sequence opt3 from IGSF10__Homo_sapiens__NP_849144
augaaggugaaaggacgcgggauaaccugccugcucgucagcuucgccguuauuugucuuguggcuacacccggagguaaggcaugcccuaggcggugugccugcuacaugccaacugagguacacuguacguuccgcuaccugaccuccaucccggacucuauacccccuaacguggaacgaauuaauuugggcuacaacucauuaguccgucugauggagacugauuucagugggcuaacuaaacucgaacugcuuaugcugcauagcaaugggauccacaccauuccagacaagacuuuuuccgauuugcaggcgcuccaagugcugaaaaugucuuauaacaagguucggaagcugcagaaagacaccuucuacggccucaggucguuaacucggcugcauauggaucacaauaacaucgaguuuaucaaucccgaaguguucuauggucuuaacuuuuugcgccugguccaucuagaggggaaucagcucacaaagcugcacccugacaccuucgugucacuuagcuaccugcagaucuuuaaaauuaguuucaucaaguuuuuguaucucuccgauaacuuccugacgucuuuaccacaagagaugguaagcuacaugcccgaccuggauucccucuaccuucacggaaauccuuggacuugcgacugucaucugaaaugguugucagauuggauucaggaaaagccagacguuaucaagugcaaaaaggauagaaguccgagcucugcucagcaguguccccuaugcaugaacccuaggaccuccaaaggcaagccacuggccauggugucagcugccgcuuuucaaugugcaaaacccaccaucgacagcagucucaagucuaaaucccugacuauucuugaggacagcucgucugccuucaucuccccucagggcuucauggcuccauuugggucacugaccuugaauaugacagaucagaguggaaacgaagccaauauggucugcagcauucagaagcccucccggaccucuccgaucgcguucacggaggagaacgacuauaucgugcucaacacuagcuuuucaacauuccuggugugcaauauugauuacggucacauacaaccugucuggcagaucuuagcacuguauagugacagcccccuaauucucgaacgcagccaucugcuuucugagaccccacaguuguacuauaaguacaaacaaguugccccuaagcccgaagauaucuuuacuaacauagaggcugaccugcgagccgauccaucauggcucaugcaggaccagauuagucugcagcuuaauagaacagcaaccacguucagcacccugcaaauccaguauuccucugaugcucagaucacauugcccagggccgaaaugcggccugugaaacacaaguggacuaugauuucgcgugacaacaauaccaaacucgagcacacaguacuggugggcgggacugucggauuaaacuguccaggccagggugauccgacaccccauguggacuggcugcuagcggacgggagcaagguucgcgccccuuacguguccgaggauggaagaauccucauugacaagucaggcaaacuggaacuucaaauggcagauaguuuugacacaggcgucuaccacugcauaucuagcaauuaugaugacgcugauaucuugaccuacaggauuacugugguagagccacugguugaagccuaucaggagaacgggauccaucacacgguguucaucggagaaacacucgaccugcccugucauuccaccgguauuccugaugcuucaauaagcugggucaucccaggcaauaacguguuauaccagucuucccgggacaagaaaguccugaauaacgggacucuucgaauuuugcaagugacccccaaggaucagggauauuaccgcugcguugccgcaaauccgaguggcguggacuuucucaucuuccagguaagcgucaaaaugaagggucagagaccucuggagcacgauggggagacagaaggcucuggacuagacgaguccaacccaauugcccaccugaaggaacccccuggcgcucagcucaggaccucagcgcugauggaggcagaaguggggaaacauacaaguagcacaucgaagcggcacaauuaucgcgagcuuacguugcaaagaaggggagacuccacccaucgucgguuucgagagaacagaaggcacuuucccccaucugcccgccggaucgauccucagcacugggcugcccuguuagaaaaagcaaagaaaaacgccaugcccgacaagagagagaauacuacaguuagcccaccgccuguggucacccagcuccccaacauaccaggugaagaggaugacucaaguggcaugcuggcacuucaugaggaauuuauggugcccgccacaaaggcacugaauuugccugcgaggacuguaaccgcugauucccgcacgaucucugacagcccaaugaccaacauuaauuacgggacagaguucucccccgugguuaacucacaaauccucccuccggaagaaccaacugauuucaaacugagcaccgccauuaagacaacugcaaugaguaaaaauaucaaccccaccaugucuucccagauacagggaacgacaaaucagcacagcucgaccgucuuuccucuacugcucggcgccacugaguuccaagacucagaucagaugggucgagggcgggagcauuuucagucucguccacccauuacagugagaaccaugaucaaggacgugaacgucaaaaugcugaguuccacuaccaauaaacuuuugcuggagagcguuaacacaacgaacucucaccagaccagcgugagggaaguguccgagccucgccauaaccacuucuacucacacacuacacaaauuuuaaguaccagcacauuuccgucugauccccauacugcugcccacucccaguucccaaucccuagaaauucaaccguaaacauaccccucuuuagaagguucggccgacagcgcaaaaucggaggccgggggagaauuaucaguccauauaggacgccuguccugcgucgccaucgguacagcauuuuuagauccacaaccaggggaucuucggaaaagagcacuaccgcauucucagcuacagugcuuaacguuacuugucuguccugccuaccccgagagcggcucaccacagccacggcggcccugaguuuuccaucugcugcaccgaucaccuucccuaaggccgacauagcucgcgugcccagcgaagaguccacuacauugguccagaauccacuguuacuccuggagaacaaacccucaguggaaaagaccacuccuacaauuaaauauuuuagaaccgagaucucucaaguuacgccaacuggugccgugaugaccuacgcacccacaagcaucccuauggaaaagacccacaaaguaaaugcgaguuauccgagggucuccagcacuaacgaggccaagcgggauucugugauuacaucaucccuuaguggcgcuaucaccaagccacccaugacaauuauagccaucacucgauucagcagacgcaaaauuccuuggcagcagaauuucgugaacaaucauaaccccaaggggaggcugcguaaucaacacaaagucucguugcagaagucuaccgcaguuaugcucccaaaaacguccccugcucugccccgggacaaggugagcccauuucacuucacaacccuaucaacaaguguaaugcagaucccuucuaacacccugacaacugcccaucacaccacgacaaagacccauaauccgggaucccuucccacuaaaaaggaacucccauuuccuccccugaacccaauguugccuagcauuaucucaaaagacaguagcacaaaguccauaaucucuacccagacugcaauucccgccacaaccccgacguucccagcuagcgugaucacuuacgagacccaaacagagagauccagggcgcagaccauucagcgcgaacaggagccucagaagaagaaucgaacagaucccaacaucucaccagaccagucuaguggcuuuacuacccccacggccaugacaccuccgguccugacuaccgcagaaacaucggugaagcccagcguuuccgcuuucacccacucuccaccugagaauacuaccgguauaucaagcacaauuuccuuucacaguagaacguuaaaccucacugaugugaucgaggaacuggcccaggccucuacccagacacuuaaaagcaccaucgcuucagagacuacacuguccaguaagagccaucaaucuaccacgacucggaaagcaauuauaaggcacuccacaauacccccuuucuugucaagcucggccacccucaugccaguccccauuucuccuccauuuacccagcgcgcggugacugacaacguugcuacacccaucagugggcugaugaccaauacaguggucaagcuacaugaauccagccgucacaacgccaaaccgcagcagcugguagcagagguggccacuucaccuaagguucauccaaaugcuaaauucacgauuggcaccacacacuuuaucuauuccaaccuucuccacucuacucccaugccugcacugaccacagugaagucccaaaauaguaaguugaccccaucccccugggccgaaaaccaguucuggcauaaaccguacagcgagauagcggagaagggcaagaagccugaagucucuauguuagcuacuacgggccugucagaggccaccacacucgugagugauugggacgggcagaaaaauacuaagaaguccgauuucgacaaaaagcccguacaagaagcaaccacaagcaaacugcuuccauuugauucucugucgagauacaucuucgagaagccucggauugugggaggcaaagccgcuucauuuaccauccccgccaacagcgacgcauucuugccaugugaagcugucgguaauccccuaccuacuauucacuggacaaggguuccauccgggcuggaucucaguaagcgcaagcagaacucucgagugcaagugcugccgaauggaacgcuuagcauccagagagucgagauacaagaccggggccaguauuuaugcuccgccucaaaccuguuugguaccgaccaucuccacgugacuuugaguguuguaucuuaucccccuaggauucuggagcgcagaacaaaagaaaucaccgugcacagcggcuccaccgucgagcucaaguguagggcggaagggcggccaucacccacagugacuuggauccuggccaaucagacgguugugagcgagucuucccagggaagucgucaagcagucgugaccguagauggcacacuuguccugcauaacuugagcauuuaugaccgcggguucuacaaaugcguggcuucgaauccuggaggccaggauucccuacugguuaagauccaggugauagccgcuccacccgucauucucgaacagcgaagacaagugaucguugguacuuggggagaaucuuuaaaacugccuuguaccgcaaagggaacaccgcagccaucaguguauuggguccuuagcgacggcaccgaggugaagccccugcaguuuacuaacaguaaacucuucuuguuuuccaaugguacgcuguacauuaggaaccucgccucuagcgaucggggcacauaugaaugcaucgccaccucauccacugggagugagcgcagaguagugaugcugaccauggaagagaggguuacaagcccucggauagaggcugcgucucaaaagcgaacugaagucaacuucggagacaaacuucuacugaauugcucagcaaccggcgagcccaagccacagauuauguggagauugccuuccaaagccgugguggaucagcagcaccgcgucgggagcuggauccauguauaccccaacggaucuuuauuuaucggcagugugacagaaaaggacucggguguuuaccuguguguggcuaggaauaagaugggggaugaccucauucugaugcacgucucccuucggcugaaaccagccaagaucgaucauaaacaauauuuccguaaacaggugcuccacggaaaagacuuucagguugauugcaaggcaagcggcucaccggugccugagauuucuuggagcuugcccgacgguacgaugauaaacaaugccaugcaggcugacgauuccggccacagaaccaggcgcuacacucuguucaacaaugggacacuauauuucaacaaagucggaguggcggaagagggcgacuacaccuguuaugcccaaaauacucuggggaaggaugagaugaagguacaucucacagugaucaccgcagcuccacggauucgacagaguaacaaaacgaauaagagaaucaaagccggagacaccgcaguucuugauugcgaagucacaggcgaccccaagccuaaaaucuuuuggcuguuaccaucaaacgauaugauuucuuucagcauagacagguacacuuuucacgccaaugguuccuugaccaucaacaaggugaagcugcucgauaguggggaguaugugugugucgcucgcaaucccagcggagacgauacaaaaauguacaagcuggacguuguguccaaaccuccgcuuauuaacggccuguacacuaaccggaccguaaucaaggccacagcggugagacauucuaaaaagcacuucgauugccgugcagaaggcaccccaucacccgaggucauguggauuaugccugacaauaucuuucucacugccccauauuacgggagcaggauaacggugcacaagaacggaacauuggaaauccggaauguucgccugucggacuccgcugauuucauuuguguggcccgaaacgaggguggcgagagugucuuaguagugcagcuagaaguucuggagaugcucagaaggcccaccuuucggaauccuuucaacgagaaaaucguggcucagcuugggaagucuacugcacugaauugcagcgucgacggaaaucccccaccggagauuaucuggauauugccuaauggcacccgcuuuucaaacgguccccaauccuaucaguaccugauugccucuaaugggaguuucaucauuagcaaaacaacgagagaagaugcuggaaaguauaggugugccgcacgaaacaaagugggcuacaucgagaagcucgucauacuggagaucggccagaagccagugauucuuaccuaugcgccugggacuguuaaaggaaucuccggugaaucacucagccugcauugcgugucugacggcauucccaagccaaauaucaaauggacaaugccuaguggguacguaguggaucggccccagauaaacggaaaguacauuuugcacgacaauggcacccuggucaucaaagaggccacugcuuaugaucgugguaacuacaucuguaaggcccaaaacuccguugggcauacauuaauuaccgugccggucaugaucguggcauauccaccuagaauaacaaauagacccccaaggagcauuguaacucggaccggagcugccuuucagcuacacugcguggcacugggcguucccaaaccugaaaucacgugggagaugccggaccauucacuccuuucuaccgccuccaaggagagaacacacggcucggaacagcugcacuugcaagggacucuggugauucagaacccacagaccagcgauaguggaaucuacaagugcacagcuaaaaauccccucgguucugacuaugcggccacuuacauacaggucaucuga

SEQ ID NO: 57607 - RNA, 1296 nt, Artificial Sequence
  derived and/or modified sequence opt3 from IGSF11__Homo_sapiens__NP_001015887
augaccagccagagaucuccccuggccccucuccuucuguuguccuuacacggcguggcugcaucacuggaggucagugaaagcccaggguccauccaaguugccaggggacagccggcggugcuacccugcacauucacuacgucugcugcccucauuaaccugaauguaauauggauggugaccccucuuucgaacgcaaaucagccagagcaggucauccuguaccaagguggccagauguuugacggggcuccccgguuccauggacgcgugggcuuuacagguacuaugccugccaccaacguuucaauuuucaucaauaacacacaguugagcgauaccgggacuuaucagugucucgugaauaaccugccagacauuggaggccgaaauaucggcgucacagggcugaccgugcucguacccccuagugcaccacacugccaaauacagggaucccaggauaucgguucugacguuauuuuacuguguagcuccgaagagggcaucccgcgucccacguaccuuugggaaaaguuggauaacacucugaaacuaccuccaaccgccacacaggaccaagugcaggggacugucaccauuagaaauaucucagcucucaguagcggacuguaucagugcguggccucuaacgcgauaggcacauccaccugucuucuggauuugcaagugauuucaccccagccuaggaauaucggucucauugcaggggccaucggaacgggcgcugucaucauuauauuuugcaucgcccugauuuuaggcgcauucuuuuacuggcggagcaagaacaaagaggaggaagaggaagagaucccaaaugagauacgcgaagacgaucugcccccgaaguguaguucugcuaaagccuuccauacugagauuuccagcucggacaacaacacacucaccucuuccaaugcguauaacucaagauacuggaguaauaacccuaagguucacaggaauacugaaagcgugucccauuuuucugaucuugggcagagcuucucauuucacaguggaaacgccaauauccccuccaucuaugcaaacgguacacaccugguaccaggccagcauaagaccuugguggucacggcuaaucgggggagcucuccucaagugaugucacgcaguaacggaagcguuucccgaaaacccagaccaccccacacccauucuuacacaauuucgcacgccacucuagagaggaucggcgcugugccugucauggugccagcccagagccgggcagguucccugguauga

SEQ ID NO: 57608 - RNA, 4026 nt, Artificial Sequence
  derived and/or modified sequence opt3 from IGSF1__Homo_sapiens__NP_001164432
augacccuggacagacccggcgagggggccacaaugcucaagacuuucacggugcuucuguuuugcaucaggaugagcuugggaaugaccuccauugucauggauccucagccagaauuauggauagagucuaacuacccgcaagcucccugggaaaauaucacacuguggugucggucaccuagucgcauuagcuccaaauuccuacuccugaaggacaaaacucagaugaccuggauccgaccaucucacaagacauuucagguuucguuccuuauuggugcacugaccgagucaaacgccggcuuguaucguugcuguuacuggaaagaaacuggguggagcaagcccaguaaggugcucgagcuggaggcgccuggacagcugccaaaacccaucuuuuggauacaagcugaaacuccugcccucccaggcugcaauguaaacaucuuaugucaugguuggcugcaggaucuuguguucauguuguuuaaggagggguaugcagaaccggucgacuaccaggugcccaccggaacgauggccauuuucuccaucgauaaucugacuccugaggacgagggcguuuauauuugcagaacccacauccagaugcuaccaacacucuggucugaacccagcaacccucugaaacuuguggucgcuggccuguacccaaagcccacuuugaccgcacauccggggccuauaauggcccccggagagucccucaaucugaggugucaagguccaauuuauggcaugacauuugcuuuaaugcggguggaagaucuggagaaaucauucuaccacaagaagaccaucaaaaacgaagccaauuucuucuuucagagucucaagauucaggacacggggcauuaccuuugcuucuauuacgaugcgagcuaucgcggaucucuguuguccgacguacuaaaaaucuggguuacugauacauucccuaagaccuggcugcucgcaagacccucagccgugguccagaugggccaaaacgugagccugaggugucgggguccaguggacggggucggacuugcucuguacaaaaagggcgaggauaaacccuugcaguuucucgacgccacaaguaucgacgauaauacaucuuucuuucugaacaauguuaccuauuccgacacgggcauuuacagcugccacuauuuacugaccuggaagacaucgauacgcaugccuucucacaacacuguggagcuaaugguaguggauaagccaccgaaacccucccucucagcauggccuaguaccgucuucaagcuggggaaagcuaucacacuucagugucgagugagccauccaguuuuggaauuuucccuggagugggaagagagagaaacuuuccaaaaguuuucugugaauggagacuucauuaucagcaacgucgaugguaaaggcaccgggacauacucaugcaguuacaggguggagacccaccccaacauauggucccaucggagcgagccucucaagcugaugggaccagccggcuaucuuacuuggaauuacguacugaacgaagcgauucguuugucucucaucaugcagcugguugccuuacugcuagugguccucuggauccgcuggaagugcagaaggcugcggauucgagaggcauggcuuuuggguacggcucagggggugacaaugcuguuuaucgucaccgcccuccuguguugcgcuauuucauucgccggcuuauguaauggagugcugauagaagagacugaaaucguuaugcccaccccgaaaccugagcuuugggcagagacaaacuuuccauuggcccccuggaagaaucucacccuguggugccgcaguccuagcggcuccacuaaagaauuugugcuacugaaggacgggacaggauggauugcuacgagacccgcgucugagcagguaagggcagccuuuccacucggugcucugacccaaucgcacacuggcagcuaucacugucauuccugggaagagauggccgucucagagccuagugaagcacuugaguugguggggacagauauccugcccaaaccaguuaucucugccagcccgaccauucggggacaggaauuacagcuccgcugcaagggcuggcuggcugguaugggguucgcccuuuacaaggagggcgaacaggagccugugcaacagcugggagcagucggcagagaggcguucuuuacaauacagaggauggaagacaaagaugaggggaacuauuccugucguacucacaccgaaaagcggcccuucaaauggucagagccaagcgaacccuuggagcucgugaucaaggagauguacccuaaaccauuuuucaagacgugggcuucucccguagugaccccuggagcccgaguuacauuuaauugcuccacuccgcaucagcacaugaguuucauucuguauaaggacgguagcgaaaucgcaucuuccgauagaucaugggccaguccaggcgcuagcgccgcacauuuucuaauuaucucggucgggauaggagacggcgguaacuacuccuguagguacuaugacuucucuaucuggagcgagcccucagauccuguggaacugguggucaccgaguuuuacccaaaacccacacuccuggcucaaccugggccgguuguguuccccggcaagagugugauucuucgcugccagggaacuuuucagggcaugcgguucgccuugcugcaggaaggggcgcacguaccauuacaauuuagauccgucucuggaaauagcgccgacuuccuccugcacaccgugggcgcugaggauuccgguaacuauucauguaucuacuaugagacgacaaugagcaauagggggaguuaccuuucuaugccucugaugauuuggguuaccgacacuuuccccaaaccauggcuauuugcagaaccuuccagcgugguccccaugggacagaacgugacacucuggugccgcggcccaguucauggugugggcuauauccugcacaaggagggggaagccaccucgaugcaguuguggggaucaacuucuaaugauggcgcuuucccgauaaccaacauuagugggacauccaugggacgauacagcugcuguuaccauccugacuggacgucuagcaucaaaauucaacccuccaauacccuggaguuacucguaacuggccugcuuccaaagcccucacuguuggcccagccugguccaauggucgcacccggggagaacaugacacuccagugccagggagaacugccugauaguaccuuugugcuacugaaagagggcgcgcaagaaccgcuugagcagcagcggccaagcgguuaucgugccgacuucuggaugcccgcugugagaggcgaagauucugggaucuacuccugugucuauuaccucgacucaacaccuuuugccgcaaguaaccacagcgauucccuggagauauggguuacugacaagcccccaaagccuucuuugucggcuuggcccagcaccauguucaaacugggaaaggauaucacguuacagugcaggggcccacucccugggguggaguuuguacuggaacacgacggagaggaagccccgcaacaguucucagaggacggcgauuuugugauuaauaacgucgaagguaaagggaucggaaauuauuccuguaguuaccgccuucaggcauaucccgacauuuggucugagccaagcgauccucuggaguuggugggcgccgcuggucccguugcgcaggaaugcacagugggcaacaucguccgguccucacucauagugguuguggucguagcccugggggugguucuagcaauugaguggaagaaauggccaagacugaggacccgaggaucugaaacugacggccgcgaucaaaccaucgcucuugaggaauguaaucaggagggggagccuggaacacccgccaacagcccgaguuccacuagccagcggaucucuguggaacucccagucccuauuuga

SEQ ID NO: 57609 - RNA, 1224 nt, Artificial Sequence
  derived and/or modified sequence opt3 from IGSF5__Homo_sapiens__NP_001073913
augggccagaaggagagaagcaccgccgacacacugcccgaucucgaagaguggaaauccgcugcaggccuuaggugguggcaaacugccguggucgacggaucugguucaggcaacgaaguuaucgaggggccucagaaugcgcgggugcugaagggaagucaggcucgcuucaacugcacgguaagccagggcuggaaauugauuaugugggccuuauccgauauggugguccugucugugcgaccaauggaaccgauaaucaccaaugaccguuuuacaucgcaaagauacgaucagggugggaacuucacuucagagaugauuauccacaauguugagcccagcgacaguggaaacauuagguguucccuacaaaauucucggcuccauggcagcgcauaucugaccgugcaggucaugggcgaacuuuuuaucccuuccgugaaccugguaguugccgagaaugaaccaugcgaggugacauguuugcccucacacuggacccgccucccugauauaaguugggagcuggggcugcucgucagccauucuuccuacuauuucgugccagaacccucagacuuacagagcgcugugaguauccuggcacuuacuccucagucuaacggaacauugaccugcgucgccacguggaagucccugaaagcuagaaagagcgccacuguuaaucuaaccgugauuagguguccacaggauacagguggcgggaucaacauuccgggaguacucucgucucugcccucccuuggcuuuucacugccuacuugggguaaggugggguugggacucgcgggcaccaugcuguuaacaccaaccugcacgcugacuauccgguguugcuguugccgccgaagauguugcggcugcaauuguugcuguaggugcuguuucugcugucggcguaaacgcggguuuagaauacaguuccaaaagaaaagugagaaggagaaaacaaacaaggaaaccgaaacugagagcggaaaugagaacuccgguuacaacucugacgaacagaagacaaccgauacggcaagccuucccccuaaaucaugcgagaguuccgacccagaacagaggaauagcucuugugggcccccgcaccaacgggccgaucagcgaccuccccgcccagcuucacauccucaggccaguuuuaaccucgcaagccccgagaaggucuccaauaccacagugguuuga

SEQ ID NO: 57610 - RNA, 726 nt, Artificial Sequence
  derived and/or modified sequence opt3 from IGSF6__Homo_sapiens__NP_005840
augggcaccgccagcagauccaacaucgcuaggcaucugcagacaaaucucauucuuuucugcgugggggcagucggagccuguacucugucuguuacgcaacccugguacuuggagguggacuauacccacgaagcgguaacaauaaagugcacuuuuucagcuaccgguuguccuagugagcagccaacaugcuuaugguuccgguacggcgcccaccagccggaaaaccugugucuagaugggugcaaaagcgaggcagacaaguuuaccgugcgcgaagcccucaaagagaaucaggucucccugacugugaaccgaguuacaucuaaugauucggcuaucuauauuuguggaaucgcauuccccucagugccugaggcccgugcuaagcaaaccggcggugggacgacucuugucgugagagaaauuaaacuguugagcaaggagcucaggaguuuucugaccgcccugguaucccucuuaucuguuuacgugacaggagucugcguggcguucauccugcuuagcaaguccaaaucaaacccauugcggaauaaggaaauaaaagaggacagucagaagaaaaagagcgcacgcagaaucuuucaggagauugcccaggaacuguaucauaagaggcacguggagacuaaccaacagucugaaaaagauaauaacaccuacgagaaucggcgcguccuauccaacuaugaacgacccuga

SEQ ID NO: 57611 - RNA, 1842 nt, Artificial Sequence
  derived and/or modified sequence opt3 from IGSF8__Homo_sapiens__NP_001193594
augggcgcccugagacccacccuccuuccuccaagccugccguuguuacugcuacucaugcuggggaugggaugcugggcuagggaggugcuuguccccgaagguccucuguaccggguugcaggcacagccguguccaucucuuguaacguaacuggguaugagggaccagcgcagcaaaauuucgaaugguuuuuguaccgccccgaggcuccugacacggcccucggcauugugucaaccaaggauacacaguucaguuaugcagucuuuaaaagccgagugguugccggugaagugcagguccagcgucugcaaggggacgcugugguacugaagauagcaagacuccaggcccaggaugcuggaaucuacgagugccacacuccauccaccgacacaagguauuuaggcucuuacucgggcaaaguugagcugcgggugcuucccgaugucuugcaagugucagccgcgccuccagggccgcgcggaagacaggcacccaccagcccuccaaggaugacugugcaugaaggucaggagcuggcccuaggcugucucgcucggacaaguacccagaagcacacgcaucuggccgucuccuucgggcgcucuguucccgaagcaccugugggacgaagcacucuucaggagguagugggcauuagauccgaccuggcugucgaggccggugcgccauaugccgaaagguuggcagcuggggagcuccggcugggaaaagaaggcaccgaucguuaccgcauggugguuggcggggcccaagcuggagacgccgguacauaccacugcacugcagccgaguggauccaggaucccgacggcucaugggcucagauugcggaaaagagagcaguguuagcccaugucgaugugcaaacccugaguagccagcucgcuguaacaguugggccgggagagaggcggaucggcccuggugagccccuugaacuguuguguaacgugucuggggcccuaccuccagcaggccgacacgccgcuuauuccgucggaugggagauggcccccgcaggcgcgccagggcccggacgccugguggcucagcucgacaccgaaggugucggcucacuggggccuggauacgagggcagacacauagccauggaaaagguggcaagcaggacguaucggcuucgccuggaggccgcuagaccaggugaugccgggacuuacaggugcuuggcaaaggcuuauguucguggcaguggaacacggcuccgagaggccgcgucugccagauccaggccgcugcccgugcauguacgcgaagagggcgucguguuagaagcuguugcauggcuggccgggggaaccguguaccggggugagacugcuagccuacucuguaauaucucggucagaggcgggccuccaggacugaggcuugccgcaucuugguggguggaacgccccgaggacggcgaguuguccucaguaccugcgcagcuggugggugggguuggccaagacggagucgccgaacucggcgugcgaccagggggaggccccgugagugucgagcugguugguccgcggagccaccgucuuagacugcauuccuuggggccugaagaugagggaguguaucacugcgcuccaucugccugggugcagcacgcagacuacagcugguaccaggcuggcucagccaggaguggucccguaacagucuauccuuacaugcaugcacucgauacccuguuugugcccuuacugguuggcacggggguggcccuagucaccggagcuacagugcucggcacuauuaccuguugcuucaugaaacgccugcggaaaagauga

SEQ ID NO: 57612 - RNA, 1236 nt, Artificial Sequence
  derived and/or modified sequence opt3 from IHH__Homo_sapiens__NP_002172
augagccccgccagacugaggccucggcuccacuucugccuugugcuguuguuacugcuagucguuccagcugcauggggcugugggccgggacgcgugguagguucccgacguagacccccuaggaagcucgugccacuggccuacaaacaguuuucucccaacgucccugagaagacccuuggcgcgucagggcgguaugaaggaaaaaucgcucgcaguagcgagagauucaaggaacugacaccaaauuacaaccccgacauuauauuuaaagaugaggaaaauacuggcgccgacagguugaugacgcaacggugcaaggaucgccucaacucccuggcaaucucugugaugaaucaguggccugguguuaagcugcgagugaccgaggggugggacgaggauggacaucacucggaagagucacuccauuaugaaggcagagccgucgacauuacaacuagcgauagggaccggaacaaauacggcuuacuggcucgucuugcaguggaggccggguucgauuggguauauuacgagaguaaggcucacguucauuguuccgugaaaucugaacacagcgccgcggcaaagaccggagguugcuuuccagccggcgcucagguccgcuuggaguccggggccagaguggcacugucagcugugaggccgggagaccggguccuagccaugggcgaagaugguagucccacauucagcgacguucucaucuuucuggaucgagagccucaccgccuuagagcguuccaggugauugaaacccaagacccacccaggcggcuggccuugacuccugcacaucuccuguuuacagcugacaaucacaccgagccagccgcucgcuucagagccacguuugcaucucauguacagcccgggcaguauguguuagucgccggagugccgggccugcagccugcuaggguugcggcaguguccacucacgucgcccucggcgcuuacgcaccccuuaccaaacacgggacacuggugguagaggauguuguggccucauguuucgccgcugucgccgaccaucacuuggcacaacuagcguuuuggccacugcgucucuuccauagccuggcuuggggaaguuggacuccuggugaaggcgugcacugguacccccagcuucuguaucgguuggggcgacuccuguuagaggaaggaucuuuccauccacugggcauguccggugccgggagcuga

SEQ ID NO: 57613 - RNA, 3999 nt, Artificial Sequence
  derived and/or modified sequence opt3 from IKBKAP__Homo_sapiens__NP_003631
augagaaaccugaaacucuucaggacccuugaguuucgggacauccagggccccgggaauccucaaugcuucagccugcgcacagaacagggaacuguguugauugguuccgagcacggcuuaauagaagucgauccaguuucucgagaggugaaaaacgaaguaucacugguggccgagggguuucuaccggaggacggaaguggccguaucgucggugugcaggaucuccuggaccaggaaagcguuuguguggcuacggcauccggggaugucauucuuugcucucugucgacccaacaguuggagugugugggaucaguagccagcggcaucaguguuauguccuggucucccgaccaggaacucgugcugcuggcgacaggccagcaaacucucauuaugaugaccaaggauuucgagccuaucuuagagcagcagauacaucaggacgauuuuggggaaagcaaauucaucacagucggaugggguagaaaggagacccaauuucacggcuccgaagggaggcaggcugccuuccagaugcaaaugcaugagucagcacugccaugggacgaucaccggccccaggugacuuggcgcggagacggccaguuuuucgccgugagugucguuugcccugaaacaggugcuagaaaagugaggguauggaaucgggaguuugcacuucagagcaccucugagccaguggccggguugggacccgcucuggccuggaagccuuccggcucacuaauugcgagcacgcaagauaagccaaaccagcaggacaucgucuucuuugaaaagaauggccuccugcaugggcacuucacucuuccguuccugaaggacgaggugaaaguuaacgauuugcucuggaaugcagacaguucugugcuggccgucugguuagaagaucugcagcgcgaggaauccagcauucccaagaccugugugcaacucuggacaguaggaaacuaccacugguaucuuaaacagucgcugucuuuuuccacuugcgguaagucaaagaucguuaguuugaugugggacccugugaccccauaccgacuacauguccugugucagggcuggcacuaucucgcuuacgauuggcauuggacaaccgacagaagcgugggggauaauuccucugaccugagcaacgucgccgugauagauggaaauaggguucuugugacgguauuccggcagacugucgugcccccuccaaugugcacauaucaacuguuguuuccccacccgguuaaccaggugaccuuccucgcacacccucagaaaucaaaugaccuggcugucuuagaugccaguaaccagauuuccguguacaaguguggcgacugccccagcgcggacccaacuguaaaacugggugccguugggggcucuggauuuaaggugugucuacguacaccucaucucgagaaacgcuauaagauccaauucgagaauaacgaagaucaggacgucaacccccugaaacuuggcuugcugaccuggauugaggaagauguguuucucgcagugucacacagugaguucagcccaagauccgucauccaucaccugacggcugccucuucggaaauggacgaggagcaugggcagcuuaauguuagcuccucagcugccguggauggagugaucauuagucugugcugcaacucuaagaccaagagcguagucuugcaacucgcagacggucagauauuuaaauaccugugggaaucccccucauuagccaucaagccuuggaaaaauagcggcggguucccagugagguuuccguaccccuguacacagacugagcuggcuaugauuggagaagaggagugcguucuaggccucaccgaucggugucgauucuuuaucaacgacauagaaguggcgucuaauauuacauccuucgcagucuaugaugaguuccugcuuuugacuacccacagucacacaugccaguguuuuugccugcgcgacgccagcuucaagacccuccaagcuggucugucuuccaaccaugugucacacggggaaguuuuaagaaaaguggagaggggcagucggaucguaacugucgugccucaggauacgaagcuggugcuucagaugccacgcggaaauuuggaagucguucaucacagagcccucgugcuggcacagaucaggaaguggcuagacaaacugauguuuaaggaggccuucgaguguaugcguaaacuccggauuaaccugaaucuuaucuacgaucacaaccccaagguauuuuugggcaauguggaaacauucauuaaacaaauagacagcgucaaccauaucaaucuguuuuucaccgaguuaaaggaagaggacgugacuaagaccauguauccugcuccaguuacaucguccguguaccucucucgagaucccgacgggaacaaaauugaucuggucugcgacgccaugagagcagugauggaaagcaucaauccgcacaaguauugucuuucaauccugaccagucauguuaaaaagacuacaccugaguuggagauugugcuccagaaaguccacgaacugcagggaaacgcgccauccgaucccgacgcuguaucugccgaggaagcacuaaaguaccugcuccaucugguggauguuaacgagcuuuaugaccacagcuuggguacguacgauuuugaccugguguuaauggucgccgaaaagucccagaaagauccuaaggaguaccuccccuuccugaauacccuuaaaaagauggagacuaacuaucaaagguuuacaauagacaaauaccugaagcgcuaugaaaaagcuaucggccaccuaucaaagugcgggccagaguacuucccugaaugucucaaucugauuaaggauaaaaacuuguauaaugaggcccugaaguuauacagccccaguucucagcaguaucaagacaucuccauugcauacggagagcaucucaugcaggaacacauguacgagccagcuggccugauguuugcccggugcggugcgcaugaaaaagcccuuagcgcuuuccugaccugcgggaacuggaagcaggcauuguguguggccgcucagcucaauuucacaaaagaccaacugguaggccuaggaagaacucuggccggcaaacuuguggagcagaggaagcacaucgaugcagcgaugguccucgaagagugcgcccaggacuaugaggaagcuguucuguugcuguuagagggggccgcaugggaagaggcucuccgccugguguacaaguauaaccgacuugauauaaucgaaaccaaugugaagccgucgauucuggaggcccagaaaaacuacauggcauuuuuggacucacaaacggccaccuucucucggcauaagaaacgucuccuggucgugagagagcuaaaggaacaggcucagcaggcgggacuggaugacgagguuccucacggccaagaaagugaucucuuuuccgagacaagcucuguagugagcgguuccgaaaugucagggaaguauagucacagcaauucuaggaucuccgcccgcucaaguaaaaaccggagaaaggcagagaggaaaaagcauagccuuaaagagggaucuccccuggaagacuuggcuuuacuggaggcccucuccgaagucgugcagaauacugagaaccugaaggaugagguuuaccacauucuuaaggugcuguucuuguuugaguucgacgagcagggccgagaacuacagaaagccuuugaggauacccugcaacucauggaacgcucgcugccagagaucuggacacuuacuuaucagcagaauagcgcuacccccgucuuagguccuaacucaacggcaaacuccauaauggccaguuaccaacagcagaagacaucugugccaguacuggacgcggaacucuucauucccccuaaaaucaaucggagaacccaguggaaguugagccugcucgacuga

SEQ ID NO: 57614 - RNA, 2265 nt, Artificial Sequence
  derived and/or modified sequence opt3 from IKBKB__Homo_sapiens__NP_001177649
auguucagcggcgggugccacucccccggauuugguagaccuucuccagccuucccggcucccggcucaccuccacccgcaccuaggccaugucggcaggagaccggggaacaaaucgccauuaagcagugccgccaggagcugaguccccgaaaccgugaaagauggugucucgagauacagaucaugaggcggcuuacacauccuaauguggucgcggcucgcgacguuccagaaggaaugcaaaaccuggccccgaaugauuugcccuuacuggcaauggaguacugccagggcggugaccuaagaaaauaucucaaccaguuugagaauuguugcgggcugagggaaggagccauucuuacucuguugagcgauaucgcuuccgcacuccgguaccugcacgagaaccgcauuauccaucgagaccugaagccugaaaauauagugcuccagcaaggcgagcagagauuaauccacaaaauuaucgaucugggcuaugccaaggagcuugaccaggggucuuuguguacgucguucguaggaacccugcaguaccuagcuccagaacuccuggagcaacagaaauauacagugacugucgauuacuggucauuugguacccuugccuucgaaugcauuacaggcuuuaggcccuuccugccuaacuggcagccagugcaauggcauagcaagguucggcagaagagugagguggacaucgucguguccgaagauuugaaugggaccguaaaauuuucuagcucccuccccuauccgaacaaucugaacucaguuuuagcggagcgucuggagaaguggcuccagcuuaugcugauguggcacccucgccagagaggaacugaccccacauacggcccaaaugguuguuucaaagcauuggaugacauacuaaaccugaagcucgugcacauucugaauauggucaccgggacgauccauacuuacccugugaccgaagaugagagucuucaaagccugaaagccaggauucagcaggacacaggaauccccgaagaggaccaggaauugcuccaagaggcuggccuggccuuaaucccagauaagcccgcaacucagugcauuucugacggcaagcugaacgaggggcacacccuagauauggaccucguguuucuguucgauaacuccaaaauaacauaugaaacccagaucucaccucggccacagccggagagcgucaguuguauucuucaagaacccaagcgaaauuuggccuuuuuccagcugcgcaaaguuuggggacagguguggcauucuauccagacgcucaaggaggacugcaacagacugcaacagggucagagggcugcgaugaugaaucuucugcggaacaauuccugcuugagcaaaaugaagaacucgauggccucuaugucccaacagcucaaagcaaagcuggauuucuuuaagacuucaauacagauugacuuagaaaaauacagugagcagacagaguucggcaucaccagcgauaagcugcuacucgcuuggcgcgaaauggagcaagccguagaacugugugggagagagaaugaggugaaacuuuuggucgaaaggaugauggcucugcagacugacaucguggaucuccagcguuccccuaugggacggaagcagggcgguacacuggacgacuuagaggaacaagcccgagagcuguauagaaggcuucgcgaaaaaccacgggaucagagaaccgagggggacucucaggagaugguuagguugcuccugcaggcaauucagagcuuugaaaagaaggugcgcgucaucuacacgcaacuaucaaaaaccgugguaugcaagcagaaagcccuggagcuccugcccaagguugaagagguggucagucuuaugaacgaagaugagaaaacagugguccgauugcaagagaagcggcagaaggaacuguggaauuuacucaaaauugcuuguuccaaggugcguggcccuguuagcggaucuccagacucaaugaacgcgaguagacugagccagcccggccagcuuaugucccaaccgucuacugcaucgaauagccugccugagccagccaaaaaguccgaagaguugguggcugaagcccacaaccucugcacccugcuagagaaugcaauacaggauacaguaagggagcaggaccagucauucacugcccuggauuggaguuggcuccaaaccgaagaggaggaacacucuugucuggagcaggcuagcuga

SEQ ID NO: 57615 - RNA, 1896 nt, Artificial Sequence
  derived and/or modified sequence opt3 from IKBKE__Homo_sapiens__NP_001180250
auggaguacugcagcuccggcucucugcucucagugcuugaaagucccgagaacgccuucgggcugccugaagacgaguuuuuggucguuuuaagaugugugguagcuggaaugaaucaccugagggaaaacgguaucgugcaucgggauauuaagccaggcaauauaaugcgccuagucggggaggagggacagagcaucuauaaacucaccgacuucggcgcagcccgagaacuggaugacgaugagaaguuuguguccguuuacgguacagaagaguaucuucacccggacauguacgagcgugcggugcugagaaaaccccaacagaaggcuuucggggucacuguggauuuguggucuauuggaguaacgcucuaucaugccgcaaccggcucgcugccuuuuaucccauucggcgggcccaggcggaacaaagaaauuauguaccgcaucacaacugagaagccugccggagcuauagccggugcacagagaagggaaaauggcccacuggaguggucauauacccuccccaucacaugccaguuaagccuggggcuucaaagucaguugguuccuauucuggcuaacauccuagaaguggagcaggccaaguguuggggauuugaccaguucuuugcggagaccuccgauauucuccaacgggucguggugcacgucuucucucugagccaggcaguucuucaucacaucuacauacacgcccauaauacuauugcuaucuuucaggaagccgugcacaaacagacauccguagcaccacgccaucaagaguaccuguucgaaggccacuugugcgugcucgagccgucagucagugcucagcacauugcccauaccacggcgagcucuccccugacuuuauuuuccaccgccaucccuaagggucuggcauuccgagacccagcucucgaugugcccaaauucguuccuaagguggaccuucaggccgauuauaacacagcuaaagggguccugggagccggcuaccaagcauugagacuagccagggcucugcucgacggccaggaacugauguuucgggggcuucacugggugauggagguacugcaggcgacuugucgucgcaccuuggagguugcaagaacaucacuccuguauuuaagcaguucucugggaaccgaaagguucuccagcguggccgguacgccagagauccaggaacuaaaggcugccgcagagcuccggucgcgacugcgcacucuugccgaagucuugucuagaugcucccaaaauauuacagagacccaggagucacugaguagccucaacagggaacuggugaagucccgggaccagguccaugaggaucgcucuauacagcaaauccaguguugccuugacaaaaugaauuuuauuuacaagcaguucaaaaagagcagaaugaggcccggccugggguauaacgaagaacagauccacaaauuggauaaggugaauuuuucacaucucgcuaaacgucuguuacaaguuuuccaggaggaaugugugcagaaguaccaggccagucugguaacucacggaaagcggaugcgagucgugcacgagacaagaaaccaucuaaggcucguuggcugcuccguggcagcguguaauaccgaagcucaagguguccaggagagccugucuaaacuuuuggaggagcugucacaccagcuccugcaagaccgcgccaagggggcacaggccaguccgccucccauagcuccauauccuagccccacgcggaaagauuuacugcuucauaugcaggaguugugcgaaggcaugaagcuccuggccuccgaccuacuggauaacaacagaauuaucgagaggcucaaucgcgugccagcacccccugacguauga

SEQ ID NO: 57616 - RNA, 1464 nt, Artificial Sequence
  derived and/or modified sequence opt3 from IKBKG__Homo_sapiens__NP_001093326
auggcccuggugauccaggucggcaagcucagacccagggagguucggaccccucaaacaauuaacccaagccuuuucccgucccugcccgugaaauugucuucaauaaucgaaguaccuagugggggagagcgcugcuguagccgacguacuuuaguguacaaggcuagagcauuuuggaaaggugccccacugcccugcuggaugaauaggcaccuauggaagucccagcucugugaaaugguccagccuucuggcgggccagcggcugaccaggaugugcugggagaggaaucgccccuuggcaaaccugccaugcugcauuugccaucagagcaaggugcaccggagacgcuccagcggugccuggaagagaaccaggaacugcgcgacgccauuagacagagcaaucaaauccucagggagcggugugaggaauuacugcacuuccaggcuagucagcgcgaggaaaaggaguuucuuaugugcaaguuccaggaagcacgaaaauugguugagagacuggggcuagagaagcucgaucugaaaaggcaaaaggaacaggcccuucgggagguggaacaucugaaacguugucagcaacagauggcugaggacaaggccuccgucaaggcacaggugaccucuuugcucggagaacugcaggagagccaaucccgcuuagaggcggccacaaaagaaugccaggcucuggagggcagagccagggcagcuucagaacaggcccggcagcucgagagugaacgagaggcgcuucaacagcagcacagcguacagguugaucaacugcgcaugcagggccagucuguggaggccgcauugagaauggaaaggcaggcugccuccgaggaaaagcggaaacuagcucaacugcaggucgccuaucaucagcucuuucaagaguacgacaaccacauuaagucaagcgugguggggagugagcgcaaaagaggaaugcagcuggaagaucuuaagcagcagcugcaacaggcagaggaagccuuggucgcuaaacaggagguuaucgacaagcucaaggaagaggcggagcagcacaaaauagugauggaaacuguacccgugcugaaggcacaagccgauaucuauaaagcugacuuccaggccgagaggcaggcacgugaaaaguuagccgagaaaaaggaacugcuacaggagcaacucgagcagcugcagcgggaauacucuaaacuuaaggcuuccugucaagagagcgcccgaauugaagauaugagaaagaggcaugucgaggugucgcaggcaccuuugccacccgcgccugcuuaucugucuuccccacucgcccugcccucacagcgccggaguccgccugaggaacccccagacuuuugcuguccuaaaugccaguaccaagcacccgauauggacacccuucagauccacguuauggagugcauugaauga

SEQ ID NO: 57617 - RNA, 1674 nt, Artificial Sequence
  derived and/or modified sequence opt3 from IK__Homo_sapiens__NP_006074
augcccgagagagacagcgaaccuuucuccaacccacuggccccggauggccacgacguggaugacccccauucuuuucaccagucaaagcucaccaaugaggauuucaggaaacuucugaugacaccucgggcugcaccaacaagugcgcccccuagcaagucccgccaucacgaaaugccacgagaguacaacgaagacgaggaucccgccgcucguagaaggaaaaagaaaucuuauuacgccaaguugcggcaacaggagaucgaacgcgagagagaauuagcagagaaguauagggaccgggccaaagagcgccgagauggggucaauaaggacuacgaagagacggaacugauuucgaccacagcuaacuauagagcaguuggaccuacugccgaggcugauaaaucagccgcggaaaagaggcggcagcuaauacaggagagcaaauuucucgguggcgacauggagcauacccaccuggugaaggggcuugauuucgcacuguugcaaaagguacgugccgaaaucgcuaguaaagagaaggaagaggaagaacucauggagaaaccacagaaggaaacuaaaaaggacgaggacccggaaaauaaaauugaguuuaagacccgccugggaagaaacguguacaggaugcuguucaaguccaaagccuaugaacggaaugagcucuuuuuacccggccgaauggcauacgucguggaucuggacgaugaguacgcugacacugauaucccuacaacccuuauucgcucuaaggccgacugcccaacgauggaagcgcagacuaccuugacaacuaacgauaucguuauaagcaaacugacccagauccuauccuaucucagacaagguacaaggaauaagaaacugaagaagaaagacaaggggaaacuugaggaaaagaaacccccugaggccgauaugaacauuuucgaggacaucggagauuacgugccaucaaccacgaagacuccccgggacaaggaacgcgagagauauagggaacgugagcgggaccgagaaagagauagggaccgcgaucgggagagagagagggaacgcgaccgagagcgggaacgugagagagauagggaacgcgaggaggagaaaaagcggcacaguuacuuugagaaaccgaaggucgacgaugaaccuauggacguggauaaaggccccggcagcacaaaggagcugauuaagucuaucaaugaaaaauucgcaggguccgcuggaugggaggguaccgagucauugaagaaaccagaagacaagaaacagcucggcgacuuuuucgggaugagcaacaguuaugccgaguguuacccugcuacuauggaugauauggccguagacucugacgaagagguugauuauuccaagauggaccagggaaauaaaaagggcccccuggguagaugggauuuugacacacaggaggaauacagcgaguacaugaacaauaaggaagcauuaccaaaagccgcuuuccaauaugggauaaagaugucggagggaaggaaaacccgacgcuucaaggaaacgaacgauaaagcggagcuggaccggcaguggaagaagauuucugcaaucauugagaaaagaaagaaaauggaagccgauggcguggaggucaagaggcccaaauacuga

SEQ ID NO: 57618 - RNA, 1299 nt, Artificial Sequence
  derived and/or modified sequence opt3 from IKZF1__Homo_sapiens__NP_001207697
auggacgccgaugagggccaggacaugagccaaguguccgggaaggaaucucccccugucucagauaccccagacgagggagaugaaccgaugcccaucccugaggaccugaguacaacuagcgguggccagcaguccucuaaaucggauagaguuguggcuucaaacguaaagguggaaacgcagagcgacgaggagaaugggagggcaugcgaaaugaacggagaggaaugugccgaggaucuccggaugcuugacgcgaguggcgagaaaaugaaugguucccaccgcgaucaagggucuagcgcucuguccggagucggcggcauucgauugccaaacgggaaguuaaaaugcgacauauguggaaucauuugcaucggucccaaugugcugaugguucauaagcguucacacaccggcgaaagaccuuuccaguguaaccagugcggggccaguuuuacacagaagggaaaucuacucaggcauauuaaacugcacagcggcgagaagccauucaaaugucaucuuugcaacuacgcaugucggcgcagagaugcccugacuggucacuugaggacccacucuggggacaagggacucuccgacacacccuaugauucaagcgcuaguuacgaaaaagagaaugaaaugaugaagucucaugugauggaccaagcaaucaacaaugccauaaacuaucugggcgcugagucccugcggccucucguccagaccccaccgggcgggagcgaggugguacccguuaucucgccuauguaccaguuacacaagccacuggccgaaggaacuccccgcucuaaucauuccgcgcaggauucagcaguggagaaccuuuugcugcuaaguaaagccaagcucgucccuagcgaacgagaggcuuccccaucuaauagcugccaagacucaacagauaccgaaaguaacaacgaggagcagagauccggucugauuuaucuuacgaaucacaucgcaccccacgccaggaacggccugagcuugaaagaggaacaucgggcuuacgaccuccugcgugccgcgucugaaaauucacaggaugccuuacgcguggugaguacuagcggggagcaaaugaaggucuauaaaugugaacacugcagaguucuguuucucgaccaugugauguacaccauucacaugggaugccauggcuucagggauccguuugaguguaacaugugcgguuaccacucccaggaccgguaugaguucucuucgcacaucacacgaggggaacaucgcuuucacaugagcuga

SEQ ID NO: 57619 - RNA, 1503 nt, Artificial Sequence
  derived and/or modified sequence opt3 from IKZF2__Homo_sapiens__NP_001072994
auggagaccgaagccaucgacggcuacauuacaugcgauaacgagcugagccccgaaagagagcacuccaauauggcuauagaccucacuucuucaacgccuaacgggcagcaugcaaguccaagccacaugaccuccacaaauucugugaaacuugaaaugcaaucggaugaggagugugacaggaagccgcugucacgggaagaugagauccgcggacaugacgaagguagcaguuuggaggagcccuuaauugaauccucugaggucgccgauaaccgaaagguucaggaacugcagggcgaagggggaauccgucuaccuaauggcgagagaccauuccacugcaaccaguguggugcgagcuuuacucaaaaagggaaucuccugaggcauauuaaacuucacuccggagagaagcccuucaagugcccuuuuuguucauaugcuugccggcgcagagacgcccugaccggccacuugaggacacauagugugggcaagccacacaaauguaacuacugcgggcggagcuauaagcagcgaucuucccucgaggaacauaaagagcgcugucacaauuaccugcagaacguaucaauggaagcagccggacaggugaugagccaccaugugcccccuauggaggauugcaaggaacaagagccaaucauggacaauaacauaagucuggucccguucgagagacccgcuguuaucgaaaaacucaccgguaauaugggcaagaggaagucuuccacuccucagaaauuugugggggagaaguuaaugcgguucagcuauccagauauucacuuugacaugaaccugacauacgaaaaagaggcagaacuuaugcagucgcauaugauggaucaggccaucaauaacgcuauuaccuauuugggagccgaggcgcugcacccccuaaugcaacauccuccaucuacgaucgcagaggucgcccccgugauauccucagcuuacagucagguauaccacccgaaccguauugaacgcccuaucagcagagagacugccgacucccacgaaaauaacauggacggccccauuucucucaucaggccaaagagccggccucaggagcgagaggcaucacccaguaauuccugucuggauagcaccgacucugaaucaagucaugaugaccaccaaagcuaucagggucauccagcucuuaaccccaaacgcaagcaguccccugccuacaugaaagaggauguuaaggcgcuggacacaacuaaggccccaaaagggucuuugaaggauaucuauaaaguguucaauggagaaggcgagcagauuagagcauuuaagugcgaacacugcaggguccucuuccuggaccacgugauguacaccauacauaugggcugucacggguaucgggauccguuagagugcaacaucuguggauaccgcucgcaagacagauaugaguuuagcucccauauugugaggggugaacacacauuccauuga

SEQ ID NO: 57620 - RNA, 1428 nt, Artificial Sequence
  derived and/or modified sequence opt3 from IKZF3__Homo_sapiens__NP_001244337
auggaggacauccagaccaacgccgaacuuaagagcacacaagagcaguccgugcccgcugaugacucuaugaaagucaaggaugaauacucagagagagacgaaaauguucucaaaagugagccuaugggcaacgcagaggaaccagagauuccguauagcuacuccagggaauauaaugaguacgagaacauaaagcuggaacggcacgugguaucuuucgauucgucacgccccacuagcgggaaaaugaauugcgacguguguggacugaguugcaucuccuuuaacgucuugauggugcauaagcgaucucacacgggugagcguccuuuccaguguaaucagugcggcgccagcuuuacccaaaaggggaacuuacugagacauauuaaacuacacacaggagaaaagccauucaaaugucaucucugcaauuaugcgugucagaggcgggaugcucugacuggccaccuucgcacccacuccguugagaagcccuacaaaugcgaauuuugugguagaucauauaagcagaggaguagccuggaggagcauaaggaacggugccgcacauucuugcagucuaccgacccuggggauacugccuccgcagaggcccgacacaucaaagcugaaaugggaucagagagagcacucgugcuggacaggcuggccagcaacgucgcuaagcggaaaaguucuaugccacaaaaguuuauuggcgaaaaacgucauuguuucgaugugaauuacaacuccagcuacauguaugagaaggagucggaacucauccagacacgcaugauggaccaggccauaaauaacgcgaucucuuacuuaggcgcagaggcccugagaccccuuguacagaccccuccagcuccgacguccgaaaugguucccgugauuucaaguauguauccuaucgccuugacuagggcagagaugagcaauggggcuccacaagaacuggagaaaaaguccauucaccuacccgagaagucugucccuagcgaacggggacucucaccaaacaacaguggucacgauuccaccgacacagacagcaaucaugaggaacgacagaaccacaucuaccagcaaaaucauauggugcugucucgcgccagaaacggcaugccccuucugaaagaggugccgaggucauaugaguugcucaagccucccccaauaugcccucgggauagugucaaaguuauuaauaaggaaggggaggugauggacguauaccgcugcgaucacuguagagugcuguuuuuagacuaugucauguucacuauccauaugggaugccacggcuuuagggaucccuucgaauguaacaugugcgguuaccguagccacgaccgguacgaguuuuccucucauauugcgcgaggggaacacagagcccugcucaaauga

SEQ ID NO: 57621 - RNA, 1758 nt, Artificial Sequence
  derived and/or modified sequence opt3 from IKZF4__Homo_sapiens__NP_071910
augcacacacccccugcccugccaagaagguuccagggcgggggacgggugcgcaccccggguagccaucgacaaggcaaggacaaccucgagcgugaucccuccgggggaugcgucccugacuuucuuccacaggcucaggauucuaaucacuucaucauggaaucacuguuuugugagaguagcggcgacuccucuuuggaaaaagaguucuuaggugcacccguugggccuucggugucaacuccaaacagccagcauaguucccccucuagaagccuguccgccaauucaauuaagguagaaauguacagugaugaggagagcucuaggcuacucggaccugacgaacggcugcuugagaaagaugacuccgugauagucgaagauucacugagcgagccauugggcuauugcgacggcagugggccggagccccacucuccuggagguauccgccucccaaacggcaagcugaaaugugaugugugcgggaugguuuguauuggacccaaugugcugaugguccauaagagaucccacacgggcgaaaggccuuuucacugcaaccaauguggugcgagcuucacccagaaggggaaucucuuacggcauaucaaacugcacucgggagagaagccauuuaaaugccccuucuguaacuacgcuugccgccgaagagacgcccuuacaggccauuugaggacucacucuguguccucaccgaccguaggcaagccuuauaaauguaauuacugcgggcggaguuauaagcagcagagcacacuggaagaacacaaggaacguugccauaacuaccuacaaucccucucuaccgaggcacaggcccuggcuggacagcccggugaugagauucgcgaccuugaaaugguuccagacagcaugcugcacucaaguuccgagagaccuacuuuuaucgauagguuggcaaauagccucacaaaacggaagcgaucuacgccccagaaauucgugggcgaaaagcaaaugcgcuuuucacugagugacuuaccauaugaugucaacagcgggggauacgagaaagacguggaacugguggcccaucacucccucgagcccggcuucgguucuucgcuugcuuuugucggggccgagcaucugagaccuuugaggcuaccaccgaccaauuguauaagcgaacugacucccguuaucuccucaguguacacccagaugcagccucucccaggccggcuggagcuucccggaagucgcgaagcgggcgaggggccugaagaucuggcagacggagguccauugcucuauagacccaggggcccgcugacagauccuggggccucuccaagcaacggaugccaagacuccacugauaccgagucaaaucacgaggaccguguagcuggcguggucagcuuaccccaggguccucccccacagccucccccaacaauugugguugggcggcacucuccggccuacgcaaaggaagauccuaaaccccaggagggccugcuacgaggaaccccaggccccuccaaggaagugcucagagucgugggggagaguggagagccuguaaaggcuuucaaaugugaacauugcaggauccuguuccuugaccacguuauguuuacgauucauauggguugucacggcuuccgcgacccauuugagugcaacaucuguggguaucacagccaagaucgguacgaguucucuucccauauagugagaggagagcacaaggucggcuga

SEQ ID NO: 57622 - RNA, 537 nt, Artificial Sequence
  derived and/or modified sequence opt3 from IL10__Homo_sapiens__XP_011507808
augcacagcuccgcccugcucugcugucuugugcuguugaccggcgucagagcuucucccgggcagggaacacaaucagagaacaguugcacucauuucccugguaauuuaccaaacaugcugagggaccuacgggaugcauuuagccgcguuaagacguucuuucagaugaaagaccagcucgauaaucugcuucugaaggaauccuugcucgaggacuucaaaggcuaccuggggugucaggcccugucugaaaugauccaauuuuaucucgaggaagugaugccgcaggcggagaaccaggaucccgacauuaaggcucacguaaauucguuaggagagaaccugaaaacccuucgauugcgucugagaaggugccaucgguuccuaccuugugaaaauaagucaaaggccguggagcaggucaaaaacgcauuuaauaagcuccaagaaaaaggcauauacaaggccaugagcgaguucgauaucuuuauuaacuauaucgaggcuuacaugacaaugaaaauucgcaauuga

SEQ ID NO: 57623 - RNA, 1737 nt, Artificial Sequence
  derived and/or modified sequence opt3 from IL10RA__Homo_sapiens__NP_001549
augcugcccugccucgugguccuucuggccgcuuuguuaagccugagacuaggcuccgacgcacacgggaccgagcucccuucuccaccgucaguuugguucgaagccgaguuuuuccaucacauccugcauuggacacccauuccuaaccagagugaaagcacuuguuacgagguggcgcuucugagguauggaauagaauccuggaacucuaucucgaauugcucacaaacguugagcuacgaucucaccgcuguaacacuggaccuguaucacaguaaugguuaccgggcccgcgugcgagcagucgauggcucccgucauucuaacuggacugugaccaauacaagauuuagcguugacgaggugacccucacugucggguccgugaacuuagagauucacaauggauucauccugggcaagauucagcuuccaaggcccaaaauggccccugcuaacgauacauaugaaucaaucuuuagucacuuccgggaguacgaaauagcaauccgcaagguaccagguaauuuuaccuucacgcauaaaaagguuaaacacgagaacuuuagcuugcugacuucuggggaggugggagaguucuguguccaggugaagcccuccguggccucaagaagcaauaagggcauguggaguaaagaggaaugcauuucucuaaccaggcaguauuuuacagucacuaacguuaucauuuucuuugcuuucgugcuccugcuuuccggcgcccuggcguacuguuuggcacuccaacuguacguacggcgccgaaagaaauuaccuagcgugcuccuguucaagaaaccaucgccguuuaucuucauaucucagagacccuccccugagacccaggacacaauucauccacuugaugaagaggccuuucugaaggucucacccgaguugaagaaucuagaccugcacgggaguaccgauagcggauucgguuccacgaaaccuucucuccagacugaagaaccacaauuucugcuucccgacccgcacccucaggcugauaggacacugggcaaccgggaacccccaguguugggggacagcugcucaaguggauccagcaauucuaccgauucaggcaucugucuccaggagccuagucugagccccuccacugguccaacaugggaacagcaaguugggucuaacucgcguggacaggacgacagcggcauugauuuagugcagaacuccgagggccgcgccggggacacccaaggagguucagcacugggccaucacagucccccugagccagaagucccgggggaggaagaucccgcugccguggcguuccagggauaucuaagacagacgaggugcgccgaggaaaaggcaaccaaaacaggcugucucgaggaggaaucuccucugacugacggucuugggccaaaguuuggccggugcuugguagaugaggcuggacugcaucccccugcccucgcuaaaggcuaccugaagcaggacccacuugaaaugacccuggccagcuccggggcacccacaggacaauggaaucagccgacugaggaguggucauugcucgcccugagcucuuguuccgauuuagguaucagugacuggagcuucgcucacgaucuggcgccucuaggcugcguugcagccccagggggacuccugggcucuuuuaacuccgaccuugugaccuugccccugaucucaagucuccagagcucggaauga

SEQ ID NO: 57624 - RNA, 978 nt, Artificial Sequence
  derived and/or modified sequence opt3 from IL10RB__Homo_sapiens__NP_000619
auggccuggagccugggcuccuggcucgggggaugccuucuggugucugcuuuggguauggugcccccuccagagaacguuagaaugaacucagugaauuucaagaauaucuuacagugggaaaguccggcauuugccaaaggcaaccugaccuucacagcgcaauaccuaagcuauaggauuuuucaggacaaguguaugaauacuacgcucaccgagugcgauuucuccucucugucgaaauacggggaccacacacuucggguacgcgcugaauuugccgaugagcauucagacugggugaacauaacuuucugucccgucgaugacaccaucauuggaccuccaggcaugcaggucgaaguucuggcagauagcuugcacaugcgauuucucgcccccaagaucgagaaugaguaugaaacauggaccaugaaaaacguguacaauaguuggacuuauaacguccaguacuggaagaaugguacagacgagaaguuccaaauuaccccucaguaugauuuugaagugcugcguaaccuggagccauggacgacuuacugcguacagguuagaggguuccuccccgacaggaauaaagcuggagagugguccgaaccugugugugagcagaccacacaugaugaaacugucccaucuuggaugguggcagugaucuuaauggccagcgucuuuaugguuugccuggcucuuuugggcuguuucgcccugcuauggugcguguacaagaaaaccaaguaugcguuuuccccgcggaacucacucccccaacaccugaaagaguuccuuggccauccucaccacaauacacuguuguucuuuaguuucccacucagcgacgaaaacgauguauuugacaagcugucugugauagcagaggacuccgagucagggaagcagaaccccggagauagcuguaguuuagguaccccuccaggccaggggccccagucuuga

SEQ ID NO: 57625 - RNA, 600 nt, Artificial Sequence
  derived and/or modified sequence opt3 from IL11__Homo_sapiens__NP_000632
augaacugcguguguagacugguccucguugugcuuagccuguggcccgacaccgccguagcuccuggcccaccgcccgggccuccaagggugucccccgauccucgggcagaguuggacucuacagucuuacugacucgcucacuacucgccgauacgcgacagcuggcggcucaacuucgugacaaguucccagccgauggagaccacaaucuggauaguuugcccacccucgcaaugagcgccggugcucugggcgcacugcagcucccugggguguuaacaagacugagggccgaccuuuuguccuaccugcggcauguucaguggcuacgcagagcuggagggucuucgcucaaaacucuggaaccagagcuugguacccugcaggccagguuggaucggcuccugcgccgauuacaacugcucaugucaagacuugcgcugccgcagcccccuccagaucccccugcaccacccuuggccccgccuagcagugcuuggggcggaaucagggccgcacacgcuauucuaggcggccugcaucucacacuggacugggccgugcgggggcuucuguugcucaagacccgucuguga

SEQ ID NO: 57626 - RNA, 1269 nt, Artificial Sequence
  derived and/or modified sequence opt3 from IL11RA__Homo_sapiens__NP_001136256
augagcuccucuugcucaggccugaguagagugcucgucgccguugcuaccgcacuugugagcgccuccucucccuguccucaggcgugggggccaccgggaguacaauacggucagcccggcaggucggugaagcugugcuguccuggggucacagcuggagacccagugucaugguuccgggauggcgagcccaaauuguuacaggguccugacagcgggcugggacacgagcuaguucucgcccaggcagauaguacugacgagggcacguauaucugccaaacccuggauggcgcccuugggggaacagugacucugcaguuggguuacccacccgcucgcccugucguguccugucaggcagccgacuaugaaaacuuuucuugcaccuggagcccaucccagauuucaggccucccgacacgauaccugaccaguuaucguaagaaaacuguacugggggcugauagccaaagaaggucucccuccacaggaccuuggccauguccccaggacccucucggcgccgcgcggugcguugugcauggugcagaguucuggucacaguaccgcauaaaugucaccgaagugaacccauuaggggccagcacgagacugcuugaugugaguuugcagucuauccugaggcccgacccgccucaaggacuacgggucgaguccguucccggcuauccacgccgacucagagcuagcuggacuuacccugccucguggcccugucagccacacuuucugcuuaaguucaggcugcaguaccggcccgcacaacauccugcuuggucuaccguggagccagccggcuuggaagagguaauuacagaugcgguggccgggcucccgcacgcaguccguguguccgcucgcgacuuucuggaugccggaacuuggucaaccuggagucccgaggcuugggguacaccuagcaccggcacgaucccaaaagaaauucccgccugggggcaguuacauacucagccugagguugaaccacagguggacucccccgcaccgccuagaccaucucugcaaccccacccuaggcuccuugaccaccgggauagcgucgaacagguggccguacuggcuucauugggaauccuaaguuuccugggccucguugcgggugcacuggcccuugggcugugguugcgacuccgcagaggcggaaaggacggcucccccaagccaggguuucuggcuagcgugauaccugucgauaggcggcccggagccccaaauuuauga

SEQ ID NO: 57627 - RNA, 762 nt, Artificial Sequence
  derived and/or modified sequence opt3 from IL12A__Homo_sapiens__NP_000873
auguggcccccuggcagcgccucccagccaccgcccucuccugcugcagccaccgggcugcacccagcggcuagacccgugucacuccaaugcaggcuuaguauguguccugcccggagccuguuguuagucgcaacacugguucuacucgaccaucugucccuugcccgcaaccugccaguggcuacucccgauccuggaauguucccaugcuugcaccauucucagaaucuccugcgagcaguaucgaacaugcugcagaaggcccgucagacgcucgaguuuuacccguguaccucagaagagaucgaccacgaagauauuacaaaagacaagacuagcaccguggaggcuugcuuaccccuggaacuuacaaagaaugagaguuguuugaacuccagagagaccucuuucauaacuaaugguagcugccuggccuccaggaagacaucauuuaugauggcgcuaugucucaguagcaucuaugaagaucugaaaauguaccaagucgaguucaagaccaugaacgcaaaacuucugauggacccuaaacggcagaucuuuuuggaucagaauaugcucgccgugauugacgaacugaugcaggcuuuaaacuucaauucugagacgguuccacaaaaguccucacuggaggaacccgauuuuuauaaaacuaagauuaaacucugcauccuucugcaugccuuccgcauaagagcagugaccaucgacagggucaugagcuacuugaacgcuaguuga

SEQ ID NO: 57628 - RNA, 987 nt, Artificial Sequence
  derived and/or modified sequence opt3 from IL12B__Homo_sapiens__NP_002178
augugccaccagcaacuggugaucagcugguucucccucgucuuucuugccucuccccugguugcuauuugggaguugaagaaagacguguacguaguggaauuagauugguauccugacgcaccaggcgagauggucgugcugaccugugauacaccggaagaggacgggauaacuuggacgcuagaucagucaagugaaguucucggaagcgguaagacccugacaauccaggugaaagaguucggcgacgccgggcaguacacuugccauaagggaggcgagguccuuucccacucucuguugcuccugcauaaaaaggaagaugguauuuggucgaccgacauccugaaggaucaaaaagagcccaagaacaaaacauuucucagaugugaagcgaagaauuauucagggagguuuaccugcuggugguuaacuacaauuagcaccgaccugacguucagugugaaauccucucggggaagcuccgauccucagggcguaacuuguggcgcugccacccuuucagcagagcgcguucgaggggacaacaaggaguacgaauauaguguggagugccaggaagauagcgccuguccagcugcagaggaaucuuugcccaucgaggucaugguggacgccgugcacaagcugaaauacgagaauuauacauccucauucuuuauacgugacaucauuaagccugauccacccaaaaaccuacagcucaagccucugaaaaauagcagacaagucgaaguuaguugggaguacccagacacuuggucuaccccgcauuccuacuucagccuuacauuuugcgugcagguacagggaaagucgaaaagggaaaagaaggaucggguguucaccgacaaaacgucugcuacugucaucugucgcaagaacgccuccauuucagugagagcgcaggauagguauuacaguagcuccuggucugagugggcaagcguucccugcucauga

SEQ ID NO: 57629 - RNA, 2109 nt, Artificial Sequence
  derived and/or modified sequence opt3 from IL12RB1__Homo_sapiens__NP_001276953
auguucgugggccuguuuagccuccuuuccuucaacgucuuuagaucuggggacggaguugccgagcccaggcgguggcagcgcgguucaccuggcgcuguggggcuguacguagauccaauggaaccguuggugaccugggucgugcccuuacuguuccuauuucuccugagucgacaaggagcagccugccguacaagcgaguguugcuuccaggacccuccauaucccgaugcggacuccggcucugcuucggguccuagagaucuuagguguuaccggaucucaagcgaccgcuaugaaugcaguuggcaguacgaggggccaacugccggaguuucccacuuucugagauguugcuugucuagcgggagguguugcuauuucgcagccggcuccgcuacgcggcuccaguuuucagaucaagcaggcgugaguguccuguacaccgugacacuguggguagaaagcugggcccgcaaucagacugagaagucucccgagguuacccuccaguuauauaacuccgugaaauacgaaccuccacugggagacauuaaggucucaaaacuugcuggucaguugcgaauggagugggaaacaccggauaaucaagugggcgccgaggugcaguucagacauaggacccccagcaguccuuggaagcugggggacuguggaccacaggaugacgauacugagucuugccuauguccccucgaaaugaacgucgcgcaggaguuucaacugcggcgucgccagcuuggcucccaggguagcucguggucuaaaugguccucaccuguuugcgugccacccgaaaauccgccucaaccccagguaagauucaguguggagcagcuggggcaggacggaaggcggcgauugacacucaaggaacaaccaacccagcuggaguuaccugagggcugccagggccuggcacccgggacggaagucacuuaccgccuccagcuucacaugcugagcuguccaugcaaggccaaagcuaccagaacauugcaucuaggaaagaugcccuaucuguccggugccgcauacaacguggcuguuauaucuagcaaucaauuuggcccugggcucaaccagacuuggcacaucccagccgacacccauacagagccgguggcgcugaauauuucagucggaaccaacggcacgacuauguauuggcccgccagggcacagaguaugacauacuguaucgaauggcagccugugggucaagaugggggccuugcuaccugcucccugacugccccacaggaccccgauccugcuggaauggccacauauagcuggucucgggagucaggcgcaauggggcaggaaaaauguuacuauauuaccaucuucgccagugcucacccagagaaguugacgcucuggagcaccguacuguccacauaccacuucggagguaaugcgucugcagccggcacuccccaucacguuucggugaaaaaccauagcuuagacuccgucucaguggauugggcuccgagucugcuaucuaccugcccugggguccucaaggaguacgugguucgcuguagagacgaagauagcaaacagguguccgagcacccaguacaacccacagaaacucaggucacccugucaggacuuagggccggcguggcauauacaguucaggugcgugccgacaccgcuugguugcggggugucuggagccaaccucagcgauuuucuauagaggugcagguauccgauuggcugaucuucuuugccagucucgggagcuuccugucuauucuucuggugggcguuuugggauaccucggccugaauagagcagcgaggcacuuaugucccccacugccuacucccugcgcuuccucagccaucgaauuuccagggggaaaagagacguggcaguggauuaacccggucgacuuccaagaggaagcaagucuacaggaggcccucgugguggaaaugagcugggauaagggugagcgcacagagccucuggaaaagaccgagcuucccgaaggcgcuccagaguuggcccuggacacugaacucucgcuggaggacggggaucggugcaaggcaaaaauguga

SEQ ID NO: 57630 - RNA, 441 nt, Artificial Sequence
  derived and/or modified sequence opt3 from IL13__Homo_sapiens__NP_002179
augcacccccugcucaacccucuucuguuggccuuaggccugauggcucuacuccugaccacagugaucgcacuuacuugccuugggggauucgccagcccagguccgguucccccuuccacggcguugagagagcucauugaagaguuggucaauauaacccagaaccaaaaggcuccacuguguaauggcucuaugguguggucaaucaaccucacagccgggauguacugcgcagccuuagaaagucugauuaauguaagcggauguuccgcuaucgagaaaacucagaggaugcuuucuggcuuuugcccccauaaggugucggcaggucaguucucaagccugcacguccgggacaccaaaauugaaguggcccaguuuguuaaggaucugcuacuccaucugaaaaagcuguuccgcgaggggcaauuuaacuga

SEQ ID NO: 57631 - RNA, 1284 nt, Artificial Sequence
  derived and/or modified sequence opt3 from IL13RA1__Homo_sapiens__NP_001551
auggaguggcccgccagacugugcggccucugggcucugcuguugugugcagggggagguggcgggggaggcggugccgcgccuaccgaaacacagccaccggugacuaacuuaagcgucuccguugagaaucugugcacggugaucuggaccuggaaucccccugaaggggcuucuucaaacuguagucuaugguacuucagccacuuuggagacaagcaagauaaaaagauugccccagagacaaggcgguccauagaaguaccccucaacgagcgcaucugccuucaggugggcucucaguguucgacuaaugagucagaaaaaccuagcauucuugucgagaagugcaucaguccacccgaaggcgacccugaguccgcagugaccgagcugcaguguauuuggcauaacuugucuuauaugaaaugcagcuggcucccagggcgaaauacauccccggauaccaacuacacucuguauuacuggcaccguucacuggaaaagauccaucaaugugagaauauauucagagaaggacaguauuuugguugcaguuucgaccucacaaagguuaaagauagcucuuuugagcagcacuccgugcagaucauggucaaggacaacgccggcaaaauuaagcccucauucaauaucgugccuuuaaccagcaggguaaaaccagaucccccucauauuaagaaccugaguuuucacaaugacgaucuuuacguucaaugggaaaacccacagaauuucaucucucgguguuuguuuuaugagguggaggucaacaacucccagacggaaacucacaauguguucuacgugcaggaggcuaagugcgaaaaccccgaguuugaacgcaaugucgagaacaccagcugcuucaugguuccgggggugcugccugacacacuaaauacuguaagaauaagggugaaaaccaacaagcucuguuacgaggaugacaaacuguggucgaauuggucucaagaaauguccauuggaaagaaacggaacucaacacuuuauaucaccaugcuguugauuguccccgugaucguugcaggcgccaucauugugcuccuguuauaccugaagcgccucaaaauaaucauuuuuccaccuauccccgauccagguaagauauucaaggagauguucggggaccagaaugacgauacgcuucauuggaaaaaguaugacauuuacgaaaaacagacuaaggaggaaacagauagugucgugcugaucgagaacuugaaaaaggcuagccaauga

SEQ ID NO: 57632 - RNA, 1143 nt, Artificial Sequence
  derived and/or modified sequence opt3 from IL13RA2__Homo_sapiens__NP_000631
auggccuucgugugccuggcuaucggcugucucuacaccuuucuuauuagcacaacuuucgggugcacguccucuucagacaccgagauaaaggucaaucccccucaggauuuugaaaucguugacccaggauaucuggguuacuuguauuuacaauggcagccgccccugagucuagaucacuucaaagaguguacaguggaauacgagcucaaguauagaaacauuggcagcgaaacuuggaaaaccaucauuacaaagaaccugcauuacaaagacggguuugaucuuaauaagggaaucgaggcaaagauacacacccuguugccuuggcagugcacuaacggcuccgagguacagucuucgugggccgaaacaaccuauuggaucucaccacaagguauucccgagacgaaagugcaggacauggauugugucuacuacaauuggcaguaucuccugugcagcuggaagccugggaucggagugcugcucgacacuaacuacaauuuauucuauugguacgaaggccuggaucaugcgcuucaguguguugacuauauuaaagcugauggccaaaacaucgggugcagguuuccauacuuggaggccagugacuauaaggauuucuacauaugugugaauggauccucugagaacaaacccauucggagcuccuacuuuaccuuccagcugcagaauaucgucaagccucuaccaccgguguaucucacauuuacucgcgaaucaaguugcgagauuaagcugaaauggagcaucccccuugguccuaucccagcacgauguuucgacuacgaaauugagauacgugaagacgauaccacacugguaaccgccacgguugagaacgagacuuauacauugaagaccacuaaugaaacaagacagcucugcuuuguggucaggucuaaagugaacaucuacugcuccgacgauggcauuuggucagaguggagcgacaagcaauguugggaaggggaggaucugaguaaaaagaccuuacugcgguucuggcuccccuucggauuuauccuuauacuggugauuuucgucacgggcuugcuacugcgcaaaccuaauaccuauccaaagaugauccccgaauuuuucugcgacacauga

SEQ ID NO: 57633 - RNA, 489 nt, Artificial Sequence
  derived and/or modified sequence opt3 from IL15__Homo_sapiens__NP_000576
augagaaucagcaagccccaccugagguccauuucuauacagugcuaccucugucuucuguugaacucacauuucuuaaccgaagccggcauccacguguuuauucuggggugcuucagugcuggacuaccuaaaacagaagcaaauugggucaacguuaucagcgaccucaagaaaauugaggaucugauccaauccaugcauauagacgccacucuuuauacggaaucugaugugcacccaucguguaagguaaccgcgaugaaaugcuuucuguuggagcuccaggugaucucacuggaaagcggugacgcuaguauucaugauacagucgagaaucugaucauucucgccaacaauuccuuaucuagcaacggcaaugugacugaguccggguguaaggaaugcgaggaacuggaggagaagaacaucaaagaguuccuucagucauuuguucacauagugcagauguucauuaauaccaguuga

SEQ ID NO: 57634 - RNA, 696 nt, Artificial Sequence
  derived and/or modified sequence opt3 from IL15RA__Homo_sapiens__NP_001230468
augagcguggagcacgccgacaucugggucaaguccuacucucuguauucaagagaaagguacauuugcaacaguggcuucaaacggaaggcugggaccagcucccucacagaguguguucuuaauaaagcaacuaacguggcccauuggacgacccccucucugaagugcauacgcgauccugcguugguacaccagcgaccagcuccgcccucgacagugacuaccgccggagucacaccucaaccagaaucauuaagccccagugguaaagagccugcagccuccucuccaagcuccaauaacaccgcugcaacuacagccgcuaucgugcccggcucacagcugaugccuaguaagagcccaucuaccgggacgacugaaauuuccucacaugagagcagucacggaaccccgucucagacaacugccaagaauugggagcuaaccgcguccgcaagccaucagcccccuggcguuuauccacaaggucacucggacacaaccguggccaucucuacguccacuguccuccugugugggcuuucagcugugagucuguuggccugcuaccucaaaagccgucagacacccccucuggcauccguagaaauggaggcuauggaagcccugccaguuaccuggggaacuucuagcagagaugaggaccucgagaacuguucacaccauuuauga

SEQ ID NO: 57635 - RNA, 3996 nt, Artificial Sequence
  derived and/or modified sequence opt3 from IL16__Homo_sapiens__NP_001165599
auggagagccacuccagagccggcaagucuaggaaaucagcuaaguuccggaguaucagccgcucccugaugcucugcaacgcaaaaaccucugacgaugggucgucacccgacgaaaaguacccugauccauuugagauuagccuugcccagggaaaagaagguauauuccauaguuccgugcaacuggcggacacaucugaggcuggcccgagcuccguccccgauuuggccuuagcaucagaagccgcucagcugcaggcagccgggaaugaccgaggaaagacuugucguagaaucuuuuucaugaaggagaguagcacggcuucuuccagggagaaaccuggcaagcuagaagcccagucaagcaacuuucucuucccaaaagcgugccaccaacgggcacgcaguaauucuaccuccguuaaccccuauuguacaagagagauugauuuuccuaugacuaagaaaagcgccgcuccaaccgacaggcagcccuacucgcugugcucuaaucggaagucccuuucacagcagcuggauuguccugccgguaaggcagcugggacaagucgcccaacccgaagccuuuccacugcccaacucgugcagccgucuggaggccugcaggcgagcguaaucucaaacauugugcugaugaaaggccaggccaaggggcucggauucaguaucgucgguggcaaagacuccauauaugggcccaucggaauuuacgugaagacaaucuuugcaggcggugcugccgcugccgaugggagauuacaagaaggagacgagauucuggagcuuaauggcgaaagcauggcaggcuugacccaucaggaugcccugcagaaauucaagcaagcuaaaaaggggcuacucacgcugacuguuaggacccggcuuacagcgccuccaucucugugcucacacuugagucccccucucugucguagccuguccucuucgacuugcaucaccaaggacagcuccucauuugcauuagagaguccaucugcccccauaagcacagcuaaaccgaacuaucgcauuaugguggaagucucccugcagaaggaggccggagugggucucggcaucgggcuuuguucaguaccuuacuuccagugcauuagcggaaucuuuguucauacccugucucccggcuccguggcacacuuggacgguagacuaagguguggggaugaaaucgucgagauuagugacagcccagugcacugccugacgcucaaugagguguauacuauacugucucauugcgauccuggccccgucccaaucauuguuucccggcaccccgacccucaggugucagaacaacagcuuaaagaggccguagcucaggccguggaaaacacaaaguucggaaaagagcgacaucaguggagucuggaaggcgucaagcgcuuggagagcucguggcacgggagaccaacccucgagaaggaaagggagaaaaauuccgcaccgccccaccggcgcgcgcaaaaggugaugaucagaucuagcucagauaguuccuacaugucuggaagcccugguggcuccccagggucaggaagcgcugaaaaacccaguucugacguugauauauccacucauagcccuucgcugccauuagccagggagcccgugguccugucaauugcaucuagucgucuaccgcaggaauccccuccacuccccgagagccgggacucucacccuccccugcgacuuaagaaauccuucgagaucuuggugagaaagccaaugagcucaaagccuaaacccccaccgaggaaguacuuuaaaagugauagcgacccucagaagucucuggaggagcgcgaaaacuccucauguaguagcggccauacacccccaaccugcggucaggaggcccgggagcuccugccccuucuguugccucaagaagauacggcugggagauccccaucugccucggcaggcugucccggaccuggcaucgggccgcagaccaaaagcucaacagagggagaaccagguuggaggcgcgcuucccccguaacucagaccaguccuauuaagcacccacuccugaagcgacaggcccggauggacuauucuuucgacacaacugcggaggaucccuggguucguaucagcgacugcauuaaaaauuuauuuuccccuauaaugucagaaaaccauggccacaugccgcugcaacccaaugccucucuaaacgaggaggaagggacccagggacacccagauggcacaccucccaagcucgacaccgcuaacgguacuccaaaaguguacaagagcgcagauaguuccacggucaaaaaggggccucccguggccccaaaaccggcuugguucagacagagccugaagggccuuaggaaucgcgccucugacccucggggauugcccgauccagcacugucaacacaacccgcgccugccuccagagagcaucucggcagucacaucagggcuagcucgucuuccagcucaauucgacagcgcaucaguucuuuugaaaccuucggguccagccagcugccagacaagggagcccagcgguuaucacugcaacccaguagcggcgaggcagcuaaaccucuugguaagcaugaagaggggagauuuuccggauugcucggcaggggugccgcaccgacucuggucccacagcagcccgaacaggugcuaucuagcggcuccccugccgcuucagaagcgcgugaucccgggguuucugagaguccaccucccggacgccaaccaaaccagaaaacccugccuccgggccccgacccacuccugcggcuuuugucgacacaggccgaagagagccaggggccugugcugaagaugcccucccaaagagcaaggucuuucccauuaacccgaucacagagcugugaaacuaaacuccuggaugagaagacauccaaguuguauaguaucucuagccagguaucauccgcugucaugaaaagucuguugugccucccuagcucuauuuccugugcccaaacgcccugcauaccgaaggagggagccucaccaaccagcucgucuaaugaagacagugcugcaaacggcuccgccgagacuagcgcgcuggauacagguuuuucacuaaaucuguccgaacuccgggaguacaccgaggggcugacagaagcuaaagaggacgacgauggagaccacucuagccuucagaguggccaguccgugaucagcuugcugucuucagaagaguuaaagaaacucauugaagagguuaaggugcuggaugaggccacucuuaagcagcuggacgguauccacgucaccauucuacauaaagaagagggcgcagggcucggauucagucuggccggcggggcugauuuggaaaacaaggugaucacgguacaccgcguguuuccuaauggacuggcaucccaagagggcaccauacagaaagguaacgaaguuuuaagcaucaaugggaagucucucaaaggaacaacucaucacgacgcccuggcgauucuuagacaggcuagggagccccggcaggccgucaucgugacccgaaagcugacaccagaggcaaugcccgauuugaacucgucaacugacagcgccgcuuccgccagugcagcuucugaugugagcgucgaauccaccgaggccacgguuuguacagugacccucgaaaagaugucagcgggccuggguuucagucuagagggcgggaaaggaucucugcauggcgacaagccucuuacuauuaauagaaucuuuaaaggggccgcaagcgaacaauccgagacagugcagccgggagaugagauacuccagcugggcgguaccgcuaugcagggguugacucgcuucgaagccuggaacauuaucaaggcucugcccgacggaccaguaaccauugucaucaggcguaaaucauuacaaagcaaggagacaacggcagccggcgauucuuga

SEQ ID NO: 57636 - RNA, 468 nt, Artificial Sequence
  derived and/or modified sequence opt3 from IL17A__Homo_sapiens__NP_002181
augacccccggcaagacaagccuggugucccuccuucuguuguuaucucuggaggccaucgucaaagcugggauuacuauaccuagaaacccaggaugccccaauucagaagacaagaacuucccgaggacgguuauggugaaucuaaacauccacaaucggaacaccaauacaaacccuaaacgcaguagcgauuacuauaaucgauccacuucuccauggaaccuccaucguaaugaggaccccgaaagauacccuucgguaauuugggaggcaaaguguaggcaccuggguugcaucaacgccgauggcaauguggacuaucauaugaacucagucccaauucagcaagaaauccuugugcugcggcgcgagcccccucacuguccaaauagcuuuagauuggagaaaauacucguuaguguggggugcaccugugucacaccgaucgugcaucacguagcguga

SEQ ID NO: 57637 - RNA, 543 nt, Artificial Sequence
  derived and/or modified sequence opt3 from IL17B__Homo_sapiens__NP_055258
auggacuggccccacaaccuguuguuccuucugaccaucagcauuuuucucggcuuagggcagccuagauccccaaagucuaaaaggaagggacaaggucggccgggcccccuggccccugggccacaucaggugccccuagaucucgucucacgcaugaaaccuuacgcucgaauggaggaauaugagcguaauauagaagagaugguugcacagcugagaaacaguagcgaacuugcccagaggaagugcgaggugaaucugcaauuguggauguccaacaaacggucucucucgccauggggauacucaaucaaucacgaccccagccgcauuccuguagaucugccagaggcgagaugucugugccucggcugugugaacccguucacaaugcaggaagacaggaguauggucuccgugcccguguuuucucagguuccuguccggcgccgauuaugcccacccccuccaagaacuggucccuguaggcagcgggcugugauggagacgaucgccguagggugcaccuguauuuucuga

SEQ ID NO: 57638 - RNA, 594 nt, Artificial Sequence
  derived and/or modified sequence opt3 from IL17C__Homo_sapiens__NP_037410
augacccugcuccccggccuucuguucuugacaugguuacacacuugccuggcccaucacgacccuagccuaagagggcauccacacucccauggaacgccgcacuguuacucugcugaagaacucccccugggucaggcaccuccacaccuucuggccaggggcgcgaagugggggcaggcuuugcccguggcccucgucucaagucuggaggcagccagccaucggggacgccacgaacgaccuuccgcuaccacacaaugcccaguucugcgucccgaggaagugcucgaggcagauacucaucagagaucuaucucgccuuggagguaucggguagacaccgaugaggaccgcuacccacagaaauuagccuuugcugaaugucugugcagaggcuguauugaugccaggacaggucgggagaccgcggcacuuaacucagugcgcuugcugcaaagccuacucguccugcgaagaaggccgugcagucgggacggguccggacuucccacuccuggcgccuucgcuuuucacacagaguucauacacgugccaguuggcuguaccugcgugcugccccguucugucuga

SEQ ID NO: 57639 - RNA, 609 nt, Artificial Sequence
  derived and/or modified sequence opt3 from IL17D__Homo_sapiens__NP_612141
augcugguggccggcuuccuccuugcucugcccccuagcugggcagccggggcgccaagagcuggaaggcggccggcccgcccccgagguugcgcagaccguccugaggaauuguuagagcagcuguacggcagacuagccgcugggguccucuccgcauuucaccauacccugcaacuuggaccaagggaacaggcccggaacgcuucuugucccgccggcggucgcccugcggauagaagguuccggccacccacaaaucugcgcucaguuaguccuugggcauaucgaaucagcuacgacccagccagauauccgagguacuugcccgaggcuuauugccucugucgggggugccugacuggacuguuuggcgaagaggaugugcguuuccgcuccgccccuguauacaugccaacggugguccucagaaggacccccgcaugugcuggcgggcggucuguguauacagaggccuacguuacuauuccugugggaugcaccugugucccagaacccgagaaggacgcggauucgauaaacucaagcaucgacaaacagggugccaaguuacugcuuggcccgaaugaugcuccugcagggcccuga

SEQ ID NO: 57640 - RNA, 492 nt, Artificial Sequence
  derived and/or modified sequence opt3 from IL17F__Homo_sapiens__XP_011512578
augaccgugaagacacugcacggccccgccauggucaaauaccuccuucugagcaucuugggguuagcuuuccuguccgaggcagccgcgagaaagauuccuaaaguuggacauacguuuuuccagaagccagaaucuugcccgcccgugccugguggcucaaugaaacuagacauagggaucauuaacgagaaucaaaggguaaguaugagccggaacaucgaaucccgcucuacuucgccauggaauuauaccgugacaugggaucccaaccgauacccuucagaggucgugcaggcucagugucguaaucucggaugcauuaacgcccagggcaaggaagacaucagcaugaauaguguuccaauacaacaggagacucugguggucagaaggaagcaccaggguuguuccgugucuuuucagcuugagaaaguacugguuaccguggggugcacaugugucacccccgugauccaucacgugcaauga

SEQ ID NO: 57641 - RNA, 2499 nt, Artificial Sequence
  derived and/or modified sequence opt3 from IL17RA__Homo_sapiens__NP_001276834
augggcgccgcuagaagcccucccuccgcagugccagggccgcugcucggacuucuguuguuacugcuagguguccucgcccccggcggggcgucucugaggcuucuggaccaccgggcuuugguuugcucacagccuggacucaacuguaccgugaagaauaguacaugccuggaugacagcuggauccauccacgcaaccugacucccuccucuccuaaggaucuccaaauucaguuacacuucgcccauacgcagcagggcgaccuguuuccaguagcacacauagaguggacccuucaaacagaugccucgaucuuguaccuggaaggugcugagcuaucagugcuccagcugaauacuaacgaacgacuuuguguccguuucgaguuucugagcaaguugagacaucaccacaggcgguggcgcuucaccuuuagucauuucgugguugaccccgaucaggaauaugaggugacaguccaccaucucccuaaaccaauuccggacggggaucccaaucaccaguccaagaacuuucuggugccugacugcgagcacgcaagaaugaaaguaaccacuccauguaugucuagcggauccuuaugggaucccaauaucacaguugaaacccuggaggcccaucaacucagggugucauucacgcuuuggaacgaaaguacucacuaccagauucuguugaccagcuuuccucauauggagaaucacucuugcuucgagcauaugcaccacaucccagcuccccggccggaagaguuucaucagcgcuccaacgucacacuaacucugcgaaaucucaagggcuguugcagacaccaggugcaaauacagccuuucuuuucaagcugucugaacgacugccuuaggcauagugccaccgugucuugucccgaaaugccagauacaccugagcccaucccaggccccggguccgaaaaguauagcgacgacaccaaauacacggauggacugccugcggcagacuugauuccaccgccccucaagccucggaaagucuggaucauuuauucggccgaucacccacuguacguugacgugguauuaaaguucgcucaguuccugcuaacugccugcgguacagagguggcacucgaucugcuugaggaacaagcuaucucugaggccggcgucaugaccuggguggggcgucagaaacaggaaaugguugaguccaauucaaagauaauuguguugugcagucgcggaacuagagcgaaguggcaggcccugcucggcaggggugcacccguccggcugcgaugugaccacgggaaaccugugggagaucuuuuuacagcugccaugaacaugauccugccagacuucaagcgccccgcuugcuuuggcaccuauguaguuuguuacuucagcgaaguguccugcgauggcgacgucccggauuuguuuggggccgcaccuagauacccacucauggacagguucgaggagguguauuuucggauucaagaccuggaaauguuccagcccggacgcaugcauagagucggugaguuaucuggcgauaauuaccugaggagcccugggggacgucagcuacgggccgcucucgaccgauuuagagauuggcaagugaggugucccgacugguucgaaugcgagaaccuguauucagcggaugaccaggaugcaccaagucuugacgaagagguuuuugaggaaccuuugcugcccccaggcacggguaucgugaaacgcgccccgcucguacgggagccugggucccaggcuugucuggccaucgaucccuuagucggcgaagagggaggcgcagccguggcuaagcuggagccacaccuucagcccagagggcagccugccccacaacccuugcauacccucguucuggcagcggaagagggagcucuaguggccgcagucgaaccugguccgcuggccgacggcgcugccgugaggcucgcacuggcuggggagggagaagccugcccacuuuugggcagccccggugcggggcgcaacucuguacuguucuuaccuguggauccagaggacucaccccucggcaguagcacaccuauggccuccccggaucugcuucccgaggacguucgagaacaccuggagggauugaugcucucucuguuugaacagucgcuaagcugucaggcucagggcgggugcucccggccagcaaugguccugacugacccucauacccccuacgaggaggaacaacgucagucagugcagagugaucaaggauauauuucuagaagcuccccacagccucccgagggucucacagaaauggaggaagaggaagaggaggaacaggacccaggcaaaccggcccugccucuuucacccgaggauuuggaaagccugaggucuuuacagcgccaacuccuguuccggcagcuucagaaaaauuccgggugggacacuaugggaagugagagcgagggcccaucugcuuga

SEQ ID NO: 57642 - RNA, 1509 nt, Artificial Sequence
  derived and/or modified sequence opt3 from IL17RB__Homo_sapiens__NP_061195
augagccuggugcuccuuucccuggccgcuuugugcagaucugcaguccccagggagccuaccguucaguguggcucagaaacagggccaaguccggaguggauguuacaacacgaccugauccccggagaucuacgggaccuccgcguggaaccuguaacuacgagcguggccaccggugauuacuccauucugaugaacgucucuugggugcuucgagcggacgcuucgauacgucuguugaaggccacaaaaaucugcguuacuggcaagucaaauuuccagagcuauaguugugugagaugcaacuacaccgaggcauuucagacacagaccaggccauccgggggaaaauggacuuucucuuauauuggcuuucccgucgaacucaauacaguguacuucaucggugcccauaacauuccuaaugcuaacaugaaugaggaugggccaagcauguccguaaacuuuaccucacccggaugucuggaccacaucaugaaguauaaaaagaagugcguuaaagcaggcagucugugggauccuaauauaacggccuguaagaaaaacgaggaaacuguggaggucaauuucaccacaacuccacucggcaaccgguacauggcuuuaauccaacauagcaccauuaucggguuuucucagguguucgaaccgcaccagaagaaacagacacgcgccuccguggucauucccguuaccggagacucagagggugcgacggugcaacugacuccuuauuuuccaacaugcggcagcgauuguaucagacauaaggggaccguagugcuuugcccccagacuggagucccuuucccauuggacaauaacaagaguaaacccggcgguuggcugccgcuacuccugcuuucucuguugguggcaacauggguucucguggccgggauauaccugauguggaggcacgagcggauuaagaaaaccuccuuuagcacgaccacauuacugccucccaucaagguccucgugguauacccaucggaaauuuguuuccaccauacuaucugcuauuuuaccgaguuccuucagaaucacugccgcucugaaguuauccuggagaaauggcagaagaaaaagauugcugaaaugggaccugugcaaugguuggccacacagaagaaagcagcugauaaggucguguuccuacuguccaacgacgucaacucagugugugauggcacuugcggcaaaagugaggggagccccuccgaaaauucucaggaccucuuuccacuggccuucaaccuguuuuguagcgaccuucgaucacaaauacauuugcacaaguacguugugguauauuucagagagaucgauaccaaagacgauuacaaugcgcucagugucugccccaaguaucaccugaugaaggacgccacagcauuuugugcugaguuacugcaugugaaacagcagguuuccgccggaaagaggagccaggcuugccacgaugguuguugcucucuauga

SEQ ID NO: 57643 - RNA, 2124 nt, Artificial Sequence
  derived and/or modified sequence opt3 from IL17RC__Homo_sapiens__NP_001190192
augcccgugccuugguuccugcucagccuugcccugggcagauccccagucguuuugucuuuagagaggcugguggggccgcaggacgcuacccacugcucacccggacuaaguugucggcucugggauagcgacauccugugccuuccuggugauauuguaccagcacccggcccugugcuggccccaacacacuugcaaacugaacucguccugcgcugucagaaggagacggacugcgaucugugucuccgaguggcgguucacuuagcugugcaugggcacugggaagaacccgaagacgaggagaaauuuggaggcgccgcagauuccggugucgaggagccucguaacgccucucugcaggcucaggugguacuuucguuccaagcauacccaaccgccagaugcguuuugcuggaagugcaggucccggcugcccuagugcaguuugggcagucagugggaagcgucguuuaugacuguuucgaggcggcacucggcagugaggugaggauaugguccuacacacaaccccgguaugaaaaggagcugaaucauacucagcagcuuccugauugccgcggccuggaaguauggaacucuaucccaagcuguugggccuugcccuggcucaauguguccgcugacggggauaacguccaccugguguuaaauguuucagaggaacagcacuuuggacugagucucuacuggaaccaagugcaggguccuccaaaacccagauggcauaagaaucuuaccggcccgcagauuaucacacugaaccacaccgacuuggucccuugccuauguauucaaguguggccccuggagccagauagcguaaggacuaauaucugcccuuuccgggaggacccccgcgcccaucagaaccucuggcaggcagcucgacugagacuucugacauugcagucuuggcuccuggacgccccaugcuccuuacccgcggaagccgcacuguguuggagggcuccugggggagauccaugccaaccgcuaguucccccucucucaugggagaaugugaccgucgacaaagugcuggaauuuccacuuuugaagggccaccccaaccuguguguccaggugaauagcagugagaagcuccagcugcaggaaugccuuugggccgauucucuggguccuuugaaagacgauguucuccuguuagagacgcgggggccacaagacaaccguucccugugugcucuagagcccagcggaugcacuucgcucccgucuaaggccuccacccgcgcagccagacugggcgaauaucuuuugcaggaucugcagucaggccagugucuccaacugugggacgaugacuuaggggcucugugggcgugcccuauggauaaauacauacacaagaggugggcacuugugugguuggccugucuccuguucgcugccgcacuaagucugauccuccugcuuaaaaaggaccaugccaaggcugccgcacggggacgagcggcuuugcuguuauauagcgccgacgauuccgguuuugagcgccucguaggcgcacuggccucugcucuuugccagcugccauugagagucgccguggaccucuggagcaggcgggaacugucagcacaggggcccguugcuugguuccacgcccagcgcagacaaacacuacaggagggaggcguggucgugcugcucuuuaguccuggugcgguagcccuguguuccgaauggcuucaggauggggugagcggccccggagcucauggcccacacgacgcauucagggccucuuugucaugcguucugccugacuuuuuacaagggcgugcucccggaaguuacgucggugccugcuucgaucggcuccugcauccagaugcagugccggcgcuuuuccgaacugugccugucuuuacccugcccagccagcuaccagacuuccucggcgcccugcagcagcccagagcuccuagguccgggcgcuugcaagagcgggccgagcagguuucuagagcacugcagccagcuuuagauucguacuuucaucccccuggaacaccggccccaggcagggguguggggcccggcgcaggaccuggcgccggggacggaaccuga

SEQ ID NO: 57644 - RNA, 2220 nt, Artificial Sequence
  derived and/or modified sequence opt3 from IL17RD__Homo_sapiens__NP_060033
auggcccccuggcugcagcucugcagcguguucuuuaccgucaacgcuugucuuaauggcucccaacuggcaguugccgcugggggaucugguagagcuaggggcgccgacacaugcggguggcggggagugggcccugcaucacgcaacagugguuuguacaauaucacuuucaaguaugauaacuguacgaccuacuuaaauccaguagggaaacacgugauugccgacgcucagaacauaacaaucagccaguaugcaugccaugaucaggucgccgugacuauucugugguccccgggagcucuaggcaucgaguuucucaagggcuuccgaguuauucuggaagaacuuaaaucugaagggcgucaaugucagcagcugaucuugaaggaccccaaacagcucaauucgucauuuaagagaaccggaauggagagccaaccuuuccugaacaugaaguuugaaacagauuacuucgugaaagucgugccauuucccaguauaaagaaugaguccaacuaucacccuuucuuuuucaggacccgggccugcgaccugcucuuacagccagauaaucuggcguguaaacccuuuuggaagccucgcaaccuuaauaucucucagcaugguagcgacaugcagguauccuucgaucacgcaccacauaacuucggcuuuagauucuuuuacuugcacuauaaacugaagcacgaggggccguucaagaggaaaacuugcaagcaagaacagacaaccgagacgacuucaugucuacuccagaauguuagucccggagacuacauuaucgaacugguggaugacaccaacacaacucggaaagucaugcauuacgcccuuaagccugugcacagcccaugggcuggccccauucgcgccguggcaaucaccgucccucugguugugauaucugcuuuugccacauuguucaccguaaugugccgaaagaaacaacaggagaacauuuauucccaucucgaugaggaaucaagcgagaguucuacguacacugcggcccugccaagagaaagguuacggccccguccgaaaguguuucuguguuauuccagcaaggacggucagaaucacaugaacgucgugcagugcuucgcauacuuucuccaagacuucugcgggugugagguugcucuugaucugugggaagacuuuucguugugccgcgagggacagagagagugggugauccagaagauucacgaaucucaguucaucaucgucguguguuccaaaggcaugaaguauuuuguagauaaaaagaauuacaaacauaagggcgggggaagggguucaggcaagggggagcuauuccugguugccgugagugcuauugccgaaaaacuccggcaagcaaagcagagcuccucugccgcucugagcaaauucauagcggucuauuuugacuacucaugcgagggagaugugccuggcauccuugaccugaguacaaaguaccgauugauggauaaccucccccagcuguguucccacuuacauagccgcgaccacggucugcaggaaccagggcaacauaccagacagggcucuaggcggaauuauuuccgcucaaaaaguggaagaagccuauacgucgcaauuugcaacaugcaccaguuuaucgaugaggagccugacugguucgaaaagcaguuugugcccuuccacccacccccucucagguaucgugagccaguucuggaaaaguuugauuccggccuuguguugaaugacguaauguguaaaccggggcccgagucugacuucugccugaaggucgaagccgcugugcucggagccacugguccugcagauucgcaacaugagagccagcacggcgggcuggaccaggauggagaggcccggccagcucuugacggcuccgccgcacugcaacccuugcuccauacaguuaaagcggguucaccuagugauaugccacgagacucugggauauacgauagcuccgugcccucaagcgaacugucuuuaccgcugauggagggccuauccaccgaccagacggaaaccaguagccucacagagucugucuccucaaguagcggacugggcgaggaggagccuccagcgcuucccucgaaguugcuguccucugggagcuguaaagccgaucucggaugcagaucauauacugacgaacugcacgcaguggccccuuuauga

SEQ ID NO: 57645 - RNA, 1602 nt, Artificial Sequence
  derived and/or modified sequence opt3 from IL17RE__Homo_sapiens__NP_001180309
augggcagcuccagacuggccgcucuccuucugcccuuguuacugaucgugauugaccuaucugauucagcagggauaggauucaggcaccucccucauuggaacacccggugcccacuggccagucacacagacgauagcuuuacugguuccucugcguacaucccgugucgcacguggugggcucuuuucucgaccaagcccuggugcguccgaguuuggcauuguucacguugccugugucagcacuugcucagcggcgggaguggacugcaaagaggccuguuucaucucuuagugcagaaauccaagaaaucuagcacauucaaguuuuauaggcggcacaaaaugccugccccagcacagcgcaagcugcuucccagaaggcacuuguccgagaagucacaucacauuaguaucccuagcccagacauuucucauaaaggucugcgguccaagcgcacucagcccucagauccugaaaccugggagagccuaccacgacucgacagucaaagacacgggggaccggaguucucuuuugaucugcuucccgaagccagggcuauccggguaacaauauccagcggcccugaagugucgguccgucugugccaccagugggcauuggagugugaggaacucucuuccccauacgacgugcagaaaaucguuucaggcgggcauaccguggagcugcccuaugaguucuuacugccuugccucuguauugaagccaguuaccuucaggaggauacuguccgcagaaagaaaugcccauuucaaagcuggcccgaggcuuauggauccgacuucuggaagucugugcacuuuacagauuacagccagcauacccagaugguaauggcccugacguugagguguccgcuaaagcuggaagcggcacucugccagcggcacgacuggcauacucugugcaaagaucuuccuaaugccaccgcucgagaaucagacgguugguauguucuggagaagguggacuugcacccccaacucuguuucaaauuuaguuucggcaacuccagccacgucgaaugcccacaucagacagggucucugacuucauggaaugugaguauggauacccaggcccaacaguuaauccugcacuucagcucccgcaugcaugcaacauuuucugcugccuggucgcuaccuggacucggccaggacacccuggugcccccagucuacacgguuagccaggcgagagguuccucacccgugagucuugauuugauuaucccuuuccugaggccaggguguugcguacuccugcacgccucucuuagcuccccgggaggcgaggacgcauggcugauaggcgucgggggaucagugcccagcgguguggcuguucgguguccugugugcuuggaggccccacucgucucuggcugucuguuacaaacucccggggcucuggauccuggaacagccggcccaccccacccgaccgguugcuguuccgggccucaucuaccagcacccacugugcgcccuggccccagugccgcuagcgcgccuccagcaagaggaggccucgggggagccgcugcccccgguggcucugcaggguga

SEQ ID NO: 57646 - RNA, 1011 nt, Artificial Sequence
  derived and/or modified sequence opt3 from IL17REL__Homo_sapiens__NP_001001694
augagcagauccgugcuggaggcccucaccucuucaacagcuaugcagugcguccccagugacggcugugcaaugcuucugaggguucgggccagcaucacuuugcacgaacgcuuacgagggcuggaggcgugcgcuaugucccuagauacgcaagaaacccagugucagucuguguggguagcccgugcaucgcauagacagcaaggaggucagcagcuccaggugcacuucggcugcuuugccgucucaguggcucaacaucuguacguuacacuuaggacuauuccucacuucuguggggugcagcuggaccagcggcauuuggucgaggcaggaaagcucagcuauuggguggaucgcagaaggaaagccauacugguacagguuccacgggcuaguggcuccccggacuacuaucugcgccucugcuuaaagcgauuuaccugugaagaugccggugcgcccgugagagucacagcaaacucugugagccaagccguguuccugccuuacucccaggagcuuccaugcuugugucuggagggguggucagcuacccccgacgccgucaggauccagauuugcccuuuugaaaaugauacugaggcacuagaaguucucugggacacaguguauuaccacccagagagucaaacccugagcugggagcccgcuuguccuguaucuggacacgugucccuuugcuggcggccaggcccgggcgccgggugccguaaacugcagcagucaagccaguugguccaucgcagagugcaauauccccucguugauacgcagccucagcuguguuuaaaguucaguacuucuuggggauccugggugaggugcccauuugaacagcggcgauuccccaccccuccaacaagccgcuguacuugcgucaccgguggcucgcacucuucccugcccgcgaacgcccauucaagaccggcaaggagucuccaaccucaggugacauggcagcccccacuucuguugccuagcuga

SEQ ID NO: 57647 - RNA, 585 nt, Artificial Sequence
  derived and/or modified sequence opt3 from IL18BP__Homo_sapiens__NP_001034749
augaccaugagacacaacuggacacccgaccugagcccucucugggugcuucuguugugcgcccaugucguuacuuuacuggugagggcuacgccaguaucccagaccacaacugcagccaccgcgucugugcggucaacaaaggauccgugucccagucaaccuccagucuuccccgcugccaaacagugcccugcacuagaggugaccuggccagaaguugaggugccccucaauggcacucugagccuuuccugugucgccugcucucgcuuuccuaacuucucgauccuguacugguuggggaauggaucauuuauugaacaccucccaggucgacugugggagggcagcacaagucgugaaagaggguccaccggaacgcagcuguguaaggcucucguguuagagcagcugacuccggcacuucauucuaccaacuucagcugcguauugguugaccccgagcaagugguccagaggcacguggugcuggcccagcuaugggcuggccuccgggccacacugccuccaacucaggaagcgcuucccuccucacauaguagcccucaacagcaggguuga

SEQ ID NO: 57648 - RNA, 570 nt, Artificial Sequence
  derived and/or modified sequence opt3 from IL18__Homo_sapiens__NP_001230140
auggccgcugagcccguggaagacaacugcaucaauuucgucgcaaugaaguuuauugauaacacccuguacuucauagagaaucucgaaagcgacuauuuuggcaaacuugaguccaagcugucuguuaucagaaacuugaaugaucagguguuauucauugaccaagggaacaggccucuguuugaagauaugacagacucagauugucgggacaaugccccacgcacuaucuucauuaucaguauguacaaagauagccagccgcgaggaauggcgguaacgauauccgugaagugcgagaaaaucucuacccuaucgugugagaacaagauuaucucauuuaaggaaaugaaucccccugacaacauuaaagauacaaagagcgacaucauauucuuucagcguagugucccaggucacgauaauaaaaugcaguucgaguccucuagcuaugaaggcuacuuucucgcuugcgagaaggagagagaccuguucaaacuuauucugaagaaggaagacgaguugggggauagguccaucauguuuacugugcaaaacgaagacuga

SEQ ID NO: 57649 - RNA, 1626 nt, Artificial Sequence
  derived and/or modified sequence opt3 from IL18R1__Homo_sapiens__NP_003846
augaacugcagagagcugccccucacccuuugggugcugaucagcgucuccacagccgaaucuuguacuucaaggccucacauuacgguuguggagggcgaaccauucuacuugaagcauugcaguuguagcuuagcucacgagauagaaaccacaacuaaauccugguauaagucuucggggucacaggagcauguagagcugaauccgcggagcaguucccgcaucgcacuacacgacugcgugcucgaauuuuggcccgucgagcugaacgauaccggaucuuacuucuuucaaaugaaaaauuauacacagaaguggaaacuuaacgugauucgacguaauaagcauagcuguuucaccgaaagacagguuacuuccaagaucguggaggucaaaaaguuuuuccagauuacaugcgagaacucauacuaucaaacccuggugaauaguacgagcuuguacaaaaacuguaagaaacuccugcuggaaaauaacaagaauccuacuaucaagaaaaacgccgaguuugaagaccaggguuauuacucuugcguacacuuccuccaccauaauggcaaguuauuuaacauaaccaaaacauucaauaucacuauuguugaggauagguccaacaucgugccaguccugcuugggcccaaguugaaccacguggcgguggaacugggcaaaaauguccggcuaaacuguucagcucuccugaaugaggaggacguuauuuacuggauguuuggagaagagaacgguagcgauccuaauauccaugaagagaaggaaaugcgcauaaugaccccagaggggaaauggcacgccaguaaggugcuuagaauugagaacaucggagaaucuaaucugaacguauuguauaauugcacaguggcauccaccggcggcacggacacuaagagcuucauucucgucaggaaagccgauauggcugacauccccgggcacguguuuacacggggaaugaucauugcaguucugauauuaguggccgucgugugucugguaaccguuugcgugaucuaccgcgucgaucucgugcuuuucuaucgacaucugacuagaagggacgagacauugaccgaugguaagacguacgacgcuuucgucucguaucuaaaagaaugccggccugagaacggcgaagaacacaccuuugccguggagauucugccacguguucucgaaaagcauuucggguacaaacuguguaucuuugagcgcgaugugguaccgggaggcgcggucguggacgaaauacacucucuuauugagaaguccagaaggcugaucaucguuuugucaaagaguuauaugagcaaugaggugcgguacgaacucgaguccggucugcaugaagcauuagucgagcgaaaaauuaagaucauucugauagaguucacacccgugacugacuuuaccuuccuaccucagucucucaaacugcuuaagagccaccgcguauugaaauggaaggccgauaagucacugaguuacaacuccagauuuuggaaaaaucuccuguaucuuaugccagcuaagacagugaaacccgggagggacgagccugagguucugccagucuugagcgaaucuuga

SEQ ID NO: 57650 - RNA, 1800 nt, Artificial Sequence
  derived and/or modified sequence opt3 from IL18RAP__Homo_sapiens__NP_003844
augcugugccucggcuggaucuuccuuuggcugguggccggggagagaauuaagggauuuaacauaagcgguuguuccaccaaaaaguuguuauggacauacucuacuaggucagaagaggaguucguccuguuuugcgaccuacccgagccucagaaaagucacuucugucaucggaaucgccucagcccaaagcaaguuccggaacaccuucccuuuaugggcuccaacgaucuuucugacgugcagugguaucagcagccuucgaauggggauccacuggaggacauccgaaaaucauacccccauauuauccaagauaagugcacguugcacuuccucaccccuggaguaaacaauagcggcaguuauauuugucguccaaagaugaucaaaucccccuacgacguggcuugcugugucaagaugauacuggaggugaaaccucagacaaacgcaucuugcgaauauagcgccucccauaagcaggaucugcucuuagguucaacugggaguaucagcuguccaucucuguccugccagucagacgcgcaaagcccggcuguuaccugguacaaaaauggaaagcuguugaguguggagagaucuaacaggauugucguggaugaaguauaugacuaccaccagggcacauacguuugugauuauacccaguccgacacugugagcucguggacaguccgggccguggugcagguccgcaccaucguuggcgauacgaagcugaaacccgacauucuagacccuguggaggauacucucgagguagaacuggggaagccacuuaccaucucuugcaaagcaagauuuggauucgagaggguguuuaaucccgucauaaagugguacauuaaagacuccgaucuggaaugggaggugucaguuccugaagccaagaguaucaaaagcacauugaaggacgagauuaucgagcggaacaucauucucgaaaaggugacucaacgcgaucugcgaagaaaauucgucugcuuugugcaaaauuccauagguaacaccacacagucuguacaguuaaaggagaaaaggggcguugugcugcucuauauccuucuggggaccauuggaacguuggucgcugugcuagcagccagcgcucugcucuaccggcacuggaucgaaauaguccugcuuuaucguacuuaccagucaaaggaccagacacugggcgauaaaaaggacuucgaugccuuugugaguuaugcgaagugguccagcuucccaucugaggcaaccucaaguuugagcgaagaacaucucgcccuguccuuauuccccgacguucuggagaauaaauacgguuacucucuaugucuccuggaacgcgauguggcuccugggggaguauaugccgaggacauugucucgaucaucaagagaagcaggcggggcauuuuuauccuuuccccgaacuacgugaauggccccucaauuuucgaauugcaggcagcuguuaaccuggcccucgacgaucaaacucugaaacuuauacugaucaaguuuugcuauuuccaggagccagaaaguuugccucaccucgugaaaaaggcgcugcgagucuuacccacagugaccuggcgcgggcugaagucuguaccacccaacagcagauuuugggccaaaaugagguaccauaugccugugaaaaauucccagggauucacguggaaccagcuacggauuaccucacgcaucuuucaauggaagggucucagcagaacagagacuaccggcaggucuucccagccaaaggagugguga

SEQ ID NO: 57651 - RNA, 534 nt, Artificial Sequence
  derived and/or modified sequence opt3 from IL19__Homo_sapiens__NP_037503
augaagcugcagugcgugagccucuggcuucugggcaccaucuugauuuuauguuccgucgacaaccacgggcugagaaggugccuaauaucuacagauaugcaucacaucgaggaaucauuccaagagauuaaacgggccauccaggcuaaggacacuuuucccaauguuacgauucucaguacccuggaaacacuucagaucauaaaaccucuggauguguguugcguaacuaagaacuugcucgcauucuacguggaccgcgucuuuaaagaucaucaggagccaaauccgaagauccugcgaaagauuagcuccaucgccaacucuuuccuguauaugcagaaaacccuccgucaaugucaggaacagagacaaugccacuguaggcaggaggcgacaaaugcuacccgggugauucaugacaacuacgaucaguuagagguucacgccgcagccaucaagucgcugggagaacuugacguguuuuuggcuuggauaaauaaaaaccacgaggucauguucucagcauga

SEQ ID NO: 57652 - RNA, 816 nt, Artificial Sequence
  derived and/or modified sequence opt3 from IL1A__Homo_sapiens__NP_000566
auggccaaggugcccgacauguucgaggaucugaaaaacugcuacagcgaaaaugaggaagacuccucuucaaucgaucaccucagucuuaaccaaaagagcuuuuaucaugucuccuacggcccucugcacgagggguguauggaccagucuguuucguugucaauuagcgaaaccaguaaaacauccaaguuaacuuucaaagagucuauggugguaguggcuacgaauggaaagguccugaagaaaagaaggcuaagccucucccagucaauaaccgaugacgaucuggaggcaaucgccaacgacagugaagaggaaauuaucaagccacggagcgcgccguuuucuuuccuuuccaaugugaaauauaacuuuaugcgcauuaucaaguacgaguucauacugaaugaugcuuugaaccagucaaucauucgagccaaugaccaguaucucacagcagccgcucugcauaaccuggaugaggcaguuaaauuugacaugggugccuacaagagcaguaaggaugacgcuaaaaucacugugauucuccguaucucuaagacccaauuauaugucacagcccaggacgaagaucagcccgugcugcuuaaagagaugccugaaauaccaaagaccauuacuggcuccgagacaaauuugcuguucuuuugggaaacccacgggacgaaaaacuacuucacuagcguagcgcaucccaaucuauuuaucgcaaccaagcaggacuacuggguuugccucgccggaggcccuccaucgauuacagauuuccaaauccuggagaaccaggcuuga

SEQ ID NO: 57653 - RNA, 810 nt, Artificial Sequence
  derived and/or modified sequence opt3 from IL1B__Homo_sapiens__NP_000567
auggccgaggugcccgaacuggcuagcgagaugauggcauacuauuccggcaacgaagacgaucucuucuuugaggccgacgggccuaagcagaugaaaugcucuuuccaagaucuugaccuguguccauuggauggagguauccaguuaagaauuucagaccaccauuacaguaagggcuuuaggcaggcggcuagcgucguuguggccauggauaaacugcggaagaugcuaguaccgugcccccagaccuuccaagaaaaugaccucuccacauuuuucccuuuuauauucgaggaggaaccaaucuuuuucgauacuugggacaacgaggcauaugugcacgaugcccccguccgcucucugaauuguacgcuucgagacucgcagcagaaaucacuggugaugagcgggccuuacgaauugaaggcucuccaucugcagggacaagauauggagcagcagguuguguuuaguauguccuucguccagggcgaggaaucuaacgacaagauuccaguggcacugggucucaaagagaagaauuuauaucugagcugcguacuuaaagacgauaagcccaccuugcaacuggaauccguugacccuaaaaacuacccaaagaagaaaauggagaagcguuuuguguucaauaaaaucgaaauuaacaauaagcuagaguucgagucagcccaguuuccgaacugguauaucaguacaagccaggcugaaaauaugcccgucuuccucgggggaacuaaaggcggccaagauauaaccgacuuuacaaugcaguucgugucuuccuga

SEQ ID NO: 57654 - RNA, 459 nt, Artificial Sequence
  derived and/or modified sequence opt3 from IL1F10__Homo_sapiens__NP_115945
augugcagccugcccauggccagauacuauaucauuaaguacgcugaccagaaagcacucuauaccagggauggccaacuucuggugggggacccugucgccgauaacuguugcgcggagaagauauguaucuugccaaaucggggauuagcucgcacaaaaguuccgauuuuccuggguauccagggcgggucccgaugccuagccuguguggaaacugaggaaggacccucucuccagcuggaggacguaaacauugaggaacuuuacaagggcggugaggaagcaacgcguuuuaccuucuuucagucaaguagcggguccgccuucagacuggaggcugcagccuggccuggaugguuuuugugcggcccagcugaaccccaacagccugugcagcucacaaaagagucugagccaucggccaggacuaaguucuauuuugaacagucaugguga

SEQ ID NO: 57655 - RNA, 1710 nt, Artificial Sequence
  derived and/or modified sequence opt3 from IL1R1__Homo_sapiens__XP_011509420
augaaggugcugcucagacuuaucugcuucauugcccuguugauaagcuccuuagaggcugacaaauguaaggaaagggaggagaaaaucauucuggucucuucagcaaacgaaaucgauguucggcccugcccucuaaauccaaacgaacacaagggcaccauuacaugguacaaagacgauaguaagacuccggugagcacggagcaggccucccgcauccaucaacacaaggagaaacucugguuuguacccgcgaagguggaagacucugggcauuauuacugugucgugcgaaauucgucauauugccugcguauaaaaaucagcgcuaaguucguugagaacgaaccuaaucuuuguuacaacgcccaggcaauuuuuaaacagaagcugccaguggccggagaugguggcuuggucugccccuauauggaguucuuuaagaaugagaacaaugaacucccuaaacugcagugguacaaggacuguaaaccacugcucuuagauaacauccacuucaguggggugaaggacagacugauuguaaugaauguugcugagaaacauaggggaaacuauaccugccacgcauccuacacauaccuuggcaagcaauaucccaucacucgggugauagaauuuauuaccuuggaggaaaauaaaccuacacgcccagucaucgugucuccggccaacgagaccauggagguggaucuggguagccagauucagcuaaucuguaaugucacugggcagcucuccgacaucgcuuacuggaaguggaacggaucaguuauugaugaagacgaucccgugcugggcgaggacuauuacaguguagaaaacccugccaauaagagaaggagcacacuuauaaccgugcugaacaucucugagauugaaucccgguucuauaaacacccauuuacgugcuucgcgaagaauacucauggcaucgacgcagccuacauacaauugauuuaucccgucaccaacuuucagaaacacaugaucgggaucugugugacacucacuguuauuaucgugugcucagucuucauuuacaagauauuuaaaaucgauauugugcugugguaccgcgacagcugcuaugauuucuuaccuaucaaggcuagugacggaaagaccuacgaugccuauauccuguacccaaaaacaguaggugagggcucuaccuccgacugugauauuuucguuuuuaaggugcuccccgagguccuugaaaaacagugcggguauaagcuguucauauacggacgagacgauuaugugggcgaggacaucgucgaagugauuaaugagaacguuaaaaagagcagaagguugaucauuauccuagugcgggaaacgucggguuuuucuuggcucgggggauccucagaggagcagauagcaauguacaaugcucugguacaagauggcaucaaggucgugcugcuugaacuggagaaaauucaggacuacgaaaagaugccggagaguaucaaauucauuaagcagaaacauggcgccauccguuggagcggggacuuuacucaaggaccucaguccgcgaagacacgcuucuggaagaacguuagauaucacaugcccgugcagaggcggucuccaagcucaaaacaccaguugcucaguccugccaccaaggagaaacugcaacgagaagcacauguccccuuagguuga

SEQ ID NO: 57656 - RNA, 1197 nt, Artificial Sequence
  derived and/or modified sequence opt3 from IL1R2__Homo_sapiens__NP_004624
augcugagacucuacgugcuugucaugggcguuagcgccuucacccugcagcccgcugcacacacaggggccgcgagguccugccgguuucgcggacgacauuauaagcgugaguucagauuggaaggugagccuguggcuuuaagguguccacaaguaccguacuggcugugggccucugugucaccccggaucaaccuaacuuggcacaaaaaugacagugcacgcacggucccuggcgaagaggaaaccagaaugugggcccaggauggggcucucuggcugcuuccagcacugcaggaggacagcggaacauaugugugcacuaccaggaacgccuccuacugugauaagaugucuauugaguugcggguuuuugaaaauacagacgcuuuccuccccuuuauaucguauccucagauccugacccugucaacuagcggcgugcucgucugcccagauuuaagugaguucacacgcgacaaaaccgaugugaagauucaaugguacaaagacucccugcuuuuggauaaggacaacgaaaaguuucugucuguacgagguacgacucaucuacucguucacgauguggcccuggaggacgcgggguauuacagauguguccuuaccuucgcacaugagggacagcaguacaauaucacaaggagcauugaacugcggaucaaaaagaaaaaggaggaaacuauacccgugaucauuuccccuuugaaaaccaucucagccagucucggcagccgucugacaauuccaugcaagguguuuuuaggcaccgggacgccgcugacuacaaugcucugguggaccgcuaacgauacucacaucgagucugccuaucccggaggucgcgucacagaaggcccuagacaggaguacuccgagaauaacgaaaauuauauagagguuccacuuauuuucgaccccgugaccagggaagaccugcacauggauuuuaaguguguagugcauaacacguugucauuccaaacccuacggacaacugucaaagaggcaagcaguaccuuuucuugggggaucgugcuggcuccucucucccuggccuuccuuguucugggaggcauuuggaugcaccgacgcugcaagcauagaacagguaaagcggacggguugacugugcucuggccacaccaccaggauuuccagagcuaccccaaguga

SEQ ID NO: 57657 - RNA, 1713 nt, Artificial Sequence
  derived and/or modified sequence opt3 from IL1RAP__Homo_sapiens__NP_001161401
augacccugcucuggugcguggucagccuuuacuucuauggcauccugcaguccgacgccucugagagaugugaugacuggggguuggauacaaugaggcaaauucagguuuuugaagacgagcccgcucggauaaagugcccuuuauucgaacacuuucugaaauucaacuacucaacugcacauagugccggacuaacgcucaucugguauuggacccgccaggaucgagaccuggaggaaccaauuaauuuucgucuuccggagaacagaaucagcaaggagaaagaugugcugugguucaggcccacauugcucaaugacacugguaacuacaccuguaugcugcggaauacaaccuauugcuccaagguagcguuuccucuggaagugguccagaaagauucuuguuucaacucgccaaugaagcuccccgugcacaaguuauacauugaguauggcauccaacgcauaacuugcccuaauguugacggguacuuuccaucaagcgugaaacccacaaucaccugguacaugggauguuauaagauucagaacuucaauaacgucaucccugaaggcaugaaucugaguuuucuuauugcuuugaucuccaacaaugguaacuacacgugcgugguaacuuauccagagaaugggagaaccuuccaucugacaaggacucuaaccguuaaaguggucggaucuccgaagaacgccgugcccccugugauacacagcccaaacgaucaugucguuuacgagaaagaacccggcgaggaacuccugauuccuuguacaguguauuuuuccuuccuuauggacucacggaaugagguaugguggaccaucgauggcaagaagccagacgacauuacgaucgaugugacuaucaacgaaaguauuagccacucucgcacagaggacgagacccgaacucagauacuguccaucaaaaaggucacaucagaagauuugaaaagaagcuacgugugccacgcaaggagugccaagggggagguugcuaaagcagccaaggugaaacagaagguccccgcuccgcgguauaccguggaacucgccuguggauucggugcgacgguacuguuaguugugauucugaucgucguguaccaugucuacuggcucgagauggugcuuuucuaucgugcacacuucggcaccgacgaaacaauacuggaugggaaggaguacgacauuuauguuucuuacgcccgcaaugcugaggaagaggaauuuguguugcuaacucugagaggaguacucgagaacgaauuuggcuauaaacugugcaucuuugauagggacucccuuccuggugggaucgucaccgaugagacacugagcuucauucaaaagucgcggcgauugcucgugguucugucucccaauuacguguuacagggaacucaggcccugcuagagcucaaagcaggccuggaaaacauggcuucccgcggcaauaucaacgucauucuugugcaguauaaggccguaaaagagaccaaggugaaggaauugaaaagagcgaagacaguucugaccgucauaaaauggaagggggagaaaucaaaguacccacaaggaagguuuuggaagcagcuccagguggccaugccugugaaaaagaguccccggcgcagcuccucugacgagcaaggucugagcuacucaagucuuaaaaaugucuga

SEQ ID NO: 57658 - RNA, 2091 nt, Artificial Sequence
  derived and/or modified sequence opt3 from IL1RAPL1__Homo_sapiens__XP_005274498
augaaggcccccaucccucaccugauucuccuuuacgcuaccuucacacagagccugaaaguggucacuaagagaggcuccgcagacgggugcacggauuggucuauagacaucaaaaaguaucaaguuuuggugggagagccaguaaggauuaaaugugccuuauuuuacgguuauauccggaccaacuacucacuggcgcagagugcuggccuaagccucaugugguauaaguccucugggccgggagauuucgaagaacccauugccuuugacggcucgcgcaugucaaaggaagaggauagcaucugguuccgaccuacacugcuucaggacaguggucuguacgcaugcgugauacguaauuccacuuauuguaugaaagucucuaucagcuugaccgugggggaaaacgauacaggacucugcuacaauuccaagaugaaauacuuugagaaggccgagcugucaaaaaguaaggaaauuagcuguagagacaucgaggauuuccugcucccaaccagggaacccgagauuuuaugguauaaggagugccggacuaaaacauggcgcccuucuaucguuuuuaagagagacacccugcuuauaagggaagugcgggaggaugacauuggcaacuacacgugugaauugaaauauggcggguucgucgugcgccgaacuaccgagcugacaguaacugcuccacuaaccgauaagcccccuaaacuccuguacccaauggaauccaaacuuacaauccaggagacccaacugggagacucagcaaauuugacgugcagagccuuuuucgguuauagcggcgacguuaguccgcucauuuacuggaugaagggggagaaguuuaucgaagaucuggacgagaacagggugugggaaucugauauccggauuuuaaaggagcaucugggagaacaggaggucuccauaagccucaucguggacucgguggaggaaggcgaucuugguaauuauucuuguuacgucgagaacgggaauggacgucgccacgcuuccguucuguugcauaaaagagaacuaauguacacuguggagcuggccggcggccucggggcgauucugcuucuguugguaugccucgugacaaucuauaaguguuacaaaauagaaauuaugcuguucuauaggaaccacuuuggagcagaggaguuagacggugauaauaaggacuacgaugccuaucugucauacaccaaagucgaccccgaucaguggaaccaggaaacuggcgaggaggagcgguucgcucuagagauccucccugacaugcuggaaaagcauuauggguacaaacuuuucaucccagaccgagauuugauucccacaggaaccuacaucgaggacguggcccgcugcguugaucaaaguaagagacugauuauagugaugacgccuaauuaugucgugaggcggggcuggagcaucuuugaacucgagacccgccugagaaacaugcuuguaacaggugaaauuaagguuauccugaucgagugcuccgaguugagggggauuaugaauuaccaggaaguggaggcacucaaacacacuauaaagcuguuaaccgucaucaaauggcacggcccaaaguguaacaagcugaacucuaaauucuggaagcgucuacaguaugaaaugcccuuuaaacggauugagccgaucacacaugaacaggcucucgacgugagcgagcaaggaccuuucggcgagcugcagacugucucagccauuaguauggcggccgcaaccuccacagcucuugccaccgcucaccccgauuugcgaagcacuuuucauaauacguaccacucucagaugagacaaaagcacuauuacaggucauaugaauacgacgugccaccuacagggacccugccccucaccaguaucggaaaccagcauacuuacugcaauauaccaaugacacugaucaacggucagcgcccccagaccaaaagcucccgggagcaaaauccugaugaagcccacacuaacucugcaauuuuaccacugcuuccgagagagacaucgaucagcuccguuauuugguga

SEQ ID NO: 57659 - RNA, 2061 nt, Artificial Sequence
  derived and/or modified sequence opt3 from IL1RAPL2__Homo_sapiens__NP_059112
augaagcccccuuuccugcucgcccuuguggucugcagcguuguguccaccaaccugaaaaugguaucuaagagaaauucaguggacggcuguaucgauuggagugucgacuugaaaacauacauggcuuuagcaggggagccagugaggguuaagugcgcccuguuuuauagcuacauucggacuaacuauuccacggcgcagucuaccggacuacgccucaugugguacaaaaauaagggugaucuggaggagccgauaaucuucucggaagugcgaaugucaaaggaggaagacagcauuugguuucacagugcugaggcccaagauuccggcuucuauacauguguccuucguaacucuacuuacugcaugaaagugagcaugucccugaccguagcagagaaugaaucaggguuguguuauaacaguagaaucagguaccucgaaaagagcgaaguuacaaaacggaaggagauuucuugccccgacauggaugacuuuaaaaaguccgaucaggagccugacguggucugguacaaggaauguaaaccaaagauguggcgcucaaucauaauccagaaaggaaaugcccugcugauucaggaggugcaagaagaggauggcgguaacuauaccugcgaacucaaguacgaggggaaauuagugagaaggacuacagagcugaaggucaccgcucuuuugacggacaaacccccuaagccacuguuccccauggaaaaucagccuagcguuaucgaugugcagcuaggaaagccacucaacauuccguguaaagcauuuuucggcuuuaguggcgagucugggcccaugaucuauuggaugaagggagaaaaauucauagaggaacuggccggucauauucgggagggcgagauccgccuucugaaggaacacuugggggagaaagaaguagagcucgcucugauuuuugacuccguggucgaagccgacuuagcgaauuacacuugccauguggagaaccgaaauggaagaaagcacgcaagcguucugcucaggaagaaagaucuuaucuauaagaucgagcuggccggcgguuugggggcuauuuuccuacugcucgugcugcuugucgugauauacaaauguuauaacaucgaacugauguuguuuuaccggcagcauuucggagccgacgagaccaaugaugacaacaaggaauacgaugcauaucucucguacacaaaaguagaccaagauacucuggacugcgauaacccugaggaggaacaguucgcuuuagagguucugccagacgugcuagaaaagcacuauggcuacaagcucuuuauucccgagcgugaucugaucccuucuggcaccuauauggaagaccuuacacgcuacgucgagcaguccagaagguugauaauugugcugaccccagacuauauccuccggcgaggguggucaaucuucgagcuggaaagucgccuucacaauaugcuggucagcggagagauuaaagugaucuugauugaaugcacggagcucaaggguaaaguuaacugucaggaaguggagucccugaagagaucuauaaaauuacugagccuaaucaaguggaagggcucaaaaaguuccaagcucaauagcaaauuuuggaagcaucugguauacgagaugcccauuaaaaagaaagaaaugcuuccgaggugccacgucuuggauucugccgagcaagggcuguucggagaacuccagccuauccccucaaucgcgaugacaaguacuagcgccacccugguguccucucaggcagacuuaccagaguuucauccuucggauagcaugcaaauucggcacuguugccgcggcuacaagcacgaaauacccgcuacuacacugccaguucccucccuugguaaccaucacaccuauuguaauuugccucucacgcugcuaaacgggcagcugccacucaauaacacccugaaggacacacaggaguuccauagaaauucaagucuuuugccgcugucuagcaaagaguuauccuuuacuucagauaucugguga

SEQ ID NO: 57660 - RNA, 636 nt, Artificial Sequence
  derived and/or modified sequence opt3 from IL1RL1__Homo_sapiens__NP_001269337
auguacagcaccguguccggcucugagaagaacucaaaaaucuauugccccacaauugaccuguacaauuggacugccccucucgaaugguucaagaacugucaggcacuucaagggaguagauauagggcucacaagagcuuucuggucauagauaauguuaugacggaggacgccggagauuauaccugcaaauucauccauaacgaaaauggugcgaacuacuccgugacagcuacucggucuuuuaccguaaaagacgagcagggcuucucguuguuuccagugauuggggccccggcacagaaugaaaucaaggaggucgagauuggaaagaacgccaauuuaacauguucagcuugcuucggcaaagguacccaguuucuggcagccgugcuauggcaacucaacgggacuaagaucacagauuucggagaaccccgcauacagcaggaggaaggccagaaucagagcuuuaguaacggccuggcuugucuugacaugguucugcgaaucgccgaugugaaagaggaggacuugcuccugcaauacgauugccuggcgcucaauuuacacgggcugcguagacauaccgucaggcuuucccggaagaacccuucuaaagaauguuucuga

SEQ ID NO: 57661 - RNA, 1728 nt, Artificial Sequence
  derived and/or modified sequence opt3 from IL1RL2__Homo_sapiens__NP_003845
auguggagccugcuccuuugcggccuguccaucgccuugcccuuaucugugaccgcugacggguguaaggauauuuucaugaaaaacgagauacugucagcaagucagccuuuugccuucaauugcacauuuccaccgaucacuagcggagaagucuccguuacgugguacaagaacucuucgaaaauucccgugucaaagaucauucaaagcagaauccaccaggacgagaccuggauacuauuccucccuauggaauggggugauaguggcguauaucagugugugaucaaagggagggacuccugccaucggauucacgucaaucugacaguguuugagaagcauuggugugauacuucuaucggaggccuuccaaaccugagcgacgaauacaagcagauuuugcaccucgguaaagaugacucccugaccugccaucugcacuuccccaagucauguguucucgggccuaucaaaugguauaaggauugcaaugagauaaaaggagagcgcuuuacaguguuagaaacccgacugcuugucaguaacgugagcgcggaggaccguggcaauuacgcuugucaagccauuuugacucacucuggcaagcaguaugaaguacugaacgggaucacaguuuccauuaccgagagagcaggauacgguggcucagugccaaagaucaucuaucccaaaaaucauagcauugagguccagcuagggacgacucucauaguggauugcaacgugaccgacacaaaggauaauacuaaccugagguguuggcgggucaauaacacccuuguugacgacuacuacgaugaaaguaaacgcaucagagagggaguggaaacacacguaucuuucagggagcauaaucuguauaccgugaacauuacguuuuuggaagucaagauggaggacuacggccucccuuucaugugccacgccgguguguccacugcuuauaucauacugcaguuaccagcaccggauuuucgggccuaccugauugggggacucaucgcucuuguugccguggcggucagcgugguauauaucuacaacauuuucaaaaucgacauuguucugugguaucgcucggcauuucacucuacagagaccauaguggauggcaaguuguacgacgccuacguccuauaucccaaaccucauaaggaaucccaacgacacgcuguggaugcccugguccucaauauccugccagaggugcuugaaagacagugcggcuacaagcuguucauuuucgggagggacgaguuucccggacaggcaguugcuaacgugaucgaugaaaauguaaaauugugucggcgucucaucgucauugugguuccugagucacuggguuucggcuuacugaagaaccuaagugaggaacagauagccguguauagcgcgcucauccaagacgggaugaaagucauucugaucgagcuugaaaagauugaggauuacacugugaugccagaauccauccaguauauaaaacagaagcauggagccauccgcuggcacggcgacuuuacagagcaaucucagugcaugaagaccaaauucuggaagacgguaagauaccauaugcccccgaggcggugucgaccuuuucccccagugcaguugcugcagcacaccccuugcuaucgcacagcaggucccgagcucgggagcagaaggaaaaaguguacucugaccacaggcuga

SEQ ID NO: 57662 - RNA, 480 nt, Artificial Sequence
  derived and/or modified sequence opt3 from IL1RN__Homo_sapiens__NP_000568
auggcccuggagaccaucugcagacccagcggcaggaaguccucuaaaaugcaggcuuuccggauuugggacgugaaccaaaagacauuuuaccuccgcaauaaccagcuugucgcaggguaucugcagggaccuaauguuaacuuggaagagaaaauagaugugguaccaaucgaaccgcacgccuuauuccuggguauucauggcgggaagaugugucuaucaugcgugaaaaguggagacgagacucgacuccagcuggaagcggucaauaucacggaucuuagcgagaaccguaagcaagacaagagauuugcuuucauuagguccgauucuggccccaccacaucguuugagucagccgcauguccugguugguuccugugcacugccauggaagcugaccagccagugagcuugaccaauaugcccgaugaggggguuauggugacaaaauuuuacuuccaggaagacgaguga

SEQ ID NO: 57663 - RNA, 531 nt, Artificial Sequence
  derived and/or modified sequence opt3 from IL20__Homo_sapiens__NP_061194
augaaggccagcucccuggcuuucucucuccuuucagcagccuuuuaccuguuguggacccccaguacaggcuuaaaaacucugaaccuagggagcugcgugaucgcgacgaaucuccaggagauuagaaacggauucuccgaaauaagggguucuguccaagcuaaggacggcaauaucgauauucggauccugcgccgaaccgagucgcuucaggacacaaaaccugccaaccguuguugccuguugagacaccuccugaggcuguaucucgaucggguuuuuaagaauuaccagacuccagaccauuauaccuuacgcaaaauuucaagccuggcaaacaguuuccuuacaaucaagaaggauuugagacugugucacgcccauaugaccugccacuguggggaagaggcuaugaaaaaguacucccagauacuaucucauuuugaaaaacucgagccgcaagcagccgugguaaaggcucugggagagcuugacauccuguugcaguggauggaagagacugaauga

SEQ ID NO: 57664 - RNA, 1515 nt, Artificial Sequence
  derived and/or modified sequence opt3 from IL20RA__Homo_sapiens__NP_001265651
augaagaacgugcugcaguggacacccccugagggccuccaaggggucaaaguuaccuacacugugcaguauuucaucuacggacagaagaaauggcuuaauaagagcgaaugcagaaacauuaauaggacguauugugaccuguccgccgagaccucugauuacgaacaccaguauuacgcuaaaguaaaggcaauaugggguacaaagugcucaaaaugggccgagaguggccgguuuuauccauucuuggaaacucaaaucgggccgcccgagguggcguuaaccacagacgaaaagagcauuuccgucgugcugaccgcuccugaaaaauggaagcgcaacccagaggaucuacccguuucuaugcagcagaucuacucgaaucucaaauacaacgugucaguccugaauacuaagagcaaccgaacauggagucagugugugaccaaucauacgcuuguacugacuugguuggaaccuaacacccucuauugcguucacguggaguccuuugucccaggacccccucguagagcccaaccaucugagaagcagugugcaaggacacugaaagaccagagcuccgaauuuaaggccaaaauuaucuucugguacgugcugccgauaucaaucacuguguuccucuuuagugucaugggcuauagcauuuaccgguauauccauguugguaaggagaaacaccccgcuaauuuaauucugaucuacgggaacgaguucgauaagcgcuuuuucgugccugcagagaaaauaguaauuaauuuuaucacccuuaacauuucugacgauuccaagaucucacaucaggacaugagcuugcugggaaagaguucugauguguccagccuaaaugacccacaacccucgggcaaccucagaccuccacaggaagaggaggaagucaaacaccugggcuaugccucucaccuuauggagaucuucugcgauuccgaagagaacacagaagggaccucacugacgcagcaagagaguuugagcaggacuauucccccggacaagacagugauagaguacgaauacgauguucggaccacugacaucugugcuggaccugaggaacaggagcucucccugcaggaagaggugucuacacaggguaccuuacuggagagccaagccgcgcucgcaguccuuggcccccagacgcugcaguauucauacaccccacaguugcaagaccuagauccucuggcccaggaacauacagacagugaggaagggcccgaggaggaaccauccacuacccucguggauugggacccccagacaggacgccugugcauuccuagccuuucuucauuugaucaggacagugagggcugugaaccaagcgagggugaugggcugggagaagagggcuugcucucccgacuguaugaggaaccggcucccgacagaccuccaggcgagaaugaaacuuacuuaaugcaauucauggaggaaugggggcuguauguacagauggagaacuga

SEQ ID NO: 57665 - RNA, 936 nt, Artificial Sequence
  derived and/or modified sequence opt3 from IL20RB__Homo_sapiens__NP_653318
augcagaccuucacaauggugcuggaggaaaucuggacuagccucuuuaugugguucuuuuacgcccuuauucccugccuguugacggacgaggucgcuauauuaccugcaccacaaaaccuguccguucuaucuaccaauaugaagcaccuccugauguggucaccggugaucgcccccggcgaaacaguauauuacaguguggaguaucagggggaauacgagagccuuuauacuucccauauuuggaucccuucuucgugguguucacugaccgagggaccagaaugcgaugucacagacgauauuaccgcgacugugcccuacaacuugagaguuagggcuacacucgguagccagaccagugccugguccauccugaaacacccuuucaaucggaacucuacgauacugacucgcccaggcauggagaucaccaaggacggguuucaucucgugauugaauuagaggaucugggaccccaguucgaguuucuugucgcauauuggcgacgugaaccuggcgccgaggaacacgugaaaaugguaagaagcggugggaucccaguucauuuggagacaauggaaccgggagcugcauacugugugaaggcccaaacuuucgucaaagcuauuggcagguacuccgccuuuucacagaccgagugcguggaggugcagggcgaagcgaucccccugguccuagcacucuucgccuuuguuggguucaugcugauacuugugguagugccucuguuugucuggaagaugggacgguugcuccaguauaguuguugcccagugguugugcugcccgacacauuaaagauuaccaauagcccucaaaaacugaucucuugucgcagagaggaagucgaugcuugcgccacggcagugauguccccagaggaacuccuuagggcuuggauuucauga

SEQ ID NO: 57666 - RNA, 489 nt, Artificial Sequence
  derived and/or modified sequence opt3 from IL21__Homo_sapiens__NP_068575
augagaagcucccccggcaacauggagaggaucgugauuugccugauggucauauuccucgggacccuuguucacaagucuucaagucagggacaagaccggcauaugauccgcaugcgacagcugauugauaucguggaccaguugaaaaauuacguaaacgauuuagugccugaauuucugccagccccggaggacgucgaaacaaauugugaguggagcgcuuucuccugcuuucagaaggcacaacuaaaaucugccaacacugguaauaacgaacguauuaucaaugugucgauaaagaaacucaagagaaagcccccuucaacgaacgcgggcaggcggcagaaacaccgccugaccuguccaagcugcgauaguuaugagaagaaacccccuaaggaguuccuugaaagauuuaaaucccuguugcagaagaugauccaucagcaccucucuagcaggacacauggguccgaggacucauga

SEQ ID NO: 57667 - RNA, 1617 nt, Artificial Sequence
  derived and/or modified sequence opt3 from IL21R__Homo_sapiens__NP_068570
augcccagaggcugggccgcuccucugcuccuucuguuguuacaagggggaugggguugcccagaccugguguguuacaccgauuaucuacagacagucaucugcauucucgagauguggaaccugcacccgagcacucuuacgcugaccuggcaggaccaguacgaagaguugaaggaugaagcaacauccuguucucuccauaggucagcccacaaugcgacucaugcuaccuauacaugccacauggacguuuuccauuuuauggccgaugacauauucagugugaacaucaccgaucagagcggcaauuacucccaagagugugggucuuuucugcuggcagaaucgauuaaacccgccccuccauucaacguaacugugacauuuucaggacaguauaauaucagcuggcggagugacuacgaggaucccgcuuucuauaugcucaagggcaaauuacaguacgagcugcaguaccgcaaccgaggugacccuugggcagucuccccacguagaaaacuuauuucuguggauagcagguccguuucauugcugccccuagaauuucggaaggacaguagcuaugagcuccaagugcgcgccgggccuaugccaggaucuuccuaccagggcaccuggucagaauggagcgauccggucaucuuccagacgcagagugaggagcugaaggaaggcuggaauccccaccuucuguugcuccuguuacuggugauaguauuuaucccugcuuucuggucucucaagacucacccacuuuggagacuguggaaaaagauuugggccguucccuccccugagagguuuuucaugccauuguauaaagggugcagcggagacuuuaagaaaugggugggugcgcccuucaccggcucgucucuagaacuggggccgugguccccugagguccccucaacacucgaaguguacaguugucauccaccucggagccccgcaaagcgccugcaacuuacugagcugcaggagccagccgaauugguggaguccgacggaguccccaagccuucuuucuggccaaccgcucagaacagcggcgguucagccuauagugaggaacgagauagaccguacgggcucguuuccaucgacacagugaccguacuggaugcagaaggacccugcacguggccuuguagcugcgaggacgauggcuauccagcuuuagaccuggaugccggccuagagcccucuccugggcucgaagacccacugcuugaugcgggaacuacaguguugucaugugguugcgucagugccggcagccccgggcugggaggcccgcucgguucccugcuugacaggcugaaaccuccauuggcagauggggaggacugggcuggcggacuccccuggggcgggcggucuccuggaggugugucggaaagcgaggccggcucaccccuggcuggguuagacauggauaccuuugacuccggauucguuggcagugauugcucuagcccaguggaaugugacuuuacuuccccuggugaugaggggcccccacguucauaccugcgccaaugggucgugauuccgccuccccuaagcucuccaggcccccaggccuccuga

SEQ ID NO: 57668 - RNA, 540 nt, Artificial Sequence
  derived and/or modified sequence opt3 from IL22__Homo_sapiens__NP_065386
auggccgcucugcagaaaagcguguccucuuuccucaugggcacccuugcaacaucaugccuguuguuacuggcccuacucguccaagggggagcggcugcccccaucaguagccacuguagacuggacaaguccaacuuucagcagccuuacauuacuaauaggacguucaugcuugcaaaggaggccucucuggcugauaacaauaccgacguucgguugauaggugaaaaacucuuucauggcgugucgaugucagagcgcugcuaucugaugaagcagguacugaacuucacacucgaagagguguuauuuccacaaagcgaucgauuccagccguacaugcaggaagucgugcccuuucuggcacgucuuaguaauagauuguccacuugucacaucgagggggacgaucugcauauucagaggaacguucaaaaacuaaaggacaccgugaagaaacucggagagucuggcgaaaucaaggccauuggugagcuggaucuucuguucaugagcuugcggaaugcuugcaucuga

SEQ ID NO: 57669 - RNA, 792 nt, Artificial Sequence
  derived and/or modified sequence opt3 from IL22RA2__Homo_sapiens__NP_443194
augaugcccaagcacugcuuccugggcuuucucaucagcuucuuucuuaccgggguggccggaacacaguccacucaugagucucugaaaccucaaagaguccaguuccagucaaggaacuuucacaauauuuugcaguggcaaccaggucgggcuuuaacgggcaacaguagcguuuacuucgugcaguauaagauaauguuuuccuguucuaugaaaucgucacaucagaagccgagcgggugcuggcagcacaucaguuguaauuuccccggaugccgcacccuggcaaaauacggccaacgacaguggaagaacaaggaagacuguugggguacacaggagcuauccugcgaucucacuucugaaaccagcgacauucaggagccuuauuacgggcguguaagagccgcguccgcuggaucauauagugaauggagcaugacaccaagguuuacccccuggugggagacuaaaaucgauccuccagugaugaauauuacacaagucaacggcucucugcuugugauccugcaugcccccaauuugccuuaccgguaucagaaggagaaaaacguuuccauagaagacuacuacgagcuccuguaucgcguguucaucauuaauaacucacuggaaaaggagcagaaagucuacgagggcgcacacagagccguggaaaucgaggcucucaccccacacagcaguuauuguguaguugcagaaauuuaccaaccgauguuagauaggcggucucagcgcuccgaggaacgaugcguggagauccccuga

SEQ ID NO: 57670 - RNA, 570 nt, Artificial Sequence
  derived and/or modified sequence opt3 from IL23A__Homo_sapiens__XP_011536779
augcugggcagcagagccgugaugcuccuucuguuguuacccuggaccgcucaggggagggcagucccuggagguuccucuccagccuggacacaaugccagcagcugucacagaagcuauguacucucgcguggagugcucacccgcugguuggccauauggaccuucgggaggaaggggaugaggaaacgaccaacgacgugccccacauccaaugcggagauggcugugacccucagggucugcgcgauaauagccaguucugcuugcagcguauucaucaagggcucauauuuuacgagaaacugcugggauccgacaucuucacaggcgaaccaucucucuuacccgauucgccuguaggccagcugcacgccucacuuuuggggcugagccagcuacuccagccagagggacaucacugggagacucaacagauucccagucuguccccuucucagccauggcaacgacuucuguugagauuuaagauccucaggagccugcaggcauucguggccgucgcugcacggguguuugcccacggugcugccaccuuauccccguga

SEQ ID NO: 57671 - RNA, 1980 nt, Artificial Sequence
  derived and/or modified sequence opt3 from IL23R__Homo_sapiens__XP_011539091
augcugcucugccacggcauccuuuuccccuggauucagguguuugccagaaagcugcaagaggggaacagcuuguucuuacugccugacaugaaucaggucaccauacagugggaugcuguuaucgcacuauacauucucuuuuccuggugucauggagguaucacaaacauuaauugcucuggccacaucuggguggaaccagccacuauauucaaaauggggaugaacaucucaauuuauugucaggcggcuaucaagaauugccaaccgaggaaacugcauuuuuacaagaacggaauuaaagagcgguuccagaucacgcgcauaaauaagaccacagcccgacuuugguauaagaacuuucuggaaccccacgcaaguauguacuguacugccgagugcccuaaacauuuccaggaaaccuugauuuguggcaaggacaucagcuccgguuauccacccgauauuccugacgagguaacaugcgugaucuacgaguauucugggaauaugaccuguacuuggaacgcuggaaaacucacauacaucgauaccaaguacgucgugcacguuaaaucgcuggaaacggaggaagaacagcaauaucugacuucaagcuacauuaauauaaguaccgacucccuccagggcggcaagaaguauuuaguguggguccaggcagccaacgcucuggggauggaggaaucuaaacagcuucaaauccacuuggaugacauugugaucccaagcgccgcgguaauaucccgugcagagacaauuaaugccacuguucccaagaccaucaucuacugggauucacagacaaccauugaaaaagugaguugcgagaugagauauaaggcuacgacuaaccagacauggaaugucaaagaauuugacaccaacuucacuuacgugcaacagagcgaguuuuaucuggagccuaacaucaaguacguguuccaggucaggugucaggaaacaggaaaacgguacuggcaaccauggucuucccuauuuuuccauaagaccccggagacgguuccccaggugaccucaaaggccuuccagcacgauacauggaauagcggucucacuguagcaaguauuucuaccggccaucugacauccgacaaccgcggggauauaggacuucuguugggcaugaucguguuugcugucaugcucagcauucugucguuaaucgguaucuucaauagaucuuuuaggacugggauuaaacggcgcauacugcuccuuaucccuaaguggcuguaugaagacauuccaaacaugaaaaauuccaacgugguuaagauguugcaggagaauagugaacuaaugaacaauaacaguagcgagcaagugcuguacgucgaccccaugaucaccgagauuaaagaaaucuucauaccugagcacaagccaacagauuauaagaaagaaaauaccggaccccucgagacucgagacuacccgcagaacucccuguuugauaauacgacagugguauauaucccugaccuuaacaccggcuacaagccccagauuucuaauuuccugccagaaggcagccacuugucaaacaacaaugagaucacuucacucacccugaaaccucccguugauuccuuagacagcgggaacaauccaagacugcagaagcaucccaacuuugccuucucugugucaagugucaauagccuauccaacacaauuuuucucggagagcugucucuuaucuugaaucaaggugaaugcucgagcccugauauacagaacuccguggaggaagagaccacuaugcugcucgagaaugacucaccaagugaaacaauuccggagcagacgcugcuucccgaugaguucgucucuugccugggcaucgugaacgaggaauugccuagcauuaauaccuauuuuccacagaacauccucgagucccacuucaauaggauaucacuguuagagaaauga

SEQ ID NO: 57672 - RNA, 624 nt, Artificial Sequence
  derived and/or modified sequence opt3 from IL24__Homo_sapiens__NP_001172085
augaacuuccagcaaagacugcagagccucuggacccuugccuccaggcccuuuugcccuccacuguuggcuacagcaucucagaugcagaugguggucuuaccgugucugggcuucacucuacuccuguggucacaaguuaguggggcccagggacaggaguuucacuucggucccugccaggugaagggcguagugccucaaaaacuuugggaagcguuuugggcugucaaggacacgaugcaggcccaggauaauaucaccagcgcacggcuguugcagcaagaggugcuccagaacguuuccgacgccgaaucuuguuaccuggugcauacacugcucgaguucuauuuaaaaacugucuuuaagaauuaccacaaccgcaccguggaaguacgaacacugaaaucguucucaacccuugcuaauaacuuuguuuugauugugagccagcugcaaccaagucaggagaaugagauguucuccauacgugauucugcacauagaagguuucuacucuuccggcgcgccuuuaagcagcuggacgucgaagcugcccuuacuaaggcgcugggggagguggauaucuugcucacauggaugcagaaauucuauaagcuguga

SEQ ID NO: 57673 - RNA, 534 nt, Artificial Sequence
  derived and/or modified sequence opt3 from IL25__Homo_sapiens__NP_073626
augagagagaggccccggcugggcgaagacagcucccucaucucucuuuuccugcaaguggucgccuuuuuggcuaugguuauggggacccacacauacucacauuggccuaguugcuguccaagcaagggacaggauacuuccgaggaauuacugcgcuggucuacggugccgguacccccucuagagccagcacgacccaaccgucacccugaaucgugcagagccucagaggacgguccacucaauagcagggcgauuagucccuggcgguaugagcuggaucgcgaccuuaacagacugccucaggauuuguaccaugcuaggugucucugcccacacugugugucccugcagaccggcucucauauggacccgcgggggaauagcgaacugcucuaucacaaccagacagucuucuaccgccgacccugccacggagagaaaggcacucauaaggguuauuguuuagaaagaaggcuguaccgggugucccuugccugcguuugugugcguccucgcgucaugggguga

SEQ ID NO: 57674 - RNA, 516 nt, Artificial Sequence
  derived and/or modified sequence opt3 from IL26__Homo_sapiens__XP_011536870
augcuggugaacuucauacucagaugcggccuucuguuggucaccuuaagccuggccauugcuaagcacaaacaguccucuuuuacaaagucauguuaccccagggggacucuaagucaagcaguugacgcccucuauauaaaagcggcuuggcugaaggccacgaucccugaggaucggauuaaaaauauccgccuucugaagaagaaaaccaagaaacaguucaugaagaacugccaguuucaggaacaauugcucagcuucuuuauggaggacguguucggacagcugcagcugcaggguuguaaaaagauucgauuuguagaagauuuccauucccuccgucaaaaguuaucucacugcaucucgugugcaucaagcgccagagagaugaaaaguauaacaaggaugaagcggaucuuuuaccgcauuggcaauaaagggaucuauaaggcuauuuccgaacuggacauccuuuugucuuggaucaaaaagcugcuagagagcucccaguga

SEQ ID NO: 57675 - RNA, 732 nt, Artificial Sequence
  derived and/or modified sequence opt3 from IL27__Homo_sapiens__NP_663634
augggccagaccgccggggaccugggauggagacucagccuucuguuguuaccccugcuacucgugcaagcuggugucuggggcuucccuaggccaccggggcggccccagcugucccuucaggagcugcgccgagaauuuacaguuucuuugcaccucgcacguaagcugcugucagaggugagaggacaggcccauagguucgcggaaagucaccucccuggcguaaacuuauaccugcuuccauugggugagcaacugcccgaugugagccuaacuuuucaggcuuggcggcgccucuccgacccugaaagacugugcuucaucucuacgacccuucagccauuucaugcccuguugggcggacucggcacacaggggagguggacuaauauggagcggaugcaacugugggcaaugcgcuuagaucugcgagaccuccagagacaccuuagguuccagguccuggccgcuggguuuaacuugcccgaggaagaggaagaggaggaagaggaagaggaagaggagcggaaaggacuacugccuggugcacucggcucggcccugcaggggccagcucaagugucauggccgcagcuucugagcaccuaucguuugcuccauagucuggaauuaguucugucccgcgccgugagagagcuacuccugcuuucuaaggcgggacacagcgucuggcccuugggcuucccuacacuguccccacagcccuga

SEQ ID NO: 57676 - RNA, 1911 nt, Artificial Sequence
  derived and/or modified sequence opt3 from IL27RA__Homo_sapiens__NP_004834
augagaggcgggaggggagcccccuucuggcuguggccucucccaaaguuagcucuguugccguuacugugggugcuauuucagcggacccgcccccaagguagcgcaggcccucuccagugcuacggggucggaccacugggcgaccuuaacuguuccugggagccccugggugauuugggggccccuucugaacuccaucugcagucacagaaauaucgaaguaauaagacacaaacuguugcgguggcugccggacguagcuggguagcaaucccaagagagcagcugacgauguccgacaaacucuuaguguggggcaccaaggccggccagccccuguggccuccagucuucgugaaccuugaaacacagaugaaaccgaaugcucccagguuggggccugauguugacuuuucugaggaugacccacuggaagcaacugugcacugggccccgccuaccuggccaucgcacaagguccuaauuugccaauuccauuaccggcgcugucaggaggcugccuggacacuccuggagcccgaacuuaagaccauaccgcugacuccuguggagauccaggauuuggaacucgcgacaggauauaaaguauacgguagaugcaggauggagaaggaggaagaccuguggggcgaguggucacccauucuuagcuuucagaccccaccuagugcacccaaagauguuuggguguccgggaaccuguguggaacgccaggcggugaggaaccccuccuucuguggaaggccccugggccaugcguccaagugucuuauaaagugugguucugggucggaggccgggaauugagcccggagggcaucacuuguugcuguucccuaauucccucaggggcugagugggcccgcguuagugcagugaaugcuaccagcugggaaccucugacaaaccucucucugguaugccuugacuccgccucagcgccacgaagcguggccgucaguucuaucgcaggauccacugagcuguuggugaccuggcagcccgguccuggcgaaccacucgagcacguuguggauugggcuagagacggggauccccuggaaaaguuaaauugggucaggcugccgccuggaaaccuaagcgcccuccugccaggcaauuuuacaguggguguacccuaccggauaaccguuacggcugugucggccucugggcuugcauccgccucaagugucuggggcuuccgugaggaguuggcuccucuggugggacccacucucuggcgccugcaggacgcgccaccuggcacacccgcaaucgccuggggcgaagucccaagacaucaacuuaggggacaccugacccacuauacuuugugugcucagagcgguacauccccgucugugugcaugaacguuagcggcaauacccagucagugacgcucccugaccugcccugggggccaugcgaguuauggguaaccgccaguacaauugcaggacaggggcccccugguccaauccugcggcuacaucuccccgauaacacucugcgauggaagguccuuccugggauuuuguuucuguggggccucuuccuguuaggauguggccugucccuugccaccagcgggcgcugcuaccacuugagacauaaagugcucccgagguggguuugggaaaaggugccagaccccgcuaauucuucaaguggacaaccucacauggagcaggucccagaagcccagccccugggugaucuaccuauccuggagguggaggaaauggagccgcccccaguaauggaaagcucccagccugcacaagcgacagcuccccucgacucuggcuacgagaaacacuuucugccaacuccugaggaacuuggguugcugggacccccacggccccagguguuagccuga

SEQ ID NO: 57677 - RNA, 462 nt, Artificial Sequence
  derived and/or modified sequence opt3 from IL2__Homo_sapiens__NP_000577
auguacagaaugcagcugcucagcugcaucgcccuuucccuggcuuuggugaccaacucugcacccacaucaaguagcacuaagaaaacgcaauuacagcuggagcaccuacuccuggaccuucagaugauucugaauggcauaaacaauuauaagaacccuaaauugaccaggaugcucacauucaaguuuuacaugccgaaaaaggccacugaacugaagcaucugcagugucucgaggaagaguuaaaaccacuggaagagguccuuaauuuggcgcaauccaagaacuuccaccuacggccccgcgaucugaucucuaauauuaacguuaucgugcucgagcugaaagggucggaaaccacauuuaugugcgaguaugcugacgaaaccgccacuauuguagaguuccuuaaucgauggaucacauuuugucagucaauaaucagcacccugacguga

SEQ ID NO: 57678 - RNA, 819 nt, Artificial Sequence
  derived and/or modified sequence opt3 from IL2RA__Homo_sapiens__NP_000408
auggacagcuaccugcucauguggggccuucugaccuucaucauggugcccgggugccaggccgaguugugugaugacgauccuccagaaauuccgcacgcuacauuuaaggcaauggccuauaaagagggaacuauguuaaacugcgaauguaagagagguuucaggcggauaaaauccggcucucuguacaugcuaugcacgggaaauucaagucauagcuccugggacaaccaaugucagugcaccucuucggcgacacgcaauacuaccaagcaggucacaccccagccugaggaacaaaaagagcgaaagaccacugagaugcagucaccaaugcagcccguugaucaggcuagccucccugggcacugucgugaaccacccccuugggagaacgaagccacagagagaaucuaucauuuugugguaggccaaaugguguacuaucagugcguccaggguuacagggcacugcaccgggggccagccgagaguguguguaagaugacccauggaaaaacgcgcuggacucagccgcaacuuauuugcaccggcgaaauggagacaucccaguuccccggcgaagagaagccucaggcuucuccagaagggagacccgagagcgagacuuccugucugguuaccacaaccgacuuucaaauccagacggaaauggcagccacuauggagacaucaauuuucaccacugaauaucagguggcugucgccggaugcguguuuuugcucaucaguguacugcugcucagcgguuuaacauggcagaggcggcaacgcaaaucucgaagaaccauauga

SEQ ID NO: 57679 - RNA, 1656 nt, Artificial Sequence
  derived and/or modified sequence opt3 from IL2RB__Homo_sapiens__NP_000869
auggccgcucccgcacugagcuggagacucccucuucugaucuuguuacugccacuagccaccuccugggcgucugcugccgugaacggcacaucacaguucacuugcuuuuacaauaguagggcaaacauuagcugugucuggucccaagacggggcccuccaggauacgucuugccagguucacgcuuggccggaccggcgccgauggaaucagaccugugagcugcuucccgugucgcaagcaucaugggccugcaaccugauauugggagcuccugauagccagaagcucacaacuguagacaucgugacccugcguguccuguguagagaaggugugagguggcggguuauggccauucaggauuucaaaccauuugagaaucuccgcuuaauggcgcccaucagucuucaggugguccauguggaaacacacagaugcaacauuuccugggagaucucucaagcaagccauuauuucgaaaggcaccuggaguuugaggcccggaccuuguccccuggccauacuugggaagaggcuccacugcuaacacucaagcagaaacaggaauggauaugucuggagacccuuacgcccgacacucaguacgaguuccaaguacgcguuaagccucugcagggggaauuuaccacauggucaccauggagucagccguuggccuuccgaacuaaacccgcagcucucggaaaggauaccaucccuuggcugggccacuuacuggugggucucagcggggccuuuggauucauuauccuugucuaucuguugauuaauugcagaaacacaggcccauggcuaaagaaagugcugaaguguaauacccccgacccuucuaaauuuuucucccaacucucaagcgagcacggcggggaugugcagaaguggcugaguucuccauuucccuccagcucguucucuccgggaggucuugcgccugaaaucucaccccuggaggucuuggaaagggacaaaguuacgcagcuccuguuacagcaagauaaggugccagagccugccucccugaguagcaaccauucccuaacuucuugcuucacaaaucagggcuacuuuuucuuucaccuccccgacgcacuggagauagaggcuugucagguauauuucaccuacgauccauauagcgaagaagaccccgacgaggggguggccggagcuccuacuggcucaaguccacagccgcuucaacccuuguccggugaagaugacgccuacugcacauuuccuagccgggaugaccugcuccuguucucuccaucacuucugggagggcccaguccuccaagcaccgcacccggcggcuccggggccggagaggagcguaugccgccuucuuugcaggaacgcgucccaagagauugggacccccagccucucggucccccaacgccuggcgugcccgaucugguugacuuucagccaccgccugaguuagugcugagggaagcuggggaggaaguccccgaugcgggaccacgggagggcgugucguuccccuggagccgaccuccaggucaaggggaguuucgcgcacuaaacgccagacucccccugaauaccgacgcuuaccuuuccuugcaggaacugcagggccaggauccuacacaucucguauga

SEQ ID NO: 57680 - RNA, 1110 nt, Artificial Sequence
  derived and/or modified sequence opt3 from IL2RG__Homo_sapiens__NP_000197
augcugaagcccagccucccuuucaccucccuucuguuuuugcaguuaccacugcuaggcguggggcucaacacaacuauccugacgccgaauggaaacgaggacaccacagccgauuucuuucuuacuaccaugcccacagacucucugucagucaguaccuugccucucccagaaguucaaugcuucguguuuaauguagaguacaugaacuguacuuggaauagcuccucugaaccccagccuacaaaccugacccugcacuauugguacaaaaauucggauaacgacaaggugcagaaaugcucacauuaucucuucagcgaggaaaucacgagugguugucaguuacaaaagaaagagauacaccuguaccagacuuuugucgugcagcuucaggauccaagagagcccaggcggcaagcuacccagauguugaagcugcagaaucuaguuaucccuugggcaccagaaaaccucacacugcauaaacuuuccgagucucagcuggaauugaauuggaacaaucgcuuccucaaccacugccuggagcauuuagugcaauaucgaacugacugggaucacagcuggaccgagcaguccgucgacuaccgucacaaguuuucacugccgaguguggauggccagaagagauauacauucaggguacggagccgcuuuaauccccucugugggucugcccaacauugguccgaauggucacacccuauucauuggggaagcaacaccaguaaagagaacccauuccuuuuugcgcuggaagcuguugugaucucugucggcuccauggguuugauuaucagccuacugugcguguacuucuggcucgagagaacgaugcccaggauaccuacucugaagaaucuugaagaccuggugacagaguaccacgggaacuucucggccuggucuggagucuccaaaggcuuggcagagucacuccagccagauuauagugaacggcuguguuuaguuagcgagauucccccgaagggcggggcccugggagaagguccuggcgcuucccccugcaaucagcacucuccauacugggcaccucccuguuauacccuaaagccagagacuuga

SEQ ID NO: 57681 - RNA, 495 nt, Artificial Sequence
  derived and/or modified sequence opt3 from IL31__Homo_sapiens__XP_011536628
auggccagccacuccggccccucuaccucagugcuguuccucuuuugcugucuugggggauggcuggcuagucauacauugccugucagauuacugaggccaagcgacgauguucagaagaucguggaggaacuacaaucccucucuaaaaugcugcuuaaggacguagaggaagagaaaggugugcuggucucgcagaacuacacuuugccgugccucucacccgaugcacagccuccaaauaacauucacagccccgccauacgggcguaucugaagacgauccgccagcuggacaauaaaagugugauugaugaaaucauugagcaucucgacaaguuaaucuuccaagaugcuccugagaccaacauauccguuccaacagacacucacgaauguaagcgauuuauccugaccauuucucagcaguucagcgagugcauggaucuugccuugaaaucccugacaucaggcgcacagcaagccaccacuuga

SEQ ID NO: 57682 - RNA, 2238 nt, Artificial Sequence
  derived and/or modified sequence opt3 from IL31RA__Homo_sapiens__NP_001229565
augaagcugagcccccaaccuuccugcgugaaccucggcaugauguggaccugggcccuuuggaugcugccaucuuuguguaaauucucauuagcugcacugccggccaagcccgagaauaucaguugcgucuacuauuacagaaagaaccuaacauguacuuggagcccugggaaggaaacguccuauacccaauacacaguuaaaaggacuuaugcguuuggagagaagcacgacaauugcaccacaaacucuucgaccucagaaaaucgggcuagcuguaguuucuuucucccacgcauuacuauacccgauaacuacacaaucgagguggaagccgagaauggugacggcguaauuaagucccauaugaccuauuggcgacuggagaacaucgcaaaaacggaaccuccaaagauuuuccgugugaaacccguccuugggaucaagagaaugauacagaucgaguggauuaaaccugaacuggccccagugucuagcgauuugaaguacacucucagguuucggaccguuaauuccacaucauggauggaggugaacuucgcuaagaaucgcaaagacaagaaccagacuuacaaucugaccggacugcagccguuuacagaguaugucaucgcacucagaugcgccgugaaagaaaguaaguucuggagcgauuggucucaagagaaaaugggcaugaccgaagaggaagcucccugugguuuagagcuguggaggguacuuaagccugccgaggcggacgggcggcgcccaguucgauugcuguggaaaaaggcaagaggagcccccgugcuagaaaagacgcucggcuacaacauuugguauuacccugaguccaauacuaaccugacagaaaccaugaacacuacaaaucagcagcuugagcugcacuugggcggggaaucauuuugggucagcaugaucaguuauaacucucucggaaaauccccaguggcuacccugaggauacccgccauucaggaaaagagcuuccaaugcaucgaggugaugcaggcaugugucgcugaagaucaguuaguugugaaauggcagucgucugcccuggacguaaauacguggaugauugagugguuuccggauguggacuccgaaccuaccacacucucaugggagagugucagccaagcgacuaacuggaccauccagcaggauaaacuuaaacccuucuggugcuacaauaucuccguguauccaaugcugcaugacaagguuggugaaccuuacucuauucaagccuacgcaaaggagggcgugcccagcgaggggccagaaacaaaagucgagaacauaggagugaagacuguaaccaucacauggaaagaaauucccaagucagagcggaaaggcaucauauguaauuauaccaucuuuuaccaggcugagggugggaagggauucaguaagacuguuaacuccagcauuuugcaguauggccuagaaucucugaaacguaagacgucauacaucgugcaggucauggccaguacaagcgcuggcgggaccaauggaacuuccauuaacuucaaaacccucucuuuuucgguguucgagaucauucugauaacaagccuuaucgguggcgggcuguugauucucaucauccugaccgucgccuauggauuaaagaaaccuaauaagcugacucaccuaugcuggccaacagugccgaaccccgcagaauccucaauugccacguggcauggcgaugacuuuaaggacaaacucaaucugaaggagagugaugacucuguuaacaccgaagaucgcauacuuaaaccuugcagcacuccauccgacaaguuggugaucgauaaacugguagucaauuucgguaacgugcuccaagagauuuuuacagacgaggcuagaaccgggcaggaaaacaaucugggcggagagaagaacggcuacguuacaugucccuucaggccugauugcccacuugggaaaucauuugaggagcugcccgugagcccggaaaucccuccacggaagucucaguauuugcgaucccgcaugcccgagggaacuagaccugaggcgaaggaacagcuccuguucaguggucagagcuuaguccccgaccaccugugugaggaaggcgcaccaaauccuuaccucaaaaacucugugaccgccagggaguuucuaguauccgaaaagcugcccgagcacacgaaaggggagguguga

SEQ ID NO: 57683 - RNA, 396 nt, Artificial Sequence
  derived and/or modified sequence opt3 from IL32__Homo_sapiens__NP_001012651
augugcuuccccaaggugcugagcgacgauaugaaaaagcucaaagccagaaugcaccaggcuaucgagagguuuuacgacaagaugcaaaacgcagaauccggccgggggcaggucaugucuucacuugccgagcuggaagaugacuucaaagagggauauuuggaaaccguugcggcuuacuaugaggagcagcauccugaauuaacaccacugcuagagaaggaacgcgauggucuccgaugucguggcaauagaaguccggugcccgacguagaggauccugccacugaggaaccaggggagagcuuuugcgacaaguccuacggagcacccaggggcgauaaagaggaacugacgccucagaaguguucugaaccacaaucgucaaaauga

SEQ ID NO: 57684 - RNA, 687 nt, Artificial Sequence
  derived and/or modified sequence opt3 from IL33__Homo_sapiens__NP_001186569
augaagcccaaaaugaaguacagcaccaacaaaaucuccacagccaaguggaaaaauacugcuucuaaggcacugugcuucaagcucggcaaaucacagcaaaaggccaaagagguguguccuauguauuuuaugaaguugagaagugggcugaugauuaaaaaggaagcgugcuacuucaggcgggagacgaccaagcgcccaagccuuaaaacaggacgaaagcacaaacgucauuuaguccuggcugccugucagcagcaguccacuguugaaugcuuugcauucgguauaucuggcgugcaaaaguauaccagagcccuacacgacucgucaaucacagauaaaguacuccugagcuacuaugagagucagcauccguccaacgaaucuggggacggaguggauggcaagaugcuuauggucacccugagccccacuaaagacuuuugguugcacgcuaauaacaaggagcauuccguggagcuccacaagugugaaaaaccucugccagaucaggcauucuuuguucugcacaauaugcauucaaacugcgugaguuucgaguguaagacagaccccggugucuuuauuggggugaaagauaaucaccucgccuuaaucaagguagacagcucugaaaaccugugcaccgagaauauucuuuucaaauuguccgagacguga

SEQ ID NO: 57685 - RNA, 729 nt, Artificial Sequence
  derived and/or modified sequence opt3 from IL34__Homo_sapiens__XP_011521205
augcccagaggcuucaccuggcugagguaccucgggaucuuucuuggaguggcccuggguaacgagccuuuggaaauguggccauuaacacagaaugaggaaugcacugucacgggcuuccugcgggacaagcuacaauaucgcagccgacuccaguacaugaaacacuauuuuccgauuaacuacaagauauccguucccuaugaggggguguuccguaucgcuaauguaaccagacugcagagggcacaggugucugaacgggagcuucgcuaccugugggucuuggugucacucagugccacagagagcguucaagaugugcugcuggaaggacauccuuccuggaaauaucuccaggaggucgaaacuuuacugcuuaacgugcagcagggcuugaccgacguagagguuucuccaaagguggagucgguccugucacuacucaaugcgcccgguccuaaccugaaacuugugagaccaaaggcucuguuggauaauuguuuuagggugauggaacuccuguacugcagcuguugcaagcaaaguuccgucuuaaacuggcaggacugugagguucccucuccucagagcugcuccccagaaccgucacugcaguacgccgcaacacaacucuaucccccuccacccuggaguccuagcucuccaccccacuccaccgggucagugcggccgguacgcgcccagggagagggccuucugccuuga

SEQ ID NO: 57686 - RNA, 477 nt, Artificial Sequence
  derived and/or modified sequence opt3 from IL36A__Homo_sapiens__NP_055255
auggagaaggcccugaaaaucgacacaccccagcaaggcagcauucaggauauaaaccacagaguguggguccuccaggaccagacccuuaucgcuguuccuaggaaggaucggauguccccagugacuauugcacugaucucuugccgccauguagaaacguuggagaaagaccgagggaauccgauuuacuuaggacugaacggucuaaaucucugucugaugugcgccaaggugggcgaucaacccacccuucagcugaaagaaaaggacaucauggauuuguauaaccagccugagccagucaagucauuccucuuuuaccacagucagagcgggcguaauuccacauucgaaucuguggcguuucccggaugguucauagcuguuucgucagagggcgguuguccucugauccugacucaagagcucgggaaagccaacaccacagacuuuggauuaaccaugcuguucuga

SEQ ID NO: 57687 - RNA, 495 nt, Artificial Sequence
  derived and/or modified sequence opt3 from IL36B__Homo_sapiens__NP_055253
augaacccccagagagaggccgcuccuaagagcuacgcaaucagggacucccggcaaaugguguggguccugucuggcaauucacucauugccgcgccacuuagucgcagcauaaaaccgguuacccugcacuugaucgcuugccgagauacagaguucuccgacaaggaaaaagggaacaugguguauuuaggaauuaaggguaaagaucugugucuauuuugcgccgaaauccagggcaagcccacucuccagcugaaacuucaggggucucaagacaauauuggaaaagauacguguuggaagcugguaggcauccauaccugcauaaacuuggacgugcgugagucguguuucauggguacacucgaucagugggggaucggagucggcagaaagaaguggaaaagcucauuucagcaccaucaccugaggaagaaggacaaagauuucaguuccaugcggacuaauauuggcaugccugggcgcauguga

SEQ ID NO: 57688 - RNA, 510 nt, Artificial Sequence
  derived and/or modified sequence opt3 from IL36G__Homo_sapiens__NP_062564
augagaggcacccccggggacgccgauggagguggcagggcuguguaccagagcaugugcaagccuaucacagggacuauuaacgaccugaaucaacaggucuggacgcuccagggacagaaccuuguugcagugccacgguccgauucuguaaccccggugacagucgccgugauaacuuguaaauaucccgaggcgcuggaacaaggccgcggugacccuaucuacuuggggauucagaauccagagaugugcuuauauugugaaaagguuggagagcagcccacccugcagcuaaaagaacaaaagaucauggaucucuacggccagccugagccagugaaacccuuccuguuuuaucgagcuaagacaggccguaccucaacucuugagagugucgccuucccugacugguuuauugcaagcuccaagagagaucagccaaucauacugacaucugaauuggggaaaucguacaacaccgccuucgagcucaauaucaacgacuga

SEQ ID NO: 57689 - RNA, 468 nt, Artificial Sequence
  derived and/or modified sequence opt3 from IL36RN__Homo_sapiens__NP_775262
auggugcugagcggcgcccucugcuucagaaugaaggacuccgcucuuaaaguccuguacuugcacaacaaucaguuacuggcagggggacuacaugccgguaagguuaucaaaggcgaggaaauuucugugguacccaacagguggcucgaugcgucacugaguccugugauacuugggguccaaggaggcagccagugucuguccugcgguguggggcaggagccaaccuugacacucgaaccgguuaauaucauggagcuguaucugggagcuaaggaaucuaaaucguuuacuuucuaccggcgcgacaugggccucacgagcucauuugagagugccgcauaucccggcugguucuuauguaccgugccugaggccgaucagccaguccgacugacacaacuucccgaaaacgggggauggaaugcuccuauuacugacuuuuacuuccagcagugcgauuga

SEQ ID NO: 57690 - RNA, 657 nt, Artificial Sequence
  derived and/or modified sequence opt3 from IL37__Homo_sapiens__NP_055254
augagcuucgugggcgagaacuccggggucaagaugggaucugaagacugggagaaagaugaaccccagugcugucuggaggacccugccgguucaccacucgaaccgggccccagucuuccuaccaugaauuuuguucacacaagcccaaaggugaaaaaccugaaucccaagaaauucuccauccaugaucaagaccacaagguauugguguuagauucugggaaccugauugcugucccugacaagaauuacauaagaccagagaucuuuuucgcacuagccucgucacucagcagugcguccgcugagaaaggaucucccauucugcuuggcgugagcaagggugaauuuugccuguauugugauaaagacaaggggcagucccauccuucauugcagcucaaaaaggagaagcugaugaaacuggccgcacagaaggaaagugccaggcggccauucaucuuuuaccgcgcucaaguuggaagcuggaacaugcucgagucugcagcccacccgggcugguucauuugcacuuccuguaauugcaacgagcccgugggcgucacggauaaauuugaaaaucgaaagcauaucgaguucucauuucagccuguguguaaagcugaaaugagcccaagugagguaucugacuga

SEQ ID NO: 57691 - RNA, 459 nt, Artificial Sequence
  derived and/or modified sequence opt3 from IL3__Homo_sapiens__NP_000579
augagcagacugcccgugcuccuucuguugcaguuacuggucaggccuggccuacaagccccaaugacccagacaacuccgcucaagacguccuggguuaacugcucuaauaugaucgacgagauuauaacccaccugaaacagcccccucuuccacuguuggauuucaacaaucucaacggggaagaccaggauauccugauggagaauaaccugcggcgccccaaucucgaggcuuuuaaccgagcagugaagucauuacaaaaugccagugcgauugaaagcauccugaaaaaccuuuugccuugucugccacuagcuacagccgcacccacucgucauccuauucacaucaaggacggagauuggaaugaguucagaaggaaacucaccuuuuaccugaagacacuugaaaacgcccaggcucagcagaccacucuguccuuggcaauauucuga

SEQ ID NO: 57692 - RNA, 903 nt, Artificial Sequence
  derived and/or modified sequence opt3 from IL3RA__Homo_sapiens__NP_001254642
auggugcugcucuggcuuacccuguuguuaaucgcccugcccugccuacuccagacaaaggagggcgggaaaccuugggcuggagcagaaaaccugacuuguuggauucacgacgucgauuuccuuagcugcuccugggccguugguccaggcgcgccggcugacgugcaauacgaucuguauuugaauguagccaacagaaggcagcaguacgagugucuccauuauaagacggacgcacaggggacccggauaggaugccgcuuugaugacaucucucgacugucaaguggcagccaauccucucacauucuggugcgugguagaucggccgcuuucgggauccccuguacagauaaauuugucguguucucacagauugaaauccucacuccuccaaauaugaccgcaaagugcaacaaaacacauagcuuuaugcacuggaagaugaggagucauuucaaucggaaguuucgcuacgaguuacagauacagaaaagaaugcaacccguuaucaccgaacaggugagggaccggacuuccuuccagcugcuuaacccuggaacauauaccguccagauucgcgcccgagagagaguguacgaguuuuugucugcuuggagcacgccacaaagguucgaaugugaucaggaggaaggcgccaauacucgggcguggcguaccucccugcuaaucgcacucggcacacugcuugcccugguaugcguuuuugugauuugucgcagauauuuggucaugcagaggcuguucccccggaucccucacaugaaggacccaauaggggauucauuucaaaacgacaaacucguggugugggaggcuggaaaggccgguuuagaggaaugccuggucacugagguucaggugguacagaaaaccuga

SEQ ID NO: 57693 - RNA, 462 nt, Artificial Sequence
  derived and/or modified sequence opt3 from IL4__Homo_sapiens__NP_000580
augggccugaccagccagcuccuucccccucuguucuuuuuguuagccugcgcugggaacuucgugcacggacauaagugcgacaucacacugcaagagauuauaaaaacucuaaauucccucacggaacagaagacccugugcacagagcuuacugucaccgauaucuuugcagccucuaaaaacacaaccgaaaaggagacuuucuguagagcggcuacaguucugaggcaguuuuacucacaccaugaaaaagacacccggugcuugggugccacggcacagcaauuccaccgccauaagcagcucauucgauuucugaagcgucuggauagaaaucucuggggcuuagccgggcugaacaguuguccagugaaagaggcuaaucagagcacucuugagaacuucuuggaaaggcugaagaccaucaugcgggagaaauauuccaaguguucuucguga

SEQ ID NO: 57694 - RNA, 1770 nt, Artificial Sequence
  derived and/or modified sequence opt3 from IL4I1__Homo_sapiens__NP_001244947
augcccaacgacgauuucugcccuggccugaccaucaaggccaugggggcugagagagcaccacagaggcaaccguguacacuccaccuucugguguugguccccauuuuacugagccuaguugccucccaggacuggaaagcggaacggucucaggauccuuuugagaagugcaugcaggacccagauuacgaacaacuccugaaagugguaacuuggggacuuaaucgcacgcugaagccccagcgagugauagucgugggugcuggcguugccggguugguggcagccaaaguccucucagacgcuggacauaaggugaccauccuggaggcagauaaccguauuggcgguagaaucuucacauauagggaccagaauacuggguggauuggagaacugggcgccaugcggaugccuaguagccaccgcauccuccauaaguuaugucagggccuggggcuuaacuugaccaaauuuacacaauacgauaagaauaccuggacugagguacacgagguuaaacugagaaacuauguggucgaaaaggugccagagaaacuaggauacgcucucaggccccaggaaaagggucauuccccugaggacauauaucagauggcccugaaucaggcgcuuaaggaucugaaagcauugggcugccggaaggccaugaaaaaguucgagcgccacacacuccuggaauacuuacugggggagggaaaccucucucgaccagcugugcaacuucugggcgacgucaugucggaagauggguuuuucuauuugucauuugccgaggcacuaagagcucacagcugucugagugacaggcuccaguacucccggaucguugguggaugggaccugcuuccgcgugcccuguugucuagccucuccggccugguguuacugaaugcgcccguaguggccaugacccagggcccucaugauguccacgugcaaauugaaacgucaccacccgcacgcaaccuaaaaguucucaaggcugacgugguccugcuuacugccagugggccugcugugaaaagaaucaccuucagcccacccuugccgaggcauaugcaggaggcccugcggcgacuccacuacguaccugcaacaaagguuuuucugucuuuccgcagacccuuuuggagggaggaacacauugagggaggucauuccaauacugaucggccaucacgcaugaucuucuauccucccccaagagaaggcgcccuucuguuggcuagcuacaccuggagugacgcggcagccgcuuuugccgggcucucuagggaggaagcacugcguuuagcccuggaugacguggcugcccuacacggacccgucgugcggcagcucugggauggcacaggugucgugaagcgaugggcagaggaccagcauucccaagggggcuucguugugcagccuccagcgcuguggcagaccgagaaagaugacuggacgguaccguauggaagaauauacuucgcuggcgaacacacugccuauccccaugggugggucgagacagcaguuaagagcgcccuuagggcugccauuaaaaucaacucgcgcaagggaccugcaucugauaccgcuuccccagaaggucacgccucagacauggagggccaggggcacgugcauggaguggcgaguagccccucccacgacuuggccaaagaagagggcucucauccuccaguccaaggucagcugagccuccagaauacuacacacacccggacgucacacuga

SEQ ID NO: 57695 - RNA, 2433 nt, Artificial Sequence
  derived and/or modified sequence opt3 from IL4R__Homo_sapiens__NP_001244336
augcagaaggacgccagaagggagggcaacaugaaagugcugcaagagccuaccugcgucagcgauuacauguccaucucuacaugugaguggaagaugaaugggcccacuaacugcucaacggaacuccggcuucuguaucaguugguuuucuuacugagugaggcucacaccuguauuccagaaaauaacggaggugcaggcugcgugugucaucuacucauggacgauguagugagcgccgacaauuacacacuggaucuuugggcggggcagcagcuguuguggaaaggauccuuuaagccgucugagcacgucaaaccccgcgcuccuggcaaccucacugugcauaccaauguuucggacacacugcugcucaccuggucaaacccauaucccccugauaauuacuuauauaaccaccugacuuacgccgugaauauauggagcgagaacgacccagcagauuuccgaaucuauaaugucacauaccuugaacccaguuugcguauugccgcuuccacccugaagucugguaucagcuacagagcaagggugcgggccugggcucaaugcuauaacacgacuugguccgaguggucaccuaguaccaaguggcauaauagcuaccgcgaaccauuugagcagcaccuacuccuggggguaucuguuuccuguauugugauccuugccgucugccuguuguguuaugugucaauaacaaaaaucaagaaagaguggugggaccagauuccgaaccccgcgagaagcaggcucguggcaaucauuauccaggaugcccaaggaagucagugggaaaagcggucucgcggccaggagccugcuaaaugcccacacuggaagaacugucugacuaaguuacugcccugcuuccucgaacauaauaugaaacgagacgaggauccucacaaggccgcaaaagaaaugccauuucagggcuccggaaagagcgcuuggugccccgucgagauaucgaaaaccguucuuuggccggagucuauuuccgugguaagauguguggaacuguucgaggccccugucgaaugcgaggaagaggaggaaguggaggaagagaaggggucauuuugugcgagucccgaaagcuccagggacgacuuccaagagggucgggagggcaucguugcccguuugacagaaucucuauuucuggaucuccugggggaggaaaacggaggcuucugccagcaggacaugggugagagcugucuucugccaccuucagggaguaccuccgcacauaugcccugggaugaguuuccaagcgcuggacccaaagaagccccuccauggggcaaggagcaaccguugcaccucgaacccucuccuccagcuucacccacgcagaguccugacaaucugacuugcacagagaccccauuagugauugccggcaaccccgcauaccgcagcuucuccaauucucugucgcagagcccguguccuagagaacuagggccagauccccuccuggccaggcaccuugaggaggucgaaccugagaugcccugcgugccacaguuguccgaaccuacuacaguaccccaaccagagccggaaaccugggagcagauccugcggcgaaacguucuccagcauggagcugcggcagccccugugucagcucccacgagugguuaucaggaguuuguccacgccguggaacaaggcgggacccaggcaucugccgucgugggacugggcccacccggugaggcuggguacaaggccuucagcucccuucuggcaucaagcgcgguuucuccugaaaaauguggcuucggagcuuccaguggcgaggaaggguauaagccauuucaggacuugauccccggaugcccuggugauccggccccagugcccguaccucucuucacauuuggccuggaccgcgagccacccagaagcccucagucuucccauuuaccgucaaguagccccgagcaccuggggcuagaaccaggagagaaagucgaagauaugccuaagcccccacucccucaagagcaggcaacugacccccugguggauucgcuuggcuccgguauuguuuacucugccuugaccugucaucugugcgggcaccucaaacagugccacggccaggaggacggaggccaaacaccagugauggcuagcccguguugcggguguugcuguggagacaggucaaguccucccacuaccccacugcgggcccccgauccuuccccagguggcguccccuuagaagcaucucugugcccugcuagccuugccccguccgggauaucagaaaagagcaagaguucuuccagcuuccauccagcgcccggaaaugcccagucgucaucucagacaccuaaaaucgugaacuuuguaagugugggccccaccuacaugcgcguuuccuga

SEQ ID NO: 57696 - RNA, 528 nt, Artificial Sequence
  derived and/or modified sequence opt3 from IL5__Homo_sapiens__XP_006714664
augggcguggucguuggguggaucggagaccccgguagcggcaccgauaacaagcugacaggggacgccgugcucuacuaugcucuuucccugccuaaagcaaaugccgagagauucagggcgaugcggauguuguuacaccugucucuacucgcucugggagccgcauacguauaugccauuccaacugaaauaccgacgucagcucuugugaaggagacccuggcauugcucaguacacaucgcacucugcugaucgccaacgaaacccuccguauucccgucccugugcacaaaaaucaucaguuaugcacagaggaaaucuuucaaggcauugguacccuggagagccagacuguucaagggggaacaguggagcgacuuuucaagaacuugucccugaucaaaaaguacauagauggccagaagaaaaaguguggcgaagagagaaggcgggucaaucaguuucuagacuaucuccaggaguuccugggggugaugaacaccgaauggaucauugagucuuga

SEQ ID NO: 57697 - RNA, 1263 nt, Artificial Sequence
  derived and/or modified sequence opt3 from IL5RA__Homo_sapiens__NP_000555
augaucauuguggcccacguccugcucauacuucugggcgcuaccgagaucuugcaggcagacuuacugcccgaugaaaagauuagccuacucccuccaguuaacuucacaaucaaagugacugggcuggcccaaguacuucugcaguggaagccgaaucccgaccaggagcagagaaacgugaauuuggaauaccaagucaaaauuaacgcgccuaaggaggaugacuaugaaacgaggaucaccgaguccaaaugcgugacaauacuccauaagggauuuucugcuucaguucggacuauccugcagaaugaucacagucugcucgccagcuccugggcaucugccgaguuacaugcuccacccgguucgccuggcaccucaauugugaaccugacauguaccacuaauacaaccgaagacaacuacagccgccuucgaaguuaucaggucuccuugcacugcacguggcugguggggacugaugcaccagaggacacccaguacuuccuauauuaccguuauggaucuuggacagaagagugucaagaguacagcaaggauacucucggcagaaauaucgccugcugguuucccaggaccuucauucuguccaaaggucgggacuggcuugcuguacugguuaacgggucaaguaagcauagcgccauccgcccuuuugaucaguuguucgcgcuccacgcaauagaccagauuaauccaccgcugaacgugacagccgaaaucgagggaaccagauuaucuauucagugggaaaaacccgucuccgcuuuuccuauccacuguuucgauuacgaggugaagauccauaauacgaggaacggcuaucugcaaauugaaaaacucaugacuaaugccuuuauaucaaucauugacgaccuuagcaaguacgaugugcagguccgggcagcuguuaguucuaugugccgcgaggccggccugugguccgaguggagccagccaaucuauguggggaacgacgaacacaagcccuugcgagagugguucguaauagugauuauggcgacaaucuguuuuauccuacugauucucucgcugaucugcaaaauuugucaucuuuggauaaagcuguucccuccaauccccgccccgaaaucuaacauuaaggauuuguuugucaccacuaauuacgaaaaagcaggauccucagagacagaaaucgaggugaucugcuauauugagaagccugguguugaaacccucgaggacaguguguucuga

SEQ ID NO: 57698 - RNA, 639 nt, Artificial Sequence
  derived and/or modified sequence opt3 from IL6__Homo_sapiens__NP_000591
augaacagcuucuccaccucugccuuuggccccguggcuuucucacuggggcuccuucuggucuugccugcagccuuuccagcgccgguucccccuggagaggacaguaaggauguggcugccccacacagacagcccuuaacaagcuccgaaaggaucgacaaacaaauucgguacauacuggaugguaucucugcacuacgcaaggagacuugcaauaaaucgaacaugugugaaucaagcaaggaggcccucgcugaaaauaaccugaaucuuccuaaaauggcagagaaggacggcugcuuccagaguggguuuaacgaggaaacgugucugguaaagauuaucaccggauugcucgaguucgaaguguaucuggaguaccugcagaaucgauuugaguccucugaagaacaggcccgugcuguccaaaugagcacaaaagugcucauucaguucuuacagaagaaagccaagaaccuggaugcgaucacuaccccagaccccacaaccaaugcaucccuuuugacuaaacugcaggcccaaaaccaguggcuacaggauaugacaacccaucucauacugagaucauuuaaggaguuccuucagaguagccugagggcuuugcggcaaauguga

SEQ ID NO: 57699 - RNA, 1407 nt, Artificial Sequence
  derived and/or modified sequence opt3 from IL6R__Homo_sapiens__NP_000556
augcuggccgugggcugcgcucuccuugcagcccuguuggcggcucccggggccgcauuagccccuagaagguguccagcucaggaggucgcacggggaguucugaccagccuaccgggugacuccgugacacucacuugccccggcguagaaccugaggauaacgccacggugcacuggguccugcgcaagccagcugccgggucucaucccucacgaugggcgggaaugggccguagacuucuguugaggagugugcaacuccacgacagcgguaauuacuccuguuaucgggcagggcgcccugccggaaccguucaucugcugguggaugucccacccgaagaaccucagcucucuugcuucagaaaaucgccauuaucaaacgugguaugugaauggggcccgaggagcacacccagucugacuaccaaggcuguucuuuuggugcggaaauuucaaaauuccccugccgaggacuuccaggagccaugccaguacucucaggaaagccagaaguuuuccugucagcuggcaguccccgagggcgauucaaguuucuauaucgugagcaugugcguggcuucuuccgucgggucaaaauuuagcaagacacaaaccuuccagggaugugguauucuacagccugacccacccgccaacauaacuguuacagcgguggcccgcaauccgcgauggcucaguguaaccuggcaggauccucacucuuggaacuccagcuuuuacagacugagguucgaacuucgguaucgugcagagcgcucgaagacguuuacuaccuggauggugaaagaccugcaacaucacugcgucauccacgaugcuuggucuggcuugagacaugugguucagcucagggcccaggaggaguucgggcaaggagagugguccgaauggucacccgaggcuaugggcacaccauggacugaaagucggagcccucccgccgagaaugagguguccaccccaaugcaggcacugacaaccaacaaggacgaugacaauauuuuauuucgagauucugccaacgcuacgagccugcccguccaggacucaaguuccgugccucucccaacuuuccuuguagcgggugggagccuggcauuuggaacauugcuauguaucgccauuguucugcgcuucaaaaagaccuggaaacucagagcucugaaggaaggcaagacuucuaugcacccgcccuacucacuuggccagcuggugccugagaggccacggcccacaccugucuuggugccacucaucagucccccggucagcccuuccucucuggggucggacaauaccagcucccauaaccgcccagaugccagagaccccaggucaccuuaugauauaaguaauacggacuacuucuuuccccguuga

SEQ ID NO: 57700 - RNA, 2574 nt, Artificial Sequence
  derived and/or modified sequence opt3 from IL6ST__Homo_sapiens__NP_001177910
augcugacccuccagacauggcuugugcaagcccuguucaucuuuuugacuacggagagcaccggcgaauuacuggaccccugcggguacauuuccccugagucuccagucguucagcuacacucaaacuucacagcuguguguguacucaaggaaaaaugcauggauuauuuucaugugaaugcaaacuacauagucuggaagacuaaucacuucaccaucccgaaagagcaguauacaauuaucaacagaaccgccaguagcgugacuuuuacagacauugcgucccugaauauccagcuuaccuguaacauacugacguucggacaauuggaacagaauguuuacgguaucacuauuaucucuggcuugcccccugagaagcccaaaaaccugucgugcauugugaaugaggggaagaagaugaggugugaaugggauggaggccgggagacccaucuggaaacaaacuuuacucucaaaucagagugggcuacccacaaguucgccgacugcaaagcaaagcgcgauacacccaccagcuguacggucgacuauaguacuguguacuuuguaaauaucgagguuuggguggaagccgagaacgcuuuagguaaagucacauccgaucauauaaauuucgacccuguguauaaggugaagccaaacccaccucacaaucugucugucauuaacagcgaagaacuuuccucaaucuugaaacugaccuggacuaacccaaguauuaagagcguuaucauccuaaaauacaauauucaguaccgaacaaaggaugcaucuaccuggucccagauaccgcccgaagacacggccucaacccguagcaguuuuacagugcaagaucucaaaccuuucacugaguauguauuuagaaucaggugcaugaaggaggacgggaaaggauacuggucugauugguccgaagaggcuagcggcauuaccuaugaagaccggccaucgaaggcccccucuuucugguacaagaucgacccuucccacacacagggcuaucgcacugugcagcuggucuggaaaacccuuccacccuucgaggcgaacgggaagauacuggauuacgaagugacauugaccagauggaaaucacaucuccagaauuauacuguuaacgcaacgaagcugacagugaauuuaaccaacgacagguaccuggccacucucaccguccggaaucuugugggaaaaagugaugcugccguacugacaauuccggcaugugacuuucaagguaacuuggcugagagcaagugcuaccuaaucaccguuacuccuguguaugccgauggccccggguccccagagucuaucaaggcguaccugaaacaggccccucccagcaagggaccaacaguccgcacgaaaaaggugggcaaaaaugaagcaguccucgagugggaccagcugcccguggauguucaaaacgguuucauucgaaauuauaccaucuuuuacagaacuauuauagggaacgaaacagcugugaauguagacucaagucacaccgaguauacacuuuccagccugacuucugauaccuuguacauggucaggauggccgcuuauacggacgaaggaggcaaggauggcccugaguucaccuuuacaacuccaaaguucgcccagggggagaucgaagcaauugugguuccggugugucucgccuuucuguuaaccacacugcuaggaguccucuucugcuuuaacaaacgggaccugaucaagaaacauaucuggcccaaugugccugacccaucaaagagucacauugcucaguggagcccccacacuccuccacgucauaacuucaacuccaaagaucagauguacucugacgguaauuuuaccgauguaucggugguugagauagaagcgaacgacaagaagcccuucccggaggaucuuaaaagccucgaccuguuuaagaaagagaagaucaauacggaaggccacuccucagggauuggaggcaguucuugcaugagcuccucacgcccuagcaucucuuccagugaugagaacgaaagcucucaaaauacauccucaaccguccaguacaguacuguggugcauagcgguuauagacaccaggucccaucgguucagguguucuccaggucugagagcacacaaccccuccuggacucagaggagcggccugaggaucuucagcugguggaccauguagaugggggcgacggaauuuugccccgacagcaguacuucaaacaaaacuguagucagcacgaauccucuccagauaucagccacuuugagcgcuccaagcaggucucaagcgugaaugaagaggacuucguuagacucaaacagcaaauaagugaccauaucucucaguccugcggcagcgggcagaugaagauguuucaagaagugucggcagccgaugcuuucggaccugguaccgagggccaggucgagagguuugaaacuguggggauggaggccgcaaccgacgaaggaaugcccaagucauaucugccacagacaguucggcagggcgguuacaugccgcaauga

SEQ ID NO: 57701 - RNA, 402 nt, Artificial Sequence
  derived and/or modified sequence opt3 from IL7__Homo_sapiens__NP_001186815
auguuccacgugagcuuuagauacaucuucggccugcccccucucauucuuguccuguugccaguugccuccucugacugcgauauagaggggaaggacggaaaacaguaugaaucaguguuaaugguaaguaucgaucaacugcuagacagcaugaaggagauugguuccaacugucucaauaacgaauuuaauuucuuuaaaaggcauaucugcgaugcuaacaaggugaaaggccggaagccggcagcccugggggaggcgcagcccaccaagucucuugaagagaauaaaucgcugaaggagcagaaaaaguugaacgaccucuguuuccugaaacgccugcuccaggaaauuaagacaugcuggaauaagaucuuaaugggaacuaaagagcacuga

SEQ ID NO: 57702 - RNA, 1380 nt, Artificial Sequence
  derived and/or modified sequence opt3 from IL7R__Homo_sapiens__NP_002176
augaccauccugggcacaacuuucgggaugguguuuagccuccuucaggucguuuccggagagucugguuacgcccaaaacggcgaccuggaagaugcugaguuggacgauuauucauucaguugcuacagccaguuagaagugaaugggucccagcacucucugacgugugcauuugaggaccccgauguaaacauuaccaaucuagaguucgaaauaugcggagcccucguggaggucaagugucugaacuuuagaaaacuucaggaaaucuauuucauugagacaaagaaauuucuguugaucggcaagucgaauauuugcgugaaaguuggugaaaagucacucacuuguaagaaaaucgaccugaccacaauagugaagccugaggcgccauucgaucugagcgucguguacagggagggggcuaacgacuuuguaguuaccuucaauacaagucaucuccagaaaaaguaugugaaagucuuaaugcacgauguggccuaccggcaagaaaaggacgagaacaaguggacucaugugaaucuguccucuaccaaacuuacguugcugcagcgcaagcuacagccggcagccauguaugaaaucaaaguccgaagcauucccgaucacuacuuuaagggauucugguccgaguggucaccuaguuacuauuuucguacuccagaaaucaacaauagcucuggcgagauggaccccauucuccugaccaucuccauacuuucauucuucagcguugcucuguuggugauucucgcaugcguacuguggaaaaagagaaucaaaccuauuguguggccaaguuuacccgaucauaagaagacacuggagcaccucuguaaaaagccuaggaaaaaccuuaaugucucuuuuaacccagaauccuuccuggacugccaaauccaccggguggacgauauccaggcccgcgacgagguugaaggcuuuuugcaggauacuuucccgcagcaacuagaggaaagcgagaagcagagacucgggggagacgugcagucgcccaauuguccuucugaggaugucgugauuaccccagaauccuuugguagggacucaagucugacaugccuggcuggcaacguaagcgccugugaugcgcccauacuuuccucuagccggucacuggacugccgcgagagugggaaaaacggaccucauguuuaccaagauuugcuccuguccuuaggcaccacgaauagcacucugccacccccguucucucuacagucagguauccucacacugaacccuguggcacaggggcagcccauucuuaccaguuugggaagcaaucaagaagaggccuaugucacuauguccucuuuuuaccagaaccaguga

SEQ ID NO: 57703 - RNA, 435 nt, Artificial Sequence
  derived and/or modified sequence opt3 from IL9__Homo_sapiens__NP_000581
augcugcucgccauggugcuuaccagcgcucuguuguuaugcuccgucgcaggccaggggugucccacacuggccggaauccuagacauuaacuuccucauaaauaagaugcaagaagauccugcgucuaaaugccacuguucagcuaacguuacgaguugccugugucuugguaucccaagcgacaauugcacuagaccguguuuuuccgaaaggcugucucagaugaccaacacaacuaugcagacccgguaccccuugauuuucucgcgcgugaagaaaucaguagaggugcucaagaauaacaaaugcccuuauuuuagcugugaacagccaugcaaucaaacaaccgccggcaacgcacugacuuuccugaagagucucuuagagaucuuucagaaggagaaaaugcgagggaugcguggaaagauuuga

SEQ ID NO: 57704 - RNA, 1566 nt, Artificial Sequence
  derived and/or modified sequence opt3 from IL9R__Homo_sapiens__NP_002177
augggccuggggagaugcaucugggagggauggacccucgaaagcgaggcccuuaggcgggacauggguacauggcuguuggcuuguauuugcauauguacuugcguguguuuaggcgucuccguuacgggggaaggacagggcccccgcucucgaaccuucacaugccugacuaacaauauccuacguauugauugucacuggucagcaccugagcucggucaagggaguagcccauggcugcuuuuuaccuccaaccaggccccgggaggcacacauaagugcauccugagaggcucugaauguaccgugguauugcccccugaggcggugcucgucccaucggacaauuucacuauuacauuucaccauugcaugucagggagggaacaggugagccugguugaucccgaguaccugccucggcgccacgugaaacucgacccacccagugauuuacaguccaacaucucuagcggacauuguauacugaccugguccaucucacccgcucuugagccaaugacgacuuugcugaguuaugaacuagccuucaagaaacaagaggaggcaugggaacaggcccagcacagagaccacauugucggugugaccuggcucauccuggaggcuuuugaacuugauccgggcuucauucaugaggcaaggcugcggguacagauggccacauuggaagacgauguuguggaggaggaacgcuacacugggcaauggagcgaguggucucagcccgucugcuuucaggcuccucagcgacaaggaccacucaucccuccuuggggcuggccagguaauacccugguggccguguccauauucuuacugcucacagggcccaccuaucuucuguuuaaguugucaccgagagucaaaaggauuuucuaccagaacguuccuagccccgcgauguuuuuccagccacuauauagugugcacaauggaaacuuucaaacguggaugggcgcacauggcgccgggguacugcucucucaggacugcgcuggaacuccucagggugcccuggaacccugugugcaggaggcaacagcccuucugaccugcggcccagcccggcccuggaaguccgucgcguuggaagaggagcaagaagggccuggaacucgucucccaggcaaucugagcucggaggauguguuaccggccgguuguacagaauggcgcguucagacccuggcauaccuaccccaggaggacugggcuccuacgucucucaccagaccagcucccccugauuccgaagggucaaggaguagcuccucuagcucaaguuccaacaauaacaauuauugcgcucugggcuguuacggaggcuggcaccuuagcgccuugccagggaacacacagucuucaggacccaucccggcacuggccugcggucucaguugugaccaccaaggccuggagacucagcaggggguggcuuggguccuugcgggacauugccagcggccuggccugcacgaggacuugcaagguaugcuccugccaagcguguuauccaaggcacgaucuuggaccuucuga

SEQ ID NO: 57705 - RNA, 1641 nt, Artificial Sequence
  derived and/or modified sequence opt3 from ILDR1__Homo_sapiens__NP_001186728
auggccuggcccaagcugccugcuccauggcuccuucugugcaccugguugccggcaggcuguuuaagccugcuagugacaguccagcacacugagagauacguuacucucuucgccuccaucauucugaaaugcgacuauaccacaucugcgcaacuucaggaugugguagugacuuggagguuuaagucauucuguaaagaccccauauuugauuacuauagugcuagcuaccaggccgcacuguccuuggggcaggacccuucuaacgauugcaaugacaaccaacgggaaguccgcaucguggcccagcgacguggacagaaugagccaguucucgguguggauuauagacagaggaagauuaccauccaaaaccgggcugaccuggucauuaaugaagugauguggugggaucauggcguauacuauuguacaaucgaggcacccggggacaccucgggagauccugacaaagaaguuaagcugauagugcuccacugguuaacugucaucuucauuauccugggcgcccuuuugcugcuacuccugauuggugugugcuggugucagugcuguccacaguacugcuguugcuacauccgcugccccuguugcccugcucauuguugcuguccagaggaggcccuugcgagacacagguauaugaagcaggcacaagcccuggggccgcagaugaugggaaaacccuuguacuggggcgcugaucggucaagccaggugaguuccuauccuaugcauccacuccugcaacgcgacuuaucucugcccagcucccucccucagaugccaaugacacagaccacgaaccagcccccgauagccaauggcguccuugaauaccuggagaaggaauugcgaaaccuaaaucuggcacaaccucugcccccagaccucaaagggagauuuggacacccuugcucaaugcuuaguagccuggguucugagguuguggagaggcggauuauccacuugcccccacucauucgugaucuguccucaagccgcagaacgagugacucuuuacaucagcaguggcugacccccaucccuuccaggccaugggaucuacgggaaggccgaagccaccaucacuauccggacuuccaccaggagcuccaagaucgcgggcccaagucgugggcucuggaaagaagggagcuugacccuucuugguccggacggcaucgcucaaguagauugaacggcagcccaauccacugguccgauagggacucucugagcgauguacccucaaguuccgaagcccguuggcggccuagccauccacccuuucgaucuagaugucaggagaggccgcgccggccuucaccaagagagaguacacagaggcacggucgccgacggcgucauagaagcuacucucccccucuccccuccgggcugucgagcugguccucagaagaggacaaagaaaggcagccacaaaguuggcgcgcgcaccggagaggaucucacagcccucauuggcccgaggaaaagccaccguccuauaggucacuugauauuacuccuggcaagaauagccgcaaaaagggcucuguggagcgacgguccgagaaagacaguagccacucugggagauccgucgugauauga

SEQ ID NO: 57706 - RNA, 1920 nt, Artificial Sequence
  derived and/or modified sequence opt3 from ILDR2__Homo_sapiens__NP_955383
auggacagagugcugcucagguggaucagccuuuucuggcugaccgccauggucgagggcuugcagguuacagugcccgauaagaaaaagguagcuauguuauuucaaccuacugugcugcggugccacuucuccacgucuucacaucagccagcagucgugcaguggaaauuuaagaguuacugucaggaccgcaugggggaaagccuaggaauguccucuacccgagcccaaucgcucucaaaacguaaccuggagugggauccguaucuugacugccuggauagcagaaggacaguucggguggucgcgaguaagcaggguuccacugugaccuugggcgacuucuaccgcgggagagaaauuacaauaguacacgaugcugaccuccagaucggaaagcugauguggggcgauucuggucuguauuacuguauuaucaccacucccgacgaucucgaggggaaaaaugaagacagcguugaguuacuggugcuuggaaggacaggcuugcuggccgaucuacucccuuccuuugcagucgagauuaugccagaauggguguucgugggccugguccuucuggggguguuuuuguucuuuguucucguaggaaucugcuggugucagugcuguccccauucaugcuguugcuaugugcgguguccuugcugcccagacaguuguugcuguccccaagcccuguacgaggcugguaaggcagccaaagcuggcuauccuccaagcgucucuggggugccgggacccuacuccauaccuucaguuccauuaggcggugcccccagcagugggaugcugauggacaagccucacccacccccgcucgcgccuucugauuccaccggaggcagccauucggugcgcaaaggcuaccgaauccaggcagacaaggaaagagauucuaugaagguccuuuauuacguggagaaagagcuggcccaguucgaccccgcuaggcggaugcgugggcgcuauaacaauacgauuuccgaauugucaagucuacacgaggaagauagcaacuuuagacaguccuuccaccaaaugaggucuaagcaguuuccaguaagcggagaccuggagucaaauccugauuacuggagugguguuaugggcggguccagcggagccucucggggccccucagcaauggaauauaacaaagaggaccgagagaguuuccgccauagccagccaagauccaagucugaaaugcucucgaggaaaaauuucgcuacuggugugcccgccgucagcauggaugagcuggcggccuuugcagacuccuacgggcaacggccucgcagagcugauggcaacucacacgaagccaggggaggcagucguuucgagcggucugaaagccgagcucauuccggguuuuaucaggacgacucacuugaggaguacuacggacagagaagcaggucucgcgaaccacugaccgaugccgaccgggguugggcauucuccccggccagaaggcgccccgcugaggaugcgcacuugccucgacucgugagucggacaccaggcacugcacccaaguaugaccacagcuaccuggggucugcccgugaaagacaggcuaggccugagggagccucccgcggcgguucauuagaaaccccaaguaaacggagcgcacaacuggggcccagaucggccuccuauuacgcuuggucuccgccuggcacauauaaggccggaagcucacaggaugaccaggaggaugcaagugacgaugcgcuaccacccuacuccgagcucgaacugaccaggggcccuucuuaucgagggcgcgaccuucccuaccauagcaauuccgagaagaaacggaagaaagaaccagcuaagaaaacgaacgauuuuccuacuagaaugucauuggucguguga

SEQ ID NO: 57707 - RNA, 1059 nt, Artificial Sequence
  derived and/or modified sequence opt3 from ILF2__Homo_sapiens__NP_001254738
auggccuuccccagagugaagccugcuccagacgagaccagcuuuuccgaagcacugcucaaaaggaaccaggaucuugcccccaauucugcggagcaggcuucaauccugaguuuggucacaaagauuaacaauguuauagacaacuuaaucguggcccccggcacuuucgaaguacaaauugaggaagugcggcaggucgggagcuacaaaaagggaacgaugaccacaggucacaauguggcagaucugguugugauccuaaaaauucucccuacucuggaggccgucgcugcacuuggcaacaaggugguagagucccugcgcgcccaggacccaucugaaguuuugaccaugcucacaaaugagaccggguuugaaaucucgucaagcgaugcuacugugaagauacugaucacaaccgucccgccuaaccugcgaaaacucgacccagaguuacaucuggauauuaaggugcuucaaagugccuuggcggcaauccgucacgccagaugguucgaggaaaaugcuucccagucuacggugaaaguccugauuaggcuacucaaggaccugcggauccgcuuucccggauucgagccucuuacuccauggauacuggauuugcucggccauuaugccguuaugaacaauccgaccagacagccccuggcauuaaacguggcuuacaggcggugccugcagauucucgccgcgggucuuuuucugccugggagcguaggaaucacagacccaugugaauccggcaauuuccgcgugcacacugucaugaccuuggagcaacaggauauggugugcuauacagcccagacccuaguucgaauccugucacauggcggguuuagaaaaauucucggacaggaaggugacgcaaguuaccuggcuagcgagaucucuacgugggauggcgugauugucacucccuccgagaaggccuaugaaaagccuccagagaaaaaggaaggggaggaagaggaggaaaacacagaggaacccccgcaaggagaggaagaggagucaauggaaacccaggaguga

SEQ ID NO: 57708 - RNA, 2121 nt, Artificial Sequence
  derived and/or modified sequence opt3 from ILF3__Homo_sapiens__NP_001131145
augagacccaugaggaucuucgugaacgacgaucggcacgucauggccaagcauagcuccguuuacccuacccaggaggaacuggaggcugugcaaaauaugguaucucacacagaacgcgcacucaaagccgugucagacuggauugaugagcaggaaaagggcaguagcgagcaggcggaguccgacaacauggaugucccaccggaagacgauucuaaagagggggcuggagaacagaagacugagcauaugacgcgaacccuucguggugugaugagaguuggccugguggccaaaggguuguuacugaagggagaccuagaucucgagcugguccuucugugcaaggaaaaacccacaacugcauugcucgacaagguggccgauaaucuggcuauacaacuggcagccguaaccgaggacaaauaugaaauccuccagucgguugaugacgcugccauugugaucaagaacacaaaagagccuccauuaucacugaccauucaccuuacuagccccgucgugagggaagagauggagaagguguuggcgggcgaaacacugagugucaaugacccuccagauguucuagaccggcagaagugucucgcagcccuggcuucccuucgccaugccaaaugguuucaggcaagagcuaacggucugaagucuugcgugaucguaauaaggguguugcgggaucucuguacccgcguccccacgugggggccucugcgaggauggccauuagagcugcucugcgaaaaaucaaucggcacugccaauagaccgaugggcgcgggggaggcccuuaggcgggugcuggaauguuuggcauccggaauuguuaugcccgacgguucaggcaucuacgauccuugcgagaaggaggcuaccgacgccauugggcaccuagaucgucaacagcgcgaagacaucacacagagugcucagcacgcccugagacucgcagccuucggacaacugcauaaagugcuuggcauggauccacugcccagcaagaugccuaaaaagccaaagaacgagaaucccgucgacuauacugugcagauaccgccuucuaccacauacgcuauuacccccaugaaaaggccaauggaagaggauggugaagagaaguccccuagcaaaaagaaaaagaagauccagaaaaaggaggaaaaagcggagcccccacaagcaaugaacgccuugaugcggcucaaucagcugaagcccggguuacaguauaaacugguaagccagacgggaccuguucacgcuccaauuuuuacuaugaguguggaagucgacggcaacucuuucgaggccuccggcccgagcaagaagacagcaaaacuacauguggccgucaaggugcuccaagacauggggcugcccaccggagcugagggucgagauucgucuaaaggcgaagacuccgccgaggaaacugaggcaaagccugcgguuguggcuccagcccccguagucgaagcagugucaacaccuagugccgcuuuuccaagcgaugccaccgcagagaauguuaaacagcaggggcccauccuuacgaagcacggaaagaacccggugauggaguugaaugaaaaacgcagaggccugaaguacgagcucaucuccgaaaccggugggucucacgacaaaagguucgucauggagguggaaguagauggccagaaguuucaaggagcuggcagcaacaaaaagguggccaaagcguaugccgcucuggcagcccuugagaagcuguucccugacacaccauuggcucucgaugccaacaagaaaaagcgggcacccguuccuguccgcgggggacccaaauuugcggccaagccacauaauccugguuucggcaugggcggacccaugcacaacgaggugccaccgccucccaaucugagaggcaggggucgugggggcucaauucggggacgaggcagagggaggggauuugguggcgcuaaccaugggggauacaugaaugccggcgcagguuacgggaguuauggcuacggaggcaacuccgcuacugccggguauagcgacuucuuuaccgauuguuacggauaucacgacuucgggucuucauga

SEQ ID NO: 57709 - RNA, 1359 nt, Artificial Sequence
  derived and/or modified sequence opt3 from ILK__Homo_sapiens__NP_001014795
auggacgauaucuucacccagugcagagaaggcaacgccguggcugucaggcuguggcucgacaauacagaaaacgaucuuaaucaaggggacgaucacggauuuagcccccugcauugggcaugucgggagggucgcuccgccguuguggaaauguugauuaugcgaggcgcgcguauaaacguaaugaauagaggggacgauacuccuuuacaccuggcugccucucauggacacagggacaucgugcagaagcuacuccaguacaaagcagauauuaacgccgucaaugagcauggcaacgugccacugcacuaugcuugcuucuggggucaggaccaaguugcagaagaucuuguggccaauggggcucuggucucaaucuguaacaaguacggagagaugccgguggacaaagccaaggcgcccuugcgggagcuccugcgcgaaagagcagagaaaaugggccagaaucugaacaggauuccuuauaaggauacguuuuggaagggcaccacacggacucgcccacgaaaugggacccucaacaaacacaguggaaucgacuucaagcaguuaaauuuucugacaaaacuuaacgaaaaccauagcggugaguuguggaagggcagauggcaggggaaugacauaguaguuaaagugcugaaggucagggauugguccacccggaagucucgugacuucaacgaggaaugcccccgccuaagaaucuuuucgcacccuaaugugcucccagugcugggagccugucaaucacccccugcuccacauccgacucuuauuacacacuggaugcccuacggcagccuguauaacgucuugcacgaggguaccaauuucguuguggaucagagucaggccguaaaauuugcacucgacauggcuagggggauggccuuccugcauacguuagaaccucugaucccacggcacgcgcucaacucccgaucugugaugauugaugaggacaugacugcccgcaucagcauggcagaugucaaguuuuccuuccagugccccggaagaauguacgcuccugccuggguggcuccagaagcccuucaaaagaagcccgaggacaccaauaggcggucagcagauauguggaguuuugccguucuguugugggagcuagugacacgcgaagucccguucgcugaccugagcaacauggagauaggcaugaaaguggcgcucgaaggccugagaccuacuauucccccagggaucucuccucauguauguaaacuuaugaaaauuugcaugaaugaggaucccgcaaagaggccaaaguucgacaugaucguucccauccuggagaaaaugcaggacaaguga

SEQ ID NO: 57710 - RNA, 501 nt, Artificial Sequence
  derived and/or modified sequence opt3 from IMMP1L__Homo_sapiens__NP_001291203
augcugagaggcgugcucgggaagaccuucaggcuugucggauacacaauccaguaugguugcauugcccacugugcuuuugaguacguuggcggggugguaaugugcagcggacccuccauggaaccuacuauacaaaacucugacaucguguucgcagagaaucugucacggcauuuuuauggcauucagcgcggugauaucgucauugccaaaaguccaagcgacccgaaguccaacaucuguaaacgagugauaggguuggaaggagauaagaucuuaacgaccucucccucggacuucuuuaaaucacacagcuacguuccuaugggccauguguggcuggagggcgauaaucuacagaacaguacagacucccguugcuaugggccaauucccuacggacucaucagagguaggauuuucuuuaagaucuggccucugucugauuucggcuuucuucgggcgagcccaaaugggcaccgcuucuccgacgauuga

SEQ ID NO: 57711 - RNA, 528 nt, Artificial Sequence
  derived and/or modified sequence opt3 from IMMP2L__Homo_sapiens__XP_005250687
auggcccagagccaaggcugggugaagagauacaucaaggcuuucugcaagggguuuuucgucgcaguucccguggccguaaccuuucuggacaggguggcgugugucgcucggguggagggagccuccaugcagccuucucucaacccagguggcucacagaguagcgauguugugcuucugaaucacuggaaaguccgcaacuucgaagugcaucgaggggacauuguauccuugguuucuccgaagaaucccgagcagaaaauaaucaagcgugugauugcauuagaaggagauaucgucagaacaauuggccacaagaacagguaugugaaagugccucggggucauaucugggucgagggggaccaccauggacacucguuugauucaaauagcuucggcccaguuagucugggccuacuccacgcccaugcuacucacauacuguggcccccugaacgcuggcaaaaacuugaguccgugcugccacccgagagauugccuguacagagggaagaggaauga

SEQ ID NO: 57712 - RNA, 2274 nt, Artificial Sequence
  derived and/or modified sequence opt3 from IMMT__Homo_sapiens__NP_001093639
augcugagagccugccagcucagcggcgugaccgcugcagcccaauccugucuuugcgggaaguucguccugaggcccuugcggccuugucgccgauacucuacaucaggaaguagcgguuuaacuacgggcaaaaucgcgggggcuggacugcuauuuguuggcggugggauuggaggcaccauacucuaugccaagugggacucccacuuccgugagucuguggaaaagacaaucccauacucggauaagcuguuugagaugguacuuggcccggcagccuauaacgugccccugccuaaaaagucaauucagagcgggccauugaagaucaguuccgucucugaagugaugaaagagagcaagcagcccgcuucccagcuccaaaaacagaagggagacacuccugcaucagccaccgcuccaacagaagccgcgcagauuaucagugcagccggugauacccugagcguucccgcuccugccgugcagccagaggagucucugaaaacugaccauccggaaauaggcgaggggaagcccaccccugcacucuccgaagcaucaagcaguucuaucagagagaggccacccgaggaagucgccgcgcgguuagcccaacaggagaagcaggaacaggugaaaauugagucccuggcaaagagccuugaagaugcuuugcgccaaacagccucgguaacgcugcaggcuaucgccgcacagaaugccgcuguucaagcggugaacgcacacucuaauauucuaaaagccgcuauggacaacuccgagaucgccggagagaagaaaucagcacaguggagaacugucgaaggcgcccucaaggagaggcggaaagcuguggaugaagccgcagacgcgcugcuuaaggcuaaggaggaacuggagaaaaugaagagugugauagagaaugccaaaaagaaagaagucgcuggugccaagccucauauuaccgcugccgaggggaaguugcacaacaugaucguugaucucgacaauguggugaaaaagguacaggcagcucagagcgaagccaaagucgugucccaauaccaugagcugguugugcaggcgcgcgaugacuucaagcgagaauuagauucuauuacaccagagguccugcccggauggaaaggcaugagcgugucagaccucgccgacaaacuuaguacugaugaccugaacuccuugaucgcucacgcacacagaaggaucgaucagcuaaaucgggagcuggccgaacagaaggcuaccgagaaacaacauauuacacucgcccuggaaaagcagaaacuugaggagaagcgugcauuugacagcgcgguagccaaagcucuggaacaccaucgcucugagauacaggccgaacaggauagaaagaucgaggaaguuagggacgcaauggagaacgagaugcggacccaauugcgacgccaggcugccgcacacacggaucaccucagagacgugcugaggguccaggaacaggaguuaaagucagaguucgaacaaaaucugagugaaaaacuaagcgagcaggagcuccaguuucggcgccugucccaagaacagguggauaacuucacucuugacauuaauacagccuaugcuagauugaggggcaucgagcaggcgguccagucucaugccguggcagaagaggaagcucguaaggcccaccaacuguggcucucgguugaggcccugaaauacagcaugaagaccuccucagcugagacuccgacaauaccucuugggagugcaguggaagccauuaaagcgaacugcucugauaaugaguuuacccaggcucugacggccgcaauucccccagagagcuugacccggggaguauauuccgaagagacacuccgagccagauucuacgcuguccagaagcuggcaaggcgcguggccaugaucgacgaaacucggaacucauuauaccaguauuuucugagcuaccuacaaucucuccugcuuuucccuccccagcaguugaaaccacccccugagcuguguccagaagacaucaacaccuuuaagcuccuguccuaugcgaguuacugcaucgagcauggugauuuagaacuggcugccaaguucguuaaucagcuuaaaggcgagagcagaaggguggcacaagacugguugaaggaggcccgcaugacacucgaaacuaaacagauugucgagauacugaccgcuuaugccucugcaguggggaucggaacaacccagguacaaccggaauga

SEQ ID NO: 57713 - RNA, 555 nt, Artificial Sequence
  derived and/or modified sequence opt3 from IMP3__Homo_sapiens__NP_060755
auggugagaaagcugaaauuccacgagcagaagcuccuuaaacaagucgacuuucugaacugggaaguuaccgaucauaauuugcacgaguuaagggugcugcggcgcuaccgacuacagcguagagaagacuauacaagguacaaccagcucagccgggccguacgcgagcuggcuagaaggcuucgggaucugcccgaacgcgaccaguuccgagugagagcauccgccgcguugcucgauaagcuguaugcucugggccucgucccuacuagggggucuuuagagcugugcgacuuugugacggccucaaguuucugucggcgucgccuuccaaccguuuugcugaaacuaagaauggcacaacaucuccaggccgcuguggcauuugucgagcagggacacgugaggguagguccggauguugugacagaccccgccuuccuggucacucggagcauggaagauuuugugaccuggguggacuccucuaagaucaagcgacauguccuugaguacaaugaggaacgcgaugacuucgaucuggaggcuuga

SEQ ID NO: 57714 - RNA, 1011 nt, Artificial Sequence
  derived and/or modified sequence opt3 from IMPA1__Homo_sapiens__NP_001138350
augggccagagacccgggccugugcugccagccgucgcuguucucggacaaguggcaaagaggaaaguagccuggcuucugcgguggaaggcggugacccgcacagagacugcugguaacagcuccggcgucuacggguucggaaaaaugaagaucuuugugaaauauuuccagaagauggccgacccguggcaggaaugcauggauuacgcaguuacguuggcccgacaggcuggcgagguggucugugaagcaauuaagaaugagaugaacgugauguuaaaaucuucacccguagaccugguuaccgccacagaucaaaagguggagaaaaugcuaauaaguagcaucaaggaaaaauauccuucccacucuuuuauuggugaggaaucggucgcugccggggagaagucaauccucacugacaauccaaccuggauuaucgaucccauagacggaacaaccaacuucgugcaucguuuuccuuucguggcggucagcaucggcuuugcaguuaauaagaaaauugaguucggcgugguauacaguugcguggaagggaagauguauacugccagaaaaggaaagggugcuuuuuguaacggccagaaacugcaggucucccagcaagaggauaucacaaagucucuucuggugaccgaauuggggagcuccaggacgccagagacuguucggauggugcucucaaauauggaaaaacuguucugcauucccguccacggaauccgcagugugggcaccgccgcaguaaacaugugucugguugcuacagguggggccgacgcguacuaugagaugggaauacauugcugggauguggccggcgcaggcauuaucgucacugaagcugggggagugcucauggacgucaccgguggcccuuuugauuuaaugagcagaagggugauugccgcuaauaaccggauccuggccgagcgcaucgcaaaggagauucagguuauaccacuucagcgagacgaugaagacuga

SEQ ID NO: 57715 - RNA, 867 nt, Artificial Sequence
  derived and/or modified sequence opt3 from IMPA2__Homo_sapiens__NP_055029
augaagcccagcggcgaggaccaggccgcucuggcagccgggccuugggaagagugcuuccaagcggcugugcagcucgcccuuagagcaggacagaucauuaggaaagcccugaccgaagagaagcgggucuccacaaaaacuucugcugcagauuugguuacggaaaccgaccacuuaguggaggaucugauaaucucagagcuacgcgaacgauuuccaagucaucguuucauugccgaggaagcugccgcgagcggugcaaaguguguacucacacacuccccgacuuggaucauugaccccaucgaugggaccugcaacuuugugcauagauucccuacagucgccgugucuauaggguuugcuguuaggcaggagcuggaguucggagugaucuaccacuguaccgaggaacggcuuuauacuggccgcagagguaggggcgccuuuugcaauggacaacggcugcgcgucucgggcgaaacagacuugucaaaagcacucgugcugaccgagauuggcccaaagcgagaucccgcuacgcugaaacucuucuuaagcaacauggaaagacugcuucaugccaaggcgcacgggguaaggguuaucggaaguuccacuuuggcccugugucaccuagcaucuggugcugccgacgcuuacuaucaguuuggccuccauugcugggaucuggccgcagccaccgugauuauccgggaggcugggggaauagucauugacacaagcggcgguccucuugaucugauggcgugucgugugguggcagccuccacucgcgagauggcuauguugaucgcccaggcacuccagaccauuaauuacgggagagacgaugaaaaguga

SEQ ID NO: 57716 - RNA, 963 nt, Artificial Sequence
  derived and/or modified sequence opt3 from IMPACT__Homo_sapiens__NP_060909
auggccgagggcgacgcugggagcgaucagagacaaaacgaagagaucgaagcaauggccgcgauuuacggagaggaauggugcgugauagacgauugugcuaagaucuucugcauuaggaucuccgacgauauugacgaucccaaauggacccugugucuccaggucaugcuuccuaaugaguauccagguacagccccgcccaucuaccagcugaacgcaccuugguugaagggccaggagcgggccgacuuaucuaauucacuggaagagauauauauccaaaacauuggggaaaguauccuauaccucuggguugagaaaauucgcgaugugcugauccagaaaagccagaugacugagccaggacccgacguaaagaagaagacggaagaggaagauguggagugcgaagacgaucuuauacuggcuugucagccugaguccucugucaaagcauuggacuuugacauuucggagacccgaacagaaguggagguugaagaacucccacccaucgaucacggcauuccuaucacugaccguagaucaaccuuccaagcccaucuggcuccaguggucugcccgaaacaggugaaaaugguacugagcaagcucuaugaaaauaaaaagaucgccagugcgacacacaacauuuacgcauauaggauauacugugaggauaagcagaccuuuuuacaggacugcgaggaugacggugaaacugccgcugggggacggcugcuucauuugauggagauccugaauguuaaaaacgugauggucguggugucccgcugguacggcggcauucuacucgggcccgauagauucaagcacaucaauaacugugccaggaauauacuggucgagaaaaacuauacaaauucuccugaggaaagcuccaaggcacuuggaaagaacaagaaaguucggaaggacaagaaacgcaaugagcauuga

SEQ ID NO: 57717 - RNA, 1080 nt, Artificial Sequence
  derived and/or modified sequence opt3 from IMPAD1__Homo_sapiens__NP_060283
auggcccccaugggcaucagacugagcccucucgggguggcugucuucugccuucugggauuggguguuuuauaccaccuguauuccggcuuucuagcagggagguucucucucuuuggacugggcggugagccagggggaggcgccgcgggcccggcugccgcagccgacgggggaaccguggaucuucgggaaaugcuggcuguaucaguguuggcagccguccgcgguggcgacgaggugcgacguguuagagaaaguaacgugcuccaugaaaagagcaaagggaagacaagggagggagcugaggauaaaaugacuuccggcgacguccugucuaaucggaagauguucuaccugcucaaaacggccuuucccucggugcagauuaacaccgaggaacacguagaugcggcagaccaagagguuauauuaugggaucauaagaucccugaagacauucugaaggaggugacaacuccaaaagagguccccgccgaaucagugaccguguggaucgauccucuugacgcuacacaggaguauaccgaagauuugcgcaaguacgucacuacaaugguuuguguggccguaaaugguaaaccaaugcugggggugauucacaagcccuucagcgaguauaccgcaugggcuauggucgacggaggcaguaacgugaaagccagauccucuuacaaugaaaagacgccuaggaucguugugagccggucccauucaggcauggucaaacagguggcgcuacagacuuuugggaaccaaaccacaauaaucccagccggaggugcaggcuauaagguacucgcucugcuugauguuccggacaagagucaggagaaagccgaccuguacauucacgugacuuacaucaagaaaugggauauuugcgcugggaaugccaucuugaaggcacucggaggccacaugaccacacugagcggugaggaaauaucuuauaccggguccgacggcauugagggaggcuuacuggccucaauccgcaugaaccaucaggcucucguccgaaaacuucccgaucuggaaaagacggggcacaaguga

SEQ ID NO: 57718 - RNA, 1800 nt, Artificial Sequence
  derived and/or modified sequence opt3 from IMPDH1__Homo_sapiens__NP_000874
auggagggcccccugaccccuccaccgcuccaagggggaggugccgcugcagugcccgaaccuggcgccagacagcacccagggcaugagacagcggcucagagguacagcgcccggcuucugcaggcaggauaugaacccgaguccccucgcuuggacuuagccacucacccaacgacaccccgaucugaacugucaagugucguucuacucgcuggcguggguguacagauggaucgucugagaagggcaagcauggccgacuaccuuaucuccgggggaaccggcuaugugccugaggauggccugacugcucaacaguuguucgccucugcggacgggcucaccuacaacgauuuucugauucugccaggauucauagacuuuaucgcagaugaggucgaccucacaucggccuuaacccggaagauuacucugaaaacaccgcuuaucucaagccccauggauaccgugacggaagcugacauggccauugcaauggcuuugauggguggcaucggguucauacaucacaauugcacuccugaguuucaggccaacgaaguucgcaaggugaaaaaguucgagcagggauuuaucaccgauccagucgugcugagucccucccauacaguaggcgacguucuagaggcgaaaaugagacacgguuucucugggauuccuaucacugaaaccggaacaaugggcagcaagcucgugggcauugucaccuccagggauaucgacuuucuggccgagaaggaccacacgacucuucugucagaagugaugacaccacggauagaguugguggucgcacccgcugggguuacccucaaagaagccaaugagauucugcaacgcaguaagaaaggaaaguuaccgaucgugaacgauugugacgagcugguagcuauuaucgcccgaacugaucucaaaaagaauagagacuauccucuugcaagcaaggauucucagaaacagcuguugugcggugccgcugugggcacaagggaagacgauaaguaccggcuagaccugcucacccaggcgggggucgaugugaucguucuggacuccucacaaggaaacagcguguaucagauugcaaugguccauuacauaaaacagaaguacccccaccuucaagugaucggcgguaauguaguuacggccgcucaggccaaaaaccugauugaugcagggguggacggcuugcgugucggaaugggcugugggaguaucugcauaacccaggaggugauggccuguggacgcccacaggguacagcugucuauaagguggccgaauacgcaagaagguucggcguuccuauuaucgcggacgggggaauccaaacugugggccauguagucaaagcucucgcccugggugcaucuaccgugaugaugggguccuuacuggccgcuacaacugaggcccccggcgaauacuuuuucagcgauggaguucggcuaaagaaguaucgaggcauggggucgcucgacgcaauggagaaaucuuccucaagucagaagcgcuauuuuagcgagggagauaaagugaagauugcucagggugucuccggcucuauccaggacaaagggagcauucaaaaguucgugccauaccugauagccggaauccagcacggcugccaggauauuggugcgagaucacuuaguguauugagguccaugauguauagcggggaacugaaguucgagaaacggaccaugucugcccagaucgaaggcggagugcacggccuccauucauacgagaagcgccuguacuga

SEQ ID NO: 57719 - RNA, 1545 nt, Artificial Sequence
  derived and/or modified sequence opt3 from IMPDH2__Homo_sapiens__NP_000875
auggccgacuaccugaucagcggcgggaccuccuaugugcccgaugacggacucacagcucagcaacuuuucaacugcggugauggccugacuuacaaugacuuuuugauuuuaccuggguauauagauuucacggcagaccaggucgaucugaccucugcccuaacaaagaaaaucacucucaagaccccacugguuucaaguccgauggacacagugaccgaagcgggaauggcuauugccauggcacuuacuggcgguaucggguuuauucaccauaacuguacacccgaguuccaggccaaugagguaagaaaagugaagaaauacgaacagggauuuaucaccgauccugucgugcugagcccaaaggacaggguucgggauguguucgaggcuaaggcacgccacggcuuuugcggcauacccaucacggacacugggcgaaugggaucccguuuggucgguauuaucucuucgagagauauugacuuccucaaagaagaggagcaugacuguuuucuggaagagaucaugaccaagagggaagaucuggugguagccccugcuggcauaacacucaaagaggccaacgagauuuuacaacggucaaagaaagggaagcugccaaucguuaaugaagacgaugagcuuguggcgauuaucgcacgcacugacuugaagaaaaacagagauuauccccuggccagcaaggacgcuaaaaagcagcuacucugcggagccgcaaucggcacccacgaagaugacaaauacaggcuggaucuucuggcucaggccggugucgacgugguggucuuggauaguucccagggaaauucuauuuuccaaauaaacaugaucaaguauauuaaagacaaguacccuaaucuccagguuaucgggggcaacgugguaacagcggcccaggcaaagaaucugauagacgcuggcguggaugccuuacgggucgggaugggaagcgguuccauuuguaucacccaggaggugcuggcuugcggccgcccacaagccacggcaguuuacaaagugucagaauaugcccgaagauuuggggucccggugaucgcugacggaggcauucagaacguaggucauaucgcgaaggcacucgcccuuggggcuaguacuguuaugaugggcagccuguuggccgcaacaaccgaggcccccggagaguacuucuuuucugauggcauuaggcucaaaaaguaucgggggaugggaucccuggacgcuauggauaaacaccucucaagccagaaucguuacuucagugaagccgacaagauaaagguggcacaaggugucucuggcgcggugcaggauaaaggguccauccacaaguucgucccuuaucugauugcuggaauccagcauagcugucaggacaucggcgccaaaucgcuuacucaagugcgcgcaaugauguacucuggugagcugaaguuugagaaaagaacauccucagcccagguugaagggggcgugcacaguuugcauagcuaugaaaagaggcuauucuga

SEQ ID NO: 57720 - RNA, 2160 nt, Artificial Sequence
  derived and/or modified sequence opt3 from IMPG1__Homo_sapiens__NP_001269297
auguaccuggagaccagaagggccaucuucguguuuuggauuuuccuccagguccaaggcacaaagguuugccaggaagcugugugggaggcauaucggauauuucuugaccgcauccccgauacuggggaauaccaggacuggguaagcauuugucagcaagagacguucugccuguuugauaucgguaaaaacuucuccaauucucaggaacacuuggacuuacugcagcagcgaauuaagcaacguucauuuccugauagaaaagacgagaucagugccgagaagacccuaggagaaccaggcgagacaauagugaucagcacugaugucgcgaacgugucccucgggccguucccccugaccccugacgauacacuucugaaugaaauuuuggacaacacccucaaugauacuaaaaugccaacaaccgagagggagacggaauuugcuguucuggaggaacagcggguggagcugucugucucgcucgugaaccagaaguucaaggccgaauuagcagacucacagagccccuauuaccaagagcuggccggaaaaagucagcuucagaugcaaaagaucuuuaaaaaguugccuggcuucaaaaagauucauguacuggguuuucgcccaaagaaagagaaggauggguccucuagcacugaaaugcagcuaaccgcuaucuucaaaagacacuccgcagaggccaagucacccgcuagugaccuccugagcuucgacucuaauaaaauagaauccgaggaaguuuaucauggaacaauggaggaggauaagcagccugaaauuuaccuuacugccaccgaccugaaaagguugaucucaaaggcgcucgaggaggaacagagccuggaugugggcacaauucaauuuaccgacgaaaucgcaggcaguuuaccagccuucgggccggauacgcagucugagcugcccacuuccuuugcugucaucacagaggacgccacccucagcccugaacuuccacccguggagccucagcuggaaacuguggauggagcagagcacgguuugccagacacaucguggucucccccggcuauggccuccaccucacuaagugaggcgccucccuucuuuauggccagcuccauuuucucucugacggaucagggcaccacagacacuauggcaaccgaucaaacaaugcucgucccagggcugacuauaccuaccagcgacuauucagcuaucagucagcuugcccugggaauuucccaucccccagcuagcucugacgauucacggaguagcgccggcggugaagacaugguucgccacuuggaugagauggaccucuccgauacacccgcaccuucugaagugccagagcugucggaauacguaagcgugccggaccacuuuuuagaggauaccacucccgucuccgcccugcaguacaucacgacaucaaguaugaccauagcuccuaaggggcgagagcuagugguuuucuuuucucucagaguggcgaacauggcauucagcaaugaccuguuuaacaaauccucacuugaauauagggccuuggagcagcaauucacucagcugcucgucccauaccugcggagcaaucuuaccggauuuaagcagcuggaaauuuugaacuuccguaauggcucugugaucguaaacuccaaaaugaaguucgcuaaaaguguucccuauaaucucacaaaggccgugcauggcguccuggaggauuuucgcagcgcagccgcucagcaauuacaccuggaaaucgacucuuacucccuaaacauugagccugccgaucaggcagacccauguaaguuccucgcgugcggggaguuugcucagugugugaaaaacgaaagaaccgaggaagccgaguguaggugcaagcccggauaugauucacaagguagucuggacggccuugaaccgggguugugcggaccuggcacuaaagagugugagguccugcaggguaagggggcaccaugccggcuccccgaccauagcgaaaaucaggccuacaaaacaucggugaagaaguuccagaaccaacagaauaacaaaguuaucuccaagcgaaauucugagcuguuaacgguggaauaugaggaguuuaaccaccaggauugggaaggcaauuga

SEQ ID NO: 57721 - RNA, 3726 nt, Artificial Sequence
  derived and/or modified sequence opt3 from IMPG2__Homo_sapiens__NP_057331
augaucauguucccccuguuuggcaagauuagccucgggauacuuaucuucgugcugauugagggagacuuuccuuccuugaccgcccagacauacuuaucuaucgaagagauucaagaaccaaaaucagcugucaguuuccugcuaccggaggaaagcacugaucucucccuggcaacgaagaaaaagcagccccuugacagaagggagaccgagcggcaguggcugauccgccgacguagaucuauauuguuuccuaacgguguuaaaaucugcccagaugaaucgguggccgaggcgguagcuaaucacgugaaguauuucaaggucagggugugucaggaagccguuugggaggcauuucggacauucugggaccgccuccccggcagagaggaauaccauuauuggaugaaccugugcgaggauggggugacuucaauuuuugaaaugggaaccaauuucagcgagagugucgaacacaggucccugaucaugaaaaagcucacauacgccaaagagaccgugucuagcuccgaguuaucaaguccuguaccaguuggcgacacuagcacacugggugauaccacgcuuucugugccccauccugaagucgacgcuuaugagggggcauccgaaagcagcuuggagcggccagaagagaguauuucuaacgagaucgaaaaugugauagaggaagccacuaagccggcuggagagcaaauugccgaauuuuccauccaucugcuaggcaaacaguaccgcgaggagcuccaggauagcucgucuuuccaccaccagcaccuggaagaggaauuuauuuccgagguggagaacgcguucaccggccuucccggguauaaggaaauccgaguccuggaguucagaucaccuaaggaaaaugacaguggaguugauguguacuacgcaguaacauuuaacggugaggccaucagcaauacuaccugggacuugauuucccuccauucuaacaaaguggaaaaucacggccuggucgaguuagaugacaagccaacagugguuuauaccauaagcaacuucagggacuacaucgcugagacgcugcaacagaauuuucuccuugggaacucaagucugaaucccgauccugacuccuugcagcuaauuaacgugcggggaguccugcgucaucagacugaagaucucguguggaacacacaaucaucuucacugcaggccaccccaaguagcauccuugacaauacuuuccaggcagcuuggcccuccgccgaugagucuauaacaucgagcauuccgccucuggacuuuuccucaggucccccaagugcgaccggccgcgaauuguggucugagagcccucucggggaucugguauccacgcacaaauuagccuuccccucaaagaugggacugucuucuuccccagaaguucuagaggugaguagccucacccugcacucugucacacccgcagugcuucaaacuggcuugccugucgcuuccgaggaaagaaccucaggcagucaucugguggaggacgggcucgccaacguugaagagagcgaagauuuucugucgaucgacucccuuccaucuagcucauucacacagccggugcccaaagagacuaucccuaguauggaggauuccgacguaucucugaccagcuccccauauuugacaucaagcauucccuuuggacucgacagucugaccucuaaggucaaagaucaguuaaagguguccccuuuccugccagacgcuagcauggaaaaggagcuaaucuuugaugguggccucgggucgggaucaggccagaaaguugaccugauuacuuggcccuggucugaaacgaguuccgaaaagagcgccgagccgcuuucuaaaccuugguuggaagaugacgauagccugcucccagcagagauagaagacaagaaacugguguuagucgauaagauggacuccacagaucaaaucucaaagcacaguaaauacgagcaugacgauaggagcacccacuuccccgaagaggagccucugucuggucccgccgugccaauuuuugcugacacugcggcagaauccgccucacuuaccuugccuaagcauaucagugagguacccgggguggacgauuauagcguuacaaaagcuccacucauccugaccuccgucgccauuucugcaucgacugacaagagcgaucaggccgacgcuauacuacgggaagauauggagcagaucacagaaucauccaauuacgagugguucgacagugaggugucuauggugaaaccggauaugcagacgcuguggaccauucucccugaaagcgagcgagucuggacucgcacauccucacuggaaaaacuuucuagagacaucuuggccagcacaccccaaagugcagauaggcugugguuauccguuacccagagcacuaagcucccacccaccacgauuucuacccugcuugaggacgaagugaucaugggcgugcaggauauaucacuggaguuggaccggaucggaacagauuauuaccagccugagcaaguacaggaacagaacggcaaggucggguccuacguggagaugaguacuagcguucacucgaccgaaauggugucugucgcguggccaacagagggaggugacgaccucuccuauacucagaccagcggcgcucuggugguuuucuuuucacuacgcgugacgaauaugauguucagugaggaucuguuuaacaagaauagccucgaauacaaagcccuggagcaaagauuccuugaauugcugguacccuauuuacaguccaaccucacaggguuucagaaucuggagauucuuaacuucaggaauggaagcaucgucgugaacucacguaugaaguuugcaaauagugugccuccgaacgucaauaacgccguuuacaugauucuggaagacuucuguaccacugcuuauaacacaaugaaucuagccaucgauaaauacagccucgacguggaguccggcgaugaggcaaacccaugcaaguuucaggcuuguaaugaguucucugagugccugguaaaccccuggagcggugaagccaagugucggugcuuuccuggguauuuguccguggaggaacgaccaugucaaucacugugcgacuuacagcccgauuucugucucaaugacggcaaaugcgauauaaugccuggacacggcgcgauuugcagauguagggucggggagaacuggugguaccgcggaaagcauugcgaggaauuugugucugagccgguuaucauugguaucaccauagccaguguggucggccugcuugugaucuucucggcuauuaucuacuucuuuauucggacucugcaggcacaccaugacagaagcgaaagggagucccccuucucugggucaagccgccaaccagauuccuugaguucuaucgaaaaugccguuaaauauaacccuguguacgagagccaccgagcuggaugugagaaguaugaaggccccuacccacagcacccuuuuuauucauccgccaguggugacgucauagggggccucagccgggaggaaauucgucagauguacgagucuuccgagcugucaagagaagagauccaggaaaggaugcgcguacuagagcuguaugcaaaugaccccgaguucgcggccuuugugcgggaacaacagguugaggaaguguga

SEQ ID NO: 57722 - RNA, 5739 nt, Artificial Sequence
  derived and/or modified sequence opt3 from INADL__Homo_sapiens__XP_011538767
augcccgagaacccugccaccgacaagcugcaggugcuccaaguccuugauagacugaaaaugaaguugcaggaaaaaggcgacacaagccagaaugagaaguuauccauguucuacgaaacucugaaaucuccacuauuuaaccagauccucacgcugcaacagucaauuaagcagcuuaaggggcagcugaaucacauaccgagugauugcagcgcuaacuucgacuuuuccaggaaaggauugcucguuuucaccgaugguucuaucacaaauggcaacgugcaucggcccucgaauaacucaacuguaagcgggcuguuuccuuggaccccaaagcugggaaaugaggacuucaacagugugauucaacagauggcacagggccgccagaucgaauauauugauaucgagcgacccuccacaggugggcucggauuuucugucguggccuuacguagccaaaaucugggcaaaguugacauauucgugaaggauguccagccuggcuccguggcggacagagaucagaggcuuaaagagaacgaccaaaucuuggcuauuaaucacaccccacuggaucagaacaucucacaucagcaggccauugcacuacuccaacagacuacagggagucugcggcuuaucguagcccgcgaacccguucacaccaagagcucuacguccucaagccugaaugacacuaccuugccugagacaguguguuggggacaugucgaagagguggagcucauaaacgacgguaguggccugggguuuggaauugugggcgguaagacuucuggggucguugugagaaccaucguaccaggaggcuuagcugauagggacggccggcugcagacaggggaucacauucucaaaaucggagguaccaacgugcagggcaugacguccgaacaagucgcacaggugcuucgcaauugcgggaacagcguucgaaugcugguggccagagacccggcuggagauaucucggucacucccccugccccagcggcauugcccguggcccuaccuacaguagcuucuaagggcccagguuccgacucaagucuguucgagaccuacaauguugaacucgugaggaaagaugggcagagccugggcauucggauagucggauaugugggcacuucccacacaggggaggccucuggaaucuacgucaagagcauuauccccgguucagcagcuuaucauaacggccacauacaggugaaugacaaaauuguugccguggaugggguaaacauccaaggauuugcgaaucaugacgucguggaaguucuucguaacgccggccaggugguccaccugaccuuggugcgcagaaagacgaguuccagcaccucuccgcucgagccucccucagauagggguacaguaguggagccacugaaaccucccgcauuauuccugacuggggcuguugaaaccgagacaaaugucgacggcgaagacgaggaaaucaaggagcggauugauacucuaaagaacgacaauauccaggcccucgagaaacuggaaaaggugccagauagucccgagaacgaacuuaaaagccgaugggagaauuugcugggaccugacuacgaagugauggucgcuacccucgauacacagauugccgacgaugcagagcugcaaaaguauuccaaacuucugccaauacacaccuugcgccucggcguugagguggacucuuuugaugggcaucacuacaucucgagcauuguguccggagguccgguagacacucugggcuuacugcagcccgaagaugagcuacucgaagucaacgggaugcagcuguacggaaagucaagaagggaggccgugaguuuccuuaaggagguuccuccacccuucacguugguguguugccggcgccuguuugacgaugaagcuucugucgacgagccuagaaggacagaaaccagccucccagagacugaaguggaccauaauauggauguuaacaccgaggaggacgaugacggcgaacuggcguuauggucccccgaggugaaaaucguagaacuggucaaggauuguaaaggucuuggguucucaaucuuggacuaucaagauccgcucgacccuacacguagcgugauugugauacggucucuggucgcagauggcguugccgagcgauccggaggccuacugccaggggacagacucgugaguguaaacgaauacugccuggauaauaccagccuugcugaggccguggagaucuugaaggcaguccccccuggacuggugcacuuaggcauuuguaaaccccucguugaagacaacgaggaagagucuugcuauauccugcauuccucaaguaaugaagauaagacugaguuuagcgguacaauucacgacaucaacucgucccuuauacuggaggccccaaagggguucagggacgaaccuuacuuuaaagaggaauugguggaugagcccuuccucgaccugggaaagucuuuucacagccagcagaaagagaucgaacagucaaaggaggcuugggaaaugcaugaguuccuaacgccacgccugcaagaaauggaugaggagcgggaaauucucgucgacgaggaauaugagcuguaccaggauccgaguccuuccauggaacuuuaucccuugucucacauccaggaggccaccccagugcccagcguuaaugagcugcauuuuggcacucagugguuacacgacaacgaaccuuccgagucacaagaagcaagaacagguaggaccguguacagccaggaggcgcagccauacggcuauugucccgaaaaugucaugaaagagaacuucguaauggagagucucccuucugugccguccacagaagggaauagccagcaaggacgcuuugaugaccuggagaaccuuaauucgcuggcuaagacuucacuagaucucggcaugauuccaaacgacguucaggggcccucucuguugaucgaucugccuguggucgcccagcgacgggaacaagaggacuuaccacucuaccagcaccaggcaacccgugugauaaguaaggccuccgcuuauacgggaaugcugagcucuagauacgccaccgacacaugcgagcuucccgaaagggaggaaggcgagggugaagagacuccuaauuucagccauugggggccgccccgcauuguagagaucuuucgggaaccaaacgugucccugggaauuucaaucgucggcggucagaccguuauaaaaagauugaagaauggcgaggaacucaaagggaucuucauuaagcaagugcuggaggauaguccugcaggaaaaacaaacgcucuaaagacuggcgacaaaauccuggaagugagcggggucgaucuucagaacgccucucacuccgaggcgguggaggccauuaagaaugcuggaaaccccguuguauucaucgugcagucacucaguagcaccccaagggucauaccuaaugugcauaacaaggcaaauaaaauuacgggcaaccagaaucaagacacacaggaaaagaaagagaagcgacaggguaccgcccccccaccgaugaaacugccucccccauauaaggcuuugacugaugacuccgaugaaaacgaggaagaggacgccuuuacagaucagaagauccgccaacgguacgcagaccugcccggggaguuacacaucauugaacucgagaaagauaagaauggacugggccuuucucuggcggguaacaaagacagaucgaggaugagcaucuucguugugggcauuaauccugaagggccagccgcugccgauggacguaugcgcauaggcgacgaguugcucgagaucaacaaucagauucuguaugggcggucacaucagaacgcauccgcuaucauuaagaccgcccccaguaaagucaagcuaguguuuaucagaaaugaagacgcaguaaaccagauggccgucacuccuuucccggugccaucuagcucccccucaucuauagaggaucaaagcggaaccgaaccuaucaguuccgaggaagacggcagcguugagguggguauuaagcagcugcccgagucugaaucauuuaaacuugcugucucccagaugaagcaacagaaauacccaacaaaggugaguuucagcucgcaggagaucccucucgcgcccgccucuuccuaccacagcacggaugcagacuuuaccggguauggaggcuuccaggcuccacugucaguugauccugccacuuguccgauugugcccggccaagaaaugaucauagagauuaguaaagggaggucuggauuggguuuauccaucgucggcgggaaggacacaccacuguuuuggcgacucggaagcccucgggccuggucacagcaccuggugcgcgcuuucaugcuucaucaccccguaaccgaaguggagggccagaacgcaaucguuauucaugaggucuacgaagagggugccgcggcuagagaugggaggcugugggccggagaccagauauuggaagugaauggcguggaucuacggaacaguagccacgaggaagcaaucacagcccugcgacaaacuccacagaaggucagacucguaguguaucgcgacgaggcucauuacagggaugaggaaaaucuggagauuuuuccuguugaccuucagaaaaaggcaggccguggguuaggacuguccaucguggguaaacggaacggcucuggggucuucauuagcgauaucgugaagggaggcgccgcggaccucgacgguagauugauacagggggaucaaauccuguccguuaauggagaagacaugaggaacgcuucacaggagaccguggccacgauucucaaaugcgcacagggccugguccaacuugagaucggccgccugcgagccgggucuuggacaagugcuagaaccacuucgcagaauagccagggaucccagcaaucugcccacucaagcugccaccccuccuuugcaccggugauuaccgguuugcagaaccuaguaggcacaaagcgggugagugauccaucucagaaaaauagcgggacugacauggaaccuaggaccguugagaucaaccgcgaacugucagaugcucucggaauauccauugccggcggucgugggagucccuuaggagacaucccagucuucaucgcgaugauucaggccagcggcguggcagcuagaacacaaaagcugaaggugggcgaucggaucgucucuauaaaugggcagccccuugacggacugucccaugccgauguugugaaccucuugaaaaaugcuuaugguaggauuauccugcagguaguggcagacacgaacauuucagccaucgccgcucagcucgagaauaugagcaccggcuaccaccuggggucgccuacugcggaacaucacccggaggauacagagacccccccaccuaagauaauuacucuugaaaaaggaucugagggccuagguuucaguaucgucgggggauauggcuccccccacggcgaccugccuaucuacgugaagacaguuuuugcaaaaggggccgcugccgacgauggacgcuugaagcgaggugaccaaauuuuagcagugaacggcgaaacccuggagggggucacgcaugaacaggccguagcuauccucaagcaccagagaggaacugugacccugacaguucuuagcuga

SEQ ID NO: 57723 - RNA, 1500 nt, Artificial Sequence
  derived and/or modified sequence opt3 from INA__Homo_sapiens__NP_116116
augagcuucggcuccgagcacuaccugugcagcucaaguagcuauagaaagguguuuggggacggauccaggcucucugcccggcuuucgggugcuggcggggcaggaggcuuccgcucacagagccugagucgauccaacgucgccucuagcgcggcuuguuccucagccaguagcuuggguuuagggcuggcauaccguagacccccugccucugauggacuagaccucucccaagcugcagccaggaccaaugaauauaaaaucauucggacaaacgagaaggaacagcugcagggccuuaaugaucgcuuugcuguuuucauagagaaagugcaucagcuggaaacucaaaacagagccuuggaggcggagcucgcagcccugaggcagcggcacgcugaaccaucacgcguaggcgagcuguuucagcgagaacucagagacuuaagggcccagcuggaggaggcaagcagugcucggucucaagcccuuuuggaacgugaugggcuggcggaggaagugcagcgccuaagagccaggugcgaggaagagucccggggacgagagggugcagaacgcgcucucaaggcccagcagagagacgucgauggcgcuacgcuggccaggcuugaccuggagaaaaagguggaaucuuugcucgaugagcuggcauucguucggcaagugcaugacgaagaggucgccgaguuacuggcuacccuccaggcgucgucucaggcagccgcugaaguggauguaacaguugccaagccggaccuuacuuccgcacugcgcgagaucagagcccaauacgaaucauuggcugccaaaaaucuacagagugcagaggaaugguauaagagcaaauuugcgaaccugaaugagcaggcugccagguccaccgaggcaauucgugccucucgggaagagauccacgaauaccgaagacagcuccaagcuaggacaauugagaucgaggggcugcgcggagccaacgaaagccuugagcggcagauacuggaauuggaggaaagacauucagcagagguggcuggcuaucaggauaguaucggucagcucgagaaugaccugaggaacaccaaguccgaaauggcccgccacuuacgagaguaccaagaccugcuaaaugucaaaauggcgcucgauauugaaaucgccgcuuaccggaagcugcuugagggggaagagacucguuucagcacaucuggauugucaauuaguggccugaacccccucccuaauccaagcuaucugcuucccccuagaauccuguccgcaaccacgucuaaggugucgagcacuggcuugucccucaaaaaggaggaagaggaagaggaagccucaaaaguggcuaguaagaaaaccucucagauaggggagagcuuugaggaaauucuggaggaaacagucaucuccacuaagaaaaccgagaagucaaacauugaggaaacaaccaucagcucucagaagaucuga

SEQ ID NO: 57724 - RNA, 2757 nt, Artificial Sequence
  derived and/or modified sequence opt3 from INCENP__Homo_sapiens__NP_001035784
augggcaccacagcccccgggccuauccacuuacucgagcuuugcgaccagaagcugauggaguucuuguguaacauggauaauaaagacuuaguguggcuggaggaaauucaagaggaagcugagagaauguuuacuagggaguucagcaaggaaccagagcuaaugccgaaaacgcccucccagaagaaccggcgcaaaaagcgacguauaucuuacguccaggaugaaaauagagacccuaucaggcggcgccucucaagaaggaagagucggagcucccagcugucuucgcgccgacuuagaucaaaagauagcguugagaagcuggcaaccgugguaggagagaacgguaguguguugaggcgggucacacgugccgcggcugccgcagccgcugcaacuauggcccucgcugccccauccucucccaccccugaaagcccaacaaugcugaccaaaaagcccgaggacaaucauacucaaugccagcuggugccuguuguggaaauuggcaucuccgagcgccagaacgcggaacagcacgucacacaacucaugucaaccgagccauuaccgagaacgcugagucccacuccugcaagcgccaccgcuccaacaucucaggggauucccacuuccgaugaggaaucaaccccuaaaaagagcaaggccaggauccuugagaguauaacagugucuuccuugauggcaaccccacaggaccccaaaggacagggcguagguacggggcggagcgcuucgaagcugcgaaucgcccaaguuucuccgggaccucgcgauucccccgcguuuccagacucaccuuggagagaaagggugcuagcccccauucucccagauaauuucaguacucccacaggcagccggaccgacucccagucuguccgccauagcccuaucgcaccaucaaguccgagcccccaggugcuggcucaaaaauauagccuuguggccaagcaggagucugucguuagaagggcuucacgucggcuggccaaaaagacugcagaagaaccugccgcuaguggccgaauuaucugucacagcuacuuggagagacuccugaacguggaaguaccacagaaagugggguccgagcagaaggaacccccugaggaagcggagccagucgcagccgcugagcccgaagugccggagaauaacggaaauaacucuuggccucauaaugauacagaaauagccaacucgaccccaaaucccaagccugcagccagcucccccgagacgccaucagcuggucaacaggaggccaaaaccgaccaggcagacggcccuagggaacccccacagagugcgcgccggaagagaucuuauaaacaagcuguuagcgaguuagaugaagaacagcaccuggaagacgaggagcuccagccgccuagguccaagacacccucaagcccaugccccgccucuaaagugguccgcccucuucgaacuuuucugcacaccgugcagcggaaccaaauguugaugacaccaacuuccgcaccccguaguguaaugaaguccuucauuaagagaaacaccccucuaaggauggauccgaaauguucuuuuguugaaaaggagcgccagcggcuggaaaaucucagaaggaaagaggaagccgagcagcugcgacgccagaagguggaggaagacaaacggagaaggcuugaggaagucaagcugaagcgugaggaacgcuugcggaaagugcuccaagcuagagagagggucgagcagaugaaggaagagaaaaagaaacagaucgaacaaaaguucgcccagauugaugagaagacagagaaagcaaaggaagaacgacuggcugaagagaaagccaagaaaaaggcggccgcuaaaaagauggaagagguggaggcacggcgcaagcaggaagaggaagccagaagguuacgguggcugcagcaagaggaagaggagcgaagacaucaggaacuacuccagaaaaagaaagaggaggagcaggaacgccugaggaaggcugccgaggcaaaacgucuugcggagcaacgggaacaggagagaagggaacaggagcgccgagagcaggaaagacgggagcaagaaaggcgcgagcaggaacguagagagcaggagcggcaauuggccgaacaggagaggcgccgagaacaggagagacugcaggcugaacgggagcuccaagagagggaaaaggcccugcgccuucagaaggagcagcugcagagagaauuggaggagaaaaagaaaaaggaggagcaacagaggcucgcagaacggcagcugcaggaggaacaagagaaaaaggcuaaggaggccgcaggggccuccaaagcucugaacguuaccguggacguacagucaccagcgugcacgaguuaccagaugacuccccagggacaccgugccccuccaaagaucaaucccgauaacuauggcauggaccugaauagcgaugacucgacagaugacgaagcacauccucgcaaaccgauccccaccugggcucgagguacuccacuaucccaagccauuauacaccaguacuaucacccucccaaccuccuggagcuuuuugggaccaucuugccacuggaccucgaagauauuuucaagaaaucuaagccuagauaccauaagaggacaagcucagccgucuggaauagucccccacugcagggagcucgggugccguccucuuuagcauacagccugaaaaagcacuga

SEQ ID NO: 57725 - RNA, 3723 nt, Artificial Sequence
  derived and/or modified sequence opt3 from INF2__Homo_sapiens__NP_001026884
augagcgugaaggagggcgcccagagaaaaugggcugcacugaaggaaaaacucgggccccaagacuccgauccuaccgaggccaaccuugaaucugcggacccagagcugugcaucagguuguuacagaugccgucagucguuaauuacaguggacugcggaagcgccuagaagguagcgauggcggguggauggugcaguuccucgagcaguccggacuggaccuucuguuggaggcucucgcccgacugucuggccgugguguagcaagaauuucggaugcccugcuccaauuaacaugugugucaugcgucagggcugugaugaacagccggcaggggauagaauauauccugaguaaucagggauacguucgccagcuuucccaagcauuggacacuucuaacgugauggucaaaaagcaaguguuugagcugcuagccgcucucuguauuuauagccccgaaggccacguacugacgcuugaugcccuggaccauuacaagaccguuugcucccagcaguauagauucucaaucgugaugaaugaguugaguggcagcgauaacgucccuuacguggugacacuccugucugucauuaaugcgguuaucuuagggccagaggaccugagggcacggacucagcuccgcaacgaauuuauaggacuucagcuguuggaugugcuagcccgacugagagaccucgaggaugcugaccugcuuauccagcuggaagccuucgaggaagcaaaagcugaggacgaggaagaguugcucaggguauccgguggcguggauaugucaagccaccaagaagucuuugccagucuguuccauaaggugucuuguucccccguuagcgcgcaguuacugucggugcuacaggggcuccugcaccuugagccuaccuugcggucuucccagcugcucugggaagcccuggagucacuugucaaucgugcagugcuguuggcuagugacgcccaagagugcacacucgaagagguaguugaacgccuguuaagcgugaaaggaagaccaaggcccuccccucuggucaaggcucauaaaucugugcaggccaaccuagaucagagccagcggggcucaaguccacaaaauaccacuacaccgaagcccuccgucgagggucagcagccugcagccgcugcggcaugugaaccaguggaccacgcccagagcgagucuauucucaagguuucacaaccccgagcucuggagcagcaggccaguaccccuccacccccgccucccccaccucuuuugcccgggagcuccgcagaaccacccccuccaccgcccccuccaccccugccuucugugggagccaaagcucucccaacggccccgccgccuccaccccugccuggcuuaggcgcaauggcgcccccagcuccuccccugccaccgccucuucccgggucgugcgaguuuuugccacccccuccacccccucucccgggacuggguuguccacccccuccacccccucuacugccgggcaugggguggggacccccaccucccccaccuccccuccugccaugcacuuguagcccgccuguagccggcgguauggaagaggucaucguggcacagguugaucacgggcuuggcuccgccugggugcccucacaucgcagagucaacccacccaccuugaggaugaagaaacugaauuggcaaaaguuaccuaguaacguggcucgggagcacaauucuaugugggccagccucuccucaccagacgcagaagcuguagagcccgauuucagcucuauugaacgccuguuuuccuucccugccgcgaaaccgaaggagccaacaaugguggcccccagagcuaggaaagaaccuaaggagaucacuuuucuugacgcaaagaaaagucugaacuugaacauauuccucaagcaguuuaaaugcagcaaugaggaaguugccgcuaugauucgugccggagauaccacaaaguucgacgucgaggugcugaaacagcuacugaagcuccugcccgaaaagcaugagaucgaaaaccuucgggcauucaccgaggagcgagcgaaauuggccucugcugaucacuuuuaucuguuacuccuggccauuccaugcuaccaacuuagaaucgaauguaugcugcuaugcgagggcgcagcugccgugcucgacauggucaggccuaaggcacagcugguuuuggccgcuugugaaucccuguuaacgucacgccagcuccccaucuucugccagcugauucuucggauagggaauuuucugaacuacggaagucacacuggugacgcggauggcuucaaaaucagcacauugcucaagcugaccgagacuaaaucgcaacagaauagagugacacuacugcaucacgugcuugaagaggccgagaagucccauccagaccuccugcaguugccuagggaucuggaacagccgucucaagcagcugggauuaacuuagagaucauacgcagcgaagccucaaguaaucucaagaaacugcuugagaccgagcgaaagguauccgccucugucgcugaagugcaggagcaguauacggaacggcugcaggcaagcauuuccgccuuucgugcguuggacgaacucuucgaggcuaucgagcaaaaacagagagagcuggccgauuaccuaugugaagacgcacagcaacugucacuugaggauaccuuuagcacaaugaaggccuucagggaccucuuucugcgcgcuuugaaagaaaacaaggaucggaaggagcaggcagccaaagcggaaagaaggaagcagcaguuagcugaggaggaagcccgacgcccccggggagaggacggcaaaccaguuagaaaggguccugggaaacaagaagaggugugcgucaucgaugcacugcucgccgacauuaggaagggcuuccagcugcguaaaacugcucgcggacggggcgauaccgacgggggaaguaaggccgcaucuauggaucccccaagagcuacagaaccuguggccacuuccaaucccgcgggugacccgguuggcagcaccagguguccagccucggagccugggcuugacgcaacaaccgcuucagagucucgaggaugggaucugguggacgccguaacucccggcccacagcccacguuggaacagcuagaggaaggugggccucggccgcuggagcgcagaaguuccugguaugucgaugcuagcgacgugcucacaaccgaggauccccaaugcccacagccucuggaaggcgcauggcccgugacucuuggagacgcccaggccuuaaagccucugaaauuuucuagcaaccagccacccgcugcgggcuccucaaggcaagaugcaaaggacccuaccagucucuuggggguccugcaggccgaggcugauagcacaucugaaggacucgaggacgccguucacucccggggcgcacgaccacccgccgcuggucccgggggagaugaagacgaggacgaggaagauaccgcgccugagucagcccuggacacuagccuugauaaaaguuucuccgaagacgcagugacagauucuucgggcagcgguacgcugccaagagcucgcggcagggccucaaaggggaccggaaaacgucggaagaagagacccuccaggagucaggagggcuugcgcccucgaccaaaagcaaaguga

SEQ ID NO: 57726 - RNA, 789 nt, Artificial Sequence
  derived and/or modified sequence opt3 from ING1__Homo_sapiens__NP_001254657
augagcuucguggagugccccuaccacuccccugccgaaagacuggucgcugaggcagacgaaggcgggccaucugccaucaccgagauucucaaggaacuugaugaguguuaugagagguuuucacgggaaacagacggagcgcagaaacgccgaaugcugcauugcguucaacgugcuuugauaagaagucaggaguuaggugaugaaaagauccagauugugagccagaugguagagcugguggagaacaggacucggcaagucgacucccacguggaacuauucgaggcccagcaggaacucggcgauacggcaggaaauucugggaaagccggcgcugaccgcccgaagggugaggcagccgcucaggccgauaaacccaacucgaagagaucaaggcggcaacgcaauaacgaaaaucgagagaacgcgagcaguaaucaugaccacgaugacggggcauccggaaccccuaaggagaaaaaggccaaaacaucuaagaaaaagaagagaagcaaagcuaaggccgaaagggaggcauccccagcugaucugcccaucgacccuaacgaaccaacuuacugucuuugcaaucagguuucauauggcgagaugauuggcugugauaacgacgaaugccccaucgagugguuucauuucaguuguguggggcugaaucacaaaccuaagggaaaaugguacugcccaaagugucggggugagaacgagaaaaccauggacaaggccuuggaaaagagcaaaaaggaacgugcguauaaucgcuga

SEQ ID NO: 57727 - RNA, 723 nt, Artificial Sequence
  derived and/or modified sequence opt3 from ING2__Homo_sapiens__NP_001278888
auggaccaggauggcgaccaacagcuggggcccagcagaauccucgccccucagacccuuaaggagauugaugacguguacgaaaaauauaagaaagaggaugaccugaaccagaagaaaagguugcaacaguuacugcagcgggcucuaauaaauucccaggaacucggagaugagaagauccaaauugucacacagaugcuggaacuuguugagaaccgcgcacgacagauggagcugcacucucagugcuuccaagacccagccgaaucagagcgugcgagugauaaggcuaaaauggacagcucccagccggaaagaucuucgaggcggccccgcagacagaggacuucagagagccgggauuugugucauauggccaaugguaucgaggacugcgaugaccaaccuccaaaggagaaaaagaguaaauccgcaaagaagaaaaagcgcucuaaagccaagcaggaacgagaagcuagccccguggaguuugcaauugacccuaacgaaccaacguacugucucugcaaucagguauccuauggcgagaugaucgggugugauaacgagcagugccccauagaaugguuccacuuuucaugugugagucugaccuacaaaccuaagggaaaaugguauugcccaaaguguagaggcgacaaugagaagacaauggauaaaagcacugaaaagaccaaaaaggacaggcggucucguuga

SEQ ID NO: 57728 - RNA, 1257 nt, Artificial Sequence
  derived and/or modified sequence opt3 from ING3__Homo_sapiens__NP_061944
augcuguaccucgaggacuaucuugaaaugaucgagcagcugcccauggauuugagagacagguucaccgaaaugcgggagauggauuuacaagugcagaacgccauggaccagcuggaacagcgcgucagcgaguuuuucaugaaugcuaagaaaaacaagccugaguggcgagaggaacaaauggcauccauuaaaaaggauuacuauaaagcccuagaagacgcggaugagaagguucagcucgcuaaucagauauacgaccugguggaucgucaccuuagaaagcuggaccaggaguuggccaaauuuaagauggaacucgaggcagauaacgccggcaucacagaaauucuggagaggcggucucuggaacucgacacuccaucacaaccgguaaauaaccaucacgcucauagucacacgcccguggagaaacgcaaguauaauccuaccagccaucacacaacuaccgaucacaucccagagaaaaaguucaaguccgaagcauuacugucuacacuuaccucggacgccucaaaagagaacacuuuggggugcagaaauaacaauagcacagcuaguuccaacaaugccuacaacgucaauucuagccagccccugggauccuauaacauugguucacuaaguagcggcaccggggcgggagcaaucacgauggccgcugcccaggcagugcaggcuacugcccaaaugaaggaaggcaggcggaccucuucccucaaagcgucauacgaggccuuuaagaacaaugacuuccagcuggguaaagaauuuagcauggcacgcgagacaguuggguacaguucuuccagcgcucuuaugacuacccugacacagaacgccucgucuuccgcugccgauucacgaaguggaagaaagagcaaaaauaacaauaaguccucuagccaacagucaaguuccucuagcucaaguagcuccuugucuucguguagcuccucaaguaccgugguccaggagauaucucagcaaacgacugugguaccugaaagcgacuccaacucacagguugauuggacauaugacccaaaugagcccagguacugcaucuguaaccaggugagcuauggcgaaauggucggcugcgauaaucaggacuguccuauugagugguuccauuacgggugcgugggacucaccgaagcaccaaaggguaaaugguauuguccgcaaugcacugccgcuaugaagcggcguggcucucgccacaaauga

SEQ ID NO: 57729 - RNA, 750 nt, Artificial Sequence
  derived and/or modified sequence opt3 from ING4__Homo_sapiens__NP_001121054
auggccgcuggcauguaccuggagcacuaucucgacagcaucgaaaaccuucccuucgagcugcagagaaauuuucaauugaugagggauuuagaccagcggaccgaagaucugaaggcagagauugacaaacuagccacagaauacauguccucugcgcgcucacucaguagcgaggagaagcuggcucugcuuaaacagauacaggaagccuaugggaagugcaaagaguucggagaugacaaggugcaauuggcaaugcagacuuacgaaauggucgauaagcauauccgacgucucgacacggaucuggccagauuugaggcugaccugaaagagaagcagauugaauccucugauuaugacucgucaagcaguaaagguaagaaaaagggcaggacccagaaggagaaaaaggcagcccgggcucgcuccaaagggaagaacucugaugaagaggccccuaaaacagcgcaaaagaaacucaaguuaguuagaacuagcccagaauacggaaugccguccgugaccuucggcucaguacaccccagugacgugcuggacaugccugucgauccaaaugagcccacauauugucuuugccaucaggugagcuacggugagaugaucgggugugacaacccugauugcucuauugaaugguuucacuucgcauguguuggauugaccacuaagccaaggggcaaaugguuuugcccccgguguucccaggagcgcaagaaaaaguga

SEQ ID NO: 57730 - RNA, 723 nt, Artificial Sequence
  derived and/or modified sequence opt3 from ING5__Homo_sapiens__NP_115705
auggccaccgcuauguaccuggagcacuaucucgacagcaucgaaaaccuucccugcgagcugcagagaaauuuccaauugaugagggaauuagaucagcggacagaggacaagaaagcagaaauugauauacuggccgcggaguacaucuccacugugaagacgcuaucuccugaccagcgcgucgagcgacuccagaaaauucaaaacgcuuauucaaaguguaaagaauacagugaugacaagguucagcuggccaugcagaccuaugagaugguggauaagcauauccguagacuugacgcagaucuggccagguuugaagcugacuugaaagauaagauggagggcagcgacuucgaguccucugggggacggggucucaaaaagggccgcgggcagaaagaaaagagaggaucgaggggccggggucgccgaacaucagaggaagauacuccaaagaaaaagaaacacaaagggggaagcgaguuuaccgacacaauucugaguguacauccguccgacgugcuggauaugcccgucgacccuaaugaaccaaccuacugccucugucaccaagugucuuauggcgagaugaucggcugcgauaaccccgacuguccuauagagugguuccauuuugcaugcguugauuuaacuacaaagccaaaggggaaaugguucugucccagaugcgugcaggaaaagaggaagaaaaaguga

SEQ ID NO: 57731 - RNA, 1101 nt, Artificial Sequence
  derived and/or modified sequence opt3 from INHA__Homo_sapiens__NP_002182
auggugcugcaccuccuucuguucuuguuacugacaccccagggcgggcauagcugccaaggacuagagcucgccagagaacugguccuugcuaagguuagggcacuguuuuuggacgcccucgguccuccagcggugacccgggagggcggggauccgggaguacgccgacugccccguagacacgcucugggcgguuucacucauaggggguccgaaccugaggaagaggaggacgugucucaggccauccucuuuccagcaacggaugccucaugugaagacaaaagugcugcacggggauuagcccaggaggcugaagagggccuguuccgcuacauguuuagacccagccagcacaccaggucccggcaagucacaucugcccagcuuugguuccauacuggcuuggaucgccaggggaccgcggcaucgaacucaagcgagccucugcuaggacuccuggcccuuaguccagguggccccguggcuguuccuaugucccuggggcacgccccaccgcacugggcaguguugcaucucgcuacaucugcccugagcuuacugacccaccccguccucgugcuucuguugcgaugcccucuauguacuugcuccgcgagaccagaagccacacccuuucugguagcacauaccaggacgcggccuccaucaggaggcgagcgugcucgcagaaguacuccccucaugagcuggccguggucuccuuccgcccugaggcuucugcagcggcccccagaggaaccugcugcccacgcaaauugucaccgaguugccuugaacauuucauuccaagaacucgguugggagcgcuggauaguguaucccccaaguuuuaucuuccauuacugccacgggggauguggccugcauauucccccuaauuuaagccugccagucccgggcgcucccccuaccccagcgcagcccuauucucuacucccuggggcacagccaugcugugccgcucugcccggaacaaugagaccgcuucacgugaggacuaccuccgacgguggcuacagcuuuaaguaugagacagugccuaacuugcugacccagcauugcgccuguaucuga

SEQ ID NO: 57732 - RNA, 1281 nt, Artificial Sequence
  derived and/or modified sequence opt3 from INHBA__Homo_sapiens__NP_002183
augccccugcucuggcuuagaggcuuccuguuggccagcugcuggaucauugugagguccucuccuaccccagggucagagggacacagugcugcaccggacugucccagcugcgccuuagcggcucugccuaaggaugucccaaacucccagcccgaaaugguugaggccgugaaaaagcauauacuaaauaugcuccaccugaaaaagcggccugacguaacacaaccagugcccaaagcagcccuucugaacgcuauccgcaaguugcaugucgguaaggugggcgaaaauggguacguugagauugaagaugacaucggacgacgugcagagaugaacgagcucauggaacagacuucugagauuaucacguuugccgaaucgggcaccgcuagaaaaacacugcacuucgagauaucaaaggaggguagcgaucugaguguggucgaaagggccgagguguggcucuuuuuaaaaguaccuaaggcgaaucggacucgcaccaaaguuacaaucagacuguuccagcagcaaaagcauccacaggggucccuugacaccggagaagaggcagaagaggugggcuugaagggcgagaggucugaacugcuacucagcgagaaagucguggaugcccggaaguccacuuggcacguguuuccggucucaaguagcauucagcgccugcuugaccaggggaaaucuucccuggauguucgaaucgcuugugaacaaugccaggagucaggagccagcuuggugcuccuggguaagaaaaagaaaaaggaagaggagggcgaagggaagaaaaagggaggcggugaagggggagcaggcgcugacgaggagaaagaacagagucacagacccuucuuaaugcugcaggccaggcaaucugaggaucauccucaccggcgucgcagaaggggccucgagugugacgggaagguaaacauuugcuguaaaaagcaguuuuucguguccuuuaaggauaucggauggaaugacuggauaauugcgccaagcgguuaucaugccaacuacugcgaaggcgagugucccucgcacaucgcagggacaucuggauccucacuuaguuuccacagcaccgucauuaaucauuaucggaugcgaggccacuccccuuuugcuaaccugaaaucuugcugugugccaacgaaguugcgccccaugagcaugcuauacuaugacgauggucagaauaucaucaaaaaggacauucaaaacaugauaguugaagagugcgggugcucauga

SEQ ID NO: 57733 - RNA, 1224 nt, Artificial Sequence
  derived and/or modified sequence opt3 from INHBB__Homo_sapiens__NP_002184
auggacggccugcccgggagagcccucggagcugcaugccuucuguuguuagccgcggguuggcugggcccugaggcuugggggagcccaaccccgcccccuacaccagccgcacccccuccacccccuccaccgggaucccccggcgguucucaggauacuuguacgucaugcgggggauucaggcggccugaggaacuaggccgcguggacggcgauuuucucgaagccgucaagcgacacauccugagucgucuucaaaugagagggaggccaaacauuacccaugcuguucccaaagcagccauggugacagcucugcggaaguugcacgccggaaaaguacgcgaggacgguagaguggaaauaccucaucucgauggccacgcgagcccaggggcagacggacaggagagggucuccgagaucauuucuuucgccgaaacugauggccuggcuucgucacgggugcgccuguacuuuuucaucagcaaugaggguaaccagaaucucuuuguugugcaggccaguuuauggcuguaucuuaaguugcugcccuacguccuagaaaaagggucccgaagaaaggugaggguaaagguuuauuuccaagagcagggacauggcgaccgguggaacaugguggagaaacgugucgaucucaagcgcucuggcuggcacaccuuuccgcugacagaagcaauucaggcucuuuucgagagaggggaaaggcggcugaauuuggacgugcagugugauagcugccaagagcucgccguggucccuguuuuuguggaccccggagaagagucccaccgaccauucguagugguccaggcgcgccugggugauucaagacauaggauccggaaacgcggcuuagagugugacgggagaaccaaccugugcuguaggcagcaguuuuucauagacuuucgucucaucggauggaaugauuggauuaucgccccuacuggcuacuaugguaacuacugcgaagggaguugucccgcauaucuugcuggcgugccaggaagcgccucuuccuuccacacagcuguugugaaucaauaccggaugcgaggccugaaccccgggaccgucaauucaugcuguauuccuacgaaguugagcacuaugaguaugcuauacuucgacgaugaguauaacaucgugaaaagagacguaccaaauaugauaguugaagagugcggaugcgccuga

SEQ ID NO: 57734 - RNA, 1059 nt, Artificial Sequence
  derived and/or modified sequence opt3 from INHBC__Homo_sapiens__NP_005529
augaccagcucccugcuccuugccuuccuguuguuagcucccacaacuguggcaacgccuagagccggcgggcagugcccagcguguggagguccgacccuggagcuagaaucucaaagggagcuccugcuugaccuggcuaagcggucaaucuuggauaaacuccaccugacacagcgccccacucugaaccgaccugucagucgugccgcacucagaaccgccuuacagcaucugcacggcguuccacagggggcucuuuuggaagacaauagggagcaagaaugcgagauuaucagcuuugcagagacaggacuguccaccauaaaccagacucggcuagauuuccauuuuucuucggaccgcacagccggcgauagagaagugcagcaggcuucacucauguucuuuguacaacugcccagcaauaccacguggacucuuaaggugaggguccugguguuggguccucacaacaccaaucucacacuggccacucaguacuuacuggagguugacgcgaguggguggcaucagcucccacuuggacccgaagcacaggccgcuuguucccaaggccaccugaccuuggagcuagugcuggagggccaggucgcccagucuagcgugauucucgggggagcagcucaccggccuuucguagccgcgcgcguucgaguggguggcaaacaucaaauccacagaagggggauugauugccagggaggcucccggauguguugccgucaggaauuuuucgucgacuuucgcgagaucgguuggcaugauuggauaauccagccagaaggguaugccaugaacuucuguauuggacaaugcccgcugcacaucgcaggcaugcccggcauugcugccucauuucacacagcugugcuuaaucuguugaaggccaacaccgcagccgggacgacuggagguggcaguuguugcgugccuacagcuagaaggccacucagccuguuauacuaugaccgggauucuaauaucgucaaaaccgacauacccgauaugguuguggaggcgugugggugcuccuga

SEQ ID NO: 57735 - RNA, 1053 nt, Artificial Sequence
  derived and/or modified sequence opt3 from INHBE__Homo_sapiens__NP_113667
augagacugcccgacgugcagcucuggcuuguccuguugugggccuuaguuagggcucaaggcaccgggagcgugugcccuuccuguggagguucuaagcuggcaccacaggccgagcgggcgcuaguacucgaacuggcuaaacagcagauccuugauggccugcacuugacaucacgcccgcgaauuacucaucccccuccacaagccgcacucacgcgugcccugagaaggcugcagcccgggaguguggcuccuggaaacggcgaggaagucaucagcuucgcaaccgugacagacuccacuucugccuacucgucacucuuaaccuuucaccugagcacaccacggagucaucaccuuuaucaugcucgcuuguggcugcacguucuacccacccucccugguacucugugccuuagaauauucaggugggggccacggcgccgaagacagggauccaggacacuguuggccgagcaccauauuaccaaucucggcuggcacacgcugacuuuaccgucuagcggccugcguggggaaaaguccggagugcucaaacuucagcuggauugucggcccuuggaggguaacucaaccgucacaggccaaccucgcagacuacuggacacugcggggcaucagcagccauuucucgagcugaagaucagggcaaaugaacccggagccggccgggcucgacgcagaaccccuacaugcgagccagccacgccccuuuguugcaggcgggaucacuacguggacuuccaggaacuggguuggcgcgauuggauuuugcaaccggagggguaucagcucaacuacuguaguggacagugcccuccccaccuggcaggcagcccaggcaucgcugccucuuuucauuccgcgguauucucauuacugaaagccaauaacccuuggcccgcaagcaccaguuguugcguuccaacugcuagaaggccccuaucucuccuguaucuugaccacaaugggaacguggucaagacagaugugccugacaugguggucgaggccuguggaugcuccuga

SEQ ID NO: 57736 - RNA, 1071 nt, Artificial Sequence
  derived and/or modified sequence opt3 from INO80B__Homo_sapiens__NP_112578
augagcaagcuguggagaaggggcuccaccucuggggccauggaggcucccgaaccuggagaggcacucgaacuuucacuggccggugcgcacggccauggggugcacaaaaagaaacauaagaaacacaagaagaaacauaagaaaaagcaccaccaggaggaagacgcuggaccaacacaaccgagucccgccaaaccucaguugaaguuaaagaucaaacugggcggucagguccuagggacuaagagcguuccaacguucaccgugauucccgagggaccucgguccccaucuccccucaugguaguggauaacgaggaagaaccuauggaaggcgucccacuggagcaguaccgcgcauggcuugacgaggauucgaaucugucaccgagccccuugcgagaccucaguggcgggcugggaggucaagaagaggaagaggaacagcguuggcuggaugcccucgagaaaggcgaguuagacgauaacggggaccugaagaaagaaauaaaugagagacuuuugacagcuaggcagcgggcacugcuacagaaggcccgcucccaaccuucuccaaugcucccccugccuguggcugaaggaugcccacccccggcccuuacugaggaaaugcuguugaaaagagaggagagggcgcggaagcgccgacuccaggcagccagaagggcugaggagcauaagaaccagaccaucgaacggcugacaaaaaccgccgcaacuagcggccguggugggcgcggaggcgcuagaggcgagaggcgagggggacgggccgcggccccugcacccaugguucgcuauuguuccggugcucagggcucaacauuaaguuuuccaccuggggugcccgccccaaccgcugucagccaaagacccucuccuuccggaccaccgcccaggugcucagugccuggcuguccacacccccggcgcuacgccugcagcagaacgggucaggcacuguguagucuccagugcuauaggauuaaucuucaaaugcgucugggcgggccugaaggaccaggcucucccuugcuagccacuuga

SEQ ID NO: 57737 - RNA, 3084 nt, Artificial Sequence
  derived and/or modified sequence opt3 from INO80D__Homo_sapiens__NP_060229
auguacgagggcaagcacauccauuucagcgaaguggacaacaaaccccugugcuccuauucuccuaagcucuguaaacagagaaggcuuaauggguacgccuuuugcauucggcacguccuggaggauaagaccgcuccauucaaacaaugugaauauguugcaaaguacaacucacagcgcugcacaaauccgauacccaagagugaggaccgacguuauuguaacagccaucuacagguguuaggauuuaucccuaaaaaggaaaggaaaaagaaaaaugauccaauugacgagguaaaggugagacaccagauggauacuauggccuucucccugacgguccccacccuagcgcucaagaugccuaacggucuggacggcaugucucuuucgccacccggggcucgggugccucugcauuacuuggagacagaacucgaggauccauuugccuucaaugaagaggacgaugaccugaaaaagggagcaacuguucgcaaaaagcugcaaucaaaacucgcccagaacagacagaggcagcgggagaccgaaaucuuaaaggugcgccaagagcacuuuagcccgcccccugcuccaagucagcagcagcccccucaacagcacucccaucugucuccacuuagcacauccuugaaacccccggcaccuccccagggcucagucugcaagaguccacaaccucagaauaccagccugcccaugcaggguguggccccaacuacacacaccauugcucaggcccgacaacuaucucauaagagaccccucccucugcuuccauccucaagggcgccgacgguagaucccccucggacugaccguauccugaugaaagcaaccgccuucagcccacacuuuaguuguauaucucgcuugcagagacucguuaagcugugcacacagaaacaccaguuagauacugaccuguucccccaucucgggcuugacugguccgaagagagcggagaagaaccugaggauucggaacaggcuucuccauaucaaguggccugguccaucagggagacccugcgguaccagcgacacgcaucagacgaugacgaugcugaaagucgcagcuccagagucacacaguuguguaccuacuuucaacagaaguauaaacaucuaugcaggcuggagcgggccgaaucucgccagaagaaguguagacacacguucaggaaagcgcuccugcaggccgcaagcaaggagcccgagugcacuggccaacuuauucaggaacugcgucgggcugccugcucacgaacaaguaucuccagaaccaaauugagggagguggaaccggcugccuguagcggcacugugaagggggagcagugcgcaaacaaagcccucccuuuuacacgccauuguuuccaacacauucuguuaaaucacucucagcagcuguucucaaguugcaccgcuaaguuugcggacggacagcaauguagcgucccaguuuucgauaucacgcaucagacccccuugugcgaggagcacgcaaagaaaauggacaacuuucuccggggugauaauuccagaaaggugcagcaucagcaacagaggaaaccucgcaagaaaacaaagcccccagcccugacuaagaaacacaagaaaaagcgacggcguggcccuagaaggccccagaaaccaauaccgccugcuguaccccaggggaaccuuucuaugccagccucggugagcuugcccgucgaggcaucccacauucgcucaccuaguaccccagaacugucugccgacgagcuccccgaugacaucgcuaaugaaauuacagacaucccucaugaucuggagcuuaaccaagaggacuucagcgaugugcugccgcgguugccagacgaucuccaggacuuugauuucuuugaaggaaagaacggcgaccuguuacccacuaccgaggaagccgaggaacuggagagagcacuacaggcgguuacaucccucgagugucugucaaccaucggugugcuugcucaaagcgauggggucccugugcaggaauugucugacaggggaauuggcguauucuccacuggcacgggggccaguggaauacagagccugucucgagagguuaauacagaucucggugaacuguuaaacggccgcaucgugcacgacaauuuuuccucacuggagcuugaugaaaacuugcuccggagugcaacccugagcaauccacccacuccucuagccgggcagauucaaggacaguucucggcuccggccaacgucggccugaccuccgcaacacucaucucucagagcgcucugggugagagagccuuucccgggcaguuccauggccuucacgacggaucacaugcgagucaaaggccacacccugcccaguugcuguccaaagcugacgauuuaauaaccucucgucagcaguacagcuccgaccacucacauagcaguccccacggcucucauuaugauuccgagcacgugccaagcccuuacucggaccauauuacuucaccccacacaacgucuuauaguggggauaauauggcagccaccuuuuccgcugaaaugccaaucauggcccaacaccuccugccgacucagcuugaggucccucugggaggugugguuaacccccgcacacauuggggcaauuugccagugaaccucggggaccccagcccuuucucuaaucugcuaggagcagauggccaucugcucagcaccucccugucaacaccacccacuaccaguaacagcgaaacgacccagccugcguucgccacaguaacuccgucuuccucaaguguccuuccagguuugccccagaccagcuuuuccgggaugggcccuucugcugagcugauggccucgacaagccccaagcaacaguuaccacaguucucagcagcuuuuggacaccaacucuccagucacucuggcaucccuaaggaccugcagcccagccacuccucaauugccccaccuacuggguucaccgugacgggagcaacagccaccucuacuaauaacgcuagcaguccguuucccuccccaaauuga

SEQ ID NO: 57738 - RNA, 4671 nt, Artificial Sequence
  derived and/or modified sequence opt3 from INO80__Homo_sapiens__NP_060023
auggccagcgagcugggcgcuagagacgaugggggaugcaccgaacucgcaaagccccuuuaccugcaguauuuggagagggccuuacggcuggaccacuuccuacgccaaacauccgcgaucuuuaaccgaaauauuucuucagaugacagugaagauggucucgacgauagcaacccucugcuuccacaguccggcgacccgcugauacaggugaaagaggaacccccuaauucuuugcucggggagacuucgggagcuggcucaagcgguaugcugaacacguacagucugaaugggguccuccaguccgagucuaagugugauaaaggaaacuuauauaauuucagcaagcugaaaaagucccguaaguggcuuaaaucaaucuugcugagugacgaaagcucugaggccgauucccaaucagaagacgaugacgaggaggaacuaaaccucagcagagaggaacugcauaauaugcuuaggcugcacaaguacaaaaaguugcaucagaacaaauauaguaaggacaaggagcuccagcaguaccaauauuacucugcaggccuguuauccaccuacgauccauuuuaugaacagcagcggcaccuucucggccccaaaaagaaaaaguucaaagaggagaagaaacuuaaggccaagcugaaaaagguuaaaaagaaacgcagaagggacgaagaguugagcucggaagagucuccucggcgccaucaccaccagacaaagguguuugcuaaguucucccaugaugcaccacccccugggacuaaaaagaaacaccuaucaauugaacaacugaaugcccgaagaaggaagguauggcucaguaucgugaaaaaggagcugccaaaggcuaacaaacagaaggccagcgcgcggaaucuuuuucugaccaacucccguaaauuggcacaucagugcaugaaggagguccgcagagccgcucuccaagcccagaaaaauuguaaggaaacacugccgagggcacggcgauuaaccaaggagaugcugcuauacuggaaaaaguaugaaaaaguggagaaggaacaccgcaaaagagcugagaaggaggcccucgaacagaggaaacuggacgaggaaaugcgggaggcgaagcgccagcaaagaaagcugaacuucuugauuacucagacagagcuguacgcccacuuuaugucuaggaaacgugauaugggacaugacgguauccaggaagagauacuccggaagcuggaagauagcucaacccagcgacaaaucgacauuggcgggggaguuguggucaacaucacgcaggaggauuaugacaguaaucacuucaaagcacaggcucuuaagaacgccgaaaaugcuuaccauauucaccaggccagaacuagguccuuugaugaggacgcaaaagagagccgcgccgcugcgcugcgggcagccaacaagucuggcaccgguuucggggaaucauauaguuuggcuaaucccagcaucagagccggagaggacauaccucaaccaacaauuuuuaacggcaagcucaaaggcuaccagcugaaggggaugaauugguuagcaaaccuguacgaacagggaaucaaugguauucuagccgaugagaugggccucgggaaaacugugcaguccaucgcucugcuugcccauuuggcagaaagggagaacaucuggggacccuuccugauuauaucuccugcgucgacccucaauaacuggcaccaagaguucacacgcuuuguaccaaaguucaaaguucugcccuauuggggcaauccgcacgaccgaaaggugauccggcguuuuuggagccagaagaccuuauacacgcaggaugcuccuuuccaugucgugauuacuuccuaucaacuggugguccaggacguuaaauacuuucagagagugaaguggcaguauaugguacuugaugaagcccaagcauugaaaucaaguucuagcgugagguggaagauccuccugcaguuccagugccgcaaccggcuacugcucacagguacccccauacagaauacuauggccgagcugugggcucuuuugcacuuuauuaugccaacacuguucgacucccaugaagaguuuaacgaaugguucucaaaagauaucgagagccacgccgagaacaagucugcaaucgacgaaaaucaauuauccagacuccacaugauucugaagccuuuuaugcuuaggcgaaucaaaaaggaugucgagaacgaacugagugacaaaauugagauauugauguacugucagcucaccagccgccagaagcugcuauaucaggcucugaaaaauaagaucucuauugaggaucuccugcaauccucaauggggaguacgcagcaggcccaaaacaccacaagcucgcuuaugaauuuggugaugcaguuccggaaaguuugcaaccaucccgaacuguuugagagacaggaaacuugguccccauuccacaucucuuuaaagcccuaccauaucagcaaguucauuuacaggcacggccagauacguguguuuaaucauucacgcgaccgguggcucagaguccugaguccuuucgcgccagauuauauccaaaggucccuuuuucaccgaaaaggaauuaacgaggaaucuuguuucagcuuucugcgguucaucgacauuuccccggccgagauggcuaaucuaaugcuccagggccuguuggcacgcuggcuggccuuauuucucucacugaaggcuagcuacagacuucaccagcugaggaguuggggagcccccgagggggaaucucaucagcgguauuugcgaaacaaagacuuccuccugggugugaauuuuccucuauccuucccaaaccugugcagcuguccccuucucaagucgcugguauuuucaucucacugcaaagcaguuaguggcuacuccgaucaagugguccaucagagacgcagcgcgaccucuagcuugaggcguugucuguuaacagagcucccuuccuuccugugcguggccucaccacgggucacugcugugccccuugacaguuauugcaaugauagaagcgccgaauacgagaggcgcguucugaaggaagggggaucuuuggcagcuaagcagugucuccugaacggcgccccggagcuagcagccgacuggcugaaucgaagaucccaguuuuucccugagccagcuggugggcuuuggucaauccggccccaaaacggcuggaguuucauaaggaucccuggaaaagaaagccucauuaccgauuccggcaagcuguaugcguuggacguguuacugacacgccucaaaucucaggggcaccguguacugaucuacucgcagaugaccagaaugauugaucuucuggaggaauacauggucuaucggaagcauacuuacaugagguuggacggaagcucaaaaaucuccgagcgccgagauaugguggccgacuuucagaacagaaaugauauauucguuuuucuacugaguacgcgggccgguggccucgggauuaaccugacagcugccgacaccgugaucuucuaugauucugacuggaaucccacugucgaccaacaggccauggauagggcucaccgccuuggacagaccaagcaagugacaguauacagauuaauuugcaagggcaccaucgaagagaggauacugcagcgggcaaaagaaaagagcgaaauccagcguauggugauuuccggugggaacuuuaaaccagacacucucaagccuaaagagguugucucauugcugcucgaugacgaggagcuggagaagaaacuucgccugcgacaggaagagaagagacaacaggaagagacaaauagggugaaggaacggaaacgcaagagagagaaauaugccgagaagaagaaaaaggaagaugaguuggacggcaaaaggcggaaggaaggagugaaccuagucauccccuucguuccaucugcggauaauagcaaccugagugcugacggcgaugacuccuuuauuagcguggauucugccaugccgucaccuuucuccgagaucaguauaagcucggaacuccacacggggucuauucccuuagacgaguccagcucagacaugcuggugaucguagaugacccagcaaguucugcaccccagucccgagcuaccaauagcccugcaucaaucacuggaagugucagcgauacagugaacggcauuuccauccaggagaugccagccgcggguagagggcauucugcucgcagcaggggacggcccaaaggcuccgguucaaccgccaagggcgcagggaaaggacguucuagaaagaguacagccggcucggcugccgcaauggcuggggccaaggcgggagccgcagcugccagcgcugcagccuacgccgcuuauggcuacaauguuuccaaagguauuucugcgucaagcccucuucaaacuucccuggugaggccggcagggcucgccgacuuuggaccaaguucugcuagcucacccuuguccaguccucugagcaagggcaacaaugucccagguaaccccaaaaaucuccacaugaccucuucccuggccccugauucacuugugcgcaagcagggcaaagggacgaacccgagcggaggccgguga

SEQ ID NO: 57739 - RNA, 1200 nt, Artificial Sequence
  derived and/or modified sequence opt3 from INPP1__Homo_sapiens__NP_001122400
augagcgacauccugagagagcuccuuugcguguccgaaaaggccgcuaacauugcaagggccugucggcagcaagaggcgcuguuccaguuguuaauagaagagaaaaaggaaggcgagaaaaauaagaaauuugcugucgauuucaagacccuggccgacguucuagugcaggagguaaucaagcagaacauggaaaauaaauuucccgggcucgagaagaacauuuucggagaagagucuaaugaguuuacaaacgauuggggugagaaaaucacucugcgccuuugcucaacggaagaagagaccgcagaacuguugaguaaggugcucaauggcaacaaagucgccagcgaggcucuggcacgagugguucaccaagacguggccuucacagauccuacucuggacuccaccgagauuaaugucccacaggauauccucgggauauggguggacccgaucgauucuacauaccaguauauuaagggaucggcugacaucaagucaaaccagggcauuuuucccugugguuuacaaugcguaaccauccugauagggguuuacgauauucagacuggagugccucuuaugggcgucaucaaucagccauucgugagccgugaccccaacacauugagauggaaaggccaguguuauugggggcugaguuacaugggaaccaauaugcauucccuacaacucacgauuucuaggcggaacgguagcgaaacucacaccggcaauacaggguccgaggccgcguuuucaccuaguuucagcgcagugaucucuacuuccgaaaaggagaccaucaaagccgcucugucacgcgucugcggagauagaauuuuuggcgccgcuggugcaggguauaagagccuuuguguugugcagggacugguagacauauacaucuucagugaagacacaaccuuuaaaugggauucuugcgccgcgcaugccauuuugagggcaaugggcggcgggaucguggaccucaaggagugucuggagcggaacccagaaacgggauuagaucugccccagcucgucuaucacguggagaacgaaggugcugccggcguugaccgcugggcuaauaaagggggacuuauagccuaccgauccagaaagaggcuggagacuuucuugagccuacuggugcaaaaccucgccccugcagaaacacauaccuga

SEQ ID NO: 57740 - RNA, 2934 nt, Artificial Sequence
  derived and/or modified sequence opt3 from INPP4A__Homo_sapiens__NP_001127696
augaccgccagagagcacagccccaggcauggcgcucgggcacgcgccaugcagcgagcguccacaaucgacguggcugccgauaugcuggggcucucucuugcaggaaacauucaagacccugaugaaccaauacuggaguucucauuggccugcagugaauuacacacuccgagccuggaccguaagcccaauuccuuugucgcuguuucugugacgaccccuccacaggcauucuggacaaaacaugcccagacugagaucauugaagguaccaacaaucccaucuuucuaucgucaauugcuuucuuucaggauagccucaucaaccaaaugacacagguaaagcugaguguguacgacgucaaagauagaucccagggcaccauguaucuucuggggucuggaacuuucauagugaaggacuugcuccaggauaggcaccaucggcugcaccugacacuccgcagcgccgaguccgacagaguuggcaauaucaccgugauugguuggcaaauggaggaaaaaucagaucagaggccuccagucacgcggaguguggacacuguaaacgggcgcaugguuuuacccguggaugagagccugaccgaagcgcuuggaauccgaucuaaguacgcauccuugagaaaggacacacugcuaaaaucagucuuuggcggcgccauuuguaggauguaucgguucccuacuaccgacgggaaucaccuccguauccuggagcagauggcugagagcgugcuuagucugcaugugccacgccaguuugucaaguugcuccuggaagaggaugccgcaagaguuugcgaauuagaggaacugggagagcucucuccguguugggagucccuuaggcggcaaauagugacacaguaccagaccauuauccugacguaucaagaaaacuugacugaccuacaccaguaccgaggucccagcuucaaagccucgucucugaaggccgauaaaaagcucgaguuuguaccuacaaaucugcauauucagcgcaugagagugcaggacgauggcggguccgaccaaaacuaugauaucgucaccaucggagcgccagccgcacacugccagggcuucaagucaggugggcuuaggaaaaagcugcacaaauuugaagagacuaagaaacauuucgaagaguguugcacaaguagcggaugucaguccauuauauacaucccccaggacgugguucgggcuaaggagauuaucgcccaaauaaauaccuugaaaacccaggugucuuacuaugcugaacgccucagcagagccgcaaaggauaggucagccacgggccuggagcguacauuagcuauucuggcggacaagacucggcagcuagucaccgugugcgauuguaaacuccuggcaaacaguauccacggccuuaaugccgcucgaccugacuacaucgccuccaaggcaagcccaacaucuacugaagaggaacagguaauguugagaaacgaccaagauacccugauggccagguggacagggcgcaauucacggaguagccuccagguugacuggcaugaggaggaaugggagaaaguguggcugaacgucgauaagucccuugaaugcauuauccagagaguggacaaacuguugcagaaggagaggcuccacggagaggguugugaagaugucuuccccugcgcuggcucuugcaccucgaagaaagggaacccggacagccaugccuauuggauucgcccugaggaucccuuuugugacgugccauccucaccuugccccaguacuaugccaucuacggcaugucacccccaccugacaacccauugcagcccuccaccggaagaguccucacccggagaauggagcgaggcguuauacccucugcuaacuacccucacagauuguguugcuaugaugucugacaaggccaaaaaggcaaugguguuccugcuuaugcaagauuccgccccaaccauagcuacuuauuugagucugcaguaccgacgggacguagucuuuugccagacacucacggcccugaucuguggcuucauuaucaaauuacguaauugccugcacgaugacgguuuucuuagacaauuguauaccaucgggcuccuggcacaguucgagagccuacugucuacuuacggcgaggaacucgcuaugcuggaagacaugucccuuggaauuauggauuugaggaacgugacauuuaagguuacccaggccacaucaagugcgagcgccgacaugcugcccgugauaacuggcaaucgcgauggguucaacguccgggugccuuuaccaggaccccucuuugacgcucugccgagagagauccagucggguaugcuucugaggguacaaccuguguuguucaauguuggcauuaacgaacagcagacccucgcagagcgauuuggggauacgucccugcaggaggucaucaauguggaaucucuagugcgccugaacagcuacuucgagcaauuuaaggaaguccucccagaggacugucugccccggucaagaagucagaccugccuuccugaauugcugagguucuuaggacagaauguucaugcccguaaaaacaagaauguggauauucucuggcaggcugccgagaucugucgccggcugaacggcgugagauucacauccugcaaaucugcaaaggacaggacugcgaugagcguaacccuugagcaaugccugauacuacagcacgaacacgguauggcuccccaggucuuuacacaagcucucgaguguaugcgauccgaagggugccggcgcgagaauacuaugaaaaacgugggcucaagaaaguaugccuucaauagccugcaguugaaggcauuuccaaaacauuacaggccucccgagggaaccuauggcaagguugaaacguga

SEQ ID NO: 57741 - RNA, 2775 nt, Artificial Sequence
  derived and/or modified sequence opt3 from INPP4B__Homo_sapiens__NP_001095139
auggagaucaaggaagagggcgccagcgaagaggggcagcacuuccugcccaccgcucaagcaaacgacccuggagauugccaguuuacauccauucagaaaacuccaaaugaaccgcagcucgaguucauacuugccuguaaggaccugguggcgcccgucagagauaggaaauugaacacguuaguucaaaucucugugauucauccuguagagcagucacugacccgguacaguagcacagaaaucguggaggguacucgcgacccacuauuucucaccggcgucacauuccccuccgaauauccuauuuacgaggagaccaagaucaaacugacuguguaugauguuaaggacaagucucacgauacagugcgaaccucgguccuuccagaacauaaagaucccccuccagagguggggcguucauuucugggauacgcuagcuucaagguaggcgaauugcucaaaaguaaggagcagcugcugguucucuccuuaagaacgucugacggugggaaaguggucggaacuauagaagugagcguggucaagaugggcgagaucgaggacggcgaagccgaucacauuaccacagacguucaggggcaaaagugcgcacuggugugugagugcacugccccggaauccguaucaggaaaagauaaucuucccuuuuugaacagugugcugaagaauccugucuguaaacuauauagguucccaaccagcgacaacaaguggaugcggauccgcgagcagaugucugaauccauucucucauuucauauccccaaagagcugauaagccuucacauuaaggaggaccugugcagaaaucaggaaaucaaagaguugggugaacucaguccucacugggauaaccugaggaagaauguguuaacacauugugaccagaugguuaacauguaccaagauauucugaccgagcucucuaaggaaacgggcuccagcuucaaaucgucuuccucaaagggggagaaaacucuugaguuugugccaaucaaucugcacuugcagcggaugcagguccauaguccccaccuaaaggacgcucuguaugaugugaucacaguaggagcaccggccgcucacuuccaaggcuuuaaaaacggugggcuccgcaagcugcuucaucgauucgaaaccgagagaaggaauacuggauaccaguucauuuacuauagcccugaaaacacagccaaggcgaaagagguucuguccaauauaaaccaguugcagccccucaucgcaacccacgccgaccuguuacugaacucugcuagccaacauucaccagauagucuaaagaacucccucaaaaugcugagcgagaagacggaacuuuuugugcacgccuucaaagaccaguugguccggucugcacugcucgcucuguacaccgcccguccuggcggcauucuuaagaagcccccaucacccaaaaguagcacagaggaauccucuccucaggaucagccaccggugaugcgcgggcaagacucgaucccccaucacagcgauuaugacgaggaagagugggacagagucugggcgaaugugggaaagucccugaauugcauaauugccaugguugauaaauugaucgagagggacgguggcucagaagggaguggaggcaacaaugauggugagaaggaaccuucucucacugacgcaaucccaagccacccccgggaggauugguacgaacagcuguauccuuuaauucugacccuaaaagacuguaugggggaggugguaaaccgagcuaagcagucccucacauuuguccugcuucaggaguuggccuacucacugccacaaugccucaugcugacuuuacgcagagauaucguguucagccaggcucuggccggccuuguuuguggauuuauuauaaaguugcagaccucucucuaugaccccggcuuccugcagcaacuacauacaguggggcugaucguccaguacgaaggacuccuguccaccuacagugaugagauugguaugcuugaagacauggcagugggcaucagcgauuugaaaaagguagccuuuaaaaucauugaggcuaagucuaaugacgugcugccgguuauaacugggaggcgggaacacuaugucguggaggugaaauuaccugcgcgcauguucgagucccucccacugcagaucaaggaaggacaacuucugcaugucuaccccguuuuguuuaacgugggcauuaaugagcagcagacgcucgcagaaagauucggugaugugucacugcaggagaguaucaaccaagagaauuuugaacuacugcaggaguauuacaaaauuuucauggaaaagaugccucccgacuauaucagccacuuucaggagcagaacgaccucaaggcccugcuugaaaauuugcugcaaaacauacagucgaaaaagaggaaaaauguagagaucaugugguuagcugccacaauuugccguaagcucaacgggauccgguuuaccugcuguaaauccgcaaaggaucgaacuucuaugagcgucacccuggagcagugcucaauucuuagagacgaacaccagcugcauaaggauuucuucaucagggcccuagacuguaugcgccgggagggcugcagaauagaaaacgugcucaaaaauauuaaguguaggaaauacgcuuucaacaugcugcaauugauggccuuuccaaaguauuaccgcccucccgagggaacauacggcaaagcagauaccuga

SEQ ID NO: 57742 - RNA, 1239 nt, Artificial Sequence
  derived and/or modified sequence opt3 from INPP5A__Homo_sapiens__NP_005530
auggccggcaaggcugcagcccccgggaccgcggugcugcucgucacagcuaacguuggaagccuuuucgacgauccugagaaucugcagaaaaacugguugagagaauuuuaccaagugguacacacucauaagccacacuucauggccuuacauugccaggaguuugguggcaaaaauuaugaagcauccaugucucacguggacaaguucgucaaagagcugcuaucaagugaugccaugaaggaauacaacagggcucggguguaucucgacgagaauuacaagagccaggagcauuuuacggcacugggguccuucuauuuucuucacgaaucucugaaaaacaucuaccaguucgauuuuaaggccaaaaaguaucgcaaaguugcuggaaaggagauuuacucggacaccuuggaaucaacaccgaugcucgagaaggagaaauucccccaagauuacuuuccugaauguaaguggagccgaaaaggcuucauacguacuagauggugcaucgccgacugugcguuugaucuggugaauauucaccuguuccaugacgcaaguaaccucgucgccugggagaccuccccaucuguguauagcgguaucaggcacaaggcuuuaggguacguacuggaucggauuaucgaccagcgcuucgaaaaaguuuccuauuuuguguucggagauuuuaauuucagacuugacucaaagagugucguggagacauugugcaccaaagccacuaugcagacagugagggcagcugacaccaacgaagucguuaagcugauauuucgggagagcgauaaugaccgcaaggugaugcuacagcucgagaaaaagcuguucgauuacuuuaaccaagaaguauuccgagacaauaacggcacggcccuucuggaguuugauaaagaauugucuguguucaaggacagacucuaugagcuggauaucuccuuucccccuucauacccauauagcgaagacgcgaggcagggcgagcaguacaugaauacucggugucccgccuggugcgaucguauuuuaaugaguccuucugcaaaagagcugguccuccgcuccgaaagcgaggaaaaggugguuaccuacgaccauaucgggccaaacguguguaugggagaucacaagccggucuuccuugcuuuuagaauuaugcccggugccggcaaaccucacgcucaugugcacaagugcuguguaguucaguga

SEQ ID NO: 57743 - RNA, 2250 nt, Artificial Sequence
  derived and/or modified sequence opt3 from INPP5B__Homo_sapiens__NP_001284363
augagcgccgcugcaggcuccagagaaaggaacaccgccgggggaucuaauuucgacggucugcggcccaacggcaagggggugccuauggaucagucaagucgcggacaagacaaaccagaaagccuccagccgcgacagaauaaguccaaaucugagaucacagauaugguccguucgucaacuauuacgguuagcgacaaggcgcacauacuuaguaugcagaaauuuggccugagagauaccaucgugaagucccauuuguuacaaaaggaagaggacuacacauauauucagaacuucagguuuuucgcugguacuuacaauguaaacgggcagucucccaaagaaugccugcggcuauggcucagcaauggaauccaggccccugauguguauugugucggcuuucaagagcuggaccuuuccaaggaggcauucuuuuuccacgauaccccaaaagaagaggaaugguuuaaggccgugucagagggccugcaucccgacgcuaaauacgcaaagguuaaguugauucgccucguggggaucaugcugcugcucuaugucaaacaggagcacgccgcuuacauaagugaaguggaggccgaaacaguaggaaccgguaucaugggcagaauggggaacaagggaggcguugcgauuagguuccaguuucauaauacuagcaucugcguggucaacucucacuuagcagcccacauugaggaauaugagcggcgcaaucaggauuacaaagacaucuguucccgaaugcaauucugccagccugauccaucacugcccccucuuacaauaagcaaccaugacgugauuuuguggcugggugaccuaaauuacagaaucgaggaacucgauguggagaaggucaaaaagcugauugaagagaaagacuuucagaugcuuuaugcuuacgaucaacugaagauccagguugccgcaaagaccguguucgaaggguucacggagggagaguugacuuuucagccaaccuauaaauacgacacaggcagugaugacugggauacuucugaaaaguguagggcuccggccuggugcgaccggauccucuggaaaggcaagaacauuacccagcuguccuaucaaagccacauggcguuaaaaacaucggaucauaagcccguaucuuccguguucgacauagggguccgugugguuaaugaugagcuguaccgcaagacccucgaagagaucgugagaucacuugacaaaauggaaaacgccaacauuccuagugucagccuguccaagagggaguuuuguuuccagaaugugaaauauaugcaguugaagguagagucuuuuacgauccacaacggacagguuccaugccacuucgaauuuauaaauaaacccgacgaggaaagcuacuguaagcaauggcuaaacgcaaauccuucacgggguuuccugcucccagauagugacguggagauugaucuggagcuuuuugucaacaagaugacugcuacaaaacugaacuccggcgaagacaagaucgaggauaucuuggugcuccaucuggaccgagggaaagauuacuucuuaagcgucucuggaaauuaucugcccucaugcuuuggcaguccgauucacacccuauguuacaugcgcgaaccuauccucgaccugccccuugagacuauuagcgaauugacacugaugccaguguggaccggugaugacgggucccagcucgauucuccuauggagauacccaaggagcuguggaugaugguugacuaucuuuacagaaaugccgugcagcaggaagaucuguuccaacagccaggcuugaggucggaguuugaacauauccgggacugccucgacacgggaaugauugauaaccugagcgcuuccaaucacucaguagccgaggcauuacugcuauuccucgaaagucugcccgagccugucaucugcuauucuaccuaccauaacugucuugagugcagcggcaauuauacagccuccaaacaggugaucucaacuuugccaauuuuccacaagaacguuuuucacuaccugauggcuuuccuccgcgaacuguuaaagaauagcgcgaaaaaccaucuggacgagaacauacuugcaucuaucuuuggguccuugcuccugagaaauccggccggacaccagaagcuagauaugaccgagaaaaagaaagcucaagaguucauucaucaguuucuguguaacccccucuga

SEQ ID NO: 57744 - RNA, 3570 nt, Artificial Sequence
  derived and/or modified sequence opt3 from INPP5D__Homo_sapiens__NP_001017915
auggugcccugcuggaaccacggcaauaucaccagaagcaaggccgaggaacugcucuccaggacagggaaagacggaucuuuccuuguccgggcuucagagaguauuagccgcgcauacgcccuguguguuuuguaucgaaacugcguguacacuuaucguauauuaccuaaugaagaugacaaguuuacgguacaggcguccgagggugugucuaugagauucuuuaccaaacuggaucaacuaaucgaguucuacaagaaagaaaacaugggccucgucacacaucugcaguauccagugccgcuugaggaagaggacacuggggaugaccccgaagaggauaccguugagucgguggucucaccuccagaacugcccccuaggaauauuccauugacagcuagcaguugugaggccaaggaagugcccuuuuccaacgagaauccucgggcaaccgaaacuucucgcccaagccucuccgagacacuguuccagagacugcagucaauggacaccaguggacucccggaggaacacuuaaaggccauccaagauuaccugagcacgcagcuugcucaggacucugaguuuguaaaaacuggcuccagcagcuugccccaucugaagaaacuaaccacacuccugugcaaggaacuuuauggugagguuauuaggacucugccuaguuuggaaucucuccagcggcuguucgaucaacaguuauccccagggcugcgcccccgaccucaggugccaggagaggcaaaccccaucaauauggucagcaaacucucgcagcuuaccucucuguuguccucaauagaggacaaggugaaggcccuacugcacgaaggcccggagaguccucauagacccagccucaucccaccugugacauuugaagucaaagcugagucccugggcauuccccaaaagaugcagcuuaaaguugauguggaaucugggaagcugaucauuaaaaagagcaaagacggaucagaggacaaguucuacagucacaagaaaaucuugcagcucauaaagucccaaaaauuucugaacaaguuaguaauucugguggagaccgaaaaagagaagauccuaaggaaggaauacgucuucgccgauagcaaaaagcgggaggguuuuugucagcuccugcagcagaugaaaaauaagcacucugagcaaccagaacccgacaugauuacgaucuucaucggcacuuggaacauggggaaugcgccuccaccgaaaaagauuacaucaugguuccuuaguaagggacagggcaaaacccgugaugacagcgcagauuauauaccccaugacaucuacgugauugguacucaggaggauccuuuguccgaaaaggaguggcuggaaauccucaaacacucucugcaggagauaacaucgguuaccuuuaagacgguggccauucauacccuuuggaacauccgcaucgucgugcuggcuaaaccagagcacgaaaauagaauuagccacaucugcacagacaacguaaagacugggauugccaacaccuugggaaauaagggcgcaguuggcguguccuucauguuuaacgggacaucacucggauucgucaauagucaucugacuucugguagcgagaaaaaguuaaggcggaaccaaaauuauaugaacauacugcgauuucuagcucucggcgauaaaaagcugucccccuucaauaucacccaccgcuuuacacaucuuuucugguuuggggacuugaacuacagaguggaucugccuaccugggaagccgagacuauuauccagaaaaucaagcagcagcaauaugcggaccuccugucacacgaccaguuacugacggaaaggcgggagcagaaagucuuccuucauuuugaggaagaggaaauuacauucgccccaaccuaccgcuuugagagauugacuagggauaaguaugcauacaccaagcagaaagcuacaggaaugaaguacaaucuccccagcuggugugaccgugugcuguggaaaucuuauccgcuaguucacgugguaugccaauccuacggcaguaccagcgauauaaugacuucugaccacuccccugucuucgccacauucgaagcuggugugacgucacaguuuguuaguaagaacgggccaggcaccguggauagccagggacaaaucgaguuccugcgguguuaugccacucucaaaacaaagucgcagaccaaguuuuaccuggaguuccauuccucuugccuugaaucauuugucaaaucacaggagggcgaaaaugaggaggggagugaaggagaguuggugguaaaguucggugaaacacugcccaaauuaaagccuauuaucuccgaccccgaguaucuccuggaucagcacauucuuaucucuauaaaaagcuccgacucagaugaaagcuacggcgagggguguaucgcacugcgauuggaggccacugaaacccaacucccaauuuauacgccucugacccaucacggagagcuaacaggccacuuucagggugaaaucaagcugcagacuagccaggggaagaccagagagaaacucuacgacuucgugaagacagaaagggaugagucuuccggccccaaaacucugaagagucuuaccucgcaugacccaaugaaacaaugggagguuacgucacgcgcuccgccuugcucuggaaguuccauuacagaaaucauaaaccccaauuacaugggcgucgggccauuuggacccccuaugccauugcacgugaagcagacccugagccccgaucagcagccuacugcguggucuuaugaccaaccgccaaaggacagccccuuagguccuugccggggcgaguccccacccacaccuccggggcagcccccaauuucaccuaaaaaguuccuccccaguaccgcaaacagaggacugccaccuaggacucaggaaagccgccccucugaucuuggcaaaaaugccggugacacccugccacaagaggaucuaccgcucacaaagccugaaauguuugagaacccccuguacggguccuugucaaguuucccaaaacccgcuccucgaaaggaccaggagagcccaaaaaugccccggaaggaaccuccgccaugucccgagccuggcauccugucccccucuauuguguuaacgaaggcccaggaagcagaucguggagagggcccagggaaacaggucccugcccccagacucaggucguuuaccugcagcucauccgcugagggacgcgccgcaggcggugacaagagucaagggaaaccaaagacuccuguuucuagccaggcgccggugcccgcuaaacggccaaucaagccuuccagaucagaaauaaaccagcagacacccccaaccccuacacccaggccgccacugccugugaagucucccgccguacuucaucugcaacacagcaaaggacgagauuaucgcgacaauacugaguugccacaucacggcaagcaccggcccgaagaggguccuccgggcccccucgggagaaccgcaaugcaguga

SEQ ID NO: 57745 - RNA, 1935 nt, Artificial Sequence
  derived and/or modified sequence opt3 from INPP5E__Homo_sapiens__NP_063945
augcccagcaaggccgagaaccugagaccuuccgaaccagcuccgcagcccccugagggcaggacccuccaagggcagcuuccaggagcacccccugcccagcgggcggguucuccacccgacgcuccuggcucagaaaguccagcccuggcaugcagcacaccggccacucccuccggggaggauccuccagcucgcgcagcccccaucgcuccucgaccacccgcccguccgagauuggaaagggcguuaucucuggacgauaaaggauggcggcgcagaagguuccggggcucgcaggaggaccuagaggcacgcaaugguacgucaccuagccgagggagugugcaauccgaaggacccggcgccccagcucacucuuguagcccucccugccucuccaccucacugcaggagauuccaaagaguagaggcguccuuagcucugaaagggggucccccucaagcggagguaacccucugaguggcguugccucuuccagcccaaauuugccgcaucgggaugcagcuguggccgggucgucuccccgucucccuucccugcugccaccccgcccuccacccgcgcucucauuagacauagccagugauagccugagaacagcaaacaaaguagacuccgaucuugcugacuacaaguugagggcccagccgcugcuagugcgggcucacucuagccucggaccuggccgaccacgcucaccccuggccugugaugacugcagucuuagauccgcaaaaagcucuuuuucacuguuggccccuaucaggaguaaggauguccggagccgcuccuaucucgaggguucucuguuagcuucgggggcgcugcucggagcagacgagcuugccagauacuuccccgacaggaauguggcucuguuuguugccacuuggaacaugcagggccaaaaggaauugccaccuagccuagaugaguuccugcuccccgcagaagccgacuaugcucaggaucuguacgugauuggcguccaggagggguguuccgaccgucgggaaugggagacccgacuucaggagacacugggaccacauuauguguugcucucaagugccgcacacgguguacuguacaugucuuuauuuaucagaagggaucugauuugguucugcagcgaaguugaguguuccaccgugacuacacgcaucgucucacaaauaaaaaccaagggcgcgcuagggaucagcuuuacguucuuuggaacuucuuuccucuuuauuaccucccauuucacaaguggcgacgguaaaguggcugaacggcugcuugauuauacuagaaccgugcaggccuugguccugccgaggaauguuccugacacaaaccccuaccgcagcucugcagccgaugugaccacgcgauuugacgagguauucugguucggggauuuuaauuuccggcucuccggcggacguacuguggucgacgcucugcuuugccagggccuggugguugacgugccagccuugcuccaacacgaucagcugaucagagaaaugaggaaggggucaauuuuuaaaggauuccaggagcccgacauccacuuuuuaccuaguuacaaguucgauauagguaaggacacauaugauagcaccucgaaacagcgcacuccauccuacacagaccggguccuguauagaucuaggcauaagggcgauauuugucccgugagcuacucaaguugcccugggaucaaaaccuccgaccaccgaccgguauauggacuauuucgcguuaaggugcggccaggcagagauaacauuccccucgcagcugguaaauucgacagggagcuguaccuuuuggggaucaagcgucgcaucucuaaagaaauucaacggcagcaggcccugcagagccaaaauuccucaacgauauguagcgucaguuga

SEQ ID NO: 57746 - RNA, 1569 nt, Artificial Sequence
  derived and/or modified sequence opt3 from INPP5F__Homo_sapiens__NP_001230123
augugccacgacgugaucuucauggccuggcugaagcagcaauuuagcgaguguacccucauugaugcuacacauagagacgucgauguucuucuguuguuauccaacucugcauacuauguggccuacuaugacgaugaaguagacaaagugaaucaguaccagaggcugucacuagagaaccucgaaaagauagagaucggccccgaaccuacucuguucgggaaaccaaaguuuaguugcaugcggcuucacuaucgcuacaaagaggcgagcggauauuuccauacgcugcgagcugucaugcguaauccggaggaagaugguaaggacaccuugcaguguauugccgagaugcuccaaaucacaaagcaggcaaugggcuccgaucugcccauuaucgagaaaaagcuggaaagaaaaucuucgaagccucacgaggacauaaucgggauuaggucacagaaccagggaagccucgcccaaggcaaaaacuuuuuaaugaguaaguucuccucucugaaucagaaggugaaacagacuaagagcaauguuaacaucgguaaucuucggaaauuggggaacuuuaccaagccagaaaugaaagugaauuuccugaagcccaaccuaaaagucaaucucuggaaguccgauucaagucuggagacaauggaaaacaccggagugauggacaagguacaggcugagagcgauggcgacaugucuuccgacaaugauucauaccauagcgacgaauuucuuacuaacaguaaaucugaugaggaccgccaacuggcaaacuccuuggagagcguuggcccuauugauuacgugcucccaucgugcgggaucauagccucugcucccagacugggauccaggucacagaguuuaagcuccacagacucuagcguccacgccccuucagaaauuaccguggcgcacgguaguggccuggggaagggacaggaguccccacucaaaaagagcccgucugcaggcgaugugcauauccuuacggguuucgccaaacccauggacauuuauugucaccgguuuguccaagaugcucagaauaagguuacucaucugucagaaacccgcagugugagccagcaggccucccaagagcgaaaccagaugacaaaucagguaucuaacgaaacucagucggagagcaccgagcaaacaccuuccagaccaucacaguuggacgugagucuaucugcaaccgggccccaguuccugagcgucgaaccugcucacuccguggccucacagaagacgccaacuagcgcgucuuccaugcucgagcuggaaacaggacuucacguuacccccaguccgagcgagucuuccucaaguagggccgugagcccuuuugcaaaaauccggucguccaugguccaaguggcuucuaucacucaggccggccugacacauggcauuaauuucgcuguaagcaagguucagaaaucacccccagaaccugagauaaucaaccaggugcaacagaaugaguugaagaaaauguucauucagugccaaacccguaucauacagauuuga

SEQ ID NO: 57747 - RNA, 1347 nt, Artificial Sequence
  derived and/or modified sequence opt3 from INPP5K__Homo_sapiens__NP_057616
augagcuccagaaagcugucuggccccaaagggaggcggcucucaauccacguggucaccuggaacguugccagugcugcaccuccacuugaccugagcgauuuguuacagcugaauaaccgcaaucuaaaccucgacauuuacgugauaggacugcaagagcuuaauuccgguaucauuucucuguugucggaugccgcguucaacgacucauggagcaguuuucucauggauguacuguccccgcugucuuucaucaaggugagccauguccgaaugcagggcauucucuuacugguguuugcuaaauaucagcaccuucccuacauccagauauuguccacaaagucaacuccuacggggcuguucggauauuggggcaauaaaggugggguuaacaucugccuaaagcucuacggauauuacgugaguauuaucaauugucaucugccaccccacauuagcaacaauuaucaacgucuugaacauuuugacagaauccuggagaugcagaacugcgaaggcagggauauaccuaauauuuuggaccacgaucucaucauuugguucggcgacaugaacuuucggaucgaggauuucgggcugcacuuuguccgcgaaucuaucaagaauagauguuacggagguuuaugggagaaagaccagcuguccauugccaagaaacaugauccacuccuuagggaguuccaggaaggccggcuguuguuucccccuaccuacaaguucgaccgcaacucaaacgacuaugauacaagcgagaaaaagcgaaagccagcauggacugacagaauacuauggaggcugaaacggcaaccgugcgccgggcccgauaccccuaucccacccgcuagucacuuuucucucucccugcguggauacagcucgcauaugacauauggcauuucugaccacaagccuguguccgguaccuucgaucuugaacugaaaccauugguaucagcaccccucaucguucugaugccggaggacuuauggacuguggagaaugauaugauggucaguuacagcuccacaucugacuucccuagcucacccugggauuggauagggcuguauaaggugggacuacgcgacgugaacgauuacgucaguuaugccuggguuggcgacuccaaagugagcuguucugacaaucucaaccagguauacauugauaucucaaauaucccaaccacggaagacgaguuucugcuuugcuacuauaguaacagcuugagauccguggucggcauuucuaggccuuuccagauucccccagggucgcugcgggaagauccccucggagaggcucagccucaaaucuga

SEQ ID NO: 57748 - RNA, 3777 nt, Artificial Sequence
  derived and/or modified sequence opt3 from INPPL1__Homo_sapiens__NP_001558
auggccagcgcuugcggcgcacccgggccuggaggugcccugggcucccaggcgccaucuugguaccacagagaccucucaagggcugccgcagaggaacuucuggcccgggcugggcgcgauggaaguuucuuggugcgagacagcgaguccgucgcaggcgccuuugcuuuauguguucuguaucaaaagcaugugcacaccuaccguauccuaccggauggugaagacuuccucgccguacagacaucucagggggugcccgucagaagguuucagacucugggagagcuuauuggccuguaugcgcaaccuaaccagggcuuggugugcgcacuccugcugccaguugaaggggagcgggagcccgauccuccagacgaucgcgacgccucggauggagaagacgagaaacccccucucccaccgagaucagguagcacgaguauauccgcucccaccggcccuucuagcccauuacccgccccugaaacaccaacugcacccgcugccgaguccgcgccgaaugggcugucaaccgugagucaugauuaccuuaagggaagcuauggcuuggaccuggaggccgucagggguggggcaucucaccuaccucaucucacacggacccuggcuacuuccugucgccgacuucacucagaaguggauaaaguacugagcggauuggagauccucaguaagguuuucgaccagcagucuucccccauggugacaagacuguuacaacagcagaaccugccacagaccggcgaacaagagcucgaaagccuuguccugaaauugucggugcuaaaggacuuucugucuggcauucagaagaaagcccucaaggcucugcaggauauguccucaacggccccucccgcaccacaacccaguacuaggaaagccaagaccaucccugugcaggcuuucgaggucaaacuugacguuacacugggggauuugacuaagauuggaaagagccagaaauuuacccucuccguggacguagaggguggccggcugguguuacugcgucgccagagagauucucaagaagacuggacaaccuucacgcacgauaggauccggcagcuaauaaagagccagcgaguccagaauaaacucggggugguuuuugagaaggaaaaagaccgcacucaaagaaaggauuucaucuuugugucagcgaggaaacgggaggcauucugccagcugcuucaguugaugaagaacaagcauaguaaacaggacgaaccagauaugauuuccgucuuuaucggaacauggaauaugggcagcgugccgcccccuaagaacguaaccucuugguucacuucaaaaggucuggggaagacacucgacgagguuaccgugacgauuccacacgacaucuacgucuucggcacccaagagaauagugugggagaucgcgaauggcuggaccuucugagaggcggguugaaagagcucacagaucuggacuauaggcccauagccaugcagagcuuauggaacauuaaggucgcugugcugguuaagccugaacaugagaaucguaucucccacgugucuacuucgagcguaaaaaccggaauugccaacacacuagguaauaagggcgcagucgggguguccuuuauguucaacggaacuucauuuggcuucguuaauugucaccucaccagugguaacgagaaaacagcccggcgaaaucagaacuaccuggauauccuuagauugcugucucucggggacaggcagcugaacgcuuuugauaucagcuuacgcuucacccaucuguuuugguucggcgaccuuaauuaccgguuggauauggacauucaagaaauacucaacuauaucuccagaaaggaguuugaaccacugcuaaggguggaucagcugaaucucgagcgcgaaaaacacaaggucuuccugcgauuuucagaggaggaaauuagcuuucccccgacuuaccgguaugagcguggaucuagagacacguacgccuggcauaagcagaaaccuacaggcgugaggaccaacguaccauccuggugcgaucgcauccuuuggaagaguuaucccgaaacucacauaauuuguaauagcuacgggugcaccgacgacaucgugacaucugaucauuccccuguuuucggaaccuucgaggucggugugacuucacaauucaucaguaaaaagggcuugagcaaaacaucggaccaggcauauauugaauuugaguccaucgaggcgauugugaagacggcuucucggaccaaguucuuuauagaguucuacagcacuugucuggaagaauacaaaaagucauuugagaacgaugcccagaguuccgacaauaucaacuucuuaaaaguccaguggucuagcagacaacuccccacacugaagccaauucuugcagauaucgaauaucugcaggaccagcacuugcuccugaccguuaaauccauggauggguacgagucauauggagagugcgugguggcccuaaagagcaugaucggcaguacagcucagcaauuucugacuuuccucucucacaggggugaagagaccgggaauauucgaggcuccaugaaaguacgcgucccuacggaacggcugggaaccagagagaggcuuuacgaauggauaagcaucgacaaggaugaggccggcgcaaagucgaaagcucccucagugucucgugggagucaggagccacgcuccggaagccggaagccggccuuuacagaagcgucuuguccuuugagcagacuguucgaggaacccgagaaaccacccccuacuggcaggccacccgccccuccgcgagcugcaccacgggaggaacccuuaaccccucgccucaagccagagggugcccccgaaccugaggggguugcugccccgcccccuaaaaacuccuuuaauaacccagcauauuacgugcuggaaggagucccccaucagcuucugccaccugagcccccaucaccggcgagagccccugugcccagugcuacaaagaauaagguugccauuacugugccagcaccccagcuaggccaccauaggcacccucggguaggugagggcucuagcuccgacgaagagucagggggaacccucccacccccugauuucccgccacccccucugcccgacagugcuaucuuuuugccaccuagccuggaucccuuaccaggcccugucgugcgagggagaggaggcgccgaagcacgcgguccgcccccaccuaaagcccaccccaggccaccucugcccccggggccauccccugcuucuacguuccucggagagguggcgucgggcgacgaccguagcugcucaguccuucaaauggccaagacacuguccgaaguugauuaugcacccgcugguccagcccggagugccuugcuccccggcccucuggagcuacagccgcccagagggcugccaucugacuacggaaggccucuuagcuuucccccuccacgcauucgagaguccauccaggaagaucucgcugaggaagcacccugccugcaaggcgggagagccucaggauugggcgaggcggguaugucugcuuggcugcgggccauaggguuagaaagguacgaggagggacucgugcauaacggcugggacgaucuggaguuccuuagcgacaucaccgaagaagaucuggaggaggccgguguacaggacccugcacacaaacgcuugcuccuggauacucuacagcugaguaaguga

SEQ ID NO: 57749 - RNA, 1740 nt, Artificial Sequence
  derived and/or modified sequence opt3 from INSC__Homo_sapiens__NP_001027024
augagaaggcccccuggcaacggggaagccgcuagcgaaggaccagguggcugggggcuguggggagugcaggagucccggcgccucugcugugcaggccacgaccgaugcaagcaagcccuucugcagaucgguauuaauaugauggcguugccugggggacgucauuuagauucugucacccugcccggccagagacuacaccucaugcagguugacucagugcaaagguggauggaagaucugaaacuuaugacagagugugaaugcauguguguacugcaggcuaagccuauaaguuuggaggaggacgcccagggcgaucucauccuggcagggggaccaggucccggcgacccucugcagcucuuacugaaacgggggugggugauuagcacugaacuucgcagaaucggacaaaaguuggcccaggauaggugggcucggguccauuccaugucugugcgccugacgugccacgcacgaucgaugguuucagaguacagcgccgugaguagaaacucccuaaaagaaaugggcgagauugagaagcuccugauggaaaaguguucugagcuuagcgcugucaccgaaaggugccuucagguggagaaugaacauguauugaaauccaugaaggccuguguuucagagacacucaguaugcugggucagcacuucgggcaauuacuggagcucgcgcuuacucgggaagugcaggcacugguccguaaaaucgacgccagcgauaacauauauaccacagagucuaccacuggaaauuuguuuucccuaacacaggaaggcgcuccacugugccgcaucauugccaaggagggcggggugguggcacucuucaaagucuguagacaagacucauuuaggugccuguacccccaggcucugcggacccuggccagcaucugcuguguugaagagggagugcaccaguuggagaagguagauggugugcucugccuggcggacauuuuaacggauaacagucauucugaagccacucgagcagaggcugccgcugucguggcccagguuaccuccccucaccuuccagugacacaacaucuaagcucguuccucgaaucuauggaggaaaucgucacugcacuggugaagcugugucaggaggccuccucaggcgagguauuuuugcuggcuagugcggcacucgccaauauaaccuucuuugacacaauggcuugcgaaaugcugcuucagcugaacgccauucgcguuuugcucgaggcauguagcgacaaacagagaguggauaccccguauacgagggaccaaaucgucacuauucuggccaauauguccguguuagaacagugcgcuucugauaucauccaggagaacgggguccagcugauuaugggaaugcuaagcgagaagccccggucaggcacaccggccgaaguggcagcgugugagcgcguucaacagaaagcugccgugacccucgcaagacugaguagggacccagauguagcccgugaagcuguccggcuuuccugcaugagccgauugauagagcuguguagaucucccucagaaaggaauaguagcgacgccgugcucguugcaugccuggcugccuuacgccggcuggcggguguguguccugaggggcuucaggauuccgacuuccagcaauugguccagccaagacucguggauucuuuucugcuaugcucgaacauggaggagagcuucguauga

SEQ ID NO: 57750 - RNA, 333 nt, Artificial Sequence
  derived and/or modified sequence opt3 from INS__Homo_sapiens__NP_001278826
auggcccuguggaugagacuccuuccccuguuggcuuuacuggcacuauggggcccugacccagccgcggcuuucgugaaccagcaccucugcgggagccaucuggucgaggcccuuuaccugguuuguggagaaaggggcuuuuucuauaccccgaagacacggcgcgaggcagaagauuugcaagugggucagguagagcucgggggaggccccggugccgggucccugcagccucuggcucucgaaggaucuuuacagaaacgaggcaucguggagcaaugcuguacuucaauuugcagucuguaccagcuugagaauuauuguaacuga

SEQ ID NO: 57751 - RNA, 834 nt, Artificial Sequence
  derived and/or modified sequence opt3 from INSIG1__Homo_sapiens__NP_005533
augcccagacugcacgaccauuucuggagcugcuccugugcccacucugcuaggcggcgcggcccuccacgagcaucagccgcggggcucgcugccaaggugggagagaugaucaacgucaguguuagcgguccgucccuucuggcagcccauggcgcucccgaugcagacccugccccacgugggagaucugcugccaugucgggacccgaaccuggcucaccauaccccaauaccuggcaccauagguuguuacagcggagccuggugcuauuuaguguaggugugguccucgcgcuggugcuuaaccuguugcaaauucagcgcaauguuacacucuucccugaggaagugauagcaacuaucuuuuccucugccuggugggucccaccgugcugugggacggcugccgcagugguaggacugcuguaucccugcauugauagccaccucggcgagccucacaaauucaagagagaaugggcuuccguuaugagguguaucgccguguuugucggcauuaaccaugcgucagccaaauuagacuucgcaaauaacgugcagcugagucuuaccuuggcugcccugagccuagggcucugguggacauuugaucggucucgcuccggacugggucuuggcaucacuauagcuuuccuggccaccuugaucacacaguuucucguguacaauggggucuaucaauacaccucaccagacuuccuguauauucgaagcugguuacccugcaucuuuuucaguggaggcguuacuguggguaacauugggagacagcuggcaaugggaguaccugagaagccacacucugauuga

SEQ ID NO: 57752 - RNA, 678 nt, Artificial Sequence
  derived and/or modified sequence opt3 from INSIG2__Homo_sapiens__XP_011509594
auggccgagggcgagaccgagagccccgggccuaagaaaugcggaccauacaucuccucugugacaucacagagugucaaccugaugauuagagguguuguguuguucuuuauaggcguauuccuugcucugguguugaauuuacugcaaauccagaggaacgucacucuauuuccgcccgacgugauugcaagcaucuucuccucugccugguggguuccuccauguugcgggacggcgucggcugugauuggacuccuguaucccuguaucgaucggcaccuuggcgaaccucauaaguuuaaacgcgaguggucaagcgucaugcgaugcguggccguauucguugguauaaaucacgcaagugccaagguggacuuugauaacaauauccagcuguccuugacccucgcugcacugucuauugggcugugguggacauucgaccguagcagauccggauuuggccucggcgucgggaucgccuucuuagcuacuguggugacccagcugcuugucuacaacggaguuuaucaauacacaucaccagauuuucucuaugugaggaguuggcugcccuguauuuucuuugccgguggcaucaccauggggaauauaggacggcagcuagcgauguacgaaugcaaaguaauugcagaaaagagccaucaggaguga

SEQ ID NO: 57753 - RNA, 603 nt, Artificial Sequence
  derived and/or modified sequence opt3 from INS-IGF2__Homo_sapiens__NP_001035835
auggcccuguggaugagacuccuuccccuguuggcuuuacuggcacuauggggcccugacccagccgcggcuuucgugaaccagcaccucugcgggagccaucuggucgaggcccuuuaccugguuuguggagaaaggggcuuuuucuauaccccgaagacacggcgcgaggcagaagauuugcaagccuccgcucucucucugucaaguagcacuuccacguggcccgagggccuggacgcaaccgcccgagcuccuccagcccucgugguaacagcgaauaucgggcaggcaggagguucuucgucacgucaguuuagacagagggccuuagguacuagcgauagucccgugcuguucauucacugcccuggggcugccggaaccgcacaaggccuugaauaccggggccgcagagucacaaccgaguuggugugggaggaaguugacuccucuccacagccccaggggagcgagucccugccugcucagccaccggcccaacccgcgccucagccagaaccccagcaggccagggagccuucaccagaggugaguuguugcggacuauggccccggcgcccgcaacgaagccagaacuga

SEQ ID NO: 57754 - RNA, 474 nt, Artificial Sequence
  derived and/or modified sequence opt3 from INSL3__Homo_sapiens__NP_001252516
auggaccccagacugccugccugggcucucgugcuucugggcccagcauuggucuucgccuuagggccggcgcccaccccugagaugagggaaaagcugugcggacaccauuuuguucgggcucuagugcgcguaugugguggcccacgauggagcacagaggcccguagacccgcaacugggggagaucagagggaaucccacucugugucacaagccggccucaaacugcuuaguagcuccaacccuccaacgcugaccuuccagucugucgguaucucggacgugucaugcuacagcggguggcgggaugacauuuguaguaugggaugguggcccacaguuauaucccgcugggauuuggcuugcucuccuuguccaagaccgcucacuaucaccgcaacaaccgugcagcugcccccuacucugcaugccacagcugccagcgucgcggugccaaauaagaccugcuga

SEQ ID NO: 57755 - RNA, 420 nt, Artificial Sequence
  derived and/or modified sequence opt3 from INSL4__Homo_sapiens__NP_002186
auggccagccuguucagauccuaccuccccgcuaucuggcuucuguugucucaguuacugagggagucacuagcagccgaacuccggggcugcgggccucgcuuuggaaagcaucugcuuaguuauuguccaaugccggagaaaaccuucacaacuacgcccgguggcuggcuguuggaaagcgggcgaccuaaggagaugguguccaccucuaacaauaaagacggacaagcgcucggcacaacuucggaauuuauuccaaaccugucacccgagcugaagaaaccucucagcgagggucagccaaguuuaaagaagauaauccugucccguaaaaagagaucugggaggcaccgguucgaucccuuuugcugugaagucauuugcgacgauggaaccagcguuaaacuuuguacauga

SEQ ID NO: 57756 - RNA, 642 nt, Artificial Sequence
  derived and/or modified sequence opt3 from INSL6__Homo_sapiens__NP_009110
augcccagacugcucaggcuuagccuguugugguuaggccugcuacucgugcgguucucccgcgagcugucugacaucucaagugcccgaaaacuuugcgggcguuaccuggucaaggaaauugagaaguuguguggacacgcuaacuggagccaguuuagauucgaagaggaaaccccuuuuuccaggcucauagcacaagccucugagaaaguugaggcguauucgccauaccaguucgaaucaccgcagacagcuagccccgcccggggucgcggcacuaauccugugaguacguccugggaggaagcaguaaacucuugggagaugcagagccugccagaguauaaggauaaaaagggguacucaccccugggaaagaccagagaauuuuccaguagccauaauaucaacguguauauucacgagaaugccaaauuccaaaagaaaaggcggaacaagaucaaaacacucucuaauuuauuuuggggccaucacccucagcgcaagcgaagagguuacuccgaaaagugcugucugacugggugcaccaaagaggaacuuucaauugcuuguuugccauauaucgacuucaagaggcugaaagagaagcggagcagucuagucacaaaaauauacuga

SEQ ID NO: 57757 - RNA, 1533 nt, Artificial Sequence
  derived and/or modified sequence opt3 from INSM1__Homo_sapiens__NP_002187
augcccagaggcuuccuggugaagaggagcaaaaaguccaccccugucucuuaccggguucgcgggggagaggacggugaucgagcccuccuucugucaccaaguugcggcggggcucgugcagaaccgcccgccccuagcccagugcccggaccuuugccacccccuccaccggcggagagagcucacgccgcauuagccgcugcacuggccugugcucccggcccucagccacccccucaagguccaagggccgcgcauuuugggaaccccgaagcagcccacccggcuccucuauauucccccacacggccaguaucucgcgagcaugaaaaacacaaguacuucgagagaucguuuaaucucggaucaccugugagcgccgagaguuuccccacuccagcagcucugcuuggcggcgggggagguggcggggccuccggagcgggcggugggggaacgugcggcggcgacccccuguuguuugccccugcagaacucaaaauggggaccgcuuucucugccggagcugaggccgcaagggguccaggcccggggcccccucugccacccgccgcugcgcugcggccuccaggaaagcgacccccgccuccaacagcagccgaacccccugcuaaggccgucaaagcacccggcgccaagaaaccaaaggcuauccgcaaacuccauuuugaggaugaggugacuaccagcccuguuuuaggucugaagauuaaggaagggcccguggaggccccaagaggcagggcaggaggcgcggcucggccgcuuggggaguucauaugucaguugugcaaagaagaauaugccgacccuuuugcacuggcccagcacaaguguucccguaucguccgcguggaguacagaugccccgagugugcuaaaguauucucaugcccagccaaccuagcaagucacaggcgguggcauaagccccgaccugcuccagccgcggcccgcgcucccgaaccugaggcagccgcuagagccgaagcaagggaggcgccgggagguggcagcgaucgggacacaccaucucccgggggaguuuccgaaucaggcagcgaggauggucucuaugagugucaccauugcgccaaaaaguuucgcagacaggcuuaccugaggaaacaccuucuggcccaccaucaagcauugcaggcuaagggggccccucucgcaccacccgccgaagaccuguuagcucuguauccuggcccggaugagaaggcgccccaggaagccgcaggagacggcgagggggcuggagugcucggucuuagugccucugccgaaugucaccugugcccagucugcggcgaguccuucgcuagcaaaggggcacaggagcgucauuugcggcuacugcacgccgcgcaaguguuuccuuguaaguacugccccgcuaccuucuacucgucuccaggacucacucgacauauuaauaaaugucacccuuccgaaaacagacaggugauccugcuucagguccccguuaggccagccugcuga

SEQ ID NO: 57758 - RNA, 1701 nt, Artificial Sequence
  derived and/or modified sequence opt3 from INSM2__Homo_sapiens__NP_115983
augcccagaggcuuccuggugaagaggaccaaacggacagggggacucuaccgcguccgacuugccgagcguguuuuuccucuguuggguccacagggcgcuccgcccuucuuagaagaggcaccuagcgccucccugccaggggcggaaagagcuacucccccuacgagggaggaaccaggaaagggccuaaccgccgaggcagcccgggagcaaucugguucacccugccgcgcugcaggggugaguccuggaacaggcggcagagaaggggccgaguggagggcuggaggucgggaaggcccagggccgagccccuccccuucuccaucgcccgccaaaccugcgggagcagagcuccgccgagccuuucuggagagaugucuuucaagcccaguaagugcugaauccuuccccggcggugccgcagcuguggccgcguuuucuugcagcgucgccccggcagcugccccuacucccggggagcaguuccuguugccacucagggcuccuuuucccgaaccagcccugcagcccgacccugcaccacuguccgccgcucuccagucauuaaagcgggcggcaggaggcgagcgucgcggcaaagccccgaccgauugugcuagugggcccgccgcagccggaaucaagaagccuaaagcuaugagaaagcugagcuucgccgacgaagugacaaccucuccaguucuugguuugaaaauuaaggaggaggaacccggcgcaccuuccagggggcugggaggcucacggacuccacuaggugaguuuauaugccaacucuguaaagaacaguaugcggaucccuucgcucuggcccagcaccgaugcagccgcaucgugagagucgaguacagguguccggaaugcgacaagguguuuaguuguccugcaaaccuugccucucaucggcgcuggcacaagccaagacccgcugccgcaaaugcugccacaguauccagcgcggaugggaaaccucccucgucuuccucaaguagcuccagggacucuggcgccauugcuagcuuccuggcagagggaaaggagaacucacguaucgaacggaccgccgaucagcauccacaagcucgagacaguuccggcgccgaucagcacccugacagcgcacccagacagggguugcagguucucacgcauccagagccgccucugccccaaggaccauauacugaagguguguuaggcaggcgcguccccgugccugggucuaccucaggaggccgggguagugagauuuuugugugcccauacugucacaaaaaguucagaaggcaggcguaucugcgcaaacaccucagcacacaugaagccggguccgcucgagcccuugcacccggcuucggaucugagcggggcgcuccucuggccuuugcaugcccguugugcggggcccacuucccaacugcugauauccgugagaagcauagacuauggcacgcggucagggaggaacugcuccugcccgcccuugcaggagcuccuccagaaaccucgggucccagcggcccuuccgacgggucagcccagcaaauauuuaguuguaaacacugcccgucuacauucuuuagcucccccggacugacccgccauaucaauaagugucacccaucagagagccggcagguuuugcuccugcagaugccuuuaagacccggcugcuga

SEQ ID NO: 57759 - RNA, 4149 nt, Artificial Sequence
  derived and/or modified sequence opt3 from INSR__Homo_sapiens__NP_000199
auggccaccggcgggagaaggggagcugcagccgcgccccugcucguggcugucgccgcacuucuguugggugccgcuggccacuuauacccuggggagguuugcccaggaauggacauccggaacaaucugacacgccuacaugaacucgagaacuguagcgugauugaaggccaucugcagauacuucugauguucaagacucgaccggaggauuuucgugacuuguccuuccccaaacucaucaugauuacggauuaucugcugcucuuuagaguauacgguuuagaaucucugaaggaccuuuucccuaauuugaccgugaucagggggucacggcuguuuuucaacuaugcucuagucauuuuugagauggugcaccucaaagagcugggacuuuacaaucugaugaacaucacacgcggcaguguuagaauagaaaagaauaacgaguugugcuaucucgccacuaucgauuggagcaggauucuggacuccguggaagauaauuacaucgucuuaaacaaagacgauaaugaggaguguggcgacauuugcccagggaccgcuaagggaaagacaaacugucccgccaccgugaucaauggucaauucguagaacggugcuggacucacucucauugucagaaaguuugcccuacaauauguaagucgcacggcugcaccgcggaggggcuguguugccacucagaaugccucggaaacuguagccagccagaugaccccacgaaaugcguggcaugucgcaauuuuuaucuugauggccgaugcgucgagacuuguccuccaccguacuaccauuuccaggacuggagaugcgugaacuuuaguuucugucaagaccugcaccauaagugcaaaaacuccaggcggcaggguugucaccaguaugugauucacaauaacaagugcauccccgaauguccuucuggguacaccaugaauagcuccaacuugcuaugcacaccaugccugggacccuguccuaaggucugccaucuccuggagggcgagaaaacuauugauucaguuaccagugcccaggaacuucguggcuguacagugaucaaugggagccugaucauuaacauacgcggagguaauaacuuggcugccgagcucgaagcaaaucugggcuuaaucgaggaaauuucuggguaucugaagaucagaagguccuacgcucuaguaucacucagcuuuuuccggaaacugcgacuuauacgcggagagaccuuggagauuggcaacuauaguuucuacgcccuggacaaucaaaaccucagacagcugugggauuggucuaagcacaaucuuacgaucacucaggguaaacuguuuuuccauuauaacccaaaguugugccucuccgaaauccacaaaauggaggaagugagcgggacaaagggcaggcaggagcggaaugacauugcgcugaagaccaacggagaucaagccucgugugaaaacgaguuacugaaauuuucuuacauccgcacuuccuucgacaagauucuacucagaugggagcccuacuggccgccugauuuuagggaccugcuuggcuucauguuguuuuauaaagaagcacccuaccagaaugucacagaguucgaugggcaggacgcuugcggaucaaacaguuggaccgugguugauauagacccaccucugcguagcaaugaccccaagucccaaaaccauccagguuggcucaugcggggccugaaacccuggacgcaguaugccaucuuugugaagaccuuagucacauucucugaugaacgaagaacuuacggggcuaagagcgacauuaucuaugugcagaccgaugccacaaauccuucaguaccacuggacccgaucaguguuuccaacaguucuucacagauuauacuuaaauggaagcccccuagugauccaaauggaaacaucacucacuacuugguguuuugggagaggcaagcagaggacagcgaacucuucgagcuggauuauugucuaaaaggccugaagcuccccucccgcaccuggucuccuccauuugaaucggaggacagccagaaacacaaucaguccgaauacgaggauucagccggugagugcuguaguugccccaagacagacucucagauucugaaggaacuugaggaaagcuccuuccggaaaaccuucgaggauuacuugcauaacgucguguuugucccgagaaagacuucaagcgggacgggcgcugaagacccuaggccaucucgcaaacgacggucccugggagaugugggcaauguuacaguggcgguacccaccgucgcagccuucccuaacacuagcagcaccucugugcccacauccccagaggagcaccguccuuuugaaaagguugugaauaaagagucauuagucaucagugggcucagacauuucaccggauauaggauugaacugcaagcauguaaccaggacacucccgaggaacgcugcagcguggccgcauacguaucggcccggacaaugccagaggcuaaggccgacgauaucguggguccgguuacgcacgagauauuugaaaauaacgucgugcaccuuauguggcaggagccuaaggaacccaacggccugaucguguuguaugaggucuccuacagaagguauggggacgaggaacuccaucugugcguuucucgaaaacacuucgcacuagagcgcggaugucggcugagaggccucagcccagguaauuacucagugaggauucgugcgaccagucuggcugggaacggcuccuggacugaacccacauauuuuuacgugaccgauuaccuugacguaccuucuaauaucgccaagauuaucauaggaccauugauuuucgucuuucuguucagcgugguuaucggcuccauuuauuuauuucuccgcaaacggcagcccgaugggccucugggaccgcuuuacgcaucaagcaacccagaguaucugagugccucugacguguuccccugcuccgucuacgugccugaugaaugggagguuagcagagagaagaucacacuacucagggaacugggccaagguucguuugggaugguguaugagggaaaugcucgagacauaaucaaaggcgaagccgagacucggguagcagucaagaccgugaacgaaucagcuucuuugcgcgagagaauugaguuccugaaugaagccagugugaugaaagguuucacgugucaucacgucguuagguuacucggcgugguauccaaggggcagccaacccugguggucauggagcuuauggcgcauggagaucugaaaagcuacuugcggucucuccgacccgaagccgagaacaauccuggcagaccgcccccaacacugcaggaaaugauccagauggcugcagagauugccgacgggauggcuuaucuaaacgccaaaaaguuugugcaccgcgaucuggcagcgaggaauugcaugguugcccacgacuucacugugaaaaucggagauuuuggcaugacccgugacauauacgagacagacuacuaucggaagggugggaaaggacuucucccugucagauggauggcucccgaaagccugaaggauggcguguucacuaccuccucagacauguggaguuuugguguuguguugugggagauuacgagccuggccgaacaaccauaccagggcuuaucuaacgagcagguccucaaguucguaauggaugggggauaucuggaccaaccugauaauugucccgagagggugacagaccuuaugcgcaugugcuggcaguuuaacccaaaaaugcgaccgaccuuccuggaaaucguuaauuugcucaaggaugaccugcauccuuccuuucccgaggugucauucuuucacagugaagagaacaaagcaccagaaagcgaggagcuagaaauggaguucgaagauauggagaacgucccccuggacagauccucucauugucagcgggaagaggcuggcgggagggauggaggcucgagccuugguuucaagcgcucauacgaggaacacaucccuuauacucauaugaaugggggaaagaagaacggccguauucucacacugccaagauccaaucccaguuga

SEQ ID NO: 57760 - RNA, 3894 nt, Artificial Sequence
  derived and/or modified sequence opt3 from INSRR__Homo_sapiens__NP_055030
auggccgugcccagccuguggccuuggggcgcuugccucccagucaucuuccuuucccugggguuuggauuggacaccguugagguguguccgucuuuagauauuagaucagaaguagcagagcugaggcagcuagaaaacugcaguguggucgagggucaccuccaaauacugcuuauguucacagccacuggcgaagacuuucgggggcugagcuucccccgcuugacccaggugacggauuaccuccugcuguuucgaguuuauggacucgaguccuuacgugaccuguucccuaaucuugcggugaucagaggcacaagguuguuucuggguuacgcucuagucauuuucgagaugccacaucuccgggauguggcccugcccgcacuuggggccguacugcgcggagcuguuagaguggaaaagaaccaggaguugugucaccucucuacuaucgacuggggccuguuacagccugcaccaggcgccaaucauauugucgggaacaaacugggagaagagugcgcugaugugugucccggugugcucggcgccgcgggggagccuugcgcaaagaccacauuuucgggacacaccgacuauagguguuggacuucaagccauugccaacgggucuguccaugcccgcacggcauggccuguacagcucgcggugaaugcugccacaccgagugucuugggggaugcagucagcccgaagauccucgagccuguguugcaugcagacaucuguacuuccagggcgcuuguuugugggccugcccacccggcacguaucaguacgaguccuggaggugugugacugcggaacggugcgccucucuacacagcguaccugggcgugcauccaccuuuggaauccaucaagguucaugucuggcucagugcccaaguggcuucacacgcaauuccucuuccauauuuugucacaaaugcgaggggcucugccccaaggaguguaaagugggaacuaagaccaucgacucaauucaggccgcucaggaucuggucggcugcacacacguggaagguagccuuauccugaacuugagacaaggguauaaucucgagccgcagcugcagcauaguuuaggccugguugaaaccauuacgggauuccuaaagaucaaacacucuuucgcccucgugucccugggcuuuuucaagaaccuuaaauugauaaggggagacgcaauggucgaugggaauuacacucuguacgugcucgacaaccaaaaucugcagcagcuugguagcuggguagccgcuggccugacaauuccuguugggaagaucuauuuugcguucaacccccgguugugucucgagcauauuuaccgacuggaagaggugaccggaacucgcggcagacagaauaaagcagagaucaacccaaggacaaauggugaccgggccgcuugccaaacccgcacguuaagauuugucucgaacgugaccgaagccgauaggauccugcuacguugggagcgguaugaaccucucgaggcacgagaccugcuuucuuucauugucuacuauaaggaaucccccuuucagaacgccacagagcacguggggccagaugcuuguggcacucagucauggaauuugcuggacguugagcucccccugaguagaacccaggaaccuggagugacauuagccagccugaagccauggacucaauacgcaguauucgucagggcgauaacccuuacaaccgaggaagauuccccgcaucagggcgcucagucucccaucguguauuugcgcacucucccugccgcaccaacgguuccccaggacgugauuagcacaucaaacaguuccagccaccuucuaguccgguggaaaccuccaacccaaagaaaugggaaccugacuuacuaccucgugcuguggcagaggcuugccgaggauggagacuuguaucugaaugauuacugccaccgcgguuuacgacuccccaccucuaacaaugacccgcgguuugauggcgaggacggggacccugaagcugagauggaaucagauuguugcccaugucagcaucccccucccggacagguacugccaccucuugaggcccaagaagcaaguuuccagaagaaauuugagaacuuccugcacaaugcuaucacaauacccauuagcccauggaaggugaccuccaucaacaaaucuccgcagcgugacucgggcagacauaggcgcgccgcggguccuuugcggcucgggggcaauagcuccgauuuugagauccaagaagacaagguucccagagagagggccguccugucaggacuacgacacuucacugaauaucgcauugauauccacgcuugcaaccaugcagcccacacagugggcuguagugcugccacguucguguuugcacggaccaugccacauagagaggcggacgggauucccggaaaagucgccugggaagcuagcagcaagaauagcguucugcucagguggcuggagccuccagaucccaacggccuuauauugaaguacgagaucaaauaucgucgccugggugaagaggccacuguguuaugcgugucacggcucagauacgcaaaguucgggggaguacaccuggcucugcugccuccgggcaauuauagcgccaggguccgagcaacaucucuagccgguaacggcuccuggaccgacaguguggcuuuuuacauucucgggccagaagaggaagaugcgggaggccugcauguuuugcugacagccacucccgugggguuaacccuccugaucguccuugcagcucugggauucuuuuacggcaaaaagcggaaccgcacguuguaugccagcgugaauccugaguacuucucugccuccgacauguauguuccagaugagugggaagugcccagagagcagaucucaauuauaagggaacucggucaggggaguuuuggaaugguauacgagggccuggcucggggucuagaggcaggcgaagagagcaccccugucgcccugaaaacagugaacgaacuugcgucgccgcgagagugcaucgaguuccucaaggaggcuuccgugaugaaggccuuuaaaugucaccacgucguuagacuguugggggugguaucucagggacaacccacucuggugauuauggaguuaaugacccgcggcgaccucaagagccaucugaggucacuucguccagaagcagagaauaacccugggcugccccagccagccuugggagaaaugauccagauggcuggcgagauugcagaugguauggccuaucucgcggcuaauaaauucguccaccgggaccuggccgcaagaaacugcauggugagucaggacuuuacaguuaagaucggggauuucggaaugacuagggacguguacgaaaccgauuauuaccgcaaaggcgguaagggccuacugccuguccgauggauggcccccgagucccuuaaggacgggauauuuacgacacauucugauguguggagcuucggaguugugcucugggagaucgucacccuggcugaacaaccauaccagggcuuguccaaugagcagguauuaaaauucgugauggacgggggaguucuggaagaacucgaaggcuguccgcugcagcuucaagagcugaugucaagaugcuggcagccuaacccccgguugaggccaucuuuuacucacauucuagauaguauccaggaggaacugcgccccucuuuccgucuccuguccuuuuauuacagcccugaguguagaggugcccgggggucgcuuccaacaaccgacgcagaacccgauucaucuccuacuccgagggacugcaguccacaaaauggaggccccggccauuga

SEQ ID NO: 57761 - RNA, 1389 nt, Artificial Sequence
  derived and/or modified sequence opt3 from INTS12__Homo_sapiens__NP_001135943
auggccgcuaccgugaaccuggagcucgaccccaucuuccuuaaggcacugggcuuuuugcacagcaaauccaaggauucugccgaaaaauuaaaggcgcugcuagacgagucacucgcuagagggauugauaguagcuacaggccuucccagaaagacgucgaaccaccgaagauaucuucgacaaagaauaucucaauuaaacaagagcccaagaucagcaguucccugccuucuggaaacaauaacgguaaaguucuuacuacggaaaaggugaaaaaggaggccgagaagcggccagcagauaaaaugaaaagcgacauuaccgaaggcguagauauccccaaaaagccucgccuggagaaaccagaaacacaguccucacccauaacugugcagaguagcaaggacuugccuauggccgaucucucuuccuucgaggagaccucagcugacgauuuugcaauggaaauggggcuggccugcgucgugugucgacagaugaugguugcuagcggaaaucaacugguggagugccaggaaugucauaaccucuaucaccgugacugccauaaaccacaggucacagauaaggaggccaaugacccgagauuagugugguacugugcgaggugcacccggcagaugaagcgcauggcacaaaagacucagaagcccccucagaaaccagcccccgcuguaguuagugugaccccugccgucaaggacccacuggugaaaaagcccgaaacaaaacuuaagcaggagacgacuuucuuggcauuuaagagaaccgaggugaaaacaucuacugucaucuccggcaacagcucgucugcuuccguuucaaguagcgugaccuccggucugacagggugggccgcguucgccgcaaagaccucuagcgcuggaccgucaacggccaaacuaaguuccacuacacaaaauaacaccggcaagccugcuacuagcucugccaaucagaagcccguaggccucacagggcuggcaaccucaaguaaaggagguauuggcagcaagaucggguccaacaauucuacgaccccaacagugccucuuaaacccccacccccucugacuuugggaaagaccggccucucgaggagcgucuccugugauaacgugucaaaaguuggucugccaaguccgucuagcuuagugcccggguccucaagccagcugucuggaaauggcaacuccggcacaagugggccuagcggaucuacuaccuccaagacaaccucagaaaguagcucguccccaucugccagccucaagggucccacuucacaagagagucagcuuaacgcuaugaaacggcugcagauggucaagaaaaaggcggcacagaaaaaguugaaaaaguga

SEQ ID NO: 57762 - RNA, 6573 nt, Artificial Sequence
  derived and/or modified sequence opt3 from INTS1__Homo_sapiens__NP_001073922
augaaccgagccaagcccaccacagugaggcggccuagcgcugcagccaaaccauccggccacccgcccccuggggacuucaucgcgcugggaucuaagggucaggcuaaugagucaaaaacugccaguacgcuccuuaagccagcacccagcggccugccuuccgaacgcaaacgagaugccgcugcagccuugucuucggcuucagccuuaaccgggcugacaaagcguccaaagcuaagcaguacucccccucucuccgcgcugggaagacuugcagaggccgcugucgccgagaaaagggcaauuucuccaagcauaaaggagccguccguugugcccaucgaaguacugccuaccguguugcucgacgagauugaggcugccgaacuggagggcaacgaugaccggaucgaagguguccugugcggggcggugaaacaacucaagguuacacgcgccaaaccagauucaaccuuauaucugagucuuauguauuuggcaaagauuaagcccaauaucuuugcuacugagggagugauagaggcccuguguagccuacucagaagggacgcuucuaucaacuucaaagccaagggcaauucccuggucucagugcuugcaugcaaccuguugauggccgcuuacgaagaggaugaaaauuggccugagauuuuuguaaaaguuuauaucgaagacagccucggcgagcggauuuggguggauaguccacacuguaagacauucgucgacaacauccagaccgcguuuaauacgcgcaugcccccgcgaucugugcuguuacagggggaggcaggaagaguggccggugaucugggcgcuggguccagcccucaccccucgcucacugaagaggaagacucucagaccgagcuucugauagccgaagagaaauuguccccagagcaagaaggacagcuaaugccuagguacgaggaacuggcagagucagucgaagaguauguucucgauaugcugcgggaccagcuuaaccgucgccagcccauugacaaugugaguagaaaccuguugaggcuccugacaagcacuugcggcuacaaggagguacgguuacuggccgugcaaaaacuagaaauguggcuccagaauccaaagcugacccgacccgcucaggaucuuuugauguccgucuguaugaacugcaauacacaugguucugaggacauggaugugaucagccaccugauuaagauccgccucaaaccuaagguucugcuuaaccauuucaugcuguguaucagagaauugcucucagcccacaaagacaaccuggggaccacgauuaaguuagugauauuuaaugagcugaguuccgcaaggaacccaaauaacaugcagguccuauauacugcgcuccaacacagcucugagcuggcuccgaaauuccuugccaugguguuucaggauuugcugacaaauaaggacgauuaccuccgggcaucacgcgcccuguuaagagaaaucauuaagcagaccaaacaugagaucaacuuccaggcuuuuugccugggacuuaugcaggaaaggaaggagccccaguacuuggaaauggaguucaaagagcguuuuguaguucacauaacugacgugcucgccgucaguaugaugcugggcauuacagcacaggugaaggaagcuggcaucgccugggauaaaggggagaagcggaaucuagaaguccugaggagcuuccaaaaccagaucgcggccauucagagagacgcugugugguggcuccauaccguugugccuuccaucucuaagcuggcaccaaaagauuauguacacugucuucacaaggucuuguucacggagcagcccgaaaccuacuauaaaugggacaauuggccuccagagucggacagaaacuuuuuccugcgcuuaugcagcgaggugcccauucucgaagauacacugaugcggauacuuguuaucggacuguccagagaguugccgcucgguccugccgacgcuauggaacuggccgaucaucuagugaagagggcagcggccguccaagcugacgauguggagguacugaaagugggccgcacucagcucauugacgccguucugaaucuuuguaccuaccaccauccagaaaacauccaguugcccccuggguaucagcccccaaaucuggcaaucucaacauuauacuggaaggcuuggccucuccugcuugucguggccgcauuuaaccccgagaauauuggacuggccgcuugggaggaauauccaacucuaaagaugcucauggagauggugaugaccaacaacuacaguuacccgccuugcacacugaccgaugaagagacucgaacggagauguugaaucgggaacugcaaacagcgcagcgugagaaacaggaaauauuagccuucgagggccaccucgcagcugccucuaccaagcagacuaucaccgaaagcuccucacugcuucugagccaauugacaucucucgacccccaggguccacccagaaggccuccaccccauauucuggaucaggucaaaucccuaaaccaaagucugcgccuugggcaccuccugugccggagcagaaauccugacuuuuugcugcacaucauucagaggcaggccucuucccagucaaugccgugguuagcugaucucguucaaaguagcgagggcucgcuggacgugcuuccagugcagugucugugcgaguucuugcuccaugaugcaguagacgacgccgcguccggagaagaggaugacgaaggcgagucuaaggaacagaaagcuaagaaacgacagcgccaacagaagcagcggcagcugcuagggagacugcaagaucuucuccugggacccaaggccgacgagcagaccacuugugaggucuuggauuacuuuuuaaggcgucuggguagcucacagguggcaagucgcguucucgccaugaaaggccugucccuugugcugucugaagggagcuugcgggacggagaggaaaaggagccuccaauggaagaggaugucggcgacacagaugugcuacaagguuaccaguggcugcucagagaccugcccaggcuuccuuuauucgauuccguucgaucaacgaccgcucuggcacuccagcaggccauccacauggagacugacccgcaaacaauaagcgcguauuugaucuaccugagucagcauacccccguggaagaacaagcucagcacucugaucucgcccuggacguagcacggcuugucguggaacgcuccacaauuaugagccaccuguuuucgaaauugucaccaucugccgcuagugacgccgugcuauccgcacugcucagcaucuucucuagauaugucaggcggaugcgacaaagcaaggagggggaggaaguuuacuccuggucagagagucaggaucagguguuuuuaagauggagcucuggcgaaacugcuaccaugcauauucugguagugcacgccauggucauccuucugacgcucggaccuccccgcgcggacgauuccgaguuccaggccuugcuggacauaugguuuccagaagagaaaccucuccccaccgcauuccugguggauacaucagaggaagcucuuuuacugccagacugguugaaguuaaggaugauucguagugagguucugcggcucguggaugccgcucugcaagaccuugaaccgcagcagcugcucuuguucguccagagcuuuggcaucccuguguccucuaugucgaagcugcuacaauuccuggaucaggcaguugcccaugacccccagacucucgagcaaaacauuauggauaaaaauuauauggcccaccuuguggaaguccagcaugagagaggggcuagcggaggucagaccuuucacucacuguuaacagcguccuugccacccaggcgcgacaguacugaggcaccuaagccaaaaucuagccccgaacagccuaucggccaagggcgaauaagaguaggaacccagcugcgggugcucggcccggaggacgaucuggccgguauguuccuucagaucuuuccacugucccccgacccuagguggcagucaucuagcccccgcccaguugcucucgccuugcaacaggcacuggggcaggaauuagcccgugugguccagggcaguccugaggugcccggaauuacgguaagagugcuacaagcucuggcgacacuccuuuccagcccacacggcggggcccuggucaugucuaugcaucggucacacuucuuggcaugcccucugcucaggcagcugugucaguaccaacgcugcguuccgcaggauaccggauuuuccagucuuuuccucaaggugcuguugcagaugcugcagugguuagacagccccggcguggaaggugggccacuacgagcucaacugagaaugcucgccucgcaggcaucugccggacggaggcuuuccgauguccgcggcggucuguugagacuggcugaggcccucgcguuuaggcaggaccuggaggugguuagcucaacuguacgggcagugaucgccacacuucguaguggcgaacaguguucugucgagccugauuuaauuuccaaagugcugcaagggcucaucgaaguucgcagcccccauuuggaggagcugcuaaccgcuuucuuuucagccacugcugacgcagccaguccauucccugcuugcaagcccguggucgugguaagcucccugcuccuucaggaagaggaaccgcuggccggaggcaagccaggggcagauggaggcucuuuggaggcgguccgacuggguccuagcuccgggcuccugguggacugguuagaaaugcuugaucccgagguugugucaucuuguccagaccugcagcucagacuacuguuuaguaggcggaaaggaaagggccaggcccaaguccccucguuccgcccuuacuugcugacccucuucacacaccagagcuccuggccgacgcuucaucagugcauaagagugcuguuggguaaaucuagggagcagcgguuugaucccucagcuagccuggacuuccucugggccuguauucacguuccacgaaucuggcaaggcagagaccagcgcaccccucagaagaggcgggaagaguuagugcugcguguccaagggcccgaacuuaucucccugguggagcuaauucucgcagaagcugagacuagaagucaggauggagacacagccgcaugcucucugauccaggccagguugccucugcuccuuagcugcuguugcggcgaugacgagucaguacgcaaagugaccgaacaccuguccggguguauucagcaauggggagauaguguuuuaggccggcgaugcagagaccuguugcuccagcuguaucuacagaggccagagcuucgcguccccgugccugaagugcugcuccauagcgagggugcugcgucuuccucagucuguaagcuggauggguugauacaccgguuuaucacacugcucgccgacacuagcgauucgagagcacuugaaaaccguggagcugacgccucuauggccugcaggaagcuggcaguagcucauccauuacuguugcuccggcaucugcccaugauugccgcgcuacuucacggccgcacccaucugaauuuccaggaguuucgacaacagaaccaccucaguuguuuccugcauguguuggguuuacuggagcuccuucagccgcacguuuuuagauccgaacaucagggcgcucugugggauugccuacugagcuucaucaggcucuugcugaauuaccggaaaucaucccgccaccuugccgcauuuauuaacaaguucgugcaauuuauccacaaauauauaacguacaaugccccugcugcaaucucuuuccugcagaagcaugccgacccacuccacgaucugagcuucgacaacagugaccuagucauguugaaaucccugcucgcggggcuuagccugcccucuagagaugacaggacagaucgaggacuagacgaggaaggcgaggaggaaucaagugcugggucccugccucucgugagcguuucuuuguuuaccccacugacugccgcagagauggcccccuauaugaagcggcuuucgcguggacagaccguggaagaucuguuagagguccucucagacauugaugaaaugagcagacgcaggccggagauccuguccuucuuuaguacaaauuugcaacggcugaugucuagcgcugaggaauguugcagaaaccucgccuucucccuugcacugcgcucaaugcagaauaguccuucuauugcugccgcguuucuacccacuuucauguacugucugggcagccaggacuuugaggugguacagaccgcccucaggaacuugccagaauaugcacuguuaugccaagagcaugcugccgugcuucugcaccgagcauuccucguugguauguacgggcagauggauccuuccgcucagaucucagaagcccugcggauauugcacauggaggccgucauguga

SEQ ID NO: 57763 - RNA, 3615 nt, Artificial Sequence
  derived and/or modified sequence opt3 from INTS2__Homo_sapiens__NP_065799
augaaggaccagcaaaccgugaucaugacagagugcacuagccugcaguucgucucccccuucgccuucgaagcuaugcagaaaguugaugugguaugucucgcaucucuuucagacccugagcugagauuguuacugccaugccuagugaggauggcccucugugcgccggcugaucagagucaaagcugggcccaggacaagaaacugauucuucggcuguuguccggcgucgaagcagugaacucuauaguugcccuccugucgguggauuuucacgcucuggagcaggacgcaucaaaggaacagcaacuccgccauaaauuagggggagguagcggcgagaguauccuggucucccagcuucagcacggguugacgcuggaguucgaacauucugauagcccccgacgucuaagacucgugcuguccgagcuucuggccauuaugaauaagguaucagaaaguaacggagaguuuuucuuuaagagcucugaguuguucgaauccccuguuuaccucgaggaagcugccgacgugcugugcaucuuacaggcggagcugccaucacuccuucccauugucgauguggcagaagcccuguugcacgugaggaauggcgcuugguuucuaugucugcucgucgccaacguuccugacagcuucaaugaggugugccggggucugaucaaaaacggggagcgccaagaugaagagagucuuggaggcagaaggcggaccgacgcacugcgcuuuuuguguaagaugaauccaucucaggcucucaaaguacgaggcaugguggucgaagagugccaucugcccggguuaggaguggcccugacacuagaucacacuaagaacgaagcgugugaggacgguguuuccgaccucgugugcuucgucagcggccugcuuuuggggaccaaugccaaagugagaacaugguuuggaaccuucauaaggaacggccagcaacggaagcgugagacuucgucuuccguacuguggcagaugcgcagacagcuccugcuugaacugauggguaucuugccuacaguuaggucaacccggauuguggaggaagcagaugucgacauggagccaaaugugagugucuauagcgggcucaaggaggagcacgugguuaaggcuuccgcccuguuacgacuguacugugcucuaaugggaaucgccggccucaaaccgacggaggaagaggcagaacagcugcuucaauugaugacuucuagacccccugccaccccagcuggcgugcgcuucguaagccugucauuuugcaugcuccuggcguucaguacauuagucuccacucccgagcaggagcagcugauggugguuuggcuuagcuggaugauuaaagaagaggcauauuuugaaucuaccucaggggugagugccagcuucggagagauguugcuccuggucgcuauguacuuucauuccaaccagcuaucugccaucauagaucuggugugcucgacacucgguaugaagauuguaaucaaaccuagcucccugucaaggaugaagaccauuuucacgcaagaaaucuuuacugaacaggugguuacagcacacgccguccgggugccagugaccaguaaucuuucugcuaacaucacuggcuucuugcccauucauuguauauaucagcuguuacgcagcagauccuuuacaaaacacaaggucucaaucaaggacuggauuuacaggcagcucugcgagaccagcacgccgcugcacccucaacuucugcccuugaucgauguuuauauaaauucuauucucaccccagccuccaaaaguaacccugaagcaacaaaccagcccgugacugagcaggaaauccugaauaucuuccagggggugauuggaggcgacaacauccgucuaaaucaacgguuuagcauuaccgcgcagcugcucguacuguacuacauacuuucuuaugaggaggcuuugcuggccaacacaaagacuuuagcagccaugcagcgaaaaccaaaguccuacucaaguagccucauggaucaaauccccauuaaauuccugaucagacaggcucagggucuucagcaagaacuagggggccugcauucggcccuccugagguugcuggcaaccaauuauccucacuuauguaucgucgacgauuggauuugcgaggaagagauaacaggaaccgacgcucuccugcgccggaugcuucugacuaacaaugccaagaaccauuccccaaagcaguugcaggaagcguuuucugccgugccgguuaaucacacacaggugaugcaaaucauugagcaucucacgcugcuaagcgcuucagaacugauccccuacgcagagguccuuaccaguaacaugucccagcuccugaacucuggcgugccuagaaggauuuugcagacuguuaauaaacuguggaugguguuaaauaccguaaugccacgccgacucugggucaugacagugaacgcccugcagcccagcaucaaguucgugcggcaacagaaauauacccagaaugaucuuaugauagacccucugaucgucuugcguugugaccaaagaguucacaggugcccaccccucauggauauuacucugcacaugcuaaacggguaccugcuugcuuccaaggccuaucucucagcacaucugaaagagacagaacaggaccgcccgagccagaacaauacgaucggauuggugggucagaccgaugcgccugagguaacucgggaagaguuaaagaacgcccugcucgcugcccaagacagugcagcugugcagauucugcuugagaucugucugccaacagaagaggaaaaggccaauggcgucaaccccgauucuuugcuaagaaaugugcaguccguuauaaccacaagcgcaccuaacaaagggauggaggaaggagaggacaaucugcucugcaaccugagggaggugcagugucuuauuugcuguuuacugcaccaaauguacaucgccgaucccaauauugcuaagcucguccauuuccagggcuacccaugcgaauugcugccucucacuguggcggguauccccucgaugcacauaugccuggacuuuaucccagagcuuauugcccagccggaacuggagaaacagaucuucgcaauucaauugcuaucacaccuguguauccaguaugcucucccuaagucuuuaaguguugcccgacuggccgugaacgucauggggacccuucugacgguacucacccaggcuaaacgcuacgcauuuuucaugcccacauugccaucccuggugagcuuuugccgggccuuucccccucucuaugaagauauaaugucucugcuuauucagaucggccaaguuugugcgagcgacguggcuacucagaccagagauaucgacccaauuaucacaaggcuacagcaaauuaaggagaagcccuccggauggucacagauaugcaaagauaguagcuacaagaauggcucucgugacacuggguccauggacccugauguccagcugugucauugcaucgagcgcaccgugauugaaaucauuaacaugucaguaaguggaaucuga

SEQ ID NO: 57764 - RNA, 3129 nt, Artificial Sequence
  derived and/or modified sequence opt3 from INTS3__Homo_sapiens__NP_075391
auggagcugcagaagggcaaaggggccgcugcagccgcggcugccagcggagcagccgguggcgggggaggcggugcuggggcaggagcccccggcggcgggagacuccuucuguccaccucuuuggacgcuaaggaugaauuagaggaaaggcuggagcggugcaugucaaucgugacaaguaugacugccggagucagcgaacgcgaggcgaacgacgcacuaaaugccuacguuuguaaaggucucccucaacacgaggaaauuugccugggccuuuucacgcugauauugaccgagccagcucaggcccagaaguguuaucgagaucucgcacuggugucccgugacgggaugaacaucguacugaauaaaauuaaccagauccucauggaaaaguacuuaaagcugcaagauacaugcagaacucagcuugugugguuggucagggagcuggugaaaucuggaguucuaggcgcugacgguguguguaugaccuuuaugaagcagauugccgggggagaugucacagcgaaaaauaucuggcucgccgagucggugcuggacauacuuaccgaacagcgggaguggguacugaagucaagcaucuugauugcaauggcuguuuauacuuaccuccgccugaucguggaucaucacggcacagcccaauuacaggcucugagacagaaagaagucgacuucugcauuagucuccuuagggagcgguuuauggaaugucugaugaucggccgcgauuuggugcgacuacugcagaacguggccagaauaccggaguucgagcuccuguggaaggacauuauccauaauccccaagcacuuuccccucaguuuaccgggauucugcaguugcuccaaucuaggacgagccggaaguuccuggccugccguuuaacuccagauauggaaaccaaacugcuauuuaugacaucccgcgucagauucggacagcagaagagguaucaggacugguuucaacggcaguaccucucaacucccgacagucagagccugcgaugugaucuuauccgcuauaucugcgguguugugcacccuucuaacgagguauuguccucagacauucugccaagaugggcuauaaucggcuggcuccugaccacauguaccagcaauguggcggcaaguaacgccaaacuugcucuguucuacgauugguuguuuuucucucccgacaaggauuccauuaugaauaucgaaccugccauacucgucaugcaucacagcaugaaaccacacccggcaauuacggccacucuguuagacuuuaugugcaggaucauccccaacuucuacccuccacuggaggggcaugugcggcagggaguuuucucgucucuaaaucacauuguggaaaagcgcguccucgcucaucuggcuccccuuuuugauaacccuaaauuggacaaggagcugagagcaaugcucagggagaaguucccagaauuuugcuccucacccaguccgccuguggagguaaaaaucgaggaacccguuagcauggaaauggauaaucacauguccgacaaggaugagucuuguuaugacaacgcggaggcugccuucagcgacgaugaagaggaccugaacucaaaaggcaagaaacgugaauuucgguuccacccaauuaaggagacaguggucgaggaaccuguggauauaacccccuacuuagaccaacuggaugagagucuucgagacaaggucuugcagcuccagaaagguuccgauacugaagcacagugcgaggugaugcaagaaaucguugaccaggugcuggaggaggauuuugacagcgaacagcuaucuguacuggccucaugucuccaggagcuguucaaggcucauuuuagaggggaaguccuuccagaggaaauuacagaggagaguuuggaagagagcgugggcaaaccccuguauuuaaucuucaggaaucucugccaaaugcaggaagauaacuccucuuuuucgcugcuucuggacuugcucagcgagcuguaccagaagcaaccuaaaaucggauaucaccuacuguacuaucuccgcgccuccaaggcagcugccggcaagaugaaucuguacgaaucauucgcgcaggccacccagcuuggggauuugcauacgugucugaugauggacaugaaagccugccaggaggacgauguucgguuacucugucaccugaccccaaguauuuacacagaguuuccggacgaaacucuuagaucuggagagcugcuaaacaugauaguggcagucaucgauagcgcccaacuccaggaacuggugugccauguaaugauggguaauuuggugauguucaggaaggacuccguucugaacauuuuaauccagucacucgauugggagaccuucgagcaguauugugcuuggcaacuguuucuugcccacaauauuccccuggaaacaaucauaccuaucuugcagcaccucaaauacaaggagcauccagaagcacugagcugccuacugcuucagcuccgccgagagaaacccucugaagagauggucaagauggugcugucccggccuugucacccagacgaucaguucacuaccaguauuuugcgucauuggugcaugaagcacgacgagcuguuagcggaacacaucaaaagccuccugauuaagaacaauucucuucccagaaaaaggcaaucccugcgcucaaguagcucgaaguuggcccagcucacacuggagcagauccuagaacaucuggauaaccuucggcucaaucugaccaacacuaaacaaaacuuuuucucccagacgccgauauugcaggcuuuacagcacgugcaagccucuugcgacgaggcacauaagaugaaauuuagcgaucuguucucacucgcugaagaguaugaggacaguuccacaaagccuccaaagucuagaaggaaagccgcacugagcucaccccgaucccgcaagaaugccacccagccucccaaugcugaagaggaaagcggcaguucuuccgcgagcgaggaagaggauacuaaaccaaagccuaccaaacggaagagaaaggggucgucagccgucggaucugacagugacuga

SEQ ID NO: 57765 - RNA, 2892 nt, Artificial Sequence
  derived and/or modified sequence opt3 from INTS4__Homo_sapiens__NP_291025
auggccgcucaccugaagaaaagaguguacgaggaguucaccaaggucguucagccccaagaagaaaucgcaacaaagaagcucaggcuuacuaaaccuagcaaguccgccgcgcugcauauugacuugugcaaggcuacgucuccagccgaugcauuacaguaucugcuacaguuugcccggaaaccgguggaggcugaaucaguagagggcgugguccgcauacuccuggagcacuacuauaaggaaaacgaccccagugugcgacuuaaaaucgcaagccuguuggggcuccuguccaagaccgccggauucucuccugauuguauuauggacgaugcuaucaauauucugcagaacgagaaaucgcaucaaguucucgcccaguuacuggacacacuuuuggcgaucgguacuaagcugccagaaaaucaggcaauacagaugcgucuaguggaugucgccugcaagcaccucaccgacacaucacauggcgugagaaacaaaugucugcaacuucuggggaauuugggaagccucgagaagaguguaaccaaagaugcugagggccuggccgcaagggacguucagaagaucauuggugauuacuuuuccgaccaggauccccgggugcgcacugcugccaucaaagcgauguuacagcugcacgaaagagggcucaaacuucaccaaacaauuuauaaccaggccugcaaacuguugucugacgacuacgagcaggucaggagcgcagcugugcaacuaaucuggguggucucccagcuguauccugaaucaauaguuccaauucccaguagcaaugaggaaauccggcucguggaugacgccuucggaaagauuugucauaugguaucugauggcuccugggugguccgcgugcaggcugccaagcugcuuggcucaauggagcagguuagcagucacuuucuggagcaaaccuuggacaaaaagcucaugucugaucugcgaagaaaaaggacggcacaugaacgggccaaggaguuauacuccagcggggaguucucgucuggacguaaauggggugacgaugcuccuaaggaagaaguggacacuggcgcggucaaccugaucgaguccggggcaugcggagccuuugugcacggccuagaggaugaaauguacgagguacgcaucgcugccguugaagcacucuguaugcuggcccagucaagucccagcuucgcugagaagugccuugacuuuuugguggauauguucaaugacgaaauugaggaggucagacugcaguccauacacaccaugaggaaaaucucuaacaauauuacacuccgggaagaccagcuggauacugugcuugccguccuggaggacagcucacgagauauccgcgaagcauugcaugagcuccuguguugcaccaacgugaguacaaaggaggguauacacuuagcgcugguugaacuacucaaaaaucugaccaaguauccgacggacagagauuccauuuggaaaugucuuaaguuuuuggggagcaggcaucccacucuggugcucccucugguaccagaguuacugucuacacaccccuucuuugacaccgcugaaccugauauggacgauccagccuacaucgcaguccuuguguugaucuucaacgccgcuaagacuugccccacaaugccggcccucuucucagaccauaccuuucggcacuaugcauaccugcgcgauagucuaagccaccugguuccugcucucagacugcccggaaggaaacuuguguccucugccgucucgccaagcauuaucccucaagaggaccccucccagcaguucuugcagcaaucacuggaacguguguauaguuuacagcaucucgauccacagggcgcgcaggagcugcuugaguuuacgauucgggaccugcaacgauugggcgaacuccagucugagcuggccgggguagcugacuucagcgcaaccuaccuaagaugccagcugcuccugauaaaggcccuucaagaaaaauuguggaauguggcugccccacuguauuuaaagcaguccgaucucgcaucagcggccgcuaaacagaucauggaggaaacauacaagauggaguuuauguacagcggaguugagaacaagcaggucgugauuauccaccauaugaggcugcaagccaaagcacuucagcugaucgugacugcucgcaccacacggggucuagacccucucuucggcaugugugaaaaguuucugcaggaggucgauuucuuucagagauauuucauugccgacuugccacaucugcaagauucuuuuguugacaaauuacucgaucugaugccgaggcuuaugacuuccaagcccgcagaaguggugaaaauacugcagaccauguugcgccagagugccuuccuccaucugccucuaccagagcagauccacaaggcuagcgcgacaauuaucgaacccgccggggagucugacaacccucugcgauuuaccuccggacuuguagucgcacucgauguggacgcuacucuggagcacguucaagauccacagaauacggugaaaguccagguguuguaccccgacggccaagcccagaugauucacccgaagccugccgauuuccggaacccaggucccgggcgucacagacugaucacacagguuuauuuaucacauaccgcuuggacugaagcaugccagguggagguaaggcuccugcuugccuacaauaguagcgcgcgcauaccuaagugucccuggauggaaggcggagagaugucgccacaagucgagaccuccaucgaaggcacaauuccuuucucuaaacccgugaagguguauaucaugccaaaaccggcucggagauga

SEQ ID NO: 57766 - RNA, 3060 nt, Artificial Sequence
  derived and/or modified sequence opt3 from INTS5__Homo_sapiens__NP_085131
augagcgcccugugcgaucccccuggcgcuccagggccgcccggaccugcaccagccacccacggucccgcgccucucuccgcucaggagcuuucucaagaaaucaaggccuuccugacaggcguggacccaauuuuggggcaucaguuaucagcaagagagcacgccagguguggacugcuacuccugcggagucuucccccugcucgcgcagccguccuggaccauuugcgaggcguuuuugaugaaagcgugcgugcucaccucgccgcgcuggacgagacuccaguagcagguccgccccaucugagaccuccacccccuucccacgugccagccgggggacccggccucgaagaugucgugcaggagguucagcaaguguuaucugaguucauaagggcuaacccgaaagccugggcaccugucaucucggcuuggucaauugaccugaugggccagcuuagcaguacguacuccgggcagcaccagcgggugccccaugccaccggagcguugaaugaacugcuacaacucuggauggguugccgcgccacaagaacucugauggauaucuauguacagugucuuucugcacugauuggcagcugcccagacgcuuguguugaugccuugcucgacaccuccgugcagcacucaccucauuuugauugggucguggcucacaucgggaguagcuuccccggaacaauaaucucuagggugcuguccugcggcuuaaaggacuuuuguguccacgguggggccggaggcggcgcagggucaagcggagguaguucuucccagaccccaagcacugaucccuucccuggcucgccagccauuccggcugagaaacggguucccaagaucgcgucugugguagggauucugggacaucucgcaucccgccacggcgacucaauccgaagagaacuucugaggauguuucaugacaguuuggccggugggagcggcggacgguccggcgauccuucucuacaagcuacagugccauuccugcuccagcuggccgucaugagccccgcacuucuggggaccgugucaggagaguugguugacugccucaaaccuccagccgugcugagucaguuacaacagcaucugcaggguuuuccccgugaggaacuagauaacaugcucaaucuggcuguccaccuugugucccaggccagcggcgcaggggcguaccgcuugcugcaauuccucguagacacggcuaugccggccucuguuauaacuacccagggacuggcagugccugauacagucagagaggccugugacaggcuuauucagcuguugcuccugcacuuacagaagcuggugcaccaucggggcgguucaccaggggaaggcguccuaggacccccucccccaccucgacucgugcccuuucuggaugcucuuaagaaccacguuggcgaguugugcggggaaacucugcgccucgagagaaaaagguuccuguggcaacaucaguuacugggacuuuugaguguguauacccggccaagcugugguccggaggcccucggccaucugcuaucccgcgcaagaucuccugaggagcugucgcucgcuacacagcuguacgccgggcuuguagucagcuuguccggacuguuaccccucgcguuuaggucaugccuggcccgugugcacgcuggcacccuucagccacccuucacggcacgguuccugcgaaauuuggcccuccugguugguugggaacaacaagggggcgagggaccugcugcccuaggcgcacacuuuggggaaagugcgucugcccaccugagcgaccucgcuccacugcuuuugcaucccgaggaggaaguggccgaggcagcugccucccuguuagcaaucugcccuuucccgucagaagcccucagcccaucucagcugcuuggacuggucagagcuggcgugcacagguuuuucgcgucccuacgccuccauggucccccugggguagccagugcaugucagcuguugacucggcugagccagacaucuccagcuggauuaaaggccgugcuccagcugcuuguugagggcgcccugcacagagguaacaccgaauuguuuggcgggcaggucgauggagacaaugagacucucuccguggugucagcuagucuggcaagcgccucgcuacuggauacaaacaggcgccacaccgcggcuguccccggcccugggggaauuugguccguuuuccaugccggcgugaucggucgagggcuuaaaccgcccaaguuugugcaaucucggaaucagcaggagguaaucuauaacacgcagagccuccugucauugcugguccacugcuguagugcaccaggaggcaccgaaugcggugaguguuggggcgccccuauuuuaucccccgaagcugcaaaagccguggcgguuacacucguggagucugucugcccagacgcugccggggcagagcuggccuggccucccgaggaacaugcucgugccacuguggaaagagaccuuaggauaggacgccgguucagagagcaaccacuguuguuugaacuccugaagcuaguugcagcugccccgccugcgcuguguuacugcagcgugcuucucaggggccuguuggccgcauuacuggggcacugggaggcuucccgacaucccgauaccacacacucaccauggcaccucgaggccagcuguacucugguagcugucauggcagaaggaagucuucugcccccugccuugggcaauaugcaugagguguucucucagcuagccccauuugaagugcgccugcuccugcuuuccgucugggguuucuuacgggagcacgggccccugccucagaaguuuaucuuccagagcgaaagaggaagguucauucgugacuuuucgcgcgagggcgguggcgaagggggaccgcaucucgcuguuuugcacucagugcugcaccggaacaucgauagacucggccuguucucugggagguuucaagcgccaagucccuccacccuucugcgacagggaacauga

SEQ ID NO: 57767 - RNA, 2625 nt, Artificial Sequence
  derived and/or modified sequence opt3 from INTS6__Homo_sapiens__NP_001035026
augaaccagagaagccaccugggcaccacauaccucgacacugccaagggggcuguggagacguucaugaaacuuagggcacgggaucccgccucccgcggagaccgauauaugcuggucaccuuugaagaaccuccauacgcgaucaaggcugguuggaaagaaaaucaugccacauucaugaacgaguugaagaauuuacaagcagaaggccugacuacccuagggcagucucuccguacagccuuugaucugcuuaaccugaauagauugguuaccggaauugacaacuauggccaggguaggaauccguucuuucucgagcccgcuauaaucauuacuaucacagaugggucaaaacugaccacgaccaguggagugcaggacgagcugcaccucccuuuaaacagcccacugcccggcuccgaacuuacuaaggagccuuuccggugggaucaacgcuuguuugcacugguacuaagacucccaggcacaaugucuguggaaucggagcagcugacuggggucccccuugacgauucagccauuaccccuaugugcgaggugacaggagguaggagcuacaguguuuguuccccacggaugcugaaucagugcuuggaaucucucgugcagaagguccaaagcggcgugguaaucaacuucgagaaagcugggccggaccccuccccuguugaagauggacagccagacauaucacgccccuuuggcagucagccuuggcauagcugucacaagcugaucuaugugcgaccaaaucccaaaaccggugucccgauugggcauuggccugugcccgagucuuucuggccagaucagaacuccccuacguuacccccaagaacuucacaccccguggucaaguuuagcugcacagacugugaaccuaugguuaucgacaaacugccauucgauaaguacgagcucgagccgaguccccuuacccaauuuauucuggaaaggaagucuccucagacuugcuggcaaguguauguauccaauagcgccaaauacucggaguugggacacccauucggcuaccuaaaggcgucuacagcacugaacugugugaaucucuucgucaugcccuauaacuacccugugcugcuuccacuguuggacgaucucuuuaaaguucauaaggccaaacccacccugaaguggcggcaguccuucgaaucauauuuaaaaacgaugccgccuuacuaucugggcccacuaaagaaggcugugcguaugaugggggcccccaaccucaucgcagacaguauggaguacggacugagcuauuccgucauaucuuaccuuaaaaaguugagccagcaggcuaaaauugaaucagaucgcgugaucgguaguguaggcaagaaaguugugcaggagaccgggauuaaggucagauccaggagccacggacugucuauggccuaccggaaggacuuucaacagcuccugcagggcaucucagaggaugugccucaucgacuucuggacuugaauaugaaagaauauacagguuuccaggucgcgcuccugaacaaggauuuaaaaccccaaacuuuucgcaaugccuacgacaucccaagaaggaaccugcuagaucaccucacccggaugcgcaguaaucugcuuaagagcacaagaagguucuugaaagggcaggacgaggaccaggugcacuccguuccuauugcacagaugggcaacuaucaagaauaccugaaacaggugcccucuccacuccgugagcuggauccggaccagccucggcgauuacauacuuuuggaaaucccuucaagcuggauaagaagggcaugaugauagacgaagcugaugaguuuguagccgggccacagaacaaacacaagagacccggagagccuaauaugcaagguaucccaaaaaggcgccggugcaugucgccccuuuugagaggcaggcagcagaacccugucgugaauaaccauauugggggaaagggcccgccagcucccaccacacaagcccagccugaccucaucaagccacugccccuacacaaaauaagcgaaaccacuaaugauuccauuauccaugacguuguggagaaccacgucgcagaucagcugucaagugacaucacgccuaaugccauggauacagaguucucugcuagcuccccggcgucacuccuggagcgccccaccaaccacauggaggcacuuggucaugaccacuuggggacuaacgaucugaccgugggcggauuuuuagaaaaucaugaggaaccacgagacaaggagcagugugccgaagagaacauuccugcuagcucucucaauaaaggcaagaaacugaugcacugccggucccacgaggaaguaaacacagagcuuaaggcccaaaucaugaaagaaauucguaagcccgggagaaaguaugagaggauauucacccuguugaaacaugugcagggaagucuccagacucgccugaucuuucuacagaauguuauuaaggaagcaagccgguucaaaaagagaaugcugaucgagcaacucgagaacuuccuggacgaaauccacaggcgagccaaucagauuaaccauauaaauucuaacuga

SEQ ID NO: 57768 - RNA, 2742 nt, Artificial Sequence
  derived and/or modified sequence opt3 from INTS7__Homo_sapiens__NP_001186738
auggccagcaacuccaccaagucuuuccuggcugacgcaggcuacggggagcaggaacucgaugccaauucagcgcuuauggagcuggacaaaggauugagaagugguaaguuaggcgaacaaugcgaggcuguggucagguuuccccggcuguuccagaaauauccuuuuccaauccuaauuaacagcgccuuccucaagcuggcagauguuuuucgcguggggaugcuuggaucccuggccucuauaaucccggaacguaaaaaugcucaccauucgauucgacagucauuggacagccacgauaacguagagguggaggcagccgucuucgcugccgcgaauuuuagugcacaguccaaggacuucgccgugggcaucuguaacaagauuucugaaaugauccaaggucucgcuacacccguugaucugaaacugaagcucauaccuaucuuacagcauaugcaccaugacgccauucuggcaagcuccgcuagacagcuuuugcagcaacuggugacuucauacccaaguacgaaaauggucaucgugagccuacacaccuuuacacuccuggccgcgucuucccuuguagauacucccaagcagauucagcuguugcuccaguaucugaaaaaugacccuaggaaggccguuaagcgguuagcaauccaagaucugaaacuccuugcuaacaagaccccacacacauggucacgcgagaauauacaggcccugugcgaaugugcuuugcagacccccuacgacagccuaaaacuggggaugcucagugugcugucuacucuuuccggaacaauugccaucaagcauuauuucagcauugucccuggcaacgugucgucuuccccaagaucaagugaucuggugaaauuggcacaagagugcuguuaccacaauaacaggggcaucgccgcucaugggguccggguucucaccaauaucacggugagcugccaggagaaggaccuguuagcgcuggaacaggacgcaguauuuggacuagagucccuccuggugcuuuguucucaggaugacagcccgggugcccaagcuacuuugaaaauugcccugaacugcauggucaagcucgcaaagggccgcccccaccugucacagagugugguugaaacccuucugacacaguugcacuccgcccaggaugcugcccgaauacucaugugucauugccuggcagcgaucgcuaugcaauuaccugugcugggggacggaaugcuaggcgaucucauggagcuguauaaagucauugguagaagcgccacugacaagcagcaggaacuuuuggugucucuggcaaccguaaucuucguugccucacagaaagcucucaguguggagagcaaggccgucauaaaacaacagcuggaguccgugucuaauggguggacagucuacaggauugcacggcaggcuucgcguaugggaaaccacgauauggccaaggaauuauaccagagccugcuuacccaaguggcguccgagcauuuuuauuucugguugaacucacucaaggaguucagucacgccgaacagugucugacgggccuacaggaagagaauuacucuagcgcucuguccugcaucgcagagucacucaaauuuuaucauaagggcaucgccagccugacugcugccucuacaccacuuaaccccuuguccuuccaaugcgaauuuguuaaacugcgcauugacuuacuccaggcauucagucagcugaucuguaccugcaauagccuuaagacuucuccuccacccgcgauugccacaaccauagcuaugacgcuggggaacgauuugcagagauguggaaggaucuccaaucaaaugaaacagucaauggaggaauuucggagucucgccagccgauacggugaccuguaucaggcaucguucgaugcugacuccgccacccuacgcaacguggagcugcagcaacagucuugccuccugauuagccacgcaaucgaagcccuuaucuuggacccggagucagcuaguuuucaggaguacggcuccacagggacugcgcacgccgauucugaauaugagagaaggaugaugagcguauacaaucauguccuggaagagguggaguccuuaaaccggaaguacaccccuguuucauauaugcacacagcaugucucugcaaugcuauuauagcccugcuuaaggugccccugagcuuccagcgcuacuuuuuccaaaaacuacagaguacuucuaucaagcucgcccuguccccaagcccuagaaaccccgcugaaccaauugcaguccagaauaaccaacaguuggcccugaaaguggagggaguagugcagcauggcucgaagcccgguuuauuuaggaaaauccagucaguuugucucaaugucucuaguacccugcaauccaagagcgggcaggacuauaagauuccuaucgauaacaugacaaaugaaauggagcagcguguggaaccacacaacgacuacuucucuacccaguuucuucugaacuucgcgauauugggcacucacaauaucacgguggagagcuccgucaaagaugcuaacggaauuguuuggaagacaggcccgcggaccacuaucuucgugaaaucacucgaggaccccuauagucaacagauucgacugcagcagcaacaggcccagcagccucuacaacagcagcaacagagaaaugcauacaccagguuuuga

SEQ ID NO: 57769 - RNA, 2988 nt, Artificial Sequence
  derived and/or modified sequence opt3 from INTS8__Homo_sapiens__NP_060334
augagcgccgaggcugcagacagagaagccgcgaccuccucuaggcccugcacaccuccacagacuuguugguucgaguuucugcucgaagagucacuucuggaaaagcacuugcggaaaccgugccccgauccugcuccagugcaauuaaucguccaguuccuggagcaggccaguaagcccagcguuaacgagcagaaucaagugcagccuccacccgacaacaaacgcaaucguauucuaaagcuccuggcacuuaaaguagccgcucaucugaagugggauuuggacauacucgaaaagucccugucugugccuguccugaacaugcucuuaaaugagcugcuuuguaucucgaaagugccaccgggcacgaagcacguugauauggacuuggcaacccugcccccuacaacugccauggcugugcuacucuacaaccgaugggccauuagaaccaucguccagagcagcuuuccagugaaacaggcgaagcccgggccuccacaacugaguguaaugaaucagaugcagcaggaaaaagagcuuacagagaacauucugaagguuuugaaggaacaagcagccgauuccauccucgugcuggaggcugccuuaaaacugaauaaggaccucuauguccauaccaugaggacucuugaucuguuggcaauggaacccggaauggugaacggugagacagaaucuagcaccgcuggccuaaaagugaagacggaggagaugcagugccaggucuguuacgaccugggggccgcguauuuccaacagggauccacuaauucagccguuuacgaaaacgcacgggagaaauuuuuccgcaccaaggaacucauagcugagaucggcagucugagccuucacugcacaauugaugagaaaagacuggccgguuauugucaggcuugcgacguguugguaccgucuuccgauucaacuagccagcaacucaccccuuacagucaggugcauaucugucugaggucugggaauuaucaggaagucauucagaucuuuauagaggacaacuuaacacugucccuacccgugcaauuccggcagagcguucuccgcgaacuguuuaagaaggcccagcagggaaaugaggcacuugacgaaauuugcuucaaagugugugccugcaacaccguccgagauaucuuggagggcagaacgauuucggugcaauuuaaccagcuguuccucaggccaaauaaggagaaaaucgacuuucugcuugaaguaugcucucgguccguuaaccuggagaaggcuucagaaaguuugaaaggcaauauggcggcauuccucaagaacgugugucugggguuagaggaucugcaguacgucuucaugaucagcucccacgaacuauuuauuacucuccugaaggacgaggagcguaaacuuuugguggaucagaugcgcaagagaucuccuagggucaaucugugcauaaaacccgugacaucauucuacgacaucccagccucagcuaguguuaacauuggacaacucgaacaccagcugaucuuauccguggaucccuggcggauacgacagauucugaucgagcuucaugguaugaccagcgaacgccaauuuuggacuguaucuaauaagugggaggucccuucaguguauaguggcguuaucuuggggauuaaagacaaccucacaagagaucugguguacauccuaauggccaagggacugcacuguagcaccgucaaggacuucucccaugcaaaacagcucuuugccgcuugccuggaacuugugacggaguucucuccaaaguugaggcagguaaugcugaaugagauguuacuccuggauauucacacccacgaagccggcacaggucaggcaggggagcggccgcccucggaccuuauaagccgcgugagaggauaucuggaaaugagguugccugacaucccacuccgucaaguuauugcggaggaaugugucgcuuuuaugcugaacuggcgggagaaugaguaccuaacucuccaggugcccgccuuccugcugcaguccaacccuuaugugaaacuuggccaguugcuggcagcuaccugcaaggaauuaccaggccccaaagagucacgaagaacagccaaggaucucugggaagucguugugcaaaucuguagugugucuagccagcauaagagggggaaugacggacgcguaucccugaucaaacagcgggagucaacucuugguauuauguacagaagcgaacugcuaucuuuuauaaagaaacucagggagccgcuggucuugaccaucauucuguccuuauucgugaagcuccacaacguucgcgaggauaucgugaaugacauuacagccgaacauaucaguauauggccuagcucuaucccaaaccugcaguccgucgauuuugaggcaguggcuauuaccguuaaagaacuugugcgauauacucugucaaucaaccccaauaaccacaguugguugauuauccaagccgacauauacuucgcgacgaaucaguacagcgccgcucuccauuauuaccugcaggcaggcgccguaugcucggacuuuuucaacaaggcugucccucccgauguguauacagaucaagugauuaaacggaugaucaaguguugcucccuacugaauugucacacccaggucgccauucuuugccaguuccuccgugagaucgacuacaagacugcauuuaaaucucugcaggagcaaaacagccacgaugcgauggacucauauuacgauuauauaugggacguuaccaucuuggaauaccugacauacuuacaucacaagagaggggagaccgacaaaaggcagauugccaucaaggcuauuggacagacugaacucaaugccaguaacccagaggaagugcugcagcuugcagcucaacgccggaaaaagaaguuccugcaggccauggcaaaauuguauuuuuga

SEQ ID NO: 57770 - RNA, 2829 nt, Artificial Sequence
  derived and/or modified sequence opt3 from INTU__Homo_sapiens__NP_056508
auggccagcguggcuuccugcgacucuagacccucaagugaugagcugccuggcgacccaagcucccaggaagaggaugaagacuacgauuucgaggacagggucucugauucggggucauauagcagugcauccucugacuacgaugaccucgaaccggaguggcuugauagcguucaaaagaacggagagcuguuuuauuuggaauuauccgaggacgaagaggagucacugcuacccgaaaccccuacagugaaucacguacgguucagugagaacgaaaucauuauagaggaugacuacaaagaacgcaagaaauaugagccaaagcucaaacaguuuacuaagauccugcgacguaagagacuucugcccaaaagguguaauaagaaaaacagcaaugacaacgguccugugucuauuuugaagcaucaguccaaucagaaaacgggcgucaucgugcaacagcgguacaaggauguuaacguguaugucaauccaaagaaacucaccgugauuaaggccaaagagcagcugaagcugcucgaaguauuaguugggaucauacaccagacaaaauggucauggcgcagaacuggaaagcaaggcgacggugagaggcuggugguccaugggcuuuugcccggaggcagcgcgaugaaaaguggccaggugcugaucggggaugugcuagucgcuguuaacgacguggauguaaccacagaaaauauugagcgggugcucucuugcaucccuggaccaaugcaggucaagcugaccuucgaaaacgccuacgacgugaagcgcgagacuucccacccgcgacagaaaaagacacaaagcaauaccucggaucuuguuaaacuguuguggggugaggaaguggagggcauucagcagucugggcucaacacgccccauaucauaauguaccugacuuuacaacuggacuccgaaaccucaaaggaggaacaggagauucucuaucacuacccuaugagugaggcaagccagaaacuuaaguccgucagaggaaucuuucugacauugugugauaugcuagaaaaugugacuggcacccagguaacaucuagcucacugcuccugaacgguaagcaaauucacguugccuauuggaaagagagugacaaacuucuguugaucgggcucccagcugaagaggugccccugccuagguuacggaacaugaucgagaaugucauucagacccugaaauucauguacggaucccuagauagcgcauuuugccagauagaaaacgugccacgucucgaccauuucuuuaaucuguucuuucagcgcgcccuucaacccgcuaaguugcacucuucagccaguccgagcgcgcagcaguaugacgcauccucugccguccugcucgauaaccugccuggcgugagauggcuuacgcugcccuuggagaucaaaauggaacucgacauggcucugucggauuuagaggccgcagacuucgcugaacugagcgaggauuacuaugacaugaggcggcuauacacuauucucggcuccucacuguuuuacaagggguaucuuaucuguagucauuugccaaaggaugaccugauagauauugccguuuacugccgacacuauugucuccugccuuuagcggccaaacagcgcaucggacaacugaucauuuggagagagguguucccccagcaccaucuuaggccauuggcagacucuagcacagaaguauuccccgagccugaaggucgguacuuucuccuggucgugggccuaaagcacuauaugcugugcguucuccuggaggcugggggaugugccuccaaagcuaucggcucaccagguccggauugcguguacgucgaccaggugaagaccacucuucaucaguuggaugggguagacagccgcauugacgaaagacuggccucuucccccgugccuuguuuaaguugcgcagauugguuccucacaggcagcagggagaaaaccgacucucugacgaccuccccaauacuuucacgucugcaaggaacaaguaagguugccacuagcccuaccugccggcgaacauuguuuggcgauuauucgcucaagacuagaaaacccuccccaucuuguagcucagggggaagugacaaugguugcgagggcggggaagaugacggauucucuccccacaccacaccggaugcugucaggaagcagcgcgagucccagggcagcgacggucuggaagaguccgggacccuacugaaagugacuaagaaaaagucaacgcucccuaacccauuucaucugggcaaucuuaaaaaggauuugcccgaaaaggagcuggagaucuacaacacagugaaauuaaccagcggaccugaaaauacucucuuccacuacgucgcgcuggagaccguucaaggcauuuuuaucacacccacccuugaagagguggcacagcugagugggucuauccacccacagcuaauuaagaacuuccaucaguguugccucuccauacgggccguguuucaacagacucugguagaggaaaagaagaaaggauugaauagcggugaccacucggauucagcuaagucugucaguucccugaacccugugaaggagcauggcguuuuauucgaauguagccccgggaauuggacagaccagaaaaaggccccaccggugauggcauauugggucgugggaagacucuuucugcacccuaaaccccaggagcuuuacguuugcuuccacgauucugugacggaaaucgccauugagaucgcuuuuaagcuguucuucggcuugacccucuga

SEQ ID NO: 57771 - RNA, 3198 nt, Artificial Sequence
  derived and/or modified sequence opt3 from INVS__Homo_sapiens__NP_055240
augaacaagagcgagaaucuccuguucgccggcuccucucuugcuucacaggugcacgcagccgcggucaacggggacaaaggagcucugcaaagauugaucguugguaauagugccuuaaaggauaaagaagaccaguuuggcaggacaccccugauguacugcgugcuagcagaucggcucgacugugccgaugcucugcuuaaggcaggggccgacguaaacaaaaccgaucauagccagcgcacugcucugcacuuggccgcgcagaagggaaauuaucgauucaugaagcuccugcugacgcguagagcaaacuggaugcaaaaagaccucgaggaaaugaccccuuuacaucugacaacuaggcaccgguccccaaagugccuugccuugcugcuaaaauuuauggcuccgggcgagguggauacccaggacaagaauaaacagacagcccuccauuggucugcauacuauaacaaucccgaacacgucaagcugcuuauuaagcacgauucgaacauagguaucccugacguggaggggaaaauuccacugcauugggcugccaaucacaaggaucccucagcgguucauaccgugcgcuguaucuuggacgccgcaccuacugagagccuccugaacuggcaggacuacgaaggaagaacaccauuacacuucgcugucgccgauggcaaugugaccguaguugacgugcugacgaguuaugaguccugcaacauuacuucuuacgauaaucucuuuaggacaccccuucacugggcugcccuguugggccaugcacaaaucguccaccuacugcucgaacggaacaaaagcgggaccauaccuuccgacucacagggagccacuccacugcauuaugcugcgcagaguaacuucgcagagaccgugaagguguuucuuaaacacccgagcgucaaggaugacucugaucuggagggucgcacauccuucaugugggccgcuggcaaagggucagacgauguuuugcgaaccaugcucagccugaagagugacaucgauauuaauauggccgacaaguacggaggcacggcauuacaugccgcugcccugucuggucacguguccacuguaaaacuacuccuggaaaacaaugcacagguggacgcgacagaugucaugaagcacacuccccuuuuuagagcuugugagauggggcauaaagacgugauccaaaccuugauuaagggaggcgccaggguugaucugguggaccaggauggccacagccuccugcauugggcagcccuugggggaaacgcugacgucugccagauccugauagaaaauaaaauuaacccuaaugugcaagauuacgccggucggacaccauugcagugugcagcuuauggcggguacaucaacugcauggccguacucauggagaauaacgcggaccccaauauucaggauaaggaaggacguaccgcccugcacuggucguguaacaauggcuauuuagacgcuaucaagcugcuacucgauuucgcagccuuuccuaaccagauggagaauaacgaggaacgcuacacgccacuggacuaugcucuuuugggugagagacacgaaguuauccaauucaugcuggagcauggggcccucucuauugcagcgauacaggauaucgccgcuuuuaaaauucaggccguguacaagggcuauaaagucaggaaggcauuccgggaccgcaaaaaccuguuaaugaagcacgaacagcugcgaaaggacgcugccgcuaaaaagagagaggaggaaaauaaaaggaaggaggccgaacaacagaaaggacggcgcucccccgauucaugcagaccgcaggcacuuccuuguuugcccaguacccaggacgugccaagcaggcaaucccgugcgccuucuaagcagcccccagccggcaacgucgcacaggggcccgagccucgggauagccgaggaucaccagguggcagucucgggggagcucugcagaaggaacaacauguguccagcgaccuacagggcacaaauucuagaaggccgaacgagacugcccgcgagcacucaaaaggucagagugccugcguucauuuccggcccaaugaagggagcgauggcuccagacacccuggagugccaucuguagagaagucgaggggcgaaaccgcuggggacgagcgcugcgcaaaaggaaaggguuuugucaaacaacccagcuguauccgaguggccggcccugaugagaagggggaagacucccggcgugcggcugccucacugccaccccacgauagucauuggaaaccgucuagaaggcacgacacagagccuaaggcaaagugcgccccacagaaacgccggacucaggaacucagaggagguagguguagccccgcuggcuccucacgaccugggagcgcacgcggcgaggccguucaugcgggacagaaucccccacaccaucggaccccuagaaacaaggugacacaagcuaaacugaccggcgggcuuuacucucacuugccccaguccacugaggaacugaggaguggagcccgucgcuuagagacgagcacacucucugaagauuuccaggucuccaaggagaccgacccagcaccgggcccucugucaggucagagugugaacauagaucuucugcccguagaauugcggcuccaaauuauccagagagagaggcgacggaaagaacuguuucgcaagaagaauaaagccgcugccgugauccagagagcauggaggagcuaccagcuacggaagcaccugucgcaucuccgacacaugaaacaacugggggcuggagacguugacagauggcgccaggaguccacugcccuuuugcugcaggucuggaggaaggaguuagaacucaaauucccacaaaccacagcggugucuaaggcccccaagagcccuucaaaaggcaccagugguacuaaguccacaaaacauucugugcugaagcagauuuauggcugcagccacgaggggaaaauccaccauccaacgcguuccgucaaggcaucaagcguucuucggcugaacagugugucuaaucuacaguguauucaccuccuggaaaacuccggaagaagcaagaauuuuucguacaacuugcagucagcuacccaacccaaaaauaagacuaaaccuuga

SEQ ID NO: 57772 - RNA, 831 nt, Artificial Sequence
  derived and/or modified sequence opt3 from IP6K1__Homo_sapiens__NP_001006115
augcuggacggcaacagcgggcucuccucugagaagaucucacacaaucccuggagucuuagaugccauaaacagcaacugagcaggaugcgguccgaaucuaaggaucgcaaauuguacaaguucuuacugcuagagaacgugguccaccauuuuaaauauccuuguguucucgaccugaagaugggaacccgacagcacggugaugacgccucggcugaaaaggcagcccgucagaugagaaaaugcgagcagucaacaagcgcgacucuuggcgugaggguaugugggaugcaaguguaccagcuggauacgggacauuauuugugccggaauaaguacuauggccgcggucucaguauugaaggguucagaaacgcucuguaccaguaucugcacaauggacucgacuuaaggcgggaucuguuugagccaauacuuuccaaauugcgcggccugaaggccguccuagagcgacaggcaucuuacagauucuacagcuccucacuccuggugaucuaugacggcaaagaauguagggccgagaguugccuugaucggcguagcgaaaugcgccugaagcacuuggacaugguucucccggagguggcuucuuccugugggcccucaaccagcccuaguaacacaucuccagaggcaggacccuccagccaaccuaaggucgaugugagaaugauugacuuugcccauucgacuuucaaagguuuuagggaugacccaaccguacacgacggccccgaucggggguacguuuucggacuggaaaauuuaaucucuauuauggagcagaugcgagacgaaaaccaguga

SEQ ID NO: 57773 - RNA, 294 nt, Artificial Sequence
  derived and/or modified sequence opt3 from IP6K2__Homo_sapiens__NP_001005911
augagccccgccuucagagcuauggacguggagccuagggcaaagggcguccugcucgaaccauuuguucaucagguagggggacauuccugcgugcuucgguucaacgagaccacacuguguaaaccguuggugccccgcgaacaccaauuuuacgagacuuuaccugccgaaaugcgaaaguucacgccacaguauaaaggucagucucagcguccccuggucucauggccuagucuaccacacuuuuuccccuggagcuuuccucucuggccacaaggcuccguggcguga

SEQ ID NO: 57774 - RNA, 1233 nt, Artificial Sequence
  derived and/or modified sequence opt3 from IP6K3__Homo_sapiens__NP_001136355
auggugguccagaacagcgccgacgcuggcgauaugagagcagggguucaacuggagcccuuccuccaccaggugggaggucauauguccguaaugaaguacgacgaacacaccgugugcaaaccucuugucucuagggagcagcgguuuuaugaaucacugccauuggccaugaagcgcuucacaccgcaguacaaaggcacugugacgguucauuuauggaaggauaguaccgggcaccugagccuaguggcgaaucccgucaaagagucccaagaaccuuuuaaggugucuacagagucggcugccguagcaaucuggcagacucuccagcagaccacaggaucaaacggcagcgacuguacccuggcccaauggccacaugcucagcuugcacgaagucccaaggaguccccugccaaagcucuguugcguucugaaccacaccucaauacucccgccuucagccugguugaggauacaaacgguaaucagguggaaagaaaguccuuuaacccuugggggcugcagugccaccaagcgcaucucaccagguuauguucagaguauccagagaauaaacggcaccgcuuccugcuuuuggaaaacgucgugagucaguacacgcauccgugcgugcuggaccuaaagaugggaacuagacagcacggcgaugacgcaagcgaggagaaaaaggccaggcacaugcggaagugugcucaaucuaccuccgccugccucggcguccgcauuugugggaugcagguuuaucagacagauaaaaaguacuuucugugcaaagacaaguauuacggacgaaaacuuucaguggaagguuucagacaggcacuguaccaauuuuugcauaauggcagccaccucaggcgggaacuguuagagcccauacugcaucagcuccgugcccuucugaguguaauccgcucucaguccagcuauagauucuacucgucuuccuugcuagugauuuaugaugggcaggagccuccagaaagggcucccggaucaccucacccacaugaggcgccccaagccgcacacggcaguagcccgggugggcugacuaaggucgacauccggaugauugauuuugcucacaccacauacaaaggauauuggaacgaacauaccacguacgacggcccugaccccggcuauaucuucgggcucgagaaucugauacgaauccuucaggauauucaggaaggagaguga

SEQ ID NO: 57775 - RNA, 1317 nt, Artificial Sequence
  derived and/or modified sequence opt3 from IPCEF1__Homo_sapiens__XP_005266979
augaccagcuacauggccaucgacggcuccgcucuacaggugccccucagacaaaagccuaggcggaaaacacagggguuccuuacuaugucucgccgacguauuucaugcaaggaucugggacacgcagacugucaggguugguuguauaaaaagaaagagaagggcaguuuucugagcaacaaguggaaaaaguucugggucauacugaaaggguccucucuauacugguauucgaaucagauggccgaaaaggcggauggauuuguuaaccucccagacuucacgguggagagagcuucagaaugcaaaaagaagcaugccuuuaaaaucagccacccgcaaauuaagaccuucuacuuugcagccgagaauguacaggaaaugaacguguggcugaauaaacuuggcagugcugucauccaucaggaguccacaacuaaggaugaggaauguuauucugagagcgaacaggaggaccccgagauugcagccgaaaccccuccacccccucacgcuucccaaacacagucacugaccgcccagcaggcgaguaguucuuccccaucauugagcgguacuagcuacucuuucuccagccucgagaacacagugaaaacccccucgucuuuuccuuccucacugaguaaggaaaggcaaagccugccagauacgguuaauucccucucugcagccgaggacgaagggcagccgaucacuuucgcugugcagguccauagccccgugccuucagaggccggaauacacaaagcauuagagaacaguuuuguaaccuccgaaagcggcuucuuaaauucucuuucaagugaugacacaagcuccuugucuucgaaccacgaucaucugacuguuccagacaagcccgcuggcagcaagaucauggauaaagaggaaaccaagguguccgaggacgacgaaauggagaaacuauauaagucacucgagcaagccagucugucuccucuuggggaucggcgcccaagcacaaagaaggaacugagaaaguccuuugucaaaaggugcaagaaucccucaauuaacgagaaauugcacaagauccggacccucaauagcacgcugaaauguaaggaacaugacuuagcgaugauuaaccagcugcucgaugacccgaaacuuacugcccgcaaauaccgagaguggaaggugaugaauacacuguugauccaggauauauaccagcaacagagagcaucuccugcucccgacgauaccgacgauacuccacaggaacugaaaaaguccccuaguagccccucuguggagaacuccauuuga

SEQ ID NO: 57776 - RNA, 1251 nt, Artificial Sequence
  derived and/or modified sequence opt3 from IPMK__Homo_sapiens__NP_689416
auggccaccgagcccccuagcccacugagaguggaagcuccggggcccccugagaugaggacauccccagcaaucgaaucuacucccgagggcacgccucagccagccggaggucggcuccgcuuccuuaacggcugcgucccccugucacaccaaguugcggggcauauguacggaaaggacaaagugggcauuuugcagcacccugaugguaccguauuaaagcagcugcagccaccgccccgagggccucgugaacuagaguuuuauaauaugguguacgcugccgacuguuucgauggaguccuccuggagcuuagaaaauaucugccaaaguacuauggcauauggagucccccuacagcaccaaacgacuuguaccucaaacuggaagaugugacucauaaguuuaauaagcccugcaucauggacguuaaaauuggccaaaagagcuaugauccguucgccuccucugagaaaauccagcaacaggugucgaaguacccucugauggaagagauuggguuucucgucuuaggaaugaggguguaccacguacauucagacagcuaugagaccgaaaaccagcacuacggucggagucugacaaaagagaccaucaaggauggcguuucccgcuucuuucacaauggguauugucuuagaaaggacgcuguggcagccucuauacagaaaaucgaaaagauuuugcagugguucgagaaccagaaacaacugaauuuuuacgcuagcucccuacucuucgucuaugaaggaucaagucagcccacuacaaccaagcugaacgauaggacgcuugccgagaaauuucugagcaagggccaguugucugacacugaggugcucgaauacaauaacaauuuccaugugcuguccucaaccgcgaacgguaaaaucgagagcagugucgggaagucuuuauccaagauguaugcacggcaccgcaaaauuuacacaaagaaacaucacagccaaacuucgcugaagguugaaaaucucgagcaggauaacggauggaaaucuaugucccaggaacaccuuaauggcaacgugcugucacaguuggagaagguauuuuaccaucuaccaaccggcugccaagagaucgccgaaguggagguccgaaugauagacuucgcucacguguucccuaguaacacaauugacgaaggguauguuuacggacugaagcaucucaucagcgugcugagauccauucuugauaauuga

SEQ ID NO: 57777 - RNA, 3048 nt, Artificial Sequence
  derived and/or modified sequence opt3 from IPO11__Homo_sapiens__NP_001128251
auggugcagcccaucauucaccugggcuacgucguuuauagccuccuuuaccugggguauaagccugugcaacauguaaccgccuugaacacaguguccucuugccacaaaauggucucaauggacuuaaauagugcuagcacugugguucuacaggugcugacgcaggcaaccucccaggauacagccguccucaagccagcggaggaacaacugaaacagugggagacucagccgggauucuacucugugcuucugaacauauuuaccaaucauacauuggacaucaacguaagauggcucgcuguucuguauuucaagcacgguauugauagguacuggcggcgcguggcaccccaugcccugucggaagaggaaaagaccacucuccgagccggcuuaaucacaaauuuuaacgagccuauuaaucagaucgcuacccaaauagcaguccugaucgccaagguggcucgucuugacuguccaagacaguggcccgaguugauuccuacgcugaucgaaucagugaagguccaggaugaccuaaggcagcaccgggcccuccugacuuucuaucacguuaccaaaacacuugcgagcaagcgccuggcagccgauagaaaauuguuuuacgaccucgcuagugggauuuacaacuucgccugcucccuguggaaucaucacacugauaccuuuuuacaagaggugucuagcggaaacgaagcagcuauccuguccucacucgagaggacacuucugaguuugaagguacuacggaaacugaccgugaauggcuucgucgagccacauaagaacauggaagugauggguuuucuccacgggauauucgagcgccugaagcaguuucuugaauguagccgaucuauuggaacggacaauguuugcagagauaggcuggagaaaacuaucauuuuguucacaaaggugcuccuggacuuuuuagaucagcaccccuucuccuucaccccucugauccaacggucacuagaauuuagcgucaguuauguguucacugagguaggcgagggcguuacauuugaacguuucaucgugcaguguaugaaccucauuaaaaugauagucaagaauuacgccuauaaaccaucuaagaacuuugaggacuccagcccggaaacccuggaggcgcauaaaaucaagauggccuucuuuacguaccccacccuuacagaaauuugccgcagauuggugucgcacuauuuccugcucacugaggaggaacugaccaugugggaggaagacccugagggguuuacagucgaagagacuggaggugauucuuggaaguacucccuuaggccauguaccgaggugcuguucaucgacauauuucaugaauauaaccagacauugacccccguucuccuggagaugaugcagacuuuacaaggcccuacgaauguggaagauaugaacgcacugcuaauuaaagacgcuguauacaaugccgucgggcucgcugccuacgagcuguucgauucaguggacuuugaucagugguucaagaaccagcuuuugccagagcugcagguuauccacaaucgguauaaaccccuccgacgcagagugaucuggcugauuggacaauggaucagugucaaguucaaaagcgacuuaaggccgaugcuguacgaagcaauuugcaaccuuuugcaggaucaggaccucgugguacggauagagacagccaccacucugaagcuaaccguggaugacuuugaguuccgcacagaccaguuucugccuuaucucgagaccauguucacucugcuuuuucaauugcugcagcagguuacagaaugugauacgaagaugcaugucuuacacgugcucuccugcgugaucgagagagucaauaugcagauuaggcccuacguuggcugucuggugcaauaucuuccacuguuguggaaacagucugaggaacacaacaugcuccguugcgcuauccugaccacucuaauccaucuggugcagggucucggggcggacagcaagaaucuguacccuuuccuuuugcccguaauucaacugucaacagaugucagucagccaccccacguguauuuacucgaggacggacuggaacuuuggcugguuacccuagagaacuccccuugcauaacaccagaacuccugcggaucuuucagaauaugagcccguugcuggaguuaucuucagagaaccuccgaacuuguuucaaaauuaucaauggcuacauuuuucugaguagcaccgaguuccuucagacguacgcagugggccugugccaauccuuuugugaauugcucaaggaaaucaccacagaggggcagguccaggugcugaaaguuguggaaaacgcccuaaagguaaaucccauacugggaccucagauguuccaaccaauccuucccuaugucuuuaaggguauuaucgagggcgagagauacccuguggugaugucuacuuaucucggggucaugggaaggguucuguugcagaacaccucguucuucagcucccuguuaaacgaaauggcucauaaauuuaaucaggagauggaucagcuccugggcaacaugauugaaauguggguggaccgcauggauaauaucacacaaccagagcggagaaaacuuucagcccuggcauugcucagucugcuacccucugacaacagcguaauacaggauaaauucugcgguauuaucaauauuuccguggaggggcugcacgacgucaugacugaagauccggagaccggcacguacaaggacuguaugcuuaugucacaccucgaagaaccuaaagugacagaagaugaggagccacccaccgaacaggacaagaggaagaaaaugcuggccuugaaggacccuguucauacugugagcuuacaacaguuuaucuaugagaaacugaaggcucagcaggaaaugcucggagagcaaggcuuccagucucugauggaaacagucgauaccgagauagugacucagcuucaggaguuucugcaaggguucuga

SEQ ID NO: 57778 - RNA, 1989 nt, Artificial Sequence
  derived and/or modified sequence opt3 from IPO13__Homo_sapiens__XP_011540763
auggagaccagccacggcaucugcagaauugccguggcucugggggaaaaccauuccagggcacuccuugaccaggucgagcacuggcaaucuuuccuggccuugguuaauaugauaauguuuuguacaggaauccccggucauuacccugugaacgaaacuacgucaaguuuaacccugacauucugguauacucuacaggaugacauucucagcuuugaggcggaaaagcaggcuguauaccagcaaguguaucggccagucuacuuccagcugguggauguucuucugcacaaagcccaguuuccguccgacgaggaguauggcuucuggucuucggaugaaaaggagcaguuucgcaucuaccgaguggacauuucagauaccuugauguaugucuacgaaaugcucggggcagagcugcugagcaaucucuacgacaaauuaggacgucugcuuacaaguuccgaggaacccuauucuuggcaacauaccgaggccuugcuguacggcuuccagagcaucgcugaaacuauagaugugaacuauuccgacguaguuccuggucuaaucgggcucauuccaagaaucucaauuaguaaugugcagcuggcagauacagucauguuuaccaucggagcccuuagcgaguggcuggcugaccaccccgugaugauaaacucuguguugccucucguccugcacgccuuaggcaauccagaacuguccguuucaagcgugaguacgcucaagaaaauuugcagggaguguaaguacgaucuucccccuuaugcggcaaacaucguagccgugucucaggacguccugaugaagcaaauucauaaaacuucccagugcaugugguugaugcaggcucuaggcuuccugcucagcgcccugcaaguggaggaaauccuuaagaaucugcacucguugaucucuccauacauucagcagcucgagaaacuggcagaagagauaccgaaccccuccaauaaguuagcuaucguucauauucuggggcuacucucaaaccuguuuaccacacuugacaucagucaccacgaagaugaccaugagggaccugaguugcggaaacugccagugccccaggguccuaauccagucgugguaguucuccaacagguguuccagcugauacagaagguccuuagcaaguggcugaacgaugcccaaguggucgaagcggugugugccauuuuugagaaauccguuaagacuuugcucgacgauuucgcacccauggugccgcagcugugcgaaauguuaggccgcauguauucuaccaucccucaggcuagcgcccuggaccuaacaagacagcucguacacaucuucgcucaugagcccgcccacuuuccaccuauugaagcacuguuccuuuuggucaccucagugacgcugacucucuuucaacaggggcccagggaucauccagacaucguugauaguuucaugcagcuguuagcccaggcucugaaacggaagcccgaccuuuucuugugugagcgccucgaugugaaagcggucuuccaaugcgcagugcuggcccuaaaguuuccugaggcuccaacaguaaaagccuccuguggauucuuuaccgaacugcucccgcgaugcggcgagguggaaagcguugguaaggucgugcaggaggacgggagaaugcugcuuauugcaguguuggaggccauaggaggccaggcuucuaggucacugauggacuguuucgccgauaucuuauuugcacucaauaagcacugcuucagucugcuuagcauguggauuaaagaagcgcugcaacccccuggcuuuccauccgcucgguugucucccgagcagaaggacacuuucucgcagcagauccuccgugaacgcgucaacaaaagaaggguuaaggagauggugaaagaauuuacacugcuaugccgggggcugcacggaaccgauuacacggccgacuacuga

SEQ ID NO: 57779 - RNA, 3117 nt, Artificial Sequence
  derived and/or modified sequence opt3 from IPO7__Homo_sapiens__NP_006382
auggaccccaacaccaucauugaggcccugagaggcacaauggauccugcucucagggaagcagccgagcggcagcuuaaugaagcgcacaagagccugaacuucguguccacuuuguuacaaauaacgaugucugagcagcuggaccuaccaguccgccaggcugggguuaucuaccucaaaaauaugauuacccaguauuggccggaucgagaaacagcccccggagacaucucaccuuacacuauuccagaggaggaucgucauugcaucagagaaaacauaguggaggcaaucauucacagucccgaacugaucaggguacaacuuaccacauguauucaucacaucauaaagcaugacuauccuagccgguggaccgccauuguggauaaaaucgguuuuuaccugcaguccgacaauucugcuugcugguugggcauucuccugugucuguaucagcucgucaagaacuacgaguauaaaaagccagaggaacgcucgcccuuaguggcagccaugcagcacuuccugccuguucuuaaggauagauuuauccaauugcugucagaccagagcgaucagagugugcuaauccagaaacaaauuuucaagauauuuuacgcucucguccaguacacucugccacuugagcugaucaaucagcaaaacuugacagaauggauugagauccucaaaaccgugguaaauagggacguuccgaacgaaacgcuccagguggaggaggaugaccggcccgaauuaccuugguggaagugcaaaaagugggcccugcacauacucgcgcgccuuuucgagcgauauggguccccaggaaaugucucuaaggaauacaacgaguuugcagaaguguuccugaaagccuuugcugugggcguccagcagguuuugcuaaaggugcuguaucaauacaaagagaagcaguauauggcccccagaguacuccagcagacucugaauuacauuaaccaaggugugagccaugcacuuaccuggaaaaaucugaagccucacauccaggggaucauucaggacgucaucuucccauugauguguuauacagaugcugacgaggaacucuggcaggaggaucccuacgaauacauuaggaugaaauuugacguguucgaggauuuuauauccccgacuaccgccgcgcaaacacuguuauucaccgccugcucaaagcggaaggaaguucugcagaaaacgaugggauucuguuaucagauccuaacugagccuaacgcagacccccguaagaaagauggcgcucuccauaugauuggcagucuggccgagauccuuuugaagaaaaagaucuacaaggaccagauggaauauaugcugcaaaaccacguguuuccacucuucagcucugagcugggguacaugcgcgcuagagccugcuggguccuucacuauuuuugugaagugaaauucaaguccgaucagaaucugcagacagcauuggagcucaccaggcggugccugauugacgaucgagagaugccuguaaaaguugaagccgcuauagcguuacaagugcugaucucaaaccaggagaaggcaaaagaauacauuacucccuuuauccgcccagucaugcaggcccuacuccauauuaucagagagacagaaaaugacgaccugaccaacgugauacagaagaugaucugugaguauagcgaggaagucacgcccauugcuguggagaugacccaacaccuugccaugacauucaaucagguuauccagacuggaccugaugaagaggguagugacgauaaggcagugaccgccaugggcauuuugaacacaaucgacacucugcucucuguagucgaagaucauaaagagauaacccagcaacuggaggggauuugcuuacaggugaucggaacaguucugcagcagcacgugcuugaauuuuacgaggaaauuuucuccuuggcucauagccugaccugccaacaggucucgccacagauguggcaacugcuaccgcugguguuugagguauuccagcaggacggcuuugauuacuucacugacaugaugccccuccugcacaauuaugugacgguugauacagacacccuuuugucugauacuaaguaccuggaaaugaucuauuccauguguaaaaaggucuuaaccgguguggccggggaggacgcagagugccacgcggcuaaacuccuggaagugauaauccuucaguguaagggaaggggcauugaucaaugcaucccucuguuugucgaggccgcauuggaacggcucacacgcgagguuaagaccucagagcugagaacuaugugucuacagguggccauugcugcccuguacuauaacccacaucuccugcuuaauacauuggaaaaccugagguuccccaauaacguggagccuguaacgaaucacuucaucacccagugguuaaacgacgucgacugcuuucucggccugcaugaucguaaaaugugugugcuugggcugugcgcacuaauagacauggaacagauuccacaaguucucaaucaggugaguggacagauccugcccgcuuucaucuugcuguuuaacgguuuaaagcgggccuacgcgugucacgccgagcacgaaaacgauagcgacgaugacgaugaggcugaggacgaugacgaaacugaggaacucggcuccgaugaggacgauauugacgaagacgggcaggaguaucuggagauccuugcaaaacaagccggagaagauggcgacgaugaggacugggaagaggaugacgcugaagagacagcccuggaggguuacucuaccauuauagaugacgaagauaauccggucgacgaguaccagaucuucaaggcaauuuuucagacaauccagaaccgaaauccugugugguaucaagcguugacucaugggcucaacgaggaacagagaaaacagcugcaagauauugccacccuagcugaccagaggcgcgccgcacacgagagcaagaugaucgaaaaacauggcggauacaaguucucagcuccaguugugcccaguuccuuuaauuucggcgggccugcccccggaaugaacuga

SEQ ID NO: 57780 - RNA, 2499 nt, Artificial Sequence
  derived and/or modified sequence opt3 from IPO8__Homo_sapiens__NP_001177924
auggagagccugacccucaagggcuacgcccuuccccugcaguuggugaacaaucaaacaaugacuacguggauggaaaucuucagaaccauuauagacaggacagucccuccagagacuuuacacaucgaugaagacgaucggccggagcugguuugguggaaaugcaagaaaugggcucuacauauuguggcacgccucuuugaacgauaugggucccccggaaacguaaccaaggaguacuucgaguuuucugaguucuuucugaaaacauaugccguggguauccagcagguccuucugaagauuuuggaccaguaccgucaaaaggaauauguggcgccuagaguucuccagcaggcuuucaauuaccugaaccagggcgugguccacucaaucaccuggaaacaaaugaagccacauauacagaauaucagugaagaugugauuuuuagcguaauguguuauaaagacgaggaugaggaacuguggcaggaggaccccuacgaauacaucaggaugaaguucgauauuuuugaggacuaugccuccccuacuacagcagcccagacccucuuauacacggcugcaaagaagcggaaggaaguucugccaaaaaugauggccuucugcuaucaaauccuuacugaucccaacuuugacccucgcaagaaagauggggcuuugcacgugauaggaucucuggccgagauucuacucaagaaaucgcuguucaaggaccagauggagcuuuuucugcagaaucaugucuucccauugcuccugucaaacuuaggcuaccugagagcgaggagcuguugggugcuccacgcauucaguucccuuaaauuucacaaugaacugaacuugcggaaugccguggagcuagcuaagaagucucugaucgaagacaaagagaugccggucaagguugaagccgcacucgcucugcaaagccuuauuuccaaccagauccaggccaaagaguauaugaagccccaugugcgcccuaucaugcaggagcuguugcacauuguacgagaaaccgagaaugaugacgugacaaacgucauacagaaaaugaucugcgaauacucacaagagguggcgaguauugccguugauaugacucagcaucucgcagaaaucuucgguaaggugcugcagagcgacgaguaugaggaagucgaggauaagaccgugauggcuauggggauauuacacacaauugacaccauccugacgguaguugaagaucacaaagagaucacucaacagcuagagaauauuugucucagaaucauugaccuggugcuucagaagcaugucauagaauuuuacgaggaaaucuugucucuggccuacucccucacaugccacucaauuagcccacagauguggcaacugcuuggaauccuguaugagguguuccagcaggauuguuuugaauacuucaccgacaugaugcccuugcuccauaacuaugucacuaucgauacagacacccuguuaaguaacgcuaaacaccuggagauucuauuuacgaugugcaggaaggugcucuguggcgacgccggcgaggaugcagaaugccaugccgcuaaacugcuugagguuauaaucuugcaguguaaggggcggggaauugaccaaugcaucccucuguucgugcagcucguacuggaacguuuaacccgcggugucaagacaucugagcugagaacuaugugccuucagguggcgauugcagccuuguacuauaauccagaucuccugcuacacacccuggaaaggauccaacucccccacaacccgggcccuauaacaguucaguuuaucaaucaguggaugaacgacacugauuguuuccuggggcaucacgaccggaaaaugugcauuaucggacuuuccauuuugcuggaguuacagaaucgacccccagcuguggaugccgucgugggccaaaucguaccuagcauacucuuucuguuccuuggucugaaacaggugugugcaacccgccaguugguuaacagagaggacaggucgaaagccgaaaaggcugauauggaggaaaaugaggaaauuucuuccgacgaggaggaaacaaacgucaccgcccaggcaaugcaaucaaauaacgggcggggagaggaugaagaggaggaagacgaugacugggacgaggaagugcucgaggaaacugcgcuggagggcuuuaguacgccccuagaucuggacaauagcguggaugaguaccaguucuucacacaggcucucaucaccguccagucccgcgacgccgcaugguaucaacugcuuauggccccauugucugaagaucagagaacugcucugcaggagguuuacaccuuagccgaacauaggcguacaguggcagaggcuaaaaagaagauugaacaacagggcggguuuaccuucgagaacaaaggagugcucagcgccuuuaauuucgguacuguacccucaaacaauuga

SEQ ID NO: 57781 - RNA, 3126 nt, Artificial Sequence
  derived and/or modified sequence opt3 from IPO9__Homo_sapiens__NP_060555
auggccgcugcagccgcggcuggcgccgcaagcgggcugcccggaccuguggcccagggucucaaggaggcucuugucgacacccugacaggcaucuuguccccaguucaagaagugagagcagccgcugaggaacagauuaaaguauuagaggugacugaagaguucgggguccaccuggccgagcuaacgguggauccgcagggagcgcucgcaauaaggcagcuggccucuguuauccuuaagcaauacguggaaacccauuggugcgcucagucagagaaauuucggcccccugaaacaacugagcgcgccaagauugucauccgagagcuguugccaaacggccuccgugaaaguauuagcaaagugagauccucuguagcauaugcuguuucggccaucgcgcacugggacuggcccgaggccuggccucagcuguucaaucugcucauggaaauguuagugucaggugaucugaacgcaguccauggggcuaugagggugcuuaccgaguuuacacgggaagugaccgacacucagaugccauuggucgcccccguuauacugccugagauguacaagaucuucacaauggcugagguguauggcauucgcaccagaagcagggccguagaaaucuuuacgacuugugcacacaugauuugcaauauggaggaacuagagaagggagccgcuaaagugcucaucuucccagucgugcaacaguuuaccgaagcguucguucaggcacugcagauaccggauggccccacaagugacuccggguuuaagauggaggugcuuaaagccgucacugcucuggugaagaacuucccuaaacauaugguaucuagcaugcaacagauuuugccaaucguuuggaauacccucacagaguccgccgcauuuuacgugcggaccgaagucaacuauacggaggaaguggaggaucccgucgacucagauggagaagugcuggguuucgagaauuuaguuuuuaguauuuucgaguucgugcacgcccugcucgaaaacagcaaguuuaagucuacuguaaagaaggcccuuccugagcugaucuacuauaucauuuuguacaugcagauaacagaagaacaaaucaaagucuggaccgcuaauccacagcaguucguggaggacgaagaugacgauacuuuuuccuacacaguucgcauugcagcgcaggaccuacugcucgcuguggccaccgacuuccaaaacgagucagcagccgcucuggccgcagcugccacgcgacaccuucaggaagcggagcagaccaagaauagcggcacagaacauugguggaaaauccacgaggccuguaugcuggcuuuggggagugucaaggcaauaauuacugauucugugaaaaacggaagaauccauuuugacaugcacggcuuccucaccaauguaauccuggccgauuuaaaccuguccgugagccccuuucuacucgguagggcucugugggccgcaucgcgguucacaguugcgaugucuccggagcuuauucagcaauuuuugcaggccacugucuccgggcugcacgaaacccagccucccucagugcguaucagugcugugcgcgccauuuggggauauugcgaccagcucaaggucagcgaguccacacauguucugcaaccauuccuuccuucuauacuggauggcuugauccaccucgcagcucaguuuagcucagaagugcugaauuuagugauggagacccuguguauuguaugcacugucgaccccgaguucacggccaguauggaguccaagaucuguccauuuacaaucgcaauuuuccuaaaauacagcaacgaucccgugguugccucucucgcucaggacauauucaaggagcugucacagaucgaagcgugccaaggcccuaugcagaugagacuuauuccaaccuuggugaguaucaugcaggccccggcagauaaaauucccgcugggcugugugccacugccaucgacauacucaccacagucgugaggaacaccaagccuccacugagccaauuacugaucugccaggcuuuucccgcaguugcccaguguacucuucauacagaugacaaugcgacgaugcagaacggaggugagugcuugcgggcuuauguguccguaacccucgaacaagucgcccaguggcacgacgagcagggccauaaugggcugugguacgugaugcaaguggucucucagcuacuggauccucgaacuucggaguucacagcagccuuuguuggacgccucgugagcacccugauuuccaaagcuggcagagaacuuggugagaacuuggaccagauccugagggcaauuuuaucaaagaugcagcaggccgaaacacucaguguaaugcaaucucugaucaugguguucgcgcaccuuguccacacucagcuggagccauugcucgaauuucugugcagccuacccgggccgaccggcaagccugcucuggaguucgugauggccgaguggacgucccggcagcaucucuuuuauggacaauacgaaggcaaaguuucaagcguggcacuguguaaacuuuugcagcacgggauaaaugccgaugacaaacgccugcaggauauuagagucaagggagaggaaaucuauucuauggacgaggguauuaggacccguuccaaaagugcuaagaacccagaacgguggacaaauauccccuuacucgugaagauacugaaacuuaucauuaacgagcugagcaauguuauggaggccaacgcagcucgacaggccacuccugcggaauggucucaagaugacuccaaugauaugugggaggaccaggaagaggaagaggaggaagaggaagauggccuagccgggcagcuccugucagacaucuuggcaaccaguaaguacgaggaagauuacuaugaggacgacgaggaagaugaccccgaugcucugaaagacccauuauaccagauugaucuccaagccuaucugacagacuuccuuugccaguuugcucagcagccuuguuacaucauguucagcggacaucugaacgauaaugagagaaggguguugcaaacuauaggcauuuga

SEQ ID NO: 57782 - RNA, 1797 nt, Artificial Sequence
  derived and/or modified sequence opt3 from IQCB1__Homo_sapiens__NP_001018864
augaagcccaccggcacagacccuagaauccugagcauugccgcugagguggcaaaauccccagaacagaacgucccgguuauacuccuuaagcugaaagagaucauuaauaucacucccuuggggucuucagaauuaaagaaaauuaagcaagauaucuacugcuaugaccugauacaguacugucuacucgugcugagucaggauuauagcaggauccagggagguuggacgaccauuucccaacuuacacagauccugucucacugcuguguaggcuuggagccuggggaagacgccgaggaguucuacaacgaacuccugccaucggcggcugagaauuuucuggugcucggacggcaguuacagacuugcuucauuaacgccgcaaaggccgaagagaaagaugagcugcuucacuuuuuccaaaucgucaccgacucauuguuuuggcugcuaggcggucauguggaacucauacagaauguucugcagagcgaucauuuccuucaccuguugcaggcugacaacgugcaaauugggagugcagucaugaugaugcuccagaauauccugcagauuaacuccggagauuuacugcgcaucggccgaaaggcccucuauucuauccuugacgaggugauuuuuaaacuguucagcacacccuccccuguaauacguucaaccgcuacuaaguugcuacugcucauggccgaaagucaucaagagauccugauucuucugagacagagcacauguuacaaaggcuugaggcggcuccugucuaagcaggaaaccgggacggaguuuucccaggaguuacgccaacugguuggacuacucucaccaaugguguaucaggaagucgaggaacagaagcugcaccaggcggcaugccuuauccaagccuacuggaaagguuuccagacuagaaagagguugaaaaagcugcccagcgcugugauagcccuccagcggaguuuucgcucuaaacgauccaagaugcugcuugagauuaauagacagaaagaagaggaggaucugaaguugcaacuccagcugcagaggcagcgggcaaugcguuuaagccgcgaacugcaacuaucgaugcucgagaucgugcacccuggccaggucgaaaagcauuacagagagauggaagagaaaucugcucugaucauucagaagcacuggaggggguaucgggagcgcaaaaacuuccaucaacagcgacagucccuuaucgaauacaaggccgcgguuaccuugcagagagccgcacugaaauuucucgcuaaguguaggaagaaaaagaaacuguucgccccauggcggggauuacaagagcugacagacgcucgcagaguggaacuuaagaaaaggguagaugacuaugugcgucggcacuugggcucaccgaugagugacgucgugagccgagagcuccacgcccaggcacaggagagacugcagcauuacuucauggguagggcccuagaggaacgcgcucaacagcaccgggaagcgcugauugcacagauauccacuaauguugagcagcucaugaaggcccccucucugaaggaagcugaggggaaagagccugaauuguuucuuagcagaucaaggccaguggccgcaaaggccaaacaagcucaucugaccacauuaaagcacauccaggcccccugguggaaaaagcucggagaggaaaguggcgaugagauugacgucccuaaggaugaacuguccaucgagcuugagaaccuguucaucggcgggaccaaaccacccuga

SEQ ID NO: 57783 - RNA, 1332 nt, Artificial Sequence
  derived and/or modified sequence opt3 from IQCG__Homo_sapiens__NP_001127907
auggaggaagacagccuggaggauuccaaccuucccccuaagguguggcacucugaaaugaccgucucaguuacaggcgagccaccgaguacuguggaagaggaggggauccccaaagaaacggacauugagauaaucccugaaauuccagagacccucgagccccugagcuugccugauguauuaagaaucuccgccgugcuggaagacacaacugaucagcuaucuauucucaauuacaucaugccaguccaauaugagggaaggcagucgauaugcgugaagucacgggaaaugaaccuggaggguaccaaucuugacaaacugcccauggcuagcacaaucaccaagauuccuaguccauugaucacugaagagggcccgaaccuccccgagauucgccaucgagggcguuucgcaguugaauuuaauaaaaugcaggaucugguguucaagaagccuacaagacagaccaucaugacgacugagacccugaaaaagauacaaauugacaggcaguuuuucuccgaugucaucgccgacacaauuaaagaacuccaggauucugcgacuuacaacagcuuacugcaggcucuuuccaaggagcgggaaaauaaaaugcacuuuuaugacaucaucgcccgcgaggagaagggaagaaagcaaauuauaucauugcagaaacagcugaucaacgugaagaaagaauggcaguucgagguacaaagucagaaugaauacauugcaaaccuaaaggaucagcuccaagagaugaaagccaagagcaaucuggaaaacagguauaugaaaaccaauacagagcuucagaucgcucagacccagaagaaguguaaccggacggaggaacuguugguugaggaaauagagaaacuccgcaugaagacugaggaagaggcacgaacacauaccgaaauugagauguuucugagaaaagaacaacagaaguuagaggagaggcuggaguucuggauggaaaaauacgacaaggacacugaaaugaagcagaaugagcucaacgcccuuaaagcuacaaaggccucugaucuggcgcacuugcaggaccuagcaaaaaugauccgggaauaugagcaagugaucauugaggaucguaucgaaaaggagcgcuccaaaaagaaggucaaacaggaccugcucgaacugaagucagugauuaaacuucaggccugguggagaggcaccaugauaaggcgggagaucgguggguuuaagaugccaaaagauaagguggacagcaaggauaguaaaggaaagggcaaaggcaaggacaaacgacgcgggaagaaaaaguga

SEQ ID NO: 57784 - RNA, 3084 nt, Artificial Sequence
  derived and/or modified sequence opt3 from IQCH__Homo_sapiens__NP_001026885
auggcccagaacaccgagaaucacgaccccgugggcagcauccugauucaaauacaugaagaucucuaccagcuuaaggagaaacugacaaaguucuccccugaagagaaaggggaaacuuuggacauccagucuuuagagacggcuauuaagagaaccgaggucggacugaggauccacauugaaaaauaucuaaacguugugaaucagaacguacucacaacuucagugaaugaugagagucuguacaccccacaagcaagcaaguggcuucugccgacagucaucgaccagaaguccuuuauauucccccaggaaucugaggguaccuuuuggcagccucaacggcagcauucgucaagccuuccaguguucccccgcgccaaaaucaagguuaguaaacucauuaagggcuccaacaucucuagccugacugugcugccuuccucacacugcacagauccauauuuuacccccauuccuguccuccaggcggacgcucauaaagggaucuuaaguaugauagagcgaggacugauuccaccgacggcccguaucacuuuccagaaucccccuauuaccccaagagcagcccccuugcacagcuuugaugaagcuaggaagaucccuacaguggcaacuuucaccaucccacgggagcccccgccuucucccgccgaaguaaaguuuuucccaaagaagcaacgcuccaaaggcaagucaagaaggagccggggucaccaugaccgcaaagcuaugaagguuaaaacaccuuugcgagcccugaagagucuaugggauuacgacuuucucauuuaugauggggugauagacaacaccgcgcccgauuuccuggcauuuaaggagcacuucucucuugccuggggaggcaucuucucccuguuggaacaugucgagaaauuucucagaaauuacgcuauuccagaggugaagaucaaaggcaacaaucugguggccuuacugcccgaguucgaacucacgaacaaacuuacuagguaugaccuguugagcguccuagaagacccugcacacguucagaugcugauaaaucucccagggcagcgguacaaaggacaagaugguaacucggaggcugccaugaagauucaggcgacauggaaguguuacaaagcccguaaguuuuuccuguuuuaucgccagcagaaaugggcaucuggcgugaucgcuaucgccuggcuucuguacugccacaagaccagauugaaaaagauucucaaggaauccaggcaacggcaucuggagaauuuccgaauccgcgcuaaacacuuagccgcaaacuggaacagaauuaggacuucacggcgcacaauaauccauauuccgagucugggguauagccagcccguaagagagcacaucgccgacuuuaauacccagcagaacaugcaacuaggaaggcucugugauauccuggacgcuaaugugaacgucauuuacauaugcucccaucacaugaaugaugaacuuguguuguauuacaagaaaauccugucucuccacgcggcaguuaagagcggcaaccuggaggaccguucagaucuucaggaccgguucaaaauuaucacgccugaagccgugaauauuuuuccaaagcaucacaugugucuggcuacccauuugauguauagucccaaggccaucaaacgaauaaagaaccucaucagagguacagaggcauacauugucuccgggcuguuacacagggaugaccuggccguggcugauaugcuagacaucccuauucucggaagcgaaccagagcuggcccaccuuuacucuacuaaaucaggcggcaagcgcguauucgacagugcaaauguugcggugcccccggggaucuaugauauauacagccagcagcaaaugauugagcaguugucccagcugaucaccgaccaucuccagauucaacgguggcuguuuaaaauggauucugaguucagaggaaacgguacagcuuuuugcgacaucccuucguauuuaaaguguuacaaauggguccugaaggaaagcuccagguauggccuugaagauuggcgcaagaaaugggcccaggagccagcauuggugaagauaucagaggaacucgccgggauccuggcucagcacgcccaacccgucaaugagaaacgauucccuacuuggcggaaguuccuacagaccuuucugagucagggaggcgugauugaagcauucccaccagcugacaacguuacaaaucucaccguggauaugcugaucgagccuaacgguaaaauuucuguacuuagcacuggggaccaguugcaugccgaaucccccuuuaucucaagcggcacgacagucccacaaaccucuguggauccgcagguucugacuuacuuaugccuccagauaggaaaggcgugucguaugagagacguggucggcuauuucuccauugaucuggugaccuuuaucgacccuaguacacuugagcagcaaguaugggccaccgggcugaauuuggcuuacagcgaucagcucgcacugacucagcuaacacuguaccucacgaacggacaccuggacugcucucuuuccaccuuggaggugcccagguucguuccaaaggaacgcaaaaagacuaaauguaugucagcccugaguaugcccauguuagcuacaagccgguaugccgucaugaccacacagcucagacauucgaaccugucccuuguguuucacuacguguuccugcaaaucugcagggcacacgguauuggcuaugaccuagaggaacgacaggggacugucuuuauccucuacgagcaucugaagcgccacaaauugggaaugcugaccauuggcgaagauuuacaggguguucucaugacguucgcgcggcaucuguuuauaauccaccaagagauuucugccccuaauaugcagggggagaccaacuucaagacaacuaucgcugacauugaaaccauccuuagagugacaaaggagaauaaaaugagguuugaagaggaacagcagagcaaggaugacaaaaaccugucaaagcccaaaaaguga

SEQ ID NO: 57785 - RNA, 480 nt, Artificial Sequence
  derived and/or modified sequence opt3 from IQCJ__Homo_sapiens__NP_001036170
augagacuggaggaacucaagaggcuucagaacccccuggagcaagugaaugacggcaaauacagcuucgaaaaccaccaguuggccauggaugcugagaauaacaucgaaaaguauccuuuaaaucugcagccacuagaguccaaagucaagauuauacagcgggcauggcgcgaguaccuccaacgacaggaaccgcuggggaaacguucucccucaccuccaaguguuagcuccgagaaacuuucuucgucagugagcaugaacaccuuuagugacuccucuacacccuucgccagagcgccuguaggaaagauccauccauauauuagcuggaggcugcagucccccggugauaaguugccuggcgggcggaaggugauccuccuguaccuggaccagcucgcucgcccaacuggauuuauucacacguuaaaagaaccgcaaaucgagagacugggcuuccuuaccuugcaguga

SEQ ID NO: 57786 - RNA, 1692 nt, Artificial Sequence
  derived and/or modified sequence opt3 from IQCJ-SCHIP1__Homo_sapiens__NP_001184042
augagacuggaggaacucaagaggcuucagaacccccuggagcaagugaaugacggcaaauacagcuucgaaaaccaccaguuggccauggaugcugagaauaacaucgaaaaguauccuuuaaaucugcagccacuagaguccaaagucaagauuauacagcgggcauggcgcgaguaccuccaacgacaggaaccgcuggggaaacguucucccucaccuccaaguguuagcuccgagaaguuaucuucgucagugagcaugaacaccuuuagugacuccucuacacccgauuauagagaagacggaauggaucuggguagcgacgccggcuccucaaguucuagcuccagggcgucaagccagaguaauucuacuaagguaacgccuugcuccgaguguaaaagcucgucuuccccagggggaucauuggaucucgugagugcucuggaggacuacgaagaacccuucccugucuaucagaagaaagugaucgaugaaugggccccagaggaagacggcgaggaggaagaggaagaggaugaacgggaccaacgcgguuacagagaugacaggagcccggcacgggagcccggggacguuuccgcccgcacccgaucuggaggcggcgggggaagaagcgcuacaacugcaaugccuccacccgugccuaacgguaaucugcaucagcacgauccacaggaccucaggcauaacggcaaugucgugguagccgggcggcccucaugcagucguggaccgcgcagagcuauucagaagccucaacccgccggcgguaggcgguccgggcgaggaccagcggcaggcggcuuaugucugcagccucccgaugggggaaccugcguuccagaggaacccccugugccaccgauggacugggaggcccuugaaaaacacuuggcuggucugcaguuucgcgagcaagaagucagaaaccagggccaggccaggacaaauagcaccucugcacagaagaacgagcgggagucaauccgccaaaagcuagcucucgggaguuucuuugaugacggacccggcauuuauacuagcuguuccaaaucugguaagccuucgcugagcuccagacuucagucagggaugaaucugcagaucugcuucgugaacgauaguggcucugacaaagauagcgacgccgaugacuccaagacagaaaccucauuggacacgccacucagccccaugucuaaacaguccaguagcuacucugauagggacacuaccgaggaagaguccgagucacuggaugacauggauuuucuuacacgucaaaagaaacugcaggcggaagccaagauggcacucgcuauggccaagccuauggcuaaaaugcaaguggaggucgaaaagcagaaccggaaaaagaguccaguugccgaccuucugccccauaugccgcacauaagcgaguguuugaugaaacgaucgcuaaagccuacugaucugagagacaugaccaucggacagcuccaggugauuguaaaugaucugcacucccagaucgaaucucuuaacgaggagcuggugcaguugcuccugauuagggacgaauuacauacagagcaagaugcaaugcuggucgacaucgaagaucuaacccgccacgccgagagccagcagaagcauauggcugagaaaaugccagcgaaguga

SEQ ID NO: 57787 - RNA, 864 nt, Artificial Sequence
  derived and/or modified sequence opt3 from IQCK__Homo_sapiens__NP_694940
auggccgcucccagacagaucccuagccacauugugaggcuuaagccauccugcucuaccgacucaaguuucacacggacuccgguccccacgguuagccucgcaucccgcgagcuuccugugucuucguggcaaguaaccgaaccaucaagcaaaaaccugugggagcagauauguaaggaauacgaggccgaacagcccccuuuuccagagggcuauaaagugaagcaggagcccgucaucacaguggcgccuguugaagagauguuguuccauggguuuagugcugaacacuacuucccagugucccauuuuacuaugauuucucgaaccccgugcccccaagauaaaagcgagacaaucaauccuaagaccuguuccccaaaggaguauuuagaaacuuucauuuuucccguccugcuaccuggaauggccucacuccugcaccaggccaaaaaggagaaaugcuucgaacguaagagaacaaaauuuaucgcaugugacuuccuuaccgaguggcuguacaaccagaauccaaagagggcuggugaacccuuuacggaguucuuuaguauaccguucguggaggaacgguugaagcagcauccuagacccccaaucccucucagccugcugcucacugaggaagaggcagccuuauauauucaaucuuucuggcgcgcuugcguaguuaggugugaucccgaaauccaggagcugcggcaguggcagaaaaagcugcgcgaggccaaacacauucaccaacaggugaagaucuuuugggcgaaacaggaacaaaaggucaaaugcaagauggaggacgaugcagugccagccgcuaagaugaaaauacccuccucauga

SEQ ID NO: 57788 - RNA, 4974 nt, Artificial Sequence
  derived and/or modified sequence opt3 from IQGAP1__Homo_sapiens__NP_003861
augagcgccgcugacgagguggauggccugggggucgcaagaccccacuacggauccguucucgacaacgaaaggcuuaccgccgaggaaauggaugagcggcgccgacagaauguggcguaugaauaccugugccauuuggaggaggcuaagcguuggauggaagccuguuuaggugaggaccugccuccaacaacugaacuagaggagggccucagaaacgggguauaucuggcaaaacuuggaaauuucuuuucuccgaagguggucucacugaaaaagaucuacgauagggaacaaacgcgguauaaagccaccggcuugcacuuccgccauacagacaacgugauucaguggcucaaugcuauggaugagauaggucugcccaagaucuuuuacccugaaacuaccgacauuuaugauagaaagaacaugccaaggugcaucuacuguauucacgcacugagucucuacuuauucaaacuggggcuugcuccccagauccaggacuuguauggaaagguugauuuuacagaggaagagauaaauaacaugaaaaccgagcuggaaaaguacggcauccaaaugccugcuuucagcaaaauuggcgggauccuagccaaugagcucuccguggacgaagcggcacugcaugccgcugucauugccaucaacgaggcaauagaucggcgcauuccagcugacacuuuugccgcgcuuaagaaucccaacgccaugcuggugaauuuggaggaaccucucgcaucuacauaucaggacauccuguaccaggcuaagcaggauaaaaugaccaacgccaagaaucgaacggagaacucggaaagagagagggacguauaugaagaguuacugacucaagcugaaauucagggaaacaucaauaaaguuaacaccuucucagcccucgcaaauaucgaucuugcccuggagcagggugacgcuuuggcgcuauuucgggcacugcagagcccagcccucggccugcgugggcuucaacagcagaacagugauugguaccugaagcaauugcucuccgacaaacagcagaagcgccagucuggacaaacagauccgcugcagaaagaggaauuacagagcggcguggacgcugccaauuccgcagcccagcaauaucagagaaggcuggcugccgucgcacuaauuaacgcggcuauacagaaggguguggccgagaagacugugcucgaacugaugaaucccgaggcacagcuuccucaagucuacccauucgccgcugauuuguaccagaaagagcuggccacccuccagcggcagucacccgaacacaaccugacacacccugagcuuaguguugcaguggaaaugcugagcucuguagcuuugaucaaucgagcccucgaguccggggacgugaacaccgucuggaagcaacugucaagcagugugacgggauuaacuaauauugaagaggagaacugccagcgcuaucuggaugaacuaaugaaacucaaggcgcaggcccaugcugagaauaacgaauuuaucacauggaaugacauacaagcauguguugaccacgugaaccuggucgugcaggaggaacaugagagaauccuugccaucggcuugaucaacgaggcucuggaugaaggcgacgcccagaaaacccuccaggcacugcaaauuccagcggccaaguuagaggggguacuggcugaaguugcccagcacuaccaggauacucuuaucagggcaaagcgggagaaagcucaggaaauucaagacgagucugccguguuguggcucgaugagauacagggagguaucuggcaguccaauaaggacacacaggaagcacaaaaauucgcccugggcauuuuugcuaucaacgaggcggucgaaagcggggaugugggaaagacccuaucggcccugcgcucucccgacgucggccucuauggugugaucccggagugcggggagacguaccacuccgaucuggcagaagcuaaaaagaagaaacuugccguuggcgacaauaacucaaagugggugaaacauuggguaaagggaggcuauuacuauuaccacaauuuggagacccaggaagggggaugggaugagccucccaacuucguccagaauaguaugcaacugagcagagaagagauucaguccucuauaagcggugugacagccgcuuacaacagggagcaguuauggcucgcaaaugaaggccugaucacucgucuucaggcccggugucgaggguaucugguuagacaagaguucaggucacgcaugaacuuuuugaaaaagcagauuccagcgauuaccugcauucagagucaguggcggggauacaagcagaaaaaggcuuaucaagacagacucgccuaccugaggucccauaaagaugaaguggucaagauccagagccuagcacgcaugcaccaggcccgaaaacgguaucgugacagacugcaauacuucagggaccauauaaaugauaucauuaagauccaggcuuuuauucgcgcaaacaaagcccgggacgauuauaagacacucaucaaugcggaggacccucccauggugguagugagaaaguucguucaucugcuugaucagucugaccaggauuuucaagaagaguuggaccugaugaaaaugagggaggaagucauaacuuuaauucgaucaaaccagcagcucgagaaugaucugaaccuuauggacaucaagauuggccugcuagugaaaaacaagaucacccuccaagauguggucagucacagcaaaaagcugacaaagaaaaauaaggaacaguuguccgacaugaugaugauaaacaaacagaagggugggcugaaagccuuaucuaaggagaagcgcgaaaaacucgaggccuaccagcaccuguucuaccuucugcaaaccaauccaacuuauuuggcaaagcucaucuuucagaugccccagaacaaaucgacgaaguucauggauagcguuauuuuuacacuguacaauuaugccuccaaccagcgggaggaauaccuacugcuuagacucuucaaaaccgcucugcaagaggaaaucaagucaaagguggaccagauucaggagaucgugacuggcaauccuaccguaauaaaaauggucgugaguuuuaacaggggagcccguggccagaaugcauugcgccaaauucuggcuccaguugugaaggagaucauggacgauaaaucuuuaaacaucaagacagacccggucgauauuuauaaaagcugggugaaucagauggaaucccagaccggggaggccucaaagcuccccuacgacguuacuccugaacaagcgcuggcccacgaggaagugaaaacacggcuugauagcucuaucagaaacaugagggcaguaacggacaaguuccuguccgcuauugucaguagcguggauaagauaccauauggaaugcgauuuaucgccaaaguguugaaggacucucuccaugagaaauuccccgaugcuggugaggacgaacugcuaaagauuaucggcaaucugcuuuacuaccgguauaugaacccugcaauugucgccccagaugccuucgacaucauagaccucuccgcugggggacagcugaccacugaucagcgcagaaauuugggcucaaucgcgaaaauguuacagcacgcagccaguaacaagauguuucugggugacaacgcucaccucagcauuaucaaugaguaccugucgcaauccuaucagaaguucaggcgguuuuuccagacagccugugauguucccgaacuucaggacaaauuuaacguggaugaguacucugaccugguaaccuugacaaagccggugauuuauaucagcauaggggaaauuaucaauacucauacccuacugcucgaucaccaagacgcaaucgccccugagcauaacgauccaauucacgagcugcuugacgauuuaggcgaaguccccacgauagagucacugaucggagaaaguuccggcaaucucaacgacccuaauaaagaggcuuuggcgaagaccgaagugucucugacacucacuaacaaauucgauguucccggggacgagaaugccgagauggacgcacgaaccauucugcuuaacacaaagagacugaucguggaugucauucgcuuucagccaggagaaacuuugaccgagauccuagaaacgccugcuacaagcgagcaggaggccgaacaucagagggcaaugcaacgucgggccauaagagacgcuaagacccccgauaaaaugaagaaauccaagucagugaaagaggacagcaaucugacucuccaggaaaagaaggagaaaauccagacaggcuuaaagaaacugaccgaacuugguacuguugauccaaagaacaaauaccaggagcugauuaaugacaucgccagggauauucgcaaccaacgaagauaucggcagaggcgcaaggcggagcucgugaaguugcagcaaaccuacgcagcccugaauaguaaagcuacauucuacggggaacaggucgacuauuacaagucuuauaucaaaacgugccucgauaaccuggccuccaagggaaaaguaagcaagaaaccgcgugagaugaagggcaagaaaucgaagaaaauaucacuuaaguacaccgcugcaagacuacacgaaaaaggugugcuguuggagauugaagacuuacagguuaaucaguuuaagaacgugaucuucgagaucucuccuacugaggaagucggcgauuuugaggugaaggccaaauucauggggguacaaauggaaacauuuaugcugcacuaucaggaccuccugcagcuucaguacgagggaguggcugucaugaagcuguucgaucgggccaaaguuaacgugaaucucuugauuuuccugcuaaacaagaaauuuuauggcaaguga

SEQ ID NO: 57789 - RNA, 3216 nt, Artificial Sequence
  derived and/or modified sequence opt3 from IQGAP2__Homo_sapiens__NP_001272390
augcacagccugcccggcguggucgccguuggguacaucaacgaggcuauugacgaaggaaauccucucagaacccuugagacacuguuguuaccaacugcaaacauauccgauguggacccggcccaugcgcagcacuaucaagauguacuguaccaugcuaagucucagaaacuaggugacucagaaagugugagcaagguccucuggcuggaugagauccagcaggccguggacgaugcaaauguugacgaagauagggccaaacaaugggugacgcuugucguggacguaaaccagugccuggagggcaagaaauccucugauauuuugucgguucucaagucaagcaccaguaaugcuaacgacaucauucccgagugugcagauaaguauuacgacgcccuggugaaagcuaaggaacugaaauccgagcgggucucuagcgacggguccuggcucaaguuaaaucugcacaaaaaguaugauuacuauuacaacacagacucaaaggaaaguagcugggugacuccugagucuugccuuuacaaagaguccugguugaccggaaaggaaaucgaggccuucuggaaaggcuauaagcagcgcaaagaauacaugcaucgacgucagacauuuauagauaauaccgacucaaucgugaagauucaaagcugguucagaauggcgacugcaaggaaaaguuaucugucucggcuacaguacuuucgcgaucacaacaaugagaucgucaagauucagucccuccugagagccaacaaggcuagggacgauuauaaaacacuuguugguagcgaaaauccaccccugaccgugauccggaaguucguauacuugcucgaccagucggaucuggacuuucaagaggaguuagaaguggcccgccugcgagaggaagucgugacgaaaauaagagcaaaccagcagcucgagaaggaucuuaaucugauggacauuaaaaucggguugcuaguuaagaacaggauuacucuggaagacgugaucucucacuccaagaaacucaacaagaaaaagggaggcgagauggagauccugaauaacaccgauaaucaaggcauuaaaucacuuaguaaggaacggcguaagacacuggagacuuaucagcaguuguucuaccuccugcagaccaacccuuuauaccuggcuaaacuaauauuucaaaugccacagaauaagagcacaaaauucauggacaccgucaucuuuacgcucuauaacuacgccuccaaucagcgcgaagaguaucugcuuuugaagcuguucaaaacugcgcucgaagaggagauuaagucuaagguggaucagguacaagacaucguuacagggaaccccaccgugauaaaaauggucgugagcuuuaauagaggagccaggggucagaacacucugcggcagcuucuggcaccugucgugaaggaaauuaucgaugacaaaucauugaucauuaauacaaacccaguugagguguacaaggcuuggguaaaucagcucgaaacccaaacgggcgaggccaguaaacugccguaugaugucaccacagagcaggcuuuaacuuaccccgaagugaagaacaaacuggaggccuccaucgaaaaucuacgacgcguuaccgacaaggugcucaacagcauuauaucuucacuggaucuuuugccuuaugggcugagauacaucgcaaagguccucaaaaacaguauucaugagaaguucccagacgccacagaagaugagcuguuaaaaaucgugggaaaucugcuuuacuauagguacaugaaccccgcuaucguagcgccugacggcuuugauauuauagacaugacugccggugggcagaucaauagcgaccagcggcgcaacuugggauccguggcaaagguucuccaacacgcugccucuaauaaacuguucgagggcgaaaacgagcaucuaucgagcaugaauaacuaucuguccgaaaccuaccaggaguucagaaaguauuuuaaggaagcauguaaugucccagagcccgaggaaaaauucaacauggauaaguacacagaccucgugaccgugucaaaaccggucauuuauaucaguauugaggaaaucauaucuacucacagccugcuuuuggagcaccaggaugccaucgcuccugaaaagaaugaccuguuauccgagcuccugggcucacuuggggagguucccacgguggagagcuuucugggagagggugccguggauccaaacgacccuaauaaagcaaacacauugucucaacucuccaagaccgaaauuagucugguacuaacuagcaaguacgauaucgaggacggcgaggcgauugauucuaggucccugaugaucaaaaccaagaaacucauaauugacgucauccguaaucagcccgggaacacacugaccgaaauucuugagacuccagcuacagcccagcaggaaguggaucaugcaacggacaugguuucacgggccaugaucgauagucgaacccccgaggaaaugaagcacagccaaucgaugauagaggacgcucaguugccucuggagcagaaaaagagaaagauccagaggaacuuacgcacucucgaacaaacaggacauguguccucugagaauaaauaccaggacauucugaacgaaaucgccaaggauauucggaaucagagaaucuauaggaaacuucgcaaggcagagcuggcuaaacuacagcaaacccucaacgcccugaauaagaaagcggccuucuacgaagaacagauaaacuauuacgacacauauauuaagacuugcuuggauaaucugaagcggaaaaacacccgacguagcaucaaguuagacggcaaaggugagccaaagggggcuaaaagagcaaagccggucaaguacacggccgcuaaacuccacgaaaagggcgugcugcuugauaucgacgaucugcagaccaaucaauuuaaaaacguuacauucgacauuaucgccacugaggaugugggaauuuuugacguaaggucaaaguucuugggcgucgaaauggagaaagugcagcucaauauacaggaucugcuacagaugcaauaugaagggguggcagucaugaagauguuugacaagguuaaagugaacguaaaucugcuuaucuaccuccugaacaagaaauucuacggaaaguga

SEQ ID NO: 57790 - RNA, 4896 nt, Artificial Sequence
  derived and/or modified sequence opt3 from IQGAP3__Homo_sapiens__NP_839943
auggagagaagggccgcuggccccgggugggcagccuacgaacggcugaccgcggaggaaauggacgagcagcgccgacaaaacguggcuuaucaguaccucugccgucuugaagaggccaagagauggauggaggcaugucugaaagaagaguugccuagcccagucgaauuagaggagucccugaggaauggaguucuacucgccaagcugggucacugcuucgcuccgucugugguaccccuuaaaaagaucuaugauguggaacagcugcgguaccaggcaacaggcuugcauuuucgccacacugacaacauuaauuucuggcucucagccauagcucauaucgggcugccuaguacguuuuucccagagaccacagauauuuaugacaaaaagaacaugcccagagucguguacuguauccacgcccugagccucuuuuuauucaggcugggacuugcgccucaaauucaugauuuguauggcaagguuaaauuuacugcagaagaacuguccaauauggccucugaacuagcuaaguacggucuccagcugccagccuucucgaaaaucgggggaauacuugcaaacgagcugucaguggacgaggcugccguccacgcggccguguuggcaaucaaugaagcuguagagcggggcguuguggaagauacccucgccgcucugcagaaccccagcgccuuacuggagaaucuccgcgaaccucuugcagccgucuaccaggagaugcuggcucaagcgaagauggagaaagcagccaacgcucgaaaucacgacgauagagaaagucaggacauuuaugaucauuacuugacacaggccgagauccagggcaacauuaaucacgugaacgugcauggggcacuagaagucguugacgaugcccuggagaggcaauccccagaagcucuccugaaggcccuucaggacccggcacuggcguugcggggagugcgucgcgacuuugcugauugguaucucgagcaguuaaauucugacagagagcaaaaggcccaggaacugggucugguagagcuacucgaaaaagaggaggugcaggcaggcgucgccgcugccaacaccaagggggaucaggaacaagcaaugcugcacgcugugcagaggaucaacaaagccauacggcgaggaguugcggccgacacugugaaggagcuuaugugccccgaagcucaguugccuccagucuaccccguggcaagcuccauguaucagcuggagcucgccguacugcaacagcagcagggcgaacuuggucaagaggagcuguucguugcuguggaaauguugucagccgucgugcucauuaaucgcgcacuggaggcgagagaugccaguggguuuuggagcucuuuagucaacccugcuacaggacuggccgaaguggagggcgaaaaugcacagagguacuucgacgcucuacucaaacugcggcaggagcgcggcaugggggaggauuuucuuuccuggaacgacuugcaggccaccguuucacaagugaaugcacagacgcaggaagagacugauagaguacuggccgucagccucaucaacgaagcucuggacaagggaaguccagagaaaaccuuaucugcgcugcuuuugcccgccgcaggucucgaugacgugucccugccgguugcuccuagguaucaccuacugcucguggccgccaagcgucaaaaggcucaggucacaggcgaccccggggcagugcuguggcuugaagagauucggcagggaguagugcgagccaaucaggauacuaacaccgcgcaaagaauggcuuugggcguugccgcaaucaaucaggccaucaaagaggguaaggcugcacagacagaaaggguccugcgcaacccagccguggcguuaagagggguggucccugacugugcuaauggcuaccagagagcccucgagagcgcaauggccaaaaagcaaaggcccgcugauaccgccuucuggguucagcaugacaugaaagauggaacggcauacuauuuccaucugcagacuuuucagggcauuugggaacaaccacccgggugcccucuuaacacaucgcaccugacccgcgaggagauacagucugcugugacuaaggugacagccgcguacgaccgacagcaauuguggaaggccaauguaggauucgucauccagcuccaggcacggcugcgugguuuucuagugagacagaaauucgcugaacacucccauuuucugaggaccuggcucccagccguuauuaagauccaagcucacuggcgcggcuaucggcagagaaaaauauaccuggaguggcuucaguauuucaaggcaaacuuggaugccauuaucaaaauccaggccugggcuaggaugugggcggcacgacgccaauaccugcggagauuacacuauuuucagaagaaugugaacucaauugucaagauccaggccuucuuuagggcucguaaagcccaggacgauuaccgcauucucgugcaugcaccgcaucccccucugaguguugugcggagauucgcccaccuucugaaccaaagccagcaggacuuucuagcugaagcggagcuccugaaguugcaggaagagguagucaggaaaauacgauccaaucaacagcuggagcaggauuuaaacaucauggacauuaagaucgggcuccuggugaaaaaucggaucacgcuucaagaaguggucucucacuguaagaagcugaccaaacgcaacaaggagcaguugagcgauaugaugguucucgacaaacagaagggacugaaaucacuaaguaaggaaaaacggcagaagcuggaggccuaccaacaccuuuucuaucuccugcagacacagccaauuuacuuggcaaagcugauauuucagaugccccaaaauaaaacuaccaaguucauggaagcugugaucuucuccuuauauaacuacgccagcucuaggcgggaggcauaucuccugcuucagcuguuuaaaacagccuugcaggaggaaauuaagucaaaaguagagcagccucaagacguggucacuggcaauccaaccgugguucgacucguggucagauucuaccgcaacgguagggggcagagugcucugcaggaaauccuaggcaaggugauucaagauguucuggaggacaaggugcuuagcguccauacagaucccguacaccucuauaaaaauuggaucaaccagaccgaagcccagacuggacagcguucccaucugccguacgacgugacgccugagcaagcguugucucacccagagguucagcggagauuagauauagcacugaggaaucuccuggccaugacagacaaguuucuucuggcuaucaccucgagcguggaucagauucccuacggcaugcgcuaugucgccaaaguguugaaggcuacucuagcagaaaaauucccugacgccaccgauuccgagguauacaagguggucgggaaccugcucuauuaccgauuucugaaucccgcuguuguggccccagacgcauucgauaucguggcgauggccgcuggaggugcccuugcagcuccucagagacaugccuuaggcgcagucgcccaacugcuccagcacgcugcggccgggaaggcauuuucaggacagagucagcacuugcgggugcugaacgacuaucucgaagagacacaucugaaauucaggaaguuuauucaccgcgcuugccaaguucccgagccagaggagcguuucgccguagaugaauacucugacaugguggccgucgcaaaaccgaugguguauaucaccguuggcgagcuugugaauacucauagacuguugcuagaacaccaggacuguauagcuccugaucaucaggacccccugcacgagcucuuagaggaucugggugaacuuccaacaauucccgaccugaucggggagagcauugccgcggauggccacacggaccucuccaaguuggaagucucacugacccucacuaacaaauuugagggacuggaagcugaugccgacgauagcaacacacggucucuucuacuguccaccaagcaguuguuagcagacaucauacaauuccauccuggcgauacacugaaggagauccucagucugagcgccucuagggagcaggaagcugcacacaaacagcuuaugucccgccgacaagccugcacugcgcagaccccagagccccugagacggcauaggucacucacggcucacaguuugcugccucuagccgaaaagcagcgcagagugcugaggaaucuccggcgucuugaggcacugggguuaguaagcgcccgcaacggauaccagggcuuggucgacgaacuggcuaaagacauucgaaaucaacacagacauaggcaccggcgcaaggccgagcucgugaaacugcaggcaacccuucagggucugucgacaaagacuaccuuuuacgaggaacagggggauuauuacucccaauauaucagagcuugucucgaccauuuggccccggauucuaaaagcucaggaaagggcaagaaacagccaagucugcacuacacagcggcccaguuacuagagaaggguguucugguggaaauugaggaccuccccgcaucccauuucaggaacgucaucuucgauauaacuccuggcgacgaggcugggaaauuugaagugaaugccaaguuccuuggaguugauauggagcgguuucagcugcacuaucaagacuugcugcagcuccaguacgaaggcguggcagucaugaaacuguucaacaaggcuaaggugaauguaaaccuucucauuuuucuguugaauaaaaaguuccugcgaaaauga

SEQ ID NO: 57791 - RNA, 3345 nt, Artificial Sequence
  derived and/or modified sequence opt3 from IQSEC1__Homo_sapiens__NP_001127854
auggccugcagaaggcgguacuucguggagggcgaagcucccagcuccgagaccgggacaucucuggacucaccuagugcauauccacagggaccgcucguccccgguagcucccuuucuccugaucacuacgaacauacuucgguuggcgccuaugggcuguacucaggaccacccggccaacagcagcgcacgcgacguccuaaguugcagcacagcaccaguaucuuaagaaaacaagcggaggaagaggcuauuaagaggucccggucucugagcgaguccuaugaacuaucaagugaccuccaggauaaacagguggagaugcuggaacgcaaguacggugggagacuuguaacaaggcaugccgcacggacuauacagaccgccuuucgccaauaucagaugaacaaaaacuucgagcgacugagaagcucuauguccgagaacaggaugucacggcguaucguguugagcaauaugcgcaugcaguuuaguuucgaaggaccagagaagguccacucuuccuacuuugaaggcaaacaggugagcguuacaaacgacggcucgcaacucggggcucuggugucucccgaguguggagaucuguccgaaccuaccacucucaaaucaccagcaccgaguagcgacuucgccgaugcuauuacagaguuagaggacgccuuuuccagacaggucaagucucuggcggaaagcaucgaugacgcacuuaauugcaggucauugcauaccgaggaagcccccgcucuggaugccgcacgggcucgagacacggagccucagacugcccuacacgguauggaucaccgcaaacucgacgaaaugaccgcgaguuacuccgacgugacacuguauauugaugaggaggaacuuagcccaccccugccuuugucucaagccggcgacagaccaucaaguacugagagcgaucucaggcugcgggcagggggagcugcccccgacuacugggcuuuagcccauaaggaagauaaagcagacaccgauacauccugucgcucuaccccgucgcuggagagacaggaacagaggcuccguguagagcaccuuccucuguugacgaucgagcccccaagcgacuccucaguugaucuaagugaccggucugaacgaggcagccugaagagacaguccgccuaugagaggucacucggugggcaacagggaagcccuaagcauggcccccacucuggcgcuccaaaaucccugccccgcgaggaaccugagcuucggccaagaccgcccaggccucuggauagucacuuggcgauaaacgggagcgcaaaucgccagucuaaguccgaaucagacuacagugacggagauaacgacagcaucaauucgacuuccaacucuaaugauacaauuaacugcagcucagagaguuccucucgagacagccuccgggaacagacccuguccaaacaaacuuaucauaaggaggcccguaauucaugggauagcccagcuuucaguaacgacgugaucagaaaaaggcacuaccgcauugguuuaaaucuguuuaacaagaaacccgaaaagggcguccaguaucuaaucgagcggggguucgugccugauacaccagugggagucgcccauuuucuccugcagagaaagggccuuucuaggcagaugauaggugaguucuuggggaaccgacaaaaacaguuuaaucgcgacguucuggauugugugguagacgaaauggauuucuccaccauggagcucgacgaagcacugcggaaguuccaggcccacauuagagugcagggcgaggcucaaaaagucgaaaggcuuaucgaggccuuuagccagcguuacugcauuuguaaccccggagugguucgccaguuccggaauccggauacgaucuuuauccuggcauucgcgauuauauugcucaacaccgacauguacucgccuaaugugaagccagagagaaaaaugaagcuggaagacuuuaucaagaacuuaaggggcgucgaugacggggaggauauuccccgagaaaugcugaugggaaucuaugagcggauacgcaaaagagaacuaaagacaaaugaggaccaugugucacaaguacagaaaguugagaagcucauuguggguaaaaagccuaucggcucucugcaccccgggcuuggaugcgucuugagucugccacacaggcggcucguguguuacugccgacuguucgaagucccugaucccaacaagccacagaaauuaggccugcaucagagagagaucuuucuuuucaaugacuugcucgugguuacuaagauuuuucaaaagaagaaaaacuccgugaccuauagcuuccgccagucuuuuagccuguacgguaugcagguacuacuguucgaaaaucaguauuacccgaacgggaucaggcucacauccucagucccuggcgcugauauuaaggugcugauaaauuuuaacgcccccaauccacaagaccguaagaaauucacugaugaccuucgggagaguaucgcagagguucaggaaauggagaagcacagaauugaaagcgaguuggaaaaacagaagggaguggucaggcccucuaugucccaguguucaagucugaaaaaggagagcggcaacgggaccuuaucccgcgccugccucgaugacucuuaugcuucgggagagggucugaaacgaagcgcccuuucauccagucugagagauuugucugaagcaggcaagcgggggaggcgcagcuccgcuggaucacucgagucuaacguggaaggcagcaucaucaguuccccucauaugcguagacgggccacaagcaccagggagugcccaucucgcccccaccaaacuaugccuaauucauccagucugcuagguagccuguucgggucgaagcgaggcaaaccgccaccccaggcgcaccucccuucugccccagcucugcccccuccgcaucccccaguagugcuuccucacuugcagcauuccguugcaggacaccaucuggggcccccagaaggcuuaccucaagccgcuaugcacggacaccauacgcaguacugucacaugcagaaucccccaccguaccaucaccaucaccaccaucacccuccccagcauauucaacacgcccaccaguaucaucacggcccacauggugggcaccccgcauacggagcgcaugcccacggccacccuccacuccccagcgcucaugucggucacacagugcaucaccacggccagccuccggccccacccccucccaccucaaguaaggcaaaaccaucugggauauccacuaucguguga

SEQ ID NO: 57792 - RNA, 4467 nt, Artificial Sequence
  derived and/or modified sequence opt3 from IQSEC2__Homo_sapiens__NP_001104595
auggaggccggcagcgggcccccuggagguccaggcuccgaaucuccgaacagagcuguggaguaccugcucgaacuuaauaacaucauugagucacagcaacagcuguuggaaacccagaggcggcgcauagaggaguuagaagggcagcuggaccaacuaacacaggagaaucgagaucuccgugaagagagucagcugcacagaggagagcuucauagggacccccacggcgcacgggauagcccuggucgcgaaucccaguaucaaaaccugagagagacucaguuccaucacagggaauugcgggagucucaguuucaucaggccgcgcgcgacgucggguacccaaaucgagaaggagcuuaucaaaacagagaggccguuuacagggauaaggagcgggacgcaucguauccccuccaggauacgaccggcuacacagcccgugaacgcgacguggcucagugccaucugcaccacgagaauccugcacugggcagagaaaggggaggacgggaggccgguccagcucaccccggccgagaaaaagaggccggguauucagcggcaguaggagugggcccucgcccaccgagagagaggggucaacucagccggggcgccagucgcuccucuagccccggagcuggcggcgggcauuccacuucaaccaguacaagcccugccaccacuuuacagagaaagucugauggagaaaacuccaggacagucucaguggagggugacgcaccaggcagcgaucugaguaccgcuguugacucucccgggucccagccuccauaccgucuuagccaguugcccccgucgucuucccacaugggaggcccucccgccgguguggggcugccaugggcgcaacgggcccgacuacagccugcaucagucgcucucagaaaacaggaagaggaagagaucaagaggaguaaagcccugagcgauuccuacgagcuuucuacggaccugcaggacaagaagguggaaauguuggagcgcaaauauggcgggagcuuccucucacggagagcugccaggacuauucaaaccgcauuucgccaguaccgaaugaauaagaacuucgaacggcugcguaguuccgccagcgagucuagaaugucaaggcgcaucauuuuaaguaauaugcggaugcaguuuagcuucgaggaauaugagaaagcucagaaccccgcguacuuugaaggcaagccagcaucccuggaugagggggccauggcuggagccagaucucacaggcucgaacgaggucuucccuauggcgggucguguggaggcgguaucgacgggggcggaagcuccguaacaacuucaggcgaguucaguaaugauauaaccgagcuggaagacucuuuuagcaaacaaguuaaguccuuggcagagucaaucgaugaagcccuaaacugccauccuagcgggccaaugucugaggaaccgggauccgcucagcuggagaagcgcgagaguaaagaacagcaggaggacagcucugccacauccuucucagaucucccccuguaccuugacgauaccgugccucaacagaguccagaacggcugcccagcacggagccuccaccccaggguagaccggaauuuugggccccugcgccauugcccccugugcccccaccuguccccucgggcacuagggaggacgggucccgugaggaaggaacacgccggggcccagguugucucgagugcagagauuucaggcugcgagcugcccacuuaccgcugcuaaccauugaaccucccucugacagcucaguggaccucagugaucgguccgaccgcgggucuguccauagacaacugguuuaugaggcagauggcuguagcccacacggaacucuuaagcauaaagggcccccugggagggccccaaucccccaccggcacuacccugcuccggagggaccagcccccgcaccuccaggccccuugccuccggcucccaauuccgguacagggccaucaggaguggccggcggucgaagacugggcaagugcgaagcggccggggagaacagcgacggaggcgauaacgaaagucucgagucuuccagcaauucgaacgaaaccauuaauuguucaucugggaguuccagccgcgacucucugagggagccucccgcuacgggacuuugcaaacagaccuaccagcgugagacacggcauagcugggauuccccagcauuuaacaaugacguagugcagagaaggcacuaucgcaucggccugaacuuguucaauaagaaaccugaaaaggguauacaauaccucauugagcgaggguuccugucagauacucccgucggaguggcccauuuuaucuuagaaagaaagggccugagucggcagaugauuggugaguuccuaggcaacaggcagaaacaguuuaaucgcgacguucucgauuguguggucgacgaaauggauuucagcucuauggaccuggacgaugcccuucguaaguuucaaucccacaucagagugcagggggaggcccagaaaguagagcgguugaucgaagcauucucacagagguauugcguuuguaacccagcgcuggugcgccaauuucgaaauccggacaccauuuucauacucgccuuugcuaucauucuguuaaacacagauauguacaguccuagcgucaaggccgagagaaaaaugaagcuggacgauuucaucaagaaucuucggggaguggacaacggcgaagauauacccagggacuugcucgucgggauuuaucagcgcauccagggaagagagcugaggacuaaugaugaccacgugucccaaguucaggcaguggaacggaugaucguaggcaaaaagccaguccuaucucugccccaucgucgccucgugugcugcugucagcuguacgagguuccugauccaaaccgaccccagagacuugguuugcaccaaagggagguguuucuguucaacgacuuacucgucgugaccaaaauuuuucagaagaaaaagauccugguaacauauucguuccggcagagcuucccucuuguggaaaugcauaugcagcuguuucaaaauucauacuaccaguucgggauuaaguugcucuccgcuguuccgggaggcgagcgcaaaguccugauaaucuuuaacgccccaagucuacaggauagacugagguucaccucugaccuccgggaaagcauugcagaggugcaggagauggaaaaguaucgaguggaguccgaacuggagaaacaaaaggguaugaugagacccaaugccucacagccuggcggggcuaaagacucugucaacggaacuauggcgcgcagcagucuugaagauacguacggcgccggggacggauugaagaggggcgcacuguccagcucuuuacgggaucucucagacgcugguaagcgugggagacgcaauuccguuggaagucuggauagcacaaucgagggcucggugaucucuucccccaggccacaccagcggaugccucccccaccuccgcccccaccucccgaggaauauaaaagccagcgaccagugucaaacaguucuuccuuucuuggcagccuguucgggucaaagagaggaaaagguccuuuucaaaugcccccgccaccuaccggccaggccagugccagcuccucuagcgcuuccucaacucaucaccaccaucaccaucaccaucacgggcacucucauggaggccuagguguacuccccgacgggcagaguaagcugcaagcauugcacgcccaguacugccagggaccaggccccgcgccuccgcccuaucugccaccucagcaacccucguuaccuccacccccucagcagccacccccgcucccucagcugggcagcauuccacccccuccagcuuccgcacccccggucgggccucauaggcacuuccacgcacauggacccgugccagguccucaacacuacacccuuggccgccccgggcgggccccaagacguggagcuggcggucauccccaguuugcaccucacgggaggcauccacugcaccagccgacaucucccuugccucucuauucaccagcuccccagcacccuccagcgcauaaacaaggacccaagcacuucauauuuagccaucacccucagaugaugccggcugccggcgcagccggcgggccaggaucccggcccccugguggcaguuacucucacccccaucacccacagagcccucugucaccccauuccccaaucccgccucaccccaguuacccaccccuaccuccacccagcccucauaccccgcacucuccacugcccccuacuuccccacacgggccccuucaugcuucaggaccucccggcacagccaauccaccgagcgcaaacccuaaagcuaagcccucgcgcauuucuacgguuguguga

SEQ ID NO: 57793 - RNA, 3549 nt, Artificial Sequence
  derived and/or modified sequence opt3 from IQSEC3__Homo_sapiens__NP_001164209
auggagagccugcucgaaaaccccgugagagccguccuuuaccugaaggaguugaccgcuaucguucagaaucaacaguccuuaauucacacacagagggaacggauagacgagcuggaacgccgacuagaugagcucucugcagagaaccguucacugugggaacaucagcaacuucugcaggcccagccuccaccgggcuuggugcccccuaguagcgcgccacuccccgcugccccugcaacugccccagcugcagccgcuagagcccaggagccccugcaagaccaggggcagagguccgcggcagccccucacccagcuccggaucggcccccucgccagcaucacggacaacugcucgaacagccacagagaggucccggcucuagggcccauacgccucaaucgccacacaaacacuuagggacccagggagcaguaacagacaaggagaaagagcggcccccgucaugcugugcugccgcgggcgcccugcuucagcauaagagcccuagugcauuggguaaaggggugcugucccgccgacccgaaaaugagacuguccuacaccaguucugcuguccagcugccgaugcuugcucugaccucgccagccaauccgauggaucauguacccaggcaggcggcgggauggaagacagugugguugccgcugcggcaguggccgcuggaagaccuagcgcccaugcacccaaggcccaggcucaggagcugcaagaagaggaggaaaggccaggugccggcgcagcgucuccccgggcugggccucagcacaaggccuccccaggacgucagcagccggcacuugccacagcucugugcccccacgccccugcagcuucagauuaugaguugagccucgaccugaaaaacaagcaaaucgaaauguuagagcauaaauacggcggucaccuggucagucgcagagccgcguguaccauucagacugccuuuaggcaguaucagcucucuaagaauuucgagaaaauccggaacucccuucuggaaagccgauugccacgcagaauuucgcuaaggaaggugcggucucccacagcugagucccuggcagccgaaaaggcucucauggagggguacggacugguaggccuuccucugguucgcucaccaaguuugcccccgaccuuugccggcacgcucacugaacuggaggauagcuucaccgaacaagugcaguccuuagcaaaaucuaucgacgaugcgcugagcacauggucacuaaagacuaugugcagucucagagaguccggggccuaucagcugcaucaagcccuucaggcugcagcuggaccuccagguuuggaggccgaaggcagggcacccgagagcgccgggccuggacccggcgacgacgcugcggaaaccccaggucugccucccgcccacucugggacacucaugauggcauuucgugaugucaccgugcagauagcuaaucagaacaucucagugaguagcuccacggcccugucugucgccaauugucuuggcgcucaaacuguucaggcaccagccgagccggcggcuggaaaagccgagcagggcgaaacaucggggcgggaggcaccugaagcccccgcugugggacgagaggacgcaagcgccgaagauuccugcgcggaggcugccgcaucaggugccgcugacggcgccaccgcaccaaagacugaggaagaggaagaggaagaggagacagcugaaguagggagaggagccgaggcggaagccggcgaucuggagcaguugaguucuagcuccaccucaacgaaaagcgcaaagucugguuccgaagcuagugccagcgcuucuaaagacgcacuccaagccaugauucuguccuuacccagguaccauugugagaacccugccucaugcaagaguccaacccugagcacagauacucuacgcaagcggcucuauagaaucgggcugaaucuuuucaacauuaaucccgacaaaggcauccaguuuuugauaucgaggggauucauuccugauaccccgaucggcguggcucacuuucugcuccagcgcaaggggcugucccgacagaugauuggagaguucuuagguaacucuaaaaagcaauuuaaucgggacguccuggauugcgugguugacgaaauggacuucagcucaauggagcuugaugaagcguugcguaaauuucaggcacacaucagagugcagggcgaggcccaaaaggucgagaggcucaucgaggcuuucagucagcgcuacuguaugugcaacccagaagugguacagcaguuccauaaccccgacacaauuuuuauacuggccuucgcaaucauucuacugaauacugauauguacuccccuaacaucaagccagaccggaaaaugaugcucgaagauuuuauaagaaaucugcgagggguugacgauggagccgacauucccagggagcuuguggucggcaucuaugaacgcauccaacagaaggaguugaaaucuaacgaggaucacgugaccuacgucacaaagguggagaaaagcauuguugguaugaagaccgugcuguccguaccucaucggagauuagucuguugcucacgucucuucgaagugacugacguuaauaagcugcagaaacaggcugcgcaccaaagggaaguguuucuuuucaacgaucuguuggucauccucaagcuguguccgaaaaagaaaagcaguucuacguauacauuuugcaaguccguggggcuacugggcaugcaguuccagcucuuugagaaugaauacuauagccacggaauuacccugguaacuccccuuucgggcucagagaagaaacagguguugcauuucugugcccuggggucugacgagaugcaaaaguuuguugaagauuuaaaagagaguauagcagaagucaccgagcucgaacagauccgcauugagugggagcuggaaaagcagcagggaacaaaaacccuuuccuucaagccaugcggcgcucaaggugacccucagagcaaacaggggucucccacugccaagcgggaggcagcccugagagaaaggccagcugagagcacaguggagguguccauccacaaccgacuacaaacgucacagcauaauaguggacucggcgccgaacggggugcgccuguucccccaccggaccugcagccuucucccccacgccagcaaaccccucccuugccacccccuccgccaacucccccuggcacacugguccagugucagcagaucgugaaggugauuguauuagauaaacccugccucgcaagaauggagccacugcuuagccaagcccuguccuguuacaccucaaguagcuccgacucuugcgggucgacaccuuugggaggccccgggagcccagucaaggugacucaccagccuccgcugcccccaccucccccaccuuauaaccauccccaccaguuuugcccgccaggaucacuccuacacggccauagguacuccagugguucucggagccugguuuga

SEQ ID NO: 57794 - RNA, 783 nt, Artificial Sequence
  derived and/or modified sequence opt3 from IRAK1BP1__Homo_sapiens__NP_001010844
augagccugcagaagacacccccuaccagaguguucgucgagcucguuccaugggccgacaggucccgggaaaacaaucuugcuucuggccgcgagacucugccgggguugcgacaccccuuaucaaguacgcaagcacagaccgccacacgugaagugcagguaagcggaacuuccgaggugucugcggguccugauagagcucaggucgugguuagggugucgucaaccaaagaagccgcagccgaggcuaagaaaagcgucugccggcgccuggacuacaucacacaaagucuacagcagcagggcgugcaagcagagaacauuaccguaacuaaggauuuuagaaggguugaaaaugccuaucauauggaggcugaaguguguauaacauucaccgaguuugggaaaaugcagaacaucugcaauuuccucgucgagaagcuggacuccucuguggugauuagcccaccccaguuuuaccacacgccuggauccgucgaaaaccuucggcgccaggccugucugguugcgguggagaaugcauggcgaaaggcccaagaaguaugcaacuuggugggccagacucucgguaaaccacugcugaucaaggaggaagagaccaaagagugggaagggcagauugaugaccaucaaucaaguagacucucuagcuccuuaacaguccagcagaagaucaaaucagcuacuauacacgccgcaagcaagguguucaucaccuuugagguuaagggaaaagaaaagaggaaaaagcaucuguga

SEQ ID NO: 57795 - RNA, 2049 nt, Artificial Sequence
  derived and/or modified sequence opt3 from IRAK1__Homo_sapiens__NP_001020413
auggccggcgggcccggaccuggugagccagcugcaccgggcgcccagcacuuccuguacgaagugcccccuugggucaugugcagauuuuauaagguuauggacgcgcucgagccagcugauuggugucaauucgccgcacuuaucgugagggaccagaccgaacugcgguugugcgagcgcagcgggcagcgaacagccuccguauuauggcccuggauuaaccguaaugcuagaguggcagaucugguccauauacuaacucaccuccagcugcuuagggcccgggacaucauuacggcuuggcauccuccagcgccccugccuucuccaggaaccacagccccgcgccccucaaguaucccugcaccagccgaagcugaggccuggagccccagaaaauugccuuccucugcaucgacuuuucucucaccagcuuuccccggcagccaaacccacagugguccggagcuggggcuggugccuucccccgccucucucuggccaccucccccaagccccgcgccuuccucaacaaagccaggaccggaaaguagcguuucuuuacugcagggcgccaggcccuuuccuuucuguuggccacuuugcgagauuucccggggcacccauaacuuuucagaagaguugaaaaucggggagggagguuucggcuguguguaccgcgcagucaugcgaaauacuguguaugcuguaaagagacugaaagaaaacgccgaucuagaguggacagcuguuaagcagagcuuucucaccgaaguggagcagcugaguagguuccggcaccccaauauagucgacuuugccggguacugcgcacaaaacggauucuauugucuuguguacggcuuucugccuaaugguucuuuggaagaucgucuccacugccagacgcaggccuguccaccccuguccuggccgcagcgcuuagacauccugcucgggacugcuagagcgauucaauuccuucaucaggauagcccuucgcugauccacggagacauuaagucuuccaacguguugcuagaugagaggcugaccccaaaacucggcgacuucggccuggcacgguuuucacgauucgccgggaguagccccucccagucuagcauggucgcucgcacacaaacuguuagaggaacccuugccuaucugccugaggaauacaucaagacagguagguuggcaguggauaccgacacguuuucauucggcguagugguccucgagacucuggccgggcagcgggcugugaaaacacauggagcccgcaccaaguacuuaaaagaccugguugaagaggaagcagaggaggcgggcguggcucuaagaaguacucaguccacacuccaggccggucuggcagccgaugcuugggccgcacccauagcuaugcaaauuuauaagaagcaccuugacccaaggccugggcccugcccaccggaauugggccugggacucggccagcuggccuguugcugccuucaccgucgggcgaaacgaagaccucccaugacccaggagaauagcuacgucucuucaacggggagggcccauaguggagcugcaccauggcagccccuggccgcuccuagcggugccuccgcacaagcggccgaacaguugcagcgcggcccaaaccagcccguggagucugaugaaucgcucgggggacugagcgcugccuuacgguccuggcaccugaccccuucauguccgcuagacccagcaccccucagagaggcuggcugcccucaaggugauacagccggggagaguucuuggggcagcggaccaggcuccaggcccacugcaguagaagggcuggcccuuggaucaagcgcuucuuccaguagcgagccuccgcagaucauuaucaaucccgcgcgccagaagaugguucagaaauuggcccuguaugaagacggugcacucgauucucugcaauuacuguccucaaguagccuuccaggcuuggggcucgagcaggaccgacagggaccugaggaaucggaugaguuucaauccuga

SEQ ID NO: 57796 - RNA, 1878 nt, Artificial Sequence
  derived and/or modified sequence opt3 from IRAK2__Homo_sapiens__NP_001561
auggccugcuacaucuaucagcugcccagcugggugcucgacgaucuuuguagaaacauggacgcucuguccgagugggauuggauggaauuugcaucuuacgucauuaccgacuugacacaauuaaggaagauaaaaucaauggagcggguucagggcgugaguaucacucgcgaacugcuaugguggugggggaugcgacaggccacgguacagcaacucguggaucugcuuugccgucuggaguuguauagagcggcucagauuauccucaauuggaagccugccccagaaauuagguguccgauccccgcauuuccugacagcgucaaaccagagaagccccuggccgcuuccgugcggaaagcagaggaugaacaggaggaaggacagccuguucgcauggccaccuucccaggucccgggucuucgccugcuagagcccaccaaccagcguuucugcagccgcccgaggaggacgcaccucauucacucaggagcgauuuaccaacaaguuccgacucuaaggauuucagcacuuccauacccaagcaggaaaaacugcuuucauuggccggcgacagucuguuuuggagcgaggcugaugugguccaggccaccgacgacuucaaccaaaaucggaagaucucucagggaacauuugcagauguguaccgcggccaccgacaugguaaaccuuucguauuuaagaaacuaagagaaaccgcuugcuccucaccagggagcauugagagguucuuucaggccgaacuccaaaucugucugcggugcugucaccccaacguucuuccggugcugggauucugcgcggcccgucaguuucauaguuucauuuauccuuacauggcaaauggcucuuugcaggaccgccuccagggccaagggggauccgauccccugccauggccucagagagucagcaucuguucggguuuacugugcgcuguggaguaucuccacggccuugagauaauucacucuaacgugaaguccucaaauguccuguuggaccagaaccuaacucccaagcuggcccauccaauggcucaccucugucccguuaauaaaaggaguaaguacacaaugaugaaaacccaucugcuucggacgagcgccgcauaccugccugaagauuucauccgaguggggcaguugacuaagcgcguagacauuuucuccugcggaaucgugcucgccgagguccugaccggcaucccagcuauggauaacaauagaucuccgguguauuuaaaagaccugcuacucagcgauauucccucaaguacagcgucccugugcagcaggaagacugguguugaaaacgugauggcaaaagagauaugucaaaaguaccuugaaaagggggccggacgguugccugaggacugcgcugaggcccuggcaaccgccgcuugucucugccugcgcagaaggaauacaucucuucaggaagucuguggcucaguggccgcaguagaggaacgucugcggggccgagagaccuugcucccauggagugggcugagcgaaggaacggguuccucuucgaacacucccgaggagacagaugacguugacaauagcuccuuagaugcgucaaguucuaugagcguggcuccuugggccggcgcagccaccccacugcuacccacugaaaacggggagggaagacucagggucaucgugggccgcgaagcugacuccucaagcgaggccugcgucggucuggagccgccucaggaugugacagaaaccucuuggcagauugagaucaacgaagcaaaacggaagcucauggagaauauauugcuguauaaagaagagaagguugacuccauugagcuuuucgggccauga

SEQ ID NO: 57797 - RNA, 1608 nt, Artificial Sequence
  derived and/or modified sequence opt3 from IRAK3__Homo_sapiens__NP_001135995
auggccggcaacugcggggcuagaggagcacugagcgcccacacccuccuuuucgaccugcccccugcguuguuaggugagcugugugcugugcuagauuccugcgacggcgcccucggguggaggggacugggcgcaguccuuucuccaucagaaaagaguuaccaggaggguggguuuccgaauauccuguucaaagaaacagccaacguuacuguggauaauguauugauucccgagcauaacgaaaagggaauacuccugaaaagcuccaucucuuuucaaaauauuaucgagggcacgcggaacuuccacaaggacuuucugauuggcgagggggaaaucuucgagguguaucgcgucgaaauacagaaucucaccuacgcugugaaauuauuuaagcaggagaagaaaaugcaguguaagaaacauuggaagcgauuccugucggagcuugaaguuuugcugcuauuucaccauccuaacauccucgagcuggcagccuauuucacagaaacugagaaauuuugccuuauuuacccauauaugcguaauggaacccuguucgauagauugcaaugugugggugacacagcuccccucccuuggcacaucaggauuggcauccugauagggauuucaaaggccauccacuacuuacauaacguccagccaugcagcgugauuuguggaaguaucuccucugcgaauauccugcucgaugaccaguuucagcccaaacuuaccgauuucgcaauggcccacuuccggagccaucuggaacaccaauccugcacuauuaacaugacaucaaguagcucuaagcacuugugguauaugccugaggaguacauacgccagggcaagcuauccaucaaaaccgacguauacucauuugguauuguuaucauggaagugcugacgggguguagagucgugcucgaugacccaaagcauauacagcugagggaucuucugcgggaguugauggaaaaacgcggacucgacagcugccugaguuucuuagacaagaaagugccgcccuguccucgaaauuuuucugcuaagcuguucugccuagccggcagaugcgcagcuacuagggccaagcuccggccauccauggaugagguccugaacacccuugaaagcacacaggcgucguuguauuuugccgaggaucccccuacuucucugaaauccuuccguuguccaucaccccucuuucuggagaauguuccgaguauuccuguggaagacgacgagagccaaaacaacaaucuucugcccuccgaugaaggcuugcgcaucgacagaaugacccagaagacaccauucgagugcucucagagcgaaguaauguuucucucacuggauaaaaagccugagaguaaaaggaacgaggaagcauguaauaugcccuccagcucuugcgaggaaucaugguucccaaaguacaucgugcccagucaagacuuacggccuuauaaggucaacauugauccaagcuccgaggcuccggggcacucuugucgaucgcgccccguggagagcuccugcucaaguaaauuuucuugggacgaauacgagcaguauaagaaagaauga

SEQ ID NO: 57798 - RNA, 1011 nt, Artificial Sequence
  derived and/or modified sequence opt3 from IRAK4__Homo_sapiens__NP_001138728
augcccuucugcgacaaggauagaacccugaugacaccugugcagaaccucgagcaaagcuacaugccaccggacuccucuucacccgaaaauaaaagucuugaggucagcgauacuagguuucacuccuucucuuuuuaugaacugaagaacguuacgaauaacuucgacgagcggccuaucucggugggcgggaauaaaaugggagaagguggcuuugggguaguguacaagggauaugucaacaauaccacaguggccguuaaaaaguuggcugcaaugguggauauuacuaccgaggaguuaaagcagcaguucgaccaggaaauaaaagucauggccaagugucaacaugagaaccugguggaacuacucggcuuuucaagcgauggugacgaucugugccuuguauacguuuauaugccaaaugggagucuguuggaccgccucuccugucuggauggaacacccccucugucuuggcacaugcgaugcaaaaucgcgcagggcgcugccaacggcauuaauuuccuccaugagaaccaccauauccaccgugacauuaagagcgcaaauaucuuacuggaugaggccuuuaccgcuaaaauauccgacuucgggcuugcaagagccucagaaaaguuugcucagacugugaugacaaguaggaucgucggaaccacggccuacauggcgccagaggcauugcggggugaaauuacucccaagagcgacaucuauucuuucggcguggugcugcuagagauuaucaccgggcucccugccgucgaugaacaccgcgagccacagcugcuucuggacauaaaagaggaaauugaggaugaagagaagacaaucgaagacuacauugauaaaaagaugaacgacgcugauuccacuucaguugaggccauguacagcguggcaagucaauguuugcaugagaaaaagaauaaaagaccggacaucaagaagguacagcagcuccugcaggaaaugaccgcuucuuga

SEQ ID NO: 57799 - RNA, 2892 nt, Artificial Sequence
  derived and/or modified sequence opt3 from IREB2__Homo_sapiens__NP_004127
auggacgcccccaaggcuggcuacgcauucgaguaucugaucgaaacccucaacgauagcucccacaaaaaguuuuucgacgugucuaaacuugggacaaaguacgauguccugccuuauucaauuagaguuuuguuagaggccgcggugaggaauugcgacggauuucugaugaaaaaggaagauguaaugaacauacuagacuggaagacuaaacagaguaauguggaggucccauucuuuccggcucgggugcuccugcaagauuucacggguauccccgccaugguugacuuugcagccaugcgcgaagcugugaagacccuuggcggggauccugagaaaguccauccagcaugucccacagaccugacuguggaucacagcuugcagauugacuucuccaagugcgccauccagaacgcuccuaauccaggaggcggugaucuccagaaagccgggaagcugucuccccugaagguacaaccuaaaaagcucccaugucgaggacagaccacaugccguggcucgugugacucaggcgaguuagggagaaacagcggaaccuuuaguucccagauugaaaauacuccgauccugugccccuuccaucuucagccuguuccagagcccgaaacaguguugaaaaaccaagaggucgaguuugguaggaaucgggaacgccugcaguucuuuaaguggucuagcagaguguucaaaaacguggcggucauaccuccaggcaccgggauggcacaccagaucaaucuagaguaccucuccaggguuguguucgaagagaaggaccugcuuuuucccgauucaguagugggaacggacagucauauuacuauggucaacggccuggguaucuugggguggggagugggcggcauugaaaccgaggccguuaugcucgggcugccggugagcuuaacacugccugaggucgugggaugugaacucacugguucuuccaaucccuucguaaccucaaucgauguugugcuuggcauaacaaaacaucugcggcaggucgggguggcuggaaaguuugucgaguucuuuggcagcggugugagucaauugucuauuguugaccgcaccacgaucgccaacaugugcccagaauauggggcaauucuauccuucuuuccuguggauaauguaacucugaagcaccucgagcacacaggcuucagcaaagcuaagcuggaaucgauggagaccuaccuuaaagccgucaagcuguuucgaaacgaccagaacucuuccggagagcccgaauauucacaggugauccaaaucaauuugaacaguauuguuccaagcguguccggccccaaaagaccucaggauagggucgcggugacugacaugaagucugauuuccaggccugucucaaugagaagguaggguuuaaaggauuccagauagcagcugaaaagcaaaaagacaucgugagcauucacuacgaggguucagaauacaagcugagucauggcuccguugucaucgccgcugugauaagcugcacaaacaauuguaacccaucugugauguuagccgcagggcugcuagccaaaaaggcugucgaggcgggacuccggguuaagccguauauucguaccucacugagucccggcagcgguauggugacgcacuaccuuuccucuucggggguguugccuuaucugagcaaacucggcuuugagaucguaggauacggcugcuccacaugcgucgggaauaccgcaccacugucagaugccgugcuuaacgcuguuaagcagggagaccuggugacuugugguaucuugaguggcaauaaaaacuucgaagggcgccucugcgacugugucagagccaauuaucuggcaucucccccuuuagugguugccuacgcuauugccggaaccgugaacaucgauuuccagacagagccacugggcacugaccccaccgguaagaauauuuaucuacacgauauauggccgagcagggaagagguacaucgggucgaggaagaacacgugauccucuccauguuuaaagcacugaaggacaagauugaaauggggaacaaacgauggaauagccuugaggcgccugauagcguguuguucccaugggaccugaagucuacauacauccgcugccccuccuuuuucgauaaacucaccaaggaaccuaucgcucugcaggccauugagaacgcacaugucuuacuguaccuuggcgacaguguuacuacggaucacauaagccccgccggaucuaucgcuagaaacuccgccgcagcuaaauauuugacaaauaggggccucaccccacgggaguuuaacucauacggggcccgcagaggaaaugacgcggugaugacuaggggcaccuucgccaacauuaagcuguuuaauaaauucaucgguaagccugcucccaagacaauucauuuuccaagugggcaaacccuagauguauucgaagcagccgagcuguaucagaaagaaggaaucccgcucauaauccuggcuggcaagaaauacgguagcggcaacucgcgugacugggccgcaaaggggccuuaucuuuugggagugaaagcgguccuggccgaguccuacgaaaagauucacaaggaucacuuaaucggcauugggaucgcuccccuccaguuucugccaggagagaaugccgacucucuuggccugagcggucgggagacuuucucauugacauuucccgaggagcucaguccugggauaacgcugaacauucagaccuccacuggaaaaguguucucuguuaucgcaucauucgaagacgauguggagauuacacuauauaagcauggcggucugcucaauuuugucgcucgaaaauucuccuga

SEQ ID NO: 57800 - RNA, 978 nt, Artificial Sequence
  derived and/or modified sequence opt3 from IRF1__Homo_sapiens__NP_002189
augcccaucaccagaaugaggaugcggccuuggcuggagaugcagauuaacagcaaucaaauaccaggccucaucuggauuaacaaggaagagaugaucuuccagauuccguggaaacacgccgcuaagcaugggugggacaucaauaaagaugcaugccuuuuucgcuccugggccauacacacaggacgauacaaggcgggugaaaaagagcccgacccuaagacuuggaaggcuaacuuccguugugccaugaacucucugccagauaucgaagaggugaaagaccagucaagaaauaagggcaguagcgcagucaggguuuaucggauguugcccccuuuaacgaaaaaucagcgcaaggagagaaaauccaagucuucgagggaugccaagucaaaagcuaagcggaaaagcugcggggacaguuccccagauaccuuuucugacggacugagcuccucaacacuacccgaugaccauaguagcuacacugugccuggcuauaugcaagaucucgaaguagagcaggcacugaccccagcccuuucuccgugugcuguguccucaacacugcccgacuggcacauuccugucgaagugguuccagauagcaccagugacuuguacaacuuccaggugucucccaugccuuccacuagcgaggccacaaccgacgaggaugaagaggguaagcucccagaagacaucaugaaacugcuggagcagucggaauggcaacccacgaaugucgaugggaagggauaucucuuaaacgagccgggcgugcagccuacuucuguauacggcgacuuuuccugcaaagaggaacccgagauugauucaccagggggagacaucggucugagucuucagcgcguuuucaccgauuugaagaauauggacgcgacauggcuggauagccuacucacuccugugcgacugcccuccauacaggcaauuccaugugcccccuga

SEQ ID NO: 57801 - RNA, 1716 nt, Artificial Sequence
  derived and/or modified sequence opt3 from IRF2BP2__Homo_sapiens__NP_001070865
auggccgcugcaguggccgucgcggcugccagcagaaggcaguccugcuaccugugugaccucccccggaugccuugggcaaugaucugggauuucaccgagccaguuugccgcggcugugugaacuaugaaggggccgaccgaguagaguuugugauugaaacagcucgucaacuuaagagagcacacggaugcuucccggaggguaggucucccccuggcgccgcugccucagcggcagccaaaccacccccucugagugcuaaggauauauuguuacagcagcagcaacagcuggggcauggaggcccagaagccgcaccccgggcuccucaggcccuagagcgcuacccacucgcggccgcagcugagagaccgcccaggcuggguagcgacuuuggguccucucggccugccgcuucgcuugcccagccacccacuccucaaccacccccggucaauggaauccuggugccuaacggcuucucaaaauuggaggaacccccagaacucaaucgccagagcccuaacccccgaagaggccacgcaguuccacccacgcuggugccucugaugaaugggagugccaccccacucccgacagcuuuaggacuggguggcagggcggcagccucccuugcugccgucucugggacugcagccgcuagcuugggauccgcccagcccaccgaucugggcgcacauaagcggccugcgucagugaguagcucugcugccguagagcacgagcagcgugaagcagccgcuaaagagaagcaaccacccccuccagcccaucgcggucccgcagacucccuaucaacagcugccggggcggccgaacucagcgcugagggagcaggcaagaguagaggcucuggggaacaggauuggguuaacaggccgaaaaccgugcgggacacucugcuugcccugcaccagcacggacauuccgguccuuuugagagcaaguucaaaaaggagccagcuuugacagccgucgcacgaaccgcgcgcaaaagaaagcccucgccugaacccgagggcgaaguggggccaccuaagauuaauggagaggcccaacccuggcucucuacguccacugaaggccugaaaaucccaaugaccccgacaucaaguuuugugagcccucccccacccacugcuuccccucacucuaacaggaccacaccacccgaggccgcacagaauggucagagcccuauggcugccuuaauucuggucgcagauaacgccgggggcucacaugcuaguaaggacgcgaaucagguucacuccaccacgcggcgcaacagcaauucuccgccaucacccaguagcaugaaccaaagaaggcucggaccucgugaggugggcgggcagggagccgguaauacuggcgggcuugaaccaguacaccccgcaucccugccugauucuucguuggcuacaagcgccccgcuauguugcacccugugucaugagcggcucgaagacacucacuucgugcagugccccuccgucccaucacauaaauuuuguuucccuugcagucgacagucuaucaagcaacagggagccagcggcgagguguauugucccuccggugaaaaaugcccacugguugggucaaacgugccuugggcuuuuaugcagggcgagauagcaacaauccuugccggagaugucaaggugaaaaaggagagagacagcuga

SEQ ID NO: 57802 - RNA, 2391 nt, Artificial Sequence
  derived and/or modified sequence opt3 from IRF2BPL__Homo_sapiens__NP_078772
augagcgccgcucagguguccucuucaagaaggcaaaguugcuaccugugugaccucccccggaugccuugggcaaugaucugggauuucagcgagccagucugccgcggcuguguuaacuaugaaggggccgaccgaauugaguuugugauagaaaccgcgcgucagcuuaagagagcucacggaugcuuccaggaugguagguccccgggcccuccuccacccguaggggugaaaacagucgcccugucugcaaaggaggccgcugcagccgcugccgcggcagccgcugccgcagcugccgcgcagcaacagcagcagcaacagcagcagcaacagcagcaacagcagcagcaacagcagcagcaacagcagcagcaauugaaucauguggacggaucgucaaaaccugccguuuuagcagcuccaagcggccuggaacgguacggucuaagugccgcugccgcagccgcugcggcagccgcugccgcaguggagcagcgcuccagauuugaguaucccccuccaccggucucucucgggagcuccucacacacugccaggcugcccaacggacuuggcggcccuaauggguucccaaagcccacgccugaagagggaccacccgaacugaaccggcagaguccgaauagcuccucugcugccgcaucaguggcgagccgccgagguacccauggcggguugguaacaggacucccuaaccccggcggugggggaggcccacagcugacuguuccucccaaucugcucccacaaaccuuacugaacggccccgcuagugccgcagugcuuccuccaccgcccccucacgccuuggggucuagaggaccacccacacccgcuccacccggugccccgggcgggccugcaugucugggaggcaccccaggugucuccgcuacuagcucgucugccuccucaaguacaagcuccucuguggcggaggugggggucggcgccggaggcaaaaggcccgggagcguuucaaguaccgaucaggagcgggaacuaaaggagaagcagcguaaugcugaagcacucgccgagcuguccgaaagccuucgcaacagagcugaggagugggccucuaaaccuaagauggugagggacacgcuguugacucucgcaggaugcacccccuacgaaguacgguuuaaaaaggaucauucacuguuaggucgaguguucgcguuugacgccgucaguaaaccaggcauggauuaugagcugaaacucuucaucgaauacccuacagggagcggaaauguguauuccucugcuucgggcguugccaagcaaauguaccaggacuguaugaaagauuuuggucgcgggcuuagcuccggcuucaaguaccuggaguaugagaaaaagcacggaucaggcgacuggagauugcuaggggaucugcuccccgaggcagugagguuuuucaaagagggagucccaggugcugacaugcugccgcagccuuaccuugacgccaguugccccaugcugccaacugcauuggugucucucagccgggcccccuccgcuccuccaggcaccggggcgcugcccccugccgcaccgucaggacgcggcgcugccgccagcuuaagaaagaggaaggcuucuccagaacccccugauuccgcagagggugcccugaagcuaggggaagaacagcaacgucagcaguggauggcgaaccagagugaagcucucaagcugacaaugagcgccggcggauuugcagccccaggccacgcugcagggggacccccuccgcccccaccuccccuuggcccacauucuaaucggaccacgccucccgaguccgccccacaaaacgguccgucaccuauggcggcuuugaugaguguagccgacacucuggggacagcacacagccccaaagauggaucguccguucauucuaccacugccagcgcucgaagaaauucaaguuccccagugucucccgccagcgucccuggccagaggcgccucgcaucccggaacggugaccugaaccuucagguggcuccacccccuccgucagcccacccaggcauggaucagguccacccccaaaauauuccugacagccccauggcgaacagugggccacuguguugcacaaucugucaugagagauuggaagauacccacuucgugcagugcccuucuguucccucccauaaguucugcuuuccauguagcagggagucgauuaaagcccagggagcaacgggcgaaguguauugcccuucaggggagaaguguccgcucguaggaucuaauguccccugggcuuucaugcaaggcgagaucgccaccauacuggcuggugacgugaaaguuaagaaggaacgcgauccauga

SEQ ID NO: 57803 - RNA, 1050 nt, Artificial Sequence
  derived and/or modified sequence opt3 from IRF2__Homo_sapiens__NP_002190
augcccguggagagaaugaggaugcggccuuggcuggaggaacagaucaacagcaauaccauuccaggccucaaguggcuuaacaaagaaaagaaaauauuccaaaucccguggaugcacgccgcucgccaugggugggacgucgagaaggaugcaccccuguuucgaaauugggccauucacacaggaaaacaucagccugguguugacaagccagaucccaagacuuggaaagcgaacuuccguugcgcuaugaauagcuugccugacaucgaagaggugaaggauaaaucuauuaagaaaggcaacaaugccuuuagaguauacaggauguuaccacugucagagcggcccaguaagaaggggaaaaagccuaaaacggaaaaggaggacaaagugaagcacaucaaacaggaaccagucgagagcucccuaggacucucuaacggcgugucggaucugucaccggaguaugcaguucuuaccagcacaauaaagaaugaaguggacaguacugucaacaucauugugguaggucagucccaucuggauucuaauaucgagaaccaagaaauuguuaccaaucccccugacaucugucagguggucgaggugacaaccgaaagcgaugagcagccaguguccaugucagaguuguacccccuccagauaaguccugucagcucuuaugccgaauccgagacuacagacucaguuccaagcgaugaagagagugcugaagggcgcccccacuggagaaagaggaacauugagggaaaacaauaccugucuaauaugggcacccggggcuccuaucugcucccggggauggcauccuucgugacgucgaacaagccugacuuacagguaacuaucaaagaggaaucuaaccccgugccauacaauuccucauggccucccuuucaggaccugccacuuaguagcuccaugacccccgccucuagcucaagucgcccugaucgagagacaagagcuuccgucauuaagaaaacuagcgacaucacccaggccagggugaagucuugcuga

SEQ ID NO: 57804 - RNA, 1179 nt, Artificial Sequence
  derived and/or modified sequence opt3 from IRF3__Homo_sapiens__NP_001184052
auggugggcagaaagcagggguggagcugcagggucaccggaaucaaacccgguaagccugccugggcugaggcaacaggcgccuacguuccagggcgggacaaaccggaucugcccacuuggaagcgcaacuuccgauccgcgcucaaucguaaagaaggacuuagacuggcugaggacaggucuaaggauccucacgacccacauaagauuuaugaauuugugaacucaggcguaggugauuucagucaacccgacacgagcccugauaccaaugggggaggcuccacaucugacacucaggaggauauauuggacgaauuacugggcaacauggugcuagccccacuccccgauccugggccaccgucgcuggcagucgcccccgagccuuguccacagccccuucggucaccuagccuggacaauccaacccccuuuccgaacuugggaccuagugagaauccccucaaacgccugcuggugccaggugaagagugggaguucgaaguuacagcuuuuuacagaggcaggcaaguguuccagcagaccaucuccugcccugaggggcuccgguuagucggaucugaagugggcgaucgcacucugcccgguuggccaguaacacuucccgacccugggaugagcuugaccgaccgaggaguuauguccuaugugagacacguccugucaugucuaggcggcgggcucgcacuguggagggccggacaguggcuuugggcucagcggcugggucauugccacacguacugggccgugagugaggaauugcucccaaacagcggccaugggccggauggagaggugcccaaggacaaagaaggcggugucuuugaucuggggccuuucauuguugacuuaaucacuuuuaccgagggcucuggacguuccccacgcuaugcgcugugguucugugugggcgagucauggccccaagaucagccuuggacaaagagacucguaauggugaaagucgugccaacuugccuuagggcacugguugaaauggcccgggucgggggagcuagcaguuuggagaauaccguggaccuacacauuucuaacucccacccccugagccucacaucggaucaguacaaggccuaucugcaggaccuuguggaagguauggauuuucaaggcccgggggagucuuga

SEQ ID NO: 57805 - RNA, 1353 nt, Artificial Sequence
  derived and/or modified sequence opt3 from IRF4__Homo_sapiens__NP_001182215
augaaccuggagggcgggggaagagguggcgaguucgggaugagcgccguguccugcggaaauggcaagcucaggcaguggcuuaucgaccaaauugauucugguaaauaccccgggcuggucugggagaacgaagagaagucaauauuucggaucccuuggaaacacgcuggaaagcaggacuauaaucgcgaagaggaugcagccuuguucaaagcgugggcuuuauuuaagggcaaguuccgagagggcauugacaaaccagauccgcccaccuggaagacacgucugagaugugcccuaaacaaaaguaaugacuuugaagaacucguugaaaggagccagcuggauaucuccgacccuuacaagguguaucggauuguaccagagggggccaaaaagggagcaaagcagcuuacucuggaggauccccaaaugucuaugucgcauccuuacacgaugaccacaccauaucccucauugccugcucaggugcacaacuacaugaugccaccgcucgaccgcagcuggagagauuauguccccgaccagccucauccagaaauccccuaccagugcccuaugacuuucgguccaaggggccaccauuggcaagggcccgcaugugagaauggaugccaggugaccggcacauuuuacgccugugcuccgccugaaagucaggcccccgguguuccaaccgagccuuccauacggucugcggaagcacuggccuucagcgauugccgccugcacaucugucucuauuaccgagagauuuuagugaaagagcugacuacauccucacccgaagggugcagaaucagucacggacauaccuaugacgcuagcaaccuugaccaggucuuguuuccauaccccgaggauaauggccaaaggaagaacauugaaaaacugcuaucucaccucgagcggggcgugguacuguggauggccccugacgggcuuuaugcaaagcgucugugucagucccgcaucuacugggauggaccauuggcucucugcaaugacagaccgaacaaacuggaaagggaucagacguguaaguuauucgacacucaacaguuucugucagagcuccaggccuucgcgcaucacggucggagccuuccccgauuucagguuacccugugcuucggcgaggaguucccugauccacaacgccagagaaaauugauaacagcccacguggaaccccuacuggcaaggcagcucuauuacuuugcucagcaaaauagugggcauuuccugcggggauacgaccuuccugaacacauuucuaacccagaggauuaucaucgcuccaucagacacagcucgauucaggaauga

SEQ ID NO: 57806 - RNA, 1497 nt, Artificial Sequence
  derived and/or modified sequence opt3 from IRF5__Homo_sapiens__NP_001092097
augaaccagagcauccccguggccccuaccccaccgagaaggguccggcugaagcccuggcucguugcucaaguaaauuccugccaguacccuggccuucagugggugaacggggagaaaaagcuguucuguauuccauggcgccacgcaacacgacauggacccucucaggacggugauaauacuauauuuaaagccugggcgaaggaaacgggcaaauauaccgaggggguggacgaagcugauccugccaaguggaaggcaaacuugcguugcgccuuaaauaaaucaagagacuucaggcugaucuacgauggaccacgggacaugcccccucaaccauauaagauuuacgaggucuguaguaacggcccggcucccacagauagccagccuccagaagacuauuccuuuggugcaggggaggaggaagaggaagaggaggaacuacagcgcaugcuccccucucugucgcuuacugaggaugugaaauggccuccaacccugcagcccccgacauugagaccucccacccuccaaccaccuacucugcagcccccaguugugcugggacccccugccccagacccgucaccccucgcuccuccacccggcaauccugccggcuucagggaauuacugagcgagguccuugaaccagggcccuugccggcgagucugccuccagcaggagagcagcuacuccccgaucugcuuaucuccccucacaugcugcccuugacagaccucgagauuaaguuucaguaccggggucgcccaccucgagcccugaccaucucuaacccccauggcugcagauuauucuauagccaacuggaagcuacgcaggaacagguggagcucuuugggccaauaucccuugagcaaguaagguucccgucaccugaagauauccccagugacaaacagcgguuuuacacuaaucagcuguuggacguucuagaucguggacugauucuccagcugcaaggccaggaccuuuacgccauccgccugugucagugcaagguguucuggagcgguccaugugcaucugcucacgauuccugccccaacccuauucagagagaggucaagaccaaauuguuuucacucgagcauuuccugaaugaauuaauccuguuucaaaaggggcagacaaacacuccacccccuuucgagauauucuuuuguuucggagaagaguggccggacaggaaaccacgggaaaagaaacuaauuaccguccagguggugcccguugccgcgcgacuccugcuugagauguuuagcggcgaguugaguuggucugccgauuccauccgccugcagauuagcaauccugaccucaaggauagaaugguggaacaauucaaagagcugcaccacaucuggcagucgcagcagaggcuucaaccaguagcacaggcucccccuggcgccgggcugggagugggucagggcccguggcccaugcauccagcugggaugcaauga

SEQ ID NO: 57807 - RNA, 1119 nt, Artificial Sequence
  derived and/or modified sequence opt3 from IRF6__Homo_sapiens__NP_001193625
auguacgacggcaccaaggaggugcccaugaacccugucaaaaucuaucagguuugcgauauuccacaaccgcaggggagcauaaucaaucccggauccacagguucugccccuugggacgaaaaggauaacgacguggaugaggaagacgaggaagaugagcuggaccagucacagcaccauguaccaauucaagauacuuuccccuuucucaauaucaacggcaguccuauggcuccagcaagcguggggaauuguuccgucggaaacugcucucccgaggccguguggccuaaaacggaaccacuugagauggaaguuccgcaggcgcccauucagccuuucuacucgucaccagagcuguggaucagcaguuugcccaugaccgacuuagauauaaaguuucaguauagaggcaaagaguacggucaaacaaugacuguguccaauccucagggguguaggcuguucuauggagaccuaggcccaaugcccgaucaggaggaacucuuuggcccggucucucuggaacaggugaaguucccugggcccgagcacaucaccaacgaaaagcaaaaacuuuuuacaagcaagcuguuggacguaauggaccggggacucauucuggagguuuccggucaugcuaucuacgccauucgccugugccaguguaaaguguauuggucaggcccaugcgcaccuagucucgucgcccccaauuuaaucgagcgacagaagaaagugaagcuguucugucuugaaaccuuuuugagcgaucugauagcucaccaaaaggggcagauugagaaacagccacccuucgaaaucuaccuaugcuuuggagaggaauggccugacggcaagccacucgagcguaaacugauucuugugcaggucaucccgguuguggcaagaaugaucuacgagauguucucuggugauuuuacuagguccuucgacucagggagcguacggcugcaaauuaguacacccgauauaaaggacaacaucguggcccaguugaaacagcucuaucgcauucugcagacccaagaaucuuggcagccuaugcagccaacgcccuccaugcaguuaccuccagcucugcccccgcaauga

SEQ ID NO: 57808 - RNA, 1512 nt, Artificial Sequence
  derived and/or modified sequence opt3 from IRF7__Homo_sapiens__NP_001563
auggcccuggcucccgagagagcagccccuaggguucucuucggcgaauggcuucugggggagaucagcuccggaugcuacgaagguuugcagugguuagacgaggcgcggaccuguuuucgcgucccauggaagcacuucgcucgaaaagaucugucugaagccgacgcacguauuuuuaaggccugggcuguugcaagagggagguggccgcccucaagucggggcggaggcccuccacccgaggccgagacagcugaacgcgccgguuggaaaacuaacuucagaugcgcgcuaaggagcacgcggcgcuuugugaugcuccgagauaauuccggggacccugcagauccacauaagguauaugcccugucuagagagcuuuguuggagggaaggacccggcaccgaccaaacagaggcugaggccccugcagcugugccaccgccccagggcgggccuccaggacccuuccuggcccacacucaugcggguuugcaggccccuggcccacuccccgcaccggcuggggauaaaggagaccugcugcuccaggccguccaacagucgugcuuagcugaucaucugcuuaccgccucauggggcgcagacccugugcccacaaaggccccaggugaagggcaggagggauugccucugaccggcgcuugugcgggcgggcccggacuaccagccggugaacucuacggcugggcaguugagacuacacccagcccugggccacagccggcugcccugaccacgggagaagcagccgcucccgagaguccucaccaagccgagccauaucuuucccccucuccuagcgcaugcacugcggugcaggaaccaucccccggcgcucuggaugucaccauaauguacaagggucggacaguguugcagaaaguaguugggcacccgucauguacuuuucucuauggcccuccagaccccgccgugcgugcaaccgauccucagcaagucgccuuccccaguccagcugagcugccugaccagaagcaguuacgcuacacagaggaacugcucagacacguggcccccggacuucaucuggaauugaggggcccacaacuaugggcacggcgaauggggaaaugcaagguguauugggaggucggagguccgccuggcagcgcuucucccuccaccccagccugucugcucccccgcaacugcgacacgccuaucuuugauuucagaguguuuuuccaggagcugguggaauuuagggcgcggcagcgcagagggucaccaagguacacuauuuaccuuggauucggccaggaccugagcgccggucgucccaaagagaagaguuugguacucgugaagcuggaaccuugguuaugucggguccaccuggaggggacacaacgagaaggcgugucuucccuagauagcucgucucucucccugugccuuucaagugcuaauagcuuguaugacgauaucgagugcuuccugauggagcucgaacagccggcauga

SEQ ID NO: 57809 - RNA, 1281 nt, Artificial Sequence
  derived and/or modified sequence opt3 from IRF8__Homo_sapiens__NP_002154
augugcgacagaaacggcgggaggcggcugcgccaguggcucaucgagcaaauugauagcuccauguaccccggacuuauaugggaaaaugaggaaaagucuauguuccgaaucccuuggaaacacgccgguaagcaggacuauaaccaggagguggaugcuucaauuuuuaaagcaugggccgucuucaagggcaaauuuaaggaaggggacaaggcggagccagcuaccuggaaaacacgucugagaugugccuugaauaagaguccggauuucgaggaaguuacugacaggagccaguuagauaucuccgagcccuacaaaguguaucggauuguaccugaagaggagcaaaagugcaaacugggaguggcaacggccggcugugucaacgaagugaccgagauggaaugcggucgcucugagaucgacgaacuaauaaaggagccaucgguugaugacuacauggggaugaucaagagaucacccagcccuccagaggcuuguaggagucagcuccugcccgauuggugggcacagcagccuuccacaggagugccacuugucacuggcuauaccacauacgacgcccaucacucugcuuuuagccaaauggugauuuccuucuauuacggcgggaaacugguaggacaggccaccacuacaugcccggaagguugucgguugucacucagucagcccggccugccugggaccaagcuguacggaccagagggccucgaauuaguucgcuuucccccugcggaugcaaucccaagcgagcgacagagacaagugacgaggaaacuguucggucaucuugaacguggggucuugcugcacucuucccggcagggaguguuugugaagcgccuaugccagggcagagucuucuguucaggcaaugccguugugugcaaagggaggcccaacaagcucgagcgggacgagguagugcaagucuuugacacuagccaguucuuucgagaacugcagcaguucuauaauagucaaggacgccuuccggaugguagagugguucuguguuucggcgaggaauuuccugacauggcucccuugaggucuaaacucauucuggugcagaucgagcaguuauacguccggcagcuggccgaagaggcagggaaguccugcggagcuggcagcgugaugcaagccccagaggaaccucccccagaucagguauuccgcauguuucccgacauaugcgcgucgcaucagagaucuuucuuuagggagaaccagcaaauuaccguuuga

SEQ ID NO: 57810 - RNA, 1182 nt, Artificial Sequence
  derived and/or modified sequence opt3 from IRF9__Homo_sapiens__NP_006075
auggccagcggcagagcuaggugcacccggaagcugcgcaacuggguggucgagcagguugaauccgggcaauuccccggaguguguugggacgauacagcaaaaacuauguuucgaaucccuuggaagcacgccgguaaacaggacuuccgugaggaucaggacgcggccuuuuucaaggcuugggcaauuuuuaaaggcaaguacaaggaaggggauacgggaggcccagccguauggaaaaccagacucaggugcgcucuuaauaagucuucagaguucaaagaagugccggagcggggucgcauggacgucgcagagcccuauaagguguaccagcuguugccuccagggauaguuaguggacaacccggcacacagaaagugccuagcaagagacagcauuccucugucucgucagaaaggaaggaggaagaggaugccaugcagaacuguacuuuaagcccaagugugcugcaagacucccuaaauaacgaggaagagggcgcuucugggggagccguacacagcgauaucgguuccucaaguucuagcuccucacccgaaccucaggagguuaccgacacaaccgaagcgccauuucagggcgaucagcggagccucgaguuccugcuuccgcccgagccugacuauagucuguugcucacuuuuauuuacaaugggcgcguggucggagaagcacaagugcagucucuggauugccgacugguggccgagccauccggcagcgaaucgucuauggagcagguccucuuccccaaaccugguccauuagaacccacacaaagacugcuuucccaguuggagagggggauccugguugcuucaaacccgcggggacuauuugugcagcgucucuguccuauucccaucaguuggaaugccccacaggcaccucccggcccaggcccccaucugcuuccuagcaacgagugcguagaacuguuccgcaccgcuuauuuuuguagagacuuggugagguacuuccaagggcucggaccaccgcccaaguuccaggucacgcugaauuuuugggaggaaucccacgguucuagccauacuccucagaacuuaauaaccgugaaaauggagcaggccuucgcgcgguaucugcucgaacaaacaccagagcagcaggccgcaauccuuucacugguuuga

SEQ ID NO: 57811 - RNA, 1446 nt, Artificial Sequence
  derived and/or modified sequence opt3 from IRG1__Homo_sapiens__NP_001245335
augauguuaaagagcaucaccgaguccuucgccacagcuauucacggccucaaaguggggcaucuuacugacagagucauacagaggucuaagcggaugauccuggauacguugggagcagguuuucugggcaccacaacugaaguuuuccacauugccucacaauacaguaaaaucuauagcuccaacauuucuucgaccgugugggggcagcccgacauccgccugccuccaacauacgcggcuuuuguaaauggaguggccauacauucaauggauuucgacgauaccuggcacccggcaacucaucccagcggcgccguccuaccugugcucacagcucuggcagaggcccuuccacgaagucccaaguuuuccggucuggacuugcuccuggcuuucaacguugggaucgaagugcagggacgucugcuccacuuugccaaagaggcgaaugauaugccuaagagauuccacccacccucugucgugggcaccuuaggcagcgcagccgcugccuccaaguuucuggggcuuucaaguacgaaaugcagggaagcauuggcuauugccguaagccaugcgggagccccuauggcaaacgcugccacucagaccaagccacugcacaucgguaaugcugccaaacauggcauugaggcagccuuccuagcuaugcucgggcugcaaggaaacaagcagguucuugaccuggaggcgggcuuuggugcauucuaugccaauuacucuccgaaaguguugcccuccaucgcuucauauagcuggcuccuggaucagcaggacgucgccuuuaagcgguucccugcacacuuaaguacacacuggguggccgaugcugccgcaucugugcgcaagcaucuggucgcggaaagagcucuccuuccaacugacuacauaaaaaggauuguucugcggauccccaacgugcaauauguaaaucgcccuuucccaguguccgagcacgaagcccgacauagcuuucaguacgucgcaugugccauguugcuagaugggggaauuaccgugcccucguuccacgagugccagaucaacagaccgcagguuagggagcugcucucuaagguggaacuggaguacccucccgacaaucuuccauccuuuaacauccuguauugugaaauuucagucacauugaaagacggcgcuaccuucacggaucggagugacacuuuuuacggccauuggcguaagccucucagccaagaggaucuggaagagaaauuccgcgccaaugcauccaagauguuaucuugggacacaguggagagccugauaaaaaucguaaagaaccuagaagaucucgaggacugcucaguucugaccacucuuuugaaggggcccaguccacccgaaguggcuuccaauagcccugccuguaacaacucuauuacaaaucugucauga

SEQ ID NO: 57812 - RNA, 546 nt, Artificial Sequence
  derived and/or modified sequence opt3 from IRGM__Homo_sapiens__NP_001139277
auggaggccaugaacguggaaaaggcuagcgcagacggcaaucugcccgaggucaucuccaacauuaaagaaacccucaagauaguuucuagaacaccugugaauaucacuauggccggggauucaggaaacgguaugaguacguucauuagcgcgcuuaggaauaccggccacgaggggaaggcuuccccaccgacagaacugguaaaagccacucagcggugcgcaucuuacuuuucgucacauuucagcaacguggucuugugggacuuacccggaaccggcagugccacaaccacucuggagaauuaucuaauggagaugcaauuuaaccgcuacgauuucaucaugguggcuuccgcacaguuuucuaugaaucacguuaugcucgccaaaacagcugaagacauggguaagaaguucuauauuguguggaccaaacuggauauggaccuuagcacgggggcccugccugagguccaguugcuccagauccgagaaaacgugcuggagaaucugcaaaaggagcguguaugugaauacuga

SEQ ID NO: 57813 - RNA, 3729 nt, Artificial Sequence
  derived and/or modified sequence opt3 from IRS1__Homo_sapiens__NP_005535
auggccucucccccugaguccgacggcuucucugaugugagaaaggucggguaccugaggaaaccaaagucaaugcacaaacgguuuuucguucuccgcgcugcaagugaagccggagguccggcgcgacuugaguauuacgaaaacgagaagaaauggcgucauaagagcuccgcucccaagagaucuaucccucuggaaucgugcuuuaauauuaacaaaagggccgacucaaagaauaaacacuugguggcauuauauacccgggaugagcauuucgccauagcugcagacagcgaggccgaacaggauaguugguaccaagcucugcuacagcuccacaaccgcgccaagggccaucacgacggggcggcagcccugggagcuggcggugggggaggcuccuguucuggcagcuccgggcuuggagaggccggugaagaucugucauauggcgacguaccacccgggccugcauuuaaagagguguggcaggucaucuugaagccaaagggacucggccagacuaaaaaucugauugguaucuacagacugugccucacaaguaagacgauuagcuucgugaaauuaaacucugaggcugccgcgguugugcugcaacuuaugaauaucaggcggugugggcacuccgaaaacuuuuucuuuauagaggucggacgcucagccgugaccggccccggcgaguucuggaugcagguagaugacagcguuguggcacagaauaugcaugaaacaaucuuggaagcuaugcgagccaugagugaugaguuuagaccuaggucuaagucccagagcucgucuaacugcuccaauccaauuucagucccgcugcggcgucaccaucuaaacaaucccccuccaagucaaguggggcucacucgcagaagcaggaccgaguccaucacagcuaccucucccgccagcauggugggagguaaaccuggcucauuccggguccgagcaaguuccgacggggaaggaacuaugagccgcccagccucuguugauggcucacccgugaguccgagcacaaacagaacccacgcucacaggcaucgggguuccgcgcgccugcacccuccccuuaaucauucuagaucgauuccaaugccugcauccagguguagccccucagccacgaguccaguaucucugagcuccucaagcacuucugggcacggcuccaccagugacugcuuguuuccccgucggagcucugcuuccgugucaggaaguccuagcgacggcggguucaucucguccgaugaguauggaucuagcccaugugacuuccgaucaaguuuuagauccgucacaccggauucucucggucauacucccccugccaggggcgaagaggaacugagcaacuacauaugcaugggagggaagggcccauccaccuuaacagcacccaacggucacuacauucugucacgcgggggcaauggacaccgguguaccccuggcacggggcucggaacuagcccagcccuugcuggugacgaggccgcaagugcggcugaucuggacaacagauucaggaaacgcacacauucugccggcaccucccccacuaucacacaccagaagaccccgagccagucgucaguggcaucuauugaggaauauacggagaugaugccugccuacccacccgggggaggcaguggugggcgauugccuggccaucggcacuccgcuuuuguucccacccguagcuauccagaagagggacuagaaaugcacccucuggagagaaggggcgggcaucaccgccccgauucuagcacacuccauacugacgauggauacaugccaauguccccgggcguggccccuguccccucaggucggaaggggaguggagacuauaugccaaugagccccaaaucuguguccgcaccucagcaaaucaucaauccaauuagaaggcacccccagcgaguagauccuaacggcuacaugaugaugucaccgagugguggcugcagcccagacauagggggaggccccuccucuucgagcucauccaguaaugcuguuccuucugggaccagcuauggaaagcuguggacaaacggcgugggugggcaucacucccacguccuuccacaucccaaaccuccgguggagucaucuggaggcaagcuguugcccuguacuggugacuacaugaauaugagcccagucggcgauaguaacaccuccagcccuucugacugcuacuaugggcccgaagauccacagcacaaaccugugcucucauacuauucccugccccgcaguuucaagcauacacaacggccaggagagccggaagagggcgccagacaccagcauuuaaggcugagcaccucgucugggcgucuacucuacgcggccacugcugacgauuccagcucaaguacgucuuccgacagccugggaggcgguuauugcggggcacgccuugagccuucauugccccacccacaccaucagguucugcagccccaccucccucggaagguggauacagccgcucaaaccaauaguagacuggccaggccaacucgacuuagccugggagaccccaaagcauccaccuugccucgggcgcgcgaacagcagcagcaacagcagccgcuccugcauccacccgagccuaagucucccggcgaauacguaaacaucgaguuugguagcgaucaguccggcuauuuaucagggccagucgccuuccacucuaguccuucggugagaugucccagccaacugcagccagcuccuagggaagaggagacaggaaccgaagaguacaugaaaauggaccuaggcccggggcggcgagccgcauggcaggaauccacuggaguugagaugggcagacucggucccgcuccaccuggggccgcaucuauuugccgccccacaagggccgugccaucaagccguggagauuacaugacgaugcagauguccuguccucggcaaaguuaugucgacaccucucccgcugcgccggugagcuacgccgauaugagaacuggcaucgcagcugaagagguaucacugccaagggccacaauggccgcugcauccaguagcucugccgcguccgcuucaccuaccggcccccagggggccgcagagcuugccgcucacagcucguugcugggagguccacagggccccgggggaaugucugcauuuacacgcgugaaucucaguccuaaccgaaaucaauccgccaagguuauaagagcggacccgcagggcugccggaggcgccauagcucagaaacuuucuccucuacccccagcgcuacgcgugucgguaacaccgugccauuuggggccggagcagccgugggcggcgggggagguaguuccagcagcucagaggacgucaaaagacacaguuccgcuagcuucgaaaauguuuggcugcggccuggcgaguuagggggagcccccaaggaaccugcaaagcuguguggcgcugccggugggcuugagaacggauugaacuauauugaucucgaccuggugaaagauuuuaagcagugcccacaggaguguacacccgaaccucaaccacccccgccuccacccccucaucagccacuaggcucuggcgagucgucaagcacuaggcgcuccagugaagaccugucugcguacgccagcaucuccuuccagaaacagcccgaggaucgacaauga

SEQ ID NO: 57814 - RNA, 4017 nt, Artificial Sequence
  derived and/or modified sequence opt3 from IRS2__Homo_sapiens__NP_003740
auggccagcccuccuagacacggcccaccggggcccgcuuccggagacgguccuaaccugaauaacaauaacaauaacaauaaccauucugugaggaagugcggcuaccuccggaaacagaagcacgggcauaaacgcuucuuuguccuucgaggaccaggcgcugguggggaugaggccaccgcgggaggcggcucagcuccccaaccuccacgucuggaauauuacgagagugaaaagaaauggagaagcaaggccggggcacccaagaggguuaucgccuuggacuguugcuuaaauauuaacaaacgggcugaugcaaagcacaaauaucugauagcccuauacacaaaggacgaguauuucgcuguggccgcggaaaaugagcaggagcaggaaggaugguaccgcgcacucacugaucugguauccgaggguagagccgcugccggcgacgcaccuccagcugccgcgccggccgcaucuuguucggcuucacuucccggggcccugggaggcagcgcuggugccgcaggggccgaagauaguuauggauugguggcuccugcgacggcagccuacagggaggucuggcaagugaaccucaaaccaaagggccugggccaguccaagaaucugaccgggguuuaccggcucugcuuaucugcucgcacaaucggauuugugaaacugaacugugagcagcccagcgucacucuucaguugaugaauauucgaagaugcggucauuccgacucauucuuuuucaucgaagugggcaggagugccguaaccgggccuggagagcuguggaugcaggcagaugacagcguuguggcccaaaacauucacgaaacaauccuagaggcuaugaaggcccucaaagaacuguuugaguuccggccacguucuaagucccagucaagcggcaguucugcaacccaccccauauccgucccgggugcgcgcagacaucaccaucuugugaaccugccucccagccagacuggguuggugaggcggucgcgaacagauucucucgcugccaccccacccgcagccaaauguuccucaugccgcgucagaacggcuagugagggcgacggaggcgccgcagcuggggccgcggccgcuggagcaaggcccguuagcguggccgguuccccacugucucccggcccuguacgggcuccauuaagccgcucacacacucugagugggggauguggcgguagaggguccaagguggcccuccuuccggcaggcggagcgcugcagcacagcaggucuaugucaaugcccgucgcccauaguccuccagcugccaccagccccggcuccuugucuucgagcuccgggcacggaucagguaguuauccuccacccccgggcccucauccaccccuaccucacccccugcaucacgggccaggacaacguccuucuagcggcuccgcaucagcuagcgguucucccuccgauccaggguuuaugagucucgacgaauacggcagcucuccgggagaccugcgggccuucugcucccaccgaucaaauacaccugagaguaucgcagaaacucccccagccagagauggcgggggaggcggugaguuuuauggguacaugaccauggacaggccccuuagccauuguggacgcucguaucggagaguguccggcgaugcugcgcaggaccuggauagggguuugcgcaaacgaacauacucucucaccacgccugcccggcagcguccaguuccccaaccuagcucagcaagucuggacgaauauacuuuaaugagagcuacauucuccggcucugccgggaggcugugcccgagcugcccagccuccucacccaagguggcuuaccacccuuacccagaggauuauggagacauugagaucggcagccaucgcaguucuuccagcaaccuaggggcagaugacggauacaugcccaugaccccuggcgccgcgcucgcugguucggggucaggaucuugucggagugaugacuauaugccgaugucccccgccagcgucucugcaccaaagcagauucugcagccuagagccgcugcagccgcggcugccgcagugcccagcgccggcccagcugguccugcccccacuuccgcagcuggcaggacauuuccagccucagggggaggcuacaaagcgaguagcccggccgaaucuuccccugaggacucaggguauaugcgaauguggugcggaaguaaacuuagcauggaacacgcagauggcaaguugcugcccaauggugacuaccucaacguauccccaucugaugcuguuaccacggggacacccccugacuucuucucggccgcucugcacccaggaggcgagccccuucgcggugugccuggcuguugcuauagcucacugccgcgguccuacaaggcaccauacaccugugggggagauagugaccaguaugucuugaugucuagccccgugggcagaauccucgaagaggagaggcuggaaccucaagccacucccgggccaucccaggccgcuucagcguuuggagcaggcccuacccagcccccacauccugucgugccgucucccguucguccaagcggugggcgcccugagggauucuuaggccagcggggcagagccgugaggcccacacgacugagucuagaagggcucccaucccugccuagcaugcacgaguacccccuuccgccagagccuaaaucucccggagaauauauaaauauugauuuuggugagccaggcgcucgguugucacccccugccccgccccugcucgcauccgccgcuaguagcucgucucuguuauccgcgagcucaccagccaguucucugggguccggaacuccuggcaccagcucagacagucgccaaagaagcccccuuuccgauuacaugaacuuggacuucucuagcccuaaguccccaaagcccggugcaccuucagggcauccaguaggaucucucgauggccugcuaagucccgaagcaucgagcccguauccuccacugcccccuaggccauccgccucucccucaagcucccuccagccgccucccccaccucccgcaccaggcgagcuguaccggcuucccccugccagugcugucgccacagcgcaggggccaggagcagccucuagcuugucauccgacaccggugauaauggcgacuauacugaaauggcuuuugggguggccgcuacgccgccccagccuaucgcagccccacccaaaccugaggcugcccgaguugcaaguccaacaagcggagugaagagacugucuuuaauggagcaagucuccggcguggaagcguuccuccaggccucacagcccccugacccgcaccgcggugcuaaaguaauuagggccgauccacaagggggacgucggagacauagcucggagaccuuuucuaguacuaccacagugacccccguuuccccuagcuucgcacacaaccccaagaggcacaauucagcuuccgucgaaaacgugucucugcgcaaaagcagugagggcggcgugggggucggaccagguggcggggacgaaccucccacuuccccacgacagcuucagccggccccuccccuggcaccacagggaagacccuggacaccuggccaaccagguggguugguuggaugccccggcagcggcgggucuccuaugcggagggagacgucagccggauuucagaauggucucaacuacaucgcuaucgaugugcgcgaggaaccgggccugccaccccagccucagccacccccucccccacuaccgcaaccuggggacaagaguuccuggggacguaccagaagccugggcggucucauuucugcgguggggguaggaucgacuggcggcggguguggaggucccggcccaggggcccugccucccgcaaauacauacgcuucaauagauuuccuuagccaucacuugaaggaggccaccaucgucaaagaauga

SEQ ID NO: 57815 - RNA, 3774 nt, Artificial Sequence
  derived and/or modified sequence opt3 from IRS4__Homo_sapiens__NP_003595
auggccagcugcuccuucaccagagaccaggcuacaaggcggcugcgcggcgcagccgcggcugccgcagccgcucucgcagccguggucacuacgccccuucugucuucagggaccccuacagcuuugaucggaacugguaguagcuguccaggcgccaugugguuauccaccgcgacagggucucgaucggauucagagagcgaagaggaagaccugccgguuggagaggaagugugcaagcguggcuaccuaagaaaacaaaagcacggucauaggcgguauuuuguacucaaacuggagaccgcagaugcccccgcucgccuugaguacuaugaaaacgccagaaaguucaggcacagugugcgggcagcugccgcggccgcagcugccgcugccuccggggcagccauuccuccacugauacccccucgccgagucaucacuuuguaccaguguuuuucugugagccagagagcugacgcgagguaucggcaucucauugcacuguucacacaggaugaguacuuugccaugguugcugaaaaugaguccgagcaagaaucaugguaucugcucuuaagucgucugauccuugagagcaaacgcagaaggugcggaaccuugggcgcccagccagacggcgaacccgcagcccuggcugccgcagcggcugccgagccuccauucuacaaggauguguggcaggucauugugaagccgcgggggcuaggacaccgaaaagaacucucugguguauuucgccugugucuuacggacgaggagguuguguucgucagacugaacacugaaguggcauccguggucguucaguugcucucaaucaggcggugcggccauagcgagcaauacuuuuuccuggaaguggggcgcaguaccguaauaggacccggcgaguuauggaugcaaguggaugacugugucguggcccagaauaugcacgaacuguuucucgagaagaugagagcucuuugcgccgaugaguauagggcacguugucggucuuacuccaucagcauuggugcucaccuguugacacuacugucggcccgaagacaucucgggcugguuccucuugaaccaggaggcuggcugaggcgcucucgguucgagcaguuuugccacuugagagcgaucggcgacggggaagaugagaugcuguucacuaggcgcuucgugacccccuccgaaccugucgcccauucacgacggggacgucuccacuuaccaagagguaggcgcagucggagagcugugagcguacccgcauccuuuuucaggcgacuggccccgucuccugcucgcccccggcacccagccgaggcaccuaacaauggcgcgagacuaagcucagagguuaguggguccggaagcggcaacuuuggugaagaggggaauccccagggcaaagaagaccaggagggaucuggcggggacuauaugccaaugaacaauuggggaucagguaacggcagggggaguggaggcggucaggggagcaauggccaaggauccucuucgcauagcuccggcgggaaccaguguucaggagagggucagggcagucgugggggacagggcucuaauggucaagggagcggcggaaaccagugcucccgcgauggccaggggacagccggaggccacgguucagggggaggccagcggcccgguggcgggcauggaagcggcgggggacaaggcccuggugacgggcacggaucuggcgguggcaaaaauuccgggggaggcaaggggaguggaagcggcaaggguucugauggggacggagaaagaggcaagucccucaaaaagaggucauacuucgguaaacugacccagaguaagcagcagcaaaugccaccgcccccuccacccccuccacccccgccuccagcuggcgggacgggaggcaaaggcaagagcggaggccgauuucggcuuuauuucugcguggaucgcggugccacuaaagaguguaaggaagcaaaggaggucaaagacgcugaaauucccgagggggccgcaagaggaccucauagggcccgggcuuuugaugaggacgaagaugaccccuacgugccaaugcgaccuggcgucgcgacacccuuggugucguccucugauuauaugccaauggccccgcagaacguuagcgcaucaaagaaaagacacagucgcuccccuuucgaggacucuaggggcuacaugaugauguuuccccgugugagcccacccccugcuccaucacccccuaaggccccggacaccaacaaagaagaugacuccaaggauaaugacagcgagagugauuacauguucauggccccaggggcuggagcaauccccaagaacccucggaauccacagggugggucuuccagcaaaucguggucaucuuauuuuagucugcccaacccuuucagauccagcccgcucgggcagaaugacaacucugaauacguacccaugcugccaggaaaguuucuuggcaggggucuggauaaagaggucagcuauaauugggacccuaaggaugccgcguccaaacccucaggggagggaaguuucagcaagccaggcgacggcgggucuccuuccaagcccucagaucacgaaccaccgaaaaacaaggcuaaacgcccuaaucgauugaguuucauaacuaagggauacaaaauuaagcccaagccacaaaaacccacacaugagcagagagaagccgacagcuccucugauuaugugaacauggacuuuaccaagcgggagucgaauacgccugcaccaagcacccagggucuccccgacucauggggcaucauugccgaaccuaggcaauccgcuuucaguaacuacguuaauguggaguuuggggucccguucccaaaccccgcaaaugaucugucugacuuacugcgcgccaucccucgugcgaacccccuaagccucgauuccgcuagauggccacugccuccccuuccauugucagccacaggaucuaacgcaaucgaggaagagggcgacuauauugaagugauauuuaauagcgccaugacuccugcuauggcccuggcagauagugcuauccgguacgacgccgagaccgguaggauuuacguaguggauccguucuccgagugcuguauggacaucagccucucucccucacgcugcuccgaaccaccucccguugcgcgacuguuacaggaggaggaacaggaaagacggaggccacagagucgcagccaaucguuuuucgccgcagcuagagccgcugucucugcauuuccuacagauucccuggagagggaccuuagccccucaagugccccggccguggcuucugcggcagagccaacuuuggcccucucccagguggucgcugccgcaagcgcccuggcugcggccccugggauaggagcagcugccgcagccgcuggcuucgauucagccagugcgcggugguuucagcccguugcaaacgccgcugacgccgaagcugugcguggcgcacaggauguggccgggggaagcaauccaggugcucacaaccccuccgccaaucuagcacgcggcgacaaccaagccgggggagcggcugccgcagcugccgcaccugagccgcccccacgaucuagaaggguaccucggcccccugaacgcgaggacagcgauaaugacgaugacacccaugucagaauggauuucgccaggcgggacaaccaguuugauuccccaaaacgaggcagauga

SEQ ID NO: 57816 - RNA, 1443 nt, Artificial Sequence
  derived and/or modified sequence opt3 from IRX1__Homo_sapiens__NP_077313
augagcuucccccagcugggcuacccucaauaucucuccgccgcugggccaggagcauacgguggcgagagaccgggggugcuugccgcggcugccgcagccgcugcagccgcuucuucaggaaggcccggcgccgcggaacugggugggggagcaggcgccgcugccgucaccaguguuuugggcauguaugcagcugccgggccuuacgcgggagccccaaacuauagcgcauuuuuacccuacgcugccgaccugucccuauucucucagauggguucgcaguaugagcucaaggauaauccuggcgugcacccagcuacauuugccgcacauacugcccccgcuuacuacccuuaugggcaguuccaauacggagacccaggccggccgaaaaacgcgacgcgcgaaucaaccagcacacugaaggcauggcuuaaugagcaccguaaaaaccccuauccuacuaagggugagaaaaucaugcuggccauuauaaccaagaugacauugacccagguaaguacuugguuugcuaaugcccgaagaaggcucaagaaagaaaacaaggugacauggggagcacgguccaaagaucaggaggacggggcccuguucggcucugauaccgaaggcgacccagagaaggcugaagaugacgaggagaucgaucuggaaagcauugacaucgauaaaauugacgagcaugauggggaccaguccaaugaagacgaugaggacaaggccgaagcaccccacgcgccugcugccccaucagcacucgcccgcgaucaaggaagucccuuagcugccgcagacguccugaagccgcaggauagcccucuugguuuggcuaaagaggcccccgagccaggcucuacgagacugcuauccccuggggcggccgcuggaggccuccagggugcaccccaugggaagccaaaaaucuggucacuggccgaaacugcuaccagccccgacggcgccccuaaggcaaguccaccgcccccugcgggacacccaggcgcccacgggcccucugcuggagccccucuucagcauccagcauuucugcccucccacgguuuguacacaugccauauaggcaaauucagcaacuggacuaauucggcuuuucucgcccaagggucucuguuaaacaugagguccuuccugggagugggcgcaccgcacgccgcuccucacgguccacaucuccccgcgccucccccaccucagcccccaguugccaucgcaccgggggcucuuaauggcgauaaggccucagugcggaguagcccuacccugcccgagcgcgacuuggucccacgacccgauuccccugcccagcaacuaaaaucuccauuucagcccgugagagacaacagccuggcuccucaggaaggaacaccgaggauucucgcagcccugccaucagcguga

SEQ ID NO: 57817 - RNA, 1416 nt, Artificial Sequence
  derived and/or modified sequence opt3 from IRX2__Homo_sapiens__NP_150366
augagcuacccccagggcuaucuguaccaagccccugggucccucgcucuuuauucuugcccagcauacggagccucagcgcuggcugccccgagaagugaggaauuggcaaggagcgccuccgguucugcuuucucgcccuauccuggcucagcagccuuuaccgcucaggccgcgacaggguucggaagcccauuacaguacagugcagacgccgcugccgcagcugccggcuuucccuccuauaugggugcgccuuacgaugcccacacuacggggaugaccggagcaaucucuuaccauccauauggcagcgcugccuaccccuaucagcugaacgacccugcuuaccggaagaaugccacacgcgaugcaacugccacccuaaaagccuggcucaacgagcaccgaaagaauccauauccgacaaaaggcgaaaagauuaugcuggcgauaaucaccaaaaugacucuuacacaaguguccaccugguucgcaaacgcccguagaaggcugaagaaggagaauaaaaugacgugggcuccccggaacaagucagaagacgaggaugaggacgaaggggaugccacucgcaguaaagacgagagcccugauaaggcacaggaaggaaccgagacaucugccgaggacgaagguauuuccuugcaugucgauucacucacugaccacagcuguagugcugagucugauggcgaaaaacugccaugcagagccggggacccccugugugaguccggaagcgaaugcaaggacaaguacgaugaccucgaggaugacgaggaugacgaugaagagggcgaaagggguuuagcaccuccaaaacccguuaccucgucuccgcugacagggcuugaggcgccuuugcuguccccgccaccugaagcugcuccccggggaggccgcaagaccccacagggcucacgaacgagucccggggcaccuccaccggccagcaaacccaagcuauggucccucgcugagaucgccacuucugaccugaaacagccuagccuuggaccagguugugggcccccuggccugccagcagcugccgcgcccgccucaacaggagcuccgccuggcgguaguccauaucccgcauccccuuugcucgggagaccccuguacuacaccagcccauuuuauggcaauuacacuaacuauggaaauuuaaacgccgcucugcaaggccaggggcuccuuagguacaauucugccgcagcggccccuggagaggcucugcauacagcccccaaggcagcuucagaugccgguaaagcaggcgcccacccauuggaaagucacuaucggagccccgggggaggcuacgagccuaagaaggacgcuuccgaagguugcaccgugguagggggcggagugcagcccuaucuauga

SEQ ID NO: 57818 - RNA, 1506 nt, Artificial Sequence
  derived and/or modified sequence opt3 from IRX3__Homo_sapiens__NP_077312
augagcuucccccagcugggcuaccaauauaucagaccucucuacccauccgagaggccgggggccgcuggagguucuggcgggucagcaggagcccggggcggucuuggggcgggagcuagugaacugaacgccagcggcuccuugucuaauguguuaucgucagucuauggcgcacccuacgccgcugcagccgcugccgcggcagcccagggguauggagcuuuucugccuuacgccgcagagcuaccaauuuucccccagcucggugcucaguaugaacugaaggacagcccuggcguucaacacccagccgcggccgcagcuuuuccccauccucacccagccuucuacccguacgggcaguaucaguuuggagaucccagucgcccuaaaaacgcuacccgagaguccacaucuacucuuaaggccuggcugaaugaacaucguaaaaacccauaccccacgaagggcgagaaaauaauguuggcaaucauuaccaagaugacacucacucaggugagcaccugguucgccaaugcuagaaggcggcugaagaaagagaacaagaugacaugggcgccucgcuccagaaccgacgaagaggguaaugcauaugggucagaaagggaggaggaagaugaggaagaggacgaagaggauggaaaacgggagcuggaacucgaggaagaggaauuaggcggcgaggaggaagacacugggggagagggucuggccgaugacgaugaagacgaggaaaucgaucuugagaacuuggacggcgcugccacagagccagaacugagucuagcaggggccgcucgccgagauggagaccucggccugggucccauuagcgacucuaaaaauuccgauucagaggacagcagugaagggcuugaggauagaccgcugccuguauugucucucgcccccgcaccaccucccguggcggucgcuuccccaagccugcccucgccuccagugucuuuagacccgugcgcccccgccccugccccagcuuccgcccugcaaaagcccaagaucuggucacucgcagagaccgcuacgaguccugauaacccaaggcggagcccgcccggcgccggaggcuccccuccaggggcggccguugcucccucugcacuucagcugagcccugccgcugccgcagcggccgcucaccguuuggugucagcaccccuaggaaaguuuccagcauggacuaaucgcccuuuccccgguccaccgccuggccccagacugcauccacucagucugcuuggguccgcucccccucaccuguugggacucccaggcgccgcaggucaccccgccgcugcggccgcauuugcuaggccugccgaaccggaagggggcaccgaccgguguagcgcccuggaggucgagaaaaaguuacugaaaacagcuuuccagccagugccccgacgcccucagaaccaucuagaugcagcccucguacugucugcgcuuucaaguagcuga

SEQ ID NO: 57819 - RNA, 1560 nt, Artificial Sequence
  derived and/or modified sequence opt3 from IRX4__Homo_sapiens__NP_057442
augagcuacccccaguucggcuauccuuacuccucugccccacaauuucugauggcuaccaacucacucaguacaugcugugagagcgggggaagaacucuugcagacuccgguccggccgcgucugcucaggcccccguguauugcccugucuacgaaucgaggcuguuggcaacggcccggcacgaguuaaauucagcugcagcccugggcguuuaugggggaccauacggcgguagccagggguauggaaacuacgugaccuacggcagugaggcuuccgccuucuauucucuaaauagcuuugauuccaaggacggcucagggagugcgcauggaggucucgcacccgccgcugccgcauacuauccuuacgagccagcucugggccaguaucccuacgaucgcuaugggacaauggacagcggaacucgacguaaaaacgccaccagagaaacaaccucuacucuuaaggcguggcugcaagagcacaggaaaaauccuuacccaacaaagggcgagaaaaucauguuggccauuauaaccaagaugacgcucacucagguauccaccugguucgcaaacgcucggcgcagacugaagaaagaaaauaagaugacauggccgcccaggaacaaaugugccgaugagaagcggccuuacgcugaaggugaggaggaagaagggggagaagaggaagcccgcgaggagccacugaaaucaagcaagaaugcagaacccgugggcaaggaggaaaaagagcucgaauuaagugaccuggaugacuuugauccucuugaggccgagccacccgcuugcgaauugaagccgccuuuccauucucuggacggcgggcuagagcgaguccccgcggcaccagauggaccugugaaagaagccuccggugcucucagaaugagccuggccgcaggcgggggagccgcucuugacgaggaucuggaaagggcccggucguguuugcguucugcagcggcuggccccgagccacuccccggugccgaagggggcccucagguuugcgaagcaaagcugggauuugugccagccggcgcuuccgccggguuagaggcaaaaccgcgcaucuggucacuggcucacacugccaccgcggccgcugcagccgcuacaagucucagccagaccgaguuccccuccuguaugcuuaagagacaaggaccugccgcaccagcggccgucucuagcgcucccgccacgucaccuaguguggcacugccacauuccggugcuuuggacaggcaccaggacagccccguaacuucucuacggaacuggguugauggcguguuucacgacccgauucugcgacauucaacacucaaucaggccugggcaaccgccaaaggggcucugcuugauccuggaccacugggccgcaguuugggugcgggggccaacguccucacugcaccccuggcuagagccuucccucccgccgugccacaggacgcuccugcagccggcgcggcuagggaguuacuggcccuacccaaggcaggaggcaagccauuuugcgccuga

SEQ ID NO: 57820 - RNA, 1449 nt, Artificial Sequence
  derived and/or modified sequence opt3 from IRX5__Homo_sapiens__NP_001239126
augagcuacccccagggcuaucuguaccaaccuuccgccucucucgcucuuuauucaugcccagcauacaguaccagcgugaucuccgggccgagaacagacgagcugggaaggucuucgucagguagcgccuucagucccuaugcgggcuccacugcuuuuacggccccuucuccaggguacaacagccacuugcaguauggagcagaucccgccgcugcagccgcugccgcguucuccucauacgucggcaguccuuacgaccauaccccagguauggcagggagcuuaggauaucaccccuacgccgcuccucugggcucuuauccauacggcgauccggccuaucggaagaaugcaacacgcgacgcuacugccacccuaaaagcguggcucaacgaacaucgaaagaaucccuacccuacaaaaggggagaagauuaugcuggccauaaucaccaaaaugacucuuacacagguuuccaccugguuugcaaacgcucguagaaggcugaagaaggaaaauaaaaugacguggacuccacggaaccgcucagaggaugaagaggaggaagagaauauugacuuggaaaagaacgaugaggacgagccccagaaaccugaagauaagggagacccagagggucccgaagccggcgcugagcaaaaagccgcaagcgggugugaaagacuccagggaccgccuacccccgccggcaaggagacagaggguagucugucugauuccgacuucaaggaaccaccuagcgaggggaggcuggaugcucuccagggacccccacggacuggcggccccucgccugcggggccagcagccgcucgcuuagccgaagacccggcaccccacuauccugccggagcuccagcccccgguccucauccagcagcgggcgaggugcccccggggccuggaggcccaucuguaauccacucacccccucccccaccucccccagcugugcuggccaaaccgaagcugugguccuuggcagaaauugccaccaguagcgacaaagucaaggauggugggggcggaaaugagggcuccccuugucccccaugccccgggccuaucgcuggacaggcccuggguggcucucgagcaagcccagcucccgccccuucaagaaguccguccgcgcaaugcccauuucccgggggaacagugcuaagcaggccucucuacuacaccgccccauucuaucccggcuacacgaacuaugguucuuuugggcaccuucauggccacccuggaccgggccccgggccaacuacaggaccugguucacauuucaauggccuuaaccagaccguucugaaucgggcugacgcauuggccaaagaucccaagaugcuccguagucagagccagcuggacuuauguaaagauuccccauacgagcugaagaaggggaugucugacauauga

SEQ ID NO: 57821 - RNA, 429 nt, Artificial Sequence
  derived and/or modified sequence opt3 from ISCU__Homo_sapiens__NP_055116
auggugcugaucgacaugagcgucgaucucuccacccagguuguggaccacuacgagaaccccagaaauguaggcucucuugauaagacaaguaaaaacguggggacuggacuggucggugccccugcuugcggcgacgugaugaaguugcaaauucagguugaugaaaaagggaagauaguggacgcaagguucaaaacguuuggauguggcucagccaucgcgagcuccucuuuagcuaccgagugggucaaggguaagacaguggaagaggcccugacuauuaaaaauaccgauaucgcaaaggaacuaugccucccaccgguaaaacugcauuguucgaugcuugccgaggacgcuauuaaggcagcccuggcugauuauaaauugaagcaggagcccaagaaaggggaagccgagaagaaauga

SEQ ID NO: 57822 - RNA, 546 nt, Artificial Sequence
  derived and/or modified sequence opt3 from ISG20__Homo_sapiens__NP_001290163
auggccggcagcagagagguggucgcuauggacugcgaaaugguugggcugggaccccacagggaguccggucucgcacgguguucucuugugaacguacauggcgccgugcuguacgauaaguucauccgcccugaaggggagauuaccgacuaucgaacacgugucucaggagugacuccacagcacaugguuggcgcgacgccguuugcuguggccagauuggaaauauuacaacugcuaaaagguaagcucgucguggggcaugaucugaaacacgacuuccaggcacuuaaggaggauaugaguggauacaccaucuaugacacaagcacugauaggcuguuguggcgggaggccaaacucgaccauugccgcagaguaucccugaggguucugucugaacggcucuuacacaagucgauucaaaauucacugcuuggccacagcaguguggaggaugcucgcgcaaccauggaauuguaccagaucucccagcgaauuagagccaggcggggccugccccgucuagcugucucugacuga

SEQ ID NO: 57823 - RNA, 1050 nt, Artificial Sequence
  derived and/or modified sequence opt3 from ISL1__Homo_sapiens__NP_002193
augggcgacaugggggaucccccuaagaaaaagagacugaucagccucugcgugggaugugguaaccagauucacgaccaauacauacuuagggucuccccagaucuggaguggcaugccgcuugcuugaaaugugcagaaugcaaucaguauuuagacgagucuuguaccugcuucguucgggauggcaagacauacuguaaacgcgacuauauccgacuguacgggauuaagugcgccaaguguucaaucggauuuaguaaaaacgauuucgugaugcgugcgagaagcaagguauaucacauugaaugcuuuagguguguggcuugcucccggcagcuaaucccgggcgacgaguucgcccuccgcgaagauggucuguuuugcagagcagaccaugaugucguggagagggccucucuuggggcuggagacccccugucgccuuugcacccagcacggccccuccagauggccgcugagccuauaucagcccgccaaccagcgcugcgaccccauguucacaaacagccugaaaagacuacgagagugaggaccguccugaaugagaaacagcuccacacauuacggacuuguuacgcagccaacccacguccggaugcucugaugaaggaacagcuuguggagaugaccggcuugagcccccgcguaaucagaguuugguuccaaaauaagaggugcaaagacaagaaacggaguauuaugaugaagcagcugcagcagcaacagccuaacgacaaaacaaauauccagggcaugaccgggacuccaaugguggccgcaucccccgagcgacaugauggaggucuacaagcuaacccugucgaagugcagucuuaucagccacccuggaaggugcucagcgacuuugcccugcaguccgauauugaccaaccggcguuccagcagcuugucaauuuuucagagggcgggccuggaaguaacagcacaggcucugaaguugccuccaugucaagccagcugcccgauaccccaaauaguaugguggcaucuccuaucgaggcuuga

SEQ ID NO: 57824 - RNA, 1395 nt, Artificial Sequence
  derived and/or modified sequence opt3 from ISM1__Homo_sapiens__NP_543016
auggugagacuggccgcugagcuccuucuguuguuaggccugcuacuccugacccuucacaucacaguccugagggggagcggagcagccgacggucccgaugcggcugccggcaacgcaucccaggcccaauugcagaauaaccucaauguugggucugacacuacgucagaaaccaguuucagccuguccaaggaggcuccucgggaacaucuggaucaccaggcagcccaucagccauuuccgcgcccccgauuccgucaagagacaggacacccuucucuccagagagacuuuccaaggucguucuuacuggaucuucccaacuuuccugacuugucaaaagcugauauuaauggccagaacccaaauauacaggugacuaucgaaguaguggacggucccgauagcgaggccgacaaggaucaacauccugagaacaaaccaaguugguccgucccgucucccgacuggcgggcgugguggcagcgcagccugucccuagcaagagccaauucaggggaucaggacuacaaguaugacaguaccagcgaugacucuaacuuccucaauccuccaaggggaugggaucacacagcucccggccaccggaccuuugaaacuaaagaccagccugaguacgauuccacagacggcgaaggggauuggucacuguggagcgugugcaguguuaccuguggaaacgguaaucaaaagcgcacgcgaucuugcggcuaugccuguacugcaaccgaguccagaacaugcgacaggccaaacugucccgggauugaggauacuuuccggaccgcugccacagaagugagccuucuggcgggaucggaggaauuuaaugccaccaaguuguucgaggucgacacggauucuugcgaacguuggauguccuguaaaucagaguuucucaagaaauacaugcauaaggugaugaacgaccugccgaguugcccuuguagcuaucccacugagguagcauacuccacagcugacaucuucgaucgcauuaaaagaaaggacuuuagguggaaggaugccucuggcccaaaagaaaaguuagagaucuauaaaccuaccgcucgguacugcauacgaagcaugcugucacucgaaaguacuacacuugccgcacagcacuguugcuacggugacaacaugcagcugaucacccgcgggaagggagccggcacgcccaauuugauuuccaccgaguucagcgcugaacuacauuauaaaguugaugugcugccauggaucauuugcaagggcgacuggucuagauacaacgaggcgaggcccccuaauaacgggcaaaaauguacagagucaccaagugaugaagacuauaucaagcaguuccaggaggcacgggaauacuga

SEQ ID NO: 57825 - RNA, 879 nt, Artificial Sequence
  derived and/or modified sequence opt3 from ISM2__Homo_sapiens__NP_872315
augagagcccugagggaccgggcuggccuccuucugugcguguuguuacuggcagcccuacucgaggcggcucuggggcuucccgucaagaaaccucgccugcgaggaccacguccggguagcuugaccagacucgccgaaguuuccgcaucucccgauccuaggccacugaaggaggaagaggaagcuccccugcucccucggacacacuuacaggccgagccacaucaacacggcuguuggacugugacggagcccgcagccaugaccccugggaacgcuacaccaccgcgcacucccgaaguaaccccucugagacuugaguugcagaaacugccaggacuagccaauacaacccucucaacucccaacccugacacacaggcgagugcaagcccagaucccaggccgcugcgggaagaggaggaagcccgccuucugccucgaacccauuugcaggcugagcuccaccaacauggcugcuggacggugacugaacccgccgcacugaccccagguaaugcuacaccucccagaacucaggaggucaccccauuacugcucgaacuucagaagcugcccgaguuggugcacgccacacuauccaccccuaacccagacaaucagacgaugucucugaggcggucggggguuccgggacuccccgcggugggcacugccgcacuggcuucaagccguggccuugggccugucgccauggcugcccugccaccccgcccugugccaguaacaugucccccgguuuuggcacucagaaccaggacuccuugggccaguccagugcgguccggaucuagcuggcccgcuaugcugcgaacaugcaugaucaaaauguggaccgcgguccgcuccgguuga

SEQ ID NO: 57826 - RNA, 1356 nt, Artificial Sequence
  derived and/or modified sequence opt3 from ISPD__Homo_sapiens__NP_001094896
auggaggccgggcccccuggcagcgcuagaccagcagaaccgggacccugccuguccggucagaggggcgccgaccacaccgcgucugcuucacuccaaaguguggccgggacagagccuggacggcauccacaggcagucgccgcuguucuucccgcaggcgguuguggggaacgcaugggagugccuacuccaaagcaguucugccccauccuggagcgaccuuugauuagcuacacguuacaggcccuggaacguguauguuggauaaaagauaucguggucgcugugaccggcgagaacauggagguuaugaaguccauuauccaaaaauaucagcacaagagaauuucucuaguggaagccggcgucacaaggcaucggucgaucuuuaaugggcucaaagcgcuggcagaggaccagauaaacucaaagcugagcaagccagaagugguaaucauucacgaugccguucgcccguucguggaggagggaguccuguugaaaguggugacugcugccaaggaacauggugcagcuggcgccaucagaccccucgucaguaccguuguguccccuucugcggacgggugccuggauuacagccuggagagggcccggcaccgcgcauccgaaaugccacaggcuuuucucuucgacguaauuuaugaggccuaccaacaguguucagauuaugacuuagaauuuggaacagagugccugcagcuugcuuugaaauacuguugcaccaaggccaaacugguggagggcagucccgaucuauggaaggucacuuauaagcgagaccucuacgcagccgaaagcaucauaaaagagagaauuucucaggaaaucugugugguuauggauacagaggaagacaauaagcacgugggucaucugcuugaggagguccugaaauccgaauugaaccacgugaagguaaccucagaggcucucgggcaugcgggaaggcaccuucaacagauuaucuuagaucagugcuacaauuucguuugugugaacgucacgacuagcgacuuucaagaaacccagaaacugcucaguaugcuugaggaaucuucccugugcaucuuguauccuguggucgugguuagcgugcacuuccuagacuuuaagcugguaccacccucgcagaaaauggagaaucucaugcagauucgggaguucgcaaaggaagucaaggagcguaacauacugcuuuacggccuguugaucucuuauccgcaagaugaccagaaacuccaggaaucccugcgccagggcgccauuaucauagcuucauuaauuaaggagagaaauagugggcugaucggacaacuacucaucgccuga

SEQ ID NO: 57827 - RNA, 1101 nt, Artificial Sequence
  derived and/or modified sequence opt3 from IST1__Homo_sapiens__NP_001257904
augcugggcagcggguucaaggccgagagacucagggugaaccuucggcuggucaucaaucgcuugaaauuacuggaaaagaaaaagaccgagcuagcucagaaagcacgaaaggaaauugccgacuaccucgcggcuggaaaggaugagcgugccagaauaaggguugaacacaucauucgggaggacuaucugguggaggcaauggaaauccuugagcuguacugcgauuugcuccuggcccgcuuuggucugauucaauccaugaaagaacucgacucuggcuuagcugagucaguaaguacacugaucugggcagcccccagacuucagagcgagguggcugaauugaagauagucgccgaucagcugugugcgaaauauuccaaggaguacgggaaacuaugcaggacuaaccagaucggaacggugaaugaccggcucaugcauaagcugucuguugaagcaccuccaaagauucuuguggagcgcuaucugaucgaaauugccaaaaacuacaaugucccguaugagcccgauucggugguaauggcugaggccccuccaggcguugaaaccgacuugaucgauguggguuucacagacgaugucaagaaagggggacccggccgaggcgggucaggagguuuuacugcaccugugggcgggccagacggaaccgugcccaugccuaugccaaugccgaugcccaugccuagcgcuaacacaccauucaguuacccccucccuaagggcccauccgauuuuaauggucugcccauggggaccuaccaagccuucccgaacauacacccuccccagauuccagcgacuccucccucuuaugagagcgucgacgacaucaaugccgauaaaaacauuuccucagcacagaucguuggaccaggccccaagccugaagcuagugccaaauuaccaagcagaccggcugacaauuacgauaacuuugugcugcccgagcucccuucuguaccagacacacuucccaccgccuccgcaggcgccucaacgagcgcuagugaagauaucgacuucgaugaccugucuaggcgguuugaggaguugaagaagaaaacuuga

SEQ ID NO: 57828 - RNA, 738 nt, Artificial Sequence
  derived and/or modified sequence opt3 from ISX__Homo_sapiens__NP_001290437
augugcgccgaggugggccccgcucuguguagagggauggaaaggaacagccucggaugcugugaggcaccuaagaaacuuucccugucuuucucaaucgaagccauuuugaagcggccagcgcgccgaagugacauggaucguccggagggucccggcgaagaggggccuggagaggcugccgcaagcggcuccgguuuagaaaaaccacccaaggaccagccucaagaggggagaaaaucuaagaggcggguccgcaccacauuuacuacggaacagcugcacgagcuagagaagauauuccauuuuacccacuacccagauguucauaucagaucgcagcucgccgcuaggauuaaucugcccgaagcacgggugcagaucugguuccaaaaccagcgcgccaaauggcgaaagcaggagaaaauuggaaaucuuggcgcuccucagcaacugucagaagccagcguagcguugccaacaaaccucgacguggcaggcccgacuuggaccaguacagcccugagaaggcuggcucccccuaccuccugcuguccaucugcccaggaucagcucgcaagcgcuugguuucccgccuggaucacuuuacugccugcgcacccaugggagacacagcccgucccggggcuuccuauacaucaaaccugcauccccguguuguguauucugccaccuccccacccaaaguggggauccaucugcgccacgucaacuuga

SEQ ID NO: 57829 - RNA, 1515 nt, Artificial Sequence
  derived and/or modified sequence opt3 from ISYNA1__Homo_sapiens__NP_001164409
auggaggccgcugcacaguucuuuguggaaagccccgacgucguuuacggcccugaggccaucgaagcgcaauaugaguacagaaccacaagggugucccgggaagggggaguacugaaggaggcuaacuauuacgguucucucacucaggccggcacggugucacuugggcuggaugcagagggacaggaagucuucgugccauuuagugccguuuugccgaugguggcucccaaugacuuagucuucgauggcugggacauuagcucccugaaccuagcagaggccaugcgccgagcuaaagugcucgauuggggucugcaggaacaacuuuggccucacauggaggcccugcguccaagacccucuguauauauaccugaguuuaucgcggcaaaucagucggccagggcugacaacuugauuccagggucacgggcccagcagcucgaacaaauccgcagagauauuagggacuuccggagcagugcaggacuggauaagguuaucgugcuguggaccgcuaauacagagcgcuuuugcgaagucauacccggccucaacgacacugccgagaauuuacugcgaaccaucgaacuuggcuuggagguguccccuucuacacuguucgcgguggccagcauucuagaggggugugcauuucucaacggauccccacagaauacccuggucccgggugcucuugaacuggccuggcagcauagaguuuucgugggcggggaugacuuuaaaucaggacagacuaagguaaaaaguguguuggucgauuuccucaucggcagcggucugaagacaaugucuauuguguccuacaaccacuuagggaauaacgacggagagaaucugucagcuccccuccaauuuaggagcaaggaaguuaguaaaucuaacguggucgacgauauggugcaguccaauccuguacuuuauaccccaggcgaggaacccgaccauugcguugugaucaaguacgucccuuacgugggcgauagcaaacgggcccuggacgaguauacgucggaguugaugcuagggggaacuaacacccugguccuccacaacacaugugaagauucucugcuugcagccccaauaaugcuggacuuggcucuccugacugaguuaugccagcguguguccuucuguaccgauauggaccccgaaccgcaaacauuccauccuguucugucacuacucaguuuucuguucaaggcgccccuugugccaccugguagccccguagucaaugcauuguuucgccagagauccugcauugagaacauccugagggccugugugggccucccaccccagaaucacaugcugcuugaacacaaaauggagcggccugggccaucucugaagcgaguuggaccgguggcugccaccuaccccauguugaacaagaaaggcccugucccagcagccacgaaugguugcacuggggaugcuaacggccaucuccaggaggaacccccuaugccaacaaccuga

SEQ ID NO: 57830 - RNA, 2712 nt, Artificial Sequence
  derived and/or modified sequence opt3 from ITCH__Homo_sapiens__NP_001244066
augagcgacuccggcucucagcuggggucaaugggaagucucaccaugaaaagccaacuucagaucacagugauuuccgccaaacugaaggagaacaaaaagaauugguucggucccucuccuuacgucgaaguuacuguggauggccagucgaaaaagacggagaagugcaacaauaccaacucaccaaaauggaagcagccguugacaguaauagugacucccgucagcaaauuacacuuuagaguguggagucaucaaacccugaaguccgacguucuacucgggacagcugcacuggauaucuaugaaacccuuaaaucuaauaacaugaagcuggaggaaguggucgugacuuugcagcucggaggcgacaaggagccuacagagaccauuggugaucugagcaucugucuggacgggcuccaguuagaauccgagguaguuacgaauggagaaacuaccugcucagagaacggcgugagucugugucuuccaagguuggagugcaauagcgccauuucugcgcacuguaaccugugccuacccggccucuccgauucaccuaucagcgcuagucgggucgccggguucacaggagcaucucagaaugacgaugguucccgcagcaaagacgaaacucgagugucgaccaacggcucugaugacccagaggaugccggggcuggagaaaaucguagaguguccggcaacaauucacccagucugagcaacgguggguuuaagccuuccaggccaccgcggcccucucgcccuccacccccuacaccaagaaggcccgcaagcgucaacggaucaccgagugccaccuccgagagcgacgggucuucaacgggcagucuuccucccacuaauacaaacaccaauacuagcgaaggcgcuacauccggacugauaaucccauugaccauuucugguggcucggggccucggccccucaacccaguuacgcaagcgccccugccuccaggaugggagcagcgcguggaccagcauggccgaguauacuauguggaucacgucgagaaaagaaccacaugggacaggccggaacccuuaccuccagguugggagcggcguguggauaauauggggcgcaucuacuauguugaccauuucacuagaaccacaacuuggcagaggcccacccuggaaagcgugcggaacuacgagcaauggcagcuccagcgaucccaacuucagggcgccaugcagcaguuuaaucaacgcuucauuuauggaaaccaggaucuguuugcaacaucacagaguaaggaauuugacccuuugggcccacuacccccggggugggagaaaagaaccgauucuaauggaagggucuacuucgugaaccacaauacucggaucacgcagugggaggacccucgcagccaaggucagcugaacgaaaagccacuccccgagggcugggaaaugagauucacaguagaugggauaccuuacuuuguugaccacaauaggcguaccacuaccuauauugauccccggacaggaaaauccgcccuggacaacggcccacagaucgcuuacgugcgagacuucaaggccaagguccaguauuuuagauucuggugucaacagcuugcaaugccucagcauauuaaaaucaccgugacuaggaagacacuguucgaggauucauuucagcaaaucaugagcuucucuccccaggacuugcgccggagacucugggucauuuuuccaggugaagaggggcuggauuacggcggaguggcuagggagugguucuuuuuacugucccacgaaguucuaaauccgauguauugccucuucgaguacgccggcaaagacaacuauugucugcagauaaacccugcgaguuacaucaaucccgaucaucuuaaguacuuucgcuucauugggcgauuuaucgccauggcauuguuccacggaaaauuuauagacacggguuucagccugccauuuuauaagcggauucucaacaagcccgugggccugaaagaucuugaaucuaucgacccugaguucuacaauucccugaucuggguaaaggagaacaauauugaagagugcgauuuggaaauguauuucucagucgacaaagagauccucggggaaauuaagagucacgaucugaaaccaaacggaggcaauauauuagugaccgaggagaacaaggaagaguacauccguaugguugcugaauggagacugagcagggguguggaggaacaaacucaggccuuuuucgagggguuuaaugagauucuaccccagcaguaucuccaauacuucgacgcuaaggaacuggagguccuuuuguguggcaugcaggaaaucgaucugaacgacuggcagcgccaugccaucuaucggcacuacgcaagaacaucgaaacagauuaugugguuuuggcaauucgugaaggagauagacaaugaaaagaggaugcgacuccugcaguuuguaaccggaacaugccgcuuaccugugggcggguucgccgaucugaugggauccaacggcccgcagaaguuuugcaucgagaaaguugguaaggagaauuggcuuccacggucucauacuuguuucaacagauuggaccugcccccuuacaagagcuaugaacagcucaaagagaagcuacuguuugcuauugaagagaccgagggguucggacaagaauga

SEQ ID NO: 57831 - RNA, 1395 nt, Artificial Sequence
  derived and/or modified sequence opt3 from ITFG1__Homo_sapiens__NP_001291931
auggacgugcugcucaccuaccuucccaagaacuaugccaaaagcgagcugggcgcugucaucuucugggggcagaaucaaacauuggauccuaacaauaugacuauuuuaaacagaacguuucaggacgaaccacugauaauggauuucaauggagaccuaaucccggauauuuuugguaucaccaacgaguccaaucagccccagauucuccugggcgggaaccuuucuuggcacccugcacugacaacuaccucaaagaugaggaucccacauagucacgccuucauagacuugacagaagauuuuaccgcggaccucuuccugacuacacugaaugcuaccacgagcacuuuucaauucgagaucugggaaaaccucgauggaaauuuuuccguuucuaccauuuuagagaaaccccagaacaugauggugguaggccagucggccuucgcagacuuugauggugacgggcauauggaucaucugcuuccuggaugcgaggacaagaauugucagaaaucaacaaucuacuuggugcggagcggcaugaagcaaugggucccagugcugcaggacuucaguaacaagggcacucuauggggguuuguucccuucguggaugaacagcagccuaccgagauuccaaucccgauaacacuccacauuggagacuauaauauggaugguuaccccgacgcccuggucauccuuaaaaacaccuccggcucuaaccaacaggcuuuccuguuggaaaaugugccuugcaacaaugcaagcugugaggaggcccgccgaauguuuaagguauauugggaacucacggaucugaaccagauuaaagacgcuaugguugccacuuucuuugauaucuacgaggacgggaucuuagauauugugguccuguccaagggauauaccaaaaaugacuucgcgauacacacacucaagaacaauuuugaagcagaugccuacuucgugaaggugaucguccuuucaggccugugcaguaacgacuguccacguaaaauuacucccuuugguguuaaucaaccugggccauacaucauguauacaaccguggacgcuaacggauacuugaagaauggcagcgccggccagcuaucucaguccgcacaccuggcucuccagcugcccuauaacguacuugggcugggaagaucagccaauuucuuggaucaucucuacguggguauaccgaggccuagcggcgagaaaaguauucggaagcaagaauggacggcgaucauccccaacucucagcugauugucaucccauauccucacaaugugccccgcuccagccauagaugcuuauguuuucaccuggggaacaacuggcacuucacccuagccggaaaagagucgagguga

SEQ ID NO: 57832 - RNA, 1659 nt, Artificial Sequence
  derived and/or modified sequence opt3 from ITFG3__Homo_sapiens__NP_114428
augcuggaccacaaggaucucgaggccgaaauccauccccuuaaaaacgaggaaagaaagagccaggagaaucugggcaacccuuccaaaaaugaagacaacgugaagucugcuccaccgcaaucaagguugagucggugccgcgcagccgcguucuuuuuaagccuguuccuaugucucuuugucguuuucgugguauccuuugugauucccugcccugaucgaccagcuucucagcguauguggagaauagacuacucggccgcagucaucuaugauuuccuggccguggacgauauuaauggggacaggauccaggauguucuuuuucuguacaaaaacaccaauucaagcaacaauuucagucgguccuguguggacgagggauuuucuagccccugcacauucgcugcagccgucuccggugcuaacggcucaacuuugugggagcgcccuguggcccaggauguagcgcucguugaaugugcagugccacaacccagagggagugaggccccuagcgcuugcauucuggucggaaggccaucuuccuuuaucgccgugaaucuguucacgggcgaaacccucuggaaccacucaagcaguuuuucugguaaugcauccauauuaagcccgcugcuucaggugcccgacgucgauggggacggagcuccugacuugcugguucuaacacaggagcgggaggaagugucgggccaucucuauucuggcuccacugggcaccagaucggacugcgcgguucacuuggcguagauggggagaguggauuccuguugcaugugacccgaacaggcgcccacuacauucucuucccaugugcgagcucccugugcgguuguucugucaagggguuauaugaaaaggugaccggaagcggcggccccuuuaaaucagacccucacugggagaguaugcugaacgccacuacaagaaggaugcucucccauagcucuggggcaguucgguaccuuaugcacgugccaggaaaugcuggugccgauguccuguuggugggcucagaggcuuucguacuacuggacgggcaagaacucacgccccguuggaccccgaaggccgcacauguucugcgcaaaccuaucuuuggaagauauaagcccgauacucuugccguggcugucgagaacggcaccgguacagacaggcagauucuguucuuggaucucgggacuggcgcggugcugugcaguuuagcacugccaagccuaccuggaggcccccucuccgccucucugccaaccgcugaccaccggucggccuuuuucuuuugggggcuucacgaauugggaagcacauccgagaccgaaacgggugaggcacgacauucacuguacauguuccaccccacucucccucgcguccugcuugaacuggccaacgugaguacacauaucguugcuuuugaugccguguuguucgagccaucuagacacgcagcguacauacuccugaccggcccggcugacagcgaggcccccggguuaguauccgucauuaaacauaaggugagggaucugguuccuucaagccgggugguccgccuaggagaaggcgguccagacucugaccaggcaaucagagauagguuuucccgucuccgguaucagagugaggccuga

SEQ ID NO: 57833 - RNA, 3111 nt, Artificial Sequence
  derived and/or modified sequence opt3 from ITGA10__Homo_sapiens__NP_001289969
augaacaucacccacgccuacagccagggccaucaaaagcugaaucucgacacaguguccuauaacaugcuuggggucgauucugacggaugccccacuuacauggauguugugauuguacuggacgguucaaauaguauauauccuuggagcgaggugcagacguucuugagaagguuagucggcaaacuguuuaucgauccagaacagauucagguggggcuaguucaauacggagaguccccggugcacgaauggucucucggcgacuuccggaccaaggaggaagucgugcgcgcugccaaaaaccugucgcgacgugaggguagagagacaaagacugcccaggcgaucaugguagcuuguaccgaaggguuuucacagagccauggaggcaggcccgaggccgcacggcuucugguuguggucacagauggcgaaagucacgacggggaggaguugccugccgcucucaaagcaugcgaagccggacgcgugaccagauaugguauugcugugcugggccauuaccugaggcggcagcgcgauccauccucuuuccuccgagagaucagaacuauagccagcgaccccgaugaaagguuuuucuuuaaugucacagacgaggcggcauuaaccgauaucguugacgcccugggggaccggauuuucggacuugaaggcucccacgcugagaacgagucaaguuuugguuuggaaaugagccaaaucggguucucuacgcaccgucugaaggaugggauucuauuuggcauggugggcgccuaugacuggggaggauccguacucuggcuggaggguggccaucgccuuuucccuccaagaauggcacuggaagaugaguuucccccugcuuugcagaaucacgccgcguaccucggguacucagugagcaguaugcuguuaaggggaggccggcgacuguuccucucuggugccccacgcuucagacauagggggaaggucaucgcauuucagcuuaaaaaggacggcgcugugcggguugcccagucccugcaaggagaacagauaggcagcuauuucgggucggaguuguguccgcuagauacugaccgcgauggaaccacagacgugcugcucgucgcugcccccauguuucuggguccucagaacaaagagacuggcagaguguacguauaucuuguugggcaacagucucuguugacccuccagggaacacugcagccagaacccccucaagaugcaagguucggcuuugccaugggugcuuuaccagaccugaaucaggauggguucgcggacguggcagucggcgcaccccuagaggacggacaccagggcgcucucuaccuguaucacgggacccaguccggagugcguccgcauccugcccaacggauugcagccgcuucaaugccccacgcccuuaguuacuuuggucgaagcgucgauggcagauuggaccuggauggggacgaucucguggacguugcagugggagcgcagggcgcugccauccugcuuuccucuaggccaauuguacaucugacgccuagcuuggaagucacuccccaggcaaucucagugguucagcgcgauugccggagaaggggucaagaggccgugugucucacagcugcccugugcuuccaggucaccagucgcacuccagggcgaugggaccaccaguuuuauaugcgguucacagcauccuuagaugaauggaccgcuggcgcccgugcggccuuugacggaagcggccagagacugucucccaggcgccuacggcucucaguggggaacguaacgugugagcaacugcauuuccacgugcuugauaccagugacuacuugagaccuguugcucugacagucacuuuugcacucgauaauaccacaaagccaggaccggugcugaacgagggcagccccacuuccauccagaaauuagugccuuucucuaaggacugcgguccagacaaugaaugugucaccgaucugguucuucaggugaacauggacauuagggggucgcgaaaggcccccuucgugguacgcggaggccggagaaaagucuuggugagcacaacccucgagaauaggaaggaaaacgcuuacaacacuucccugucacuaauauuuagucguaaucugcaccucgccucucugacgccucaacgcgagagcccaaucaaaguugagugcgcagcgcccuccgcccaugcucggcuuuguucagugggucacccggucuuccagacaggcgccaaggugaccuuuuugcuggaguucgaauuuagcuguucuuccuuacucagucagguuuucgugaaacugacugcaagcucugauucccuugaaagaaacgggacccugcaggacaauacagcucaaaccucagccuauauucaguacgagccucauuugcucuuuaguagcgaaucgacucugcacagguaugagguacacccauacggaacacuacccgucggcccugggcccgaguucaagacgacccugcgagugcagaaccucggaugcuauguggucuccggccugaucauaucugcacuuuugccagccguugcucauggugggaauuacuuucugagcuuaucacaggugauuacuaacaaugcgaguugcaucguacaaaaccucacagaaccucccggaccaccggugcacccugaggaacugcagcauaccaaucggcuuaacggcuccaauacacagugccaggucgugcgcugucaccugggucaacuagccaaaggcacugagguuucuguggggcuccugagauugguccauaacgaguucuuuaggcgggcaaaguucaagagccugaccgugguuuccacguuugaauuaggaaccgaggaaggcucagugcuccagcugacagaggcuagccgauggagugaaucucuucuggaggucguacagacuagacccaucuugauuucccucuggauccugauugggagcgugcuaggaggccugcuucuccuggccuugcugguuuucugcuuauggaaacucgguuucuuugcccacaagaaaauaccagaagaggagaagcgcgaagagaaacuggaacaauga

SEQ ID NO: 57834 - RNA, 3567 nt, Artificial Sequence
  derived and/or modified sequence opt3 from ITGA11__Homo_sapiens__NP_001004439
auggaccugcccagaggccucguggucgccugggcucuuagccuguggccuggguucaccgauacauuuaacauggacacuaggaagccacggguuaucccgggaucccgcacggcauucuuugguuacaccgugcagcagcacgauauuucuggcaauaaaugguugguagugggggcccccuuagagacaaacggauaucagaagacuggcgacgucuacaaaugcccugugauacaugguaauuguaccaagcugaaccuagggcgaguuacacucucaaaugugagugaacguaaagauaacaugagacugggacuuagccuggcgaccaauccaaaggacaacuccuucuuggcuugcucuccccucuggucgcacgaguguggcucaagcuauuacacuacaggcaugugcaguagggucaauuccaacuuucgguucucuaagaccguggccccugcacugcagcgcugucagacguauauggauaucguaauuguucuggacgggagcaauuccaucuacccauggguggaaguccaacauuuucucauuaacaucuuaaagaaguucuauauaggacccggucagauccaggugggcgugguccaguacggggaggauguugugcacgaauuucaucugaaugacuacagaucaguaaaagauguggucgaggccgcuagucacauugagcaaaggggaggcacugaaacccggacagcauucgguaucgaguuugcccgcagcgaagccuuccagaaagggggacgaaaaggcgccaagaaggugaugauuguuaucacugacggcgagucucacgauuccccugaccuugagaaagugauacagcagucagaaagagacaacgucaccagguaugcgguggcaguauugggguacuauaaucggcguggaauuaacccagagacauuucugaacgaaaucaaguacauugccagcgauccggacgauaaacauuucuucaauguuaccgacgaggcugcccuaaaggauaucguggacgcacucggugaucgcaucuuuagucuggaaggcacgaacaaaaaugagacuucuuucgggcuugagaugucccaaacaggauuuagcucgcacgucguggaagacggcguccuguugggugcugugggggccuaugauuggaacggcgcgguucucaaggagaccucugccggaaaagugauuccccugagagaauccuacuuaaaggaguucccugaagaguugaagaaucauggcgcauaucucggguacacuguaacaucagucgugaguagcaggcagggacggguuuacguggcuggugccccacgauuuaaccacaccggcaaagucauacuuuucacgaugcacaauaaccgcucccugaccauccaucaggcuaugagagggcaacagauuggaucuuauuuuggcagcgagaucacaucaguggacauagauggugacgggguaacugacguguugcuaguuggcgcccccauguacuucaaugaaggaagggagcggggcaaggucuauguguacgaacugcgccagaaccucuuuguguauaaugggacccugaaagauagucacuccuaccagaacgcaagauucggaagcucuauugccucagucagggaccuuaaucaagauaguuauaacgacguuguggugggugcuccucuggaggauaaucaugcgggcgcaaucuacaucuuucacggguuccguggaagcauuuugaagacaccaaaacagcggaucacugccuccgaacucgcuaccggccugcaguacuuugguugcucuauucaugggcaguuagaccugaacgaggauggccuaauagaccucgccguaggagcacugggcaacgccgucauccuuuggucgcgacccgugguucaaauuaaugcuagcuugcacuucgagccguccaagaucaacaucuuccacagagauuguaagaggucagggcgcgacgccacaugccuggcagcguuucucuguuucaccccuauuuuucuggcuccccauuuccagacuacgacagugggaauacgguauaaugccaccauggaugaaagaagguacacuccacgcgcacaccuugacgagggcggugaucgauuuaccaaccgggccguccuguugaguucugggcaggaacucugcgagcguaucaauuuccaugugcuggacacagcugacuauguuaaaccugugaccuuuagcguagaguacuccuuagaagaucccgaccacggaccaaugcuggaugacggcuggcccacuacacuaagagucucagugccuuucuggaacgguuguaaugaggaugaacacugcgugccagaccucguccuggaugccaggagcgaccuuccgacggcaauggaguauugccagcgcguuuugcggaagcccgcucaagauuguucugccuacacccuguccuuugacacuacaguguucauuaucgaaaguaccagacagaggguagcgguggaggccacacucgagaaccgaggcgaaaaugcuuauagcacuguccugaacauuucucaguccgcaaauuuacaguuugccucacugauccaaaaagaggauagugacgggagcauagaaugcgugaacgaggaacgccggcuucagaagcagguuuguaaugugucguacccuuucuuuagagcuaaagccaaggucgcauucagguuggauuucgaguuuuccaagucuaucuuccuccaucaccuggagauugaacuagcggccggaagcgacucaaacgagcgugacaguaccaaagaagauaauguggcuccacugcgcuuucaucucaaguacgaggccgacguucuguucacgcgguccucuagccuuucccacuaugaagugaaacccaacucaagccuggagagauacgauggcaucgggccuccauuuaguugcauuuucaggauccaaaaccugggauuauuucccauacauggcaugaugaugaagauuaccaucccgauugcaacacgaucugguaaucggcuccugaaacuucgcgacuuccugacugaugaggcuaacaccuccuguaauaucugggggaacagcacagaauauagaccuacuccagucgaggaagacuugaggcgggcuccccagcucaaucacucgaacucagauguagugucuauaaauugcaacauccgacugguuccuaaucaggagauuaacuuucaccuacugggaaaucucuggcugagaagucuuaaggcauugaaguacaaauccaugaagaucauggugaacgccgcucugcagcgccaauuccauagccccuuuauuuucagggaggaagacccaucucgucagaucgucuucgagauaagcaaacaggaagauuggcaagugccuauuuggaucaucguaggcuccaccuuagguggccuccugcuucuggcgcuacucgugcuggccuuguggaagcugggguuuuuccggucagcaagaaggcgccgagagcccggauuagacccaacgccgaaaguccucgaauga

SEQ ID NO: 57835 - RNA, 3540 nt, Artificial Sequence
  derived and/or modified sequence opt3 from ITGA1__Homo_sapiens__NP_852478
auggcccccagaccuagggcucggccaggcguggcagucgccugcuguuggcugcucaccguugugcuucgcugcugugugagcuucaacguggacgucaagaacuccaugacauuuucugggccgguggaggauauguucggauacacuguucagcaauaugaaaacgaggaagguaaaugggugcugaucggcucacccuuggucgggcagccuaagaaucgaacgggagacguguacaaaugcccaguaggccguggugagaguuuacccuguguuaagcuggaucuaccugugaacaccagcauuccaaaugucacagaagugaaagagaacaugacuuuuggguccacccucgugacaaaucccaacggaggcuuccuggcgugcggcccucuuuaugcuuacagaugugggcaucugcauuauaccacuggaauaugcucugacgucucgccaacauuucagguuguaaauucaaucgccccgguacaggaguguagcacccaauuggauauugugaucguccucgacgguaguaacuccauuuaccccugggauucugugacggcauuccugaaugaccugcucgaaaggauggauaucggcccuaagcagacucagguugggauagugcaguauggagagaacgucacccacgaauuuaauuuaaacaaguacagcuccacagaggaggugcugguagccgcuaaaaagaucguucaacggggcggucgccagacuaugaccgcacuugggauugacacagccagaaaagaggcuuucaccgaagccaggggagcgcggcgcggcgugaagaaagucauggugaucgucacggauggcgaaucacaugacaaucaccgauugaagaaggugauucaggauugcgaggacgaaaacauccagagauuuaguauagcaauucuggggagcuacaacaggggaaaucuaucuacugagaaauucguugaggaaaucaaguccauugccucagagccaacagaaaaacacuuuuucaacgugagcgacgagcucgcucugguaaccaucgucaagacucuuggugaacggaucuuugcccuggaggcaacagcugaucaaagugccgcgucuuucgagauggaaaugucccagaccggcuucagcgcccacuauucgcaggacugggugauguugggggcaguuggagcuuacgauuggaauggcacgguggucaugcaaaaagccucucagauuauaaucccccguaacaccacauuuaauguggaguccacuaagaaaaacgaaccucucgcuucauaucuggguuacaccguaaauagugccacagcaagcuccggggacguguuauauauugccggccagccacgcuacaaccacacuggacagguuaucauauauagaauggaggauggcaauauuaagauccugcaaacccucucuggggaacagaucggaagcuacuucgguucaauucuuacaaccacugacaucgauaaggacaguaacacggauauucuguuggucggcgcucccauguacauggggacagagaaagaggaacagggaaagguguauguguacgcgcuaaaucagaccagguuugaguaucaaaugucccuggaaccgauaaaacagacuuguugcagcucucggcagcauaacucaugcaccacagagaauaagaacgagccuuguggcgcacgauucgguaccgccaucgcugccgucaaagaccucaaucuggauggguuuaacgacauuguuaucggcgcaccccuugaagacgaucacggaggcgccguguacaucuaucaugggaguggaaagacuauucgcaaggaguacgcucagagaauaccaagcgguggcgacgggaaaacacugaaguucuuuggacaauccauccacggcgaaauggauuugaacggugacgggcucacggaugugaccauuggcggacugggcggggccgcauuauucuggucuagggacguagcggucgugaaaguuacuaugaauuuugagccuaacaaggugaauauccagaaaaagaacugccacauggaaggaaaggagacagucuguauuaaugcuaccgugugcuucgauguuaaacugaagucgaaagaggacacaaucuaugaagccgaucuacaguaccgggugacucucgacagccugcgccagauauccagaucauuuuucaguggcacccaagagaggaagguacagcguaacaucacgguccggaaaucugaauguaccaagcauagcuuuuacaugcuugauaagcacgacuuccaggauuccgugcgaauuacauuggacuucaaucugacugaccccgagaacgguccagugcucgaugacucacugcccaauagcguccaugaauauaucccuuuugcaaaagauugcgggaacaaggagaaauguauuucugaccuuucccugcacguugccaccacagagaaggauuugcucaucgugagaagucaaaaugacaaauucaacguaagccugacugugaagaauaccaaagauucugcuuacaacacgaggacaauaguccauuauuccccaaauuuaguguuuucaggaauugaagccauccagaaggacaguugcgagagcaaccacaacauuaccuguaagguuggcuacccguuccugcgccggggugaaauggugacuuuuaaaauccuauuccaguuuaauacaucguaucucauggagaacgucaccauauaccuguccgcaacuucugauagcgaggaacccccugagacccuuucagacaaugugguuaacaucaguauuccagugaaguaugaagucggcuugcaguucuacuccucugcuagcgaguaccacaucuccauugccgcgaaugaaacaguacccgaggugaucaacucaacggaggauauagggaaugaaauuaacaucuuuuaucugaucagaaaaagcggaaguuucccuaugccagagcucaagcugucuauuuccuuucccaauaugaccagcaacggcuacccgguuuuauauccuacugggcugucgucaucugaaaaugccaacugcaggccacauaucuucgaggaccccuuuaguauuaauuccgguaaaaagaugacaaccagcacagaucaccuuaagcgcggcacuauauuggacuguaauaccugcaaauucgcuacgaucacaugcaaucucaccucuagcgacauuucccaagugaacgucucacugauccuauggaagccuacuuucauuaaaaguuacuuuagcucucugaaccucaccauccgaggugaacugcgguccgagaaugcaucacuuguguugaguagcuccaaccagaagcgugagcuggccauacagaucucuaaagauggguuacccggaagaguaccacucugggugauucugcuuucggcuuucgccggccuguugcuccugaugcuacugauccucgcacuguggaagauuggauuuuucaagaggccucuuaaaaagaaaauggaaaaguga

SEQ ID NO: 57836 - RNA, 3120 nt, Artificial Sequence
  derived and/or modified sequence opt3 from ITGA2B__Homo_sapiens__NP_000410
auggccagagcucugugcccccuccaggcacuuuggcuguuggaguggguguuacugcuacucggcccuugugccgcgccaccggcuugggcccugaaccuugaccccguccaacugaccuucuacgcagggccuaauggaagccaguuugguuucuccuuggauuuucacaaggacucucauggcaggguugccaucgugguaggggcuccacggacacucggacccucacaggaagagacuggcgguguguuccugugcccuuggcgcgcagaagggggacaguguccaagucugcucuuugauuuacgagacgagacgcguaacgucggcagccaaacccugcagacauucaaagccagacagggccuuggggcuuccgugguuucuuggucggaugugauugucgccugcgcgcccuggcagcacuggaauguguuggaaaagacugaggaggcagagaaaaccccuguaggaucauguuuucuggcccaaccagaaagcgguaggcgggcugaauauaguccgugccgcggcaacacacuauccagaauauacguugagaaugacuucucuugggauaagagguauugugaggccggguuuagcuccguggucacccaggcaggagaacucgugcugggcgcucccgguggguacuauuuccuuggacuguuggcccaggcgccuguggccgacaucuuuucaaguuaccggccaggcauucuccuguggcaugucagcucucaguccuuaucauucgauagcaguaaccccgaguauuuugacggcuacuggggguacucuguugcagugggagaguucgauggugaccugaauacuacagaauauguagugggcgcuccuaccugguccuggacgcucggggccgucgaaauccuugauagcuacuaucaacgccugcaccgauugagaggagagcagauggcuucguacuucggccauucuguggccguuacugacgugaacggugacgggaggcacgaucuacuggucggcgcaccacucuauauggagucccgggccgaccguaaacuggcugaagugggacgcguauaccuuuuucugcagcccagaggcccgcacgcguugggggcaccuucacuccuguuaaccggaacacaacuguaugguagguucggcagugccauugcuccccuaggggaucucgaccgggauggauacaaugacaucgccguugcagccccauacggcgguccuagcgggcgaggccaggugcuggucuuucuuggacaguccgagggcuugcgcucuagacccagccaggugcuggauucaccauuccccacugggagugcuuuuggauucucccucaggggugccgucgacauagaugacaacggcuauccugaucugaucgugggggcauacggagcgaaucaaguugcuguguaucgggcccagccaguagucaaggcaagcgugcagcuucugguucaggacucuuugaacccggccgugaagucaugcguccucccccaaaccaaaacaccugugaguuguuuuaauauucagaugugcguaggcgcuaccggucauaacaucccacagaagcugagcuuaaaugccgaacugcagcuagaccgccaaaaacccagacaggggaggcgugugcuccugcuuggcucccagcaggcaggaacgacuuugaaccuggaucucggcgggaagcacucuccuauuugucauacaaccauggcuuuccugcgggacgaggccgauuuucgagacaaauuaucgccaaucguucugagccuuaacgucuccuugcccccgacugaagcgggaauggccccugcuguggugcuccacggcgauacacacguccaagagcagaccagaauaguucuggacugcggugaggaugacgugugcgugccacagcuacaacugacggcaucaguaaccgggaguccccuccuggucggagccgauaaugugcuugaauugcagauggacgcugccaacgagggcgaaggugcauacgaggcggaacuggccguucauuuaccucagggcgcucacuauaugagggcccucucuaauguggagggguucgagcgccugauuuguaaccagaagaaggaaaaugagacacgggucgugcuuugcgaacugggaaaccccaugaaaaagaaugcacaaaucggcauugcuauguugguuagcguggggaaccucgaggaggccggagaauccguaucauuucagcugcagaucagaagcaaaaauucucagaacccaaauuccaagaucguccuacuggaugugccugugagggcagaggcccaagucgaacuccgcggcaacaguuuccccgcuagccugguuguggcggccgaggaaggugagcgagagcaaaauucucuugacuccugggggccaaaaguagaacauacuuacgaguugcacaacaauggaccgggcaccgugaacggucugcauuuaucaauucaccucccuggccagagucagcccagcgaucugcuuuauauacuggacauccagccacaagggggacuacaguguuuuccccagccuccagucaacccccucaagguggacuggggccugccuauuccgucgccaucccccauccacccugcacaucacaaacgggaucguagacagauauucuugccagaacccgagcagccuucuaggcugcaggacccgguuuuagugagcugcgauucagcucccuguacagucgugcaaugcgaccuccaggaaauggcccgcgggcagcgggccaugguuacugugcuggcuuuccuuuggcugccaaguuuguaccagagaccucucgaucaauuuguccugcagucccaugcaugguucaauguaucuagccuacccuacgccgugccaccucugucccuucccaggggagaggcgcagguuuggacccagcuccugcgagcuuuggaggaacgcgccauuccaaucuggugggugcuggucggcguguuaggugggcuccugcuucugacaaucuugguacucgcaauguggaaggugggauuuuucaagcggaacagaccgccucuggaggaagacgaugaggaaggcgaguga

SEQ ID NO: 57837 - RNA, 3546 nt, Artificial Sequence
  derived and/or modified sequence opt3 from ITGA2__Homo_sapiens__NP_002194
augggccccgagagaaccggggccgcuccucugccacuccuucugguguuggcauuaagccagggaauccugaacugcugucuagccuacaaugucggucucccggaagcgaagauuuucuccggccccucuucagagcaauuuggguaugcuguucagcaguucauaaacccuaaaggaaauuggcugcuugugggcaguccauggagcgguuuucccgaaaacaggaugggggacguauacaagugcccuguggaucuguccacagccacuugugagaaauugaaucuccagacgucuaccucgaucccaaacgucacagaaaugaagacuaauaugucacugggacugauucucacccggaacaugggcacaggcggguucuuaaccugcggaccccugugggcacaacagugugguaaucaguauuacacuacaggcgugugcagcgacaucaguccugauuuucagcuuuccgccucuuucagcccagcuacccaaccgugucccuccuugauugacguuguggucgugugcgaugagucaaacaguaucuauccuugggacgcaguuaaaaauuuucuggagaaguucguacaggggcuagauauaggaccaacgaagacucaggugggccucauccaguacgccaacaauccccgcgucguguuuaaccugaauaccuauaaaacaaaggaagagaugauuguggcuacuagccaaaccucucaguacgguggggaccuuacaaacaccuucggagccauccaguacgcgcgaaaauaugcauacuccgccgcuucaggcggccguagaagcgccacgaaggucaugguugugguaacugauggggaaagucacgacggaucuaugcugaaagcagugauugaucaauguaaccaugacaauaucuugagguuugguauagcuguccucggcuaucugaaccggaaugccuuagauacaaagaaccugauuaaggagaucaaagcgauugccuccaucccuaccgagcgcuacuucuuuaaugugagcgacgaagcagcucuccuugagaaggccgggacucugggagaacagaucuucucgauugagggcacaguucaggguggggacaacuuccagauggaaaugucucaagugggcuuuuccgcugauuauucaagucagaaugacauauugaugcuaggagccgucggcgcauucggguggagcggaaccaucgugcagaaaacgucccacggucaucugauuuuuccaaagcaggccuucgaucaaauccuccaggacagaaaccacucuagcuaccugggcuauucaguagcugcgauaaguaccggggaguccacacauuuuguugcaggagcccccagggcuaauuacacuggccagauugugcuuuacagcgucaacgagaaugguaacaucaccgugauccaggcccaccggggagaucaaauuggcucuuauuucggaucaguccugugcaguguggacguugauaaagacacaaucacugauguguugcucguaggcgcaccgauguacaugagcgaccugaagaaagaagaggggcgcgucuauuuauuuaccauuaaggaaggaauacugggucagcaccaguuccuagagggcccugaagggaucgagaauacacgauuuggauccgccauugcugcccucucugauaucaacauggacggcuucaaugacgugaucguugguucgccccuggagaaccagaacagcggggcaguguacauuuauaauggccaucaaggaaccauaagaacuaaguacucccagaaaauccuuggcucagauggggcguuuaggagucacuugcaguauuucggacggucucuggacggcuacggugaucucaacggggacagcauuacggaugucuccaucggagcuuuuggccaagugguacagcuguggucacagagcauugccgacguggcaaucgaagccucuuucacaccagagaagauaacccuuguuaauaaaaacgcucagaucauucugaaguuguguuucuccgccaaauuucguccuacuaagcaaaauaaccaggucgcaaucguguacaauauuacccucgaugcugacgguuucaguagccgcgugacaucuagaggccuguuuaaggaaaacaaugagaggugcuuacagaaaaacauggucguuaaucaggcccaauccugccccgaacauaucauauauauucaggagccaucagauguggugaacagucuggaccuacggguagauaucagccucgagaaucccgggaccucgccugcgcuggaagccuacuccgagacugcuaaggucuucucuauuccauuucacaaagacuguggagaagauggccuuugcaucagcgacuuggugcuggacguucgacagauaccggcagcccaggagcaacccuucaucgugucaaaccagaauaagcgccucacauuuagugucacgcugaaaaacaagagagaguccgcuuauaacaccgggauugugguugauuucucugaaaauuuauuuuucgccagcuuuucccugccuguggacggaacugagguaacaugucaggucgcagcgucacaaaagagcguggccugcgaugugggcuacccagcucuuaaaagggaacagcaggucaccuucacaaucaacuuugacuucaauuugcagaaccuccaaaaucaggccagucugucuuuccaggcacuauccgagagccaggaagagaacaaggcugauaaucugguuaaccucaaaauuccccugcuuuaugacgccgagauccacuugacucggucgaccaauauaaacuuuuacgaaauuucaucugaugguaaugugccuaguaucguacauuccuucgaggacguggggccaaaguuuaucuucagccugaaagucacgaccggaucugugcccguuagcauggcaacagugauuauccacauuccgcaauauacuaaggaaaagaacccuuuaauguaccucaccggcguccagacagauaaagccggugacauauccuguaaugcugauaucaacccacugaagauuggccagacuucaaguagcgugucuuuuaaauccgagaauuuccgccauaccaaggaacuuaacugcagaacggcgucauguaguaacguuacaugcuggcugaaagacgugcacaugaagggggaguacuuugucaauguaaccacuaggaucuggaacggaacauucgccagcuccaccuuucagacugugcaauugaccgcagcugccgagauuaauacauauaaccccgaaaucuacguuauagaggauaauacggugaccaucccucucaugauuaugaaacccgacgaaaaggccgaggucccaacuggcgugaucauugggucuaucauagcugggauucugcuacugcucgcacugguagccauccuuuggaaguugggcuucuuuaaacguaaguaugagaaaaugacaaagaacccugacgaaaucgaugagaccacagaacugucgagcuga

SEQ ID NO: 57838 - RNA, 3156 nt, Artificial Sequence
  derived and/or modified sequence opt3 from ITGA3__Homo_sapiens__NP_002195
augggccccgggccuagcagagccccaagggcuccgcggcugaugcucugcgcacuugcccugaugguggcggcuggagguugugucguuuccgccuucaacuuggacacccgcuuuuuagugguaaaggaggcaggcaaucccgggucucuguucggauacucaguggcccuacaccgacagacagaacgucaacagagauaucuccugcuugcuggcgcaccuagggagcuggccgucccagaugguuacacuaaccggacgggggcuguguauuugugcccccucaccgcccauaaagacgauugugaacgcaugaauaucacaguuaagaacgacccuggacaccauauuauagaggauauguggcugggcgugacugucgcgagucagggcccagcagggagagugcugguaugcgcccacagguacacccagguucucuggagcggauccgaagaccaacggcgcaugguggguaaauguuauguccgaggcaaugauuuagagcuggacucuucggaugacuggcagacauaccauaacgagaugugcaauucaaacaccgauuaucuugaaacugggaugugucaguugggaacaagcggcgguuuuacccagaauacgguguacuucggggcucccggagccuacaacuggaagggcaauaguuauaugauccaaagaaaagagugggaccuguccgaauacucuuauaaggauccugaggaccagggcaaccuauacauuggguauacuaugcaaguggguagcuuuauccuccacccaaagaauauuaccaucgucacaggugcaccgaggcaccggcauaugggcgcuguuuuccugcuuucccaggaggccgggggagaccugcgucgcagacagguguuggaaggcucacagguaggugcguacuuugggagugccauagcacucgcugaucugaacaaugacggcuggcaggauuuacuggugggagcccccuauuacuucgagaggaaagaagaggucggcggggcuaucuacguguuuaugaaccaagccggaacuagcuucccugcacacccaucucuccuucugcauggucccuccggcucagccuuuggguugagcguugcuaguauuggagacaucaaccaggauggcuuccaggacauugcggugggugcaccuuuugaagggcuaggcaaggucuauaucuaccacucuuccagcaaaggacugcuccggcagccacaacaggugauacacggcgagaagcuggggcuucccggacuggccaccuucgguuauucguugucuggccagauggauguagacgagaauuucuacccggaucuccugguuggguccuuaucagaccauauugugcugcuacgagcucgcccugucaucaacauugugcacaaaacacucguccccagaccagccgugcuggauccugcacuuugcaccgccacgaguuguguucagguggaauugugcuuugcuuauaaucaaagcgccggaaaccccaauuacaggcggaacaucacucuggcauauacacucgaggcggaccgcgacagaaggccaccccgucugcgguucgcuggcuccgaaucugccguauuucaugguuucuuuagcaugccugagaugcgaugucagaagcuagaacuguugcucauggauaaucugagagacaaguuaaggccaaucauuauaucaaugaacuacagucugccgcuacgcaugcccgaucggccuagacucgggcugaggucccuugacgcauacccaaucuugaaucaggcccaggcucuggagaaccacaccgagguccaauuccagaaagaaugcggccccgauaauaagugcgagagcaaccuccagaugcgcgccgcauuugugucugaacagcaacagaaacugucacgauuacaguauagucgggacguucguaagcugcuuuugagcauuaaugugacuaacacaagaaccuccgagaggucuggagaagaugcucaugaggcccuccugacgcuagucgugccuccagcgcugcuccugucgagcguacggcccccgggcgccugucaagcuaaugagaccaucuucugcgaacuugggaacccuuuuaaacgcaaccagagaauggaguugcugauagcauucgaagugauuggaguuacauuacacacuagggaccuccagguccagcugcaacuuuccaccucaagucaccaggauaaucuguggccaaugaucuugacacuccugguggacuacacucuacagaccucucugagcauggugaaccaucgacuccaguccuuuuucggcgguacagucaugggggagucaggaaugaagaccguugaggaugugggcagcccccugaaauaugaauuucaaguggguccuaugggcgaggggcuuguaggauugggcacucuggucuuagggcucgaauggcccuacgaggugucuaauggaaaguggcugcuuuauccaacggaaaucacaguucacggcaacgguuccuggccuugucggcccccaggggaccugauuaauccgcuaaaccucacccugagugauccuggagaccgccccagcucuccacagagaaggcgucgccaguuggaccccggcgguggccaggggccuccacccgugacucuggccgcugccaagaaagcaaaguccgagaccgucuuaacaugcgcgaccggacgggcccauuguguguggcucgagugcccuaucccggaugcuccaguugugacuaauguaacagucaaagccagaguguggaacucaacguucauugaagacuacagggauuucgaccgagugcgggucaauggcugggcaacccuguuucuucgcacaaguauacccacuaucaacauggagaauaagaccacaugguucagcguugauauugacucggaacugguggaggaauugccugcugagaucgagcucuggcugguacuuguggccgucggggcaggacugcuucuccugggcuugaucauucuguuacucuggaaauguggauuuuucaagagagccaggacucgggcucuguaugaagcgaagcgacaaaaagccgagaugaagucccagccaucugaaaccgagagacuuacggaugacuacuga

SEQ ID NO: 57839 - RNA, 3099 nt, Artificial Sequence
  derived and/or modified sequence opt3 from ITGA4__Homo_sapiens__NP_000876
auggccugggaggcuagaagggaacccggcccucggcgcgcagccgugcgagagaccgucaugcugcuccuuugccuggggguuccaacaggacguccguacaacguggacacugaaagcgcguuguuauaucaggguccccacaauacgcuguucggcuacuccguagugcuacauucucacggggcuaacagauggcuccuggucggagccccuaccgcaaauuggcuugccaacgcuucagugaucaauccaggcgcaauuuauaggugucggauagguaagaaccccgggcaaacaugcgagcagcugcaguugggaaguccuaauggcgaaccauguggcaaaacuugccucgaggagcgcgauaaccaguggcuggggguuacccugagcagacaacccggagaaaaugguuccaucgugacauguggccauagguggaagaacaucuuuuacauuaaaaaugagaacaagcucccuaccgggggaugcuauggcgucccaccggacuuacggacugaacugucuaaacgcauugcccccuguuaccaggauuaugugaagaaguucggugagaauuuugcuucgugccaggccgggaucagcucauucuacacaaaagaccuuauaguaaugggagcgccuggcaguuccuacuggaccggcucuuuguuuguuuauaacaucacgacuaauaaguacaaagcauuccuggauaagcagaaccaagugaaauuugggagcuaucuaggauacuccgucggugccggccacuuccgaucacagcauaccacagaggugguggguggagcuccacagcacgaacagauuggcaaggccuauaucuuuaguauugacgagaaggaacucaacauccugcacgagaugaaagguaagaaacuugggagcuacuucggcgcaucugucugugcuguugaucugaaugccgacggauuuuccgauuugcucgugggcgcgcccaugcaaucaacuauaagagaagaggggaggguauucguguauauuaacagcggaaguggugccgucaugaaugcaauggagaccaaccuggugggcucugacaaguacgcugcccgguuuggggaauccaucguuaauuuaggagauauugacaacgauggcuucgaggacguggcuaucggugccccucaggaagacgaucugcagggggcaaucuacauuuauaauggccgugccgacggaauaagcucgacauucucucaacgcaucgagggccuccagauuuccaaaucacuuaguauguuugggcagagcaucuccggacagauagaugcugacaacaaugguuacgucgauguggcgguaggcgcauucagaucugacagcgccguucuguugaggacccggccaguggucauuguggaugcuucacuaagucaucccgaauccgucaaccgaacgaaguuugacugcguggagaauggguggccgagcguuuguaucgaucugacucucugcuucucuuauaaaggaaaggaggugccuggcuacaucguacuguuuuauaacaugucacuugacgucaaucgcaaggccgaaagucccccaagauucuacuuuagcuccaacgguacaucugaugugauuaccgggucgauccaaguuagcuccagggaggcaaauugccggacucaccaggccuucaugcgcaaagacgugagagacauucugacaccuauacagaucgaagcugccuaucauuugggcccccacgucauuucaaagaggaguaccgaggaauuuccaccccuccagccuauccugcaacagaaaaaggagaaagauaucaugaagaagacgauuaacuucgcacguuuuugugcgcacgagaacugcucugcugacuuacaggugagcgccaaaauaggauuccugaagccacaugaaaauaaaaccuaccuagcaguaggcuccaugaagacacucaugcugaacgugucacuuuuuaaugccggggaugacgcuuacgagacuaccuugcacguuaaacugccggucggacucuauuucaucaagauucuggaacuugaggagaagcagaucaacugugaagugacagauaauagcggcgugguccaacuggacugcucuauugguuacaucuauguugaucauuugucccggauagacaucaguuuccuccuggaugugagcucuuuaucccgagccgaggaagaccugucaauuacugugcacgcaaccugugagaacgaagaggagauggauaaucuaaaacauaguagaguaacagucgcuaucccccucaaguacgaagugaaacugaccguucacggguuugugaacccuacuagcuucgucuauggaucgaaugacgagaacgaaccagagacgugcaugguggaaaagaugaaucuuacauuucacguuauuaacaccggcaauuccauggcccccaacgugucuguagagaucauggucccuaauagcuucucaccacagacugauaaauuguuuaacauacuggacgugcagaccacaaccggugagugucauuucgaaaacuaccagagggugugcgcgcucgagcaacagaagagugccaugcagacucugaagggcauuguccgcuuuuuauccaaaacagacaagcggcugcuuuauuguaucaaagcugauccccacugcuugaauuuccucuguaacuuugggaagauggaaucuggaaaagaggcaagcguucauauucaacuggaaggcagaccguccauccuagagauggacgagacgucagcccugaaguucgaaauaagggcuaccggguuuccugagccaaauccccgcgugaucgaacucaacaaagaugagaauguagcccacgugcugcuugagggauugcaccaucagcgaccuaagcgguacuucacuauugucaucauuagcaguucucuguuacucggccugaucgugcuucuguugauauccuacguuauguggaaggcaggguuuuucaaacgucaguauaagagcauucuccaggaagagaacagaagggacucguggucauacaucaauucuaaaaguaacgaugacuga

SEQ ID NO: 57840 - RNA, 3150 nt, Artificial Sequence
  derived and/or modified sequence opt3 from ITGA5__Homo_sapiens__NP_002196
augggcagcagaacccccgaguccccucugcacgccgugcagcucaggugggggccacggcgccgaccgccccuucugccuuuguuacugcuacuccugccacccccuccacgugucggagguuucaaccuugacgcugaagcacccgccguucugucuggcccuccagggucauuuuucggauuuaguguggaguucuacagaccgggcacagaugguguaagcguguuggucggggcgcccaaggcuaauacuucccaaccuggagugcuccagggcggcgccguuuaucugugcccauggggagcaucucccacgcaguguaccccuaucgaauuugacucgaaagggucaaggcugcucgagagcaguuuauccucuagcgaaggugaggagccaguggaauacaagucccugcagugguucggcgccacaguccgggcucaugggucaaguauucuugcaugcgcccccuuguauagcuggcgcacugagaaagaaccgcugucugauccugugggaaccuguuaccuauccacagacaacuuuaccagaauacucgaguaugcucccugcaggucagauuucagcugggccgcgggccaagguuacugucaagggggauuuagugcagaguucacuaagacaggccggguaguucugggcgggccaggaucuuauuuuuggcagggucagauccuuuccgccacccaggaacagauugcugagagcuacuacccugaauaucugaucaauuuggugcagggccagcuccaaacgcgccaggccucgucuauuuacgacgauuccuaucugggguacucagucgcagugggagaguucaguggcgacgauacugaagacuuuguggcugguguccccaaagggaacuuaaccuauggcuacguuacaauccugaauggaagcgauauacgaucccucuauaacuucucuggcgagcagauggccagcuacuucggguacgcgguggccgcaacugacguaaauggagauggucuugacgaccuguuggugggcgcuccacuacugauggauagaacccccgacgggaggccucaagaggucggacggguguauguuuaccuccagcacccagccggcaucgaaccgacacccacccugacgcuuacuggucaugaugaguuugggcguuucggcucaagucugacaccuuugggagaccucgaucaggacggcuauaacgauguggcuauuggggccccauuuggaggugaaacccagcaaggcgucguguucguauuucccgggggaccuggcggucugggguccaagccaagccagguuuuacagccccugugggcagccucucacacuccggacuucuuuggcucagcucuacgcggaggcagagaucucgacgggaauggauacccugaucugaucgugggcaguuucggugucgacaaggcgguggucuauagggggcggccaauugugagcgcauccgccucucuuacaaucuuucccgcuauguucaacccugaggaacgaucgugcagcuuggagggaaaucccguugccuguauaaaccuguccuuuugccucaaugcaucaggcaaacauguggccgacaguauugguuucaccguagagcugcagcuugauuggcaaaagcagaaaggcgggguccgcagagcucuguuuuuggccucuaggcaggcaacgcucacccagacacuguuaauccaaaacggagcgcgggaagacugucgcgagaugaagauuuaccugagaaaugaaagcgaguucagggauaaacuauccccaauccacaucgcucucaacuucucacuggacccucaggcccccguggauagccacggccuucguccagcauugcauuaucagucuaagucccggauugaagacaaggcccagauacugcucgauugcggggaggacaacaucuguguuccggaucugcaauuagagguguuuggagaacagaaucacgucuaccugggcgacaaaaacgcucuuaauuugacuuuccaugcccagaacgugggugaagggggagcauacgaggcugagcuccgaguaaccgccccucccgaggcggaauauaguggccuggugagacacccagguaauuuuagcucucuauccugcgauuacuucgccguuaaccaaucaaggcugcucgucugcgaccugggcaaucccaugaaggcuggggcaagucuuuggggaggcuugcgcuuuacagugccucaucugcgggauacuaaaaagaccauucaguucgacuuucagaucuuaagcaaaaaccucaauaacucgcaguccgacguggucucuuucagacugagcguugaggcccaagcucaggugacacuuaauggggugucaaagccagaagccguacuguuucccgucagugauuggcacccuagggaccagccgcagaaagaggaagauuugggaccagcagugcaccauguuuaugagcucauaaaccaaggccccuccucuauuagccagggugugcuggagcuauccuguccucaggcgcuggaagggcagcaacuccuguacgucacccgcgugacuggacuuaauugcacgacaaaccacccaaucaaucccaagggcuuggagcuggacccugaagguucauuacaucaccagcagaagcgagaggccccgagccggaguucugcuuccagcggcccccaaauccucaaauguccagaagccgagugcuuccgucugagaugugagcuugggccucugcaccagcaggaaucgcagucacuacaacuccauuuuaggguuugggcaaagaccuuccugcagcgcgagcaccagcccuuuucuuugcagugcgaagcuguguauaaagcccugaagaugccauaccggauuuuaccuagacaacucccccagaaagagaggcagguagcaacugccguccaguggaccaaggcugaaggaaguuauggcgugccacuguggaucauuauacuugcgauccuguucggguugcuccugcuaggacugcuuauuuacauccucuacaagcugggcuucuuuaaacgauccuugccguaugguacagccauggagaaggcacaacugaaaccucccgcuaccagcgaugccuga

SEQ ID NO: 57841 - RNA, 3222 nt, Artificial Sequence
  derived and/or modified sequence opt3 from ITGA6__Homo_sapiens__NP_000201
auggccgcugcaggccagcugugccuccuuuaccugagcgccggguuguuauccagacugggagcggcuuucaaccuagacaccagggaggauaaugugauccggaaguauggugaccccggcucucucuuuggguucucacuggccaugcacuggcaacuucagccugaagauaaacgccuguugcucgucggagcaccacgagccgaggcucugccgcugcagcgugcaaacagaacaggcggucucuacaguugugacauuacugccagggggcccugcacgcggauagaauuugauaaugacgcugauccuaccagcgaguccaaggaagaccaguggaugggaguuacagugcaaucucagggcccaggcgggaaaguagugacuugugcccaucgcuaugagaagagacagcacgucaacaccaaacaggagucgagggauaucuucggacggugcuacguguuaucacaaaaucugcgcauugaagacgauauggacgguggcgauuggagcuuuugugacgggcgacuuagaggacaugagaaguucggcaguugccagcaggguguugcggcaacauuuaccaaggacuuccacuauaucguguuuggggcccccggaacuuacaacuggaaaggcauugucaggguggaacagaagaauaacacauucuuugauaugaauaucuucgaggacggcccuuaugagguagggggagaaaccgagcaugaugaauccuugguuccagugcccgcuaacucuuaccuggguuuuagccuagacuccggcaaagggauagucucaaaggaugagaucacguucgugaguggagccccucgggcaaaucacagcggcgcugugguccuccugaaacgugacaugaagucugcccaccuucugccagaacauauuuucgauggugagggguuggcguccucauuuggcuacgacguugccgugguagaucucaacaaggacggauggcaagauaucgugauuggcgcaccgcaguauuucgaccgcgacggggaggucggaggugcuguguacguuuauaugaaucagcaaggcagauggaacaaugugaaacccaucaggcugaacgggacuaaggauagcauguuuggaauagccgucaaaaacauuggcgacaucaaucaggaugguuacccugacauugcugugggggccccauaugaugacuuaggcaagguauucaucuaccacggaagugcaaacggcaucaauaccaaacccacacagguucugaaggggauuucuccuuauuuuggauacuccauagccgguaacauggaucucgaccggaauagcuacccagauguggcugucggcucgcuuucugacuccgugacuaucuuccgaucacgccccgucauuaacauccagaaaaccauaacagugaccccgaauagaauugaucugaggcaaaagacggcguguggggcaccuaguggaaucugcuugcagguuaagagcuguuuugaauauacugccaaccccgcuggcuacaauccauccaucucuauuguggguacacuagaggccgaaaaagagcggcgcaagagcgggcugucaaguagaguacaguucaggaaccagggcuccgaaccuaaauauacccaagagcucacucugaagcgucagaaacagaaggucugcauggaggaaacacuuuggcugcaggacaauauccgggauaaguugcgacccauuccaauaaccgcaagcguggagauccaagaacccucuucaagaaggcgcguuaacagucucccugaggugcugccaauuuuaaauagcgacgaaccgaaaacggcccauaucgacguccacuuucugaaggagggauguggcgaugacaacgugugcaauuccaaccuaaaacucgaguacaaguucugcacccgggaagggaaccaggauaaauuuucuuaucugcccauccagaagggaguaccugagcuuguguugaaggaccagaaagauauugcucuggaaauaacaguuacuaauucgccaagcaaccccagaaauccuaccaaggacggcgaugacgcccacgaggcaaaacucaucgcgacauucccagauacucugaccuacuccgcuuauagggagcuucgcgccuuucccgaaaagcaacugucaugugucgcaaaccagaaugguagucaggccgacugcgaguuggggaacccguucaaacgaaauucuaacgugacauucuaccucgugcugagcaccacugaagucacguuugauacaccugacuuagauauuaaucugaagcuagagaccacuuccaaccaagacaaucucgcuccaaucaccgccaaggcaaaaguugugauugaacugcuuuugucagugagcggaguagcuaagcccucucaggucuacuucggcgguacagugguuggcgagcaggccaugaaauccgaggacgaaguggggagucugaucgaguaugaauuucgggucauaaaccucggaaagccucugaccaauuuaggcacugcgacacugaacauccaguggcccaaagagauuagcaaugggaaguggcuuuuguaccucgugaaaguugaaucuaagggacuggagaaggugacgugugagccacaaaaagaaaucaacucccuaaaccugaccgagucacauaauagucguaagaaaagagaaauuacugagaagcagaucgaugacaacaggaaauucagccucuuugccgaacgcaaguaucagacacugaauugcucgguaaacgucaauugugugaacauacggugcccucuuagaggcuuggauuccaaggcuucucugauuuuaaggagccgacucuggaacucaaccuuccuggaggaguacaguaaacuuaauuaucuggacaucuugaugcgcgcauuuauugaugugacagccgcugccgaaaauauccggcuccccaacgcagguacucaggucagaguuaccguguucccauccaagacgguagcgcaauacucuggggugccgugguggauaauccuggucgccauucuagcuggaauccugaugcucgcccugcuuguguuuauuuuguggaaauguggcuucuuuaagaggaauaaaaaggaccacuaugaugcaaccuaccauaaggcugagauccacgcccagccuagcgacaaagaacgucugacauccgaugcauga

SEQ ID NO: 57842 - RNA, 3426 nt, Artificial Sequence
  derived and/or modified sequence opt3 from ITGA7__Homo_sapiens__NP_001138468
auggccggcgcuagaagcagggaccccuggggagcauccgggaucugcuaccuguucgguucucuccuuguggagcuguuguuuucacgggccgucgcguucaacuuagauguuaugggcgcucugcgcaaggaaggggagccuggaagucuauuuggcuucagcguggcccuccaccgacagcugcaaccacguccgcaguccuggcuucugguaggugcaccccaggccuuggcucucccugggcagcaagcaaauagaaccggaggccuguuugccuguccacugucucucgaagagacagacugcuauaggguggauauugaccagggcgcugauaugcagaaagaaucgaaggagaaccagugguuaggggucucagugcggagccaaggacccgguggcaaaauaguuacuugugcccaucgcuacgaggcgagacagaggguggaccagauccuggaaacgcgggauaugauugggcgcugcuucguccuuagucaggacuuggcaauccgagaugagcuggacggaggcgaauggaaguuuugugaggguagaccucaagggcacgagcaguucggauuuugccagcaaggcaccgccgcugccuucuccccagauucucauuaucuacucuuuggcgcacccgggacauacaauuggaaaggaacugcuaggguggaacugugugcccaggguagcgcggaccuugcccaccuggaugacggcccuuaugaggcagggggagaaaaggagcaggacccacgguugauuccgguacccgcuaacuccuacuucggcuuuucaaucgauagugguaaggggcucguucgugccgaggagcugagcuucguggcuggcgccccucgcgcaaaucauaaaggagccgucgugauauuaagaaaggacucugcuuccaggcuggugccagaggucaugcucucaggcgaacggcuuaccagcggguucggauauagucuggcgguugcagauuugaacucugacgguuggcccgaucuaaucgugggcgccccuuacuuuuucgagcgacaggaggaacucgggggagcuguauacguguaucugaaucaaggcggucacugggccgggauuuccccacugcgccuuugcggcagccccgacucgauguuuggaaucucucuggcagucuugggcgaucucaaccaggacggguucccggauauugccgugggagcuccuuuugacggugauggcaaaguuuucaucuaccacggguccucacugggaguggucgccaagcccagucagguguuagaaggcgaggcaguagguauaaagagcuuuggguauucccugucuggcagccuagacauggacggaaaucaguacccagaucuccugguuggcucacuugcggacacagcuguguuguucagagccaggccuauucugcaugucagucacgagguguccaucgcaccccggagcauugaucucgaacaaccaaacugugccgggggacauucugucugcguggaccugcgcguuuguuuuucauauaucgcugugcccaguagcuacuccccuaccguagcccuugauuauguccuggacgcagauacugacagaagguugcguggccaggugccacggguuacauuccucucucgaaaucuggaggaaccgaaacaccaggcuucggguaccgugugguuaaagcaccagcaugauagagucugcggggacgccauguuucaacugcaggagaacgugaaagauaagcuaagggcgaucguagugacgcucagcuacucccugcagacuccccgccuucggagacaggccccuggacaaggcuugccacccguugcuccuauucugaaugcacaccagccaucaacccagagggccgaaauacauuuccucaaacaagguugcggcgaggacaagaucugucagaguaaccugcaguuaguccgcgcucgauuuugcacacgggugucugauacugaguuccagccccugccgauggacguggacgggaccacagcccuuuucgcauugagcggacaaccugucauuggccucgaacugaugguuaccaaucuaccauccgaucccgcgcagccucaggccgacggggaugacgcucacgaggcccagcugcucgugaugcugcccgauucacuucauuacagcggagugcgugcauuggacccagcugaaaaaccucuguguuuaucuaacgagaacgccucccacguagagugcgaacucggcaaucccaugaagagaggugcacaagucacguuuuaucugauccuuaguacuagcgggauaucuauugagacaaccgaacuggagguggaauugcuccuggccacuaucuccgagcaggagcuacacccaguuucagcuagggcgcgcguguucaucgaacugccgcucaguauugccggaauggcaaucccucagcagcuguuuuucagcggcgucgugcggggugagagagcuaugcaaucggaaagggauguuggcuccaaagugaaguacgagguaacagucucuaaccaggggcagagccuucgaaccuugggaucagccuuucugaauauuauguggccccaugaaauagccaacggcaagugguuacucuauccaaugcaaguggagcuggaagggggacagggccccggucagaaagggcuuuguaguccucgcccaaauauccugcaccuagacguggauucccgggacagaaggcgucgcgaacucgagcccccugaacagcaagagccgggagaacggcaggagccaucuaugagcugguggcccgucuccucagcugagaagaaaaagaacauuacgcuggauugcgcaagaggcaccgccaauuguguuguguucagcugcccuuuguacaguuuugacagggcggcuguacugcauguguggggucgauuauggaacucuacauuccucgaagaguauuccgccgucaaaagccuggaagugaucguucgggcaaauaucacugugaagucgucaauuaagaaccuuaugcugcgcgaugccucuaccgucauaccagugaugguuuacuuggaccccauggcuguggucgcagagggcguaccuuggugggugauccuccuggccguucuagcggggcugcuugugcucgcucuguugguccuguuacucuggaaaaugggauuuuucaagagagccaaacacccggaggcaacagugccccaguaucacgccguaaagauuccaagggaagaccggcagcaauuuaaagaggaaaagacuggcaccauccugcgaaauaacugggggaguccuagacgcgagggacccgaugcucauccaauucuugccgcagacggccacccugaacugggucccgaugggcauccaggaccgggcacagcuuga

SEQ ID NO: 57843 - RNA, 3147 nt, Artificial Sequence
  derived and/or modified sequence opt3 from ITGA8__Homo_sapiens__NP_001278423
augagccccggcgccuccagagggccuaggggaucucaggcuccacugaucgcaccgcucugcugugccgcggcugcccuugguaugcuguuguggucacccgcaugccaagccuucaacuuagacguggagaagcugaccgucuacaguggcccuaaagggagcuauuuuggauacgcuguugauuuccacauuccagacgcacggacagccuccgugcuaguaggcgcucccaaggccaauacuucucagccugauauaguggaagguggggcggucuauuacuguccauggcccgcagagggaucggcccagugccgccagaucccuuuugacacgaccaacaaucgaaaaauucgugugaacggcacaaaggaaccaaucgaguucaaaucaaaucaaugguuuggcgcuacuguuaaggcccauaaggggaaaguggucgcaugugcuccgcucuaucacuggagaacccugaagcccacaccugaaaaagauccagugggaaccugcuacguagccauucagaacuucagcgcguaugccgaguuuagucccuguaggaacuccaaugcagacccugagggucagggcuacugccaggcuggguucucucuugauuuuuacaagaauggagaccugaucguuggcgguccagggagcuucuauuggcaaggacaggugauaacugccuccgucgcugauaucauugccaacuacucauuuaaagacaucuugcggaagcucgcaggcgaaaagcagacagagguggcccccgcuaguuaugaugacagcuaccuggaacugguggcgggcauuccgcgcggggcacagaauuucggauaugucucuaucauaaacuccaccgauaugacguuuauucaaaauuucacuggugagcagauggccucauacuucggcuauaccguugugguaagcgacgugaacagugacgggcucgaugacgucuuagugggagcuccucuguuuauggagagagaguucgagucuaaucccagggaaguuggccagaucuaccuuuacuugcaaguguccagccugcuauuucgggauccacagauucucacagguacugagaccuucgggcgcuuuggcucggccauggcacaucugggagaccuuaaccaggauggcuauaacgacaucgccaucggggucccuuucgcuggaaaagaucagcgagguaaggugcugauuuacaauggcaacaaagacggguugaauacaaagcccucucaaguacuccagggaguuugggccucccacgcagugccaucaggcuuugguuucacccugagaggggauagugacauagauaaaaacgacuaucccgacuuaaucgucggcgcguuuggaacgggcaagguggcugucuacagggcccggccugugguuacuguggaugcacagcugcuccuucauccaaugauuaucaaucuggaaaacaaaacaugucagguaccggacagcaugaccuccgccgcuugcuucucuuugcgugucugugccagcgugacugggcaaucaauagcaaauacaauuguucuaauggcugaggugcagcuggauagucucaagcagaagggagccaucaaacgcacccuguuucuugacaaccaccaggcgcacagagucuucccccuggugaucaagaggcaaaaaucccaucagugccaggauuuuauuguauauuugcgggacgagacggaguuccgagauaagcucagcccuaucaauauuucucugaacuacucauuagacgaaaguaccuucaaagaaggucuggaggugaagccaauacuaaauuauuaccgcgaaaacaucguuagcgagcaggcccacauucucgucgauugcggcgaggacaaucugugugugcccgaucuuaaguuguccgcuagaccugacaaacaucaagugaucaucggggaugaaaaccaccugaugcucauuauaaaugcaaggaacgagggagaaggcgccuacgaggcugaacuguuugucaugaucccagaggaggccgacuauguugguauugaacggaacaauaagggguuccgcccccuuucuugcgaguacaaaauggaaaacgugacaagaauggugguaugugaccugggcaauccgauggucucgggaacuaacuauagcuugggccucagguuugcagugccucgucuggagaagaccaauauguccaucaacuucgauuuacagauucggucaaguaauaaagacaacccagauucuaauuuuguuagccugcagaucaacauaacagcgguggcccaagucgagauccgaggggugucccaucccccucagauuguucuacccauccacaauugggaaccagaggaagaaccucacaaggaagaggaggugggaccccucguagaacauauuuacgagcugcacaacaucggcccaucaacuauaagcgacaccauucuugaagucgguuggccguucucugcuagagaugaguuuuugcuguauaucuuccauauucagacacucgggccucugcagugccaacccaauccaaacaucaauccccaggacauaaagccugccgcauccccagaagauacccccgaguuaagugcuuuucugaggaacagcacuaucccucaccuugugcgcaaacgggacgugcacgucguugaguuccauagacagucuccggccaagauuuugaacuguacgaauaucgaaugccuccagauuuccugugcagugggaaggcuggagggcggugaaucagccguacuaaaagugcgcagucgacugugggcucacacauuucuccaacggaagaacgauccauacgcgcuggccagccuugucucguucgaggugaaaaagaugcccuauaccgaccagccugcaaaguugccagaaggcuccaucguuauaaaaacuucugugauuugggcuacccccaaugucagcuuuucaaucccucugugggugaucauuuuagccauccuccuggggcuucugguuuuggccauucucacacuggcucuauggaagugcggauucuucgaucgugcaagaccgccccaggaggacaugaccgauagggagcagcugacuaacgacaaaacaccagaagccuga

SEQ ID NO: 57844 - RNA, 3108 nt, Artificial Sequence
  derived and/or modified sequence opt3 from ITGA9__Homo_sapiens__NP_002198
augggcgggcccgccgcuccuagaggagcagguaggcugcgggcccuccuucuggcguugguggucgcuggcaucccagccggggcauacaacuuagacccgcagcgccccguucacuuccaaggaccugccgauagcuuuuucggcuaugcugugcuggagcauuuucacgacaauacccgaugggugcuaguaggugcaccaaaggccgauuccaaauacucucccucagucaagaguccuggggcuguguucaaaugccguguucauacaaacccagacagaagguguacugaacucgauauggcccggggaaagaaucgcggcacgagcugcggcaaaaccuguagagaggacagggaugacgaauggaugggggugucccuggcgcggcagcccaaggcagauggacgcguccuugccugcgcucaccgauggaagaacauuuauuacgaggccgaccauauacugccucacgguuuuuguuauaucauuccaucuaauuugcaggcaaaaggcagaacacucaucccgugcuacgaagaguauaagaaaaaguacggggaggaacacggaucgugucaggcuggcauugccgguuucuuuacugaggaacuggugguaaugggggcgcccggaucauucuacugggccggcaccaucaaaguucugaaccucacagauaauaccuauuuaaagcugaacgacgaggugauaaugaauaggcgguacacuuaucuuggcuacgcagucacagcugggcauuuuagccacccuaguaccaucgauguggugggaggugccccacaagacaagggcauugggaaagucuauaucuuccgugcugaccgcagauccggaacguugauuaagaucuuucaggccucuggcaaaaagauggguagcuacuucggguccucacugugcgcaguugaucuaaacggcgacggacucagugaucugcuugugggcgcccccauguuuagcgagauaagggacgaagggcagguaacuguguauauuaaucggggaaacggugcucuggaggaacaguuggcgcucaccggcgauggggcauacaaugcccauuucggagagucuaucgcuucccuggacgauuuagacaacgauggcuucccugacgucgccauuggugcaccaaaagaagaugacuuugccggggcuguguacaucuaucacggcgacgccggaggcaucguuccccaauacucaaugaagcugagcgggcagaaaauuaauccggugcuccgaauguucggacagaguauaucugguggcaucgauauggacgggaacggauauccugaugucacagugggcgcauuuauguccgacagcguaguucuucugcgcgcgagacccgugauuacugucgaugugucgaucuucuugccagguucuauaaacauuaccgcuccucagugucacgacgggcaacagcccgucaauugccuaaacgugacaaccuguuuuuccuuccauggcaagcacguuccaggagagaucggccugaauuacgugcucauggccgauguagcaaagaaagagaaggggcagaugcccagggucuauuuugugcugcuuggagaaacgaugggccaaguuacugagaaacugcaguugacauacauggaagagaccugccggcauuauguggcccacgucaagcgcagagugcaggacguaaucucaccuauuguguucgaagcugccuacagucucagcgagcauguuacuggugaggaagagagggaacugccaccguuaacacccguccugcguuggaaaaaggggcagaagaucgcacagaaaaaccaaaccguguuugagcggaauugccgauccgaagauugugcugccgaccuacagcuccagggaaagcugcuuuugucuagcauggaugagaaaacgcuguaccucgcgcugggcgccgugaagaacauuucacuuaauauaaguaucuccaaccugggugacgaugcuuaugacgcaaaugucagcuucaacguuucuagagaguuguuuuucauuaauauguggcaaaaagaagagaugggcaucucaugcgaacuccuggagagugacuuuuuaaaguguagcgugggguucccuuucaugagguccaagucuaaauacgaguuuucggugaucuucgauaccagccaccuguccggagaagaggaaguacuaucauuuauugucacagcccagaguggcaacacugagcgcucugaaagccuccacgacaauacccuggugcuuaugguuccauugaugcaugagguggauacauccauaacugggaucaugucacccaccagcuucgucuauggagagucuguggacgcugccaacuuuauucagcuggaugaccucgaaugccacuuccagccuaucaauauuacacugcaaguuuacaacaccggcccauccacuuuacccgguaguagcgugucuaucuccuuuccgaaccggcugucaagugggggagcagagauguuccauguacaggaaauggucgugggccaggagaaggguaauuguagcuuucagaaaaacccuacgccaugcauaaucccccaagaacaggagaauauuuuccacacaaucuuugcguucuuuaccaagucgggcagaaaagugcuugauugugagaagccugggauuuccugcuugacugcccacuguaacuucucugcucucgccaaggaagagagcaggaccaucgacauauauaugcugcuaaauacagaaauucugaaaaaggauucaaguuccgucauccaguucaugucucgcgcaaaaguuaagguggaccccgcucuccgaguaguggagauugcccauggaaacccagaagaggucaccgugguuuuugaggcacugcacaaucuugaaccucggggcuacguggucggguggaucauagccaucagcuugcuggugggaauuuuaaucuuccuccugcuugcuguucuguuguggaaaaugggcuuuuuccguagaagguauaaggagauuaucgaagcggagaaaaaccgcaaggagaaugaagauuccugggacugggugcaaaagaaccaguga

SEQ ID NO: 57845 - RNA, 3486 nt, Artificial Sequence
  derived and/or modified sequence opt3 from ITGAD__Homo_sapiens__NP_005344
augaccuucggcacagugcugcuccuuagcguccuggccuccuaccacggguuuaacuuggacguugaggaacccacuaucuuccaggaggaugcuggagguuuuggccaaucugugguacaguucgggggaucaagauuaguggucggcgcaccucuggaagugguugccgcgaaucagacggguaggcuauaugacugcgcugccgcaaccgggaugugucagccaauuccgcuccauauacggcccgaggccgugaacaugagucugggacuuacacuggcugcaagcacuaauggcucccgcuugcucgccugcggcccuacccugcaccgagucuguggggaaaacucuuacucgaagggaucaugccugcucuuagguagccguugggagaucauucaaacagugccagaugcuacccccgaguguccucaucaggaaauggacaucguauuucugauugauggcaguggguccaucgaccagaaugauuucaaccagaugaaaggauuuguucaagccgugaugggccaguucgaggguacugacacacuuuuugcguugaugcaguauucuaaucugcuaaagauacacuucaccuuuacgcaguucagaacuagcccaucccaacagucacucgucgaucccaucgugcagcugaaagggcuuaccuuuacagcaacugguauucugaccguggucacacaauuguuccaucacaagaacggcgccaggaaaagugcuaagaagauccucauuguuaucaccgacggccagaaauacaaggauccucuggaauauagcgacgugauaccacaggccgagaaagcagggauuauccgguacgcuauuggaguaggucacgccuuccagggcccgacggcgcgccaagaguuaaauacuaucucuuccgcacccccucaggaucauguguuuaaggucgacaacuucgccgcucuggggucaauccagaaacagcuccaagaaaagauuuaugccguggagggaacacagagcagagcuaguucuuccuuucagcacgaaaugagccaggagggcuucucgaccgcccuuacuauggacggucuguuuuugggggcaguuggcucuuucuccuggucaggaggcgccuuucuauacccacccaauaugaguccuacauucauaaacaugagccaagaaaauguggauaugagggacuccuaccugggguauucuaccgagcucgcucuguggaagggaguccagaaccuugugcugggugcgccacgguaccagcauacgggcaaagcaguaaucuuuacccagguuagccgccaauggcgaaagaaagccgaggugacagggacucagauuggaucauauuucggcgcuaguuugugcuccgucgauguggacagcgaugguucuaccgaccucauccugauaggggcaccccacuacuaugaacagacaagaggcggacaagucucaguguguccguuaccuaggggccggguucaguggcagugcgaugccgugcugcguggggagcagggacaccccuggggucgcuuuggcgccgcucuaacuguacucggggacgucaaugaagauaagcugauugacguggccaucggagcaccaggcgagcaagaaaacagaggugcgguuuaccuuuuccauggggcuagugagagcggcaucuccccuucucacucgcagaggauugccagcucccaguugucaccccggcugcaguauuuuggacaagcacucaguggcgggcaggaucugacccaggacggacuuauggaccuggccgugggcgcucgaggucaggucuugcuccugcgcucuuuaccagugcugaaaguagggguggccaugagauucagccccguugaggucgcaaaggcuguguacagguguugggaagagaaaccuuccgcccuagaagcgggagaugccacagugugccucaccauccaaaagucaagccuggaccagcuuggcgauauucagucuuccguccgguucgacuuggcucuggauccaggucgccucacgaguagagcaauauuuaacgagacuaagaauccgacacugaccaggcguaaaacuuuaggccuggggauccauugugaaacccuuaaguugcuccugcccgacugcguugaggauguggugagcccuauuauccuacaccugaacuucucucucguacgggagccaauccccuccccucaaaaucugcgaccaguccuugccgugggaucacaggacuuguuuacagcuagucugcccuucgagaaaaacugcggccaggauggguuaugugaaggagaccucggcguuacccugagcuuuucgggucuucagacucugacagugggguccucuuuggaacucaaugucauugugacgguuuggaacgccggagaggauagcuacggcaccgugguaucacuguauuacccggcaggucuaagucauagaagggucuccggcgcgcaaaagcagccucaccagucugcccugcgccucgcuugcgagacugugccaacagaagacgaggggcugcggagcuccagauguucagugaaucaccccauauuccaugaaggaagcaacggcaccuuuaucgucacauucgauguuaguuauaaagccacucuuggggacaggauguugaugcgcgcaucugcuuccagcgagaauaacaaggccucgucaucuaaggcaaccuuucagcuggaauuaccugugaaauacgccguauauacgaugauuagucgacaagaggaguccaccaaguacuucaauuuugcuacaagcgacgagaaaaagaugaaagaagcggaacaccgguaucgugugaacaaucucucucagagagaucuggccaucagcauuaacuucuggguccccgugcuucugaauggaguugcagugugggacgucgugauggaggcuccaucccagucacuaccuugcguuagugaaaggaagcccccacagcauagcgauuuucucacucaaaucucucgcuccccgaugcuggacuguucaauagccgauugcuugcaguuccggugugacgugccuaguuucagcguccaggaggagcuggauuuuaccuuaaagggcaaccucuccuucgguuggguaagagaaacacugcagaaaaaggugcuuguugugucugucgccgagaucacuuuugacaccucgguguacagccaacugcccgggcaggaggcuuucaugagggcacagauggaaaugguauuggaagaggaugagguguacaacgccauuccaaucauuaugggaucauccgucggcgcgcuccugcuacuggcucuuaucacggccacacucuauaaacugggauuuuucaagcgacacuacaaagaaauguuggaggacaagcccgaagauaccgcaacuuuuaguggcgacgauuucucuugcguugccccuaaugugccacugagcuga

SEQ ID NO: 57846 - RNA, 3540 nt, Artificial Sequence
  derived and/or modified sequence opt3 from ITGAE__Homo_sapiens__NP_002199
auguggcuguuccacacccuccuuugcaucgccagccuggcuuuguuagcagccuuuaacguggacgucgcgagacccuggcugacaccuaagggcggggcuccauucguucuauccucucuccugcaucaggauccgucaacuaaucaaacguggcuucuggugaccagucccaggacaaaacggacuccuggaccauugcaccgcuguagccucguacaggacgagauucugugccaucccguggaacacgucccuauaccaaagggucgacaucguggcgugaccguugugagaucccaccacgggguccugaucuguauucaggugcucguaaggcggccccauucuuuaucgucagagcugacaggaaccugcagccuuuugggcccugaucugcgcccacaggcccaagcaaacuuuuucgaccuagaaaaucuccuggauccggacgccagaguugauacuggugacuguuacaguaacaaagaagggggaggcgaagaugacgugaauacagcuaggcagcggcgcgcacuugagaaggaggaagaggaagauaaagaggaggaagaggacgaagaggaagaggaggccggcaccgaaaucgcuauuauccuggauggguccggaucuauagaucccccugacuuucagcgagccaaggacuucaucagcaacaugaugagaaauuuuuaugagaagugcuucgaauguaacuuugcguugguccaguacgguggcgugauucaaacggaguucgaccucagggauucccaggacgugauggcaucacuggcccggguccagaauaucacucagguugggagugugaccaaaacagcuagcgccaugcaacacguauuagauucuauuuuuacuuccucacauggaagccgucgcaaggcaaguaaagugauggucgugcugaccgacggcgguaucuucgaagauccacucaaccuuacaaccguuauaaauucucccaagaugcaggggguggagagauuugcuauuggagucggcgaggaguucaaauccgccaggacggcgcgggagcugaacuugaucgccagcgacccugaugaaacucacgcauucaaggugacaaauuauauggcucuagacggccugcucucgaagcugcgauacaacauuaucucuauggaggggaccguaggagaugcccuucacuaucagcuggcucaaaucgguuuuuccgcccagauuuuggacgaacgccagguucuccugggcgcagugggggccuucgacuggucaggaggcgcuuuacuguacgauacuagaaguaggcggggucgcuuucuaaaucagacagcggcagccgcugccgacgcagaggccgcucaauauagcuaccucggguacgccgucgcagugcugcauaaaaccugcucccuuucuuauauagcgggcgcuccaagauacaagcaccauggagccgucuucgaguugcagaaagaaggcagggaggcgagcuuucugcccgugcucgaaggggagcagaugggaucauauuucgguagugagcuguguccgguugauaucgacauggauggcuccacggacuuucuucugguggccgcuccuuucuaccacguacauggggaagagggacgugucuauguguaccgguugagcgaacaggauggcucuuuuucacucgcccgaauccugaguggucaccccggguucaccaacgcaagauuuggcuucgcuauggccgcgaugggagacuuaagccaagauaagcugacagacguugccauuggcgcuccacuagagggguuuggagcagaugacggugccuccuucggcucuguguauauauacaacgggcacugggauggacucucggcuagcccuucccagaggauucgcgccucaacugucgcacccggccugcaguacuucgguaugaguauggcagggggcuuugacaucucuggagacggccuugccgauaucaccguggggacauugggacaggcuguaguguuccggagcagaccaguugucaggcugaaaguguccauggccuuuacucccucagcacucccuauuggcuucaaugguguggucaacguucgccugugcuuugaaaucagcucugugaccacagcuuccgagaguggguuacgagaggcccugcuuaauuucaccuuggacguggauguaggaaagcaacggcguagacuccaguguagcgacgucaggucuugccugggcugccuacgcgaaugguccucagguagucagcugugugaggaucuccugcuuaugccaacugaaggcgaguugugcgaagaggacuguuuuagcaacgcaucggugaaaguuuccuaucagcugcaaacgccggaggggcagacagaucauccccagccuauuuuagaccgguacaccgaaccauucgccauauuucaacuccccuaugagaaggcuugcaagaauaaacuguucuguguggcggaacuucagcuggccacuaccgucucucagcaggaguuggugguuggacucacaaaggaacugacccuaaacaucaaucugacuaacagcggcgaggauucauacaugacaaguauggcacucaauuauccuagaaaccugcaacuuaaaaggaugcagaagccacccuccccgaauauucagugcgacgauccucagccaguggcuucuguauugaucaugaacugucgaaucgggcaccccguccugaaacgcagcuccgcccaugugucaguggucuggcaauuagaggaaaaugccuuuccuaaccggacggcugacauuaccguuacugugacaaauagcaacgagagaaggagucucgcaaacgaaacccacacacugcaguuccgucacggauuuguagccgugcuuucuaagcccuccauaauguacgucaauacuggccagggucugagccaucacaaggaguuccuauuccaugugcacggggagaaccucuuuggagcggaauaucagcugcaaaucugcguuccaaccaaauugcgcggcuuacagguggucgcugugaagaaacugacgcggacccaggccucgacaguuuguacuuggucacaagagagagcaugcgccuacucuagugugcagcaugucgaagaguggcacuccguaagcugugugauugcuucugauaaggaaaauguuaccguggcagccgagaucagcugggaccacuccgaggaacuccugaaagacgucacagagcuucagauucugggugaaaucucauucaacaagaguuuguacgagggccucaaugcggaaaaccauaggacuaagauaaccgugguauuucugaaagaugagaaguaucacagccuaccuaucauuaucaaagggucugugggaggccugcuuguccucauuguuauccuggugauauuguucaagugcggguuuuucaaacgaaaguaccagcaacugaauuuagaguccauucggaaggcucagcucaaaucagaaaaccugcuugaggaagagaauuga

SEQ ID NO: 57847 - RNA, 3261 nt, Artificial Sequence
  derived and/or modified sequence opt3 from ITGAL__Homo_sapiens__NP_001107852
augaaggacagcugcaucaccgugauggccauggcucugcucuccggcuucuuuuucuuugcacccgccucuucauacaaccuugaugucagaggggcgaggaguuucagcccuccacgggcuggacgccacuuugguuaucgaguucuucaggugggcaaugggguaauugugggagccccgggcgaggguaacuccacagggucuuuguaccaaugucagucgggaacuggccauugcuuacccgucacgcugcguggcucaaauuauaccagcaaauaccuagggaugacacucgcaacugacccuaccgauggaaguauacuguucgccgcugugcaguuuuccacaucuuauaagaccgaguucgacuuuagcgauuacguuaaaagaaaggacccagaugcacuucugaaacacgugaagcauauguugcuccugacuaacacauucggugccaucaauuaugucgcuaccgagguguuuagggaagaacugggcgcccggcccgacgcgacgaagguacucauuaucauuacugauggggaagcaaccgacuccggaaacaucgaugccgcuaaagacauaauccgcuacauuaucggcauugguaagcacuuccagacaaaagagucacaagagacuuuacauaaguuugccaguaaaccugcaagcgaguucguuaagauccuggauaccuucgaaaagcugaaagacuuguuuacagaacugcagaagaaaauauacgugauugaggggaccucuaagcaggaccuaacguccuucaauauggagcucucaagcaguggaaucucugcugaucuguccagaggccacgccgucgugggcgcggugggggccaaagacugggcaggagguuuucuugaucugaaggcugacuugcaggaugacacuuucauuggcaacgaaccacucacacccgaggucagggccggguaucugggauacaccguuacuugguuaccuagccggcagaaaacaucgcugcucgcuucuggcgccccacgcuaucagcacaugggucgagugcuucuguuucaggaaccgcaagggggcggacauuggucccaaguacagaccauccacggcacgcagaucgggucauacuucggaggugaguuguguggcguggaugucgaccaagauggggaaaccgagcuacugcucauuggagcaccccuguuuuauggcgagcagagaggugggaggguguucauauaccagcggcgucagcuuggcuuugaagagguuagugaacugcaaggagacccuggcuauccauuggggcgcuucggagaggccaucacagcucucacugauauuaauggugacggccugguggacgucgcggugggggcacccuuagaggaacagggagccguauacaucuuuaacggcagacauggugggcugagcccucagccaucccagaggauagagggcacccaaguucuaucugggauucagugguucggccggagcauccacggggugaaggaucucgaaggagacggccuggcugaugucgccgugggugcagagucacagaugaucguccuuaguucccgacccgugguugacauggugacauugaugagcuuuucuccggccgaaauuccuguacacgaggucgaaugcucauacaguacuagcaauaagaugaaagagggggugaacaucaccauuuguuuccagauaaagucccugaucccccaauuccagggacgccucguugcuaaucugacauauacccuucagcuggauggccauagaacuaggcggcgcgguuuguuuccaggcgggagacacgagcucaggcguaacauugccgugacgacaucuaugucgugcaccgacuucagcuuucauuucccugucugugugcaggaucugaucucccccaucaauguaucauuaaacuuuagucugugggaagaggaaggaacuccacgggaccaacgagcaggcaaagauauucccccuauacuaagaccaucucuccacagcgagaccugggagaucccguucgaaaagaacugcggggaggacaaaaagugugaagcgaaucugaggguguccuuuucacccgcucgcagccgggcccuuagauugacagcauucgccucucuguccguugagcucagucugagcaacuuagaagaggaugcuuacuggguccagcuggaccuucauuuuccuccaggauugucuuucaggaagguggagaugcucaaaccccacucccagauuccugugucaugcgaggaacugccagaagagagucgccuacugagccgagcccucucguguaaugucuccucucccaucuuuaaggcaggccacagcguugcucugcaaaugauguucaacacccuuguaaauucaaguuggggugauuccguggaauugcaugccaacgugacuugcaauaacgaggacucugaccuguuagaggauaauagcgcgacaacgauuaucccgauacucuauccuaucaacauucugauccaggaccaggaagauuccacccuuuacgucucauuuacuccaaaagggcccaagauucaccaggugaaacauauguaucaaguucggauccagccuagcauacacgaccacaauauucccacacuggaggccguggucggagugccacagccucccagugaaggcccaaucacccaucaguggucuguucaaauggagccgccugugcccugccacuacgaagauuuggagcgucucccagacgcugcagagcccugucugccuggugcccuauucagaugcccaguagucuucaggcaggaaauucugguccaggugaucggcacacucgagcuggugggggaaauagaggcuuccagcauguuuucgcuuuguucaucuuugaguaucuccuucaacagcucuaagcauuuucaccuguauggaagcaaugccuccuuagcacagguugugaugaagguagauguggucuacgagaaacaaaugcucuaccuguaugugcuuucaggcauugggggacugcuacuccuguugcugaucuucauuguuuuauacaaggugggcuuuuucaaacgcaaccucaaggagaaaauggaagcgggucggggaguccccaauggaaucccugccgaagacagugagcagcuggcuagcggccaggaagccggugauccgggcugccuuaagccacugcaugagaaggacucugaguccgggggaggcaaagauuga

SEQ ID NO: 57848 - RNA, 3459 nt, Artificial Sequence
  derived and/or modified sequence opt3 from ITGAM__Homo_sapiens__NP_000623
auggcccugagagugcuccuucugaccgcuuugacauuaugccacggcuucaaccuggacacugagaaugcaaugacguuucaggaaaacgccaggggguucggacaaagcgucguucagcuacaggguucccgggugguagugggcgcgccccaggagaucgucgcugccaaucaacgcgggucucucuaccagugugauuauucaaccggaaguugcgaaccuauucgacugcaagugccaguugaggcagugaacaugagccuuggccuguccuuggccgcuacaacuucuccgccccagcuccuggcaugugguccuaccguccaucaaacaugcucggaaaauaccuacgugaaggggcuguguuuucucuucggaucaaacuuacgucagcagccacagaaauuucccgaggcccugagaggcugcccucaagaggacagcgauauagcuuuccuuaucgacggcaguggguccauuaucccacacgauuuuaggcggaugaaggaguucguaucuacuguuauggaacaguugaaaaagagcaaaacacuguuuucccuaaugcaguauucagaagaguuccgcauucauuuuaccuucaaggaguuucaaaauaaccccaauccuagaagucucgugaagccaaucacgcagcugcuuggaaggacucacaccgccacagguauacggaaagucgugcgcgaacuguucaacaucacuaauggcgcgcgaaagaacgcauucaaaauuuugguggucaucaccgacggggagaaguuuggagauccgcucggcuacgaagacguuauucccgaggccgauagagaaggugugaucagguauguaauaggggugggagacgcuuuccggagcgagaaaucucgucaggagcugaauacaauugccuccaagccuccacgcgaucaugucuuucaggugaacaauuucgaagcauuaaagaccauccaaaaccagcugagagagaaaauuuuugcuaucgaaggcacgcagacuggcucaagcaguucuuucgagcacgaaaugucccaggagggguuuagcgccgcgaucacaucgaacggaccccuccuuucuaccguugguuccuacgacugggccggcgggguguuccuguauacuucaaaggagaaaaguacauuuauuaauaugaccagggucgauagcgacaugaacgacgcauacuugggauacgcugccgcuauaauccuacggaaucgagugcaaucccugguacucggcgccccucgcuaucagcacauuggucugguugcaauguucagacagaacacggggaugugggaaucuaaugccaacgugaagggcacccagaucggagcuuacuuuggcgcgagccuuuguucagucgauguggacaguaauggguccacagaucuggucuugauaggagcaccacauuauuacgagcaaacuagggguggccaggugagcguuugcccccucccgcgggggcgcgccagauggcagugugacgcugugcuguauggagaacagggccaaccuugggguagguucggggccgcauuaaccguacugggcgaugucaacggagacaaacuaacagauguggccauuggcgcucccggggaggaagacaaucguggagccguuuaccucuuucacgguacuucuggcucagggaucaguccaagccauucccagcggaucgcaggaucuaagcugucgccucgacuucaguauuucggccagagcuuguccggugggcaggaucugaccauggacggccucguggaucugacagucggagcgcagggccacgugcuucuguugagaucacagcccguacucagggugaaagcuauuauggaguucaacccacgcgagguugcccggaaugucuuugaaugcaacgaccaaguggugaaggggaaggaggcaggagaagucagaguuugucugcacgugcagaaaaguaccagggaccgcuuacgagagggccagauccagucugugguaacuuacgaucuggcccuagacagcggucggccccauucccgugcugucuucaaugagacgaagaacucaacaagaaggcaaacccaggugcucgggcugacucagaccugcgaaacacuuaaauugcagcugccuaauugcauugaggauccaguuagcccgauagugcuccgccugaacuuuucuuuagucggaaccccucuguccgccuucggcaaccuucggccuguguuggcagaagacgcucaaagacucuuuacugcccuguucccauuugagaagaauugugguaacgauaauaucugccaggacgaucuaaguauuacauucagcuuuaugucucuggacugucucguugugggcgggcccagggaguucaacguaacggucaccgugcgaaaugauggagaagacuccuaccgcacucaggugacauuuuucuuuccucuggaucuuucauaucggaaagucaguaccuugcaaaaccagagaagccagaggucguggcgucuggcgugcgaguccgccucuagcacagaaguuucaggcgcuuuaaagaguacuuccuguucuaucaaucacccaaucuuccccgagaacagcgaagugaccuucaauauuacguuugacguagauuccaaggcaucacucgggaacaaacugcuucugaaggccaaugugaccagcgagaacaauaugccgcgcacaaacaaaacugaguuccaguuggaacucccugucaaguacgcuguguauaugguugugaccagucauggagucucuacaaaauaccugaauuuuacugccuccgagaacaccagccgggugaugcaacaccaguaucagguuucgaaccuaggccagagaucacugccaauaucucucguguuccugguccccguaaggcuuaaucaaacggugaucugggaccgaccucagguuacauuuagugaaaacuuguccucuaccugccauacuaaggagcggcugcccagccacagcgacuucuuagcagaacuccgcaaggcgccaguggucaauuguuccauugccgugugccagagaauccagugugauauucccuuuuucgguauccaagaggaauuuaacgcuacacugaaagggaaucuuucauucgacugguacauaaagaccagucacaaccaucugcuaaucguaagcacugccgagauucucuuuaaugauucuguguucacccuguugcccggacagggcgcauucgucaggucccagacagagacgaaaguugaaccauuugaggugccgaacccucugcccuuaaucguggguucaagugucggcgggcuccugcuucuggcuuugauuaccgccgcacucuauaagcugggauucuuuaaacggcaguacaaggacaugaugagcgaaggcgggccacccggagccgagccucaauga

SEQ ID NO: 57849 - RNA, 3009 nt, Artificial Sequence
  derived and/or modified sequence opt3 from ITGAV__Homo_sapiens__NP_001138471
augcugcucggcacccuucuguugaucuuauacauucugaugcuaugcagaauguuccuccuggugggggcccccaaggcuaacacaacucagccuggaauagucgaggguggccaaguucuuaaaugugacuggagcuccacgaggcggugccagccaaucgaauuugaugcaaccgggaaucgcgacuaugccaaggaugacccgcuggaguucaaaucucaccagugguuuggagcgucagugcgaaguaagcaggauaaaauuuuggcuugugcaccccucuaccauuggcguacagaaaugaagcaagagagagaaccuguaggcacuugcuuccugcaggacgguaccaagacaguggaguaugccccauguaggagccaggauaucgacgccgaugggcagggauuuugccaaggcggcuucuccauugacuuuaccaaagcugaucggguccugcucgggggacccgguucuuucuacuggcagggccaguuaaucucggaccagguggcagagauaguuucaaaguaugauccuaacguguacagcaucaaauauaauaaccaacuggccacucgcacagcucaggccauuuuugacgacaguuaccuuggguacuccgucgcggugggagauuucaauggcgacgguaucgaugacuuuguaucugggguuccaagagcagccaggaccuugggaaugguguauauuuacgauggcaagaacaugagcucccuguauaauuucacgggcgaacagauggcugccuacuuuggguucucagucgcagcuacugacaucaacggagaugacuaugccgauguguucauaggugcgccccuauuuauggaccggggcagugaugggaaacuccaagaggugggacaggucagcguuucucugcagcgcgccuccggcgacuuccagaccacaaaacuuaaugguuuugaaguguucgcacgauuugggucagcuauugccccucugggcgacuuggaucaagacggauucaacgauaucgcuauugccgcaccauacggcggggaggacaagaaaggaaucguauauaucuuuaaugguagaagcacuggccucaacgccgugccgagucagauucuggaggggcagugggcugcgaggucuaugcccccuuccuucggauacagcaugaagggcgcaaccgauauagacaaaaaugguuacccagauuuaaucgucggggccuuuggcguggaccgggcuauucuguaucgugcccgccccguuaucacagugaacgcaggacucgaagucuacccuucgauacuuaaucaggauaacaagaccuguucucugccaggcacggccuugaaaguguccugcuucaacguaagauuuugucuaaaggcugacgggaaaggaguucugcccaggaagcucaauuuccaaguggagcugcuucuggauaaguugaaacagaagggugccauucggcgagcacucuuucuguauucacgcaguccgagccacuccaaaaacaugacuaucucuagaggcggguuaaugcagugcgaagaacugaucgcguaccuaagggacgaaagcgaguuccgggauaagcucacaccuauuaccaucuucauggaguaucgccuggacuacagaacugcugccgacacaaccggacuucagcccauuuugaaucaauuuacgccagcaaacauaucaaggcaggcccauauccugcucgauuguggcgaagacaaugucugcaaaccuaagcuggaggugagugucgauuccgaccagaagaaaauuuauaucggugaugacaacccccuuacccugaucgugaaggcucagaaucaaggggaaggcgccuacgaggcagaauugauuguuagcauaccacuccaggcugauuucaucggagugguacguaacaaugaggcccuggcgcgguuaucuugcgccuuuaaaacagagaaccagacucgacaagucgugugugaccugggcaaucccaugaaggcugggacccagcuacucgcaggacugagauucucaguucaccagcagagugaaauggauacaagcgugaaauuugaccuucaaauucaguccucuaacuuguucgauaaggucucgccugugguaagccauaagguggaccuggccguucucgcugccgucgagaucaggggcguguccucaccagaucacauuuuucugccgauccccaauugggaacacaaagagaacccugaaacugaggaggacguggguccagucguucagcauauauacgaauuacgcaauaacgggcccaguucuuucagcaaggcaaugcugcaccuucaguggccuuauaaauacaacaauaacaccuugcucuauauccugcauuacgacauugauggaccaaugaauugcacauccgacauggagaucaacccccuacggauuaagaucucaagccugcaaaccacugaaaagaaugauacgguggcgggccagggugagagagaccaccucauaacaaagagggaucuggcccuuucugagggcgacauucacaccuugggguguggaguggcucagugccugaagaucguaugucaggucggccgcuuagaucgagggaaauccgccauucucuaugugaagagucugcuuuggacugaaaccuuuaugaacaaagagaaucaaaaccauagcuacucucugaaguccucagcaaguuucaauguuaucgaauuuccguauaaaaacuugccuauagaggacaucacaaauagcacccucgugacuacaaacgucacgugggguauucagccagcucccaugccugugcccguuugggugaucauucuggccguacuagcaggccugcuccugcuugccgucuugguguucgugauguaccggaugggauuuuucaagcgugucagaccaccucaggaggagcaagagagggaacagcugcagccccacgagaauggggaaggaaacucggagaccuga

SEQ ID NO: 57850 - RNA, 3492 nt, Artificial Sequence
  derived and/or modified sequence opt3 from ITGAX__Homo_sapiens__NP_000878
augaccagaacaagggccgcucugcuccuuuucacugcacuggccacgagcuugggcuuuaacuuagacaccgaggaacugacagcguuccggguggauuccgcuggguuuggagacucugucguucaguacgccaauucaugggugguagugggugcaccccaaaagaucacugccgcuaaccagaccggcgggcuauaucagugcggauacaguacaggcgcaugugagccuauuggucuccaggucccaccggaagccgugaauaugagccuggggcuuucccuggcuucuaccacuucgcccucacaauugcucgccugcggaccuacaguucaccaugaguguggccgcaacauguaucugaccggccugugcuuccucuuagggccaacgcagcugacucagcgacuucccgugagccgucaggaauguccuagacaagagcaggauauagucuuuuugaucgacggaagugguuccauuucuagcaggaauuucgcgaccaugaugaacuuugugcgggcaguaaucucccaguuccagcgcccaucaacacaauuuagucugaugcaguucagcaauaaauuucagacucacuucaccuuugaggaguucagaaggucuuccaacccccuaucacuccuggccagcguucaucaacuucagggcuucacauacaccgcuacggccauucagaaugugguccaccggcuguuucaugcaaguuauggggcucgccgagaugccgcgaagaucuugauagugaucacugacggcaaaaaggaaggagauucucucgacuacaaagaugugauuccuauggccgacgcagcugguaucauuagauaugccaucggggucggacuggcuuuccagaacagaaauuccuggaaggaauuaaacgauauagccagcaagccaucgcaagagcacauuuuuaaaguugaggacuucgaugcacugaaggacauccagaaucagcucaaagaaaagauuuuugccaucgagggcacagaaaccacuucuuccucaaguuucgagcuugaaauggcucaggagggcuuuagcgcgguguucacaccggacgggcccguacugggagcaguggguuccuuuaccuggucuggcggggccuucuuguacccuccaaacaugagccccacguuuaucaauaugucacaagagaacgucgauaugcgggacaguuaccuaggauauuccaccgaacuggcucucuggaaaggcgugcagagccugguucuuggugccccucguuaccagcacacagggaaggcagugauuuucacucaggucucucgccaauggagaaugaaggccgaggugaccggcacacagauaggaucauauuuuggcgcuagucugugcagcguagauguugacuccgaugggucuacugacuuggugcucaucggagccccacauuacuaugaacagaccagggguggccaggucucgguguguccccugccgcggggguggcgacgcugguggugcgaugcagucuuauacggagagcaaggccacccuugggguagauucggggcggcucugacagugcuaggcgacguuaacggagauaaacucaccgacgugguaauuggcgcccccggggaagaggagaauaggggagcagucuaucuguuccauggugugcuuggcccaagcaucuccccuucacacagucagcggauagccgggucucaguugagcucccgccugcaauacuuuggacaggcucucucaggcggucaggaucugacucaggacgggcuuguugaccuggccgugggcgcaagaggacaagucuugcuccugaggacgcgucccguguuauggguaggcgugagcaugcaguucauuccagcugaaaucccccggucugccuuugagugucgagaacagguugucuccgagcagacacuggugcaaaguaacaucugccuauacauugauaagagaagcaaaaaucuccuggggucuagggaccuucaguccucagugaccuuggaucuggcgcucgacccuggacgccugaguccacgggccacuuuccaggaaaccaagaacaggagcuuaucgaggguccgcguucugggccuuaaagcucacugugagaauuuuaacuugcuccugccguccugcguggaggauucugugacacccaucacccuacgacugaauuucacucucguagguaagccucugcuugcauuucggaacuugcguccaaugcuggccgcugacgcccagagauauuucacagcgagcuuacccuuugagaaaaauugcggggcagaucauauuugucaagacaaccucggaauaucauucaguuuuccuggccugaagucccuucuggucgguucuaauuuggaacucaacgccgaagugaugguuuggaaugauggcgaggacagcuacgggacgaccaucacuuucucccacccagcuggacugucauauagguacguggccgagggccagaagcaggggcaacuacgcagccugcaucucacaugcgauagugcacccgucggaucucagggcaccugguccacaagcugucggauuaaccaccugaucuuuagagguggggcucagaucacuuuccuugccaccuucgacgugucgccgaaagcaguuuugggagauaggcuguuacucacggccaaugugucaucugaaaacaacaccccucgaacaaguaagacuaccuuucagcuggagcuuccaguaaaauaugcugucuacacagugguguccagccaugaacaauucacuaaguaucugaauuuuucugagagcgaagagaaagagucccacgucgcgaugcaccgcuaccagguuaacaaucuaggccagcgggaccuccccgugucaauuaacuucuggguaccuguggaacugaaucaggaggccgucuggauggacguggaaguuagucauccccaaaacccuagcuugagauguucuuccgagaagauagcaccacccgcuucagauuuucuggcccacauccagaagaauccaguguuagacugcaguauugccgguugccucagguuccguugugaugucccgagcuuuuccgugcaggaggaacuggacuucacccuuaaaggcaaccugucuuuuggguggguucgccagaucuugcaaaagaaagugucggucguaagcguggcugagauuacguucgauacaucaguuuacucccagcucccuggacaggaagcauuuaugcgggcccagaccacuacagugcuggagaaguauaaaguccauaaucccaccccacuaaucgugggcaguucuauagggggacugcuucuccuggcguugaucacugcuguacuguacaaggugggcuucuucaagagacaauauaaagaaaugauggaggaagccaacggucagauugcacccgagaaugggacccagacaccuagcccacccuccgagaaguga

SEQ ID NO: 57851 - RNA, 603 nt, Artificial Sequence
  derived and/or modified sequence opt3 from ITGB1BP1__Homo_sapiens__NP_004754
auguucagaaagggcaaaaagaggcacagcuccucuucaagucagagcuccgagaucucuaccaaaucgaagucaguggacagcagucucgggggacugucccggucuagcacagucgccucccuugauacugacucaacgaaaaguagcggucaaucuaacaauaacuccgauaccugcgcugaauuucgcauuaaguacguuggcgcaauagagaagcugaaauugucagaagggaagggauuagagggcccccuggaccuaaucaauuauauugauguggcccagcaggacgguaaacucccuuucguaccaccggaagaggaguuuaucaugggggugagcaaguacggaauuaaagucaguacaucugaucaguaugacgugcugcaucgacacgcgcuuuaccugaucauacguaugguuuguuaugaugacggcuugggcgcugggaagucccuccuggcccugaagacuaccgaugcaagcaacgaagaguacucgcucuggguguaucaaugcaauucuuuagaacaggcccaggcuaucuguaaaguccuguccacagcauucgacucagugcuuaccagugagaagcccuga

SEQ ID NO: 57852 - RNA, 2406 nt, Artificial Sequence
  derived and/or modified sequence opt3 from ITGB1__Homo_sapiens__NP_391988
augaaccugcagcccaucuucuggauuggccucauaagcuccgugugcugugucuuugcccaaaccgacgagaauagaugccuuaaggcuaacgcaaaaucuuguggggaaugcauccaggccggaccuaauugugguuggugcacaaacucaacuuuccugcaggagggcaugccaacgagugcgaggugugaugacuuggaggcuuuaaagaaaaaggggugcccgcccgaugacauugaaaauccucggggaagcaaagauaucaagaagaacaaaaauguuaccaaccgcuccaagggcacagccgaaaaacugaagccagaggacauuacucagauccaaccccagcagcuagugcuccgacugcguucuggugagccucagaccuuuacacuuaaauucaagagagcagaagauuacccaauagaccuguauuacuugauggaucucucguauucaaugaaggacgaucuggagaauguaaaaagccuggggaccgaccucaugaacgaaaugaggcggaucacaagugauuuucgcauuggauucggcuccuuuguggagaagacugucaugcccuacaucucuaccacgccugccaaauuaagaaauccauguacuagcgagcaaaacugcaccuccccguucucauauaagaaugugcugagucuuacaaacaaaggcgaaguuuuuaaugaguugguggggaagcagaggauuagcggaaaccuggacucucccgaagguggcuucgacgcuaucaugcaggucgcagugugugggucccuaauaggauggcggaacguaacucgccuccugguuuuuagcaccgaugccggcuuccacuuugcuggugacgggaaacuuggaggcauugugcugccuaaugauggccagugccauuuggagaacaauauguacacaaugagccacuauuacgacuacccaaguaucgcccaucucguccaaaagcugucugaaaacaauauucagaccaucuucgcggugacggaggaguuccagcccguguauaaggaacugaaaaacuuaaucccuaaguccgcagucgggacucucagcgccaauucgucuaacguuauucaacuuauaaucgaugcuuacaauucccugucaagugaggugauuuuggaaaacggaaaacuaagcgaggguguaacaaucuccuauaagucuuacugcaaaaauggcgugaacgggaccggagaaaauggccgaaaguguagcaacauaucaauuggugacgagguccaguuugagaucaguaucacuuccaauaagugccccaaaaaggauagcgacucuuucaaaauuagaccacugggguuuacagaagagguggaaguuauccuccaguauauuugugagugcgaaugucagucagagggcauaccggagaguccuaagugccacgaaggaaacggcaccuucgaguguggggccuguaggugcaacgaaggacgggugggucgucauugcgaguguagcacggaugaggucaauuccgaagacauggaugcauacugccgcaaagagaacucuucggaaaucugcagcaauaacggcgagugugugugcgggcaauguguaugcagaaagagggacaauaccaacgaaauuuauuccggaaaguuuugugagugcgacaauuucaacugugaucggucaaauggccugaucugcggugggaacggcguuuguaaaugccgagugugugagugcaaucccaacuacacaggaagugcuugcgacuguucucuugauacuucaaccugcgaagccuccaauggccagaucuguaacgggcgcggaauuugcgaguguggugucugcaaguguacagacccaaaauuucagggccagacuugcgaaaugugucaaaccugccugggggugugugcggagcacaaggaaugcguccagugcagagccuucaauaaaggagagaagaaggauacauguacccaggagugcucauacuuuaacauaacuaaaguggaaagcagggacaaguugccucagcccguucaaccagaucccgugucucacuguaaagagaaggacguagaugacugcugguucuauuuuacguacuccgucaacggcaauaacgaagugaugguucauguggucgagaauccugaauguccaacagguccggauaucauucccaucguggcagggguaguggcuggcauuguucucaucggacuggccuuacugcuaauauggaaacuccugaugaucauucacgaccggcgcgaguucgcuaaguuugagaaagaaaagaugaacgccaagugggauacccaggagaauccuaucuauaaaaguccaauuaacaauuucaagaaccccaauuacggcagaaaagcagggcuuuga

SEQ ID NO: 57853 - RNA, 2310 nt, Artificial Sequence
  derived and/or modified sequence opt3 from ITGB2__Homo_sapiens__NP_000202
augcugggccucagacccccucuucuggccuuggugggguuacugagccuaggaugcguccucucccaggaguguaccaaguucaaaguuucuucaugcagggaauguaucgagagugguccaggcugcacauggugucaaaagcugaacuuuacugggccgggagaccccgauagcauucggugcgacacgcgcccucagcuucugaugcgaggcugugcugcagaugacauaauggauccaaccuccuuggccgaaacacaggaggaccacaauggugggcagaaacaacucucuccccagaaggugacucuguaccugcguccuggacaggcggcugccuucaacguaaccuuuagaagggcaaaaggcuauccaaucgaucucuacuauuuaauggaccugucguacucaaugcuugaugacuugcggaaugugaagaagcugggcggggaucuacuccgcgcccugaacgaaauuacagagagcggaagaaucgguuucggcaguuuugucgacaaaaccgugcuucccuucguuaauacucauccugauaagcugaggaacccaugcccgaauaaagagaaggaaugucagcccccuuuugcuuuccggcacguguugaaacucacaaacaauuccaaccaauuucagaccgaggucgggaagcagcugauuucuggaaauuuagacgcaccagaaggcggucuggacgccaugaugcaaguggcugccugccccgaggagaucggguggcgcaacguaacgcgacuccuuguuuucgcgacugaugacggauuucauuucgcaggcgauggcaagcugggggccauauugaccccuaaugacggaagaugucaccuagaagauaaccuguauaaaaggagcaaugaguuugacuacccauccgugggucagcucgcucauaagcuggccgaaaacaacauccagcccauuuucgcagucacaucacggauggugaaaacuuaugagaaacuuaccgaaaucauuccgaagagugcugugggcgagcugagcgaggauucuuccaaugucguucacuugaucaagaacgccuacaauaaacucucaagccguguguuccuggaccacaacgcguuaccugauacacugaagguaaccuacgacaguuuuugcucuaauggggugacgcaucgcaaccagcccagaggagauugcgacggcguccaaauaaaugugccaauuacuuuccagguuaaggugacagccaccgaauguauccaggagcaguccuuugucauuagggcacuagguuucacugacaucgugacaguacaaguucucccucagugcgaaugucggugccgagaucagagccgcgacagaucgcugugucacgggaaaggcuuucuugagugcggaaucuguaggugcgauaccggcuauauugggaagaacugugaaugccagacgcaaggacggucuucccaggaguuggaggguucaugucgcaaagacaauaacaguauaaucugcagcggccugggggauugcguguguggacagugccucugucauaccuccgacguccccggcaagcugauuuacggucaguauugcgaaugugauacaaucaauugcgagagauacaacgggcaaguguguggcggaccaggcagggggcuuugcuucuguggaaaaugccguugucaccccgguuuugaaggcucugcuugccagugcgagcggacuaccgaagggugucugaauccucgaagagucgagugcagcggaaggggccgcugucggugcaacgugugugagugccacucagguuaucaguugccacucugucaggaaugcccggggugucccaguccuugcggcaaguacauauccugugccgagugccugaaguucgaaaaaggaccauuuggcaagaauugcagcgcugccugucccggguuacaacugucuaacaacccuguuaaaggaagaacaugcaaggagagggacucagagggcuguuggguggcauauacucuagaacagcaggaugguauggaccgcuaccucauuuacguagaugagagucgagaaugcgucgccgggccaaauaucgcugcgaucgugggaggcaccguugcagguauugugcugaucggcauucuuuugcuggucauauggaaagcccucauccaucugagcgacuuacgggaguaucguagauucgaaaaggagaagcugaaaucccaauggaacaaugauaacccccuuuuuaagucugcuacaaccacugugaugaauccgaaauucgccgagucguga

SEQ ID NO: 57854 - RNA, 2367 nt, Artificial Sequence
  derived and/or modified sequence opt3 from ITGB3__Homo_sapiens__NP_000203
augagagccaggccccggccucgcccacugugggcuaccgugcucgcacuuggcgcccuggcgggggucggaguugguggcccgaacaucugcacaacucgaggggugagcuccugucagcaaugcuuggcuguaucucccaugugugccuggugcucagacgaggcauuaccucugggaaguccacguugugaucuaaaggaaaaucuccugaaagacaacugcgcccccgagagcauugaguucccuguguccgaggcuagaguccuugaagauaggccacugucugacaagggcucgggugauucaagccaggugacgcagguuaguccccagcggauagcauugcgccucagaccugacgauuccaaaaauuuuucuauccaagugaggcaggucgaggacuacccaguggauauuuauuaccugauggaccugagcuauuccaugaaggaugaccucuggucaauccagaacuuagggaccaaacuggccacacagaugcggaaacuuaccaguaauuugcgcauuggauucggcgcuuuuguagauaagccgguuagccccuacauguauaucucuccuccagaggcccuggaaaaccccuguuacgacaugaagaccacaugccuaccuauguucggcuauaagcacgugcucacccugacugaccaagucacacgauuuaaugaggaagugaaaaagcaguccgugucaagaaacagggaugcgccagaagggggauucgacgcaauaaugcaggccaccgucugugaugagaaaaucgguuggcggaaugacgcuagccaucuucugguuuuuacgacugaugccaagacccacauugcauuggacggccgucucgcugggaucgugcagcccaacgauggacaaugccauguaggcagugacaaucacuacucugccuccacaacuauggauuacccgagccuggguuuaaugaccgaaaagcugucgcagaaaaacauuaaucucaucuucgcggugacagagaacgucgugaaucuuuaucagaacuacucugaacugauaccugggaccacgguuggaguguuguccauggacucaaguaacguccuacaacugauuguggaugccuauggcaagauccgcagcaaaguagagcucgaaguuagagaccugcccgaggagcuuucccugucuuuuaaugcaacuuguuugaacaaugaagugauuccaggccucaagagcugcauggggcugaaaaucggagacacagucucauucaguaucgaggcuaaggugagggguugcccucaggaaaaagagaaguccuuuaccauuaagcccgucggcuucaaagauagcuuaauagugcagguuacuuuugacugugauugcgccugucaggcucaagccgaaccaaacucucaucggugcaauaacgggaauggaacauucgaguguggcgugugccgauguggucccggguggcugggcucacagugcgaguguagugaagaggacuaccgcccuagccagcaggaugaaugcuccccaagagagggacaaccgguauguucucagaggggcgaaugccuaugcgggcagugugucugccacucgagcgacuucggaaagaucaccgguaaauauugugagugcgaugacuuuuccugugugcgguacaagggcgagaugugcucagggcacggacaguguaguugcggcgauugucucugcgacucugauuggacggguuauuacuguaacugcaccacacgcacugacacuugcaugagcuccaaugggcugcuuuguucaggcagaggaaaaugcgaauguggcagcugcguuuguauucaacccgggucuuacggagauacaugcgagaaguguccuacuugcccagacgcauguaccuucaagaaagaaugcguggaguguaagaaauuugacaggggugccuugcaugaugagaacacaugcaaucguuauugccgggacgaaaucgaguccgucaaggaacugaaagauaccggcaaggacgcugugaacuguacuuacaagaaugaggaugacugcguagugcgauuccaguauuacgaagauaguagcgggaaaucuauacucuauguugucgaggagcccgaauguccuaagggaccagacauucugguggugcuucuguccgucaugggcgcgaucuugcucaucggucuggcagccuuacugauuuggaaacuacucaucacgauucacgauagaaaggaguuugcuaaauucgaagaggaaagggcccgcgcaaagugggacacagccaacaauccccuguacaaggaggcuaccucaacuuuuaccaacauaacauaucgggggaccuga

SEQ ID NO: 57855 - RNA, 5469 nt, Artificial Sequence
  derived and/or modified sequence opt3 from ITGB4__Homo_sapiens__NP_000204
auggccggccccagaccuagcccaugggcuaggcugcuccuugcagcccugaucuccgugucuuugucagggaccuuagcgaaccggugcaagaaagcuccggucaagaguuguacagagugcguucgcguggacaaagauugugccuacugcacugacgaaauguuccgagaucguagauguaauacgcaggcagagcugcuagccgcuggaugccaaagggaaagcauuguagugauggaguccucuuuucagauaaccgaagagacacagaucgacacuacccuccggcgcucgcagaugucaccccaaggucugagagucaggcuucggccuggcgaggaacgccacuucgagcuggaaguguuugagccauuggagagccccguugaucucuauauucugauggacuucaguaacuccaugucugaugaccuggauaaucucaagaaaauggggcagaacuuagcacgagugcugagccagcuuacauccgacuacaccaucggauuuggcaaguucgucgauaaggugucaguaccucagacugacaugagaccagaaaaauugaaggagcccuggccuaauagugauccaccguuuagcuucaaaaacguuauuucucugacagaagacguggacgaguuuaggaauaagcuacaaggugaacggaucuccgggaaccucgaugcccccgagggaggcuucgacgcuauacugcagaccgccgucuguacgcgugauaucggcuggcgcccugacucaacucaucuucugguguuuagcaccgagagugcguuccacuaugaagcagauggggccaauguguuggcuggaauuaugucuagaaacgacgagaggugccaucucgauacaacugguaccuacacacaguaucggacccaggacuacccauccguccccacgcugguucgauuacuggccaaacacaauaucauuccuaucuuugcagugacuaacuauagcuacucguacuaugaaaagcuccauacauacuucccaguaucuucccuuggcgugcugcaagaggauucaaguaauauagucgaauugcuagaggaggcuuucaaccgcauuagaagcaaucuggacaucagggcccucgauuccccccgggggcugcgcaccgaagugacuucuaagauguuucagaaaacaagaaccggaagcuuccacauuaggcguggcgagguugguaucuaucaggugcaacuucgggcgcuggaacacgucgacgggacgcaugugugucaguugccggaggaccagaagggaaacauccaccucaaaccuucauuuagugauggccugaagauggacgccggcauuauaugcgauguauguaccugcgaauuacagaaagagguucgauccgcaagaugcagcuucaacggggacuuuguguguggacaaugcgucuguucugaggguuggucaggccagacaugcaauuguaguacugggagccuguccgauauccagcccugccuaagggaaggagaggacaagccauguucuggccgcggugaaugccagugugggcauugcguguguuacggcgagggacgguaugagggccaauucugcgaauacgauaacuuucagugcccuagaaccucgggguuccucuguaaugacaggggacgcugcagcaugggucagugugucugcgagcccggcuggacagggccauccugugauugcccccugucaaacgcuacuuguauugacaguaauggaggcaucugcaacggucgagggcacugugaaugcggccggugucacugccaucagcaaucucuuuauaccgauacaauaugcgagauuaauuacagcgccauccacccuggauugugugaagaccugcguuccugcgugcagugucaggcuuggggcaccggggagaaaaagggaagaacuugcgaggaauguaacuuuaagguuaaaaugguggaugagcucaagagggccgaagagguagucgugcgcugcucauuccgggacgaagacgaugacuguacguacagcuauacaauggagggugauggcgcaccagggccgaauucuaccguucuggugcauaaaaagaaagacugccccccuggauccuuuugguggcuuaucccacuguugcuccuguuacugccccuacucgcccugcuuuugcugcucuguuggaaguacugcgcuuguugcaaggcgugccuggcauuacugccuuguugcaacagaggccacauggucgguuucaaagaggaucauuauaugcuuagggaaaauuugauggccagugaccaccucgauacuccaaugcugcgaagcgggaaccuaaagggccgcgacgugguacgguggaaagugaccaauaacaugcagagacccggauuugcuacacacgccgcaucuauuaauccgaccgagcugguuccuuacggccucucccugaggcuugcccguuuguguacugaaaaccuguuaaagccagauacacgcgagugcgcucaacuccggcaggaagucgaggagaaccugaaugaaguguauagacagaucucaggggugcauaaacuucaacagacgaaguucaggcagcagcccaacgccggaaagaaacaagaccacaccauugucgauacuguucugauggcaccucgaagugcgaagcccgcuuugcucaaacugacagagaagcagguggaacagcgggccuuccaugaccuaaaaguggcaccaggcuacuauacccugacagccgaucaggacgcucgcgguaugguagaguuucaagagggggucgaacucguggacguuagagugccucuguucauaaggcccgaggaugacgaugaaaagcagcuuuuggucgaggccaucgacgugccagcaggaacugcuacccugggccggcgauuaguuaauauuacgaucaucaaggaacaggccagagaugugguaagcuuugagcagccggaguucucggucucccgcggugaccaaguggcgaggauuccugugauacgucggguccucgauggcgggaaaucucagguuagcuacagaacccaggacggaacagcccaaggcaacagggauuacauccccguggaaggggagcugcuuuuucagccaggagaagcuuggaaggagcugcagguaaaacuacucgaacugcaggagguggacucauugcugcgcggccgacaagucagacgguuccacgugcaguuaaguaaucccaaguuuggugcacaccucgggcagccucauuccacuaccauuaucauuagggauccagacgagcuggaccgcucuuucacaagccagaugcuuuccucacaacccccuccgcacggagaucugggcgccccacagaaccccaaugcuaaagccgcagguagccguaagauccauuuuaacugguugccuccaaguggcaaacccaugggguauagaguuaaguacuggauacagggagacucugaauccgaggcgcaccuccuggauagcaaggugccuucggucgaacuaacuaaucuguauccguacugugacuaugagaugaaagugugcgccuacggcgcucagggggaaggacccuauucaucucuuguuaguugucggacccaucaagaggugccauccgagccuggcaggcucgccuucaacgucguaagcucuacggugacacagcugagcugggcagaacccgcugagaccaauggugaaaucacugccuacgagguuugcuacggguuggugaacgaugacaaucgcccaauuggaccuaugaagaaaguccugguggauaaccccaagaaucgaauguuacucaucgagaaccugagagaaucccagccauaucgguacacaguaaaagcaaggaacggcgccgguuggggcccggagcgcgaagcuauuaucaaucuugcgacccagccuaagagacccaugucaauaccaauuauccccgacauuccuaucguggaugcccaaaguggggaggacuaugauagcuuucugauguacucugacgaugucuugagguccccaucaggaagucagcggcccagcguuuccgacgacacuggcuguggguggaaguucgaaccucuccugggagaggagcuagaucugcgucgcgugaccuggcgacuuccgccagaacucauacccagacugucugcaucgagcggcaggucauccgacgcugaggccccucacggucccccagaugacgggggagccggcggcaaagggggaaguuugccucggucugcuacacccgguccaccuggcgaacacuuagugaacgggcgcauggauuuugcauucccgggaagcacgaauucccugcauagaaugaccacuacaucagccgcggcuuauggcacccaccucucuccccaugucccacacagggugcugagcacaaguuccacucuuacccgggacuacaacagccugacgcgaucugagcauucacacuccacaaccuugccuagagauuauaguacucuaaccagcguuucgucucacgacucccgccugacagccgguguacccgauacuccaaccaggcucguguucagcgcacuggggccuacaucacuucgggucaguuggcaggaaccccguugcgagagaccguuacaaggauacucuguggaguaccagcugcucaauggcggcgaauugcauaggcugaacaucccaaauccugcccagacguccguuguggucgaggaccuccugcccaaccacagcuauguguuucgcguacgggcucagucacaagaaggguggggacgagagagagaaggugucauuaccaucgagagucaggugcauccacagagcccccuuuguccucugccgggcuccgcauucacuuugucuacacccagcgccccagggccucuaguuuuuaccgcgcugucccccgauucacuccaguuaucuugggagaggccucgccggccaaauggagacauugugggcuaccuggucacuugcgaaauggcucaaggugggggacccgccacagcauucagaguggauggcgacaguccugagucgcgucuuaccguuccaggccugagcgaaaacgugcccuauaaguuuaaaguccaggccaggacgacugagggguucggaccggagcgggaagguaucauaaccauugagucccaggacggcgggccuuuuccacagcucggaucucgcgcuggcuuguuccaacacccccugcagucagaauacagcuccaucacaaccacucacacaagugccaccgagccuuuucucguggauggucugacacuuggggcacagcaucuagaagcuggaggcucucugacucgacacguaacccaagaguucgugagcagaacguugacaaccucaggcacuuuauccacccauauggaccagcaguuuuuccagacauga

SEQ ID NO: 57856 - RNA, 2400 nt, Artificial Sequence
  derived and/or modified sequence opt3 from ITGB5__Homo_sapiens__NP_002204
augcccagagccccugcuccacuguacgcaugccuccuuggccugugugccuuguuaccgaggcuggcggggcuaaacaucugcaccagcggauccgcuacaucuugugaggaaugccuccugauucaccccaagugugccuggugcucaaaagaggacuucgguaguccucggagcauaacuucccgcugugaucuucgagcaaaucuggugaagaacggcugcgggggagaaaucgagucuccagccucgucauuucaugucuugcguagccucccccugaguuccaaaggcucugguagcgcugggugggacguuauucagaugacgccucaagaaaucgcagugaaucugagaccaggagauaagaccacauuccagcuccagguaaggcaaguggaggacuaucccgucgauuuauacuaucugauggaccuuuccuugucaaugaaagaugaccuggauaacauucggagucuaggcacuaagcucgccgaggaaaugcgcaagcugaccagcaauuuuagacuuggcuucgggucuuuuguggacaaagauaucuccccuuucucauacacagcuccaagguaucagaccaacccguguauaggauacaagcuguuucccaauugcguuccuagcuucgguuuucggcacuugcucccacugacugaccgcguggauaguuucaacgaggaaguccgaaaacagagagugucuaggaaucgggacgcccccgagggcggguuugacgcgguauuacaggcagccguuuguaaggagaaaaucggauggcguaaggaugcucugcaucuccuuguguucacaaccgacgaugucccucacauugcccuggacggcaaguugggugggcuagugcagccacaugauggacaaugccaccugaacgaagcaaaugaguauacggcuuccaaccagauggacuaccccagccucgcccugcuuggcgaaaaacuggcggagaauaacaucaauuugauuuuugccgugacuaagaaccacuacaugcucuauaaaaacuucaccgcacugaucccgggcacaacugucgaaauauuagauggggacucgaagaauauuauccagcugauuaucaacgcuuacaauucuauccgcuccaaaguugagcuaucagugugggaucagccugaggaccucaaccuguucuuuaccgccacaugccaagauggaguaaguuaucccggucagagaaagugugaaggccuuaaaauuggggacaccgcuagcuucgagguguccuuggaagccaggucuugcccaagccggcauacggagcacgucuuugcacugcgaccugugggauuccgcgacucacucgaaguuggcgugacuuacaauuguacaugcgguuguagugucgggcuggagcccaacuccgccagaugcaauggcagcggaaccuauguguguggccuuugcgaguguucuccaggguaccugggaacuaggugcgaaugucaggauggugagaaccaaucaguauaucagaauuugugccgggaagcugagggcaagccccucugcagugggcgcggagacuguagcugcaaccaguguuccugcuuugaaucugaguucggcaagauauacgguccuuuuugugagugcgauaauuucucgugugcgagaaacaaagggguucugugcagcggccauggagaaugucacugcggcgaguguaagugccacgcaggguacaucggagacaauugcaacuguuccacagauauuucaaccugcaggggucgugacggccagaucuguagugaacgggggcauugcuuauguggacaaugccaguguacggagccaggcgccuuuggugagaugugcgaaaaauguccgaccugccccgaugcuuguucuacaaagcgagacugcguggagugccugcuacuccacagcgggaaaccugauaaucagacuugucauucccugugcagagacgaagucauaaccuggguggauacaauugucaaggacgaucaggaggccgugcuuuguuucuauaagacugcaaaagacugcguuaugauguuuaccuacguggaauugccaucaggcaagagcaaccugacaguacucagggagcccgaguguggaaacaccccuaaugccaugacuauccuguuagcugucgugggcucuauccugcuuguuggguuggcccuccuggcaauuuggaaacuacuggugacgauccacgaccgccgggaguucgcgaaguuucaauccgaaagaaguagggcucgcuaugaaauggccagcaacccacucuaccgaaaacccauuucuacacauaccgucgauuucacuuucaauaaguuuaacaaguccuauaauggaaccguggacuga

SEQ ID NO: 57857 - RNA, 2367 nt, Artificial Sequence
  derived and/or modified sequence opt3 from ITGB6__Homo_sapiens__NP_000879
augggcaucgagcugcucugccuuuucuuucuguucuuggggagaaacgaccacgugcagggagguugugccuuaggcggggcugaaaccugcgaggauugucugcuaauuggaccccaaugcgcauggugugcccaggaaaauuuuacacauccuagcggcgucggugagaggugcgacacuccagcgaaccuccuggcuaaggggugucagcuuaauuucauagaaaacccgguuucccagguggagauccugaaaaauaagcccuugucuguaggacggcagaaaaacucaagugauauugugcaaaucgccccucagagccucauucugaagcugcgcccaggcggcgcacagacgcuccaaguccacgugcgacagaccgaggacuaccccguugauuuauauuaccugauggaccuuuccgccucuauggaugacgauuugaauacaaucaaagaacuggggucgcgucuaucaaaggagaugagcaagcucacuuccaacuuuagacugggauucgguuccuuuguggaaaaaccugucucuccauucgugaagaccacacccgaggagauagcuaauccuugcagcuccaucccauauuuuugucuuccgaccuucggcuuuaaacauauucugcccuugacuaacgacgcagaaagguucaaugagaucguaaagaaccagaaaauuucagccaauaucgauacaccugaagggggauuugacgcuauaaugcaggccgcgguuugcaaggagaagauuggcuggcggaacgauagucuccaccuguuaguguucgucagcgacgcagacucucauuucgguauggauuccaaacuggccgggaucgugauuccaaaugacggacucugucaccuugauucaaagaacgaauacagcaugaguaccgugcuggaguaucccacgaucggccaauugaucgacaagcuaguccagaacaauguucugcucauuuuugcugugacucaggagcaaguacaccuguacgaaaacuaugccaaacuuauaccuggcgcaaccguggggcuguugcagaaagauucuggaaauauccuccagcugauuaucuccgcuuacgaggaauuacgcagcgaggucgaacuggaggugcuaggugacacagagggccucaaccugucguucacugccauaugcaauaacgggacccuuuuucagcaucaaaagaaaugcucucacaugaagguuggagauacagcguccuucucagugaccgucaauauuccacauugugaaagaaggagucggcacaucaucauuaagcccgugggcuugggugacgcccuggagcuccugguaagcccggaaugcaacugugauugccagaaagagguugaagugaauaguucuaagugucaccaugggaacggcagcuuucagugcggagucugugcaugccacccuggccauauggggccccgcugugagugcggagaggacaugcuuucaacggauaguuguaaagaagcuccagaccacccuuccugcagcggucgaggcgacugcuacugugggcagugcaucugucaucugucucccuauggaaauauuuacggcccauauugccaaugugauaacuucucaugcgugagacacaaggguuugcucugugggggcaauggagacugcgauuguggcgagugcgucuguaggaguggguggacuggagaauacugcaacugcacaaccagcacugacuccugugugucugaggaugguguucugugcucgggccguggggacugugugugcggaaaauguguaugcacaaaucccggcgccagcgguccuaccugugagcggugcccaacguguggggauccgugcaacuccaagcgcucauguauagaaugccacuuaagugcugccggccaggcaagagaggaaugcgucgacaaguguaaacuggccggagcuaccaucucugaggaagaggauuuuagcaaggacggcuccgugucaugcagccuacagggggagaacgaaugucucauuacauuccugaucacuaccgauaaugagggaaaaacaaucauucauucuauaaacgaaaaggacugccccaaaccuccaaauauccccaugauuaugcuuggcguuuccuuggcgauccugcucauuggugugguccuguuauguaucuggaagcugcuugugaguuuucacgauaggaaggagguagcaaaauucgaagccgagcggagcaaggcuaaauggcagacugggaccaacccuuuguaucgaggaucuacauccaccuuuaagaaugugacuuacaaacaucgcgagaagcaaaagguugaccucucaacggacugcuga

SEQ ID NO: 57858 - RNA, 2397 nt, Artificial Sequence
  derived and/or modified sequence opt3 from ITGB7__Homo_sapiens__NP_000880
augguggcccugcccaugguccucguucuucuguugguguuaagcagaggcgaguccgaacuggacgcuaagaucccuucuaccggggaugcaacagaguggaggaacccacaccuaucaaugcucggaaguugccagccggcccccagcugucaaaaaugcauucugucccauccuucuugugcguggugcaagcagcuuaauuucacugcuucgggugaagccgaggcacggcgcugugcccgacgugaagaacuguuggcuagaggcugcccacucgaggaacuggaggaacccagggggcagcaggagguacugcaagaccagccucucucacagggagcacggggcgagggugccacgcaguuagcuccacaacgcgugagagucacccugaggcccggggaaccucagcagcuucaggugcgguuuuugcgcgccgagggauacccaguugaucuguauuaccuaauggaccucagcuauaguaugaaagaugaccuggaacgagugagacaacuuggccacgcgcuguuggucaggcuccaggaggugacacauuccguacggauaggcuucgggucuuuuguugauaagacugugcugccguucgucagcaccgugcccuccaaauuacgucacccuuguccaacacgccuggaaagaugccagucacccuuuaguuuccaucacgugcucagccuuaccggagacgcacaagccuuugagagggaggucggucggcagucuguuuccggcaaccuggauucaccugaagggggauucgacgcuaucuugcaggccgcacuaugucaggagcaaauuggcuggcgaaaugugagccgccugcucguauuuacaagugaugacacuuuccacaccgcuggugaugggaagcugggaggcaucuuuaugccaucugacggccauugccaccuugacuccaacgggcuguacagcagaucgacggaguucgauuaucccucugugggacaggucgcccaggcguuguccgccgcaaauauucagccgaucuuugcugugacuucagccgcucucccuguuuaccaagagcugaguaaguuaauacccaaaagcgccgugggugaacuguccgaggacucuagcaacgucgugcagcuaaucauggaugcauauaauucacucaguuccaccguaacacuggagcauagcucucuuccaccuggcguucacauuucauacgaaagucagugugaggggcccgaaaagagggagggaaaagccgaagaccggggccagugcaaccacgugcgcaucaaucaaacugucaccuucugggugagcuugcaggcuacacauugccugccagagccccaccuccugagacuuagggcgcuggguuucuccgaggaauugauugucgagcuccauacccugugugauugcaacuguucugacacgcagccucaggcaccacacugcucggaugggcaaggccauuuacaguguggagugugcagcugugccccgggccgucuggggcggcuaugcgaauguuccguugcugagcucucaagucccgaccuggagucuggaugccgagccccuaaugguacuggcccacuuuguagcgggaagggacacugccagugcggcagauguuccugcucaggucaaagcucugggcacuugugugaaugcgaugacgcauccugugagaggcaugaaggcauccugugcggaggcuuugggcgcugucagugcggagugugucacugccaugccaaccggacagguagagcuugugagugcaguggcgauauggacagcugcauaucucccgaagggggacucuguuccggccacgguaggugcaaauguaaucgcugccagugucuggacggguacuauggcgccuuaugcgaucaguguccuggaugcaagaccccaugugagcgacaccgggacugcgcagaguguggcgcguuccguacugggccccuggcuacaaacugcucaaccgccugcgcacauacgaauguaacccuugccuuggcuccgauucucgaugacggaugguguaaggaaagaacacuggauaaccaacuauuuuucuuucuggucgaggacgaugccaggggcacugugguucuccgcgugcggccucaggaaaaaggugcagaccacacccaggcuaucguccuggggugcgugggaggcauuguagccgugggucuuggcuugguucuggcguacagauuaagugucgagaucuaugauaggcgagaauacagccgcuucgagaaggagcagcaacagcucaacuggaaacaggacucgaauccacuguauaaguccgccaucacaacuaccauuaacccccgguuucaggaagcugauucuccuacacuuuga

SEQ ID NO: 57859 - RNA, 2310 nt, Artificial Sequence
  derived and/or modified sequence opt3 from ITGB8__Homo_sapiens__NP_002205
augugcggcagcgcccuggcuuucuuuaccgcagccuucgugugucuccagaacgacagaagggggcccgcguccuuucuuugggcugccugggucuucucucugguuuugggauuaggucaaggcgaggauaaucggugcgcaucaaguaacgccgcuagcugugcacgcugccuggcccuagggccugaauguggauggugcgugcaggaggacuuuaucuccggcgguucucgaucggaacguugugauauuguaucaaaucucauaagcaaggggugcaguguggacuccaucgaguacccaucuguccacgugauuaucccgacagaaaacgagauuaauacucagguuacgcccggagaggugagcauccagcugagaccuggcgcugaagccaacuucaugcuuaaaguccauccacugaagaaauaucccguggauuuguacuaucucguagacguuuccgcgucaaugcacaauaacauagagaagcugaauagugugggcaacgaucugagcaggaaaauggcauuuuucucucgggacuuucgccucggguucggauccuacgucgauaagaccgugucaccuuauaucagcauucauccagaaagaauccacaaucaauguagugacuacaacuuagauugcaugcccccucaugguuauauucacgugcugucucuuacagagaauaucacugaguuugaaaaggccguccacaggcagaaaauauccggcaacauugacaccccagagggcggauucgaugcuauguugcaggccgcaguuugugaaagccauaucggcuggcggaaggaggcuaaacgccugcuacucgugaugacagaccagaccucgcaccuggcccuugacucuaagcuggcggguauuguagugccgaaugaugggaacugccauuugaaaaacaaugucuacgugaaguccacuacaauggaacaccccucacucggacaacugagugagaaguuaaucgacaacaauaucaacguuauuuuugccgugcagggcaaacaguuccacugguacaaggaucugcucccucuucugccaggcaccauagcaggggagaucgaaagcaaagcugccaauuugaacaaucuagucguggaggcuuaucagaagcugauuuccgaaguaaaaguucaaguggagaaccagguccagggaaucuacuucaauauaacggccauuugccccgacgguucucgaaagccuggcauggaaggguguagaaacgugacuagcaaugaugagguccucuuuaacgugaccguuacaaugaaaaagugcgacgugacuggaggcaagaauuaugcaaucaucaaaccaauugguuucaacgagaccgccaagauccauauucacaggaauuguucaugccaaugugaagauaaccgggggcccaaaggcaagugcguagacgagacauuucuggauaguaaauguuuccagugcgacgaaaacaagugucauuuugaugaggaccaguucuccagcgaaucuugcaagucacacaaagaccagccggucuguaguggacguggcgugugcguuugcgggaaguguagcugccauaaaauaaaacuuggaaagguguacgguaaguauugugagaaggaugacuuuuccugcccuuaccaccacggcaaucugugugcugggcauggagagugcgaagcgggccgcugucaaugcuucucugguugggagggggauagaugucagugccccucggcagccgcucagcacugugucaacagcaaaggccaggugugcuccggaagggggaccugcguaugugggcggugcgaauguacggacccacgaucaaucggacgcuuuugcgagcauuguccuacuugcuauacagccuguaaggagaauuggaacugcaugcaauguuugcacccccacaaucucagucaggcaauucuggaucagugcaaaaccucuugugccuuaauggaacagcaacauuacguggaccagacuagcgagugcuucuccucaccaagcuaccugagaaucuuuuucaucauuuuuauaguuacauuccuaaucggucuccugaagguccuuauuaucaggcaagugauuuugcaguggaacucuaauaaaaucaaguccaguagcgauuaucgggugucugcuuccaagaaagacaagcugauacuccagucagucugcacccgcgccguuacguacagaagggaaaaacccgaggaaaucaagauggauauuaguaaacugaacgcacacgagaccuuccguuguaauuuuuga

SEQ ID NO: 57860 - RNA, 1062 nt, Artificial Sequence
  derived and/or modified sequence opt3 from ITGBL1__Homo_sapiens__NP_001258683
augugcaagaacagccaggacaucauuuguuccaaugccgggaccugccacuguggcagaugcaaaugugauaacucugacggaucaggucugguguacggcaaguucugcgagugugaugacagggaaugcauagaugacgagacagaagagaucugugggggacauggcaaaugcuauugugguaauugcuacugcaaggcuggguggcacggagauaaaugugaauuucaaugcgacauuacucccugggagaguaagcggcgcuguacgagcccugauggcaagaucugcuccaaccgaggcaccugugucugcggggaguguacaugccaugacguugauccaacuggagacuggggugauauucacggcgacaccugugaaugcgacgagcgugauuguagagcaguguaugacagguacucugaugacuucugcucggggcauggacagugcaauuguggccggugcgauuguaaagccgguugguaugggaagaaaugcgaacacccgcagucauguacacucagcgcggaggagaguauccgcaagugccagggauccucugaccuucccuguagcggcagaggcaaaugcgaaugugggaagugcaccuguuacccuccaggagauaggcggguauaugguaagacuugcgagugcgacgaucgccgaugugaagaccuggauggcguggucugcgggggacacggcacauguuccugcgguagaugugugugcgagagggggugguuuggcaaauugugucaacauccccggaagugcaacaugaccgaagaacagaguaaaaauuuaugugagucagcugacggaauacugugcagcggcaaggggucuugucacugcggaaaaugcaucuguuccgccgaagagugguacauuucaggugaguucugcgacugugaugaccgugauugcgacaagcaugauggccuaaucuguacggggaacggaauuugcagcuguggcaauugcgaguguugggacgguuggaacgggaaugcaugcgaaaucuggcucggcagugaguacccuuga

SEQ ID NO: 57861 - RNA, 2736 nt, Artificial Sequence
  derived and/or modified sequence opt3 from ITIH1__Homo_sapiens__NP_002206
auggacggcgccauggggcccagaggacugcuccuuugcauguaccuggugagcuuguuaauccugcaggcuaugccugcacuagguuccgccaccggcaggucuaagucaagugagaaacggcaagcggucgauacagcuguugacgggguguucauucgcagccucaagguaaacuguaaagugacuucccgauuugcccacuaugucgugacgucucagguugugaauaccgcaaacgaagcccgugaggucgcuuucgaucuggaaauaccaaagacagcauuuaucucggacuucgccgugacugcugauggaaaugccuuuauuggcgacaucaaagauaagguaaccgcguggaagcaguacagaaaagcagccauuucaggugagaacgcugggcuuguuagggccagcggacggacaauggaacaguucaccauccaucugacugugaauccgcaaaguaaggucacauuucaguugaccuaugaggaggugcucaaacgcaaccacaugcaguacgaaauagugaucaaggucaaacccaagcagcugguucaucacuucgagauugacguggauaucuuugaaccucaaggcauuuccaagcuggacgcacaggcuucuuuccucccaaaagaguuagccgcgcagacgaucaagaaauccuuuuccggcaagaaagggcauguacuguucagacccacugugucacagcaacagaguugcccuaccuguagcacaucucuuuugaauggacacuuuaaggucacuuaugauguguccagggacaaaauaugcgaucugcuaguugccaacaaucacuucgcacauuucuuugcuccacagaaccucaccaauaugaacaagaauguggucuucgugauugacaucucagguagcaugcggggccaaaagguaaaacagacaaaggaggcccugcuuaaaauucugggggacaugcagcccggagauuacuuugacuugguucucuucggcacccgcgugcagaguuggaaggguucucugguccaagcuagcgaagccaacuuacaggcagcccaggauuuugugcgaggguucagccuggacgaggcuacgaaucucaacggaggccuucugagaggcaucgaaaucuugaaccagguccaagagucgcuaccugaacugucuaaucacgcguccauucucauaaugcugacugauggggacccaacagagggagugaccgauaggucacagauccuuaaaaacguucggaaugcaauucguggucgcuuuccgcuguauaacuugggcuucgggcauaauguggacuuuaacuuccucgagguaaugaguauggaaaauaacggcagagcccagaggaucuacgaggaucacgacgcuacucagcaacugcagggauuuuacagccaggucgccaagcccuuacugguggauguugaccuacaguauccucaagacgcagugcucgcccugacacagaaucaccauaagcaguacuaugaagguuccgagauagucguggcugggcggauugccgauaacaaacaaucuagcuucaaggcagacguacaggcgcacggcgaaggacaggaguuuucaaucaccugucuuguggaugaggaagagaugaaaaaguugcugcgagaacgcggccauaugcucgagaaucacguugaaagacugugggcuuaccuuacgauccaggagcuguuggccaaaaggaugaaggucgaccgggaggaacgcgcaaaccucaguucccaagcccugcagaugagcuuagauuauggguucgugaccccacugacaucuaugucaauuagaggaauggcugaccaggauggucuaaagcccacuaucgacaaaccuagugaggauagcccaccccucgaaaugcugggcccgaggcguaccuucgugcuuuccgccuugcagccuucucccacacauucgagcuccaauacucaacggcugccagaccgagucaccgggguugauacagacccucacuuuauuauacacgugccccagaaggaggauacccucugcuucaacaucaaugaggaaccaggagugauucugucauuaguacaggaccccaacacuggcuuuagugucaacggucagcugaucgggaauaaagcaagaucuccuggccaacaugacggaacguacuucggcaggcuugggaucgcuaacccagccacagauuuucaguuggaggugaccccgcagaauauuacucucaaccccggauucgguggcccuguuuuuagcuggcgcgaccaagcggugcugcggcaggauggggucgugguuaccauaaauaagaaaagaaaccuagugguauccgucgacgauggaggcacauucgaaguggugcugcacagggucuggaaggguucaagcguucaucaggacuuucucggguucuaugugcuggauucucaccgcauguccgcccgaacccacggccuuuugggacaguuuuuccauccaaucggcuuugagguaagugacauucaccccgggagcgauccuacuaagccagacgcuacaauggugguccggaaucguagacugacggugaccaggggauuacaaaaagauuacucuaaggaccccuggcauggcgcagaaguuuccuguugguucauccacaacaauggugccgggcucauugauggagcuuacacugacuauaucgugccggacauauucuga

SEQ ID NO: 57862 - RNA, 2841 nt, Artificial Sequence
  derived and/or modified sequence opt3 from ITIH2__Homo_sapiens__NP_002207
augaagagacugaccugcuucuuuaucuguuucuuucucagcgagguguccggcuucgaaauucccauaaacgggcuuucugaguuugucgacuacgaagaucugguugaguuggccccuggaaaauuccaguuaguggcugaaaauaggcgguaucaacgcucacugccaggugagagugaggaaaugauggaggaaguagaccaggugacacuauacagcuauaagguccaguccacuaucacgucucgaauggcaaccacaaugauucagucgaaagugguuaacaauucaccgcaaccccagaacguggucuuugaugugcagaucccuaagggcgccuucauuagcaauuuuaguaugacuguagacgggaaaaccuuccguuccucuaucaaggagaagacaguuggcagagcgcucuacgcucaggccagggcaaaaggaaagaccgccggucuggugcggagcuccgcucuugauauggagaacuuucgcacugaagucaaugugcugccaggggcaaaagugcaauucgaguugcacuaucaggaagucaaguggagaaaacucggaucauacgagcauaggauauaucugcagcccggccggcuggccaagcaccucgaaguugacguguggguaaucgagccucagggcuuacgcuuucugcaugugccagauacauucgaggggcacuucgacggaguccccgugauuaguaagggucaacagaaagcucauguuagcuuuaagccuaccguggcccagcaacgaaucugcccaaacuguagagaaacggcggucgauggcgagcuugugguauuguacgacguuaaaagggaagagaaggcaggggaacuggagguguucaauggauacuuuguccacuucuuugccccggauaaccuagaccccauuccuaaaaauauccucuucgugauagaugucucuggcuccauguggggugugaagaugaaacagacuguugaggcuaugaagaccauucuggacgaccuucgggccgaagaucacuuuucagugaucgacuucaaccagaauauucguacauggcgcaacgaucugaucagcgcaacuaagacccagguagcugacgccaaaagauauaucgagaagauucaaccaagugggggaacaaauauaaacgaagcguugcucagggccaucuuuauucugaacgaggcaaauaacuuaggccugcucgaucccaauucugucucccuuaucauacuggugagcgacggcgauccuaccguuggggaauugaaacuaucgaagauucagaaaaacgugaaggagaauauccaggacaacaucucucuguucucccucggaauggguuuugaugucgacuacgauuuccugaagcggcuuucaaaugagaaccauggcauugcucagcgaaucuaugggaaucaagacacgaguagccagcugaaaaaguuuuacaaccagguguccacuccauugcuccgcaauguacaguucaacuauccccacacaucugugaccgacguuacucaaaauaacuuccauaauuacuuuggaggcagcgaaauugucguggccgguaaauucgauccggcuaagcuggaccagauagagucagugaucacagccaccagugcaaacacgcaguuaguccuggaaacccuagcccagauggaugaccuccaagauuuucuguccaaagacaagcacgcugauccugacuucacaagaaaacuuugggcguauuugacuauuaaccagcugcucgcagagaggagccuggcccccaccgcugccgcaaagcggcgcaucacaagaucuauccuucagaugucacuggaucaccauauuguuacuccauugaccagucucgugauagagaaugaagccggggacgagaggaugcuggcugaugccccuccccaagacccaagcugcuguuccggcgcauuauacuacggaucuaaggugguacccgauucgacaccuagcugggcgaacccauccccgacccccgucaucucaaugcuggcucagggcagucaggugcuagaaucuacuccuccaccccacguuaugcguguggagaaugacccucauuuuauuaucuaucucccaaaaagccagaagaacauuugcuucaauaucgacuccgaacccgggaaaauacugaaccuugucucagauccggagagcggaaucgugguuaauggucaauuggugggcgccaagaagccuaacaaugggaaacugucuacguacuuuggaaagcucggcuucuauuuucaguccgaggacauuaaaaucgaaauuaguacagagaccaucacucugagccacgguucuuccaccuucucauuaaguuggagcgauacagcacagguaaccaaccagcggguccaaauaucggugaagaaagaaaagguggucacuauuacacuggacaaagagauguccuuuucuguucuuuugcaucgaguguggaagaagcacccaguaaauguggauuuccucgggaucuacauucccccuacgaacaaauuuagccccaaggcccacggccugaucggacaguucaugcaggaaccaaaaauacauaucuucaaugagagaccuggcaaggaccccgagaaaccagaggcuucaauggaagucaaggggcagaagcuaauuaucaccaggggacugcaaaaagauuaucgcacugaccucguguuugguacagauguuaccuguugguucgugcacaacaguggcaagggguuuauugacggacauuacaaagauuauuucgucccgcagcuguacuccuuucuuaagcggccuuga

SEQ ID NO: 57863 - RNA, 2673 nt, Artificial Sequence
  derived and/or modified sequence opt3 from ITIH3__Homo_sapiens__NP_002208
auggccuucgcuugguggcccugccugauccucgcacuucugagcuccuuggccgcgucuggcuuuccuagaucaccauucagguuacuggggaagcggagucuaccggagggaguggcuaacgguauugaagucuacagcaccaaaauaaauuccaagguuacaucucgcuuugcccacaacgugguaacuaugcgagcagugaaucgugccgacacggcuaaagaggucucguucgauguggaacuccccaagaccgcauuuaucacaaacuucacucugaccauugacggcguuacauauccugggaaugugaaagagaaggaagucgccaagaaacaguacgagaaggcugugucacaaggaaaaaccgccggccuuguaaaggcgagcgguagaaaacuggagaaguuuacuguuagugugaacgucgcagccggguccaaggugacauucgaauugaccuaugaggaacuccugaaaaggcauaagggaaaauacgagauguaucugaaggugcagccaaaacagcucgucaagcacuuugagaucgaaguugauauuuucgagccccagggcaucucuauguuagacgcugaagccagcuuuauaacgaaugaucugcuuggcuccgcauugacuaaaucauucagugggaagaagggacaugugagcuuuaaaccuucucuggaccaacagcgguccuguccaaccugcacagauucacuacucaacggugacuucacuaucaccuacgauguaaaucgcgagagccccggcaacgugcagauugucaauggguauuucgugcacuuuuucgcuccucagggacugccaguugugccgaagaacgucgccuuugugaucgacauuaguggcucuauggcggguagaaaacuugaacaaacaaaggaggcccuguugaggauccucgaggauaugcaggaagaggacuaccugaauuucauauuauuuuccggggauguaagcaccuggaaagaacaucugguucaggcaacgcccgagaaccuccaggaagcucggacuuucgugaagucgauggaggacaagggaaugacaaauauuaacgacggccuucugcgcggcaucucuauguugaacaaagcccgagaggaacacaggauuccugagagauccaccucaaucgucaucaugcuaacugauggggacgcuaaugugggagaaagucggccagagaagauucaagaaaacguccguaaugccauagguggcaaauuuccccuguacaaccucggguucggaaauaaccugaauuauaacuuucuugagaauauggcacuggagaaccacggcuucgcccgcagaaucuacgaagauagcgacgcugauuugcagcuccaggguuuuuaugaggaaguggcgaauccucuguuaacagggguugagauggaguacccagaaaacgcaauucuggaccuaacccaaaauacguaucagcauuucuacgauggcuccgagaucgugguagccggaaggcucgucgacgaagauaugaacucuuuuaaggcugacgugaaaggccacggggccaccaaugaucugacauucacugaggaaguugacaugaaggagauggagaaggcacuucaggaacgggacuauauauucggaaacuacauugagcgauugugggccuaccugaccaucgaacagcuccuggagaaacgcaagaacgcucauggugaagagaaagagaaucuuacagccagagcacuggauuugagccucaaguaucacuuugugacuccccugaccucaauggucgugacaaaaccggaagacaacgaggaugaaagggcgaucgcugacaagccuggcgaggaugccgaagcaacccccguaaguccagccauguccuacuuaacuagcuaucaaccuccccagaauccauacuauuacguggacggggauccccacuucauuauccagauuccugagaaggacgaugcucuguguuuuaacauagacgaggccccaggaacgguucuacggcucauccaggaugcagucacaggccugaccgugaauggucaaauuacuggggacaaacgcggcucuccggauucaaagaccagaaaaacauauuucggaaaguuaggcaucgcuaacgcccagauggacuuucagguggaagucaccacugagaaaaucacauuguggaauagggcgguucccaguacguucagcuggcuggacaccgugacugugacacaggaugggcucuccaugaugauuaaccguaagaauaugguagucucuuuuggagacggugugaccuucguugugguccugcaucaaguguggaaaaagcacccuguucaucgggauuuucuuggcuucuacgugguagacucgcaccgaaugagcgcccagacacaugggcugcuuggacaguuuuuccagccauuugauuucaaggucuccgacauaagacccggcucagauccuacuaaaccagacgcuaccuugguggugaagaaccaccaacucaucgucacgagggguagucagaaagauuaccgcaaggacgcaucuauugggaccaaaguugugugcugguucguacacaauaacggcgaaggacugaucgauggcgugcauacagacuauauuguccccaaucuauuuuga

SEQ ID NO: 57864 - RNA, 2703 nt, Artificial Sequence
  derived and/or modified sequence opt3 from ITIH4__Homo_sapiens__NP_001159921
augaagcccccuagaccagugaggaccugcagcaaaguccugguucuccuuucccuguuggccauccaccagacaacuacggcugagaagaacggcauugacauauacucuuuaaccguggauucacggguaaguagccgcuucgcacauacaguggucacuucccgagugguuaaucgugccaacaccgugcaagaagcgacauuucagauggagcugccgaaaaaggcuuucaucaccaauuuuucuaugauuaucgacgggaugacuuaucccggaauuaucaaagaaaaggccgaggcacaggcccaguacucggcugcagucgccaaggguaaaucagcuggccuagugaaggccacagggagaaacauggaacaauuccagguaagcguuaguguggcgccuaaugcaaaaauaaccuuugagcucgucuaugaggaacugcuuaagaggcggcugggaguguacgaguugcuccugaaagugcgcccacagcagcuggucaagcaccuccaaauggauauccauauuuucgaaccccagggcaucuccuuuuuagagacggagucuacuuucaugaccaaccagcugguugacgcccuuacaacuuggcagaauaagaccaaagcucacauuagauuuaagccuacauugagccaacagcagaaauccccagaacaacaggagaccgugcuggaugguaaccuaaucauaagguaugacguagaucgggccauuucagggggaaguauccagauugaaaauggcuacuucgugcauuauuuugcacccgagggccucacgacuaugccuaagaacgucguguucguuaucgacaaaagcgggucuauguccggacgcaagauccagcaaacacgagaagcucugauuaaaauacuugaugaccugucaccaagagaucaguuuaauuugaucguguucagcaccgaggccacucaguggaggccgagucucguccccgcgucugccgagaacgugaauaaggcacgguccuucgcugccgguauucaggcucugggcgggacaaacaucaaugacgccauguuaauggcaguacaacugcucgauagcucgaaccaggaggaacgucuuccugaaggaucuguuucccugauaauuuugcuaaccgacggcgacccaacggugggugagaccaacccccgcucaauccagaauaacgucagagaagccgugagugggagguacagccuguuuugucucggauucggcuuugaugucuccuacgcuuuccuggagaaacuugcgcuggacaauggcggguuggcacggcgaauccacgaggauucugacagcgcccuccagcugcaagauuuuuaucaggaaguggcuaacccuuuacugacagccguuacuuucgaguacccaucaaaugcaguggaagagguaacccagaacaauuuucgccuacucuucaagggaagugaaauggucguggccgguaagcugcaggacagaggccccgauguucuuacagcuacuguguccgggaaauugccgacccaaaacauuacauuucagaccgagagcucugucgccgagcaggaagcagaguuccaaucaccuaaguauaucuuucacaauuucauggaaaggcugugggcguaccucacuauucagcagcugcuugagcagacggugagugcuagcgacgccgaucaacaggcacugcggaaccaggccuugaaucucucccuggcuuauucuuuuguaacacccuuaaccucgauggugguuacuaaaccagacgaucaggagcaaagccaggucgccgaaaagccuauggagggagaaucccgcaacagaaaugugcauucagcaggcgcugccgguaguaggaugaacuuccgucccggggugcugucuagccggcagcuaggccucccaggacccccugacgucccagaccacgcggccuaccauccguuccgaagacuggcuauacuucccgcauccgccccuccagcuaccucaaaucccgauccugccguuagcagggugaugaacaugaagaucgaggaaacaaccaugacuacacagacgccagcacccauucaagcgccgucugccaucuugccucugccaggccaguccguggagcgccucugcguagacccccggcacagacaggggccugucaaccuguuaagugaucccgagcaaggaguggaaguuaccggucaguaugagagggaaaaagcuggcuuuagcuggaucgaggugacuuucaagaauccacuggucugggugcacgccucuccugaacauguugugguaacacgcaaccgacgguccucagcauacaaauggaaggagacccuuuuuagugucaugcccggguugaaaaugacaauggacaagacuggacuccugcuacugagcgauccagacaaggugaccauuggccuccuguucugggauggucguggggagggccuuagauugcuguuaagggacacggaucgcuuuucgucccacgugggaggcacccucgggcaguucuaccaggaaguccuguggggaucuccggcugccagcgacgauggucggagaacacuuaggguucaaggcaaugaccauucagcaacucgagagcgccggcuggauuaucaggaagggccucccggaguggagauaaguuguugguccguagaauuguga

SEQ ID NO: 57865 - RNA, 2109 nt, Artificial Sequence
  derived and/or modified sequence opt3 from ITIH5__Homo_sapiens__NP_001001851
augcugcuccuucugggcuugugcuuagggcugagccuaugugugggaucccaggaggaagcccaaucuuggggucacucaagugagcaggacggccucagaguccccaggcagguucggcugcuucagcgccugaagaccaaaccuuugaugacagaguucagcgugaaguccacuaucauuucucgauacgcuuuuacgaccguaucgugccguaugcucaacagagcaucagaggaucaagacauagaguuccagaugcagaucccagccgcggcuuuuauuacaaauuucacuaugcugaucggggauaaaguguaucagggagaaauuaccgagagggaaaagaaaagcggcgaccgggucaaggagaagcgcaacaaaacaaccgaagagaauggugagaaggggacugaaaucuuuagagccagugcagugauaccguccaaagauaaggccgcuuucuuucugucuuacgaggaacucuuacaaaggcggcugggaaaauaugagcauagcaucuccguucgcccccagcagcuuucaggccgauugaguguggacgucaacauucuggaaagcgcaggcaucgccucucuagaggugcucccucugcacaauuccagacagagggggucaggacggggugaggaugacagcggcccacccccuaguacaguaauuaaccaaaaugaaaccuucgcuaacaucauauuuaagccaacgguugugcagcaggcccguauugcgcaaaaugggauccuuggagauuucauuauccgcuacgacgucaacagagagcagucuaucggcgauauucaggugcugaaugguuauuuugugcauuacuucgcacccaaggacuugccuccacucccgaaaaacgucguuuuugugcuggauuccagcgccucgaugguagggacuaaguuaaggcagaccaaagacgcucuguucacaauacuccacgaccuucggccccaagaucgauucucuaucauuggauuuuccaaucgcaucaagguguggaaagaccaucugauaucagucacuccugauaguauuagagacggcaagguguauauccaccacaugagcccaaccggcgggacagauaucaacggagccuugcagagggcaauucggcuacugaauaaauacguugcucauuccgguaucggcgaccgcucugugagccucauugucuuccugaccgaugggaagcccacggugggagaaacucacacacuuaagauacugaacaacaccagagaggccgcgaggggccagguauguaucuuuacuauugguaucgggaaugacguugauuuccguuugcucgaaaaacugucauuagagaacugcggccugacacggcgagugcaugaggaagaggacgccggaagucagcuaaucggcuuuuacgaugaaauuagaaccccucuccuguccgacauaaggaucgacuauccacccagcucugucgugcaagcaacgaagacccuuuucccgaauuacuuuaacgggucagagauuaucauugcuggaaaauuggucgaucgcaagcuggaccaccuccacguggaaguuacagccaguaauagcaaaaaguucaucauacugaagacugaugugccuguacggccccagaaagcugguaaggacgucaccggcuccccaagaccugggggagauggcgagggugacacaaaccauaucgagaggcuuuggucuuaucugacuaccaaagaauugcucucgagcuggcugcaguccgaugacgagcccgaaaaggagcgcuuacgacagcgggcccaagcacuggccgugucauaccguuuucuaacaccauucaccaguaugaaacucagagggcccguuccuaggauggauggccuggaggaagcucacggaaugucugcggcaaugggcccagagccggugguccagagcgugcgcggggccggaacucagcccgguccucuuuugaagaagccauaucagccccggauuaaaaucuccaagacgucaguaagaggcuuuaggcgagaagaacaaauuuucagcaaugugaugaaauuuccuuucgcuucuauccuggaacucuga

SEQ ID NO: 57866 - RNA, 1863 nt, Artificial Sequence
  derived and/or modified sequence opt3 from ITK__Homo_sapiens__NP_005537
augaacaauuucauccugcucgaggaacagcuuauuaagaaaagccaacagaagagaaggaccucccccucuaacuuuaaagugcgguucuuuguccugacaaaggccucauuggcuuacuucgaggaccgccacggcaaaaagcgaacuuuaaaggggaguauagaacugagccguaucaaaugcguugagauugugaaguccgauaucucuauuccuugucauuauaaauacccauuucagguagugcacgacaauuaucuacucuacgucuucgcaccggauagagaaucgaggcagcggugggugcuggcccuuaaggaggagacgcgcaacaauaacucacugguucccaaauaucauccuaauuuuuggauggacggaaaguggagaugcuguagccaauuggaaaagcucgcgaccgguugcgcucaguacgauccaacuaaaaacgccaguaagaaaccccugccuccaacacccgaggacaauaggcggccucugugggaaccagaggagaccguggucaucgcacucuaugauuaccagacaaacgacccgcaggaauuagcccugcgccgaaaugaggaauacugucuuuuggauuccucugagauacacugguggagagugcaagacaggaacggccaugaaggguauguacccagcuccuaccugguugagaagucaccuaauaaccuagagaccuaugaaugguacaauaaaaguaucagccgggauaaggcugagaaacuccugcuugacacuggaaaggaaggcgcauucauggugcgugauucucgcacagccgguaccuauacggucuccguguuuacuaaggcuguggucucagagaacaacccaugcauuaaacacuaccacaucaaggaaaccaaugacaaccccaaaagauauuacguugccgagaaguacguguucgacagcauuccucuguugaucaauuaucaucagcacaacgggggaggccucguaacaaggcugcgguacccaguguguuuuggccgacagaaagcgcccgucacugcaggguuacgcuauggaaagugggugauagauccgagugagcugaccuucguucaggaaauugguucuggccaauuugggcucgugcaucuuggauacuggcugaauaaggacaaagucgccaucaagacaauuagagagggcgcuauguccgaagaggauuucaucgaagaggccgaggugaugaugaaauugagccacccuaagcuaguacagcuguaugguguuugccucgaacaggcacccaucugucugguguucgaguuuauggaacacgggugccuuucggacuaccugaggacccaacggggauuguucgcugccgagacgcuccugggcauguguuuagaugucugcgagggcauggcguaucuggaagaggccugcgugauucaucgcgaccuagcagcuagaaacugucucgucggggaaaaucaggugauaaaaguuucugauuuuggaaugacuagguucgugcuggacgaucaguacacauccucaaccgguacuaaguuuccaguaaagugggccaguccugaggucuucagcuuuucccguuacucuagcaaaucagacguguggaguuucggcguucuuaugugggaaguguuuuccgaggggaagauccccuaugagaaccggagcaauucugaagucguggaggauauuucaacaggauuccgauuguacaaaccaagacuggcuaguacccacguauaucagaucaugaaccauugcuggaaggaaaggcccgaggaccgcccugccuuuagccggcuccugagacaacuugcagaaauagccgaguccggccuguga

SEQ ID NO: 57867 - RNA, 942 nt, Artificial Sequence
  derived and/or modified sequence opt3 from ITLN1__Homo_sapiens__NP_060095
augaaccagcugagcuuccuccuuuuucugaucgccaccacaagaggcugguccacugacgaggcuaauacguacuucaaggaauggaccuguucuucaagucccagcuugccuagguccugcaaagagauuaaggaugaaugcccaucugcauuugacggguuauauuuccugcggacagagaacggagugauauaccaaacuuuuugugauaugaccucggguggcgggggauggacacuggucgccucaguucacgaaaaugacaugcgcggcaaaugcaccgugggugaucgauggagcagucagcagggguccaaggcgguauauccggagggagacggcaacugggcuaauuacaacacuuucggcucugccgaggcagccacaagcgaugacuauaaaaaucccggguacuaugauauccaggcuaaggaccucggaauuuggcaugugccuaacaaguccccaaugcaacacuggcguaauucaagucugcuuagauacaggaccgauacggguuuucugcagacuuugggccauaaccucuucgggaucuaccagaaauaucccgucaaguacggagaaggcaaauguuggaccgacaaugguccugugauuccaguuguguaugauuuuggggacgcacagaagacagccagcuacuauucucccuacggacaacgggaguucacugcuggcuuuguccaguuccgcguguuuaacaaugaaagagccgcgaacgcacugugcgccggcaugaggguaaccggguguaauacagagcaccauugcaucggagguggcggguauuucccugaggcuuccccacagcaguguggagacuucucaggcuuugauuggagcgguuacgggacccacguuggcuacaguucuucccgggaaauaacggaggccgcagugcuacucuucuaucgcuga

SEQ ID NO: 57868 - RNA, 978 nt, Artificial Sequence
  derived and/or modified sequence opt3 from ITLN2__Homo_sapiens__XP_011507512
augcugagcaugcucagaaccaugacaaggcuuugcuuccuguuguuuuucuccguggccacuucuggcuguucagcugcagccgcgaguagcuuagagaugcugucccgggaauuugagacgugcgcuuucucuuuuucgucacuaccccgcagcuguaaggaaaucaaagagcgaugccacagugccggggacggacucuacuuccugcguaccaagaacggugucguuuaucagacauuuugugauaugacuuccggcgggggaggcuggacccuuguggcaucuguacaugaaaaugacaugagagguaaaugcacagugggggauagguggagcucccaacagggaaacaaggccgacuacccugagggcgauggcaauugggcuaacuauaauaccuucgggucagcagaggccgcuacaagugacgauuacaaaaacccaggauauuacgacauucaggccaaggaucuggguauauggcacgucccgaauaagagccccaugcagcauuggcggaacucugcguugcuccgcuauagaacuaauaccggcuuucugcaaaggcuggggcacaaccucuucggaaucuaccagaaauacccugugaaguaucgguccggcaaauguuggaaugacaacgguccagcaauucccguuguguacgauuuuggggacgccaagaaaacggcuucauauuacagcccuuauggacagcgcgaauuugucgccggcuuugugcaguuccgaguauucaauaacgagagagcagcuaaugccuuaugcgcgggcaucaagguuacuggguguaacaccgaacaucacugcauuggagguggcggguuuuucccacaaggaaagcccaggcaguguggcgauuuuagugccuucgacugggacgguuacgggacacacgugaaaucuuccugcagccgggagaucacugaggcagcuguccugcuuuucuaucguuga

SEQ ID NO: 57869 - RNA, 660 nt, Artificial Sequence
  derived and/or modified sequence opt3 from ITM2A__Homo_sapiens__NP_001165052
auggugaagaucgccuucaacacccccacagcuguccagaaagaggaagcaagacaagacguugaggcccugcucagcaggacugugcggacgcagauucuuaccggcaaguccacaauauaccgcggggaaaugugcuuuuucgauucugaggacccugcuaauucacugcgaggaggugaaccaaacuuuuugccgguaacugaggaggcggauauccgugaagacgauaauauugccaucauugacgugcccgucccuaguuucagcgauuccgacccagcagccaucauacacgauuuugagaaaggcaugaccgcuuauuuagaccugcuacucgggaacuguuaccugaugccccuuaauacaucuaucgugaugccuccaaagaaccugguugaauuguucggaaaacucgcaucgggcagauaucugccccagaccuacguggucagggaggaucugguggccguagaggaaauucgggacguuucaaaucucgguaucuuuauuuaucaguuaugcaacaaucgcaagagcuucagacugaggcggcgcgaucuuuugcugggguuuaacaagcgagcuaucgacaaauguuggaagauaagacauuucccuaaugaguuuauuguggaaacuaaaaucugccaagaguga

SEQ ID NO: 57870 - RNA, 801 nt, Artificial Sequence
  derived and/or modified sequence opt3 from ITM2B__Homo_sapiens__NP_068839
auggugaaggucaccuucaacagcgcccuggcucagaaagaggcaaagaaagacgaacccaaguccggcgaggaagcccucaucauuccuccagaugcgguugcuguggacugcaaagauccggacgauguagugcccgucgggcaaagaagggccugguguuggugcauguguuuuggacuugcauucaugcuggccggugugauauugggcggggcuuacuuauauaaguacuuugcacugcagccugacgauguuuauuacugcggaaucaaguauauuaaagacgaugugauccuaaaugagccaucugccgacgcucccgccgcgcucuaccagacaauugaagagaacaucaagauauucgaggaagaggaagucgaguuuaucucagugccuguaccagaguucgcagauagugaccccgccaauauuguucacgauuuuaacaaaaagcugacugcuuaucuugaccugaauuuggacaaauguuacgugaucccucucaacacgagcauugucaugccaccgcggaaucugcuggaacucuuaaucaacauaaaggccggcaccuaccugccccaguccuaucuuauucaugagcacauggugaucacagaucgcauugaaaauaucgaccauuuggguuucuuuaucuaccgacugugccacgauaaggagacuuauaaacuacaacguagagaaaccauuaaggggauacagaaaagggaggcaucuaacuguuucgcuauccggcauuuugagaauaaguucgccguggaaacacucauuugcucguga

SEQ ID NO: 57871 - RNA, 663 nt, Artificial Sequence
  derived and/or modified sequence opt3 from ITM2C__Homo_sapiens__NP_001012532
auggugaagaucagcuuccagcccgccgucgcuggcauuaaaggggacaaggcagauaaagccuccgcgucugcuccugccccagcaucagccaccgagauacugcucacaccggcuagacuugcaagggacaacuuuuuccggugcggaguucuguacgaagauaguuugagcucccaagugcgcacucagauggaguuagaagaggacguaaagaucuaucuggaugaaaauuacgagcgaauuaacgugcccgucccucaguuugguggcggggacccagccgauaucauucacgacuuccagcguggacuaacggcuuaucaugauaucucucucgacaaauguuacgugauagagcugaauaccacaaucguucuucccccuagaaacuuuugggaacuguugaugaaugugaagaggggcacuuaucucccacaaaccuacauuauccaggaggaaauggucgugacagagcacguaucggauaaggaggcccuggguucauucauuuaucaucugugcaacgggaaagacaccuaccggcuccgcagaagggcgacucggcgccgaaucaauaagagaggagccaaaaacuguaaugcaauaaggcacuuugaaaacacauucguuguggagaccuuaauuugcggcgucguguga

SEQ ID NO: 57872 - RNA, 462 nt, Artificial Sequence
  derived and/or modified sequence opt3 from ITPA__Homo_sapiens__NP_001254552
auggccgcuagccuggugggcaagaaaaucgucuucguuaccgggaacgcaaagaaacucgaggaagugcagggacccguacuuguggaggacacaugccuguguuuuaaugccuuggguggcuuaccugggccauacauuaagugguuccuggaaaaacuaaagccggagggacuccaccaacugcuugcgggcuuugaagauaaguccgcuuaugcccugugcacuuucgcauugucuacgggugaccccucacagccugucagacucuuuagggggcggaccaguggacgcauaguggccccacgaggcugucaggauuucggcugggaccccugcuuucagccugauggguacgagcaaacauaugcugagaugccaaaagcagaaaagaacgccguuagccaucguuucagagcucugcuggagcuccaggaauacuuuggauccuuagccgcguga

SEQ ID NO: 57873 - RNA, 1245 nt, Artificial Sequence
  derived and/or modified sequence opt3 from ITPK1__Homo_sapiens__NP_001136065
augcagaccuuccugaagggcaaaagagugggguacuggcucagcgagaagaaaaucaagaaacuuaacuuucaagccuucgcugaacugugcaggaagcggggaauggaggucguucaguugaauuuaucccgccccauugaagaacaggguccucuggacgugauaauccacaagcuaacagauguaauucucgaagcagaccagaacgauucucaaucacuggagcuugugcaucgauuucaggaguauaucgacgcccacccagaaacuauuguccuggauccguugcccgcgauccguacgcuccuggacagaaguaaaagcuacgagcugauaaggaagaucgaggcuuauauggaggaugaccggauuuguuccccuccauucauggagcucaccucuuuaugcggcgaugacacaaugcgccugcuugagaaaaauggguugacuuuucccuucaucuguaagaccagaguggcccauggaacaaacucgcacgaaauggcaauuguuuuuaaucaggaaggccugaacgccauccagccuccaugcgugguccaaaauuucauaaaccauaaugcugugcuauacaaaguauuuguugugggugagucauauaccgucgugcagaggcccagccucaagaacuucagugcagggacuuccgaucgggaaucuaucuuuuucaauagccacaacguguccaagccugagucaaguagcguccugacagagcuugacaaaauugaaggaguuuuugagcgcccaucugaugaagugauucgagagcuguccagagccuugaggcaggcucucggcguaucacuguucggcaucgacaucauuauaaauaaccagaccgggcaacacgccgugaucgacauuaaugcguucccgggauacgaaggugucagcgaguuuuucacggauuuacugaaccauaucgcaacugugcuccagggccagaguaccgccauggcugccacaggggacguugcacuucugcggcacucuaaguugcuagcugagcccgccggaggccuggugggugaacguacuuguuccgcgagcccugggugcuguggaucgaugaugggccaagaugccccauggaaagcagaggcugacgccggcgggaccgcuaagcucccccaucagcgccugggaugcaacgccggugucucuccuuccuuucagcagcacuguguggcaucacuugccacaaaagcuaguagccaauga

SEQ ID NO: 57874 - RNA, 1386 nt, Artificial Sequence
  derived and/or modified sequence opt3 from ITPKA__Homo_sapiens__NP_002211
augacccugcccggcgggccuacaggaauggccagaccagguggcgcuaggccgugcagccccgggcucgagcgggcaccucgccgauccgugggagaacuucgucuguuguucgaggccagaugugcggcugucgccgcagccgcugcagccggcgaaccaagggcucggggugccaagcgcagagggggacagguucccaacggcuuaccuagggcgccacccgcaccugugaucccacaacugacuguaacggccgaggaaccggacgugcccccuaccucuccagggcccccugagcgggagcgcgauugccuaccagcugccggcucaagucaccuccagcagccccgaagacugagcacauccucugucucgucaacuggaagcaguucccuucuggaagacucugaggaugacuugcucagcgauuccgaaucaaggagucgggguaaugugcagcuggaggcaggcgaggacguugggcagaaaaaccauuggcaaaagauucguaccauggugaaucugccggucauaagcccuuuuaaaaagcgcuacgcuugggugcagcucgccggacacacaggcucuuucaaagcggccgguaccuccggguuaauccugaagagauguucagaacccgagagguauugccuugcacgguugauggcugaugcccugcgaggauguguaccagcuuuucauggcguuguggaacgcgacggcgagagcuaccuacagcuccaagaucugcuugacggguucgauggaccuugcguccuggacuguaagaugggugugagaacuuauuuggaagaggagcucacaaaagccagggaacggcccaagcugcgcaaagauauguacaagaaaauguuagcaguggacccagaggcccccaccgaagaggaacacgcucagagagcggucacgaagccuagguauaugcaguggcgugagggcauuaguucuuccacuacccugggguuucggaucgagggaauuaagaaagcagacggcagcugcucgacagauuucaagacuacccgaucuagagaacagguucucaggguguuugaggaguucguacaaggugacgaagaagugcuucgccgguaccugaacagauugcagcagaucagggauacacuagaggucuccgaguuuuuccgccgacaugaagugauagggucaagucugcucuuuguucacgaccacugucaucgggccggcguguggcugaucgauuucggaaaaaccacgccacuuccggacggccaaauucuggaucaccguagacccugggaggaagggaauagggaggacggauauuugcucggucuggauaacuuaaucggcauucuggcuagccuagccgagcgcuga

SEQ ID NO: 57875 - RNA, 2052 nt, Artificial Sequence
  derived and/or modified sequence opt3 from ITPKC__Homo_sapiens__XP_006723467
augagaaggugccccugucggggcagccugaacgaggccgaagcuggggcacucccugccgcggcucgcaugggacuugaggccccacgagguggccguagaaggcagccggggcaacagcggcccggaccuggcgccggugcaccagcugggcgccccgaaggaggcggcccuugggcaagaaccgagggguccucucugcacucagaaccagagagggccggauugggucccgcuccuggcacagagaguccacaggccgaguucuggacugacgggcagacggaaccggcggcagccggauuaggcguggaaaccgagcggcccaagcagaaaacagagccugaucgcagcucccugcgaacucaucuagaauggucuuggucggagcucgaaaccacaugccuguggaccgagacugguacagacgggcuuuggaccgauccacacagaucagaccugcaauuucagcccgaagaggcuagcccuuggacgcagccaggaguccauggccccuggacugaguuggaaacccacggcagucaaacacagccggagaggguuaaguccugggccgauaaucucuggacucaucagaacucuagcucccugcagacccacccugaaggggcaugucccucaaaagagccaagugcugacggaagcuggaaggaacuguacacagaugguucucggacccaacaggacaucgagggcccuuggacggagcccuauacugaugggucccagaaaaagcaagacacagaagccgcgcguaagcagccaggaaccggcgguuuccagauucagcaagauacugacgggucauggacacagcccagcaccgauggcagucagacggccccuggaaccgacugccucuuaggcgagccagaagacgggccgcuggaggaacccgagccuggagagcuuuugacacaccuguacucucaucuaaaauguuccccacucugccccgugccucgccugauaaucacuccagaaacccccgagccggaagcacagccuguagguccacccagcagaguggagggcgggucgggaggcuuuucuuccgcuucaaguuucgaugagagcgaagacgaugucguggccggugggggcggagcuuccgacccugaggauaggucuggcagcaagcccuggaaaaagcuaaaaacaguucugaaguauucaccauuuguggucaguuuccggaagcacuacccuugggugcaauuguccgggcaugccggaaauuuucaggccggugaagacggccgcauucucaaacgauucugucagugcgagcagagaagccuggaacaauuaaugaaggauccccugaggccauuuguaccggcauauuacgggaugguucuccaggacggacagacuuucaaccagauggaggaucuucuggcugacuuugagggcccuucuaucauggauuguaaaauggguucacggaccuauuuggaagaggaacuugugaaggcgcgcgagagacccaggccacguaaagacauguacgaaaagauggucgcaguggaccccggggccccuacaccagaggagcacgcucaaggcgccgugaccaaaccccgguacaugcaguggcgagaaacuaugaguagcacguccacacugggauucagaauugagggcaucaagaaggcagaugggaccugcaauacuaacuuuaaaaagacccaggcccucgaacaagucacaaaaguucuggaggacuucguggauggagaccacguaauacuucagaaguauguggcuugucuggaagaguugagggaggcccucgaaaucucuccuuucuuuaaaacccaugaggucgugggcucgagccuguuauucguucacgaucauacuggucuggcaaagguguggaugauugacuuugggaagacagucgcgcuaccggaucaccagacgcucucccaucgccugccaugggcugaaggaaaucgggaggacggcuaccuuugggguuuggauaacaugaucugccugcuccagggccuggcccaaucauga

SEQ ID NO: 57876 - RNA, 8133 nt, Artificial Sequence
  derived and/or modified sequence opt3 from ITPR1__Homo_sapiens__NP_001093422
augagcgacaagauguccucuuuccugcacaucggcgauauuugcucacucuacgccgaggggaguaccaacggauuuauaagcacacuuggucugguggacgauagaugugucguucagcccgaaacuggcgacuugaauaacccuccaaaaaaguucagggauugcuuauuuaaacuguguccgaugaaucgguauuccgcucaaaagcaguucuggaaagcagccaagcccggggcgaacucuacgaccgacgcugugcuacucaauaagcugcaucacgccgcagaucuugagaaaaagcagaacgaaacagagaaucgcaaacuguugggaacuguaauccaguacggcaacgugauucaacuccugcaucugaagucgaauaaauaucucaccgucaacaagcgauuaccugcccugcuugaaaagaaugcuaugcgugugacauuggacgaggcagguaacgaggggucaugguuuuacauccagccauucuauaaacugagaagcauuggagauaguguugugaucggcgacaaggucgugcuaaaucccguaaacgccggccagccucuccacgcuuccucucaucagcugguugauaauccagggugcaacgaagugaacagcgucaauuguaacaccuccuggaaaauagugcuuuuuaugaaguggucagacaauaaagaugacauccugaagggaggugacguggucagguuguuccacgccgagcaagaaaaauuucucacuugcgaugagcaccggaagaagcagcauguuuuccugcgcacaaccggcagacagagugcgacgagcgcaacuucuuccaaagccuuaugggagguggaaguagugcagcacgaccccuguagggggggagcuggcuacuggaacucacuguuucgguucaagcaucucgccaccggucacuaucuugcagcugaggucgauccugacuuugaagaggaaugccuggaguuccaaccaagcguggauccggaccaggaugccagucgcucucgauugagaaaugcgcaggagaaaaugguuuacucccuagugagcguccccgaagggaacgacauuucgucuaucuucgagcuggauccuacaacucucaggggaggcgacucccuggugccacggaauucauacguacgucuucgccaccuguguaccaacacauggguucauaguaccaauauucccaucgauaaggaagaggaaaaaccugugauguugaagauaggcacgagcccagucaaggaggacaaagaggccuuugcaauugugcccgucuccccggcugaagugagagaccucgauuucgccaacgacgcuucuaagguucuggggagcaucgccggaaaauuagagaaggguacuauuacacaaaaugaaaggcggucagugaccaaacugcuagaggaucucguauauuuugucacuggcgggacaaacaguggacaggacgugcuggaaguuguguucuccaagccuaaucgagagcgccagaagcuuaugagagagcagaacaucuugaaacaaaucuuuaagcugcuccaggcacccuucaccgauugcggcgacgguccaaugcugaggcuugaagagcugggggaucagcggcacgccccuuuucgccauauuuguagauugugcuacaggguccuccgucacagccagcaagacuaucggaaaaaucaggaauacauagcuaagcaguucggcuuuaugcagaaacaaaucggauaugaugugcuggcggaggacacgauuaccgcauuacugcauaacaaccgaaagcuacucgagaagcacaucacagccgcugaaauagauacuuucguaucucuggugagaaaaaauagggagccccgcuuucuugacuacuugucagaucugugcguuaguaugaacaagagcauuccagucacccaggaacucaucuguaaagccgugcugaaucccacaaacgcagacaucuuaauugagacuaagcuggugcuuucccgguucgaauuugagggcgucucuucgaccggggagaaugccuuggaagcuggagaggacgaagaggaaguuuggcucuucuggagagauagcaacaaagagaucagguccaagucagugcgcgagcuggcccaggacgcaaaagaaggucagaaggaggaucgagacgugcuaaguuauuaccgguaccaacugaaucucuucgcgcguaugugccuggauagacaguaucuugcuauuaacgaaauaucuggccaguuggacguagaucugaucuuaagguguaugagcgacgagaaucucccuuacgaucugcgcgccuccuuuugccggcuuaugcugcacaugcaugucgacagagauccacaagaacaggugacaccgguuaaguaugcaagguuguggucagagauucccagcgagaucgccaucgacgauuacgacucuuccggggcuaguaaagacgaaauuaaggagcgauucgcccagaccauggaauuuguggaggaguaucuccgcgaugucgugugucagcgguucccuuuuagcgacaaagaaaagaacaaacugacuuucgagguugugaaucuagcaagaaaccugauauacuuuggauucuauaauuuuucugaucuccugaggcuuacgaagaucuugcuggcuauuuuagacugcguacacgucacaaccaucuucccaauuuccaagauggccaaaggcgaagagaacaaggguucaaaugugaugcguaguauccauggggugggcgaacucaugacucaagucguucugcgcggaggcggguuucuucccaugaccccuauggcggccgcuccagagggaaacgugaaacaggcagagcccgaaaaggaggauauaaugguaauggacacaaaacugaagaucauugaaauccuacaguucauucucaacgugcggcuggauuacagaaucagcuguuugcugugcauauuuaagagggaguucgacgaaucgaauucccagaccucugagacuagcucagguaacaguucccaagagggcccgucuaaugucccuggggccuuagauuucgaacacauugaggaacaggcugagggaaucuuuggcgguagcgaagagaacacaccacucgaccuggaugaccacgggggccgaacguuccuucgggugcuguugcaucucaccaugcacgacuaccccccucugguuuccggagcccuacagcugcuuuuucgccauuucucacagagacaagaggugcuccaggcauuuaaacagguccaacuguuggugacuagccaggauguugacaauuauaagcagauuaaacaggaucuggaccaauuaaggaguaucguggaaaagucugagcucugggucuacaaaggccaggggcccgaugaaacaauggacggagcguccggcgagaacgagcacaagaagaccgaagaggguaauaacaaaccacagaagcaugaaagcacaucgucauauaauuaccggguagugaaagagauacugauccgacuuucuaagcuguguguucaggaaagugccuccgugagaaaaagccgcaagcaacagcagagguugcuccguaacaugggggcucacgccgucgugcuggagcuacugcagauuccuuaugagaaagcagaagauacuaagaugcaagagaucaugcggcuugcucacgaauuccuccagaauuuuugcgccggaaaccagcagaaucaagcacuguugcauaagcacauuaacuuauuccugaaucccggcauccucgaggccguaaccaugcagcauauauuuaugaacaacuuccagcuguguucugaaauuaaugagagagugguccaacacuuuguucauugcaucgagacgcacgguaggaacgugcaguacaucaaauuccuucagaccauugugaaggcugaaggcaaauucaucaagaaaugccaggacauggucauggcggagcuggugaauagcggggaagauguuuugguauuuuauaacgaccgcgccuccuuccaaacacuaauucagaugaugcgaucagagagagaucggauggacgaaaauaguccacugauguaccacauacaucucguggagcugcuugcagucuguacugagggaaagaacguguacaccgaaaucaagugcaauagcuuacugccgcucgaugacauuguuaggguggucacacacgaggacuguaucccugaagugaaaauugcuuauaucaacuuuuugaaucauugcuacguagauacugaggucgagaugaaggaaauauauaccucuaaccacauguggaaacuguucgagaauuuucucguggacaucugucgcgccugcaacaauacguccgaucguaagcacgccgacucaauucuggaaaaauacguuacagagaucgugaugaguauugucaccacuuucuuuagcucccccuucucugaucagucgacaacccuucagacuagacaaccaguguuuguucagcuguugcagggcguguuccgggucuaucauuguaacuggcuaaugcccagccagaaggcuucaguggaauccugcaucaggguacugagugacguggcaaagucucgcgccauagcgauuccuguugaucucgacagccaagucaauaacuuauuucugaaaucccacucaaucgugcagaagaccgcuaugaauuggcgacuuucugccagaaacgcagcccggagggauagcgugcuggcugcaagucgcgacuacagaaacaucauugagaggcuccaggauauagucuccgccuuggaggaccggcugcguccacucguacaagcggaacugagcgugcuuguugaugugcuacaucgccccgagcuguuguucccugaaaauacagacgcucgaagaaaaugugagucugggggauuuaucugcaaguuaauuaaacacacgaagcagcugcucgaagagaacgaggaaaagcuguguaucaaaguccuucagacccugagggagaugaugacuaaggaccggggcuauggugaaaaaggggaggcccuccgccagguguugguuaauagauacuacggaaacgugaggccgucaggccggcgagaaucccugacaaguuucgguaauggcccacuaagcgcagggggacccggcaagccugggggaggcggugggggaucgggcucuuccagcaugucaagaggugagaugagucuggccgagguccaaugccaucucgauaaagaaggcgcuucuaaccuugugauugaccugaucaugaaugccuccagcgaucgcguauuccacgagucaauauuauuggcaaucgcucugcucgaagggggaaacaccacaauucagcacaguuuuuucugcaggcugacugaggacaagaagagcgagaaauuuuucaagguguuuuaugaucggaugaaaguugcccagcaggaaaucaaggcgaccgucacggugaauacauccgaccuuggcaacaaaaagaaagaugacgagguggaucgugacgccccaucuagaaagaaggcaaaagaacccaccacucaaauuaccgaggaagucagggaucagcugcucgaggcuagcgccgcuacacgcaaggcauucacuaccuuucggcgagaggccgacccugacgaucauuaccagccgggggaaggaacacaggccacggcugacaaagcgaaggaugacuuggagauguccgcaguuaucaccauaaugcaacccauucugagauucuuacagcuacugugugaaaaucacaacagggaucuccagaauuuucuucgcugccagaacaauaaaacuaacuauaaccuggugugugagacauugcaauuccuggacugcaucuguggcucaaccacuggugggcucggacugcuuggccucuacaucaaugaaaagaacguagcccugauuaaucagacauuggagucucugaccgaguauugccagggcccaugucaugaaaaccaaaauugcaucgcuacgcacgagaguaacgggauagauauuaucacugccuuaauucuaaaugacaucaacccucugggaaagaaacggauggaucucgugcuugaacugaagaauaacgcaucgaaauugcugcucgccauaauggagagcagacacgacuccgaaaaugcugagcguauucuguacaacaugaggcccaaggagcuugucgaagugaucaaaaaggcguauaugcagggugagguugaauuugaggauggcgagaauggggaagacggagccgcaucuccacggaacgugggccauaauaucuacauuuuagcucaccagcuggcccgccauaacaaggagcuccagucaauguugaaaccuggugggcaagucgauggagacgaagcacuggaguucuacgccaagcacaccgcucagaucgaaauuguacgacuagacagaacaauggagcagauaguguuucccguuccaagcaucugugaguuccugaccaaagaauccaagcucaggauuuauuacacuacagagcgggaugaacagggcaguaaaaucaacgacuucuuucuucgcucugaggaucuguucaaugaaaugaacuggcaaaagaaguugagagcccagccggugcuguauuggugcgcgaggaauaugagcuuuuggucauccaucaguuucaaccucgcaguccugaugaauuuacuuguggccuuuuucuacccuuuuaaaggcguccgagggggaacccuggagccccauuggagcggucuccuauggacagcuaugcugauuucuuuggccauagugaucgcucugccaaagccccacggcauucgggcacucaucgccuccacuauucuucgucugaucuucucaguuggguugcagccuacccuguuucucuuaggagcuuucaacguguguaauaaaauaaucuuucugaugagcuucguaggcaacugcgguacguuuacaagaggguaucgcgccauggugcuugacgucgaguuccuguaccaccuacucuaucugguuauuugcgcaaugggauuguucgugcaugaauuuuucuacucgcugcuccuuuuugaucuggucuacagggaggaaaccuuacugaaugugaucaagucuguaacucggaacggcagaaguauuaucuugaccgcggugcucgcccugauacuaguuuaucuuuucuccauugugggcuaccuguuuuucaaagacgauuuuauccucgaggucgaccgccugccaaaugaaacagcugugcccgagacuggggagagcuuggccucagaauuccuguuuuccgaugucuguaggguggagucuggagaaaacugcagcaguccugcaccgcgagaggagcucguuccagcugaagagaccgaacaggacaaggagcacacgugugaaacacuucugaugugcauuguaaccguguuaucccauggucugcggagcggcgggggagucggcgauguguugagaaaacccucuaaggaggagccucucuucgccgcaaggguuaucuaugaccugcuauuuuucuuuauggugauaaucauuguccuuaaucugaucuucggugugauuaucgacacuuucgccgaucuccgcucagaaaagcaaaaaaaggaggaaauacugaaaacaaccuguuuuauuugcggguuggagcgugacaaguucgauaacaaaacuguaacauuugaagagcacaucaaggaggaacacaauauguggcauuacuuauguuucaucgugcugguuaaggucaaagacaguaccgaguauacgggacccgaauccuacguggcugagaugauuaaggaacggaaccucgauugguuuccaagaaugagggcgaugagccuugugucuucggacucagagggcgagcagaacgaacugcgcaaucuacaggagaaacuggaaagcacuaugaagcucgucaccaacuuguccggccaacugagugagcuuaaagaucagaugacagagcagcgaaagcagaagcaacggaucgggcugcucggacacccuccccauaugaauguuaacccacagcagccugccuga

SEQ ID NO: 57877 - RNA, 8106 nt, Artificial Sequence
  derived and/or modified sequence opt3 from ITPR2__Homo_sapiens__NP_002214
augaccgagaagaugagcuccuuccuguacaucggcgacauugugucucuauaugccgaagggucagucaacggauuuauaaguacccuuggucugguugaugacaggugcgugguacaccccgaggcuggcgauuuggcaaauccucccaagaaguucagggacuguuuauuuaaagugugcccgaugaaccgguacagcgcccagaagcaauauuggaaagcgaagcaagcuaagcaggggaaucauacugaagccgcacugcucaagaagcuccagcacgccgcugagcuggaacaaaaacagaacgaguccgagaauaagaaacuucugggagaaaucgucaaguacucuaacgugauucaguugcuccauaucaagucgaauaaauaucugacgguuaacaagcgccugcccgcacucuuagagaaaaaugccaugcgagugucacuggaugcugccggcaacgaagguagcugguucuacauucacccuuuuuggaaacuucguagugagggggacaauaucgucgugggagauaaaguaguuuugaugccagugaacgcgggccagccccugcaugcauccaauauagagcuacucgacaacccuggcuguaaggaagucaaugccgugaacugcaacaccucuuggaaaaucacacuguucaugaaguauagcuccuacagagaggaugugcuuaaagggggagacgucguuaggcuguuucacgcugaacaagagaaauucuugacuugugaugaauacgagaagaaacagcacauuuuucuccggaccacacugcgccagucagccaccagugcaacuagcucuaaggcuuuaugggagaucgaagugguacaucacgacccaugcagagguggcgccgggcaguggaacucccuguucagguuuaaacaucucgcgacaggaaacuaucuugccgcagagcugaaucccgauuaccgggacgcucaaaacgaaggcaagaaugugcgcgacggugucccuccaaccucaaagaaaaagcgacaggccggggagaaaauuauguauacguuggugagcguuccgcacggaaacgauaucgcuagucuauucgaacuggacgccacuacccuccagagagcagauugucuggugcccagaaauucuuacguccggcuucgucaccugugcacaaacacuugggugaccuccacaagcauaccuauugacaccgaugaggagcgcccaguaauguugaagaucggcacgugucaaacuaaagaagacaaggaggccuuugcuauuguuucggugccccucucugaagucagagaucuggacuucgcgaaugaugcaaacaagguguuagccacaaccgucaaaaagcuggagaauggcacuaucacacagaacgaaaggcgguucgugaccaaacuacucgaggaccugaucuuuuucguugcugaugugccuaauaacgggcaggagguacuugacgucgugauuacgaagccaaaucgagaacgccagaaauugaugagagagcaaaacauacuggcccagguuuuuggaauccucaaggcacccuucaaggaaaaagccggugagggcuccaugcugaggcuugaggaccugggggaucagcgguaugcuccguacaaguauauguugcgccucugcuacagagugcugaggcauucacagcaagacuaccguaaaaaccaggaauauauugccaagaauuuuugugucaugcagagucagaucggauacgauauauuagcagaggacaccauuacagcgcugcuacacaacaaucggaaacuccuggaaaagcauaucacugcuaaagagaucgaaaccuucgugagccuuuugcgaagaaacagggagccucgcuuucuggauuaucucuccgaccugugcguaucuaauacaacugccauucccgugacccaagaguuaaucugcaaguucaugcugagcccaggcaacgcagauauucuuauacagacaaagguugucucaaugcaggccgacaauccuauggaaaguuccaucuugagcgaugacauugaugacgaggaaguguggcucuacuggaucgauucuaacaaagagccccacgguaaggcuauccggcaucuggcccaggaagcaaaagaggggaccaaggcugaccuagaggugcugacuuauuacagauaucaacucaaucuguuugccaggaugugucuugaccgccaguacuuggcgauuaaccagauaucaacgcaacugagugucgauuuaauccuccgaugcguuagcgacgaaucccugccauucgaucuucgggccucuuuuugucgucugauguugcacaugcacguggacagagauccccaggagucggugguaccugucagguacgcucgccucuggacagaaauuccaaccaaaaucacuauucaugaguaugacagcaucaccgauuccucacggaaugacaugaagagaaaguucgcacugacaauggaauuuguggaggaguaccuaaaagaaguugugaaccagccguuccccuucggcgauaaggagaaaaauaagcugaccuuugaagucgugcaccucgccaggaaccugauauauuucggauuuuacaguuucucugagcuuuugcgacugacucgcacauuacucgcuauccuggacauuguucaggccccuaugagcuccuauuuugagcggcuuucaaaauuccaagauggcgggaauaacgugaugagaacgauccauggaguaggugaaaugaugacccagaugguccugagcaggggcucuauuuuuccaauguccgugcccgacgugccuccaaguauccaccccagcaagcaggggucuccgacugagcacgaagaugucacaguuauggacaccaagcuaaaaauaauugagauccuccaguucauucuguccgugcguuuggacuaccgcaucucauauaugcugaguauauacaagaaagaauuuggagaggauaacgacaaugcagagacaagcgcgucgggcuccccugauacuuuacucccaucugccaucguacccgacauugaugaaaucgcugcccaagcagagaccauguucgcuggucggaaggagaagaauccugugcagcuggacgaugaagggggaagaacguuucuuaggguccugauucauuugaucaugcacgacuacccaccacuccugagcggagcccuacagcugcuuuucaagcauuuuucacagcgagcagaagugcuccaagccuucaagcagguucagcuguuggugaguaaucaagaugucgacaacuauaaacagauaaaggcugaucuggaccaguuacggcucaccguggagaaauccgagcuguggguugaaaagucuagcaauuacgagaacggcgaaauuggggagucccaggugaaaggaggugaggaaccuaucgaggaaucaaauauccuuagccccguccaagacggcacaaagaaaccacagauugauaguaacaagucuaauaacuaucgcaucguaaaggagauucugauaagauuguccaaacucugcgugcagaauaagaaauguaggaaccagcaccaacggcugcuaaagaauaugggggcgcauagcguugugcuggaccuucuccagaucccguacgagaaaaacgaugagaagaugaaugaggucaugaaccuggcccacacuuucuugcagaacuuuugccgaggaaauccucagaaccaaguguuacugcacaagcaucucaaucuguuccuuacccccggccuguuggaagcagagacaaugagacacauuuuuaugaacaauuaucaucuauguaacgaaaucucggagcgcguagugcagcacuucguccauugcauugaaacucacgguaggcacguugaguaccugcguuuucuccagaccaucgugaaagcugacgggaaguaugugaaaaagugucaggauauggucaugacggagcugauaaauggcggagaagacgugcuuaucuucuacaacgaucgggccucauuuccaauuuuacugcauaugaugugcucugagagagacaggggcgaugaaagugggccccucgccuaccacaucacauugguugagcugcucgcugcauguaccgaaggcaaaaauguauauacugagauuaagugcaacucccugcuuccucuggacgauaucgugcgcgucgugacacaugacgauugcauaccagagguuaagauugccuacgugaauuucgucaaccacuguuauguggacaccgaaguagagaugaaagaaaucuacacuagcaaucacaucuggaaguuguuugagaacuuccuagucgacauggcgcgagugugcaauaccacaacggauagaaaacaugcugacauuuuucuggaaaaguguguuaccgagucuauaaugaacaucgugagcggcuucuucaauucccccuuuucagauaacaguacuagccuccaaacacaccagccugucuucauucaguuacugcaaucugccuuucggaucuauaacugcaccuggccgaauccagcacagaaagccuccguggagucauguauuaggacacuugcugaaguugcaaagaaccgcgguaucgccauacccguggaccuggauagucaggucaauacucucuucaugaaaagccauuccaacauggugcagcgugcggcuaugggguggagauugucugcccggucgggaccuagguuuaaagaggcacugggcgguccagccugggacuaccgcaauaucauugaaaagcuccaagauguaguggcuagccuggagcaccaguucucacccaugaugcaggccgaguuuuccguucuugucgacgugcuauauaguccugaacuguuguucccggagggcucugaugcacgaaucagaugcggggcuuuuaugagcaaauuaauuaaccauaccaagaaacugauggaaaaggaggaaaagcucuguaucaaaauacugcagacgcuucgggagaugcuggagaagaaagacuccuucguggaagagggaaauacacucaggaagauuuugcugaaccgcuacuuuaaaggcgauuacucaaucggggucaauggacaccuaucuggcgccuauagcaagaccgcgcaaguaggugggaguuucuccggacaggacagcgauaaaaugggcaucucuaugucagacauucagugccugcucgacaaggaaggugccuccgagcuugugaucgauguuauagugaacacuaagaaugacagaauuuuuagugaaggcaucuuccuggggauugcauuauuggagggaggcaacacccagacacaauacagcuucuaucagcagcugcacgagcagaaaaagucggaaaaauuuuucaagguccucuacgauaggaugaaagcugcccagaaggagauccggucuacugugaccguuaauacaauagaccuggggaacaagaaacgugaugacgauaaugaacuuaugacguccggaccccgcaugcgagugagagacagcacccugcaucucaaggagggcaugaaaggucaguugacugaggcuucaagugcaacaucuaaggccuauugugucuacaggcgggagauggauccagagauugacaucaugugcaccgggccugaagccggaaacacugaggaaaaauccgcugaggaggugacaaugagccccgcgaucgcaauuaugcagccaauccugcgcuuuuuacaacuacugugugaaaaccacaauagagagcuccagaacuuccuuaggaaucagaacaauaagaccaacuauaaucugguaugcgaaacguugcaguuucuggauugcauuuguggcucaacuaccgguggccucgggcugcuuggacucuacauaaacgagaagaauguggcccugguuaaccaaaauuuggaaagucugacagaguacugccagggcccuugucaugagaaccagaccugcaucgcuacucacgaaagcaaugggauugacaucaucauugccuuaauacuaaacgacaucaauccccugggaaaauaucggauggaucucguccuucagcugaagaacaacgcauccaaauugcugcucgccauuauggagucucgacacgacagcgaaaaugcugagagaauccuguucaacaugcgcccaagggaacuuguggaugugaugaagaaugcguacaaccaaggcuuagagugugaccauggugaugacgaagggggagaugacggcgucuccccgaaagauguuggccacaauauuuauauccuggcccaucagcucgcacggcacaacaaguugcugcagcagaugcuaaagccugggucagaccccgaugaaggagacgaggcucugaaauacuaugccaaucauacagcacaaauagaaaucgugcgucacgauagaaccauggagcagauuguauuuccagugcccaacaucugcgaauaccucacaagggagucuaagugucgcgucuucaauacuaccgagcgggacgaacaggguaguaaagugaacgacuuuuuccaacagacggaggaucuuuauaaugaaaugaaguggcagaaaaagauucgaaacaauccugcccuguuuugguucucgagacacaucagcuuguggggcuccauaucuuuuaaccuggcuguuuucauuaaucucgccguggcgcuguucuacccauuuggggacgauggagacgagggcacauuaucaccccuuuucagcguccugcucuggaucgcaguagccauuugcaccuccaugcuauuuuucuuuaguaaaccuguggguaucaggccguuccugguuucuauaauguugcgcagcaucuacacuauugggcugggaccaacccucauccuucugggcgcugccaacuuguguaacaagauuguguuucuggucucauucgugggcaaucgggggacauuuacuagaggauaucgugcugucauccucgauauggcauucuuauaccauguggccuauguucuggugugcaugcuuggucuguuuguacacgaguucuuuuacuccuuccuacucuucgaccugguguauagggaagagaccuugcugaacgucauaaagaguguuacgcggaauggccgcagcauuauccucacagcugugcuugcccugaucuuagucuaccuguuuucuauuaucggguucuuguuucucaaagaugacuucaccauggaaguggaucgacugaagaacagaacucccguaacaggaucccaucaggugccuaccaugacucuaacaaccaugauggaggcaugugcgaaagaaaauugcucacccacgauaccagccagcaacacugcugacgaggaguaugaagauggcauugagaggaccugcgacacacuucugauguguaucguuaccgugcucaaucaaggucugcggaacgggggaggcgucggcgacguguugcgcagaccuucgaaggaugaaccccuguuugccgcaagggucguguacgaccuccuuuucuacuuuauuguuaucauaaucguacugaauuuaauuuucggggugaucauugauacauuugcugaccugcgaucugagaaacagaagaaggaagagaucuugaaaacuaccugcuucauuuguggacucgagcgggauaaguuugacaacaaaacggucaguuucgaagaacacaucaaguccgaacacaauauguggcauuaucuguacuuuauagugcuaguuaaagugaaggauccaacagaguauacugguccugaaagcuacgucgcccagaugauuguggagaagaaccuugacugguucccgcguaugagagcaaugucacugguauccaaugagggcgauucugaacagaacgagauccgcagccuccaagaaaaacuggagaguaccauguccuuggugaagcaguuaagcgggcagcuggccgagcucaaagaacagaugacagagcaaaggaagaauaaacagcggcuuggauuccugggcucuaacacaccccacguuaaccaucacaugccaccucauuga

SEQ ID NO: 57878 - RNA, 8016 nt, Artificial Sequence
  derived and/or modified sequence opt3 from ITPR3__Homo_sapiens__NP_002215
augagcgagauguccucuuuccugcacaucggcgacauugugucacucuacgccgaagggagugucaacggauuuauaagcacccuuggucugguugaugacagaugcgugguagagcccgcugcaggcgauuuggacaauccuccaaagaaauucagggauuguuuauuuaaggugugcccgaugaaccgguauuccgcccagaaacaauacuggaaggcgaaacagacaaagcaggacaaggaaaaaaucgcugaugucgugcugcuacagaagcuccaacaugccgcacagauggagcagaaacagaaugacacugaaaacaagaaaguucacggggauguggucaaguauggaucugugauucaacugcuucauaugaagucgaauaaauaccugacgguaaacaagcgcuugcccgcccuccuggagaaaaaugcuaugcgaguuacccuggacgcaacaggcaacgaggguucauggcucuucauccagccuuuuuggaaguuacguagcaauggggauaacguggucgugggagacaaagugauucugaauccagucaacgccggccagccccuucacgcuaguaauuaugaauuguccgauaacgccggcuguaaggagguuaauucugugaacugcaacacuagcuggaaaaucaaucuguucaugcaguuuagagaccaucuagaagagguacucaaggggggagacguggucaggcuguuccacgcggagcaagaaaaguuucuuaccugugaugaguacaaagguaagcugcagguguucuugcggacaacccuccgccaguccgcaacuucagccacaaguagcaacgcucugugggaaguugaggugguccaccaugacccuugcagaggcggggccggacacuggaauggcuuauauagguuuaaacaucuggcaaccgguaacuaccucgcugccgaagagaauccaucuuacaagggggaugcguccgaccccaaagccgcaggaaugggcgcucaaggccggacggggcgccgaaacgccggagagaagauaaaguauugucuuguggcuguaccucacgguaaugauaucgccucacuguucgaauuggacccaacuacccuacagaaaacagauagcuuuguuccgagaaacaguuacgugaggcugcggcaccucugcacuaauaccuggauucagucuacaaacguccccaucgacauugaggaagagcguccuauccgccugaugcuuggcaccuguccaacgaaggaagauaaagaggcauucgccauaguguccguccccgugagcgagauuagagaccuggauuucgcuaaugacgcgucgucuauguuggcauccgccguugaaaagcucaacgagggguuuaucucacagaaugacaggcgguucgugauucaacuguuagaagaucugguauuuuucgucagugacgugccuaacaauggacagaacguucuagauaucauggugacuaaaccaaaccgagagcgccagaagcucaugagagaacagaauauccugaagcaagucuuuggcauucuuaaagcucccuucagggagaaggguggggagggcccguuggugcggcuggaagagcucagcgaccagaaaaacgccccuuaucagcauauguuucgccugugcuacagaguacuuaggcacucccaggaagauuaucguaagaaucaagagcauauagcaaaacaguucggaaugaugcagucucagaucggcuacgacauucuggccgaggauacaaucaccgcuuugcuccacaacaaucggaagcuguuagaaaagcauauaacuaaaacagagguggaaaccuuuguuagccugguccgaaagaacagagagcccagguuccuagacuaucucucagaucugugugugaguaaucacauugccaucccagugacgcaagaacuuaucugcaaaugcgucuuggacccuaagaacuccgauauucugauccgcaccgagcuccggcccguuaaagagauggcacagagccacgaauaccugucuauugaguacucagaagaggaagugugguuaacauggacugacaagaauaacgagcaucacgagaaaagugugagacagcuggcgcaagaagcuagggccgggaaugcacaugaugagaacguacuuagcuauuaccgcuaucaguugaagcucuuugcccgaaugugucuggaccggcaguaccuagcuauagacgaaaucucccagcaacugggagucgaucucauuuuccugugcauggccgacgagaugcuuccauuugauuugcgugcaucuuucugucaccugauguuacacgugcauguugacagagauccccaggaacucgugaccccugucaaguucgcuaggcuguggacagagaucccaacugccaucaccauuaaagacuaugauucgaaucuuaacgcgagccgcgacgauaagaaaaauaaguuugccaacacaauggaguucguggaagacuaccugaacaauguuguguccgaggcuguaccguuugcaaacgaagagaaaaauaaguugaccuucgaggucgugucacucgcccacaaccugauauauuuugguuucuacaguuuuucugaacuacugcggcucacuagaacgcugcuuggcaucauugauugcgugcaggggcccccugcuauguugcaggccuacgaggacccaggaggcaagaaugucaggcgaagcauccaagguguugggcauaugauguccacaauggugcugucacgcaaacagagcguauucucugcacccuccuuaagugcgggcgccagcgcugccgaaccucucgaucggucuaaguuugaggaaaacgaggacauuguggucauggagaccaaacugaagauccuugaaauacugcaguucauccuaaaugugagacucgacuauaggauuuccuaccuguugucaguuuuuaaaaaggaguucguggaagucuuuccaaugcaggauaguggagcagacggcacugcucccgccuucgauagcaccacagcaaacaugaaucuggaccguaucggggagcaagccgaagcuauguucggaguggguaagaccucguccauguuagagguugaugacgagggcgggcgcauguuucuccgggugcugauucaccuuacuaugcaugauuaugcgccgcuggucucuggagccuugcagcuccuguucaaacacuuuagccagagacaagaagcaaugcacacauucaagcagguacagcuacugaucucagcucaggacguggagaacuacaaaguuauaaagagugaacuugauaggcuccgaacgaugguggagaaauccgaacugugggucgacaagaagggcucugguaaaggggaggagguggaagccggcgccgcuaaggauaaaaaggagcggccuaccgacgaagagggauuuuugcauccacccggcgagaaaagcuccgaaaauuaucaaauuguaaaggggauccuggagcgcuuaaacaaaauguguggagugggcgaacagaugagaaagaagcagcagaggcuccugaaaaauauggacgcacacaaggucaugcuugaucuguugcaaauuccuuacgacaaaggugaugccaagaugauggagauccuccgguauacucaucaguuccugcagaaauuuugcgcggggaaccccggaaaucaggcucuacugcacaagcaucuucaccucuuccugacaccaggcuuguuagaagccgagaccaugcaacacauauuucugaacaacuaccagcucuguucagagaucagcgaaccuguucugcagcauuucgugcaccuucuggcaacacauggucgacacgugcaguacuuggacuuucuacacacugucauuaaggccgagggcaaauaugugaagaaaugccaagauaugaucaugaccgaacugacgaaugcuggggacgauguuguaguguucuacaacgacaaggcaagucucgcccaucugcuugauaugaugaaagcggcuagagacggagucgaggaucacucucccuuaauguaucauauuucccugguggaccucuuggccgcaugugccgaaggcaagaauguuuacaccgagaucaagugcacaagccugcucccacuggaggauguggucucggugguaacucacgaagacuguauaaccgaggucaaaauggcuuaugugaacuucguuaaucauugcuacguggacacagaagucgagaugaaggaaauuuauacuucaaaccacaucuggacccuuuuugagaauuucacgcuggauauggcccgcgugugcucuaaaagggagaagcguguugcagacccgacauuggaaaaauacgugcuaagugucgugcuggauaccaucaacgcuuuuuucuccagcccuuuuucugagaauagcacuucccuccagacacaccagaccauuguagugcaauuacugcagucaacuacccggcuucuggaaugucccuggcuccagcagcaacauaaggggaguguugaggccugcaucagaacauuggcgauggucgccaagggaagggcaauucugcucccaauggaccuggaugcucacauaagcucuaugcuuuccucaggcgccaguugugcugcagccgcccagcgcaacgcuagcuccuacaaagcgacgacccgagcauuccccagagugacuccuacagccaaucagugggacuauaagaacaucauugagaaacuacaggauaucauuaccgcucuggaagagcgguugaagccauuagugcaagccgaacugucuguccucguagacgugcugcauuggcccgagcuucuguuucucgaagguucggaggcauaccagaggugcgagagcgggggauucuugucaaaacugauccagcacacaaaggaucuaauggaauccgaggaaaagcuguguauaaaaguucuccgcacucuucagcaaaugcuguuaaagaaaaccaaguauggcgaccgugguaaucaguugagaaaaaugcugcuccagaacuaccugcaaaaucggaagaguacgucuaggggcgaucuuccugacccgaucgggacaggacuggauccagacuggagcgccauugcugcgacccagugccgccucgacaaagagggcgccacuaaguuggugugugaucugaucaccuccacaaagaacgaaaaaauuuuucaggagucaaucggguuagcaauacaccuacuggacggaggcaauacugagauucagaagucuuuccauaaccucaugaugagcgauaaaaagagugaacgauuuuucaaaguccuucacgacagaaugaagcgggcucaacaggagaccaaguccacaguggccguuaacaugaaugaucuggguagccagccccaugaagacagggagccuguggauccaacgaccaaagggcgcgucgcaucuuuuucaauccccggauccaguagcagauauucguugggcccuucucugaggcggggucacgaaguguccgagcguguacagagcucagagaugggcacuagugugcucaucaugcaaccgauucugcgcuuccuucagcuccugugcgaaaaccauaaucgagacuugcagaacuuccugagaugucagaauaacaagacaaauuacaacuuaguuugcgagacccuacaauuucuggauauaaugugugggucuacuacaggaggccucgggcuucugggauuguauaucaaugaagacaacgucggccuggugauucagacccucgagacgcugacugaguacugccagggucccugccacgaaaaucagaccuguaucgugacacacgaguccaacgggauugauaucauaaccgcccuuaucuuaaaugacauuagcccacugugcaaauacaggauggaccucgucuugcaacugaaggauaacgcuucaaaacuacugcucgcccuuauggaaagucggcaugacagcgagaaugcggaacgcauccugauuuccuugagaccucaggagcugguugaugugaucaagaaggcauaucuccaggaggaagagagggaaaacucugagguaagcccccgggaagugggacacaacauauacauucuggccuuacaacuuucccgacauaauaaacagcugcagcaccuccuaaagccagucaaaagaauccaggaggaggaagcugagggcaucucaucuaugcugaguuugaacaauaagcaacugucgcagaugcucaaaagcuccgccccugcucaggaagaggaagaggacccccuugcauauuacgagaaccacacuucucagauugaaaucgugcgccaagauaggucaauggagcagauaguuuucccagugccgggcauuugucaguuucugacagaagagaccaagcaucgguuguucacaacuaccgagcaggacgaacaagggagcaaggucuccgauuuuuucgaccagaguucuuuucugcacaaugagauggaauggcagcguaaacucagaagcaugccuuuaaucuauugguucucaaggcgcaugacgcuguggggauccauuaguuuuaaccuugccguauucaucaauauaauuaucgcuuuuuucuaccccuauauggagggugccagcacaggcgugcuggauucuccacuaaucucccuccuguuuuggauuuugaucugcuucucaauugcagcgcuguucaccaagcgguacagcauacgaccccucaucguugcccuuauucugagaucgaucuacuauuuagggaucggaccuacucugaacauuuugggcgcucucaaucugaccaacaaaauaguguuugucgugucuuucgucgguaauagggggacauuuauccgcggauacaaggccauggugauggacauggaauuccuauaucauguuggcuacauucuuacuagugugcugggccucuuugcacacgagcuguucuauuccaucuugcuguuugaucucauuuaccgggaggaaacccuuuucaacguaaucaaaagcgugacgagaaaugggcguucaauacuguuaacagcucuguuggcccucauccuggucuaucuauuuuccauuguuggauuccuuuuucugaaggacgauuucauccucgagguggacaggcugccaaacaaucauucuaccgcaagccccuuggguaugccucacggcgccgcugcguuugucgacacuuguaguggggauaaaauggacugcguguccggauuaagcguaccggaagugcuggaggaagaucgggagcucgacucuacagagcgcgccugugauacccuucugaugugcauuguuacugugaugaaccacggccuacgaaacggugggggagucggcgacauccugagaaagccaucaaaggaugaaagucucuuccccgcaaggguggucuacgacuugcuguucuuuuucauagugauuaucauuguucuuaaucugaucuuuggcguaauaaucgauacauucgcugaccuccgguccgagaaacaaaagaaagaagagauuuuaaagaccacguguuuuaucugcgggcuggaacgcgauaaauucgacaacaagacugugagcuuugaggagcauauuaaguuggaacacaauauguggaacuaccuguauuucaucguccucgugagaguuaaaaauaagaccgacuacacaggaccugagucuuauguggcccagaugauaaaaaacaagaaucuugauugguuucccaggaugcgagccaugucgcuggucucaaacgaaggugagggcgagcagaaugaaauucggauccuacaggacaaacugaacagcaccaugaagcucgugucccauuugacagcacaacugaaugagcuuaaggaacagaugacugagcagcguaaaagacgccagaggcugggguucguagaugugcaaaacuguaucagucgguga

SEQ ID NO: 57879 - RNA, 3663 nt, Artificial Sequence
  derived and/or modified sequence opt3 from ITSN1__Homo_sapiens__NP_001001132
auggcccaguuccccaccccuuuuggcgggagccuggacaucugggcuauuacaguggaggaaagagcaaagcacgaucaacaguuccauucccucaaaccaauaucuggauuuaucacuggugaccaggccaggaacuucuuuuuccagucaggccuuccgcaacccguccuggcgcagauuugggcuuuggccgauaugaauaacgacgggcggauggaucagguugaguuuaguaucgcaaugaaguuaauuaaacugaagcuacagggauaccaacucccuagcgcccugccacccgugaugaaacagcagccuguagcuaucuccucugcaccagccuucggcaugggugggauagcuucgaugcccccucuuacggccguggcgccagucccgaugggaucaauccccgugguuggcaugagcccuacccuggugaguuccgucccaacagcagccgugcccccuuuggcuaauggcgccccacccguaauucagccgcucccugcauuugcucaccccgccgcgacucugccaaagucuagcuccuucucacgcagugggccuggaagccaacugaacaccaagcuccagaaagcccagucuuuugacguugcauccgugcccccagucgcugaaugggccgugccccaaucaagccgauuaaaguaucgucagcuguucaauagucaugauaaaacaaugucuggucaccuuaccggcccucaggcuagaacuaucuugaugcaguccagccugccacaagcccagcuagcaucgauuuggaaccucucugacaucgaucaggacgggaagcugacagccgaggaauuuauacuugcuaugcaucugauugauguggcgauguccggacagccguugcccccuguccucccacccgaguacaucccuccaucauucaggcggguucgcaguggcagcgguauuuccgugaucucuagcaccucaguagaccaaagacugcccgaggaaccgguguuagaggaugaacagcagcagcuggagaaaaagcucccugucacguucgaggacaagaaaagggaaaauuuugagcgggggaaccuugaacuggagaagcgccgacaagcauugcuagaacagcagagaaaagagcaggagaggcuggcccaacucgaacgggcugagcaggaacguaaggagcgcgaaagacaggagcaagagaggaaacggcagcuggaacuugagaagcagcuggaaaaacagcgagaguuggaacgccaaagagaggaggaaaggcggaaggagaucgaacgcagagaggccgcaaagagggagcucgaacgucagcggcagcuggagugggaacgaaauagaaggcaggaguuacugaaccaacgcaauaaagaacaggaggacauugugguucuaaaggccaaaaagaaaacucucgaguucgaacuggaggcucuuaacgauaagaagcaccaguuggaaggaaaacugcaggacauacggugcagacucaccacacaaaggcaggagaucgaaaguacuaauaagucccgcgagcugcgaauugccgagaucacccaccuucagcaacagcugcaggaaagccagcaaauguugggccggcucauaccagagaaacagauucugaacgaucaguuaaaacaggugcaacaaaauucucugcaucgugacucacucgucacacucaagagagcacuggaagcgaaggagcuugcuaggcagcacuugcgcgaucagcuggacgaaguggagaaggagacccggaguaaacuccaggaaaucgauaucuuuaacaaccagcugaaggaguuaagagaaauucauaauaaacagcagcugcaaaagcagaaaagcauggaggccgagaggcuuaagcagaaggaacaagagcgaaaaaucauugaauuggagaagcagaaagaagaggcacagcgccgggcccaggagagagacaagcaauggcucgaacacguacagcaggaggaugaacaccagaggccccguaaacugcaugaggaagagaagcuaaaacgcgaggaauccguuaagaagaaagacggcgaggaaaaggggaaacaagaggcucaggauaagcugggaagacucuuccaccagcaucaggaaccugccaaacccgcagugcaagcuccauggucuacggccgagaaggguccucugacuauaucggcgcaggagaacgucaagguggucuauuaccgggcccuuuaucccuuugaaagcaggucccacgacgagaucacaauucagccaggcgacaucgugaugguuaaaggggaauggguggaugagucacaaaccggagagccgggcugguuggguggggaacugaagggcaaaacuggaugguucccugcuaauuacgcagagaagauccccgaaaacgagguaccagcccccgucaaaccugugacagacaguaccucugcuccagcccccaaguuagcacuccgagaaacgccugcgccgcuggccguuaccagcuccgagccaucaacaacucccaauaacugggcugauuuuagcucuaccuggccuacauccacuaaugagaagccagaaaccgacaacugggaugccugggcagcucagcccagucuuacagugccuagcgccggccagcugcggcagcgcucugcauucaccccggccacugcuacgggguccucacccaguccagucuugggacaaggugagaaaguggaaggccuccaggcgcaggcccuguauccuuggagagcaaagaaagacaaucaucuaaacuuuaauaagaacgauguaauuacagugcuggagcagcaagacauguggugguucggggaaguucagggacagaaaggcugguuucccaagagcuacgucaagcucauaucggguccaaucaggaaauccaccucuauggauagcgggucaagugaguccccugcuucucugaagcggguggccagccccgccgcuaaaccaguggucuccggcgaggaguucauugcaauguacacuuaugaaucaagcgaacagggagaccuuaccuuucaacagggcgauguuaucuuggugacaaagaaagacggggauugguggaccggaacugugggugacaaggccggcguauucccgaguaauuacguccgacugaaagacucugagggguccggaacagcgggcaagacggguagcuuagggaagaaaccugaaauugcucaggugaucgccucguauaccgcaacuggccccgagcagcucacacuggccccaggacaacuuauacugaucagaaagaaaaaccccggcggguggugggagggagaacuacaggcucgcggcaagaaaaggcagauugguugguucccugcaaauuacguuaagcuccugucaccagggaccucuaagaucacacccacugagccuccgaaaaguaccgccuuggcggcugugugucaagucauuggaauguaugauuacacggcccagaacgacgaugaacuggcauuuaacaagggccagaucauaaauguguuaaacaaagaggacccagauugguggaagggugagguuaauggccagguggggcuauuccccuccaacuauguaaaacugaccacagacauggauccuagccaacaguga

SEQ ID NO: 57880 - RNA, 5094 nt, Artificial Sequence
  derived and/or modified sequence opt3 from ITSN2__Homo_sapiens__NP_006268
augauggcccaguuccccaccgcuaugaacggcgggccuaauaugugggcaaucacaagcgaggaaagaacuaagcacgacaggcaauuugauaaccugaaaccauccggagguuacauuacgggcgaccaggcccggaauuucuuucuccagucugggcuuccggcgcccgugcuggcugagauaugggccuugucagauuuaaacaaggacggaaaaauggaucagcaagaauucaguaucgcaaugaagcugauuaaacuaaagcuccagggccagcagcugccugucguucuuccacccaucaugaagcaaccuccaauguuuagcccccugauuuccgcccgcuucgguauggggucuaugccuaauuugucgaucccacagccgcuccccccugcugcaccaauaaccucacugagcagugccacauccggaacuaaccugcccccucucaugaugccaacccccuuagugccgucuguaagcacauccucacugccuaauggcaccgcuagucuuauccagcccuugccaauuccuuauagcucuuccacucugccccauggcucaagcuacagucuaaugauggggggauuugguggcgccucuauccagaaagcgcaaucccucauugaccuggggagcucgucuuccacaucaaguaccgcaagccuuuccggaaacucuccaaagacgggcacuagcgagugggccgugccccagccuacccgacugaaauaucgucagaaguucaauacauuggauaaaucaaugagugguuaccucuccggguuucaagcuagaaacgcccuguuacagagcaaucugucucagacucagcucgcaaccaucuggacacuugcugacgucgauggagacggccaacugaaggccgaagaguucauauuggcgaugcaccuaaccgauauggccaaggcaggccagccacugccgcucacgcugcccccugagcuugugccacccucauuuagggggggaaaacagauugacaguaucaacgguacucugccuagcuaucagaagaugcaagaagaggaaccacagaaaaaguugcccguuacauucgaggauaaacggaaggcuaauuacgagcgcggcaacauggaacucgagaaaagaaggcaggcccugauggaacagcaacagcgggaggcugaacgcaaggcccagaaggagaaagaggaaugggagcgaaagcagagagaauuacaagagcaggaauggaaaaagcagcuggagcuagagaaaaggcucgaaaagcaacgggagcuggaacgucagcgcgaggaagagagaaggaaggacauugagcggcgagaagcagccaaacaggagcuugaacgccagagaagguuggagugggagcggauccgcagacaagaacugcucaaucagaagaacagggagcaggaagagaucgugcgucugaacuccaaaaagaaaaaucuucaucuggaauuggaggcucucaacgggaagcaccagcaaauuucuggacggcugcaggacguccgauuaaagaaacagacccagaagacugagcuggaagugcuagauaaacaaugcgaccucgagauaauggaaaucaagcagcugcagcaagagcuucaggaauaucagaauaaauugauuuaccugguaccggagaagcagcuccugaacgagagaaucaagaauaugcaauuuucgaacacaccugauagcggcguuuccuuacugcauaaaaagucacuugaaaaagaggaauugugucagaggcucaaggagcagcuggacgcgcuagaaaaagagaccgcaaguaagcugucugagauggauagcuucaauaaccagcucaaaugcgguaauauggacgauuccgugcugcaaugucuuuugucacuguuaagcugccucaacaaucuguuccuucuguugaaggaacuccgcgagacguacaacacccagcagcuggcccuagaacagcuguauaagauaaaacgggacaagcucaaagagauugagagaaagaggcuggaacuuaugcaaaaaaagaaguuggaggaugaagcugcccgcaaagcaaagcaggggaaagagaaucuguggaaggaaaacuuacgaaaagaggaggaagagaagcagaagcggcuccaggaagagaaaacacaagaaaagauccaggaggaggaacguaaagccgaggaaaagcagagaaaagacaaggauacucugaaggcugaggaaaaaaagagggagaccgccucuguccuugugaauuaccgcgcacuguauccauuugaggcgcggaaccacgacgaaauguccuucaacaguggcgacaucauucaaguggaugagaaaacagucggagaacccggcuggcuauacgggagcuuucagggaaauuucgguugguuuccuuguaacuauguugagaagaugcccucuuccgagaaugaaaaagcugugucaccaaagaaagcccuccugccucccacuguaaguuugagcgcaaccucgacauccucugagccacugagcucaaaccagccggccagugugaccgacuaccagaaugucuccuucucuaacuuaacugugaauacgagcuggcaaaagaaguccgcuuuuacaagaaccguuucaccuggcagcgugagucccauccacgggcagggacaggucguggaaaaccucaaagcccaggcacugugcucuuggacugcuaagaaagauaaucaucuuaacuucuccaagcacgacauuauaaccguacuggagcaacaggaaaauuggugguuuggcgagguucauggugggaggggcugguucccaaaaagcuaugugaagaucauucccggaucggaggucaagcgagaagagccugaagccuuguacgcggccgugaacaaaaagccaacaucagcugcauacucugucggcgaggaauauaucgcccucuaccccuauaguuccguggagccuggggaucugaccuuuacugagggagaagagauccuaguuacacagaaagacggugaaugguggacgggcagcauuggggaucgcucuggaauauucccgagcaauuacgugaagccaaaagaccaggaguccuuuggcucagcuaguaagagcggugccucuaacaagaaacccgaaaucgcacaaguaaccuccgcguaugucgccucagggagugagcagcugagccuugcuccuggccagcucauucugaucuugaagaaaaauacuuccggaugguggcaaggcgagcugcaggcccgggggaagaaaagacagaagggaugguucccagcaucucacgugaaguuacucggccccucgagcgaaagggcuacaccugccuuccacccgguuugucaggugauugcaauguacgauuaugccgcuaacaacgaggacgaacugucauuuuccaaaggucaacuuaucaaugucaugaacaaggaugaccccgauugguggcagggggagauaaauggagugaccggccuguucccaaguaacuacguaaaaaugacaacugacucugacccuagccagcaguggugcgcggauuugcaaacccucgacacgaugcagcccaucgagcguaagcgccaggguuacauucaugaacugauccagaccgaggaacgguauauggccgaucuacaacuggugguugaggucuuucagaaaagaauggcagaauccggcuuccuuacagagggggagauggcucucauuuuugugaauuggaaggaacugaucaugucaaacacuaaguuguuaaaagcccugagggugcgaaagaaaaccggaggcgagaagaugccaguccagaugauaggggacauucucgccgcugaacugucucacaugcaggcauacauccgguucuguagcugccaacuuaauggagccgcgcuguugcagcagaaaacagaugaggacacugauuuuaaggaauuccuaaaaaagcuggcuagugacccucgcuguaagggcaugccccucuccagcuuucugcuuaaaccaaugcaaagaauuaccagguauccguuacugauccggucuauacucgagaacacgccugagucacaugccgaucacuccaguuugaagcuggcacucgaacgagccgaggaacugugcagccagguuaaugagggugugagagaaaaagagaacucggaccgccuugaguggauccaggcucaugugcagugcgaagggcuggcagagcaauugauuuucaauucucuaacaaacugucugggacccaggaagcucuuacacuccggcaaacuguacaagaccaagagcaauaaagaacuucacgguuuucuguucaacgauuuucucuugcugacuuauaugguaaagcaguucgccgucucaaguggcucugagaaacucuucuccagcaagucaaaugcgcaguuuaaaauguacaagacaccaaucuuccugaacgaggugcuuguuaagcuacccaccgacccuaguagcgaugaaccaguguuucauauuucccacaucgaccgugucuauacucugcggaccgacaacauaaaugagagaacagcuugggugcagaaaauuaaggccgcaucugaacaauacaucgauacggagaaaaagaaaagggaaaaggccuaccaggcucgcagccagaagaccuccgggaucggacgauugaugguucaugugauugaggccacugaguuaaaagcaugcaagcccaacggcaaaucaaauccuuauugugaaaucucuauggggagucagucguacacaaccagaacaauucaagacacucugaacccgaaguggaauuucaacugccaguuuuucauaaaagaucucuaucaggacguacugugucuuacccuguuugaucgggaccaauucagcccagaugacuuucucggaaggacggagauccccgucgcuaagauucgcacagaacaggaguccaaaggcccuaugacccguagauugcugcuacacgaagugcccacuggugagguguggguccgguucgaucugcagcucuuugagcagaagacccuucuguga

SEQ ID NO: 57881 - RNA, 1191 nt, Artificial Sequence
  derived and/or modified sequence opt3 from IVD__Homo_sapiens__NP_001152980
auggccgagauggcuaccgcaacaagacugcucggcuggaggguggccagcuggcggcuucgacccccucuggcgggguucgucucccagcgcgcucacucuuuguuaccaguugacgaugccaucaacggacugucagaggaacaacgucaggaauuuuggaagcagcuagguaaucucggcgugcuggggauuacugcaccgguacaguacggaggcaguggucuuggguaucuggagcauguguuggucauggaagagauaagcagagccuccggagcugugggccucucuuacggcgcacacucgaaccugugcaucaaucaacugguuaggaacgggaaugaggcccagaaagaaaaguaucuccccaaauuaauuucaggagaguacaucggugcucuggccaugagcgaaccuaacgcgggcagugacguggucuccaugaaacuuaaggcagagaagaaggggaaucauuauauuuugaacggaaauaaauucuggaucacgaacggcccagaugccgacgugcugauaguauacgcuaagaccgaucuagccgcaguucccgcuucucgggguaucacagccuuuauuguggagaaagggaugccuggauucagcacuuccaagaaacucgacaagcugggcaugcgcggcucaaauaccugugaacuuaucuuugaggauugcaagauuccagcggccaacauccuggggcacgaaaauaaaggagucuauguguugaugaguggucucgaccuggagagauuagugcuggcaggcgggccccucggacuuaugcaggcuguccuggaucauacaauaccuuacuugcacguuagggaagccuucggccagaagauuggucacuuucaacuaaugcaggggaaaauggcugacauguacacccggcugauggccugucgccaguauguguacaacguagcaaaggccugcgaugagggccauuguacugcuaaagacugcgcgggagugauccucuauagcgcagagugugccacacaggucgcucuggauggcauucaaugcuucgggggaaaugguuacaucaacgacuuuccaaugggccgauuccuuagagacgccaagcuguaugaaaucggggcaggaaccucugaggugaggcgguugguuauuggccgugccuuuaacgcugauuuccacuga

SEQ ID NO: 57882 - RNA, 1758 nt, Artificial Sequence
  derived and/or modified sequence opt3 from IVL__Homo_sapiens__XP_006711363
augagccagcaacacacccugcccgugacacucuccccugcccuuucucaggagcuguugaagacugucccaccgcccguuaacacgcaucaggaacagaugaaacaaccuaccccauuacccccuccaugccagaaggugcccguagagcugccuguggaagucccaucaaaacaggaggaaaagcacaugacagcugugaaaggccuaccggagcaggagugugaacaacagcagaaggagccccaggaacaagagcuccagcagcaacauugggagcagcacgaagaguaccagaaggcagaaaauccugagcagcaacugaaacaggaaaagacucagagagaccagcaacuuaacaaacagcuggaggaggaaaagaaauugcucgaucagcagcuggaccaagagcugguuaagagggaugaacagcucgggaugaagaaagagcaguuacuggaacuuccagagcagcaagagggacauuugaagcaccuggaacagcaggagggucaacuaaaacaccccgaacagcaggagggccagcucgaacugccugagcaacaggaggggcagcuugaacugccagagcagcaagaaggacaguuggagcuccccgagcagcaggaaggccaacuggaguuaccggaacagcaggagggucaacuggaacucccugagcagcaggaggggcagcuugaacugccccaacagcaggagggacaguuggaacuaagugagcaacaggaaggccagcuggagcucagcgagcagcaagaaggccagcugaagcaucuugagcaccaggaagggcagcuggaggugccagaagaacaaaugggacaguugaaauaucucgagcagcaagaaggucagcugaagcauuuagaccagcaggagaaacaaccugaacugcccgagcagcagaugggccagcuaaagcaccucgagcaacaggaagggcagccaaagcaccuggagcagcaagaaggacagcuugagcaguuggaggagcaagagggccagcugaaacaucucgaacagcaggagggucaacuggaacaccuugagcaucaggaagggcagcugggauugcccgagcagcaaguccuccagcugaagcaguuagagaaacagcaaggccagccuaagcaccuggaagaggaagagggccagcuaaaacaucucgugcagcaagaagggcagcugaagcaccuuguacagcaagagggacaguuggagcagcaggaacggcaaguugagcaccuggaacaacaggugggucagcucaagcaucuggaggagcaggaaggccaguuaaaacaccuggagcagcagcaagggcagcuugaagucccagagcagcaagugggacagccgaagaauuuggaacaggaggagaaacagcucgaacugcccgagcaacaggaaggccaggugaagcaucuagagaaacaggaagcccaacuggagcucccugagcagcaggucggucagccaaagcaccuggaacaacaggagaagcaccuugaacaucccgagcagcaagaugggcaguugaaacaccuggaacagcaggagggccaauuaaaggaccucgagcagcagaaaggacagcuggaacaaccuguuuucgcgccagcucccggccaggugcaggauauccagccggcccuuccuaccaagggggagguacuguugccaguggaacaucaacagcagaaacaggagguccaauggcccccuaagcacaaguga

SEQ ID NO: 57883 - RNA, 1929 nt, Artificial Sequence
  derived and/or modified sequence opt3 from IVNS1ABP__Homo_sapiens__NP_006460
augauccccaacggcuaccugauguucgaggacgaaaauuuuauugagagcuccguggccaagcucaacgcucuuagaaaaucugggcaguucugcgaugucaggcugcaaguuuguggacacgaaauguuggcacaucgggccguguuagcgugcuguucaccuuaucuguuugagauauucaauagugacagcgauccacacgguaucucccauguaaaguuugacgaucuaaacccggaagcuguggagguccuccugaauuacgccuauaccgcacagcuuaaagccgacaaggagcuggugaaagauguuuacucugcugcaaagaaguugaaaauggaccgcgugaagcaggucugcggcgauuaucuccugucgcgaauggacgugacaucauguauuagcuaccguaacuucgccaguugcaugggggauuccagacugcucaauaaaguagacgcuuauauccaggaacacuuacugcaaauuucugaggaagaggaguuucuuaaguugcccaggcugaaacuagaaguuaugcucgaggauaacgugugucugccuagcaauggaaaacuuuacacuaaggucaucaacugggugcagcgguccauaugggaaaauggcgacucacuggaggaauugauggaggaggugcagacgcucuacuauagugccgaccauaagcuguuagaugguaaccugcucgacgggcaggcggaagucuucggaagcgaugacgaucacauccaauuuguucagaagaaaccaccccgcgagaauggccacaagcagauuucuuccucaagcaccggcugccuuaguucuccuaacgcaacagugcaguccccaaaacaugaauggaagaucguagccagcgagaaaacuucgaauaacaccuaccuguguuuggcugugcuagacgggauuuucugcgucaucuuucugcacggaagaaacucuccccaauccucaccuacaaguaccccaaagcucagcaagucccugucuuucgaaaugcagcaggaugagcuuauagagaaaccgaugagccccaugcaauaugccaggucaggucugggcacugcagaaaugaaugggaaguugauugcugccggaggcuacaaccgggaggaaugucuccgcacaguggagugcuauaauccucauaccgaccacuggaguuuucuggcgccaaugcgaacgcccagagccagguuccagauggcaguuuuaaugggucagcuguacguggucgggggauccaacggccacagcgaugaccuaucuugcggcgaaauguaugauucaaauaucgacgacuggauuccugugccagagcuccggacuaaccguuguaaugcugggguaugcgcccugaacggaaaacuuuacaucguugguggcagugaucccuacgggcagaagggauugaaaaauugugacguguucgauccggucaccaagcuguggacaagcugcgcuccucucaacauccgcagacaucaauccgccgugugugagcugggcgguuaucuuuacauuauagggggcgcagaaucuuggaauugccugaacacugucgagagguauaaucccgaaaacaauaccuggacauugaucgccccaaugaacguggcucggcgaggagcgggcguugcagugcucaacgggaagcuguuuguauguggagguuucgacggcucgcacgccauuagcugcgucgagauguacgauccuacccgcaaugaguggaaaaugauggggaacaugacgucccccagaucaaaugcuggaaucgccacugugggcaacacaauauaugcaguugguggguuugacggcaaugaguucuuaaacaccguggaagucuacaaucuggaaaguaacgaguggucuccauauacuaagauuuuucaguucuga

SEQ ID NO: 57884 - RNA, 882 nt, Artificial Sequence
  derived and/or modified sequence opt3 from IYD__Homo_sapiens__NP_001158166
auguacuuccugacccccauccucguggccauucuuugcauacuggucguuuggaucuuuaagaacgcugacagaagcauggagaaaaagaaaggcgaaccuaggacacgggcagaggcccgcccauggguggaugaagacuugaaggauuccucugacuuacaccaggcggaggaagaugcugacgaguggcaagagucagaagagaauguagaacauauuccguucagucacaaccauuaucccgagaaagagauggugaagcgaagccaggaauuuuacgagcugcuaaauaagcguagauccgucagguucaucucuaacgaacaggugccuauggagguuauugauaaugugauccggacugccgggacggcaccaucgggagcccacaccgaacccuggacauuugucgugguaaaagacccugauguuaagcauaaaauacgcaagaucauugaggaggaagaggaaaucaacuauaugaaaagaaugggucacaggugggugacugaccucaagaagcugcggaccaauuggauuaaagaguaccuugauacagcuccaauccugauauugauuuucaagcagguccacggcuuugcagccaacgggaaaaagaaagugcauuauuacaaugaaaucucagugagcauugcuuguggaauccuccuggccgcgcugcaagucaacaauggcaucaccaugcgccaccagacugcacgacauagacaccucauugagggucccgggaggaguuccgaggccugcucuaaguuaagcucccagggauguccugaaugccggucaggcgacugucacuaucauaguagccagcuguggccaucuacagagggcgcuccggggcccccucguaccuga

SEQ ID NO: 57885 - RNA, 1131 nt, Artificial Sequence
  derived and/or modified sequence opt3 from IZUMO1__Homo_sapiens__XP_005258850
augagcgugcugcuccuuuccgucuggggcgagucuacccugcccaacggguugagagaauuaugcgccccugcugcaaugggaccacacuucacacugcuaugugccgcgcucgcugguugccugcuuccggccgagggcuguguuaucugcgaccccucagugguacuggcauugaagagucucgaaaaagauuaccugccugggcaucuggacgccaagcaccauaaagcuaugauggagaggguggaaaaugcagucaaggauuuucaggagcucagcuuaaacgaggacgccuauaugggagugguugaugaagcuacucugcaaaaaggcuccuggucucuuuugaaggaccugaagcggauuacggauucggacgugaaaggugaucuauucgucaaggagcucuuuuggaugcugcaccuucagaaagaaaccuucgccacauacguggcgcgcuuucagaaggaggcauauuguccaaauaaaugcgggguaaugcugcagacuuugauaugguguaagaacugcaagaaagagguucaugccugucgaaagucauacgacugcggagaacguaauguggaggucccccaaauggaagauaugauccucgacugugagcugaacuggcaccaggcuagcgaaggcuuaaccgauuauaguuucuacagaguguggggcaauaacacagagacccugguguccaaagggaaggaggccacucucacaaaaccuauggucggaccagaagacgcagguucuuauaggugcgagcuuggcagcguuaauuccucacccgcuaccauuaucaacuuucacgugacgguacugccuaagaugauuaaagaagagaagccaaguccgaauaucgugacucccggggaagccaccacagagagcucuauauccuugcagccucuacagccagagaagaugcuggcgucacggcuccugggacuucugaucugcggcagcuuggcccucauuacuggucugaccuucgcaaucuuucgcagaaggaaagucauugacuucaucaagaguucuuuauuugggcugggauccggcgcugccgaacaaacacaggugcccaaagagaaggcuaccgauagccggcagcaguga

SEQ ID NO: 57886 - RNA, 2493 nt, Artificial Sequence
  derived and/or modified sequence opt3 from JADE1__Homo_sapiens__NP_001274366
augaagagaggcaggcugcccagcuccucugaggacucagaugacaacgggagucucagcaccacauggucccaaaauucucggucgcagcaccgccgaucaagcugcagucgucaugaagauagaaaaccuuccgagguguucaggacugaccuuaucacggccaugaagcugcacgauucuuaccaguugaacccagacgaauauuacgucuuagcugauccguggcggcaggagugggaaaaaggaguucaggugcccguaagcccugguaccauuccacaacccguggcacgcccuaagaaauauauagucuccucaggcagugagccacccgagcugggguacguggacaucagaacacuagccgauagcguuuguagguaugaccucaaugauauggacgcggcuuggcuggaacuuacuaacgaggaauuuaaggagaugggaaugccugagcuggaugaauacaccauggagcggguguuggaagaguucgaacagcgcugcuaugacaauaugaaccaugccauugagacagaggaaggccucgguaucgaguacgacgaagaugucgugugugacguaugccagucuccagauggggaggacggaaaugaaaugguguuuugugauaagugcaacauuuguguucaccaggcaugcuacggcauccugaaagucccggagggcuccuggcugugucgaaccugcgcccucggggugcaacccaaguguuuacugugcccuaaaaagggaggugcuaugaaaccaacuagaucaggcacaaagugggugcaugucagcugcgcacuuuggauacccgagguuaguaucgggucuccugaaaagauggagccaauuaccaaagugucccacauccccagcucgaggugggccuugguauguucucugugcaaugaaaaguucggagcuuccauucaguguucagugaaaaacugccggacggccuuucacgucacuugugcguucgaccguggccuagagaugaagaccauccucgcagaaaaugaugaggugaaauuuaagaguuauugcccgaaacauagcucccaccgcaagccugaggaaucucuggguaagggggccgcucaggagaacggagcccccgaauguagcccaagaaauccucuugagcccuucgcaucacuggagcagaacagggaagaggcucaucggguuagugugcgaaaacaaaaguugcagcagcucgaagacgaguuuuacacauucgucaaucuguuagauguggcccgcgcgcugagacucccagaagagguaguugacuuucuuuaucaauacuggaaacugaagaggaaagugaacuucaacaagcccuugauaacuccuaagaaagaugaggaagacaaucuagccaagcgggagcaggacguccuguuucgcagacuccagcuguucacccaccuuaggcaggaucuggaacgugugcggaacuugacauauauggucacccgaagagagaaaauuaagagguccgugugcaaaguucaagaacagaucuucaaucucuacacgaagcuguuagagcaggagcgcgugagcggcguaccaucuucauguaguagcuccucucuggaaaacaugcuacucuuuaauucgccgagcgucggccccgacgcaccuaagauugaggaucugaaauggcacuccgcuuucuuucggaagcagauggggacuucacuugugcauaguuugaaaaagccacacaaaagagacccccugcaaaacucuccuggaagcgaagguaagacacuccugaagcagccagaucuuugcggcaggcgcgaggggaugguugugcccgaauccuuccugggauuggagaaaaccuuugccgaggcucgacucaucucagcccagcagaagaauggcgucgugaugccggaccaugguaaacggcgugauaacagauuccacugugaccugaucaagggggauuuaaaagacaagagcuuuaaacaaucucauaagccucugagguccacugauguaagucagcgccaccuagacaauacacgggcagccaccagcccaggcgugggacagucugcucccggcacgagaaaggaaauuguuccuaaaugcaacgggucccucauaaaggucaauuauaaccagaccgcggugaaagugcccacaacuccagcaucaccugucaagaauuggggagguuucaggauccccaaaaagggcgagcgacaacagcagggggaagcccacgauggagcuugccaucaacacagugacuacccauaccugggccuuggucgcguuccggccaaggagcgggcaaaaagcaaguugaaaucggacaacgagaaugauggguaugugccugacguggaaauguccgauucugagagcgaagccucagagaagaaauguauucauaccaguuccacaaucucuagaaggacugacauaauucgucgcagcauccuggcuuccuga

SEQ ID NO: 57887 - RNA, 2553 nt, Artificial Sequence
  derived and/or modified sequence opt3 from JADE2__Homo_sapiens__NP_001276914
auggugcccaccgccgcuaucgcagucggcggguacuuccugggagguauggaggaaaagagaaggaaauauagcauuuccucugacaacucagauacaacugacagucacgccacgagcaccuccgcgucucggugcucgaagcucccuucaagcacaaaaaguggcuggccacgccagaaugagaagaaaccguccgaaguuuuucgaacugaucuuauaaccgcuaugaagauccccgacucuuaccaacugagcccugaugacuauuacauuuuggccgauccauggcgucaggagugggaaaagggggugcagguacccgcaggagccgaggcuaucccugagccaguggucagaauuuuacccccucuggaaggcccaccggcacaggccucccccucaaguacaaugcuaggugaggggagccaaccugacuggccaggaggcucuagguaugaucucgacgaaaucgaugcuuacuggcuggagcuuauaaacuccgagcugaaagaaauggagcggcccgaauuggacgagcucacccuggaacgcgugcuggaggagcucgaaacuuuaugucaucagaauauggccagagcgaucgagacacaggaaggccuggggauugaguaugaugaagacguugugugcgacgucuguaggucaccugagggagaggaugguaacgaaaugguguucugcgacaaguguaauguaugcguucaccaggcauguuacggcauccuuaaagugccaaccgggagcugguugugccggacgugugcccugggaguccaacccaagugccuacucuguccgaaacgcggcggugcucugaagccuacucgaagugggaccaagugggugcaugugucuugcgcccuuuggauucccgaggucuccaucggaugcccagagaaaauggagccuauaacaaagauuagccacauccccgcaucgagaugggcucugucuuguuccuugugcaaagaauguacugggaccugcauucaguguucaaugccaaguugcguuacagccuuucaugugaccugugcguucgaucacggccucgagaugaggacgauccuggccgacaacgaugagguaaaguuuaagagcuucugccaggaacacuccgacggcggaccccggaaugagccuacuucugaaccaacagagccgagccaggcuggugaggauuuagaaaaggugacccugcguaaacaacgccuccagcagcuugaggaagacuuuuacgagcuggucgaacccgcagagguggccgagagauuggaucuagcugaagcccugguugacuucaucuaucaauacuggaagcucaagaggaaagcaaacgccaaucagccucugcuuacuccaaagacagaugagguggacaaccuggcucagcaggaacaagacgucuuguaucggcgacucaaacuguuuacccauuuacgccaggaucuggagagagugaggaaucuauguuacaugguaacgcggcgcgaaagaaccaagcacgcgauuugcaaacuccaggagcagauauuccaucugcaaaugaaacuuaucgagcaggacuuguguagggaacguucaggccggcgagcaaaggggaaaaagagugauuccaaaagaaagggaugcgagggcagcaaagguucuacagaaaagaaggagaaaguuaaggccgggcccgacucagugcugggccagcucgcuggacugaguacuagcuuuccuauugauggcaccuucuuuaacuccuggcuugcccagucuguccaaaucacagcagaaaauauggccaugucggaguggccacugaacaaugggcacagggaggaccccgcuccgggauugcucagcgaagaacuguuacaggaugaagagacucugcuauccuucaugcgcgacccuucacuccggccaggugaucccgccagaaaagcaaggggccgcacccgacugccugcgaagaaaaagcccccaccucccccaccgcaggacgggccuggaagucggacaacccccgauaaggcucccaaaaagacuuggggccaggacgccgguucugggaaaggcggacaaggcccaccuacgcguaagccacccagaaggacaagcucccaccuuccuucaagcccggcagccggggauugcccaauauuggcuacccccgagucuccuccaccccuggccccugaaacuccggacgaggcagcuuccguggccgcggacagugauguccaggugcccggaccagccgcuagcccuaaaccccucggucgccugcggccaccuagagaaucuaagguuaccaggcgauuacccggcgcacgcccagacgccgggaugggaccgccuuccgcuguggccgagcggcccaaaguaucacugcauuucgauacagaaaccgacggcuauuuuagugauggugagaugagcgacucggaugucgaggcagaagacgggggcgugcagagaggaccaagggaggcgggcgccgaagagguugugcguauggggguccuugcuuccuga

SEQ ID NO: 57888 - RNA, 3657 nt, Artificial Sequence
  derived and/or modified sequence opt3 from JAG1__Homo_sapiens__NP_000205
augagaagccccaggacccggggccgcuccgggcgaccucugucucuccuucuggccuuguuaugcgcucugcgugcaaagguguguggagccucaggucaguucgagcuagaaauccucaguaugcaaaacgucaauggcgagcugcagaacgggaauugcuguggaggcgcgagaaacccaggugacaggaaaugcacacgggaugaaugugacacuuacuuuaagguuugccuuaaagaguaucagagccgcgugacggcugggggaccguguuccuucggcucuggcucgacccccguaauugggggaaauacauuuaaccugaaggccucaagagguaaugauaggaaccggauaguguugccuuucagcuuugcauggccacgcaguuacacucuccuggucgaagccugggacuccucuaaugauaccgugcagcccgacagcaucauugagaaagccucccacucaggcaugaucaacccuagucgacaauggcagacacugaagcagaauaccgggguugcacauuucgaguaucagauuagagugacuugcgaugacuacuauuacggauuuggcuguaacaaguucugcaggccacgggaugacuuuuucggucacuaugccugugaucaaaaugggaacaaaacaugcauggaaggauggaugggccccgagugcaaucgugcuaucugucgccagggcugcagcccuaagcaugggucuuguaaacucccaggagacugcagaugucaguacgguuggcagggcuuauacugcgauaaguguauaccgcaccccgggugcguccauggaaucuguaacgaaccuuggcaaugccugugugagaccaacuggggcggucagcuuugcgacaaagacuugaauuauugcgggacgcaccagccaugucugaacggcggaacuugcuccaauaccggccccgauaaguaccaauguucaugcccugagggguauagcggaccaaacugugaaauugccgagcacgcgugccuaagugaccccugucauaauagggguucuugcaaggaaacaucccucggcuuugagugugaaugcagcccgggguggacuggaccuaccuguucgacaaacaucgaugacugcucucccaauaacugcucccacggcgguaccugucaggaucuggugaauggguucaaaugcguauguccaccucaguggacgggcaagacuugccagcuugacgcaaacgagugugaggccaaacccugcguuaaugcuaagucauguaaaaaccugauugccaguuacuauugcgauuguuugccaggauggaugggccaaaauugcgacaucaacauaaaugauugucucgggcagugccagaacgacgcaagcugccgggaucuggugaacggauaccgauguauuugucccccugguuaugcuggcgaccauugcgaacgcgacaucgaugagugcgccuccaauccauguuuaaacgggggacacugccagaaugaaauuaacagauuucaaugucugugcccgacaggcuucucugguaaucucugucagcuugacaucgauuacugcgagcccaacccuugucagaauggggcgcagugcuacaacagggccagcgacuauuucugcaaguguccagaagauuacgagggcaaaaauugcucacaccugaaggaccauugucggaccacucccugcgaggucaucgauaguuguacaguggcaauggcuuccaacgacaccccugaaggagugcgcuauauuagcucuaaugucugcggcccacacgggaaguguaaaucacaaaguggaggcaaguuuacgugcgauuguaacaaagguuucaccgggacauacugccaugagaauauaaacgacugugaaagcaaucccugcagaaacggaggcacuugcaucgaugguguuaacuccuauaaguguauuugcucugacggcugggagggggccuacugugaaaccaauaucaacgauugcucgcagaauccgugucacaacggaggcacaugcagggacuuggugaaugacuuuuauugugauugcaaaaacggguggaagggaaagacuugucauagccgugacucccagugcgaugaggcuaccuguaauaacggcgguacaugcuacgacgagggggaugccuucaaauguaugugcccuggaggcugggaagguaccacuugcaauauagcacggaacucaaguugucuaccaaaucccugccacaacggcgggacguguguagugaauggagagucuuuuacaugcgucuguaaggaaggcugggaggggccuauuugcgcccagaacaccaaugacuguagcccccacccaugcuacaacuccggaacuuguguggauggcgacaacugguaucgaugcgagugugcuccugguuucgcggggcccgauugcagaaucaauaucaacgaaugccaaucaagcccaugugcauuuggagcuaccugcguugacgagauuaauggcuacaggugugugugcccgccuggucauucuggcgcuaaaugucaggaagucuccgggcgccccugcaucacaaugggaagugugauuccagauggcgccaagugggacgaugacuguaauaccugccagugucugaacgggcggauagcaugcagcaaaguaugguguggacccagaccuugccuccugcacaagggccauucugagugcccauccggucaaucauguauccccauucuugacgaucagugcuucguucacccuuguacuggggugggagaaugcaggaguagcucgcugcagccggucaagacaaaauguacguccgacucuuauuaccaggauaacugcgccaauaucaccuuuacuuucaacaaggagaugaugagcccaggcuugacaaccgagcacaucuguucagaacuccgcaaucugaacauuuuaaagaaugugagugcugaguauuccauauacaucgccugcgaacccucuccuagcgcaaacaaugagauucaugucgcgaucuccgcugaagacauucgagaugacggcaacccaaucaaggagauaacagauaaaaucauugaccuggugucaaagcgggaugggaauagcagucuaaucgccgcaguugccgaggugcguguacaaagaaggccccucaagaaccgcacugacuuucuggucccucuuuugucuuccgugcugaccguugcuuggauuuguugccucgugacggccuucuauuggugucugcggaaaagaaggaagccgggaagccacacccauucggcaucagaagauaauacaacuaacaacguccgagagcagcuuaaucagaucaaaaaccccauagaaaagcacggugcuaauaccgugccaauuaaagacuacgagaacaaaaauucuaaaaugaguaagauccgcacacauaacuccgaaguagaggaggacgauauggacaagcaccagcaaaaagcccgguuugcgaagcagccugccuacacucugguggauagagaagagaaacccccaaauggcaccccuacgaagcaccccaacuggacaaauaaacaggacaacagggauuuggaaagcgcucagucucucaaucguauggaguauauuguuuga

SEQ ID NO: 57889 - RNA, 3717 nt, Artificial Sequence
  derived and/or modified sequence opt3 from JAG2__Homo_sapiens__NP_002217
augagagcccagggcagggggcggcugccccgccgacuccuucuguuguuagcucugugggugcaagcagcccguccuaugggauacuucgagcuacagcucagcgcgcugagaaacgucaauggugaacuucuguccggcgcuugcugugacggggauggaaggaccacacgggccggcgguugcgggcacgacgagugugauacuuauguucgcgugugcuugaaggaauaccaggcaaaaguaacgccaaccggaccguguucuuauggccauggcgccacacccgugcucgggggaaacucauuuuaccugccuccagcuggugcagccggcgacagagcuagggcccgggcgcgcgcagggggagaucaggaccccggccuggucgugaucccuuuccaauuugccuggccacgaaguuucacucucauuguugaggcuugggauugggacaaugauaccacacccaacgaagaguuacugauagagagagugagccacgccgguaugaucaauccugaagacagguggaagucccuucauuuuucugggcacgucgcacauuuggagcugcagauucgggugcguugcgaugaaaacuauuacucggcuaccuguaauaaauucugccgcccaagaaacgacuuuuucggacacuauacuugugaucaguacggcaauaaggccugcauggacggcuggauggggaaagaguguaaggaggcgguaugcaagcagggaugcaaccuacuccacgguggcuguacaguuccgggggaauguaggugcucauacggauggcaaggccgguuuugcgacgagugugugcccuauccugguugcguccaugggagcuguguggaaccauggcagugcaauugugagaccaacuggggcggacugcuuugcgauaaagaccugaauuacuguggcagucaccaucccugcacgaacgggggaacuugcaucaaugccgaaccugaucaguaucgauguaccugcccagacgguuacuccggccgcaacugugagaaggcagagcacgcuugcacaucuaaccccugugccaaugggggaagcugccacgaagugccguccggcuucgagugucauugcccuucagguuggagugggcccacuugugcuuuggauauugacgaaugcgccagcaacccaugugcagccggcggaaccugcgucgaucagguugacggcuuugagugcaucuguccugaacaaugggugggggcuacaugccagcucgaugcgaaugagugugagggaaaacccugccugaacgcauucucuuguaagaauuuaauagguggcuauuacugcgacuguaucccaggguggaaaggaauuaacugccacaucaauguaaacgauuguagaggccagugccaacauggugggaccuguaaggaccuggugaauggcuaucagugcgucugccccaggggauuuggcgggcggcacugugaacucgagcgcgacgaaugcgccuccucaccuugucauagcggaggccuuugcgaggaucuggcugacgguuuccacugucacugcccacagggguucaguggaccguugugugaaguggauguugaccuaugcgagcccucuccuuguagaaacggcgccaggugcuacaaucuggagggugauuacuauugugcaugcccagacgauuuuggcgggaagaacugcuccgugccccgugaaccuuguccaggaggcgccugccgggucauugacggguguggaagcgaugcuggccccgguaugccggggacggccgcaucgggagugugcggcccucauggucgauguguaucucagccaggcgggaauuucuccugcaucugugacucaggauuuacuggcacauacugccacgagaacauagaugacugucucgggcaacccugcagaaauggaggcaccuguauugaugaaguugacgcguucaggugcuuuugcccuagugguugggagggggagcugugugacacuaaccccaacgauugccuuccagacccuugucauagccgcggacggugcuaugaucuggugaaugacuucuacugugcuugcgaugacggcuggaaagguaagacaugucacuccagagaauuucagugcgaugccuauaccuguucuaacggcgggacgugcuacgacagcggagauaccuucaggugugcaugucccccaggcuggaaagggucaacaugcgccgucgcuaagaauaguuccugcuugccgaacccuugcgugaauggaggcacuugugucgguagcggggccucuuuuucaugcaucugucgcgacggaugggagggccgaaccugcacacacaacacuaaugauuguaacccccucccaugcuauaauggcgggauuuguguggacggaguuaacugguuccggugcgaaugugcacccgguuuugcuggcccugauugccguaucaauaucgacgagugucagaguagcccaugcgccuacggggcgaccugcguggacgaaauuaacggauacagauguuccugucccccuggcagggccgguccgcgcugccaggagguaauaggguucggacggucuugcuggucgagaggcacaccauuuccccauggcagcuccugggucgaggauuguaauucauguaggugccuggacgggcgacgcgauugcaguaaagugugguguggauggaagccuugcuuacuggcuggucaaccagaagcacuaucugcccaguguccccucggccagcggugccuggagaaagcuccugggcagugccuuagaccgcccugugaagccuggggagagugcggcgcagaggaaccaccuagcacccccuguuugccaagguccggucaccuggacaacaauugcgcgcgucucacucugcauuucaaccgcgaucacguuccucaagggacgacagugggagccaucuguucaggcauucggagccuucccgcuaccagagccgucgcaagggaccgacuguuggugcuccugugcgaucgggcuucuuccggcgccagugcaguagagguggccguuagcuucucuccagcucgcgacuuaccggauuccucacugauccagggggcggcccaugcaauagucgcugccauuacucagagaggaaacaguagccuacuccuggccgugaccgaagugaaggucgagacaguugugaccgguggcucguccacugggcuuuuggugccuguacuguguggagcuuuuucuguccucuggcuggcaugcgugguuuuaugugugugguggacaaggaagcggcgaaaagaaagagagcgcagcaggcugccccgugaagagucagccaauaaccagugggcgccacuuaaucccauccggaacccuaucgagagaccaggcggucacaaggacgucuuguaucaaugcaaaaauuucacgcccccuccgaggcgcgcugaugaagcccucccagggcccgcaggacacgccgcugugcgagaggacgaagaggacgaggaucugggcagaggcgaagaggacagucuagaagcagagaaguuucugucccauaaauucaccaaggauccugggcggucucccggaaggccagcccacugggcgagcgguccuaagguugacaaccgcgcugugcguuccauuaaugaagccagauacgcaggcaaagaguga

SEQ ID NO: 57890 - RNA, 552 nt, Artificial Sequence
  derived and/or modified sequence opt3 from JAGN1__Homo_sapiens__NP_115881
auggccagcagagcuggccccagggcagccgggaccgacggauccgauuuccagcaccgggagcgcguggcgaugcauuaccaaaugucugucacacugaaguaugaaaucaaaaagcucauuuacguucaccuugugauauggcuguuguuaguagcuaaaaugucagugggucaucugcgacuacucagucacgaccaggucgccaugccuuaucagugggaguacccauaucugcuuagcauccugccguccuugcucggccugcugucuuuuccccguaacaauauuucguaccucguguuaucaaugaucagcauggggcuguucaguauugcaccucuuaucuauggauccauggaaauguuuccagccgcucagcaauuguacagacauggcaaggcauacagguuccuguuugguuucucugccguuagcauaauguaucuagugcucguccuggcugugcagguacacgccuggcagcuuuacuauuccaaaaagcuguuggauucaugguuuacgaguacucaggagaagaaacacaaguga

SEQ ID NO: 57891 - RNA, 3399 nt, Artificial Sequence
  derived and/or modified sequence opt3 from JAK2__Homo_sapiens__NP_004963
augggcauggccugccugaccaugacagagauggaagggacuagcacguccucuaucuaccagaacggagacauuucagguaaugcuaacaguaugaagcaaauagaucccgugcuccaggucuaucuuuaccacagccugggcaaauccgaggcagacuauuugaccuucccuucuggggaauacguugccgaggaaaucuguauugcggcuucgaaggccugcggaaucacaccaguguaucauaauauguuugcauuaaugucagagacugagagaauuugguacccgcccaaccacguauuccauaucgaugaaagcaccaggcacaaugugcuguaucggauacgcuuuuacuucccucgaugguacuguaguggcuccaaccgugccuauagacaugguaucucucgaggggcugaggcaccacuacucgacgauuuugucaugagcuaccuguucgcccaguggcggcacgacuuugugcacggauggauuaaaguucccgugacacaugaaacccaggaggagugccuuggcauggcuguccuggauaugaugcgcaucgccaaggaaaaugaccaaacuccuuuggcgauuuauaacuccaucucauacaaaacauuccucccaaaguguauaagagcaaagauucaggauuaucacauccugaccaggaaacggauucgcuaccgauuuagaagguucauccagcaguuuagucaaugcaaggccacggcucggaaucugaaacucaaguauuuaaucaaccuggagacucuucagagcgccuucuacaccgaaaaauuugaggugaaggaacccggcucugggccuuccggagaggagauuuucgcaacaauaaucauuacugguaauggcgggauccaguggucacguggaaagcauaaagaaagcgagaccuugacagaacaggaccugcaacuauacugugauuucccaaacauaauugacguaaguaucaagcaggcuaaucaggagggcucuaacgaaucccgcguugugaccauccacaaacaagaugguaagaaucucgagauugagcugagcucgcuuagagaagcccugucuuuugucuccuugaucgacggguauuacaggcucacggcggacgcccaccauuaucugugcaaagagguggcaccgcccgcuguguuagaaaacauucagucaaacugucacggaccuauaaguauggauuucgccaucagcaagcugaaaaaggcuggcaaucagacuggccucuacguccuucggugcuccccaaaggacuuuaacaaauauuuccugacauuugccguugagcgagaaaaugugauugaguacaagcauuguuugaucaccaaaaacgagaaugaagaguauaaccuaucugggacuaagaaaaauuucagcucacugaaggaucuccugaacugcuaccagauggaaacaguacgcagugacaauaucauuuuucaauucaccaagugcugucccccuaaaccaaaggauaaauccaaccuucugguguuuagaacgaauggagucagcgacgugcccaccucuccgacauugcagaggccuacucacaugaaccagaugguuuuccauaagauacggaaugaggaucucaucuuuaacgagucacugggucagggcaccuucacaaaaauuuuuaagggggugcgcagagaagucggagacuacggccaauuacacgagacugaagugcugcuaaagguacucgauaaagcacacaggaauuauagugagagcuucuucgaagccgcuuccaugaugucuaagcugucgcauaaacaccuuguuuugaacuacggugugugcgucuguggggacgagaacauccuggugcaggaguuugucaaguucggcagccucgauaccuaucugaaaaagaauaagaacugcauuaauauccuuuggaaacuggaaguggcgaagcaguuggcaugggccaugcauuuucucgaggaaaacacacugauacacggaaauguuugugcuaaaaacaucuuacugauucgugaggaagaccggaagaccggcaaucccccauucaucaaacuauccgacccugggauuucaaucacugugcuccccaaggauauacugcaggagaggauuccauggguacccccugagugcaucgaaaacccuaaaaaucuuaacuuggccacggacaaguggaguuuuggaacaacccugugggagauuuguucugguggcgauaagccgcucagcgcacuggacucccaaagaaaauuacaguucuacgaagauaggcaccagcugcccgccccuaagugggcugagcuugccaauuugaucaacaauugcauggacuaugaaccagauuuucgccccucauuccgggcaauaaucagagaccucaacagccuguuuacuccugauuacgagcuacugaccgagaaugacaugcucccaaacaugaggauuggggcgcugggauucucuggcgcuuuugaagaucgcgaccccacacaguucgaggaacgacaucuuaaauuuuugcaacagcuggguaaggggaacuucggcuccgucgagaugugucgguaugauccguuacaggacaauaccggagaggugguugccgugaaaaagcuccaacacaguacugaggaacaucugcgugacuucgaaagagagaucgaaauucuuaagagccugcagcacgauaacaucgucaaauacaagggcgugugcuacucugcagggaggcgcaauuugaaacucauaauggaguaucugccuuacggaucccuacgggacuaucugcagaagcauaaagagagaauugaucacaucaagcuccugcaguacacaucacaaaucuguaaggguauggaauaucuuggcacgaaaagguacauucaccgagacuuggccacccgcaacauccugguagagaaugaaaaccgggugaagauuggggauuuuggauuaacuaaaguucucccacaggacaaggaguauuacaaagucaaggaacccggcgagaguccuauauucugguacgcucccgagagccugacagaaucgaaguuuuccguggccucugauguguggagcuucggugucguucuuuaugagcuguuuaccuacaucgaaaaaucaaagaguccaccagcagaguucaugagaaugauugggaaugacaaacagggccagaugaucguguuucaucuaauugaacuccugaagaacaauggaagguugccccguccagauggcugcccggacgagaucuauaugauaaugacagagugcuggaacaauaacgugaaucaacgcccuuccuuccgggaucuggcuuuaagaguagaccagaucagggauaacauggccggguga

SEQ ID NO: 57892 - RNA, 3504 nt, Artificial Sequence
  derived and/or modified sequence opt3 from JAK3__Homo_sapiens__XP_005259953
augaccguggcccaggagacaaagggccccacucaagaaggggcugagugggacuucccucuggcagccagcagacucugcccaccguuugaaucccccggaucucuuccugcgaggcaggucgcucugauggccccacccucagaggaaacgccuuugaucccacagcggaguuguagcuuacuguccaccgaggcuggugcccuacacguucuccugcccgcucgcggcccugggccaccgcagcgacuuucuuucucguuuggagaucaucuggcagaggacuugugcgugcaagccgcuaaagccucaggcauucuccccguauaccacagccuguucgcgcuggcaacagaagaucucaguuguugguuuccuccaucccauauauucucuguggaggacgccagcacucaggucuuacuguaucguaucagauuuuacuuccccaacugguuuggucuugaaaagugccacagguucggguugcggaaagaucuggcuuccgccauucuagaccucccugugcuggagcaucuuuuugcacagcaccgcucagaucugguuaguggaagauugccagugggccucagccugaaggagcagggcgaauguuuaucucuggcuguccucgaccuugccaggauggcgcgggagcaagcccagcgccccggggaacuguugaaaaccguguccuauaaggcaugccuaccgccuucacugcgagaucucauccagggacugagcuucguaacaagaaggcggauucgucgcaccguuagaagggcacuucggcgaguggccgcuugucaggccgaccgccacagucugauggcaaaguacaucauggauuuggagagacucgaccccgccggugcugcggaaacuuuucaugucggccugccaggggcauuaggaggccacgauggucuggggcuacucaggguggccggagacggcggcauagcuuggacacaaggggagcaggaggugcugcagccuuucugcgacuuccccgaaaucgucgauauuucuaucaaacaagccccacggguuggacccgccggugagcaucgccuugugaccguaacgagaacugacaaucagauuuuggaagcagaguuuccuggccugccagaagcucucuccuucguggcccuggucgauggguauuuuaggcuuaccacagacagccagcacuucuuuuguaaggagguggcaccgccccgucuguuggaggaaguugcggagcagugccacggaccuaucacucucgauuucgcuauaaacaaacugaagaccggcgguucgcggccagggucuuacguguuacgaagaucaccccaagacuuugauuccuuccugcuaacagucugugugcagaauccucucggcccagacuauaaaggaugccugauuaggcgcagucccaccggcacguuucuuuugguagggcugagccggccgcauuccucucucagagaacuguuagccacuugcugggauggaggucugcacguugacggcguggcagucacacuuaccagcuguugcaucccuaggccaaaggagaagucaaacuugauugugguccagcgcgggcauagucccccuacuuccagccucgugcagccccaaucucaguaccagcugucacagaugacauuccacaaaaucccagccgauagucuagaauggcaugagaaucugggacacggcagcuuuaccaagaucuaccgagguugucggcacgagguuguggacggggaagcucguaaaacggagguacuccugaaggucauggacgccaaacauaagaacugcauggaauccuuccuugaggcagcuucuuugaugucgcaagugagcuauagacaccugguuuuacuccauggcguguguauggccggagauuccaccaugguccaggaguuugugcaccugggcgcgauugacauguaccuuaggaaacgcgggcaccugguaccugccucauggaagcuccaggugguuaagcaguuggcuuaugcacugaauuaccuagaagauaaaggacugccccaugguaacgucagugcccggaaggugcuccuggcuagagagggcgccgacgggucuccaccguucauaaaacuuagcgauccuggagugucccccgcagucuugucacuggaaauguuaacagacaggaucccauggguugcgcccgagugccuccgagaagcccaaacucugagccuugaggcugauaaguggggcuucggugccaccgugugggagguguuuucugggguaacaaugccuauuuccgcacuggacccagcuaaaaagcuacaguucuaugaagaucgccagcaacuccccgccccuaaguggacugagcuggcauugcugauccagcaguguauggccuacgaaccgguccagcggccaaguuuuagagcugugauaagggacuuaaauagccucauuucuuccgauuaugagcugcuuucagaccccaccccuggcgcgcuggccccacgugauggauuguggaacggcgcacaacucuacgcuugccaggaccccacaaucuucgaagagaggcaccugaaauacaucagucagcuagggaagggaaauuuuggcagcguugagcugugucgguaugacccucuuggugauaacaccggggcccucguggccgucaaacagcugcaacauucgggaccggaccagcagagagauuuccagagggaaauucaaaucuugaaggcucugcacuccgacuuuauugugaaauaccgaggcguuucuuauggucccggccggcagagcuuacgccucgugauggaguaccugccaucagggugccuuagagauuuccugcagaggcaucgggcacgauuggacgccaguagacuccugcuauauuccucucaaauauguaagggaauggaauaccugggcagccgccgcugcguacaccgugaucuugcggcucggaauauccucgucgaguccgaagcccacgugaagauugcagacuuugggcuggccaaauuguuaccucuggauaaggacuauuacguggucagagagcccggacagucaccaaucuucugguacgcuccugagagccucagugauaacaucuuuucuaggcaguccgacguuuggagcuucggcgugguacuguaugaacuuuuuacuuacugcgauaaaucguguucacccucugcagaguuccugcgcaugauggguugcgaacgagacgugccagccuuguguagacuacuggagcuccuggaggaagggcagcggcuuccggcgccucccgcuugcccagccgagguccaugaauuaaugaagcuguguugggcacccaguccucaagacaggccauccuucagcgcccucggaccccaguuggauaugcuguggucuggcagccgcgguugcgagacgcacgcuuuuacagcccauccugaaggcaaacaccauucccucucauucaguuga

SEQ ID NO: 57893 - RNA, 2496 nt, Artificial Sequence
  derived and/or modified sequence opt3 from JAKMIP1__Homo_sapiens__NP_001092903
augagcaagaaaggcagauccaagggggagaaacccgaaauggagaccgacgccgugcagauggcuaacgaggaacugagggcaaagcucacaucuauccaaauugaguuccagcaggaaaaaucaaaggucggaaaacuucgggagcgccugcaggaagccaaauuggagcgagaacaagagcagcguagacacacugcguacauaagugaguuaaaggcuaaacugcaugaagagaagacgaaagaacuacaggcccucagggagggucugauccggcagcacgaacaagaggcagcccgcaccgcuaagauuaaggagggcgaacuucagagacugcaggcaacauugaauguucucagggauggggccgcugacaaagugaagacugcccugcugaccgaggcgcgggaagaggcacgccgagccuuugauggagaaagacucagguuacagcaagagauccuggagcuuaaagcugcccggaagcaggcagaagaggcuuugagcaacugcaugcaggccgacaaaacaaaggcggccgaucugcgugcagcuuaucaagcccaucaggacgaaguacaccgcauuaaaagagagugugaaagggauauccggcgacuaauggacgagauaaagggcaaggaucgcgugauccucgcucuggagaaagaacuugguguccaggccgggcagacccaaaagcuguugcuccagaaagaggcacuggacgaacaguuagugcagguuaaggaggccgagagacaucacuccucuccuaaaagggaacugccaccgggaauuggcgauaugguggagcucaugggcguccaagaccagcacauggaugaacgggacgugcgcagauuccagcuuaagaucgcugagcuuaauucgguaauuaggaaguuggaagaccguaacacucuacuggcggaugagcggaaugagcuccugaaacgaucaagagaaacagagguucagcuuaagccccugguggaaaagaacaagaggaugaauaaaaagaacgaggacuugcuccaaagcauccagcgcauggaagagaagauuaaaaaucugacccgggagaacgucgaaaugaaggagaaauuaagugcacaggccucccugaagagacauacgucucuaaaugaucucagccugacuagggacgaacaggagauagaauuucuucgcuugcaagugcuggagcagcagcacgugaucgaugaccucucccuggagcgagaacggcuucugcguucaaaaagacauagggggaagaguuugaagccucccaaaaagcacgucguugagaccuucuuuggauucgaugaagagagcguggacucugagacacucuccgaaacuucauacaacaccgaucgcacagaccggaccccagcuacgccugaggaagaucuggacgacgccacugcaagagaggaagccgauuuaagguuuugccaacugacacgagaguaucaggcucuacagcgcgccuacgcacuccugcaggagcaaguagguggcacccuugacgcggaacgggaggcuagaacuagggaacaguugcaggccgaucugcuccguugucaggcaaaaauugaggaccuggaaaaguuacugguggagaaagggcaagauagcaagugggucgaggaaaaacagcuuuugauccgcacaaaucaggaccuccuggagaagaucuaucggcuagaaauggaggaaaaccagcugaagaaugagaugcaagaugccaaagaccagaacgagcuccuggaguucagagugcuugaauuggaagagagggagcgacggaguccagcuuuuaaccugcagauuaccacguuccccgaaaaucacucuuccgccuuacaacucuuuugccaucaggagggaguuaaggaugugaacgucagcgaacugaugaaaaagcuggacauacugggcgauaaugguaacuugcgcaaugaggaacagguggcaaucauucaggcugggaccguacucgcccugugugagaaauggcuaaagcaaaucgagggaacagaagcggcccugacucagaagaugcucgaccuggagaaagaaaaggaucuuuucucgagacagaaaggcuacuuggaggaggaacuggacuauaggaagcaggcuuuagaccaagcauaccucaaaauacaggaucuggaggccacccuuuacacagcucugcagcaggaaccuggccggcgagccggggaggcacuaucugaaggacaaagagaggaccuccaggcggccguugaaaaggugcgcaggcagauucugcgucagucccgggaguuugauucacaaaucuugagagagaggauggaacuguuacagcaggcucaacagcgcauccgagagcucgaagacaagcuggaguuccagaaaagacaccuuaaggagcuggaagagaaauucuuguuucucuuccuguuuuucagucuagccuuuauucuguggccauga

SEQ ID NO: 57894 - RNA, 2400 nt, Artificial Sequence
  derived and/or modified sequence opt3 from JAKMIP2__Homo_sapiens__NP_001257863
augagcaagaaaggcagaaacaagggggagaaacccgaagcccugaucguggcucuccaggcagccaaugaggaccuuaggaccaagcugacagauauucaaauagaauugcaccaggagaaauccaaggucucuaaguuagaacgggagaaaacucaggaggcgaagcgcauccgagaacuggagcagcguaaacauacgguucuagugaccgaacucaaggcuaaacugcacgaggagaagaugaaggaacuucaagccguaagagagaaccugauuaaacagcaugaacaggagaugucaaggacagugaagguccgggacggagaaauccagcgcuugaaaagugcacucugcgcccugagagaugguagcuccgacaaggugaggacugcucugaccauugaggcacgggaggaagcccgcaaacucuucgauacagagcgauuaaagcugcuucaagaaaucgcugacuugaaaaccgccaagaagcagguugaugaggcgcugucuaauaugauacaggcagacaaaaucaaggccggcgaucuaagaucggaacaccagucacaucaagaggcuauuagcaaaaucaagugggagagugaaagggacauucggcgucucauggaugagaucaaagccaaggaccgcauaauuuuuagccuggaaaaggagcuugaaacucagacaggguacgugcagaaacugcaauugcagaaggaggcacucgaugagcagcuguucuuagucaaagaagcugaguguaacaugucuagcccuaagagagaaaucccaggaagggccggcgacgguuccgagcacugcucaaguccggaccugcggcgaaaucagaaacgcauugcggagcucaacgccaccaucagaaaacuugaagauaggaauacgcuguugggggacgagcggaacgaacuacugaagcgcgugagagagacugaaaaacaauguaagccccuccuggagaggaauaaaugccuugcaaagcguaacgaugagcugaugguauccuugcagcggauggaagagaaacucaaggcuguuaccaaggaaaauucugagaugcgagaaaagaucacaucccacccuccacugaagaaauuaaagucacugaacgaccuagaucaggccaaugaggagcaggaaacugaguuucucaaacugcaagugauugaacagcagaacauaaucgacgagcuuaccagagauagggaaaaguugauucgccggagaaaacauaggcgcagcaguaagcccaucaagcgaccuguccuggacccauucauaggauaugaugaggacucuauggauuccgagacaagcucgauggcuucuuuucggaccgaccguacgcccgccacuccugacgaugaccucgaugaaucccuggcagccgaggaaucagagcuuagauucaggcagcugacaaaagaguaccaggcuuugcaacgcgcguaugcacuccugcaggaacagaccggcggcauuaucgacgccgagcgggaagcuaaggcccaagagcaguuacaggcagaagugcugagauacaaagccaagaucgaggaucuagaggcuacucucgcccaaaaagggcagauugaaaagcaggaggcagaaaaucacaggcugcagcaagagcuucaggacgcgcgagaucagaacgaauugcuggaguuucgcaaccucgagcuggaggagcgggaaagaaggaguccaccguucaauuuacagauccaucccuuuagcgacggaguguccgcucugcaaauuuauuguaugaaggagggugucaaagauguuaacauaccugaccuuaucaagcaguuggauauucucggcgacaaugggaaccugcguaaugaagaacagguggccaucauccaggcaucuacaguacuaagccuggccgagaaauggauucaacagauagaaggagcugaggccgcacuccaccagaagaugauggaacuggagucagauauggagcaauucugcaaaaucaagggcuaccuugaagaggaauuggacuaucgcaagcaggcucuggaccaggccuacaugcggauucaggaguuagaagcgacccucuacaacgcccugcaacaggagacggugaucaaauuuggugagcuucugagugaaaagcagcaggaggaauugagaaccgcugucgagaaacucaggcgacaaaugcugcggaagucccgcgaauaugauugucagauucuacaggagagaauggagcugcuccagcaagcacaccagaggauccgggaccuggaagauaaaacagacauacagaagcgacagaucaaggaucuugaggaaaaauucuuguuucuguucuuauucuuuagccucgccuucauucuguggccauga

SEQ ID NO: 57895 - RNA, 2535 nt, Artificial Sequence
  derived and/or modified sequence opt3 from JAKMIP3__Homo_sapiens__XP_011537986
augagcaagagaggcauguccucuagggccaaaggggacaaggcugaggcacuggccgcgcuccaggcugccaacgaagaucuucgggcaaaacugaccgacauccaaauugaguugcagcaggaaaagucaaaagugaguaaggucgagcgcgaaaagaaucaggaguuacgacaaguucgugagcacgaacagcauaaaacagccgugcugcuaacugagcucaagacgaaacugcacgaagagaagaugaaagagcuucaggcuguaagagaaacccuguugaggcagcaugaggcagaacuccugcgggugauaaagaucaaggauaacgagaaucaacgccugcaggcccucuuaagcgcucugagagacggaggucccgaaaaagucaagacagugcuuuuguccgaggccaaagaggaagcgaagaaaggcuucgagguugaaaaggugaaaaugcagcaggagauuucugaacugaagggggcaaagaggcaagucgaggaggcccuaacucucgugauccaggcugauaaaauuaaggccgcagaaauccggucgguauaccaccuucaucaggaggaaauaacccgcaucaaaaaggagugcgaacgagagauuagaaggcuuauggaggaaaucaaauuuaaggaccgggcuguuuucgugcuggagcgugaauugggaguccaagccggccacgcgcagcgccuccagcugcagaaggaggccuuagaugagcaacugucacaggugagagaagcagacaggcacccugguagcccacggcgagagcucccgcaugcugccggggcuggagaugccagugaccacuccggcucucccgaacagcagcuugaugagaaagacgcacgcagauuucaacugaagauugccgaauugagcgcuaucauaaggaaacuagaggaucggaacgcgcugcucuccgaggaacgcaaugagcugcuuaagagagugagggaagcagagucacaguauaaaccucuguuggacaagaacaagcgucucagucggaaaaaugaagaccugagccaugccuuacgaagaauggagaacaagcugaaauucgucacacaggagaauauugaaaugaggcagcgcgcuggcaucauucggagaccaucuucccuaaacgaucucgaccaaucacaggaugagagggaaguugacuuucugaaacuucagaucguggagcagcaaaauuugaucgaugaacugagcaagacccucgagacugccggguacguaaagagugugcuggagcgcgacaaacuucugcgauuccggaagcagcguaagaaaauggcaaaguugcccaaaccugucgugguugaaacauuuuucggauaugaugaggaagccucucucgaguccgacgguagcucggugucuuaccagaccgauagaacggaccaaacuccauguacccccgaugacgaccuggaggaaggcauggcuaaggaggaaacagaguuaagguuucgccagcugacuauggaauaucaggcccuacagcgggcauacgcgcuccugcaagagcaggucgggggaacccuugaugcugagagagaagugaaaacaagggagcaguugcaggccgaaguacaacgagcacaggcccgcauugaggaccuggaaaaggcucucgccgagcagggccaggauaugaaguggauagaggaaaaacaagcacuguaucggagaaaccaggaguuaguugaaaagaucaaacagauggagaccgaagaggcuaggcugcgucacgaggugcaagacgcccgcgaucagaaugaacuuuuggaguuccggauucucgaacuggaggagagagaaaggaaguccccugcgaucucauuucaccauacgccauucgucgacgguaaaaguccgcuacagguguacugcgaggccgaaggggucacugauauagugguugcugagcugaugaagaagcucgacauucugggagauaacgcaaaucuuacaaacgaagaacaggugguagucauccaagcccgaaccguguugacucuggcugagaaaugguuacagcagaucgaggagacagaagccgcacuccagcggaagaugguugaccuggagagcgaaaaagagcuguuuuccaagcaaaaaggcuaccuggaugaggaauuggacuaucgcaagcaggcgcucgaucaggccaacaagcacauucuggagcuagaagcuaugcuguacgacgcccuccagcaagaggcaggcgcuaaaguggccgaacugcuuucugaggaggaaagagagaaguugaaagucgcaguggaacaguggaagaggcagguaaugagcgagcugcgggagcgagacgcccagaucuuaagagaacgcauggagcuccugcaacuugcucagcagaggauuaaagaacuggaggaacguauagaggcgcaaaagcggcagaucaaggagcuagaagagaaauuccucuuccuguuuuuguucuuuucacuggccuucauuuuauggaguuga

SEQ ID NO: 57896 - RNA, 789 nt, Artificial Sequence
  derived and/or modified sequence opt3 from JAM2__Homo_sapiens__NP_001257336
auggccagaaggagccggcaccgccugcuccuucuguuguuacgauaccugguggucgcucuaggcuaucauaaggcauacggguucuccgcccccaaagaccagcaaguugugaccgcgguagaguaucagggagauuuuaagaaccgugcugaaaugaucgacuucaauauuagaaucaaaaacgugacaaggucugaugccgguaaguaccggugcgaggucucagcaccuagugaacagggccagaaucucgaggaagacacugugacgcuggagguucuuguggccccagcugucccgagcugugaggugcccuccucugcacugucggggaccguaguugaauugcgcugccaagauaaagagggaaacccugccccagaauauacaugguuuaaggacggcauaagacuccuggagaaucccaggcuggguucacagagcacuaacaguuccuacaccaugaauacaaagaccgggacucuccaguucaacacagugucuaaauuagauaccggagaguauagcugugaagcucgcaauuccgucggcuaccggcgaugcccuggcaagagaaugcaaguggacgaucugaacauuucagggaucauugccgcgguggucguuguggcacuuguaaucaguguguguggauugggugucugcuacgcccagaggaaaggcuauuuuagcaaggagacgucuuuccagaaauccaauucaagcaguaaggcuacuaccaugucugaaaacgacuuuaagcacacaaaauccuucauaaucuga

SEQ ID NO: 57897 - RNA, 780 nt, Artificial Sequence
  derived and/or modified sequence opt3 from JAM3__Homo_sapiens__NP_001192258
auggcccugagaaggcccccucggcuccgccuuugcgcucgacugccagacuucuuuuuguuacugcuauuccguggcugucucaucggggcagugaaccugaagucauccaauagaaccccggucguucaggaguuugaaucuguggagcuuucaugcauuauaacagauagucaaacuagcgaccccaggaucgaauggaaaaagauucaggaugagcagacgaccuacguauucuuugacaacaaaauccaggugaagccugucacaccagugugucggguucccaaagccgugccugucggaaagauggcgacucugcacugccaagaauccgagggucauccacgcccccacuauucuugguacagaaaugaugugccuuugccaaccgacucgagggcuaacccgcgguuccgcaauagcagcuuucaucucaacagugagacaggcacccugguauucacugccguucacaaggaugacuccgggcaguauuacuguauugcaucuaaugaugccggaagcgcucgaugcgaggaacaggaaauggagguguaugaccugaacaucggcgguauaaucgggggaguccucgugguguuagcaguccuggcccuuauuacauugggcaucuguugcgcuuacagaaggggcuauuuuauuaauaacaaacaggauggggaguccuacaagaaucccggaaaaccugacgguguuaacuacauccggaccgaugaagagggcgacuuccgucauaagucaaguuuugugauauga

SEQ ID NO: 57898 - RNA, 3225 nt, Artificial Sequence
  derived and/or modified sequence opt3 from JARID2__Homo_sapiens__NP_001253969
augguguacuucggcagcucccaggacgaggaagaggucgaagaggaagaugacgagaccgaggauguuaagacagccacuaacaaugcuucuucaaguugccaaagcacgcccagaaaagggaagacccacaaacaugugcacaacggacauguauuuaaugguuccucuaggucgacacgggaaaaggagccugugcagaaacacaagucaaaggaagcaacuccagccaaagagaagcauagcgaccaccgcgcggauagucgacgugagcaggcuuccgccaaccacccggcagccgcucccucuaccggcagcuccgcaaaagggcuggccgcuacacaucaccauccuccacuccacagaucagcccaggaccuuaggaagcaagucaguaaagugaauggaguuacccggaugagcucucugggcgcgggugugacuuccgcaaagaagaugcgcgaagucagacccucaccuagcaaaacagugaaguauaccgccacgguaacuaaaggggcuguuaccuacacaaaggccaaaagggaguuggugaaggauacuaaaccaaaccaccauaagcccaguucugcagucaaucacaccaucuccggaaagacagaaagcucgaacgcuaaaacccggaaacagguguuaucucugggcggcgccuccaagucaacggggccugcggugaauggacuaaaggucaguggucgccucaacccaaaaagcuguacuaaggagguuggcgggcgacagcugagagaaggacuucagcugagggagggcuugcguaauuccaagcggcgccucgaggaagcccaucaagcagagaaaccgcagucucccccuaagaaaaugaagggugcugccgggccagcugaaggacccggcaaaaaggccccugcagagagaggccugcugaacgggcacgugaagaaagaaguaccagagaggagccucgagcggaaucgacccaagcgcgccacagcuggaaaaucaaccccggguagacaggcgcauggcaaggcagacagugccuccugcgaaaacaggagcacuucucagccugagucagugcacaaaccccaagauagugggaaggcugaaaagggaggcgguaaagccgggugggcagccauggacgagauuccagucuuacggccuagcgcuaaggaauuucacgauccccugauauauaucgaguccgugcgcgcccagguugagaaauuuggcauguguagagugauuccacccccugacuggaggccagaaugcaagcucaaugaugagaugcguuucgucacacagauccaacauauucacaaauugggacggcgauggggcccgaacgugcagagacuggcauguaucaagaaacaucuaaagucucaggggauaaccauggacgaacucccccugaucggagguugcgagcuugaccuggcguguuucuucagguugauuaacgagaugggcgggaugcagcaaguaacggaucucaagaaauggaauaagcuggcugacauguuacgcaucccucggaccgcccaggauagacuggcaaaacuccaggaagccuacugccaguaucuucugucguacgacagcuuguccccagaggaacacaggcgccuagagaaggaaguucugauggagaaagagauucucgaaaagcgaaagggaccccuggagggccacacagaaaacgaucaucacaaauuucauccucuuccacgguucgagcccaagaauggucugauccacgggguggcuccgcguaacggcuuuagaucaaaauugaaggaagucggacaagcccagcucaaaacuggcaggcgccggcuguucgcacaggagaaggagguggucaaggaagaggaagaggacaaagggguguuaaaugauuuucauaaguguauauauaaaggaagaaguguuucucugaccacauucuacaggacugcucgaaacauuaugagcaugugcuuuuccaaggaaccugccccagcggagaucgagcaggaauacuggcgccuaguggaggaaaaagacugucacguagccguccacugcgguaagguggauaccaauacacauggcucaggguuccccguuggaaagagcgagccuuucucucggcacggcuggaaccucaccgugcugcccaauaacacugguuccauucuuagacauuugggggcugucccaggcgugacgaucccuuggcugaauaucggaaugguauuuaguacaagcugcuggucuagggaccaaaaccaccuccccuauauugauuaccugcauaccggcgcagacuguauaugguauugcaucccagccgaggaagagaauaaacuugaagacgugguucacacucuguugcaggcuaacgggaccccgggacuccagaugcuggaguccaaugucaugauuucaccugaaguguuauguaaggagggcaucaaagugcaccguacaguccagcaaaguggucaguucguugugugcuuucccgggagcuucgugucgaagguauguugcggauacuccgucucugagaccgugcauuuugccacuacacaguggacgagcaugggcuucgaaaccgcaaaagagaugaagcgccggcacauagcgaaaccauuuucaauggaaaagcugcuauaucaaauugcccaggcugaggccaagaaagaaaacggucccacucucaguacaaucuccgcacugcuugaugaguugagagacaccgagcugaggcagcgacggcagcuuuucgaagcuggccugcauucuagcgcccgcuacgggucccacgauggaucaagcacaguugcagacggcaagaaaaagccuagaaaaugguuacaacuggagacuagcgaaaggcggugucagaucugccagcaccuuuguuauuugucuauggugguccaggagaacgaaaaugugguguuuugccucgagugugcccugcgacauguugagaagcaaaaguccugcagagggcuaaaacugauguaccgcuacgaugaggaacagauuaucagccucguaaaccagauuugcggaaaggucucgggcaaaaaugguucaauagaaaacugucugucuaagccaacccccaaaagggggccucguaagcgggcuacgguggacgugccgccaaguagacuuuccgcgagcucuagcuccaagucagccaguaguucuuccuga

SEQ ID NO: 57899 - RNA, 732 nt, Artificial Sequence
  derived and/or modified sequence opt3 from JAZF1__Homo_sapiens__NP_778231
augaccggcaucgccgcugccagcuucuuuuccaacacaugcagauucgggggauguggucugcacuuucccacucucgcagaccuuauugagcauauagaagauaaucacaucgacacggauccuagggugcuggagaagcaggaauugcaacagccaaccuacgucgcguuaucuuauauuaaccgguucaugacagacgcugcccgccgagagcaggaaucacugaaaaagaaaauccagccgaagcuaagucucacucugagcuccucuguuucgcguggcaaugugucaacacccccuagacauagcagugggucccuuaccccacccguaaccccuccaauuacucccucuagcuccuuuaggucaaguacaccuaccggaagcgaguacgaugaggaagagguggacuaugaagagucugauuccgacgagucauggacgacugaaagcgcaaucaguucugaggccauacuguccagcaugugcaugaacggcggugaagagaaaccauucgcuuguccgguccccgggugcaagaagcgguacaaaaaugugaacggaaucaaguaucacgccaaaaauggccaucgcacccaaauuagaguuaggaagccuuuuaaaugucggugcggcaagucguacaagacagcacagggguugcgccaccacacuaucaacuuccauccacccgugucugcugaaauuauccgaaaaaugcagcaguga

SEQ ID NO: 57900 - RNA, 492 nt, Artificial Sequence
  derived and/or modified sequence opt3 from JDP2__Homo_sapiens__XP_005267389
augaugcccggccagaucccugacccaagcgugaccacagggucccugccgggacucgguccccuuacuggccugccuucuucagccuugacggucgaggaauuaaaguacgcugauauuagaaaccugggggcaaugauagccccacuacacuuccucgagguuaaacugggaaagaggccccaaccugugaaaagugaacuugacgaggaagaggagcggcgcaagcgacguagagagaaaaauaagguagcggcugccaggugccggaacaagaaaaaggagcgcaccgaauuucugcagagagagagcgagagguuggaacucaugaaugcagagcugaaaacacagaucgaagaacugaagcaggaacggcaacagcucauuuuaaugcugaaccgccaucgaccaacuuguaucgugagaaccgauuccgucaaaacacccgagucugagggcaauccucuuuuggaacagcuggagaagaaguga

SEQ ID NO: 57901 - RNA, 7077 nt, Artificial Sequence
  derived and/or modified sequence opt3 from JMJD1C__Homo_sapiens__NP_001269877
augcagggccccuacucccugaacggguauagagugaggguauaccggcaggacuccgcaacccagugguucacuggaaucauuacucaccaugaucuauuuacgcgcaccaugauaguuaugaaugaccaggugcuugagccucagaacguagauccaucuauggugcaaaugacuuuccuggacgaugucgugcacucauuguuaaagggugaaaauaucggcauuacaagucgacguagaaguagggcuaaccagaauguuaacgcggugcauucccacuauacccgggcccaggcaaauucuccgcgccccgcuaugaacucgcaggccgcagucccuaaacaaaauacacaucagcagcagcaacagagaucaaucaggccaaacaagcggaaagggagcgacaguuccauucccgaugaggaaaagaugaaagaggaaaaguacgacuauaucucucgcggagagaauccuaagggcaaaaacaagcaccugaugaauaaacgaagaaagccagaggaagaugagaaaaagcuaaacaugaagaggcuccggaccgacaaugugagcgauuuuuccgaaucaagugacagcgagaacucuaacaaacguauaaucgauaauuccucagagcagaagcccgaaaacgagcugaaaaauaagaacacuagcaaaauuaauggugaagaggggaagccucacaacaaugaaaaagccggagaggagacacuuaagaacagucaaccaccgugggaccagauccaggaagacaagaaacaugaggaagcugagaagcgcaaaucuguagauacccagcugcaagaagacaugauuauccacuccagcgagcagucgacgguuucugaucauaauuccaacgacuugcucccccaggagugcaauauggauaagacucacaccauggaacugcugccuaaagagaaguucgugucaagaccacccacaccuaagugugucauagacauuacuaacgauaccaaucucgaaaaaguggcacaggagaacaguagcacauuuggcuuacaaacccugcagaagauggacccaaauguguccgauucuaaacacagcaucgccaacgcuaaguuccuugaaacggccaaaaaggacucagaucagaguugggucuccgacguugugaagguagacuugacucagagcucugugacaaacgcgucaaguggcaaugaucaucugaacauggagaaagagaaguacgucagcuauauuucccccuuaucugcagugucgguuauggaagacaaacuccacaagaggagcccgccucccgagaccaucaaauccaagcugaauacuucaguggauacacauaagaucaaaaguucuccaagcccugaagucgugaagcccaaaauuacccacuccccagacucaguaaagagcaaagccacguacguuaacucucaagcuaccggggagcggcgacuugccaauaagauagagcaugaacugucccgcugcaguuuucaccccaucccuacaagaagcucuacuuuggagaccacaaaauccccacucauuaucgauaagaacgaacacuucacuguguacagggacccggcacugauaggaucagagaccggugcuaaucauauuagucccuuuuuaagccagcacccuuucccacugcauucguccucucaccggacaugucucaaccccggcacccaccauccugcccuuacuccagcgccccaccuguuggccgggagcucaagucagacgccgcuaccuacaaucaauacccauccacugacuuccggaccccaccaugcaguccaccacccucaucuccugcccaccgugcuuccaggcgucccuacagcuucucuguugggugggcacccccgccucgaaagcgcccaugcuuccucacugagccacuuagcccuggcacaucagcaacagcagcaacuacuccagcaccagaguccacaucugcuuggacaggcccauccgucugcuuccuauaaccaauugggccuguacccuaucauuuggcaguaucccaauggcacccacgcguacagcgggcucggacugccaucgucaaagugggugcaucccgagaacgcaguuaaugccgaggcuucucuuagaaggaacaguccuuccccauggcugcaccagcccacuccugugacaagcgccgaugguaucggcuugcucucucacauuccgguacguccaagcuccgcagaaccccaucggccucugaaaauaacggcccacucaaguccacccuuaaccaagacucuggucgaccaucacaaagaggaacuagagcgaaaggcuuuuauggaaccucucagaagcguggccucuacauccgccaaaaaugaucuggaccuuaacaggucacagaccgggaaggauugccauuugcaccgccacuucguugacccggugcugaaccaacuccagcggcccccacaggagacaggagagagacugaauaaguauaaagaggaacacaggcgcaucuuacaggaaaguauugaugucgcgccuuuuacuaccaagaucaaaggccuggagggugaacgagagaacuacagccggguggcuuccucuucgagcucacccaagucccacaucauuaaacaagacauggacguagagcguagugugucugaucuuuauaagaugaagcauagcguuccacaguccuugccucagucaaauuacuucacgacccucucuaacagcgucgugaaugaacccccaagaaguuacccguccaaagaggugagcaacauauauggggacaagcaaucuaaugcccuggcagccgcugccgcaaacccucagacacuaacuucauucaucaccucccugaguaaacccccaccccucauuaagcaccagccugaaagcgagggccuggucggaaaaaucccagagcaccuuccccaucagauugcuucgcacucuguuacaacuuuuaggaaugauugucgcuccccuacccauuugacggugagcucaacaaacacccugcggaguaugccggccuuacacagagcgccaguguuccaucccccuauccaccacucucucgaaaggaaggagggcuccuacagcucacugagucccccaacucuuacaccuguaaugcccgucaaugccgggggaaaggugcaagaaagccagaaaccaccuacccugauaccggagcccaaggacucccaggcuaacuuuaaaucuagcuccgaacagucauugacugagauguggcgaccaaauaacaaucucucuaaggagaaaaccgaauggcauguugagaagaguucggguaaacugcaagcagccauggcuagcgugaucguccgcccuuccucuucaacaaagacggauagcaugcccgccaugcagcuagcauccaaggaccgggugagugaaagaucuagcgcgggcgcccacaaaaccgauugccugaagcucgcugaggccggggaaacuggaaggauuauccugccaaacguuaacucagacuccgugcauacaaaaagugagaagaauuuccaggcaguaagccagggcucugucccuuccucagugaugagcgcugugaacaccauguguaauacaaaaacugaugucauuaccucggccgcagacacgacaucuguuaguuccuggggugggagcgaggugaucucaucccuuucuaacaccauauuggccagcacaaguuccgaaugcguaagcucuaagucagugagucaacccgucgcucagaagcaggaguguaaaguguccaccacagcgccgguuacucuggccagcucuaagaccggcucggugguccagccaucaagcggauuuuccggcacaacggauuucauucaccucaaaaagcacaaagcagcucuagccgccgcucaauauaagaguucuaaugcaagcgaaaccgagccuaacgccaucaagaaucagacucuguccgcgucacuuccccuggacaguacagugauuugcucuaccaucaacaaagcuaauagcguugggaacggacaggccucccaaacuucacagccaaauuaccauacaaagcucaaaaaggcauggcucacccgucacagcgaagaggauaaaaacacgaauaagauggagaacucugguaauuccgugagugaaauaaucaagcccuguagcgucaaccugauugccucgacuuccucugacauccaaaauucaguagacagcaaaauuaucguggauaaguauguuaaagacgauaaggugaaccgccggaaagcuaagagaaccuacgagaguggcuccgaaucuggggacagcgaugagucagaguccaagagugaacagaggacaaaacgacaaccuaagccgaccuauaaaaagaaacagaacgacuugcagaagcggaaaggagagauagaagaggaucugaagcccaauggcgucuuaagccgcucugcaaaggaaagaucaaaacucaagcugcaguccaacagcaauacugguauuccaaggucugugcuuaaagacuggcggaaggucaaaaagcugaagcaaacaggggagagcuuuuugcaggaugacucgugcugcgagaucggcccuaaccuccagaaaugucgagaaugcagacugauccgcuccaagaaaggagaggaacccgcccauagcccuguguucuguagguuuuacuacuuccgucggcuaucauuuucuaagaauggcgucguuagaauugauggguucagcuccccagaccaguaugacgaugaggcgaugagucuguggacccacgaaaacuuugaggacgaugagcuugacaucgaaacaucaaaauacauucucgauauaaucggagacaaguucugccaacuggugacuucugagaagaccgcuuugagcugggugaaaaaggaugccaaaauugcauggaagagggccguccgcggcgugcgagaaaugugugacgcuugcgaggccacgcuguucaauauccauuggguuugucagaaaugcgguuuuguaguguguuuagauugcuauaaggcaaaggaaagaaaauccagucgggacaaggagcucuacgcuuggaugaaaugugucaaggggcagccccacgaucacaaacaucugaugccuacacaaauuaucccaggaagcgugcuuaccgaccuguuggaugccaugcacacucucagggagaaguauggcauaaaaucccauugccacugcaccaacaagcagaaucugcagguugguaacuuccccacaaugaauggcgugucucagguccuacaaaacgugcugaaucauucaaacaagaucagccuuuguaugccggaaucgcagcagcagaauacuccuccaaaauccgagaagaacgggggaaguucucccgaaagcgacguaggcaccgacaacaaacucacgccuccagagucacaaagcccccugcacugguuggcggauuuagccgagcagaaggcacgcgaagagaaaaaggaaaauaaggagcugacacucgaaaaccagauuaaagaggagcgugaacaggacaauucugagaguccgaacgggagaaccagcccucuggucucccaaaauaacgaacagggaucaacucuucgggaucuguugacaaccacugcuggcaagcuaaggguggguagcacagacgccgggaucgcuuuugcacccguuuacucuaugggagccccaaguuccaaaagcggccgcaccaugccuaauauucuggaugacaucauagccucaguggucgagaacaagauucccccaucuaaaacguccaagaucaaugugaagcccgaacucaaagaggagccugaagagucgaucauuagcgcuguugaugaaaacaauaagcuguauagugacauaccacacucuuggaucugcgagaaacauauucuuugguuaaaggauuacaaaaacuccagcaauuggaagcuguucaaggaauguuggaaacagggucagccggcgguggucucaggcgugcacaagaaaaugaacaucagucucuggaaggcagaguccauuagcuuggacuuuggggaucaucaagccgaccugcucaauugcaaagauucuaucauaucaaacgcuaacguaaaggaguucugggacggauuugaagaggugagcaaacgacagaagaauaaguccggcgaaacuguuguccugaaacuuaaggacuggcccucuggggaggauuucaaaaccaugaugccugccagauacgaggaccuguugaagagucuaccacugcccgaauauuguaacccugagggaaaauuuaaucucgcaucgcacuuaccaggcuucuuugugcggcccgaucuggguccuaggcuuugcagcgccuacgggguggucgcugcgaaggaccacgauaucggaacaaccaaccugcauauugaaguauccgacgugguuaauauccucguguaugucggcauugccaaggguaacggcaucuugucaaaagcagggauacugaagaaauucgaggaagaggaucucgacgauauucugcgcaagagacuuaaagacucuagcgagaucccgggagcucuauggcacaucuacgccggcaaggauguggacaagauuagggaauuucugcagaaaaucaguaaggagcaaggguuggaaguuuuaccagagcaugaccccauacgggaucaguccugguaugugaauaaaaagcugcgucagcgccuccuggaagaguacggaguccgaacauguacucuuauucaguuccugggcgacgcaaucgugcucccugccggugcuuugcaccaaguacagaacuuccauucaugcauucaggugaccgaggauuuuguuucucccgaacaccuggucgagagcuuccaccuaacgcaggaacugagacuccuuaaagaggaaaucaauuaugacgauaagcugcaagugaagaacauauuauaccaugccgugaaagagauggucagggcguugaagauucacgaggacgaaguugaggauauggaagagaauuga

SEQ ID NO: 57902 - RNA, 1245 nt, Artificial Sequence
  derived and/or modified sequence opt3 from JMJD6__Homo_sapiens__NP_001074930
augaaccacaagagcaaaaagagaaucagggaggccaaacgguccgcucgccccgaacugaaggacucucucgauuggacccgacauaauuacuaugagucauucagucuuagcccugcagccguggcggacaacgucgaacgugcugaugcccugcaguuguccguugaggaauuuguggagagauacgagaggccauauaaaccgguaguguuacugaaugcacaagaaggcuggucugcccaggagaaguggacacuagaacggcucaagcgcaaauacagaaaccagaaguucaaaugcggggaggacaaugauggauauucggucaagaugaaaaugaaguacuauauugaguacauggaaucaacuagggacgauagcccccuguacauauuugacaguuccuauggugagcacccuaagcggcgcaaacuucuggaagauuacaaggugccaaaauucuuuacggacgauuuguuccaguaugcuggcgagaagcgaagacccccuuacaggugguuuguuauggggccaccccggucuggaaccggcauccauauugacccucucgguacaagcgcauggaacgcccuggugcaagggcacaaacguuggugucuguucccaacuuccaccccgcgcgaacucaucaaggucacaagagaugagggaggcaaucagcaggacgaggcuauuaccugguuuaacgugaucuaucccaggacucaguuaccuacauggccacccgaguucaaaccucuggaaauacuucaaaagccaggcgaaaccguauuuguucccgggggaugguggcauguggucuugaaucuggacacgacuaucgccauuacccagaacuucgcgucaaguacaaauuuuccggugguguggcacaagacuguccggggucgaccuaaacuaagccgcaagugguacagaauccucaaacaggagcaccccgaacuggcaguucuugccgauucuguggaccugcaggaguccaccggcauugcuucagauagcaguucugacuccagcucgucuuccucaaguagcuccucugauagcgacucagagugcgaaaguggguccgagggagauggcacaguacauaggcggaagaaacgcagaaccuguagcaugguggguaacggggacacgacuucucaagaugacugcgucucaaaggaaaggaguagcucccguauccgggauacauguggaggccgagcccacccauga

SEQ ID NO: 57903 - RNA, 2967 nt, Artificial Sequence
  derived and/or modified sequence opt3 from JMY__Homo_sapiens__NP_689618
augagcuucgcccuggaggaaacccucgaguccgacuggguggcugucagaccccacguuuuugaugaaagggagaagcauaaauucguguuuaucguagcauggaacgaaauugagggcaaguucgccauaacaugccacaaucggacugcgcagcgccaacgaucugggucacgugagcaggcuggagccagagguggcgcagaagccgggggagcugcaagugacggcagcagggguccuggguccccagccggacggggccgcccggaggcuacggccucugcgacccuugugagaucgcccggcccuaggcggucaagcgcaugggccgaagggggaaguccacgcuccacacgaucucuguugggugaucccagauuaaggagcccuggcuccaaaggggcugagucacggcugcguaguccaguccgcgccaagcccaucccuggacagaaaacuagcgaggcagacgaugcugccggcgcggccgcagcugccgcuagaccagccccgagggaagcacaggugucuuccguucggauugugucagccagcgguaccgucagugaggaaaucgaggugcuagaaaugguaaaggaggacgaggcuccccucgcgcugucugaugcagaacaaccuccacccgccacagagcuugaauccccugcugaggaauguagcugggccgggcuguuuucguuccaggacuugcgagcaguucaucagcagcucugcucugugaacucccaacuggagccaugucugcccgucuuuccggaggaaccuucaggaauguggaccgugcuguucggcggcgcccccgagaugacugaacaggagauugauacauuaugcuaccagcuccagguguaucuugggcacggauuggacaccugugguuggaagauccugagucaaguccuauuuacggaaacugaugacccagaggaguacuaugaaagccucuccgagcugcgccagaaaggcuacgaagagguucuucagagagcuaggaagcggauacaagagcuguuggauaaacauaagaauaccgaaucuaugguggagcuccuggacuuauaucagauggaagacgaggccuacagcucacuggcagaagcgacaacugagcucuaucaguaccuucugcagccuuuccgcgauaugagagaguuggcuaugcuaaggcgucaacagaucaaaauuaguauggaaaacgacuaccuggggccccggcgaaucgagucccuccagaaggaagaugccgacuggcagagaaaggcacacauggccguacugagcauucaagaucuuaccgugaaauauuuugagaucacagcuaaggcccagaaagcagucuacgacaggaugcgcgcugaucagaagaaauucggaaaggccucuugggcggccgcugcagaacggauggagaaacugcaguaugccgugucaaaggagaccuugcaaaugaugagagcuaaggaaauaugccucgagcagaggaaacacgcccugaaggaagagaugcagaguuuacgcggcgguacggaagcaauugcgcgacuggaccagcuagaggccgauuacuaugaccuccaacugcagcuuuacgagguucaguuugaaaucuugaaaugugaggaacugcuccugacugcucaacuugagagcauuaagcggcugaucuccgagaaacgugaugaaguggucuauuacgacacauacgagucuauggaagccauguuggagaaggaagagauggcagcuucggccuaucuccagagagaggaacugcagaaguuacagcaaaaagcaaggcagcuggaggcccgccgggggagagugagcgcuaagaaauccuaccuaaggaauaagaaagaaaucugcauugcgaagcauaacgagaagauacagcagcgaacccgcaucgaagacgaguaucggacucaccauacaguacaacucaaaagagagaagcugcacgaugaagaggaaaggaaaucagccuggguuagucaggagcgucagcgcacccuugaccgguugagaacguucaagcagagguacccaggccaagugauucugaaaucuacccgacuccggcuggcacacgcucgcagaaagggagccgccagccccgucuuacaggaagaucauugugacucccugccuucagugcuucaggucgaggagaagacagaagaggugggcgaagggaggguuaaacggggaccaagccaaacuaccgagccgcagucuuuggugcagcucgaggauacaucccugacucagcuagaagcuaccagucugccccucagcgguguaacaucugagcugccuccaaccaucucccuucccuugcugaauaacaauuuagaaccuugcucagucacuauaaacccacuccccaguccgcugccuccaacgcccccucccccaccucccccaccgccucccccacccccuccaccccuuccuguggcaaaggacagcggcccggagacacuggaaaaagauuugccacgaaaggaggggaaugagaaaagaauccccaagucggccuccgcgccuucugcucaccucuucgacagcucacaacugguuagugcccgcaaaaagcuaaggaagaccgcagaaggacugcagcgucggagaguguccucuccaauggaugagguccucgccagccugaaaaggggcuccuuucaucuuaagaaaguggaacagcgcacuuugcccccuuucccggacgaggaugacucaaacaauauucuggcucagauccgaaaggguguaaaauuaaagaaggugcaaaaagauguucucagagagagcuuuacccugcuucccgacacagacccacugacccggaguauucacgaagcacuaaggcgcaucaaggaggccucuccugaauccgaggaugaagaggaagcgcuccccuguacugacugggagaacuga

SEQ ID NO: 57904 - RNA, 390 nt, Artificial Sequence
  derived and/or modified sequence opt3 from JPH2__Homo_sapiens__NP_787109
augagcggcgggagauucgacuuugaugacggaggugccuacugcggcgggugggagggaggcaaggcucacggucaugggcuguguaccggacccaaaggccagggcgaauauuccgggucuuggaacuucggauuugagguggccggugucuacacauggccuucaggcaauacuuucgaaggguauuggagucaaggaaagaggcacggccucgguaucgagacgaaagggcgguggcuuuacaagggagaauggacccauggcuuuaaaggccgcuaugggauucgacagagcuccucuucgggagcaaaguacgaggguacauggaacaauggccugcaggauggguauggaacugagaccuacgcggacggcgguaugugcuga

SEQ ID NO: 57905 - RNA, 561 nt, Artificial Sequence
  derived and/or modified sequence opt3 from JPH3__Homo_sapiens__NP_001258533
augagcuccggcgggagauucaacuuugacgauggagguucuuacugcggcgggugggaggacggaaaggcccacggccaugguguguguaccgggcccaaaggacagggcgaauauacaggcucauggagucacggguucgagguccugggaguuuacacuuggccuagcgguaauacguaucaaggcaccugggcucaggggaagaggcauggaaucggccucgaauccaaagguaaguggguguacaaaggggaguggacacacggauuuaagggccgguauggcguacgcgaaugcgcagggaacggagccaaguacgaggguacuuggucuaauggccuucaggauggguauggaaccgagacauacucggacggcgaugcgaccgcuuucggugccgaaccagggccggaggcacgagaacugcccgccgcugcagccgcugccgcggcagccgcugccgcagcugugcguugguuuuuguguagagagccuuggccagccuuacagcugcccgcgugccuagacucaccuauuagcacuccacaauguacauga

SEQ ID NO: 57906 - RNA, 1887 nt, Artificial Sequence
  derived and/or modified sequence opt3 from JPH4__Homo_sapiens__NP_115828
augagccccggcgggaaguucgacuuugaugacggagguugcuacgugggcgggugggaggccgggagagcucacggcuauggugucuguaccgggccuggagcacagggcgaauacuccggcugcugggcccauggguucgagucucugggaguuuuuacagguccaggcgggcacucauaucaaggacauuggcagcagggcaaaagggaaggucucgggguggagcggaagagucgcuggacuuaccgaggagaauggcuuggcggccugaaagggcguagcggaguaugggaguccgugucugguuugagauaugcgggcuuauggaaggauggguuccaggacggauacggcacggagaccuauucggauggugggacauaccaaggccaguggcaggcuggaaaaaggcacggcuacgggguccggcagucagugccguaucaucaagccgcacugcuacgcagccccagaaggacuucccucgacuccggacacucugauccuccaacacccccuccaccccugccucuuccaggugacgaaggcgggagcccggccuccggaucacggggcgguuuuguucuggcugggcccggcgaugcagacggagccaguagccgcaagcgaaccccugcugccggcggguucuuuagaaggucuuugcuccuguccggacugcgggcggguggccgucgcucaagccucgggaguaagagaggaucuuuaagguccgaggugagcucggaagucggcucuaccgguccacccggguccgaggcaucaggcccuccagccgcugcacccccggcccugaucgagggaagugcuacugaaguguacgccggcgaguggcgggcggaucgacgcagcggguucggaguaucccagagaucuaacggccuuagguaugaaggugagugguuggggaaucggcgccacggauacggcagaacaaccaggccugacgguagccgugaagagggcaaauauaagcggaaccgacugguucaugggggaagagugaggucacuacucccccuggcccuucgccggggcaaagucaaggagaaaguggauagagcaguggaaggggcuaggcgcgccgucagugcugcccgacagcggcaggagauugcagccgcucgugcggcagacgcccuguugaaggcuguugccgcauccagcguggccgaaaaggcuguagaggccgcaagaauggcgaaacucauagcucaagaccugcagccaauguuagaagccccuggaaggcgcccccggcaggauucugagggcucagacacggagccacuggaugaagacagucccgguguguacgagaaugggcucacuccuagcgaaggauccccagagcuuccgucuucgcccgcaagcuccagacaaccuuggaggccacccgccugucgaucaccucugccacccggcggugaucagggcccguuuaguucuccuaaggcuuggccagaagaguggggaggagccggcgcacaggcugaggaauuggccggguaugaggcggaagacgaggccggaaugcagggccccgguccucgcgaugggagcccccuacugggaggcugcuccgacucaagcgguucucuccgggaggaagagggcgaagaugaggaaccacugccuccccuuagagcuccagcagggaccgagccggagccuaucgccaugcuggucuugaggggauccaguagccguggccccgacgcugggugucucacagaggaacugggagaaccagccgcaacugagcgccccgcgcaaccuggcgccgcuaacccauuagugguuggugccguggcacugcuagaucucucucuggcuuuccuuuuuagucaguugcugaccuga

SEQ ID NO: 57907 - RNA, 1671 nt, Artificial Sequence
  derived and/or modified sequence opt3 from JRK__Homo_sapiens__NP_001070995
auggccagcaagcccgcugcaggcaaauccagaggggagaagaggaaacgggugguccugacccucaaggagaaaaucgacauuugcacacgccuugagaagggagaaucucgaaaggcccugaugcaggaguacaacguugguaugucaacuuuguaugauauacgugcgcacaaagcucaauuacugagauucuuugccaguagcgacuccaauaaggcacuagaacagaggcggacgcuccauaccccuaaacuggagcaccuugaucgcgugcuguacgagugguucuugggcaagagaucugaagggguaccagugucgggaccgaugcucaucgagaaagccaaggacuuuuaugaacagaugcagcugacagagcccugugucuucucaggcgguuggcuguggagguuuaaggcucggcaugggauuaaaaagcucgaugcaagcagugagaaacaauccgccgaccaccaggcugccgaacaguucugcgcguuuuuccgcucuuuagcagccgagcauggacugagcgcugaacagguguacaacgccgaugagacuggcuuguuuuggcgaugucuuccuaauccaacccccgaaggcggggcaguuccuggaccaaagcaagguaaagacagacugacagugcuaaugugcgcuaacgccaccggcucccacaggcucaagccccuggcgaucgggaaauguucaggaccucgggccuucaagggcauucagcaccuuccagucgcauauaaggcucaggguaaugccuggguggauaaagagaucuuuagugacugguuccaucacauauuuguaccgagcguucgugagcauuuccgcacuaucgggcugcccgaagauucuaaggcuguguugcuccuggacuccucaagagcccacccucaggaggcagaauuagucagcaguaacguguucacaauuuuucugccagccucuguggcuucccucguccaacccauggagcagggaaucaggcgggauuucaugcgaaauuuuauuaacccuccaguuccccuucagggcccgcacgcgcgcuacaauaugaacgacgcaaucuucagcguggccugcgcuuggaaugccguaccuucgcauguguuuagaagggcauggcggaaacuguggcccucugucgccuucgcugaaggcuccucaagugaggaggaauuggaggccgaauguuuuccagugaagccucacaacaaaucauucgcacauauacuagagcugguuaaggaaggguccucuugccccggacaacuccgccagagacaggcggcuagcugggguguggccggcagggaggcagaagggggacguccacccgccgcuaccagcccugccgaagucguguggaguuccgagaagacgccaaaagcagaccaggauggccggggugacccgggggaaggcgaggagguagcuugggaacaagccgcgguugccuuugaugcugugcugcgauucgcagagagacagcccuguuuuagcgcccaggaagucggacagcuuagggcucugcgcgccguguuccggucucaacagcaggagacugucggcuuggaagacgugguugugaccucaccugaggagcucgcaauuccaaagugcugucuggaagcgaguacagagacuuga

SEQ ID NO: 57908 - RNA, 996 nt, Artificial Sequence
  derived and/or modified sequence opt3 from JSRP1__Homo_sapiens__NP_653217
augagcaugaccacaagagccugggaggaacuggacggcgggcucggauccugccaggcucuugaggaucacucugcacuggccgaaacucaagaggacagggcgucagcuacgccccgguuggccgauagugguagcgugccucaugacucccaggucgcagaaggcccaucuguugauacccgcccgaagaaaauggagaaggagcccgccgcucgagggacaccuggaacuggcaaagaacguuuaaaggccggugccucgccaagaucagugcccgcuaggaaaaaggcccagaccgcgccuccacugcagcccccuccaccgcccccugcacuaagcgaggaacucccauggggagaccugagucuuaacaagugucugguauuggccucccucguggcucugcuggggucugccuuccaacucugccgggaugcaguccccggcgaggcugccuuacaggcgcgcgugccugagccauggguucccccgagcuccgccccuagagaacccucaaguccacugccuaaauuugaggcacaggcucccccaagcgcacccccugcuccaagggccgaagcagaggugcggccgaagauccccggcucucgcgaagccgcugagaaugacgaggaggaaccuggggaagcgacaggagaggcaguccgagaagauagagugacccuugccgacagggguccaaaagagcggccccgucgcgagggcaagccuagaaaagaaaagccaaggaaggaggaacggcccaaaaaggagcgaccgcgcaaagaagagagaccuagggcugcccgggagccacgcgaagcauugccccagagaugggaguccagggaagggggacaccguccuugggcccgggauucacgagacgcugagcccagaaagaaacaagccuggguaagcccaaggcgcccugaugaggaacagcggcccggcaguagacagaagcugagggcagguaaagggcgcgacuga

SEQ ID NO: 57909 - RNA, 441 nt, Artificial Sequence
  derived and/or modified sequence opt3 from JTB__Homo_sapiens__NP_006685
augcuggccggcgcugggagacccggacucccucaggguaggcaccuuugcuggcuguugugugcauucaccuuaaagcugugccaagccgaggcgccagugcaggaagagaaacuaagcgcuuccacaucuaaccucccguguuggcuggucgaagaguuuguuguggccgaagagugcucacccuguaguaauuuccgggcaaagacuacgccugagugcggcccaaccggguacguagagaaaaucacauguagcuccucuaagcgcaacgaauuuaaaucgugccgaucagcccuuauggaacagcgucuguucuggaaguuugagggagcuguggucuguguggcauugauuuucgccugccucguuauaaucagacagaggcaacuggaccggaaggcucuggagaaagugcgcaagcagauugaaagcaucuga

SEQ ID NO: 57910 - RNA, 1044 nt, Artificial Sequence
  derived and/or modified sequence opt3 from JUNB__Homo_sapiens__NP_002220
augugcaccaagauggagcagcccuucuaccacgacgauagcuauacagccacuggcuacgggagagcuccuggaggucugucccuccaugacuauaaacuucugaagccaucuuuggcagugaacuuagccgauccguacaggucacugaaagcgcccggcgcucgggggccuggaccagaaggcggugggggaggcaguuauuuuagcggccaaggguccgacacgggagccucucuaaagcucgcaucgucagagcuggaacgccuuaucguccccaauagcaacgguguuauuaccacaacuccuaccccacccggccaguacuucuauccucgagggggaggcaguggugggggagccggcggcgcugggggaggugugacagaggaacaggagggcuuugcagauggguucguaaaagcccuggacgauuugcacaagaugaaucaugugaccccaccgaacgucucccucggagcuacuggcggucccccugccgggccaggcggaguguacgcgggccccgagccuccacccguuuacacaaaucugucuagcuauuccccggcaucagccaguagcgggggagcuggugccgcagugggcaccgggucuuccuacccuacgacuaccauaucauaucugccccacgcuccaccuuuugccggaggccaucccgcgcagcucgguuuagggcguggcgccagcacauucaaggaggaaccacaaacuguccccgaagcaagaaguagggacgcuaccccuccagugucuccgaucaacauggaggaucaggagcggauuaaaguagaacgcaagagacugaggaaucggcuugccgcuacaaaaugucgcaagcgaaaauuggagagaaucgccaggcuggaagacaagguuaagacccuaaaagcagagaacgccggacucuccagcacggcuggccugcuucgggaacagguggcgcagcugaagcaaaaagucaugacucacgugucgaaugggugccaguugcuccugggagugaagggucacgcauuuuga

SEQ ID NO: 57911 - RNA, 1044 nt, Artificial Sequence
  derived and/or modified sequence opt3 from JUND__Homo_sapiens__NP_005345
auggagacccccuucuacggcgacgaagcccugagcgggcucggagguggcgcuuccgggucuggaggcucauuugcaaguccugguagacuuuucccaggggccccgcccacagcggcugccggaagcaugaugaagaaagaugcacugacuuuguccuuaucugaacagguggccgcugcacugaagccugccgcugccccacccccuacgccacuaagggcggacggcgcacccucggccgcuccuccagauggccuccuggccucaccggaccuugggcuguugaaacucgcaagccccgaacuggagcggcugaucauucaaaguaacggacucgucaccacaacuccuaccuccucucaguuuuuauauccaaagguugcugccagcgaggagcaggaguucgcggaagguuuugugaaagcccuggaggaucuucacaagcagaaucaauugggcgcaggggcugccgcugccgcagccgcugcggcagccggaggccccuccgguacagcuaccgggucagccccuccaggagaacuggcacccgccgcugccgcaccggaggcgccuguauacgcuaaccuaaguagcuaugccggcggcgcagggggagccgguggcgcugccacuguggcauucgcugccgagcccgucccauuuccucccccacccccuccaggggcgcucggaccgccccgccuggccgcucuuaaggacgaaccucagacagugccagauguucccucuuucggcgaguccccuccacugucacccauagacauggauacccaggaacgaaucaaagcagagcguaagagauugaggaaucggauugccgcuagcaaaugccgcaagagaaaacucgaaaggaucagucggcuggaggagaaggugaagacguuaaaaucucagaacacugaacuggccuccaccgcaagccuccuucgcgagcaagucgcgcagcugaagcagaaaguguugucgcauguaaauucugguugucagcuacugccgcaacaccagguuccugccuacuga

SEQ ID NO: 57912 - RNA, 2238 nt, Artificial Sequence
  derived and/or modified sequence opt3 from JUP__Homo_sapiens__XP_006721941
auggaggugaugaaccugauggaacagcccaucaaggucaccgaguggcaacagacauacacuuaugacagcggcauucacuccggggccaauacgugcguuccuucugugucaaguaaaggaauaauggaagaggaugaggcuugugguagacaguacacccucaagaaaacaacuaccuauacacagggcguaccaccgagccaaggggaccuugaauaccagauguccaccacugcaagggccaagcgggugcgcgaggcgaugugccccggagucucuggcgaagauucgucacuguuguuagcuacacagguggagggucaggccaccaaccugcaacgacuagcagaaccuagccagcuccugaaaagugccaucguucaucuuauuaauuaucaggacgaugcugagcuggcaacgcgugccuugccagagcucacuaagcugcugaacgacgaagaucccguggucgugaccaaggcugccaugaucguaaaucagcucuccaaaaaggaggcgucuagaagggcauuaauggggagcccucaacugguugccgcugugguccggacaaugcagaacacuuccgaccuugauaccgcccgcuguacaaccucaauuuugcacaaucugagucaucacagagaaggacuacucgcaaucuucaaaagcggcggcauaccagcucuggugaggaugcuuucuucccccguggagucaguccuguuuuacgccaucacgacuuugcauaaccuccuguuauaucaggaaggggcgaagauggccguucggcuggcagacggacuccagaaaauggugccucuucugaauaagaacaauccaaaguucuuggcuauuacaaccgauugccuacagcugcucgccuacgguaaccaggagagcaaacugaucauucuugcuaauggcgggccgcaggcccugguacaaaucaugcgcaacuacaguuaugagaaguugcucuggacuacaucucgagugcugaaagucuuauccgugugucccagcaauaagccugcaauaguugaagccggaggcaugcaggcucuggguaaacaccuaaccucgaacucuccaagacucgugcagaacugccuguggacgcuuaggaauuuguccgacgucgcgaccaagcaggaggggcuggaaucagugcucaaaauucugguaaaccaacuuaguguugaugacgugaauguccugacaugugcaacuggaaccuugagcaaccucacaugcaauaacuccaagaauaagacucuggugacccagaacucuggcgucgaggccuuaauccacgcuauucugcgggccggcgacaaagaugacaucacagaacccgcagugugugcccuacgucaucucaccagccgccacccugaggcugagauggcccaaaauucaguuagacugaacuacgggaucccagcaauugugaaacuuuugaaucagcccaaccaauggccgcugguaaaggcgacuauaggacucaucaggaaucuggcuuuaugcccugccaaccaugcaccccugcaggaagccgcugucauuccacggcuugugcaguugcucguuaaggcccaccaggaugcacaacgacacguggcugccgguacgcagcagccuuauacagacggcguccgcauggaggaaaucguggagggguguaccggagcgcugcauauacuagccagagaucccaugaauaggauggaaauuuuucggcugaacacuaucccacucuucguacaacugcuuuacaguuccguggagaacauccagcgcguugcugcaggcgucuugugcgagcuggcccaggacaaagaagcugccgaugcaauugacgcggagggugccagcgcucccuuaauggaacuccugcacucuagaaaugaggggaccgccacauaugcagcugccgugcuuuuuaggaucucagaggauaagaacccugacuaccguaagcgggugagugucgaacugaccaauagcuuguucaaacaugauccagcagccugggaggcugcgcaguccaugauuccgauaaacgaacccuauggcgacgacauggaugccacuuaccgaccuauguacucuucggacguuccacucgauccccuggagaugcacauggacauggauggagacuauccuaucgauacauacagcgacggccuaagaccacccuauccgacggcagaucauaugcuggcuuga

SEQ ID NO: 57913 - RNA, 2043 nt, Artificial Sequence
  derived and/or modified sequence opt3 from KAL1__Homo_sapiens__NP_000207
auggugcccggcgucccuggggccguucugacccucugccuuuggcuggcugcaagcuccggauguuuggccgcggguccaggcgcugccgcagccagaagguuagacgagucucugucagcugggagugugcagcgggcacgcugcgccagccgaugucuaucccuccaaaucacacguauuucugcuuucuuucagcacuuccagaacaauggaucgcugguauggugccagaaccauaagcaauguucaaaaugccuugaaccguguaaggagagcggcgaucugagaaaacaccagugccagaguuuuugugaacccuuguucccuaagaaauccuacgagugccucacuucuugugaauuucugaaguauauacugcucgugaagcagggugacugcccagcccccgagaaagcgagcggguucgcagccgcuugcgucgaguccugugaaguggauaaugagugcucaggaguuaagaaauguugcaguaacggcuguggccauacgugccaagugccuaagaccuuauacaaaggggucccacugaagcccaggaaggaacuucgguuuacagaguugcagagcggacagcuggaggugaaauggucuuccaaguucaauaucucaauugaaccuguaaucuauguugugcagcgcagauggaacuacgguauucacccaagcgaggacgaugccacucauuggcaaaccgucgcacagacaaccgacgaaagggugcagcuaacugauauccggccgagucgcugguaucaauuucgaguggcugccgucaauguucacggcacaagaggguucaccgcgcccucuaaacacuuuagguccagcaaggacccuucggccccacccgcuccugcaaaccuccggcuggccaauucuacggugaacuccgauggaucaguaacugugaccauagucugggaccuuccagaggaacccgauaucccggugcaucacuacaaaguuuucuggaguuggauggugagcuccaagucucuggucccuacaaagaagaagcgucgcaaaacuaccgacggcuuucagaauagcgugauuuuggagaagcuccagcccgauugugacuauguaguugagcugcaggcuaucacauacuggggucaaaccagauuaaaaucagccaaggugagucugcauuucacguccacucacgcaacaaacaauaaagaacagcucgucaagaccaggaaagggggcauucagacucagcuuccauuccaacggcgacgcccuacaagaccccuggaggugggagccccauuuuaccaggacggccaguugcaggucaaaguguauuggaagaaaaccgaagaucccacgguuaacagguaccacgugcggugguucccugaggcuugcgcgcauaaucgcaccacagggagcgaagcaucuucaggaaugacucacgagaacuauaucauacuacaagaccugaguuuuagcuguaaguacaaaguaaccguccagccaauuagaccgaagucccauucuaaggccgaggcuguguucuuuacaacucccccuugcucggcccucaaagguaagagccacaaaccaguuggcugucugggggaagcaggacaugugcuuuccaagguccuggccaaacccgagaacuugucagcuaguuucaucgugcaggauguaaauauuaccggccacuuuucuuggaagauggccaaggcaaaccucuaucagccuaugacagguuuccaagugaccugggcggaaguuacuacggagagcaggcaaaauucccugccaaacucaaucaucagccagucucagauuuuacccuccgaccacuacguccugacagugccgaaucuacguccuaguacccucuaucggcuggaagugcagguccuuacuccagggggcgagggacccgcuaccauaaaaacauuucgaaccccugaguugcccccaagcucugcccauagaucccaccugaagcauaggcacccucaccauuacaaacccucaccagaacgcuacuga

SEQ ID NO: 57914 - RNA, 8961 nt, Artificial Sequence
  derived and/or modified sequence opt3 from KALRN__Homo_sapiens__NP_001019831
augaccgacagauucugggaucagugguaccugugguaucucagacuucugcgguuguuagaccgcggcagcuuucgaaacgaugggcugaaggccuccgacgugcuacccauccucaaggaaaaggucgcuuucguuucuggaggucgugauaaaagaggcgggccuauucugaccuuuccagccagaucaaaucacgaccggauccgccaagaagaucuuagaaagcuggugacuuacuuggccagugucccgagcgaagacgugugcaaaaggggauucacggucaucauugauaugcggggcuccaagugggaccucaucaagccccugcugaaaacccuccaggaagcguuuccugcugagauucacguggccuuaaucauaaagccagauaacuucuggcagaaacagaagacaaauuuugguucuucgaaauucaucuuugaaacuucaaugguuagcguggaggggcugaccaaacuugucgaccccagucaauugacagaggaguucgauggaucccuggacuauaaccacgaggaauggauugagcuacgccucucucuggaggaauuuuucaauagcgcagugcaucuucugucccgauuggaggaccuccaggaaaugcuggccagaaaggaguuuccuguggauguugaaggcucaaggcgguuaaucgacgagcacacccagcugaaaaagaaagugcucaaggcuccagucgaggaacuugaucgugagggccagcgccuguugcaauguauuagaugcagugacggguucagcggaaggaacuguauccccgguucugcagauuuccagucccuagugccuaaaauaacuucacugcucgacaagcugcauagcacacggcagcaccuucaccagauguggcaugugcgaaaacugaaguuggaucaaugcuuucagcuccgccuguucgaacaggacgccgagaagauguuugauuggauuagucacaauaaagaauuauuccugcaaucucauaccgagaucggcgucuccuaccaguaugcucuagaccuccagacgcagcacaaccacuuugccaugaauagcaugaacgcguacguuaauauuaacagaaucaugucgguggcaucuaggcuguccgaggccgggcauuaugcuucacaacagaucaagcagauuaguacucagcuugaucaagaauggaagucauucgccgcagcuuuggacgagcgguccaccauacuggccaugucugcgguauuucaccagaaggccgaacaguuccucagcggaguggacgcaugguguaaaaugugcucagagggcggucugccaagugaaaugcaggaucuugagcuggcuauccaucaccaucaaacauuguacgagcaggucacucaggccuacaccgaagugucccaggacgggaaggcucuccuggauguuuuacaacgcccgcugagccccggaaauucugagucacuaacagccaccgcaaacuauaguaaggccgugcaccagguccucgacgugguacacgaaguucugcaucaccagagaaggcuugagagcauuuggcaacaucguaaagugcgguugcaccagcgacugcagcucugugucuuucagcaagaugugcagcagguccuggacuggaucgagaaucacggcgaggcuuucuuauccaagcauacgggcguggggaaaucucugcacagagcgagggcacuucagaagcgccaugaugacuuugaggaaguugcccaaaacacuuacacaaacgcugauaaauugcucgaggccgcagaacagcuggcccagaccggagagugcgacccugaggaaauauauaaggcugcccggcaccuagaggugaggauucaggauuucguaaggcgcgucgaacaacgaaagcugcuccuggacaugucggugagcuuucauacucacacaaaagagcuuuggaccuggauggaagauuugcagaaggagaugcuggaggacguuugugcagacuccguggaugcgguccaggaauuaaucaaacaauuccagcagcagcaaacggcuacccucgacgccacacugaaugugaucaaggagggugaagaucuuauucagcagcugcggucagcaccacccaguuugggcgagccuucugaagcccgugacagcgcuguauccaacaauaaaacuccacacucaagcucuaucucccauauugagagugugcuccagcaacuggaugacgcccagguucagauggaggaacuauuccacgagagaaagauaaagcuggauaucuuucuccagcugaggauuuucgaacaauacaccaucgaggucacagcagagcuugacgcuuggaacgaagauuugcugcgccagaugaaugacuuuaacacugaggauuuaacccucgccgaacagcggcugcagagacauacagagaggaaacuugcgaugaauaacaugaccuucgaagugauccaacaggggcaggaccugcaccaauauauuacugaggugcaggccagcggaauagagcuaaucugcgaaaaggauauugaccucgcugcacagguccaggagcuguuggaauuucugcaugagaaacaacacgaauuagagcucaaugccgagcagacgcacaagcgacuggaacagugucuucagcugcgccauuugcaagcugagguuaaacaggugcucggcuggauccggaacggugaaucuaugcugaaugccucccuagugaacgcaucaagucugagcgaggcggaacagcuucagagagagcacgagcaauuccagcucgccauugaaucgcuguuucaugcuacauccuugcagaagacccaccaaucugcccugcagguacagcagaaagcagaggucuuacuccaagcugggcacuacgacgccgaugcaaucagggaaugcgccgagaagguggcucugcauuggcagcagcuuaugcugaagauggaggaccguuugaaacucguuaaugcgagcguggccuucuauaagacuucagaacaggucugcagugugcuggagucccuagaacaagaguaccgccgggaugaagacugguguggcggaagagauaaacugggccccgcagcugagauagaccacguuaucccgcuuauuucuaagcaucucgagcagaaagaagccuuucugaaggccugcaccuuggcuaggcgaaacgcagagguguucuuaaaguacauccaccggaauaacguaagcaugccuuccgucgccucacauacacgcgggcccgaacaacaggugaaagcgauucugagcgagcuccugcaaagagaaaacagggugcuucacuuuuggacccugaagaaacggcgauuggaucagugucagcaguaugucguuuucgagagaagugcuaagcaagcccuagacuggauccaggagacuggagaauuuuaccugucuacacacacguccaccggugagacuacagaagagacccaggaacuccugaaagaguauggcgaguuccgcgugccagcaaagcaaacaaaggaaaaaguaaaacuuuuaauacagcuggccgauagcuucguggagaaagggcauauucacgcuacugaaaucaggaagugggucaccacgguggacaaacauuaccgugauuuuucgcuccggaugggaaaguauagauacucauuggagaaggcacugggcguuaauaccgaggacaacaaagaccucgaacuggauauuaucccugccucucuuagugacagggaggugaagcugcgcgaugcgaaucacgaagucaacgaggaaaaacgaaaguccgcuaggaagaaggaguucauaauggccgaguugcuacagacagaaaaagcauaugugcgggaccugcacgagugccucgaaacuuacuuaugggagaugaccagcgguguugaagagauacccccagggauucugaauaaggagcauaucauuuuuggcaacauccaggaaauauacgauuuccacaauaacauuuuucuuaaggagcuggaaaaauaugagcaacuccccgaagacgugggacauuguuucgucacaugggccgauaaguuucagauguacguaacuuauugcaaaaauaagccugacucuaaccaguugauccuggagcacgcuggcaccuucuuugaugagauccagcaaaggcaugggcucgccaauagcauuuccucauaccugaucaaaccagugcagcgcauuacgaaguaucagcuucuacugaaggaauuguuaacauguugcgaggaaggaaaaggugagcugaaggacggccucgagguuaugcugagugugccgaaaaaggcaaacgaugcuaugcacgucagcaugcuugaaggguucgacgagaaucuggaugugcagggagaacucauauugcaagacgccuuucagguaugggaccccaaaucucugauccguaagggcagagagcggcaccuauuccuguucgaaauuucccucguguuuucaaaggagaucaaagauaguagcggucauaccaaguacgucuauaaaaacaaacuucugacuuccgaguuagggguuacagaacacguggagggcgacccuuguaaauucgcguuguggucuggaaggaccccaucgagcgauaauaagacugugcugaaggccucaaacauugaaaccaaacaggaguggaucaagaacauacgcgaagucauccaagagcgaauuauccaucucaaaggcgcacugaaggagccccuucagcugccuaaaacaccagcuaagcagagaaauaacuccaagcgggacgggguggaagauauugacagucagggagauggcucuagccaacccgacacgaucuccauagccucaaggaccucucagaauacuguugauagcgacaaacucaguggugggugcgaguugacaguagugcugcaggauuuuuccgcuggacacagcucugaauuaaccauucaggucggccaaacaguggagcuacuggaacgcccgucagagagaccugguuggugucucguuaggacuaccgagcgguccccaccccuugaaggccuggugccuaguagcgcauugugcaucucgcacucucguuccagcgucgagauggacugcuucuuuccccuggugaaggaugccuacucacauaguucuuccgaaaacgggggaaaaagcgagucaguagccaaucuccaggcucagccaagucugaacagcauccacuccucuccuggccccaagcgcagcacgaauacacuuaaaaaguggcucaccuccccaguccgaagacugaacucagggaaagcggacggaaauauuaagaagcagaaaaaggugagggacggccggaaaucuuucgauuuggguaguccgaagccuggggacgagacuacaccccagggagauucggcagacgagaagucaaagaagggcuggggugaggaugaaccagacgaggaaucccauacaccccugccuccacccaugaaaauauuugauaacgacccuacucaggaugagaugucuagcagcuuacuagccgcucgccaggccuccaccgagguuccgacagcagccgaccuggugaaugcuaucgaaaagcucgucaaaaacaaacuuagucuggagggcucuagcuacagagggucauugaaagauccagcgggaugucugaaugaaggcauggcacccccuacgccacccaagaacccugaggaagaacaaaaggcaaaagcucucagggggcggauguucgugcugaaugagcuuguucagaccgaaaaggacuaugugaaagacuuaggaauugucguggagggcuuuaugaagcgaaucgaagagaaagguguaccggaagauaugagagggaaggacaagauuguguucggaaacauccaccagauauacgauuggcauaaagacuuuuuccuggccgagcucgagaagugcauccaggaacaagaucgcuuggcacagcuguuuauuaaacacgagaggaagcuacacaucuauguuugguacugucagaacaaaccccgguccgaauauauugucgccgaguacgacgcuuauuucgaggaagugaagcaggagaucaaucaacgucugacucucagugauuuccuuauaaaaccaauucagagaaucacaaaguaccagcuguugcugaaggacuuucucagguacagcgaaaaagccggccuggagugcucugauaucgaaaaggcgguggaguuaaugugucuugucccuaaacgcugcaacgacaugaugaaucugggucggcuccagggcuucgaggggacccuaacugcacaaggaaagcuguugcagcaggauacauuuuauguaauugaacuggacgccggcaugcagucccgaaccaaagagagaaggguguuccucuuugaacaaaucguuauauucucagagcuucugcgcaaggggagcuugacgcccggauacauguuuaagcggucgauuaaaaugaacuaucuggugcucgaagagaaugucgauaacgacccauguaaguucgcuuuaaugaauagagagacuucugaacgugugguucugcaggccgcuaacgcagacauccagcaagccugggugcaggauauuaaucagguccuugagacccagagggacuuucugaacgcucuacaaaguccuaucgaauaccagcggaaagagcgcuccacagccgugaugcgaagccagcccgcaagacucccacaggcgucaccgaggccuuauuccucuguacccgccggcagcgaaaagccacccaaagguaguuccuacaauccuccacugcccccuuugaagauaagcaccucuaacgggucaccgggauucgaguaucaucaaccaggcgauaaguuugaggcuaguaaacagaaugaccugggcgggugcaacggaacuuccagcauggccgugauuaaggauuacuacgcacucaaagaaaaugagaucuguguuucucagggugaagucguacaggugcuugcugucaaccaacagaauaugugccugguuuaucagcccgccucggaccacagcccugcagccgagggcugggugcccgggagcaucuuagcuccacugacaaaggcgaccgccgcagaguccagugauggaucuauuaaaaagagcuguuccuggcauacauugcggaugcgcaagagagcugaaguagagaacacuggcaaaaacgaagccaccgguccuaggaagcccaaagacauccucgggaauaaggugucagucaaagagacgaacaguucugaagagagcgagugcgaugaccuggauccaaauacauccauggaaauucuaaacccuaauuucauacaagagguggccccggaauuucuuguuccccugguggacguaaccugccuccugggagacacuguaaucuugcaguguaaggugugcggccgaccaaaaccuaccauuacauggaagggccccgaucagaacauccuggacacugauaauucaagcgcaaccuacacgguuucuuccugugacaguggggagaucacacucaagauuugcaaccuuaugccacaggauagcggaauauauaccuguaucgcuacuaaugaccacgguacaaccucgacuuccgccacagugaaaguccaaggcgugccugcggcucccaaccggccgauugcccaggaacguucuugcaccucagucauccugagaugguuaccaccuagcaguacggggaauuguacuauuuccggauacaccguggaguaucgcgaggaaggcucucagaucuggcagcaaagcguugcaucaacacuggauaccuacuuggugauagaggaccucucccccgguugcccauaucaguucaggguaagugccagcaaccccugggggaucucucugccuucagaaccguccgaguucgugcggcuacccgaauacgaugcugcagccgacggagcgacaauuagcuggaaggagaauuuugauucugcuuacacugagcuuaacgaaaucggcagaggccgcuucaguauugucaaaaaguguauccauaaagccaccaggaaggacguugcagugaaguuugucucgaaaaagaugaaaaagaaagagcaggccgcucacgaagccgcacugcuccagcaucugcaacauccacaguauauaacguugcacgauacauacgaguccccuacuagcuauauuuuaauccuggagcucauggacgacgggcgacuucuggauuaccuaaugaaucaugacgaacugauggaggaaaagguggcuuucuauauucgggauaucauggaggcccuccaguacuugcacaacugcagaguagcgcaccuggacauaaagcccgaaaaccuucugaucgaucucaggauuccugugccacgcguuaaauuaaucgaccuggaggaugccgugcagauuucaggacauuuucacauccaucacuugcuggguaaucccgaguucgcagcuccugaagucauacaaggcauuccagugucucucgggaccgacaucuggagcaucggaguccuuacauaugugaugcuguccggcguuagucccuuucuagaugagucaaaggaagagaccuguauuaacguaugccguguggacuucucuuuuccgcaugaauacuucugcggugucagcaaugccgcacgggauuuuaucaacgugauacugcaggaggacuucagaaggcgcccuacugcugccaccugucuccagcacccaugguugcaaccccacaauggguccuacaguaaaauuccucuggauacaagccgacuugccugcuuuaucgagcggagaaagcaucagaacgacguuaggccaauucccaaugugaaauccuauaucgucaaccgcgugaaucagggaacguga

SEQ ID NO: 57915 - RNA, 4059 nt, Artificial Sequence
  derived and/or modified sequence opt3 from KANK1__Homo_sapiens__NP_001243806
auggcccacaccacaaaggugaacggcagcgcuuccgggaaagcaggagacauccugucuggugaucaggacaaggagcaaaaagaucccuacuucgucgaaacuccuuauggcuaccagcucgaccuugauuuucugaaguauguugacgauauucagaaagggaauacgauaaagagauugaacauccagaagaggcggaaaccaucagugccgugccccgagccucgcaccacaaguggacaacagggcauuuggacuagcaccgaauccuuaucuucgucaaauagcgacgauaacaagcaguguccaaauuuccugaucgcccgaagucagguaacauccacccccauuucuaaaccuccacccccucuagagacuagccucccauuucugacaaucccggaaaaccgucaacuucccccuccaaguccccagcugccuaagcauaauuugcacgugaccaaaacgcucauggagacuagaaggcggcuggagcaggaacgcgcgaccaugcagaugacaccaggugaguucagaaggccccggcuggcuucauuugggggaaugggcacuaccaguagccucccgucuuucgucggcuccgggaaccauaauccugccaagcaccaauuacagaacggauaccaggguaauggcgacuaugggucauacgcacccgccgcuccaacaaccagcaguaugggaucuuccauacgccauagcccucugucgucuggcaucuccacgcccgugacuaacguuucaccaaugcaccuucaacacauucgagaacagauggcaaucgccuugaagagacugaaagagcuagaggaacaggugaggacaauucccguccuccaggugaagaucaguguacugcaagaggaaaaacggcagcuuguuagccagcugaagaaucagcgugcugccucccaaauaaacgugugcgguguccgcaaaagaucuuauagcgcggggaaugcaucacaguuggagcagcucaguagggcccggcgauccggaggcgaacuguacauugauuacgaggaggaagagauggaaaccguggagcagagcacucaacgcaucaaggaauuuagacaguuaacagcugacaugcaggcccuggagcagaaaauucaagauucuucaugugaggcaaguagcgaacucagggagaacggcgaaugccgguccguggcugucggggccgaggaaaacaugaaugacaucguuguguaucaucgcggaucuagaucguguaaggacgcggccguagguacccuuguggagaugaggaacugcggcgucagcgugacggaggcaaugcuggggguuaugaccgaagcugauaaggagaucgaauugcagcagcaaacaauugagucccuaaaagagaagauauaccgucuggaagugcagcuccgggagacuacccacgaccgagaaaugacaaaacugaagcaggagcuucaggccgcuggaucaagaaagaaggucgauaaggccacuauggcacaaccucugguguucaguaaaguaguugaagccgugguccagaccagggaccagauggugggcucucauauggauuuggucgacacauguguggguaccagcguugagacuaauuccguggggaucucaugccagccagaguguaagaacaaaguagucggcccggaacuccccaugaauugguggauugugaaggagcgcguugaaaugcacgaucggugcgcuggaagaagcguggagaugugugacaaaucugucuccguggaaguaagugugugcgagacgggcagcaacacagaggaaucuguuaaugaucugaccuuacugaagacuaaccuaaaucucaaggaggucagguccaucgggugcggagacuguucaguggaugugaccgucugcaguccuaaagaaugugcgagccgcgguguuaacacagaggcagugucgcaaguggaagccgcuguaauggccgucccacgaaccgcagaccaggacacuuccacagaucuggagcaagugcaccaguuuacgaauaccgagacugccacacuuauagaaucuugcaccaacacauguuugagcacucuggacaagcaaaccucaacgcagaccguugagacacggacuguggcugucggcgaagggcgugugaaagauauuaauaguuccaccaagacaagaucuaucggaguuggcacucuccugagcggucauuccggguucgacaggcccucagccgugaaaaccaaggagagcggcguaggacagaucaacauuaaugauaacuaucuugucggccugaagaugcgcacgaucgcaugcgggccuccacaauugacagugggacucaccgcgagucggagaucugugggugucggcgacgaucccguuggggagucccuggaaaacccgcagccucaggcuccauuaggaaugaugacuggccuggaccacuacauugagaggauacagaaacuacucgccgaacaacagacacugcuugcagagaauuauagcgaauuggccgaggcuuuuggugagccccauucgcagauggggucacugaacucucagcucaucaguacccuguccagcauuaauucugugaugaaaagcgccuccacugaagaguuacgaaacccugauuuccagaaaaccucacugggcaagaucacaggaaauuaccuuggcuauacguguaaaugcgggggauugcagaguggcagcccccucucuucccagaccucacagccagaacaagagguagguacuuccgaagggaagccuaucagcucccuggacgcauuucccacacaggagggaacccuaucuccagugaaccugacagaugaccagauugcugccggccucuacgcguguacuaauaacgagucgacccugaaaagcauaaugaagaagaaagaugguaauaaggacucaaacggcgccaaaaagaaucuucaguucgucgggaucaacggaggcuacgaaacgacauccagugacgauucuagcuccgacgagucaucuagcagugaauccgaugacgagugcgaugugauugaauauccguuggaggaggaagaggaagaggaggacgaagauacccgcgggauggcugagggacaccaugcaguuaauaucgaaggccugaaaagcgcccggguggaggacgaaaugcaaguccaggagugugagccugaaaagguggagauuagagaaagguacgaguuaucugaaaagaugcucucagcuugcaaccugcuuaaaaauacuaucaacgaucccaaggcccugaccuccaaagacaugcguuucugcuugaacacacuccagcacgagugguuucgcguuaguagccaaaagucggcaauaccagcgauggugggugauuauaucgccgcuuucgaggccauuucucccgacguccugcgguacguaaucaaucuagcagaugggaacggaaauacugcucugcacuauuccgugagccauucaaacuuugaaauuguuaaacuccugcuugacgccgacguguguaaugucgaucaccagaacaaggcaggcuacaccccuaucauguuggccgcucuggcggccguggaggcagaaaaggacaugagaauaguagaggaauuauucgguugcggcgaugugaaugcuaaagccagucaggccgggcagacagcucucaugcuggcagucucucauggaaggauugacaugguuaagggccuucuggccuguggggcggaugugaacauccaagacgaugagggauccacggcucuaaugugcgccagcgagcacggccacguggaaauugucaaacuccuguuggcacagccagguuguaaugggcaucuggaggacaacgauggaucaaccgccuuaaguaucgcucucgaagcaggccacaaggacauagccgugcugcuuuaugcgcauguuaauuuugcuaaagcccagagccccgguacuccucgacugggccggaagacauccccggggccaacccaccgcggaucuuucgauuga

SEQ ID NO: 57916 - RNA, 2556 nt, Artificial Sequence
  derived and/or modified sequence opt3 from KANK2__Homo_sapiens__NP_001129663
auggcccaggugcugcacguccccgcuccuuucccaggcacuccggggcccgcaagcccuccagccuuucccgcgaaggacccugauccacccuacuccguugagacaccuuauggauacagacucgaccuugauuuccugaaauauguggacgauaucgaaaagggucauacuuugaggcggguagcugugcaacgccgaccacguuuaucuucacugccgagaggccccgggaguugguggacgagcaccgagucccuaugcucuaacgccucgggagacucaaggcacagcgcauacaguuauuguggccgggguuuuuacccucaguauggggcccucgaaacacgcggaggcuucaauccaagagucgagaggacucugcuugaugcucggcgccgacuggaagaccaggcagccacccccacaggcuuggggucccucaccccuucugcugccggaagcacugcgucccugguggguguuggccugccacccccgacaccuagaucaagugggcucagcacccccgugccaccuucugcaggacauuuagcccacgucagggagcagauggcuggcgcccugcggaaacuucgucaauuggaggaacaggugaagcugauucccguacuacagguuaaacucuccgugcugcaggaggaaaagcgccaacuuacgguccagcugaagucacagaaauuuuugggucauccaacugcagggagaggaaggagcgagcucugccuggauuuacccgacccuccagaggauccgguggcucuggaaacccggagugugggcacauggguccgagagcgcgaccucggcaugcccgauggggaagccgcgcuugccgcaaagguugcugugcuggagacucaguugaaaaaggcccuacaagaacugcaggcugcccaggcaagacaagccgacccucagccacaggcuuggcccccuccagacucucccguaaggguggauaccguccgggugguugagggaccgcgcgagguggaagucguggcguccacagcagccggugcuccugcccagagagcacaaagccucgagccauacggcaccgggcugagggcccuugcuaugcccggacguccugaaucgcccccaguauuccggucucaggagguuguggaaacgauguguccuguccccgccgcagcgacuuccaacgugcacauggucaaaaagauaucaaucacagagcgaaguugcgacggcgcugccggucugccagaggugccggcagaaagcuccucuagcccucccgggucagagguugccaguuugacccagccagaaaaguccacuggcagagugcccacacaggagccuacccacagggaaccaacgcgccaagcugccagccaggagucugaggaagcaggaggcaccgggggacccccugcugguguacggucaauuaugaaaagaaaggaggaagucgccgauccgacagcgcauaggcgcagucuccaguuugugggcguuaaugggggauacgagagcuccucugaggacucgagcacugccgaaaacaucuccgauaaugacucaaccgagaacgaagcuccagagccccgagaacgggugccuagugucgcagaggccccacagcugcgucccgcuggcacagccgcagcgaaaacuucuagacaagagugucaguuaagcagggaaucccagcacauuccuaccgccgagggugcuucagggagcaauacagaagaggaaauccgcauggagcugucuccggaucuaauauccgccugccucgcacuggagaaguaucuugacaaccccaaugcuuugaccgaacgggagcugaaaguggccuacacuacgguacuccaggaauggcugagacuugcauguaggagugaugcccauccagagcuggugcgacgccacuugguuacauuccgggcuaugagcgcgagacuccuggacuaugucgugaacaucgccgauucuaauggcaacaccgcauuacacuacuccgugucacaugcuaauuuuccugucguucaacagcugcuagacaguggagugugcaagguggacaaacagaacagggccggcuauagccccauuaugcucacugcccuggcuacccuuaagacacaagaugacaucgaaaccguauugcagcuguuccgucucgggaauauuaacgcaaaggccucgcaggcgggacagacugcucugauguuagccgucucccacggucgcguggauguugugaaagcacugcuugccugugaggcugacgucaacgugcaagaugacgauggcucuacagcauugaugugcgccugugagcaugggcacaaggaaaucgcgggacuccugcuagcuguuccaagcugcgacauaucacugacggaucgggacggcaguaccgcccucaugguggcacuggaugccggucaguccgagauugcuucuaugcuuuacagcagaaugaauaucaaaugcuccuuugccccuaugucagacgaugaaagccccaccaguucuuccgcagaggaguga

SEQ ID NO: 57917 - RNA, 1104 nt, Artificial Sequence
  derived and/or modified sequence opt3 from KANK4__Homo_sapiens__NP_001307198
auggagaagaccgacgaaaucagccccuccacaucucugaaaucaauuaugaagaaaaaggauuacggcuucagagccgggggaaacgguacuaaaaagaaucuccaguuugugggcgucaacgggggauaugagacgaccaguagcgaagagacauccggcgaagacucuacuccugaggaucuuucggacucagaggcugaaaagaaaugcgaugguccagaccacaagcauguuaaagaugcacaccugaccugugaggccgggcaaggaauaccggaaggcacaugccaugcggcucaggagagcggccccggggaggaagugccucacaguaaggccgagagguacaaaccauccgaagaguucuugaaugcaugucgggccuuaucucagcaucugcccgaaaccggaacuacaaccgaccagcuacuccgccaaagccugaacacgaucucccaggagugguuucgaguaucaagucguaagucuagcuccccugcuguggucgcaucauaucuucacgaggugcagccacacagcccccauuuccugaaguugcucguuaaucuggccgaucacaacgguaauacugcucugcauuacagugugucucacuccaacuuuagcauugucaaacucuuacuggaaaccggcgugugcaauguagaccaccagaacaaggccggguauacagcgguuaugaucacuccucuugcaucggccgagaccaaugaagauauggcuguggucuggaaauugcugagagagggaaacgugaauauucaagccacacagggcggucagaccgcacuaaugcucggggugucucaugacagggaagauaugguccaggcucugcuuuccugucaagccgacguuaaccugcaggaccacgauggaucaagugcguugaugguggccugccaucacggcaauguagaccucgugcggcuguuacuggcacauccagcuugugauagcucccucacggacaaggccggccgcacugcucuuucuaucgcccugaaaagcccgacacacauggagauagcaggguugcuaagagcccacgcugagcagggaaggucacugggucucuga

SEQ ID NO: 57918 - RNA, 3318 nt, Artificial Sequence
  derived and/or modified sequence opt3 from KANSL1__Homo_sapiens__XP_005275701
auggccgcuauggcacccgcccugaccgacgcggcugccgaggcacaccauaucagauucaagcucgccccuccaagcuccacacuuucuccgggcucagcugaaaacaaugggaacgcaaauauucugauagccgcuaacggaacuaaaaggaaggccaucgcggcagaggaucccaguuuggacuuucggaauaacccuacgaaagaagauuuagguaagcugcagccccuaguggccagcuaccucugcuccgacgucaccucuguucccucgaaagagucacugaaacuucaaggcguguucagcaagcagacaguacugaagagucacccuuugcucucccagucuuaugaacugcgcgcugagcugcucgggcgacagccaguguuagaguuuagccuggaaaaucuucguacuaugaacaccuccggacaaacagccuugccccaggcaccugucaauggccuggcuaagaaacuaaccaagucaaguacucauagcgaucacgacaacucuacaucccucaauggugggaaaagagcccugaccucaagcgcgcuucauggaggcgagaugggcgggagugaaucuggagaucugaaggguggcaugacgaacuguacuuugccacacaggucccucgacguggagcacaccacacuguacagcaauaacucgacugccaauaagucuuccguuaacucaauggagcagccggcauuacaggggaguagccggcugucccccggaaccgauucuagcucaaaccucggcggugugaaacuugaagggaagaaaaguccucuguccagcauuuuguucucugcucuagacucagauacacgcaucaccgcccugcucagaaggcaagcugacauugagagucgggcccgccgacugcagaagagacuucaggucgugcaggcaaaacaaguagaaaggcauauccagcaccagcugggaggcuuuuuggagaagacgcucagcaaacugccaaauuuagaaucccugcggccccguucucaacuaaugcucacucgcaaggccgaggcugcgcugagaaaggcagccucggagacaaccacuagcgaaggccuuuccaacuucuugaaaucaaauaguauaucugaggaacuggagagguuuacagcuagcgggaucgccaaccuccggugcuccgaacaggcauucgauucagacguuaccgacucuagcuccggaggugagagugauauugaggaagaggaacugacgcgagccgacccugagcagcgccaugugccacuuagaaggcggagcgaauggaagugggcugccgaucgcgcagcgaucgucucuagauggaauuggcugcaggcucacguguccgacuuggaguauaggauucgucaacagaccgauaucuacaaacagauacgggccaacaagggccucauugugcugggggaggucccaccgccugaacacacaacugacuuauuucugccccuaucaagugagguuaaaaccgaucauggaacagacaagcucaucgaaagcgugucgcagccacuggagaaucacggcgcaccuauuaucggucauaucuccgagucucuuagcacuaagucauguggggccuugcgacccguaaacggcgugauuaauacccugcaaccaguccucgcugaucacauacccggagacaguuccgaugccgaggaacagcugcauaaaaagcagagauuaaaccuggugucuagcuccucagacggcacaugcguugcagcuaggacccgcccugugcuuagcuguaaaaagcggagauuggucaggccaaauaguaucgugccgcucucuaaaaagguacaccgcaacuccacuauucgacccgggugcgacguuaauccuagcugugcccugugcggaucggguucaaucaacacgaugccacccgaaauacacuaugaggcgccucuacuggaacggcucucucagcuggauaguugugugcauccaguccuugccuuccccgacgaugugccgacauccuugcacuuucaaagcaugcugaagucucaguggcagaauaaaccuuucgacaagauuaaaccacccaagaaauuaagccucaagcaucgugcuccuaugcccggcucccugccagauccugcaagaaaggacaggcacaaacuugucucaaguuuucugaccacugccaaguugagccaccaucagacccgccccgaucggacacacagacaacaucucgacgaugugggggcuguuccaaugguggagaggguaaccgccccgaaagcagagcgacugcuaaacccucccccacccguccacgacccuaaccauucuaagaugcgccugcgggaucacuccucagaaagaagugaggugcucaaacaccauacugacaugagcuccucuucguaccuggcggccacacaccauccaccccacagcccucuuguuaggcaguugucaacguccagugauucuccggcuccagccagcuccucaucucaggugaccgcaagcaccagucaacagcccguccgucgccggagaggagaauccagcuucgacaucaauaacaucgugauuccuaugucuguagcugccacaaccaggguggagaagcugcaguauaaagaaaucuuaacaccaucauggcgagagguugaccuccagucccugaagggcagucccgaugaggaaaaugaggaaauugaggaccuuagcgaugcagccuucgcugcgcugcaugccaagugcgaagagauggagcgggcacgcuggcuauggacuaccucggucccuccgcaaagaagggguucucgguccuaccgaagcucagacgggagaacgacuccccagcucggcagugcuaacccaucuacaccucagcccgccuccccagaugugagcucaagucacagccuguccgaauacucucacggacagagcccucgcucccccauaucaccagaguugcauucugccccgcugacuccuguggcuagggacacaccccgucacuuagcaagugaagauacccgguguucgacuccagagcucggccuggacgagcaaagcguccagcccugggaaagaaggaccuuuccucuugcccauuccccacaggcggagugcgaagaucagcuggacgcucaagagcgcgccgcacgaugcacgagacggacaucugggucaaaaaccggaagggaaacugaggccgcucccacaagcccuccgaccguuccauugaagucccgccaccucguggcagccgcgacugcucagcgucccacccacagauga

SEQ ID NO: 57919 - RNA, 2637 nt, Artificial Sequence
  derived and/or modified sequence opt3 from KANSL3__Homo_sapiens__NP_001108488
auggcccacagaggcggggagagggacuuccagaccagcgcucggcgcaugggaacaucccugcucuuucaacuuucugugcaugaacgagagcuggauuuggucuucuuagaccacucauacgcaaagcccuggagugcccauccugaugcgagcuccgcucguccaacuagaaugcuguuuguuacgccgaggcggcagcacgaaucuaccaucgagucggacgugcccauugauguagaaacagugacuucaaccccuaugccacuauaugacaaccagaaagcccgcagcgucaugaaugagugcgagagacaugugauauucgcaaggacagaugccgacgcucccccuccacccgaagauugggaggaacacguuaaccggaccgguuggacuauggcacagaauaagcucuuuaacaaaauccugaaggcccuucaaagugaccgccuggcucgauuggccaaugagggcgcguguaacgagccugugcucagaagggucgcaguggauaaaugcgcccggcguguacgccaggcucuggccuccguuucuugggacacaaagcugauucaguggcuccacaccacguuaguggaaacucugagccuuccaauguuggcagcuuaccuggaugcccuacagacccucaaggggaaaaucccgacacugauugacagaaugcuugucuccucaaauacuaagaccggagcggccggcgcagaggcucugaguuugcuccugaaaaggcccugggacccugccguggguguguuaagccauaacaagccaucuaaacugcccggguccccucucauccuuauagcuucaagcggaccaaguucuuccgucuuccccacaagccggcgacaccgcuuuuggcaaucgcagcugucuuguuugggcaagguuaucccgguggccacccaucuacugaauaacggcuccgggguaggagugcuccagugccuggaacacaugauuggugcagucagaucaaaggugcuugagauccacagucauuucccucacaaacccauuauccugauaggcuggaauacgggggccuugguugcuugucaugugagcgucauggaauaugugacugcgguaguuugccucggauuuccacuguuaacaguggauggcccuaggggugacgucgaugacccccugcuagauaugaagaccccaguccucuucgugauugggcagaacucccugcaaugucaccccgaggcaauggaggacuuucgggagaaaauccgcgccgaaaauucucuugugguugugggaggcgcugaugacaacuugagaauuagcaaggccaaaaagaaaucagaaggccugacucagaguaugguagauaggugcauccaggacgagaucgucgauuuccucacaggggugcugacccgugcagaaggacauauggguuccgagccucgggaccaagacgccgagaagaagaaaaagccacgagauguugcuagaagggaccuugccuuugaagugccggagcgcggcagccggcccgcaucuccugcggcuaaacugccagccucacccagugggagcgaagauuuguccucugucucgagcuccccuacgucaaguccaaagaccaaagugacaacuguaaccucugcacaaaagagcucccagauuggaucaagccagcuccugaagagacacgugcagaggacagaggccguuuuaacucacaaacaggcucagguccccauaucuuccgaaccgccugaggagggcgaaaaggaggaccugcgcgugcagcuaaaacgacaucacccaaguagcccccucccugguucuaagaccuccaaacggcccaagaucaaggugucacugauuagucaaggggauacagccggcggaccaugugcaccuagccagggcucggcucccgaagccgccgggggaaaaccaaucaccaugacucuuggucaggcguccgcuggcgcaaaggaguugacggggcugcucacaaccgccaaaucuagcucaagugagggaggcgucuccgcuucuccgguuccuagcgugguguccucaagcacugcccccagugcacugcauaccuuacagucucgucugguagcgacauccccagguagcucgcuucccggggccaccucagcuucuaguuugcuccaaggccuguccuucagccuacaggacauaucuagcaagacuuccggacugccugccaauccaucacccggcccugcaccgcaggcuacaagugucaaacucccaacgcccaugcagagccugggggccauuaccacuggaacaucuaccaucgugagaacaaucccuguugcaacuacccuuuccucauugggugccacgccaggcgggaagcccaccgcuauucaccaacuguuaacaaacggaggccucgcgaagcuggccaguagccuuccuggucuggcacagaucuccaaccaggcuucuggguugaaagugccgacuaccauuacacucacucugaggggccaacccucgcgcauaaccacgcuaagcccaaugggaucaggcgccgccccuuccgaagagaguucuagccagguccugcccuccucaucucagcggcucccuccagcucccuga

SEQ ID NO: 57920 - RNA, 1878 nt, Artificial Sequence
  derived and/or modified sequence opt3 from KARS__Homo_sapiens__NP_001123561
augcugacccaggccgcugugagacucgucaggggcagccuucggaagacauccugggcagagugggggcaccgcgaacugcgauugggacaauuagcccccuucacugcgccucauaaagacaagucuuuuucagaucagcguagugagcugaaaagaaggcuaaaggcugaaaagaagguugccgagaaggaagcaaaacagaaggagcucagcgagaaacagcugucccaagccacggcugcagccaccaaccacacaacugacaauggugugggcccagaagaggaaucuguagauccgaaccaguacuauaagauccggucgcaggcuauucaucagcuuaaagugaauggggaggaccccuacccucacaaguuccaugucgauauaucacugaccgacuuuauccaaaaguauagccacuugcagccaggagaucaccucacagacauuacccugaaaguggccggccgcauccaugcgaagagagcaaguggugggaaacugauuuucuacgaucucaggggagagggcguuaaguuacaggugauggccaacucccggaauuauaaaucugaagaggaauuuauccacauaaacaauaagcugcgccgaggcgacaucauugggguccagggaaaccccgguaaaacuaagaagggcgagcuuagcaucauuccuuacgaaaucacauugcuguccccaugccuacauaugcucccccaucugcacuucgggcuuaaagauaaggagaccagauauaggcaacgguaccuggacuugauacucaaugauuuugugcgucagaaauucauuauccgcucaaagauuaucacguacaucagaaguuuucuggacgaguuaggauuccuggaaauugagacuccuaugaugaacauaaucccaggcggugcuguagccaaaccguuuauuaccuaucacaaugaacucgacaugaaccuuuacaugaggaucgcacccgagcuguaucacaagauguugguugucgggggaauagaucggguguacgaaauuggccgacaguuccgcaaugagggcaucgaccuaacacauaacccugaguuuacuaccugugaguucuauauggcuuacgccgauuaucacgaccugauggagaucacagaaaagauggugagcgggauggugaaacauauuaccggaucuuacaaggucacguaccacccagauggucccgagggccaagcguaugacguugauuucacuccuccauuuagaaggaucaauaugguggaagaacucgagaaagcccuggggaugaaacuucccgaaacaaaccuguucgagaccgaagagacucggaaaauuuuggacgauauaugcguagcaaaggcuguggaguguccgccuccccgcacaaccgccagacuccuggacaaguuagucggagaauuucuggaggugacgugcaucaacccaaccuucauuugugaucacccucagaucaugucaccccuagcuaaauggcauagguccaaggaaggccucacagagcguuuugaacuguucguuaugaaaaaggagaucugcaaugccuacacugagcuuaacgacccaaugcggcagcgacaguuguuugaggaacaagcaaaagccaaggcugcgggugacgaugaagcaauguucauugacgagaauuuuuguaccgcccuggaauaugggcugcccccuacagcuggcuggggaaugggcauagauagaguggccauguuccucacugacagcaacaauaucaaggagguccuucuguuuccagcaaugaaaccggaggauaagaaagaaaacguggccaccacagacaccuuggagaguacuacgguagggacaucuguuuga

SEQ ID NO: 57921 - RNA, 2514 nt, Artificial Sequence
  derived and/or modified sequence opt3 from KAT2A__Homo_sapiens__NP_066564
auggccgagcccagccaggcuccuaccccagcaccggccgcgcaacccagaccucugcaguccccagcucccgccccuacaccaacucccgcaccuucuccagccucagcuccgauccccacgccuaccccagcacccgccccugcuccagccgcggcacccgccggcaguacagggacuggagguccgggcguggggagcggaggcgcugguuccgggggagacccugccaggcccggccucucucagcagcaacgggcaucgcagcgcaaggcucagguccgaggccuuccacgugccaaaaagcuggagaaauuggggguuuucucagcgugcaaggccaacgagaccuguaaaugcaauggauggaagaacccuaagcccccaacagcacccagaauggauuuacagcaaccugcugccaaucugagcgaacuauguaggaguugcgagcacccacucgcugaccaugugucccaccuggaaaacguaucugaggaugagauuaaucggcuucuggguaugguggucgacguggaaaacuuguuuaugagcguucauaaagaggaagauaccgacacuaagcaaguguacuucuaucucuuuaaacugcugcgcaaguguauacuccagaugacaagaccggucguggagggcuccuuagggucacccccuuucgagaaaccaaauaucgaacagggaguacugaacuuuguucaauacaaguucagucaccuugcccccagggagcggcagaccauguuugaauugagcaagauguuccugcuaugccucaauuauuggaaacuggagacgccugcacaguuucgccaacgaucucaggccgaagauguggcuacuuacaaggucaacuauaccagauggcuuuguuacugccaugugccacaguccugugacucacugcccagguaugagacaacucacguguucggccggagcuugcuccguaguauuuuuaccgucacacgcagacagcuguuagagaaauucaggguugaaaaggauaaacuggugccggagaagcggacccucauccuuacgcacuuuccuaaauuccugucuauguuggaagaggaaauuuacggugcaaauuccccaaucugggagagcggguucacuaugcccccuucggagggaacacagcuaguaccccgaccagcgucuguguccgccgcugucgugccuucaacccccauauuuaguccaagcaugggcggcggguccaacucuagccugucacucgacagugccggagcagaaccgaugccuggugagaagcgcacucugcccgaaaaucuuacacuggaggaugccaagagauugaggguuaugggcgacaucccaauggaacucgugaacgaggucaugcugaccauuacggaucccgcugccauguuagggccugagaccucccugcuaagcgcaaaugcggcucgggacgaaacagcccgccucgaggaaagaaggggaaucauugaguuccaugugaucggcaacucucugacuccaaaagcaaaccgucggguacuuuuguggcugguuggucuccagaauguguuuucacaccagcugccccgaaugccuaaggaguacauagccagacuugucuucgacccgaaacauaagacccuggcuuugauuaaagaugggagggugaucggcggaauuugcuuucgcauguucccaacacagggcuuuacugaaaucgucuucugugccgugaccaguaacgagcaaguuaagggguauggaacacaccucaugaaucaccugaaggaauaccauaucaaacacaacauuuuauauuuucugaccuacgcagacgaguaugcuauagguuacuucaagaaacagggcuuuagcaaggauaucaaagugcccaagucccgguaucuaggguacauuaaggacuacgaaggagccacucucauggagugcgagcugaauccuagaaucccauauacggaacuuucucauauaauuaaaaagcagaaagagaucaucaagaaauugauugaaaggaagcaggcgcaaauccgcaagguauaccccggccugucgugcuucaaagaggguguccgacagauuccuguggaaagcguuccggggauacgggagacaggcuggaagccccucggaaaagagaagggcaaagaacugaaggauccagaccaguuauauaccacucugaaaaaccuuuuggcccagaucaagucccacccuucagcuuggcccuuuauggagccagugaagaaaagugaagcaccugauuacuaugaggucauucguuuccccaucgaccucaagaccaugacagaaagacugaggucucgcuacuaugugacccggaaacuauucguagccgaucugcaaagagugaucgcuaauuguagggaguacaacccaccggacagcgaguacugccgaugugccuccgcacucgaaaaguuuuucuauuuuaaacugaaggaagggggacuuauugauaaguga

SEQ ID NO: 57922 - RNA, 2499 nt, Artificial Sequence
  derived and/or modified sequence opt3 from KAT2B__Homo_sapiens__NP_003875
augagcgaggccggcggggcuggacccgguggcugcggggcaggagccggcgcgggugcugggccuggagcccugccaccgcagcccgcagcccucccuccagcucccccucaaggcuccccaugugcagccgcugccggcgggucuggagcgugcggucccgcaaccgccguggcugccgcaggcacagcugaagggccuggaggcggugggucagccagaaucgcggucaagaaagcccagcuuaggagugcaccacgggcuaagaaacuggagaaguugggaguuuacagcgccuguaaagcugaagaguccugcaaguguaacggcuggaagaauccgaaccccucuccuacuccaccccgcgccgacuuacagcagauuauagugucgcugacggaaucaugccgaagcuguagucacgcacuagccgcucauguaucccaccucgagaaugugucugaggaagagaugaaccgucugcuuggcaucguccuggauguggaauauuuguuuaccugcguucauaaagaggaggacgcggauacaaagcaaguguacuuuuaucucuucaaacugcugagaaagagcauucuccagagggggaaaccugucguggaaggauccuuagagaagaagccacccuuugaaaaaccgucaaucgagcaggguguaaauaacuucguucaguacaaguuuagucaccuuccugcaaaagaacggcaaacuauuguggagcuugccaagauguucuugaaucgcaucaacuauuggcaucuggaggcucccagccagagaaggcuacggucuccaaaugacgauauauccggcuacaaagaaaacuauacccgcuggcucuguuacugcaaugucccucaguuuugugacucacugccccgauacgagacaacccagguguucgggagaacucuucugaggagcguguuuacagucaugcggcgucaauugcucgaacaggcccgccaggagaaggauaaacugccauuagaaaagagaacccugauccucacgcacuuccccaaguuucuuaguaugcuggaggaggaaguuuauucucaaaacuccccuauuugggaccaggauuucuugagcgcaucgucuaggacuucccagcuaggaauccagaccgugauuaauccaccgcccguagccggcacaaucucauacaacaguacuagcuccucucuggagcaaccuaaugcugguagcucaaguccagccugcaaagcauccagcgggcucgaagcgaaccccggcgagaagcggaaaaugaccgacucucacgugcuggaagaggcuaagaaaccucgagucaugggagauauaccaauggagcuuauuaacgaagugaugucaacaaucaccgaccccgccgcaaugcugggcccggagacgaauuucuugagugcccauagcgcucgcgaugaagccgcaagacucgaggagaggcgcgggguuauugaguuccacguggucggaaacucccugaaucagaagccuaacaagaaaaucuuaauguggcuggugggucuacagaauguauucucucaucagcucccacggaugcccaaggaauauaucacuagacugguuuuugacccuaaacacaagacacuugcuuugauuaaagacggcagggugauagggggaaucugcuuccguauguuucccucgcaaggcuucaccgaaauugucuuuugugccgugacuagcaacgagcaggucaaggguuacgggacacaccugaugaaucaucucaaggaauaucacaucaaacaugauauacugaacuuccuuaccuacgcggacgaguaugccauuggcuacuuuaagaaacagggauucuccaaggagaucaaaaucccaaagacgaaguacgugggcuauauuaaagauuacgaaggggcuacccugaugggaugcgaguugaauccucggauccccuauacagaauuuucaguuauuauaaagaaacagaaggagaucauuaaaaagcucaucgaacgaaaacaagcacagaucagaaagguguacccaggucugaguuguuucaaggacggcguaaggcagauuccgauagagucuaucccugggauucgcgagacuggauggaaacccagcggcaaggaaaaauccaaggagccacgggaucccgaccaguuauauucaacccugaaaagcauccuacaacaggucaagucucaccaguccgccuggccuuuuauggaaccagugaagagaacagaggcucccgguuacuaugaaguuauuagguucccuauggaucucaaaacuaugagugagcgccugaagaaccgauacuacgugagcaaaaagcuguuuauggccgacuugcaacgggucuucaccaauugcaaagaguauaacccgccagaaucugaguacuauaagugugcaaauauccuggaaaaguucuuuuucuccaaaauaaaggaggcggggcucaucgauaaauga

SEQ ID NO: 57923 - RNA, 1485 nt, Artificial Sequence
  derived and/or modified sequence opt3 from KAT5__Homo_sapiens__NP_001193762
auggccgagguggucagccccguuccuggcgcugggagaagggaaccaggagaggugggucgggcacgcggcccgcccguagccgacccugggguggcgcuguccccacagggagaaaucauugagggcugccgacuccccguccuucguagaaaccaagauaaugaagacgaguggccucuggcugagauauugucugugaaggauaucucagguaggaaauuauucuacguucacuauauugacuuuaacaagcggcuggaugaaugggugacccaugagcgccuagaccucaaaaagauccaguuccccaaaaaggaagccaagacaccaacuaaaaaugggcugccuggaaguagaccaggcagcccggagagggaggucaagcggaaaguggaaguaguuucccccgcaacgccugugccaucugagaccgcccccgcuucggucuuuccucagaacggcgcagcccgccgagcuguggccgcgcagccagggagaaagaggaaaucaaauugucuuggaacagaugaagacagccaagauaguuccgacgguauucccucugcaccgcggaugacuggcagccugguguccgaucguucacacgacgauaucgucacccgcaugaagaacauagagugcaucgaauuggggagacauaggcucaagccuugguacuucagucccuauccacaggagcugacaacccugccuguucucuacuuaugugaguuuugccugaaauauggacggagccuuaaguguuugcagcgacaccugacuaaaugcgaccuacgccaucccccaggcaaugaaauuuacagaaaggguacaaucucuuucuuugagauugacgggaggaaaaacaaguccuauucacagaaucucugucugcuugccaaaugcuuccuggaucacaagaccuuguacuacgacacggaucccuuucucuucuaugugaugacugaauacgacuguaagggauuucacaucguaggcuauuucagcaaagagaaggaaaguaccgaggauuacaacguggcuugcauacugacauuaccuccauaucaacggcgcggcuacgggaaacugcucauugaguuuucuuaugaacuuuccaaggucgagggaaaaacugguaccccggaaaagccccugagcgacuugggccuacugucguacagaucuuacuggucccagacaauccucgagauucugauggggcuuaagucagaaaguggagagaggccucagaucaccaucaaugagauuagcgaaauaacguccaucaaaaaggaggaugugauuucuacucugcaguauuugaaccucaucaauuacuauaaaggccaauacauacugacauuaagcgaagacauuguugauggucaugagcgugccaugcugaagcggcuacuccgaaucgacucaaaaugucugcacuucaccccaaaggauuggaguaagagagggaaaugguga

SEQ ID NO: 57924 - RNA, 6015 nt, Artificial Sequence
  derived and/or modified sequence opt3 from KAT6A__Homo_sapiens__NP_006757
auggugaagcuggccaacccccucuacaccgaguggauccuugaagcuauuaaaaaggucaaaaagcagaaacaaagaccuagcgaggaaaggauaugcaaugcaguuuccucuucacacggccuggaccggaagacaguguuggagcaguuagaacugaguguaaaggaugggacuauccuaaaagugagcaacaagggacucaauuccuauaaagacccagauaacccgggucgcauugcccugcccaagccucgaaaucauggcaaacuugacaacaagcagaaugucgauuggaacaagcugaucaaacgugcgguggagggguuggcugagucuggaggcucgacgcucaagucaauugaaagauuccugaaaggucagaaggacguuagcgcccuguuugggggaagugcagccuccggcuuccaccaacagcucagguuagcuaucaaacgggcaauaggccaugggcgccugcuuaaggauggaccauuguacagacugaauaccaaagccacaaacguggacgguaaggagucuugugaaagccuauccugccuccccccugucucacugcuuccacacgagaaggauaaacccguggcugagccuaucccaauuuguaguuuuugccugggcacuaaggaacagaauagggagaaaaagccggaagaguugaucagcugugccgacugcgggaacucuggacaucccuccugucucaaauucucaccugaacugaccguacggguuaaggcguuacgcuggcagugcauugaguguaagacaugcagcaguugucgagaucaaggcaaaaaugcagacaacaugcuguuuugcgauucuugcgacagagguuuccacauggaguguugcgacccaccccucaccaggaugccuaaggggauguggaucugucagauaugccggccacguaaaaagggacgcaaacuucugcagaagaaggccgcucagauuaaaagaagguauacuaaucccaucggccggccgaagaaccgauugaaaaagcaaaacacaguguccaaaggcccuuuuagcaagguccgcaccgggcccggaagagguaggaagcggaaaauuacgcuaucgucucaguccgccucaaguagcuccgaagagggcuaccuggaacgcaucgaugggcucgacuucuguagagauucuaaugugagccugaaguuuaacaaaaagacuaaaggacuuaucgacggccugaccaaguucuuuacaccaucaccugaugguaggaaagcacguggggagguggucgacuauagugaacaguaccggauucgaaagagaggcaauaggaaguccagcacuucugauuggcccaccgacaaccaagauggaugggacggcaaacaggagaaugaggaacgcuuguucgggucacaggagauaaugacagaaaaggauauggagcucuuucgggacauccaggaacaagcucugcagaaaguuggagugaccgguccacccgacccucagguaagaugcccaagugugauugaguucggcaaguaugagauccacacgugguacagcuccccguacccccaggaauauucuagguuaccuaaacuguaccuaugugaguucugccucaaguauaugaagucgcgcacuauacugcaacagcauaugaaaaagugugggugguuucacccacccgccaacgaaauuuaccgaaaaaauaacaucagcgucuucgagguggauggaaauguuuccacaaucuauugccagaaccuuuguuugcuggcgaagcucuuucuggaccauaaaacccuuuacuaugauguggagccuuuccuguuuuacgucuugacucagaaugacgugaagggcugccaccucguagguuacuucucaaaggaaaaacacugccaacagaaguauaacguuaguuguauuaugauccugccacaguaccagcggaaaggguauggccguuuuuuaauugauuucucuuaccugcuaagcaagagagagggacaagccggcucccccgaaaaaccgcucucagaccuggggaggcuuagcuauauggcauacuggaagucugugauauuggagugccuguaucaucagaaugauaagcagaucuccauuaaaaagcucaguaaacugacaggaaucuguccucaagacaucaccagcacguuacaccaucugcgcaugcuugauuuucggucugaccaguucgucauuauaagaagggaaaaguugauccaggaucacauggcuaaacuccagcugaaccuacgaccaguggacgucgaucccgagugccugcgcuggaccccugugauuguuuccaauucagugguaagugaggaagaggaagaggaagccgaggagggugaaaacgaggaaccccaaugucaggagcgggaacucgagaucagcgucggcaagucggugucccaugagaacaaagaacaggacucuuacagcguugagucagaaaagaagccagaggugauggcuccugucaguuccacaagacugucuaaacaggugcuuccccacgacagcuugccagccaauucccaaccgucaaggcgugggcgcuggggacggaagaacagaaaaacucaggagagguuuggcgauaaggacagcaaacuguuacucgaagagaccaguucugcaccucaggaacaguacggugagugcggggaaaaguccgaggccacacaagagcaguauacugaaagcgaggaacagcugguagcuucggaggaacaacccucacaggauggcaagccagaccuucccaaacgacggcugucugagggaguggagccuuggcgcggccaguugaagaaaaguccagaagcgcucaaguguagacugaccgagggguccgaaaggcuaccccggcgauacagcgagggagauagagcaguucugcgcggcuucucugaaagcuccgaggaggaagaggaaccugagucaccgaggaguagcucuccacccauucucacaaaaccuacccugaagcguaagaaaccauuucuucaccggagaaggcgcguccgaaagagaaaacaucacaauuccucaguggugacugagacgaucagugaaacaaccgaggucuuggacgaacccuucgaggauagcgacuccgaacggccuaugccgaggcuggagcccacuuucgagauagaugaagaggaagaggaagaggacgagaacgaauuauuuccacgcgaguauuuccguagacucucuucgcaggauguucugcggugccaaagcucauccaagaggaaaaguaaggacgaagaggaagaugaggagucugacgacgccgaugacaccccuauccuuaagcccgugagccugcuacgcaaacgagaugugaagaauuccccacucgaaccugacacaucaaccccccugaaaaagaaaaaggguuggccaaaggggaaaucuagaaagccgauucauuggaaaaagcggccuggaaggaaacccggcuuuaaguugagccgcgagaucaugccaguaaguacucaggcuugugucauugaacccaucguguccauaccuaaagccgguagaaagccaaagauucaggagagcgaggaaacaguugagcccaaagaagauaugccucugccggaggaaaggaaggaggaggaagagaugcaggcagaagccgaggaagcugaggagggcgaagaggaagacgccgcaucuucagaggugccagcggcuucccccgccgauaguagcaacucgccugaaacggagaccaaagagcccgaagucgaggaagaggaggaaaagccacgggugucugaggaacaacgucaguccgaggaagagcagcaggaguuagaagagccugaacccgaggaagaggaggacgcagccgcugaaacugcccaaaaugaugaccacgaugcagacgacgaggaugacgggcaccucgaaagcacaaaaaagaaggagcuggaagagcagccaacccgcgaggauguuaaagaagagccuggagugcaggaaucauuccuugacgcuaacaugcagaagagucgagagaaaaucaaggauaaagaggaaacagagcuggacucugaagaggaacaaccgucccaugauacuagcguagucucagagcagauggccggcagugaggacgaucacgaagaggacagccauaccaaggaagaguugauugaacucaaggaggaggaagagaucccccacuccgaacuggaucuagagacggugcaggcggugcaaucucugacccaggaagagagcuccgagcaugaaggggccuaccaggacugcgaggaaacacuugcugcaugucagacucuccaaucauauacccaggccgaugaggacccacagaugucuauggucgaggacugccacgcuagugaacacaauucgccuauaagcuccguucagucucaucccucacaaagcgugagauccguaaguucuccaaacgugccugcccuggagagcggauacacacagaucucacccgaacagggcuccuugagugcaccgagcaugcagaauauggagacuucuccaaugauggaugucccuuccgugucagaccacagccaacagguuguggauucggguuuuucugaccuggggaguauugaauccaccacggagaacuaugagaaucccagcucauacgauuccacaaugggaggcucuaucugcgguaacagcaguucccagagcucuuguucauacggcggguuaaguuccagcucuucgcucacccaaucaagcugcgucgugacucagcagauggcguccaugggaaguucuuguagcaugaugcagcaauccucaguucagccagccgcuaauugcaguauuaaaucuccccagagcuguguggucgaaaggccuccguccaaccagcaacagcagcccccaccucccccuccacagcaaccccagccuccacccccgcagccucagccagccccccaaccuccacccccgcagcagcaaccucagcagcagccccaaccacagccucagcagcccccacccccuccaccgccccaacagcagccuccacugucacagugcagcaugaacaauucuuucacacccgcaccuaugaucauggagauaccagaauccggcaguaccgggaacauuagcaucuaugagcggauccccggagacuuuggcgcugguucguacucccaaccuucugccacuuucucacuugcaaagcugcagcaguugaccaauacaauuauggauccgcaugccaugccauauagccacagucccgcuguaacguccuacgcgaccucugugagccucucaaacacugggcuggcccaacuagcaccuucccauccccuggcuggaacaccacaggcccaggccaccaugacaccucccccaaaucuugcuaguacuaccaugaaccucacgagcccgcuguugcaguguaauaugucugcaacaaacaucggcauuccucacacccaacgcuuacagggucagaugcccguuaaaggccacauaucaaucagauccaagagcgccccacugcccucugcggcugcccaucagcaacagcucuaugggaggaguccuucggcaguggccaugcaggcuggaccacgggcacuggccguccagcgaggcaugaauaugggggugaaccuuaugcccacuccugcguacaauguaaacuccaugaauaugaacacccugaaugcuaugaacagcuauagaaugacacaaccgaugaugaacucaucuuaccacagcaauccagccuacaugaaccagacugcacaguaucccaugcaaaugcagaugggaaugaugggcucccaggccuacacccagcaaccuaugcagccaaauccccaugguaacaugauguauacagggccuagucaccacucauacaugaaugcugccggagugcccaaacagucuuugaacggcccauauaugcgcagguga

SEQ ID NO: 57925 - RNA, 5673 nt, Artificial Sequence
  derived and/or modified sequence opt3 from KAT6B__Homo_sapiens__NP_001243397
auggugaagcuggccaacccccucuacaccgaguggauccuugaagcuauucagaaaauaaagaaacagaagcagagaccuagcgaggaaagaaucugccacgcagucuccaccucucauggacuggacaaaaagacuguuucagagcaguuggaauuaagcgugcaggaugggagcgugcugaaggugacgaauaaaggacuagccuccuauaaggacccagauaacccgggucgguucucuucggucaaacccggcaccuuuccuaagucagcgaaagggagccgcggaaguuguaaugaccuccgaaacguggauuggaauaagcugcuucguagagcuauugagggccuggaggaaccaaacgguuccucuuugaagaauaucgagaaauaccucaggagccaauccgaccugacaucaacuaccaacaaucccgccuuccagcagcggcugcgccucggggcaaagagagccguuaacaauggaagguuacugaaagauggcccucaguaucgggugaacuacggcagucuugacgggaagggagcuccacaauaucccagcgcauuuccuucuuccuugccaccggucucacugcuaccccacgaaaaagaucagccucgcgccgacccaauucccaucugcagcuucugucucgguacaaaggagaguaaucgagagaaaaagccugaggaacugcuuucuugcgcugauuguggcuccagcgggcauccaucgugccugaaguuuugucccgaauugaccacuaacgugaaagcccucagauggcagugcauagaguguaagacaugcucugcguguaggguacagggacggaaugcagacaacaugcuguucugcgauuccugcgaccguggcuuucacauggaauguugcgacccgccuuuaucacgcaugcccaaagguauguggaucugucaaguuugcagaccaaagaaaaaggggaggaagcugcuccaugagaaagccgcucagauuaagcggcgauacgccaaaccuaucggacgccccaagaacaaacuuaagcagagacuguugagugugaccagcgaugagggcuccaugaaugcauucacgggcagggggucuccaggacggggucaaaagacuaaagucuguaccacacccagcucaggccacgcugccagugggaaggacuccagcucucgccuagcggugacugauccuaccagaccaggagccacaaccaaaauuacgacuacaucaaccuauaucagugcaagcacucugaaggugaacaaaaagacaaagggccucauagacggucugaccaaauuuuucacgccgucccccgaugggaggcguucucggggcgaaauuaucgacuuuucgaagcacuaccgaccuaggaagaaggucagccagaaacaguccugcaccucacauguucuugcuacagauacugagauuaagaucaauaucaaacaggaaagugccgacgugaacguaauuggaaauaaggauguggucaccgaggaagaccuggauguguucaagcaagcucaggaguugucuugggagaaaauagaaugugagagcggcguugaagacugcgggagguacccauccgugaucgaguuuggaaaguaugaaauucagacaugguacucaagccccuauccucaggaguacgcccgccucccaaaacuguauuuaugugaguucugccugaaguacaugaaaucuaagaacauccuacuccggcacuccaagaaaugugguugguuccaucccccggcaaaugaaauauauagaaggaaggaccugagugucuuugagguggauggcaacaugagcaaaauuuacugccaaaaucuuugcuugcuggccaaacucuuccuggaccacaaaacucuuuacuaugauguagaaccuuuucuguucuacguuuugaccaagaacgacgagaaggggugucaccucgugggauauuuuucuaaagagaagcugugccagcagaaauacaaugucuccuguaucaugaucaugccacagcaucaacgccagggcuucggucgauuuuuaauugauuucucauaucugcuaagucggcgugaagggcaggcuggcagccccgagaagccucucucggaccugggaagacuuuccuacuuggcguauuggaaaucugugauccuggaauaccucuaccaccaucacgagaggcauauuagcauaaaggcaaucucacgcgccacaggcaugugcccccacgauauugcuaccacucugcagcacuuacauaugaucgacaagcgggaugggagauuugucaucauuaggcgagaaaaacugauacuuagucacauggagaaguugaaaacguguucccgcgccaacgagcucgacccagauucucugcgguggacaccuauccuaauuagcaaugcagccguguccgaagaggaaagagaggcugaaaaggaggccgagaggcugauggaacaagcaucaugcugggagaaagaggaacaggaaauccucagcacccgugcgaacagucgccagucucccgcuaagguucaauccaaaaauaaguaucugcauagcccagagucgcggccggugacuggagagagaggucagcuuuuggaacugucaaaggagucuagugaagaggaggaagaggaagaggacgaagaggaggaagaggaagaggaagaggaggaagaggaugaagaggaagaggaggaagaggaagaggaggaagaggaagagaacauucaguccagcccucccagguuaaccaaaccacagucuguagccaucaagcgaaaacggcccuucguccucaagaaaaagcgcggcagaaagaggcggcgaauaaacagcuccgugacaaccgaaacuaucucagagacaacggagguucugaaugaaccuuuugacaacagugacgaggaaagaccaaugccccaacuugagccuaccugugaaauugagguggaggaagaugggcgcaaaccgguccugaggaaggcauuccagcaccagccaggcaagaagcgucagacugaggaagaggaaggcaaagacaaucacugcuuuaagaacgccgaucccugucggaauaacaugaaugacgauagcucuaacuugaaggaggguuccaaagacaauccugagccacucaagugcaaacaaguguggcccaaggggacaaaaagaggccugucaaaguggaggcagaacaaggaacgcaaaaccggauucaagcuaaaucuguacacaccuccggagacucccauggaaccagaugagcagguaaccguggaggaacagaaagagacgagugaaggcaagaccagcccuucccccauccgaauugaggaagagguuaaagagacaggggaagcucuccugccacaagaggaaaacagacgggaggaaacuugugccccugucucucccaauaccucgccaggagagaagccggaggacgaucuuaucaagccugaagaggaagaggaagaggaggaagaggaagaggaggaagaggaagaggaagagggcgaggaagaggaaggugggggaaacguggagaaagaccccgauggcgcaaagagccaggaaaaagaggagccagaaauaucaacagagaaggaagacuccgcuagguuggaugaccaugaggaagaggaggaagaggacgaagaaccaagucacaaugaggaucaugacgccgaugacgaagaugacucucacauggagagcgcggaaguggagaaagaggagcugccucgcgaguccuucaaggaagucuuagagaaccaggaaacuuuucucgaucugaacguucaaccaggucauucaaaucccgaggugcuuauggacugcggcguggaucugaccgccucuugcaacagcgaaccuaaagagcuagcuggggacccggaggcaguaccagaaagugaugaggaacccccucccggagagcaggcccagaagcaggaccagaaaaauuccaaagaagucgacacggaguucaaggagggcaacccagcuacaauggaaauugauagcgagaccgugcaagccguucagucucucacucaggaaucauccgagcaagacgauacauuucaggacugugcagagacccaggaagcgugccguagucugcagaauuauacuagagccgaucaaagcccucagaucgcuaccacauuggacgauugucagcagucggaccacucuucccccgugagcucaguccacagucauccagggcaaucugugcgguccguuaacagcccuucagugccggcccuggagaauaguuacgcacagauuagccccgaucaguccgcuaucucuguacccagcuuacaaaacauggaaacguccccuaugauggacguccccucagugucugaucacagucaacagguggucgacucgggauucagcgaucucggcuccauagagucuaccacugaaaauuaugagaacccaucaagcuacgacuccacaaugggugggaguaucugcggaaauggcucuagccagaacucauguuccuauaguaaucugaccaguucuucccuuacacaaucaagcugcgccguuacucagcagaugucgaacauuucugguaguuguuccaugcugcagcaaaccagcaucucauccccucccacgugcucugugaaaagcccgcagggcuguguaguggagaggccaccuaguuccagccagcaguuggcacaaugcucuauggccgcuaauuuuacacccccaaugcagcucgcggaaauucccgagaccucaaacgccaacaucgggcuguacgaacgcaugggacagagugacuucggcgcagggcauuacccucaaccguccgcuacuuuuagccuagccaagcugcagcagcuuaccaauacacucauagaucacucucugcccuauucgcauucagccgcugucacuagcuacgcaaacuccgccaguuugucuaccccacugagcaauacaggauuagugcagcucucccaaucaccucacaguguucccggcgguccucaggcgcaggcuacgaugaccccacccccuaaccugacuccacccccgaugaaucuuccuccaccccuguugcagcgaaacauggccgcaucuaauauugggaucagccacucccaaagacuccagacacagaucgccucaaaaggacauauuagcaugcggaccaagucugcuucccugaguccugcagccgcgacucaccagagccaaaucuauggcaggucgcagacaguggcuaugcaggguccagcccgcacccuaacgaugcagagaggcaugaacauguccgucaaucugaugcccgcaccggccuacaacguaaauucuguuaacaugaauaugaacacucuuaaugcuaugaacggguauucaaugagccaaccuaugaugaauaguggauaccauuccaaccacggcuauaugaaccagacaccccaguacccaaugcaaaugcagauggggaugaugggaacacagccuuacgcccagcaacccaugcagaccccaccccacggcaauaugauguauacugcaccuggucaucacggguacaugaacacaggaaugucuaagcagagccucaauggcucauauaugaggcgguga

SEQ ID NO: 57926 - RNA, 1746 nt, Artificial Sequence
  derived and/or modified sequence opt3 from KAT7__Homo_sapiens__NP_001186084
augcccagaaggaagcggaacgccggcagcuccucugacgggaccgaggauucagacuucaguacagaucuggaacacacugacagcuccgagucugauggaacgucgcgccgaucagcucgugugaccagaagcagugcaaggcucucccagucuagccaagacuccucaccuguccggaaucuucagaguuuugguacagaagaaccagccuacagcacucgcagaguuaccaggucucagcagcaaccgacacccgugaccccuaaaaaguauccacugcggcagacucgcuccucaggcagcgaaacagagcagguaguggauuucagugaccgagagaccaaaaacacggcggaucaugacgaaucucccccuagaacuccaaccgggaaugcucccuccagcgagucggauaucgacauuucuuccccuaacgucucacacgaugaaaguauagccaaggacaugagcuugaaagacuccggaucugauuuaagccauaggccaaagcggcgucgcuuucacgagucauacaauuucaacaugaagugcccgacacccggcuguaauagucugggucaucuaacugggaaacacgagagacacuuuuccaucagcggaugcccucucuaucauaaccugucugcagacgaauguaaggccccaaccgagaggcagcuucgguacaaagaaaagguggcugagcugcgaaagaagcgcaauucaggcuugaguaaggaacaaaaagagaaguauauggagcacagacagacauacggcaacaccagggaaccccuccuggagaaucugacgagcgaauaugaucucgacuuauuccggcgcgcacaggccagagcuuccgaggaucuggaaaaacuuagguugcaggggcaaauuacugagggaucuaacaugaucaagacaauugccuuuggucguuacgagcuggacaccugguaccauucgccuuauccagaagaguacgcgcggcuaggccgacucuauaugugcgaguucugucugaaauacaugaaaagccagacuauccuuagaaggcacauggcaaaaugcguuuggaagcaucccccgggggaugagauauaucgcaagggauccaucucaguguuugaagucgacggcaaaaagaauaaaauuuacugucagaaccugugcuugcucgccaagcuguucuuagaucacaaaacacuguauuacgacguggagccuuuucucuucuacguaaugaccgaggcugauaauacggguugucaccuuaucggguauuuuaguaaggaaaagaacucuuuccugaacuacaauguuagcugcauuuugaccaugccccaauauaugcggcagggauacggcaaaaugcuaaucgacuucuccuaucugcucucaaagguggaggaaaaagucggcagcccagagagaccucugucugaccuugggcugauauccuacaggaguuauuggaaggagguguugcuccgcuaccugcauaacuuucagggaaaagaaauuagcaucaaggagauuucucaggaaacagccgugaaucccgucgauaucguuuccacuuuacaagcacugcagaugcuaaaguacuggaaagguaagcaccucgugcugaaacgacaggaccuuaucgaugaguggauugcuaaggaagccaaacggucaaacaguaauaagaccauggacccaagcuguuugaaguggacacccccuaaaggcacuuga

SEQ ID NO: 57927 - RNA, 1377 nt, Artificial Sequence
  derived and/or modified sequence opt3 from KAT8__Homo_sapiens__NP_115564
auggccgcucagggcgcagccgcggcuguggccgcagggaccagcggagucgccggugagggcgaacccgggccuggagagaacgcugcagccgaaggcacagcuccauccccggguagaguuucucccccuacuccagccaggggagagcccgaagugacgguagagaucggggagaccuaccugugccggcgcccugacucaacauggcacagugcggaagugauucaaagccgagucaaugaucaggagggccgugaagaguucuaugugcauuacguuggcuuuaacagaaggcucgacgaguggguggauaagaaucggcuugcacugacuaaaaccgucaaggacgccgugcagaaaaacuccgaaaaguauuugucugaguuagcugaacagccagagcgcaaaauaacaagaaaucaaaagaggaagcacgaugaaaucaaccauguacagaaaaccuacgccgagauggaccccacuacagcagcucuggagaaggaacacgaggccauuaccaaaguuaaguauguggauaaaauccauauugggaauuacgaaaucgacgcgugguauuucucgccuuuuccagaggauuacggaaagcagccgaagcuauggcucugugaauacugccugaaauauaugaaguacgagaaaucauaucgguuccaccuuggucagugucaauggcgccagcccccuggcaaggagauauaccgaaaaagcaacaucagugucuaugaaguggacgggaaggaucacaaaauuuacugccagaaucuguguuugcucgccaagcuguuucuggaccauaagacgcucuauuucgauguggagccauuugucuucuacaucuuaacugaaguugacagacagggagcacacauugugggcuacuuuuccaaagagaaggaaucucccgacgguaacaauguagcuugcauccugacccuuccuccauaucaaaggcggggguacggaaaauucuugauagccuuuagcuaugagcuguccaagcuagagucaacagugggcagucccgaaaaaccgcucagcgaucugggcaaacuuucuuaccguuccuauuggucauggguccuguuggagauucuccgcgacuucagagggacucugagcaucaaggauuuaagucagaugaccucuauuacacagaacgacaucaucuccacccugcaaagccucaauauggugaaguacuggaagggacagcauguuauuugugugacgccuaaacuugucgaggaacaccugaagucggcucaguauaaaaagcccccaauaacuguggauucuguaugcuugaagugggccccucccaaacacaagcagguuaaacuauccaagaaauga

SEQ ID NO: 57928 - RNA, 936 nt, Artificial Sequence
  derived and/or modified sequence opt3 from KATNA1__Homo_sapiens__NP_001191005
augagccugcucaugaucuccgagaacgugaaacuugccagagaauacgcucuguugggcaauuaugacucugcaauggucuacuaucaggggguuuuagaucaaaugaacaaauaccuguauucagugaaggacaccuaccuacagcagaaauggcagcaaguauggcaggagauuaauguggaagccaagcacgucaaagauauaaugaagacacucgagaguuucaagcuggacagcacuccccuuaaagcggcucagcaugaucugccugccuccgaaggagagguguggucuaugccaguuccgguggagaggcggcccucgccugguccacgcaagcgacagucaagccaauauagugaccccaaaucccacggcaaccguccuucuacgaccgucagagugcauaggagcuccgcacagaauguacacaacgaucgggggaaggccguucgcugcagagaaaagaaggagcagaauaagggaagggaagagaaaggcguguugauggucgguccacccgggacaggaaagacucuccuggcuaaagcaguggccaccgaguguaagacaaccuuuuucaacgugucaaguagcacucugacaucuaaauaccggggcgaauccgagaagcucguccgcuuacuguuugaaauggcucgauucuacagcccugccaccaucuuuauugacgagaucgauucaauuugcaguagaaggggcacgucugaggaacaugaggcgucccggcguguuaaagcagaacuuuuggugcagauggacgggguaggagguacuagcgagaaugaugacccaucgaagauggugaugguccuggccgcuaccaacuucccgugggauaucgacgaagcccuacgcagaaggcucgagaagcggauauauaucccccugccuucuggcaugcgaccauga

SEQ ID NO: 57929 - RNA, 1695 nt, Artificial Sequence
  derived and/or modified sequence opt3 from KATNAL2__Homo_sapiens__XP_005258414
augaagaaaaucgagcagagaaagaccaggcccugcuucagcacauccaacgaaaaucgggugcuggcccaaugucucauggagcuuucuuaccagacucugaaauuuacgcaccaggcucgcgaagcaugcgagaugcgaaccgaagcccguagaaagaacuuguuaauucugauaucacauuaucuaacacaggagggcuacaucgacacugcgaaugcucucgagcaagaaaccaaacuggggcuuaggcgguucgaggucugugauaacauugaccuggaaacaaucuugauggaguaugagaguuacuauuuuguuaaguuccagaaguacccuaaaauugugaagaaaagcuccgauaccgccgaaaauaaccucccacagcgcucuagaggaaagacuaggcggaugaugaaugacucgugccagaaccugccgaaaaucaaucaacagcgcccccgaucaaagacaaccgcagguaagacgggcgauacuaaaagccugaacaaggagcacccuaaucaggaaguaguggacaacaccagacucgagagugccaauuuuggguuacauauauccaggauccggaaagauucuggagaagagaacgcucacccacgucgcggccagauuaucgacuuccaaggucugcuuacagaugcaauuaagggggccacuagcgaguuggcucugaauaccuuugaccauaaccccgauccuuccgaaagacuacucaaaccacugucagccuucaucggaaugaacagugagaugagggaacuugcggcagucgugagccgggacauauaucugcacaaucccaacauuaaguggaaugauaucauuggcuuggacgccgcuaaacagcucguuaaggaggccguggucuacccuauccgauacccacagcuguuuacaggcaucuuaucuccguggaaggggcugcuccuuuauggacccccugguaccggcaaaacgcuguuggcaaaggcuguggccacugaauguaaaacaaccuucuuuaacauuuccgcgucaacuauaguaagcaaguggcgcggggacagugagaagcuaguuagagugcuguucgagcucgccagguaccacgcaccaucuacaaucuuucuggaugaacuugaguccgucaugagccaacggggaaccgcuucgggcggugaacaugaggggucucugcgcaugaaaacggaauugcucgugcagauggacggacuggccagauccgaggauuuaguguucguccuggcugccucaaaucuacccugggagcucgacugcgcaaugcugaggcgucuugaaaagcggauuuugguugaucugccuagucgagaggccagacaggcuaugaucuaucacuggcucccacccgugagcaaauccagggcgcuggaacuucauaccgagcuggaguacucuguauugagccaggaaacagagggcuauucaggcagugacauaaagcucgugugucgcgaagcagccaugcggccggucagaaaaauuuucgaugcucuggagaaccaccaauccgaaagcucugacuuaccuaggauccagcuggauaucgugacuaccgccgacuuucuagauguucucacacacacuaagcccucagccaaaaaucuggcacagcgcuacagugacuggcagcgagaguucgagagcguguga
